United States Patent 11,866,728 (ENGINEERED RETRONS AND METHODS OF USE) - sequence listing, part 4

SEQ ID NO: 8994 - RNA, 1143 nt, unidentified
  source 1..1143: mol_type = other RNA; note = synthetic construct
atgcaggcgtggaattcacagagatttagagctggtgcaaaagcctcaggcagctctgaggagacaatccaagcggcaattgagattgccgcttgtatcaggaaagagaatcccaggctccctgtggtgttcaccttccatcatctgtcccatcttactgatgtgagctctgaatttctgcaagatgtagccttcaggaaggttgatgcatatcgcacatttcagctaaaaaagagaggcaagcctaactccgtccccgcacctgctcgtcggtttagaaccattagtgtgccagaacccggactcatgcgagtgcagcggtggattagccagaacatactgaacgtgacaacgacccacgcagccagcttcgcgtttactcccaaacgcgatttgaagcaagctgcaatgcgacacagggaggccaaatggctcgtaaagatggacatcacaagctttttcgaatcaatcaaggagaacaagatctatttcgtctttcgtaagcttggctacccacctctgctgtgctttcagatggcaaggatttgcactagactgccaatagagcacggttcaaagattccaaagcaggataaaatgttgccgtacaaaaggcgcactgaagggtttctgcctcagggggctccaacgtcccctatgctggcaaatctggtcgctcacgctcttgacaatgacctgtctatgttagccgcccaggagggctggatatatacacgctacgccgacgacttatccttcagtcacaccgagtgtagatctaggcaagaagccgttgccctggtgcggagggtcgaaagccttttaaaacgtcacgggttcctgcacaaccccaccaagaccaccatctctccaccgggtgcccgcaaaatcgtgttgggcctgcttgtggacagagaggacccccggctccccaagtccttcaagaataatctggaagctcatctctatgcactccgcagtccgaaaataggggcccgagcccatgtcaaacgacggggattcacttcccacatcggactccggcggcatgtttacggactattggcctttgcgcatcacattgagccttcgtacgctaagaaaaagtacgccgaattcaacatgatcgattggagtgcttga

SEQ ID NO: 8995 - RNA, 1143 nt, unidentified
  source 1..1143: mol_type = other RNA; note = synthetic construct
atgttgcatccatgggattcacagcagtttcgaaggggagctaaagatgctgggcgcccggatcaggtgatcgatcgtgccattgctacagcccggagaattaagaggaaaaaccgcgacttgccagtgattttcagtatcttccatctggcccatctcacagacatagacgtggactccctactctccgtggtagatagaacagaggaccactaccggatatttcgagttaagaagagatccgttcctggccgcgtggctccaagcagacgataccggacaatatgcgttccttcacctgccctgaagcggattcagaggtggatcgcacagaatatactgaatgtgactgagacgcaccccgccagccatgcttttgcaccggagtcagatctggtcgaagctgcaaacgaacatctgagatcctcttggattgtgaagttggacatcatcaatttctttgaaaccgtcaccgagcgacaagtgtactacgttttccgctccctgggctatgcggccctgttatctttccagctcgccaggatttgtaccaggacccttaagctcactcccaagggacgggctggaagtgagggcagggtaccccacgaaagatacatcgcgggtcaccttcctcaaggtgcccccactagtcctatgttggcgaacttagcagtgcgccagctggacgacgagctcgacaatctggctaaacgtctgggctggaaatacacccggtatgcggatgacctcacattttctctggagggcaagtcatctcgcggaaaagctgccgaattaatgagccttgcaagccaaactctgagccgtgccgggttcacgagcaacaaactcaaagcaaaaatcatccccccaggagcccggaaagtcgtcttgggggtgctggtcgataccgaccgagcaaggctaagtaagaagttccggaataatctcgagactcacctgtatgcccttaccagccacaagatcggcgtgagatctcacatgcaaaaccgcggctttgattccgtaatcggtatgaggcagcatattgaggggcttctggccttcgcccaccacgtcgatgaaaagtatgcagccgggctatatagacagtttaactcgattgactggctggcttga

SEQ ID NO: 8996 - RNA, 963 nt, unidentified
  source 1..963: mol_type = other RNA; note = synthetic construct
atgctttcctttgttgagcggacccatgaccactatcggattttccgagtgaaaaaacgcgccaccccaggaacaactgccccaacgaggcgctaccgaactatctgcgtcccaagccccgcactgaaaagggtgcagcgctggatcgcccaaaatattctgaatatcatagacccgcatgaggcgtcccacgcttttgctcctgaaagcgatctcgttgaggccgccaataagcatttagggtgttcgtggctggttaagctggatatcgtcaatttcttcgaaactatcggtgagagacacgtgtactacgtgttccgtagcttgggctacacggccctgctgtcttttcagctcgctagaatatgcaccagaacattacgcttgacccctaacggccgcgctggcaacgatggtagactgccacacgagaagtatatccctggccatctgccccagggtgcacctagctctccgatgctggccaatttggtggcaagacatctcgacgaggaattgactgctctggccagttcccgtgggtggacttatacacggtatgctgacgatctaaccttttctgtgcacggcaaaagctcaagggggaaggccgcagaaatcatggcagtcgcaacccaagcgcttgcacggcagggatttgcttcaaacaagctcaagagtaaagtagtaccccccggagccaggaagctcgtgctaggaatagtcgttgacacagagcatacaaagctcagtaggaagtttcgaaacaatctggagactcatctttatgctctgacatcagacaaaattggagtgaagctccacatggcgaacagggggttcgattctattgtgggcatgcggaaacacgtggctgggctgcttgccttcgcccaccacgtcgatgaaaaatacaccgccagattataccagcagttcaactccattaactggcttacctga

SEQ ID NO: 8997 - RNA, 1128 nt, unidentified
  source 1..1128: mol_type = other RNA; note = synthetic construct
atgctgtcttggaatccacagcagtttacccgcgaggcaaagaaagaagggtgttcgcagcctctgatcaacgctgctattcagactgccagcttaattaagaaagtggacatcggactccccgtgatatttacgctgagtcacctggcccagatcaccgacactccattggtcaagctgggagcctactccaggcgcacctccaagaattcttaccgagtattcaggctcaagaaagccgacagacgtaaatttcgcgttatctgtgtcccagagcctactctcatgcatgtgcaaagatggttggcacaaaatgtcttccaaacaagggctgcagctccgcatcaggcgagttacgcttattatagcgatactcggcgggggctacttaacgccgcaaaacaacacgccggttgcttgtggctgattaagatggatattcagaacttcttcggatccatcatggagcctcaagtgtataaagtgtttcgagacttaggttactcagctctcctgtcctttcagctggcccggatttgcacttatgttggcgacaagccgagtcccagacgaaagaaaagttatgggatccccaactcatactgcgagaatctggggtatcttccacagggagccccaacctcccccgcacttgctaatctaactacaagactcctggactcagaactcgagaagctagctcaggaaaatgggtggaggtactctcgttatgcagatgacattgccttcagcaccacacagacgattaacagagaggtggccaaaagcctcgtgttgctggtgcgcgaaaaactgatcaacttcggctttacccctaacgatacaaagacagtgatcagcccccccggcgcacgttgcatagtactgggactgctggttgacggcccttaccctcggctgaccaatgacttccggaataacttagatacacacctctacgcgcttctttctaagaaaatcggcgtcaagaaacaccaggaaaagcggggttttgattctgtcaccggcatgcgcaggcacattatgggcctgttggcgtacgcccatagcatagatagggagtattcaagaaagtgttacgagaaattcaacaagatcatatggtga

SEQ ID NO: 8998 - RNA, 1227 nt, unidentified
  source 1..1227: mol_type = other RNA; note = synthetic construct
atgaattacctgaccagccagcactttcggtctgtgggaatctcactcaacatagaaagcaaggttttggataacgccgtgttggtacaccagcgaatcagaaagcagtccccgaatcggggcgtggtcttcacactggcacatctggctcacctgaccggagttcactataacttcttgcgaatgtgtgtgtctgatcccggcaccgggagttacagggagttctttatcaaaaagtcaactagcggccagaaaaaaaacaaaagggctgcttctagacccatgcggcggatttctattccggcacctatgctgatgttagtacagagatggatcctgcacaggattcttcatactgcagaggggcatgaggcgtccgtggccttccataaggacgcagatatcaagcgggctgccaaactgcactgcggttgccgctggctcattaagttggatgtgcagaacttttttgagtccatcactgaggaacaggtcttcaaagtgtttgtcaggctcggatacccccgtctcctttccttcgagctagcgcgtctgtgcaccaaagtgataggtcctgaagacagatccctgtctccaactacccgctttgccaacttcggacggggcccttatgaagatgctgctttcatcgaccctagtacaccccgcagactaagacgagatgccccactgatcgtctcgagacgggtactccctcaaggtgccccaaccagcccactcctcgccaatctggccgtgacggaactggatacagagatcctagccatagccgaagagcacgggcttatttatacgcggtacgccgacgacatcgctctgagtaccaagcgcaaggacttcagcagagatgaggcaagtcaagtcatcgggaaagtttatgcagcatttgcgagggccaggttgctgcctcacacaggaaaggcctgtgtcaggccacccggcgctctcaaaattgtgctgggcttagtggttaatgggcccgagccccgcttaacaagagagtacaggaataagttgaggcttcatgcccatattcttgggcgcctgggaatcgaaccagccgaccacgctaaagcgctcggcttccgctccgtcctgtcaatgcgacgccacatatacggcaaggttgagcatgcacgacgtattgaacctgactttgcttcaaagattgcagacactttaagcaaggtgaattggctgctttga

SEQ ID NO: 8999 - RNA, 945 nt, unidentified
  source 1..945: mol_type = other RNA; note = synthetic construct
atgaggcgcatcagtgtgcccgctcctcttctgatgcacgtccagaggtggatactccaccgaatcctccacaccgctgccggacatgaggcatctgttgcattccacaaggatgccgatatcaagggggctgccaaactgcattgcggatgcaaatggttaatcaagcttgacgtgcagaattttttcgagtcagttagcgaggaacaagtgttcaaagtgttcgtgcgcctcggctatcctcggctcctgtctctggagcttacccgtttgtgtactaaagtgattgacccagagaaaagggtgagaactcggtttacaagactggcgagctacgggcgtggaccgtacgaggatgacgcatttctggaccaatcactgaaacgccgcgagaggctgggatccccaatcttggcccagagaagggtgttacctcagggtgctcccacgtccccgttacttgccaacctggcagtcttcgaaatggacagagaaattatggaaatcgccattgagcacgatctggtctacacccgctatgccgatgacatagccttgtctaccaacagggataacttcactcgggatgaggccagcaagattattggcaaggtgtacgcttgttttgcgcgagctagactcgtacctcaccccggcaaagcctgcgtcagaacaccaggtgcgctgaagatcgtgctagggctagtcgttaacggcaccgaaccccggcttacacgggagtataagaataagctccgattgcatgctcacatcctgggcacaaagggaatagaccccagtgaacatgccaaagcactaggctttaggtccgtactgtcgatgagacggcatatctttgggaagctggaacacgctaagcgcattgaaccagacttcgcagtaaagattggtaatagcctgaaagcagttaattggctcttgtga

SEQ ID NO: 9000 - RNA, 1227 nt, unidentified
  source 1..1227: mol_type = other RNA; note = synthetic construct
atgaattacctgacctcacagcaccttcgcaatatcgggacctcactgcaaattgaacccgaagtgttagaccgcgccgttttgattcatcggcgggtgacctcccaaaacacaaagcgtgctgttgtgtttacaatgtcacatctcgctcacctgactggcgtgcactataattacttgcggatgtgcattggggaccctggcttactcagttacagggagttttttatcaaaaagtctacctctgggcggacaaagggcaaaaaaagcccaagcagaacaatgcgccgcatatccgtgcctgctccaatgctcatgctggtccagaggtggatcctgcatcgcattcttcacacagcagccggacacgaggccagtgtcgcatttcataaagaagccgatatcaaaaaggctgccaagctacattgtggatgcaaatggctgatcaagctggatgtcagggatttctttgagtcgatttccgaggagaaagtcttcaaggtcttttcaggcctgggctaccccagattactgtcctttgagctcacacgactctgtactaaagtccttgaccccggtaaaagaatcgcgtctcagaacaccagactagccaatgttcagcgcggcccttatgaggatgaccttttcacggaccagcggattccgaggcgtcagaggctcgacgcagacgtgctgacccacagaagagtgctacctcagggtgctcccacctctccactgctcgctaacttggccgtgttcgacatggatgaagaaataatggaaatcgcagctcggcatggcatggtattcactagatacgccgatgacattgcactctccaccaagcggacggacttcacgcgtgatgaagccagcaaggttatcggaaaggtatatgccgctttcgagaaggccggactgattccacaccccggaaaggcttgcgtgcgcactcctggcgcgctgaaaattgtgctgggcttggtggtaaacggaagcgagccgaggctgactcgggagtatcgaaacaaattgaggctccacgcatacatgttgggtactcgagggatacttccaagtgagcacgcaaaggcgcttgggttcaaaagcatcctgagcatgaggcgacatatcttcgggaagctggaacacgccaagagaatagaacccgagtttgccaacaagatcgatatcacactgaagggtgtgaattggttactgtga

SEQ ID NO: 9001 - RNA, 1278 nt, unidentified
  source 1..1278: mol_type = other RNA; note = synthetic construct
atgagctccttctctccccagcattacaaacaaatcggacggagactgggtgtggatcccgcagtactggagacagctgcaaagattggcacacgcatcacggcttcagcgccagatagagccgtggtttttagcctccgacatctgagcgctctctccggggtcccctatcagtttctccgtgactgggtgggacgatggggcccagacccatatagagagttcttcctcgctaagaagcctgacggcagaaccgccaacaaaccttctcggcgacctaaacggcggatagccgctcccacccccatcttaatgcgacagcagcggtggttggtggaaagagtcctccaccatgctccacgtcaccccagctcaatggccttccacagaaaggcagatatcgtagaaaccgcgaggcttcattgtcaatgcaattggctgatcaaaatggacattcggaactttttcgagtcgatctacgagccttccgtcttcaatgtgttcgtcgaactggggtacccacgcttgctggcatttgagctgacccgcctttgcaccagaattgtgcccgaaaataggttaaagtgggcctctggcctcaagcacggtctgttcgacgcaagacgaggcccgaagttttactcccgcgtgcgcaagcagcctgacgcgaaaggacagcatgcaataggaaagcgcgatcgcttccacgagtgggtgactggggcaatcggctcagaccggctaccattgcctttagggagtctgccccagggcgctccaacatctccgcttctggccaacctcgccgtgaggggactggacgagcgtatcaacattatcgccgccgagcacgatatgacttatacaagatacgctgatgacgtagccctgtcaacggaaaggaaagatttttcccggaaagaggccggccaggttatcggaaagattaaacgggaattcgaacgcgaagggctgttgccacaccatagtaaaacccgtttggtcagccccggtgctcggaagatagttctaggcctagttgtggatgggaaggctcctaggctgactagggagtatagaaataaactgagactgcacgcgcatatgctgggtactagggggataagtccgtctgcccatgccagtgcacttaggtttcgaagcgtcatctccatgcgcaggcacattgagggaaagattgcccacgccaggagggtggaagagccttttgcagacaaaattgctgcgcaacttgccaaggtggattggacactctga

SEQ ID NO: 9002 - RNA, 1278 nt, unidentified
  source 1..1278: mol_type = other RNA; note = synthetic construct
atgcccagctttagtccgcaacactacattcagattgggcggcggctcggcatctcgccaactgtattggctcgcgcaggtgctgtcggtacaagaatcacggccaatgcgccagatcgggcagtcgttttctccctgagacatctgagtgctctgtcaggggtcccataccgtcttttaagggactgggtgggtagatggggacccgacccataccgcgaattcttcattgcaaaaaagtccgacaataggcggactaacaagccctctgtccgcccaaagagacggatagccgcccccacaccagacctgatgcgacagcagaggtggctcgtggagagagttttgcaccatgctcccaggcaccctgccagcatggcctttcaccgtgatgcagatattgtggaaaccgctagactacactgcaaatgtaactggcttatcaagatggatattaggaacttctttgagtcaatctacgagcccgccattttcaaggtattcatcgatctggggtatccccggcttttggcctttgagttgacccggctatgcacacggatagtgcccgagaacagactggaatggaaaactggcctccgccatggcctattcgaccctcgccgaggcccaaaattttataacagggtgcgtgggacacctgatgtgacgggcaggcgtaccattcataccagagacagattccacgagtgggcaatgggagctgttggtagcgatcgcatgccactgcctctcggctctttaccgcagggagctcctacgtcaccgctgctggccaatctggccgtacgagcgctggatgaaagaattactcttatcgccgctgaacacgacttggtctataccaggtatgcagacgacgtggccctttccacacagagaaaggactttactcgaaaagaagctgtgcaggtgatcgggaaagttctgagggagttcgagcgcgagggattaagacctcaccacgccaagacacgtctcatcagccccggagcccggaaaatcgtcctgggactggcagtcgacggcaacacccctcggctcacccgagagtaccggaataagctgcgcctccacgcacatatgcttggagcgcgcggcatcaatccttctgcccacgcgaccgcactgcgatttcgcagtgtggtgtccatgaggaggcatatcgaagggaaaatagcccatgctcatagggtggaacctgcctttgctgatgatataaaggctaagctgcaaggcgttgactggactctctga

SEQ ID NO: 9003 - RNA, 1176 nt, unidentified
  source 1..1176: mol_type = other RNA; note = synthetic construct
atgtctgtgtggagggcccagccgtacattaacgcaggacgtcgagccggtgcagatccagtggccttagcgcacgccgtgagatatggccagtctattgtgcgccattccgccagcctcgtccctatattcactttgaaacatctggcagttctgagtggaacgccttacggtgtcctaagggaaatcgtgggaagagatgctactagcatgaaggatcagccctatcgcattttccgcatccggaaaagaattgctaagaaaggggaggcccagcgcctgagaaccatctgtgttcctagtcccatgctgctccgggtgcagaggtatatacacgaaagaattctggttcggctacccgtgcaccctgcgtctattgcttacaacccggggcgggtcatggttgaggacgttgccgtgcactgcggctgccagtggctcatcaaagtggatatcaagaatttcttcgaagctatcccagagcaggtagtgtacagagtatttaggaatgcaggctaccctgcactgattagttttgaaatggctcggctatgcacccgcgttcctatgccattcgcgcttgaacgccccttcaattttcccccaaatcgatcggagagatatagcatctcagcctacagtaagaggttacaggggtcattaccccaaggctccccatcctccccccttttggcgaacctgtgtagccgggcactggatgagcggatcgaggagcttgctctccgtcatggactcgtgtatacacgatatgccgacgatatcgcactttcttcagaggacaaaagctttgggcgcgggcatgcccgctatatagtccggaagttgcacgccattatgagggattgcggatttgcccccaacttggcaaaaaccatcgtggtaccacccggcggcaggaaggtgctgttgggtctgtacgtggacacagagcgtcctcgactcagcagagaattccgggctaagctggaacaacatcttcacttttgtctgaggcctgacgtgggtgctatcgcccactccaaacaccgtggctttgacgctgtcctgggattccgaaatcatgtcagggggctggtcgcctttgctatacaagtcgacccagactacggcgccaagagactgtcagagttcaacaaggtagaatggccgctctga

SEQ ID NO: 9004 - RNA, 1176 nt, unidentified
  source 1..1176: mol_type = other RNA; note = synthetic construct
atgagtgtgtggagggcacagccgtacgttaatgctgggagaagagccggagctgatcccgtagcgctggcacatgcagtgcggtacggtcagtcaatcgtgagacattctgcatctctgatccccatcttcactctcaagcacctggcagttttaagcggaactccttacggggtattgagagaaatcgtgggccgcgatgccacatcgatgaagggacagccttatcgaatcttcagaattcggaaaaggattgccaaaaccggcgaggctcaaaggctccggactatctgtgttccctctccaatgttactgcgggtgcagaggtacattcacgaaagaatactagtccaccttccagtccatgctgcttccatcgcctataatcctggcagggtgatggtggaggacgtagcagtgcactgcggctgccagtggctcattaaggtggacattaagaacttctttgaagcgatacccgagcaagtcgtttatagagtgttcaggagtgccggctaccctgccctgatatcctttgagatggcgagactctgtacccgagtccccatgccattcgccttggaacgcccatttaactttcctctcaacaggagcgagcgctacagtattaccgcgtattcaaagcgtttgcaggggagcctaccacaaggctcccccagctcaccactgctcgccaatctgtgtagccgcgtgctcgacgagcggatcgaagagctggctctgaggcacggtctagtttacacgcggtatgcagatgatattgctctgtcatccgaagacaagagcttcgggcgaggacacgcccgccatatcattcgcaagctttacgccatcatgcgcgactgcgggtttgccccgaatctggccaaaacaatcgtcgtgccacctgggggtcgtaaagtccttttgggcctttatgtggacaccgatcgacccaggctttccagagagtttcggtctaaactcgaccagcatctgcacttctgcctgaggcccgatgttggagccatggcccatagtaaacgccggggttttgacgctgtgttaggcttccggaaccacgtccgaggcttgattgcttttgcaatacaggtagaccctgattatggagagaagcgtctgacagatttcaacaaggtggtctggccgctgtga

SEQ ID NO: 9005 - RNA, 1176 nt, unidentified
  source 1..1176: mol_type = other RNA; note = synthetic construct
atgtctgtgtggaggccccaaccctataagaaagctggggagctcgcaggagccgatcccacagcacttgctcacgcagttcgctacggacagaccattatcagacataatgccgaggtgactccagtatttactttgagacatctctcagttctgagcgggacgccctacggcgtcctacgagaaatcgttgggcggcatgctacctcaaagaaagatctgccgtatcgtatattcagaatccggaagaggatggcccgtccagatggtatcgaaaggtttaggacgatttgtataccgtctcccgtcctcctgagagtgcaacgctacatccacgagcatatcctggtgcacttacctgtgcatccagcaagtattgcgtataaccccggtaaaaagctgatcgacggcgtggctgtccactgcggttgcaactggcttattaaggtggacattaagaatttcttcgaggccattcctgaacaggtggtgtatagagtgttccgacaggcggggtaccctgcactcatttcctttgagatggcgcgcttgtgcacccgaaccgttatgcctttcagtcccgacggaccattcaactttactcagaataggcctgacaaatacaaaatcacatcctacagcaaccgcttacagggctccttgcctcagggcgctccctcttcaccgttgcttgcgaatctatgtagtcggttacttgatgagaggattgaggaactcgccctgctgcatggactggtttatacaagatacgccgacgatatagccctgtcttccgaggacaaacggttcggaagagggaacgcaaaagacgtcatcaggaagctctacgccatcatgcgcgattgcggctttgcacccaacctagccaaaaccatagtagtacctccaggaggtcgtaaggtggtcctgggcctgtatgtagatacttcgcggcctcgactgagccgcgaattcaggagcaatctggaacaacaccttcacttctgtttgcacccagacattggggccgtggctcacgccaagcataagggctttgacgccgtcctcgggttccggaatcacgtgcggggcctggtcgcttatgccacacagatcgatccagcttacggcgctaagcagctggcagactttaacaaggtgaaatggccattttga

SEQ ID NO: 9006 - RNA, 1176 nt, unidentified
  source 1..1176: mol_type = other RNA; note = synthetic construct
atgacggtgtggcgcccccagcacttccggaagaacggcttaaaagcaggtgctgataaagcagtgattgccaacgcaatagaatacggcaaggccatcgtgaggtgcgatcctgctctgactcctgtctttaccctgcgccacctggccgctttatcaggtacaacctacgaagtgctccgggagatcgttggccgtcaggctgtggtaggaaaagaacaaccatacaggatttttcggatccgaaagagaaaacccaggccagacggcgcagaaagattcaggaccatatgtattccctctcccatgctcatgcgagtacagagatacatccatgaccacatactcacgcacctagctgcccatcccgcctctatcgcgtataacgagggaaagaaaatcgttgacgaggtggctatccactgcggatgcaagtggctgattaaggtcgacatcaagaacttcttcgaggcaatcccagagcagtctgtgtaccgggttttcaggggtgcggggtatcctgccctggtgtcctttgagatggcccgattatgtacccgcgtcgtcccacttaattggaccgaggggccaaggggtaacagtcagaatctcgatagcaagtattccatcgcacgatatagtaatcggtaccaggggtcactgccccaagggagtccctccagccctttgcttgcaaatctgtgcagccgccgtctggacgacagaatagaacagttggcgattgagcacgatctggtgtatactcggtatgccgatgacctgagcctctcaacagacgatccggagtttaaccgcacaaaggcttctcaggtcattggcagactctatgccatcctagcggagtgtggcttcgcccctaatactatgaagacagccgtggtcccacctagcggacgcaagattctgttgggcctgtacgtggattccgaccgccctcgtctctcgcgggagtttagatacaaactggaacaacatctgcatttctgtcttcatgccggagtggggccggtagaacacgccaaaagaaggggatttgacgccgtcttcgggtttaaaaatcacgttagaggccttgtagcttacgccgttcagattgatcccgaatacggcgcaaaaaggttggctgagttccataaggtggcttggccattttga

SEQ ID NO: 9007 - RNA, 1206 nt, unidentified
  source 1..1206: mol_type = other RNA; note = synthetic construct
atggctatttggaggccccaaccttataaagcaactgggcagaaattgggggtgaaccaggttgccttagtcaatgccatcaaatacggcaagagcatcacaggccatcacccatccctgacacccgtattcacactgagacatctcgccgcactgtcgggaactccatatgccgtcctgcgcggtatcgtgggtcgccaaacggagacaggtactgacagggcttaccgcatcttccgaatacggaagcggttgtctaagaagggtgagccacagcgctaccgtaccatttgcattccttctcctgttgtcctgcgggtacagcgatacattcacgaacacatactaactcacctggccgtgcattctgcttccatcgcgtacagtgaaggcaataagattgccgaggaaatcgccgtgcattgcggctgtaagtggctcatcaagatggacgtgaagaactttttcgaggcgatcccggagcaggcagtttacaaggtgtttcgcggtgcgggctatcccgcccttattagcttcgaaatggcaagactttgcaccagggtagtcccgctgaattggtcagaaggacccacagcataccccactaataggatttcccgttattccatcaccacgtattctaacccatctaaaggggtgcaaccagccggcacccaagtgcagggaagcctacctcagggaagcccctcaagccccttgctggctaacctgtgtgcccggggattggatgagatgctctcagagctcgctgatgagtacggattagtttacacaaggtacgctgatgacctcgcgttcagtaccagtgataaaagctttgatagaagacgtgccagtcaggtgatcggccgggtttatgcaattatggccaagtgcgggtttgttcctaacaccgctaaaaccgtcgtggtgcctccaagaggccgcaagatactgcttggattatatgtcgactccgacagaccgcggctctcaagggagttcagatacaagctggaacagcatctgcatttttgtatgcaccccaaaatagggcctgtactgcacgctaaacgacgagggttcgatgcagtgctcggctttaaaaatcacgtgcggggcctgatcgcatatgccgtgcaggtggacccagagtatggggctaagaggcttgccgaatttcacaaagtcatgtggcctttctga

SEQ ID NO: 9008 - RNA, 1206 nt, unidentified
  source 1..1206: mol_type = other RNA; note = synthetic construct
atggccatctggcgaccccagccatatcagaagactgggcagcagcttggaatagaccctgcggtactggcctctgcaatcaagcacggcaagagcattattggccaccacccgagtctcacccccgtgttcaccctgagacatctcgccgccctgtctggaacatcttacgctgtcctgagaggcgtggtgggcaggaagacggagctcggttccgaccgcagctatcggatcttcaggatccggaagaaaatctctaaggtcgggggagctcagcgataccgcactatatgtattccaagccctgttctactccgggtgcagcgctatattcatgaacatatcttaatgcacctcccagttcactccgcatcgatagcctatagcgctggaaataagattgcagaagagatcgccgtccattgtggctgtaaatggcttattaaggtggatgtcaagaacttttttgaggcgatcccggagcagggtgtatataaagtgttcagaggcgccggctacccagcccttatatccttcgaaatggcaaggctatgtactagagtggtgccgttaaactggacggaaggtccacatgggtatctgaacaatcgttgctcccgctttagcatcgctgcatactcaaatccctcacaagatgctcggcctgctgggacacagatccaggggagccttcctcaggggtccccttcaagtcccctcctcgcaaacttgtgcgcgcgtaagctggacgagaaaattgaagagttggctgatgattgtggcctggtgtacactcggtacgcagacgacctggccctcagtaccgatgatcagtgctttaccagacgcaaagccaaacaggtgatcgggaggatttactctctgatggctagctgcgggctgacacccaacaccgctaaaacagtagtggtccccccaggaggccggaagttgctgttgggcttgtacgtggacagtgatcgtcccaagctatcccgagactttagatatcgccttgagcaacacctgcacttttgcctgcaccccggagttggtcctgtctcacacgccaaacaaaaaggcttcgacgcagtcttaggattcaaaaatcatgtgaggggtctgattgcctacgcggttcaagttgatcctctgtacggagagatgaggctggtagacttcaataaggtggcctggccattctga

SEQ ID NO: 9009 - RNA, 1176 nt, unidentified
  source 1..1176: mol_type = other RNA; note = synthetic construct
atggtggtatggcggtcccaattgtacaggaaaaccgggagacagctgggggttgacaattcgatactggacgcagctgtgctctatggcaaggcgatcagcaatcaccagccttgcctcgtcccagtgttcaccctacgtcacctggcagccctctcctccactccctataacgccttacgcgaaatcgtgagaaggcatcagctgggtggggggatgcacccataccgcctgttccgaatccggaaacgcatcagcaagaaaggtggcgaggagcgcttccgaacaatatgtattccatcaccagtactgttgagggtccagcggtacatccatgaacacatcctgattcatctccccgtccaccctgctagcatcgcctataacgagggtaaaaggatcgtagatgaggttgccattcactgcggatgtaggtggctgatcaaagtagacgtgaagaacttctttgaagctattccagagcaggccgtgtaccgagtctttcggggagcgggataccccgctctggtgtcatttgaaatggctcgactctgtacacgggtcatatcccgcagtagggacgaaggcgcatttggctacagagacaatcgctctctgaggtactccattaaggcctattctcaggcccttcagggatctctacctcagggtgcgcctagctcacctctgctagccaacctctgctctattcccctggatcacgaaattgagaaacttgctgaggaatatgggcttgcatatactcggtacgcggatgatttagccctgagtaccccggacacaaccttcgaccgtgatcaagcccggcaggtcattgtgagactgtatgccgctatggcccggtgtggcttcgttcccaacacggcaaagactgcagtgatcagccctgggggaagaaaggttatattgggactttatgtggatacagagcgaccgagactgagtagagacttccgttacaaattggaacaacacttgcacttttgcctccatgatggcgtgggcccagtggagcatgcaaagcatagaggattcgaggctgtgcttgggtttaagaatcatgttaggggcctcatcgcccacgcagtgcaagtcgatcccgagtacggcgcccgcaggttagctgactttcataagattgcttggcccttctga

SEQ ID NO: 9010 - RNA, 1170 nt, unidentified
  source 1..1170: mol_type = other RNA; note = synthetic construct
atggccatttggagagcacagcattaccggcagaatgggttactccaggggattgaccctcagcttctgtccagggctatcgaatacggcgatgcaattacccgcagtaaccgaaacctaactccggtgttcaccttacgccatctggctctgctgtgcggcgcctcatatgcagctctccgtgcctacgctggacgcaagaacgacgaagctaatcatccctatagattctttcggatacggaagaggaccggtcccggagagaggccaagacgaaggacaatctgtgtgcctgcacccgagttgcgaaaggcccagcgcttcatacacgatagtatcctgagctatctccctgtacacccaggatccatagcttatagcagacacacgaggccagtggaagagattggcattcactgcggctgtcgttggttgattaaacttgatgtccagaactttttcgaggcgatctccgaacgggccgtgtaccgcgtattcagaaacgccggctaccctgctttgatttctttcgaaatggcacggctctgcacccgaattgtccctggaaatagggatgaggggcccagcggtcaaacatctgggcgggtcgggagatattcgatagaggcatactggaattggagacaaggatccctgccgcagggagcaccctctagtccactcttggcgaacctatgctcttttggcctggacacactggttgccaacatcgcctcagaatatggcatggtctatacacggtacgcggacgacatcgcccttagcactaccaatcatcactttagcaggtccgacgcactccgggtgatccaacaggtgtacgccgccatgcgccaatgtgatctgcagccaaatacagcgaaaactatgatcgccccacccggcgcccgaaaaatcgttctgggcctgtacgttgaccagagcactcccaggttgactagagagtttagatcacgcctcgagcagcacctgcacttctgtttacatcctgacgttggtcctgtcgcccacgctcggcgtaagggtttttcagccgtgcttgggttcaagaatcatctgaggggacttatcgcctatgctacccaagtggagcccgggtacggcgctacgaaactggtggatttccagcgcgtggcatggccattttga

SEQ ID NO: 9011 - RNA, 1167 nt, unidentified
  source 1..1167: mol_type = other RNA; note = synthetic construct
atgaatcattggcgcccacagcattataggaagcagggcactaagagcggaaaagatcccgtgatcataaaacgggccatcgaaatcggtacatctataacccgaaaatatcccaccattaccccaatcttcacgctgaaccatctagccctgatctcgggaacatccctgcacaaattacgcaaggtggttagtcggaacgaaagcgatggctatcactatagattcttccagatcagcaagagatgtcgaaaaaaatccaagccgacaaagcgttttatctgtattccgtctagtgacctgatgcgagtccaaagggtgatcaattccgtgatattatccaaagtaccagcacactctgcctcagtggcatatacgaagggtagcagcatatacaatgcagcgagcatccactgtggatgcaagtggttgattaagctcgacatcaagaactactttgagagtatttctgagcggtccgtatattctattttccggagcattgggttccccgcgctcctctcattcgaaatggcaaggatttgcacccgcgtgattccccgcagaggcctgacttacgactcaaggtggatcaatcccagatttgaaaaggggaagattaaggcctacaggaatcgcgacgtcggctccctccctcaagggtcaccctcatctcctatgctggccaatctcgcttcggttcatctcgatgaagagatcgctgaccttgcctataaaaatggcctagagtacaccagatacgccgatgacattactttgtcaactgataacgagtactttagtaggttgaaagctagcaagttgattcaggaagtgtactttgtcatgaggaaatacggattcgagcctaacacaacaaaggccagcgtcactcctcctggggggcgtaaagtggtccttggactgctggttgatggtgccagtcctcggctgaccagagactttagatccaaactgcggcagcatctttacttctgccgcaaagatgggtatggcccaataaaacacgcaaagcacaagaatttcgcttctatcctgggctttaagaaccaccttgctggactgatttcctacgctaagcagatcgacccagactttggcaagaagatgaacgatgagttcaacaaaatcgagtggccattttga

SEQ ID NO: 9012 - RNA, 1146 nt, unidentified
  source 1..1146: mol_type = other RNA; note = synthetic construct
atgaaacagtggtccccccagcgataccgagcagaagctctcattcagggagtgaaaccggaaatcatagacagcgccatcctgcacaccaagaagatcattaatctgaatcctaaggtgattccgattctcactttacggcacctggctttcatggcaggtgtcgagtatagctttctgcggaaagtgatcaacagggaacattttcatccctatcgctttttcctcatacggaaacggcggtctatcagtaagaggaagatttttgtcccagaaccccagcttctaaaggtgcaaaagttcatacacgacaatgtgctgaagcacatcctgcctcacgatgcctcctttgcgtatactccttatagctctatttacgatgcggcccatgtgcatatcaattccaggtggcttattaagatcgacatcaccaatttcttcgagagtatttcagagattgatgcctaccatgtgtttaaatacaacggctactcaaacttgatttcctttgagctcgcccgtatctgcacctggcctatccccagatccaggaacgaacgcctgcacagactgcagaacaagtacctgaaagagtacaagttctatgatagaaaacagaaactcggatcaacacctcaaggcgcacctacgtccccatgtctttctaacctcgtgtgcaaaaatttagacgctgagattagcttcctgtgtgaaaagttgcaggttaggtatagtcgttactcggacgatattacaatctctagcaccaacaagtcattttctagacataacgcccagcacattatagactccatctacagaatcttaaacaagtacgggttcaaccccaacaagtataaaacaaagatcattccaccaggcgctaaaaagattgtactagggctgaatgtcgacaaagatagcgtgggcctggacaaggagttcaaatacaagataaaacagcacatccacttttgccttcacgaaaaggtcgggcccgtccaacatgcacgctttaaaggtttcagcagtgttatagggtttcgcaatcatttgtacggattgatagtttatgcccgatctatcgatgtaatcttcggcgagaagatgctgagcaaatataatgagatcaattggccattctga

SEQ ID NO: 9013 - RNA, 1146 nt, unidentified
  source 1..1146: mol_type = other RNA; note = synthetic construct
atgaagcagtggtccccccagcgttacaggtccgaggctctgatccgcggtgtcgaaccagagatcgttaacaacgcgatcctgcacatcaaaaagatagtgaatctcaacgacaagctccttcccatattaacgctacgacacttcgcctttatggctggagtggaatactcctttcttcgcaaagtgattaatcgcgagcatttccacccatatcggttcttccttatcaagaagaagaagtctattagcaaacggaaaatctttgtgcctgaacctcaattgctaaaggcccagaaattcattcacgataacgtgctgaaaaacattagcccacatgaagccagcttcgcttacacacctcagtcgagtatatactacgccgctaatatgcacatcaattccagatggttgataaagatcgacattacctcattcttcgagagcatatctgagatcgacgtctaccatgtctttaaaagcaatggttacagcaacctggtgtcatttgagctgagtagagtttgtacctgggtgatccccagaagtcccaaggaacggctcccgaggttaaagaataagtatctcaaggagtacgatttctataaccgatcatccgagctgggctcaactccacaaggcgcccctacttcaccgtgcctttctaacctggtatgcaaacacttggattcggaaatttctctgctgtgcgagaaactgaaagtgcggtatagcagatactccgatgacatcacaattagtgcggtgaatattaacttttccaggacaaatgcactggatatcgttgactccatctacaggatcctgaggaagtatggcttcaacccaaacaaggttaagaccaagattatcccccctggggcaaaaaaaattgtactgggcctcaatgtggataaaaaccgtgtgaatttagacaaggcctttaagtataagctcaagcagcatgtccacttttgtctgcacgaaaaaatcgggcccgtcaagcatagtaaattcaaaggatttagcagcgtaataggctttagaaatcatctctacggattgatcatttatgctcggtctattgacgcaatgtttggggaggaaatgcagaagaaatatgagcgcatttcttggcctttctga

SEQ ID NO: 9014 - RNA, 927 nt, unidentified
  source 1..927: mol_type = other RNA; note = synthetic construct
atgagaaagaaaaattccttggagaaaagacgaattttcatcccacacccacaactggtcaaggtccagaagtacattcatcagaacatcctgaaatttgttgaatgccatgagaatagcttcgcctatactcctggtattagcatcgtggatgccgcttccttgcacaccaactcaaagtggctaataaaactcgatatcacagcattctttgagagtatttccgaggtgtcggtttataaagtattcaggagtctggagttccccgctttgctttcctttgaactggcacggatttgtacctggaattcaccccgcaaccgtaacacaatccctcctaggttcaagatttccaaaaagacaaactacaccgtttactctagcactgaggggatagaactgggccacctgccacagggagcaccaactagcccctctcttagcaaccttgtgtgtcgggaactcgataaacaactcaccgccttctctgtgaaaaatgagctggaatactcaagatactcagatgacattaccttcagcagcaaaaacattaatttcagtcgcaaagatgcgatcgagataattaagatggtctacaagatcctcattaactatgggtttacacccaatattcagaagacgaaaataatcagtccgaaagctaagaaaatcgtgttaggcctaaatgtcgaccgggagaaggtaaagctggacaaaaagttcaagaacaagatcaaccagaacatctatttttgcctgcatcccgacattggcccggtgaggcaggccaaatataagaagttttcctctgtgttagggtttaagaatcaccttcacggtctgataatctatgccctgtctatcgacaaggaatttggagaaaaggctctcaacaattacaataagatcgtgtggcctatccattga

SEQ ID NO: 9015 - RNA, 1161 nt, unidentified
  source 1..1161: mol_type = other RNA; note = synthetic construct
atgcgccagagatggagcccccagaggtttcaggcctctgccaaaaaccaagacatagaccagaacacaattgaacatgctatcaaacatgccaagaacattatacagcatgggaagtatatcctccccatcttcaccttaaggaatttaagcttcctggccggggtggaatacagcttcctcagagagatagtttcacgcgaatatattcacccctaccgatttttctacatcagaaaaaaaggccggaatcgtaggagaaaaatctgtatccccaatccacaactgtgtaaggtccagaggttcctccataaggaagtattgcaggaatttcaggttcacccagcttgctttgcctatatacgggatagctcaatcgttgacgctgcgtccgtgcacgtggaatcccggtggctactgaaacttgacatcgtcaacttttttgactctatcagcgaaattagtgtgtacagggcattccgagagaacgggtttcccgcgctgatatcctttgagatggctagaatttgcacttggctgagtctgcgcaacccacatgagatagatagccgctggaaaattgatcatcgacacaattacaagatctaccacagaagctccattagtgaaatgggctccctgcctcaaggtgccccttcatcacctatgctttctaacattgtgtgctttaagctggatgagacattggaggagctggcagtcgagaatggactccgctatacccgttattccgacgacctgacattctcgactaactcaattaacttcaatcggaagaacgcaacgttgttcatcagcaaggtgttcagcattctaaagtcttttggattcgagccgaacaaaaccaaaaccgagatcattcctccatcttcaaagaaagttgtgttggggctgaatgtcgataagaaatctgtgtctctggataagaacgtgaagtacaagatcaaacagcacatccacttttgtcttcacagtgacgtcggcccaatcaatcacgcaaagcggaagggcttctcgtccgtaattggtttcaggaatcatcttaaaggcctcatcaattatgccaagagtatcgagccggagtttggagaaaaaatgctgtccctctacaagaagattaaatggcctttagatatctga

SEQ ID NO: 9016 - RNA, 1185 nt, unidentified
  source 1..1185: mol_type = other RNA; note = synthetic construct
atgaacaatatctggaggccccagttatatatatccgaggctagatcccaaggcatcccaacagatataataaacaatgcagttgcgattggcgacaggattactaacaagggcctaaatattcccatcattttcaatctggaacaccttgccaaactgtcaggggtcgattacgaccaggtttataaacttaccaagagagcgggcgaaaacagtagcggtaaagactactatcgcatttttgcaatacgcaagaaagacaccaagtcaaaacgttacatatgtgtgcctagcaaaaacctgttgcgggtccagaagtacattaatcaattcatccttcacaacctgaagtcacatccttcttccatggcctataataaggggtgtaagattgtcgacgtggccaatgtgcaccggcaggccaagtggcttctcaagatcgacatcgaagatttttttgagaatatctccgaagtagacatctacaagatcttcttcagttccggatacagtaaactgctgtcatttcagctcgcccgattgtgtacaaggattgttccttaccagaaggagcacgctgagaaatatagccactcccgctggagagcccacaagaactacaacaacaagaactacaatttccatgtgataggatctctcccccagggtgctccaacctctccgttgctcgcaaacctggtgctccgcgagttggacgagaaaatcactaaaattgctttatcgtacggggtgcggtatacccgttattctgatgatctgacattcagcagctgcgatatcaagtttggaaggaaaaactgctacagactgattcgagagatctatgatagcctgtattctaatggcttctcaccgaagaagaataaaactaaaatcatctccccaggaagcaggaaggtagtgctcggcctgattgtggatggaaataagcccaagttgacgaaagaatttaaagccaatatcctgcggcatctgcatttttgcaatctggaatctgtcgggcctgttcagcacgcaaaacaccaaaaattcgactcggtgatcggcttcaacaaccatctaaaggggcttgtctcttatagcctcagtattgaccccaagtttggtagcaaagtgaagtcattatacgagagtattaactggccttccctgccattcaactga

SEQ ID NO: 9017 - RNA, 1182 nt, unidentified
  source 1..1182: mol_type = other RNA; note = synthetic construct
atgaataactggcggcctcaacaatacagaatagaagcccagaggaagggggtgccagagaatgtgattaacagtgccatcgccattggagacaagatcagttcgacaggactgaacatcccaatcattttcaatctcgagcacctgtcctatctgagcggcgtggactacaatcagctctacaagctcacaaaacgtgtcggagagcgcttttacgaaaaggaaaattaccggatcttcaccattaagaagaagaactcaaagtctaaacgctatatatgtgtgccaaatcacaaactgctgcgcgtacagaagtacattaacaagtttattctgcagcagatcaaaacacatcacgcaagtatggcttataatagtggctgccaaattgtcgatgttgctaagttacattgtaactcccgctggctgattaagatcgacatcaaggacttcttcgaggaaataagcgaggttaacgtctattccgtgttcaatgagtgcggttattctaacctcctttcctttcagctggcacgactgtgtacgcgtatcgtaccgtatcagaaggaggatgttcttaacaatatcaagagtcggtggaaatcaagcaaacagtacaggaacatcaactataaccatgacgttaccggatccttaccccaaggtgcgcccaccagccctatgcttgccaatctctttttccgagctctggatgagaaaattatgactatcgccaacaagtacaacctgatatatagcaggtacagcgatgatatcgccttatcatctagagacgacctattcggcaggagcaaatgccatcaggtcgtgaaagacgtgtataaggtgttgtactcctctggcctttcgccccagaaagggaaaaccaaaatcttgtcaccaggatctagaaaaattatattgggtttggtggtcaacggctcctcacccaaattgactaaggaatttaagaagaacctgctgcagcaccttcacttctgcaatctcaaaagcattgggcccgtgagacacgctaagtacaagaagtttgactccataatcgggtttcggaatcatctgcacggcctcatttcttatgcactgaatgtcgatccgaatttcgggaaaaaagtaaaacaacagtacgatcacatcgattggcctcctctaccctttgtgtga

SEQ ID NO: 9018 - RNA, 1173 nt, unidentified
  source 1..1173: mol_type = other RNA; note = synthetic construct
atgtacaaaaattggaatccccaaagatacaggaagaacgctaatcgagataatatctcacatgacgtgatccggaacgccattgaaattggaaaccggattaacagtgtcaaccgcgatatccccatcgtgtttactttgaatcacctctctgtgctgagcaaaagcaaacttagcttcctcgaatctatcgcatccaggaattacgaggacaagccatatcgcttcttcaagataagaaaaaaagggaagaactcaaacgacaaacgacgtgttatttgtataccggagccaaggctactgtcagtacaacagtacatcaacgaggaaatactgtctaagatcccttcacacgaatgtgccatggcttattccaagggcaaaggtgtctatgatgcagccgagttgcactgcggatgtcggtggcttatcagaatcgacctgaaggacttttttgatagcatcagtgagcggcaggtgtactacgtttttaataagctcggttatcctaagctgttgagcctcgagctggccagaatttgcacccgcgtttacccaaggttcatttaccccagtgagaaaagcaagtggatatccaaccggtccaaagactctggcattgcctcctatacctgcagcggaaatatgcttggctcgctacctcagggcgcacctacaagtccggctctctccaatctggtgtgtaagtcgttagatggggacttgcttctcttttctgaacagcatggctttctgtataatcgatactccgacgacctgtatcttagtacgacctctgacctgtcaagaaaggacattcggtgcttcttactgtccgtttatggtttactcaacaagagggagttccaggtgaacaagaataagactgtaattagcggacctaagacaaaaaagctggtcctggggctgaatgtggataaggaatatcccaaagtcaggcgcgaggtgaaaaaccagattaagcagcatctccacttttgcctgagaaaggatatagggccagtcatccactcacagaaaaaaaagttcagcagtgtggtgggcttccgcaaccatctgttggggatgatcaattacgtaaaccaaattgaacccatgtacgcgatcaaattgcgtaaatctttcgatcgtatcgattggccatttatctga

SEQ ID NO: 9019 - RNA, 1146 nt, unidentified
  source 1..1146: mol_type = other RNA; note = synthetic construct
atgaatcgttggtcgtccagagcctttaagaagcacaatagcgacaaacccgcggcagtagtcgaaacagcagctctgtatggaagaaaaatacaaacatcttgcccagaactccctgtcatcttcactctgaatcacctggccctgaagagcggggtaccatataacaacctgcgcagcttcgtcgacagaaccatcgagcgaccttacagaagtttcacgcttcgtaagaacggactgggctccaaccccaggaagtttcgagtgatcaaggtgccgcagcaagatttaaagaaggctcaacagtttatcaaccagaacatcctctctaaaatggagccgcatgagtgttctgtggcgttctccccaggaagcaagatctatgatgctgcaagcgaacattgcaacgctcggtggctccttaaattcgacatcgtgtctttcttcgaatccattaccgagaagagtgtgtatcgggtgtttaggagatataattaccctgctttactgtcctttgaaatggcaaggatttgtacagcgttgaaagcacggcctcccataaactgggggggtgcccctcccaacatacggtaccgcacgattcccgggtattcaaataaaaatttgggtaccttaccgcagggagcccccacttcccctatgctggccaaccttgtctcatacaacctggaccgtcggttgaagctgattgccgacgcttataactgtcattacagtagatacgcagatgacatcacattttctaccgatagttctctcagccgcggcgaggtgagcaggattatagccatgatcaattccacactacgagagtacggacatactatgaataaggccaagaccactattgccccaccaggcgccaggaaattctacctgggcatgaatattcacggcgactcgcctcagctacggaaaagttttaaaaggaagcttaaacagcacctcttcttctgcgaaaagaattcagttggcccagagaaacactcaaagcacctgggctttgtcagcgttattggtttcaagaatcatctgcgcgggctcatcaactacgctaaccaggtggataccgtttttggggagaattgcatgaaacgctttcagtcaatcgattggcccttgtga

SEQ ID NO: 9020 - RNA, 1158 nt, unidentified
  source 1..1158: mol_type = other RNA; note = synthetic construct
atgaatagatggtccagccaactgtttcagaaagaagctcgccgtctgggtcggtcagaggatgtgattgacaactgcttaaatgctgccgccctcatccagcttaagaactcacaaatcacccccatctttagcctgagacacctttcatacatggccaaagctgattatgggttcttacgggccatagtgagcagggacgacagaattgatagttaccgaacgttccagatccgtaaaaggaagcgcaggaagaatgacaaagaaaggtaccgcaacatcaatgtgccatctcacgacctaaagaagactcagcaatggattaataagcatatcctctcacacgtatcgcctcatcagtgcagtatggccttctataaggatagttcaatcatagaggccgtaaatgcccacgtcggggccaagtgggttataaaagtggatgtcaagaacttcttcgagtctatcaacgagatatccgtgtacagagtgttccgggaattgggatttaatgctctgctctcctttgaactggcaaggatttgtaccaagaaacggacaatgctgccctcccggtcgaggaagtggattagcaccggcagacgagagacaatatccacatatgctcagccgatccaaggttttctgccccagggtgcgcctacctctccaatgttgtccaacttggcaagtcttcgcctcgatcaggagatctttaagttttgcgcccatgaaggattcatatatactagatacgctgatgacattgtgatttccgtgcacagggacgtgaagaaaagcgagtgtagcaacatcatcaacaaactgtaccgagttatggcatctaatggcttatctcctaataagaccaagacaattgtcctgcatcccggcgcgagaaaggtcatcctaggactcatgttgactgacaagggagtcatgctcacgaaagagttcaaaagccgcctgcgccagcacctgttttttcttaactccgagaacgtggggccagttgaacacgcccagcacaagggcttcgttagcattatcggcctccggaaccatattattgggctgctgtctttcgcaaaagcggtggacaaaaatttcgctagtaaatgtcaggcagactttgatcgtatcgtatggcctatttga

SEQ ID NO: 9021 - RNA, 1152 nt, unidentified
  source 1..1152: mol_type = other RNA; note = synthetic construct
atgacactttgggattcacaggcttacattgttgaagcccgcgccactggtatcaacccaaatattgttaccgcggcgctcgggcatgctaatgccattagatccgtgtcgcgtgatctgccaatcatcttcactctgagtcacctcgcacaggcctgtggagtggcacactcttacctgatggacgtagctgatcgcaggatagacccgtaccgcgattacatcacaaagaagagagagaaaccccaccgcacagccttcagccggcgttacagaatcatatgcatgcctgaccctgagctgaagaaggttcagaggtgggtgcatcaaaacatcctttcaaaagttacgcctcatcgcgcctccaccgcctattccaactccaacactttgttagatgcagctgcgcggcacaccaatgctaggtggctcatcaagatcgacatcgaaagatttttcgagagcattaaggagccctatgtggccggcatatttgagcggctgggctatcccgaccttctgagcttccagcttgcgcgactctgtacacggctcccctctttaaaaagtcggaaggatattttctgccgccggtctaagccagtcaaaggcgtgatgcagaatgactggatcggcttccttccgcagggagcccctaccagccctcaactggccaacttggtgatgaggcggttcgacagaagaatgaccagcttgagcagaaccgaaggtctgagatattctcggtactctgacgatatgattttttccacactggggtcattcagtaggccacaggccactagttttgtgcatcaagtctatgatgtcttgggagcttatggcttcgaagcaaacaggacaaaaacctcaatcgctgcacctggcgccaggaaagtggtcttagggctcctggtcgatagggacgagccaaggctgactcgagagtttcgaagcaatatagagacgcacctacactacctggagcgcccaaacgtgggtcccgtagcccatgcaaaagctcgggaatttgactccattattgggctccagaatcacttgctggggctaattgcctttgcacgacagatcgacagaaagtacggagatgaactgcgcgctcgactgcaccgtataaattggcccgcatga

SEQ ID NO: 9022 - RNA, 1152 nt, unidentified
  source 1..1152: mol_type = other RNA; note = synthetic construct
atgactctctgggactcccagattttcacagctggagctagagctgccaatgttgatccggcagtaatcagcgccgccgttggccatgcgaacgctatacgcagtgtgagtattgacctgcctatcgtgtttacacttgcgcaccttgcccacttgtccggcgtgtctcataggtacctcatcgaagtggctgggagagggtcagacccctatcgagactatattgcaaagaagcggcaggcacccggatcaactgctgcctcgagaagataccgcactatttgcatgcccgatccagagctaaaaaaggtgcagcggtggttgcaacagaatatgctctctaagatcgcacctcacgctgccagcaccgcgtactccgaggacgacactgttttcgcagcagcagccaggcatgtgaacgcgagatggctgattaaaatcgatatagagaggttcttcgagtccattaaagagccttacgtcgcatccgtctttgaacggttagggtatcccgatctgctctctttccagctgggtcgcctttgtaccaggcttcctacattaaaaagccgcaaggacatttttaaaagacggagtaagccggcccgtggcgtcatgcaacacgaatggatcggcttcttgccccaaggcgctccttcaagcccacagctggctaatctcgtcatgcgtaggtttgaccgtagggcaaccgccgctgctaagaaagccggtttgcgatactcacgctacagcgatgatatgatctttagtaccgcaggttctttctcccgggagagggcagagcacttcgtgcatgatatatacgacgtcctgggagcctatggctttgaggccaaccgaacgaaaacgagcatcgcggcccctggagccagaaagattgtgctcggcctgctggtggacagagataagccccggctgacaagagagtttcgggccgggatagaaacccacctgcattatctagagcgaccagacgtgggaccagttgggcacgccgaagttagggaatttgattctgtgatcggcctgcgcaaccacctggaaggtttagtagccttcgctcgccagatcgaccagccatatggagataggctcaaggctcgactgcgggccatcgtatggccagcctga

SEQ ID NO: 9023 - RNA, 1155 nt, unidentified
  source 1..1155: mol_type = other RNA; note = synthetic construct
atgcagaattggaacagtcaacttttcagcaaaggggccgctgccgcaggagtaagccctagtataatcgcaagcgctaatgcctacgctagaagaattatttcctgtaatagcgacctgcctatcgtctttaccctgaaacatttcgcccacctgaccgaattaccatttgacaacctggtgaagatcgtagaacgaaaagaggatccttatcgatcttttctgatcaagaagagatcaaggcctggtgatagggccgtggctagaagatataggaccatctgtattccggatactactctgatgtttgcccagcgttggatcgaccagaagatcctgagcaaggttgacccgcataattgcagcactgccttccatggcaattcttccatcgttagggcagcacagcgccattgcggatgccggtggctgattaagattgatatccagcggttcttcgaatccataacggaatcgtctgtatgccgggtcttccagagtctgggctatccagacctcctgtcttttgaactcggccggctctgtacccgggagcctagtgtgctgtcccgccgatggaagtttagacgcacacgctcttaccccagcggggtccaccaacacccatcaattgggttcttgcctcagggttcccccacttctccccgactcgcgaacctaacaatgagggagttcgacgaaggcgtgaactcaatttcacgtagctatggcctggtgtattccaggtacgcagacgatctcatattttcaacggacgcggccaccttttccagagtggaggccgaggcgctgatctctcgtatctaccaggtgttacttgagtacggcttcgagcccaacagaacaaaaacaatgatcagtccaccccgggctaggaagatagtgttgggactacttgttgatcgcgacacacccaaactcactaggcaattcaagcaggatttggagaaccacgtgttttacttatcgcacccacggcatgggccaagccaacacgctaacaaacggaattttacctcagtcattggactccaaaattacgtgcagggattgcttgcccacgccgctcaggttgattccgctttcgccgaccgcatgcgcgcaatgctggctcaggtcaaatggcccatttga

SEQ ID NO: 9024 - RNA, 1134 nt, unidentified
  source 1..1134: mol_type = other RNA; note = synthetic construct
atgaatcgctgggtgccgcatatatatcgacaaacaggacagcaaaaagatgtccccgacgcgatcatcaatgaggccctaagccaggctcaccgcgtgcagaataaagagctgcccgcaatcctcaccttacgccatttagcgttccagactgatgttagctacacgaatctgcacaaaattatctcacgagatgtcgatccttatagatcttttagcatcaagaaacggagcggcggttggagacggatcagtgtaccacagtttgaactccttaaggtgcagaagtatatagaccacttcgtattgtcaaggatagccgactccagttacagctatgcatttaaatctaagacctctatcgctgattgtgccaatcagcatttatcatgcagatggcttgtgaaaattgacctccgtcacttcttcgagtccttgagcgagatgcaggcttatagggtgtttaacgaggcaggctataataacctggtgtccttcgaactggctagactgtgcaccaaagtcctgccactgaccgccaagaagtactcgaaaccaaactggcggagcgtcgggcacatctccatgtacagcttttacgaggataaatataaccgcattggccatctaccgcagggggtgcctacatcccctcgattgtctaaccttattgttcgtggactggatagggaaatcgtggaagccaccgacgagtatgacctgacgtatactcggtatgccgacgatatgacattttcgactggctcctcatgtttctctaagaagaaggggagggacttcattaataagatttactcactgttgcccaagtacggcctcagacctcacccccaaaaggctcaaatcgttcctccaggcgctcggaagattgtcctggggcttctggtggacggagataaggtgaggctcacaaaacactttcgctctaaccttgaatgccatctgtactactgtgttaagaatcccattagtcacgcaactaaccgggggttcgcaagtgtcctcggactcaagaactacgttaatggtttgctggcctacgccaaccaggtggaccccgactacgtgaacaaaatctccagtgacgtaggtaaacctgattggccaatatga

SEQ ID NO: 9025 - RNA, 1119 nt, unidentified
  source 1..1119: mol_type = other RNA; note = synthetic construct
atgaagcggtggtccccacacctgtacaagatctacggcaagaagaacaaaaaggatgacaaacttatcgagaatgctcttaatcaagcggacatattgcagaatcgcaacttaccagtggttctcaccctaggccacctggctaggcacacagatattccctaccagactctgcggaaactggtagcgaggcaagtcaatgcatataggatatttcgaattcggaagagatcctccggatatcgggtcatttgtgtgcctaacaaagacctgctaaaggtccagcggtggatcgacaaattcattctatctaacctggagtcatccccttattcttacgcatttgaagagggccagtcaattgttgattgcgcttctcagcatttgtcatgccgctggttgatcaaaatcgacctcaggaacttttttgaaagtcttagcgagatccaggtgtatcgagtgtttaaggttgcagggtataataatctggtcagttttgagatggctcgtctgtgcacgaaacagtcaaaaagcgggtggaagctctataacccctattggaagtcctacccgcgcgagaaaatccctttgtataatgccgatgtaatcggccatctgccacagggtgcccctacctcgccaaagctcagtaacctgatcatgaaaaacctcgacttcgaagtgaataacattgcacaaaaattctccttggtgtacactagatacgccgacgatatgatttttagtaccatagactctagcttcgactataagaaggccaagtgtttcatcaaggacatattcaacatccttcccaaacatggcttattaccgaatagacagaaaaccaagataatccctcccgggggaagaaagattgtgctgggtctgctcgtcgatagcgaaaaggtgcgtctgcccaaggatttccgcaacaaactcgaatgccactggtactactgtacaaaggacattacacagcacgccgaaaagagaggcttcaaaagctatctgagcatgcagtactacattaaagggctcatctcttttgccaggcaagtggatagcgatttcgttgagaaacttaagaagaagtacggagagatcaaatggctgtga

SEQ ID NO: 9026 - RNA, 1152 nt, unidentified
  source 1..1152: mol_type = other RNA; note = synthetic construct
atgtcaatcggtccaccacacacttatgtgacagaaggcaggaagcggggagtgtcgaaccagattctgcgagattccctagagcaggcccggaaagtgcaggagaagggcctccccccggttctcacactgagacatctgtcctctctgacaaatgtcgagtacaaattattgcgcaaaatcgtagcacgccggcaggacgatgcatatagatcattccttatcaccaaacacagcggcggtaagcgcgtcatctgtgtgccccaccctagcctcaaaagagtgcagcgatggatcaatcagaagattctgatgaacgtgtccacgcattggaggtcatacgcttattccagaaattctagcatcgtcgactgcgcccagcaacactgcggatgcaactggctgattaagttggacattcgtcagttcttcgaatccattaccgaaatacaagtctaccaagtgtttcagaacttggggtaccagcctttagttagtttcgaactggcccgcatctgtactagaacttactctagttataacgagctggaattgaacaagaaatggctcagccagcccgaggcctatagcgtaattcccttttatcagtacaaataccttggtcatctccctcagggcgcacctacgagtcctatgttagcgaacctcgtctgcaagctgatggatgaggcgctgttcaatatcgctcacgatgagggtctggtgtacacacgctacgctgatgatatagtgctgagctctagtgacatacactttacccggaagaaggcccaatccgtaattagaaaggtgtcttcagtgttgactaagtatgagtttgaaccgcagcacaataaaacatccgtcgttccaccaggggccaggaaactggtcctgggcctcctagtgaacaattctactcccaggcttacccgaaccttcaagtgtaagctagaaaggcacatctgggccgttgggaagttcggacttgccaatcatgctcatcacatcggatttgacagcatatggggcttcgttcggcatctggaaggccttatttcatacgctatgatggtggagaggcgttttggggagagtatgcagatcgcatttcaaaaaaccctcgacgggaacggatggaataataactga

SEQ ID NO: 9027 - RNA, 1146 nt, unidentified
  source 1..1146: mol_type = other RNA; note = synthetic construct
atgatgtggagttctcaacattacttggcccaggggcggcagctacaaataagtgaggccatactgcagacggcgatgaaacagtcacgtcggctcgttcagagaaggcctcagagtctgcccgtactgctgacactgggccacctggcaaagcgaaccggaattccgtactcttcccttagggcttatgtgggccggcaggcaattgagccttaccgccggttcagaatacgcaagcgcagtggggggatccgacgcatttgcgtgccagagcctgcgttatcggccatccagggctggatcgccgagaacatcttacagagggtggacgttcattccgctagccacgctttcaaaaaaggtgactctatcgctcggtgcgcagaggtgcatgcaggagccagatggctggtcaagatggatatcgccgatttctttggcagcatttcagagattgatgtctttcgagttttcaaatccctcgggtataactcattggtgtccttcgaactagccaggatctgtactgagttgcccctgaattccgccaaatatgccttttcaagctggcgcagaagccacgctcgaagaggaatccccgcttacaatcagcaatatgtcggacgccttccccaaggagccgctagctctccaatgctggcaaacctggcgatgattaacaccgatcagcgcctgacagaaatcgccaattcttttgggctcgaatacactcggtactccgacgacctgacctttagcactacaggcgactttgatcgcgcctccgcttacgccctcatagaacaagtggctaatgtgctcaagaggcggaatcttttccctaacaaggcaaagacaaaggtagtgcacccgggagcgcggagagttgttctgggcctcctagtagacggtgtcgcacctaggctgaccagagcgtttagggaccgactcagacagcacctttatttcctggagaaacgggggattgaagcccacgtgcaggctcgtgccttcgaatctgctggtggcctttacagacatttgaggggcctggtggattatgctaacagcattgactcggcatatgccgccccagtcctcgcacgtttggaagcattaccctggaggccagaggtgaagatctga

SEQ ID NO: 9028 - RNA, 1131 nt, unidentified
  source 1..1131: mol_type = other RNA; note = synthetic construct
atgtggtcatcccaacactatttagctcaggggaaacaactgcaacataacaacgaagtgcttcaggaggccctgaagcagtcacgccgcctcgtacaacacaggccacagcccctgccggttatcttgactctgttccatttagccaagcggaccggagttccctactctgccctccacgcatacgtcggacgacaggcaatcgagccttaccggcgttttaggatcagaaagcggtccgggggaatccggcgcatttgcgtagcagagccccgattgggctctatacaagcctggattgccgagaatatactgcagagggcagaagttcacccagccagccacgctttcagaaagggcgactccatctccaggtgcgcggaagtacatgctggggccaggtggctagtcaaaatggacattgctgatttcttcggtagcatcagcgaaattgacgtgttccgagtgtttaaatcgctcgggtataatccactggtcagtttcgagcttgctcgaatttgtactgagttgcctgcaaagagcgcaaagtacctgctccctagctggcagctgcatcatacgcgtcggcagatacctggctatagtcagaagcacgtcggcagactcccgcagggtgcttctagttcgcccatgctggcgaacctatcaatgatcagaacagatcagacactctctgagattgctaactccttcggcctgaagtacacccggtactccgacgaccttaccttttctactgcaggtgatttcgataaagcctcagcctacgcccttatcgaacaggtcgccaatgtgctgaagagaaggaatctgtttcccaaccgcgcaaaaacaagtgtggtgcacccaggcgccaggagagttgtgctgggcttactcgtggatggagacgtcccccgcctgaccagaacatttcgcgatcgactccgccagcacctgtattatttggagaaacatgggattgtggcccatgtgcaggctcgggcttttgaatctgcaggaggtctgtatcgtcaccttcggggattgatcgactacgccaatagcgtggaccctgcttatgcggccccacttctcgccagactagaggcgctgccttggaggagctga

SEQ ID NO: 9029 - RNA, 1131 nt, unidentified
  source 1..1131: mol_type = other RNA; note = synthetic construct
atgtggagttctcagccatatctggtgcgcgggcgcaaactgggtctgtctccggaactgttacaggaagcagtgaaacagagcaggagactggctcagaggcaccctcaacctctgccagttttgctgacactgtgccacttagcaaagaggaccggagtgccttatagctccctccgcgcctatgtaagccgtcaggccgttgagccctaccgccgttttagaatacggaaaagatccgggggcgtgaggagaatttgtgttccagaacccaccctgggcgcgatccaaacttggattgccgagcatattctgcagagagctcaggtgcacagagcctcccacgcctttaagaaaggcgactcaatagtgaggtgtgcagagcaacactcgggagcgcgctggcttgtgaagatggatatcgctgacttctttgggagcgtttccgaaatcgacgtgcatcgcgtcttcgtagggctggggtacaatcccctggtttcttttgagttggcccgaatctgcacagaactgccctcacggtctgataagtacgccctgagttcctggcaatgtcggtatgcccggcgcggcatccctgcatatggacagcaatacattggccgcctccctcagggtgctccctcaagtccgatgcttgccaatctgacaatggtcgccactgaccagaaactcgaggaaattgccctcaaggctggcctactctacacccggtattctgacgacttaacattcagtaccgccggggacttcgataaggggagggcatacggcctgatagaagaggtcgcggccgtgttgaaaagcagaggtctattcccaaaccgggccaagactgtgatcgtccacccaggcgctaggcgacttgtacttggactcctggtcgatggagacgcacccaggctgacccgagtgtttcgtgataggctcagacagcatctatactatcttgagaagctcggcatcgcagcgcatgtccaggctagagcattcgagagcgcaggcggattataccgacatctgcggggattgattgattacgctaactcagtggatcctacgtacgccggtcccttgcttgctcggttggaggccctcccatgggctcgatga

SEQ ID NO: 9030 - RNA, 1131 nt, unidentified
  source 1..1131: mol_type = other RNA; note = synthetic construct
atgtggtcttctcagcactatctcgctcgcggtagagagatagggcggtcacctgagttgcttcaggaagctgttaagcaagcccgcagactcgtgcataggcacccacaagggatacccgtacttttaacactctgccacctcgcaaaaaggaccggcgtgccatactcaagtttgagatcctacgttggccgacaggctattgaaccttaccgcagatttcggataaggaagaggtccggaggggtcagaaggatctgtgtgccggaacccaacctgggcgctgttcaggcctggattgctgaacacatcttacagcgcgtcgatgtccaccaggcgagccatgcctttaagaagggcaattccatcgtacgatgcgctgagcaacatgtcggtgccaggtggctgctgaagatggacattgcggatttcttcggtagtgttagcgaaattgacgtgtatcgggtgtttgtggccctcggctacaattccctggtgtccttcgagcttgcccggatctgtaccgagcttccagccgcctctgccaaatatgccctgcgctcttggaattgccatcgatttagaagtgggattacgcattatcagcagaaatacgtcggcagactgccccaaggcgcaccaagctcgcccatgctggctaacctggccatgttgaaaacagaccagttgatagcagaactggcgtctaaagaggggctgatctatacccgctattcagacgacctcaccttcagcactagtggtgactttgatcgccggcgagcaaataagtttatcgaggaggtggctgctattctaaaggcacgtggactcttccccaaccgcgcaaaaacagtggtagtgcacccaggagccagaaaagtcgtgttagggcttctagtggatggagacgcgcctcggctcactaggcagttccgtgataagatccggcagcacctgtactacctggagaagaacggaatcaaggctcacgttgaagcccgtgcattcgagtcaatcggcggcatgtacaggtatctgcgaggactgattgattacgccaaaagcatcgacagcgcatacgcagccccgttgctgaggagactagaagccctgccttggcctcggtga

SEQ ID NO: 9031 - RNA, 1137 nt, unidentified
  source 1..1137: mol_type = other RNA; note = synthetic construct
atgtggtcacccaggcattacttagaacaaggcagacttcaaaaacagccctcagccgtgctggcagtagcagttgagcagataaaacgcctgcaggctcacaatcctcccctcccgccaatactgaccttaaagcatttggctaaagttacgaaggtgaggaaagccaaacttgagtgcttcgttgagcggatcgcccccgaagtgagctacaaacgattcaacatcaagaagcggacgtcagggtacagaaaaatttcaatccctgagcctgacttaatgaaggtgcaggcatggatctctcaaaatatcctgcagctgccctccgtgcactctgctagcaaggcatttcggaagcacgattccatcttgaaatgtgctgaggtgcattgtggggccaagtggatgattaagattgatattgccgacttctttggcagtataactgaaatccaggcctatcgtgtctttaaggatctgggctacaacccattgattagctttcacatggcccgaatttgcacagacctgatcccaaagtctcagaagtataaaatgcaagcctggcaaatctttgagaacaaatactccataaccgaataccacaataagaacaactttggacgacttccgcagggcgctcccaccagtccacttctctccaacctcgtgatgttgcgcctagacaaaaccattgctgaactcgccgaaaaacaggggctgaggtacaccaggtatagtgatgacattactttcagtacaaagggcgattatagccgcaagcaggcggtcgagttcgtagcgtctgtgagcgcactgctcaaggcagacggactgtatctcaatcggaagaaaacagtcatcgtgccacctggaagccgcaagatagtcttgggtctgctcactgacagagaataccctaacctgaccaaggaattcaaagagaagctacgtcagcatctgtactacattaaaacactgggggttgaggcgcatatgcggaggagagagttcgattccgtcggtggactttatagacacatcctgggtctgatcaattacgctaatctagtggaccccacttatgcctataagatgaagcagcagttcaaatcgctcccatggcctggccagtga

SEQ ID NO: 9032 - RNA, 1152 nt, unidentified
  source 1..1152: mol_type = other RNA; note = synthetic construct
atgccttggtccccccaacgctttctcgcagagggacttcgaagaggtagagatcacaaagccctgatggaggccattcgccagatttctcggatgcagcggcaaaggcccgtgcttccgacgctgctgaccttggggcatctcgcgtgcagaacgcagatcagttacgaatacctgcgcgacatcattgcccgtaatacaggtcatcctccctataggtccttcagaatcactaagcgcagcggaggtctgagggttatttccgtccctagccctcaactgatgaaagtgcagtcatggctaaccacgcacgtactgaacaaggtccagccgcatccaacctcctacgctttctctccaggcagctcaattgcagattgtgcccggcagcacgctggcgctacttggttggtgaaaattgacatagccgatttctttggcagcatcacagaaatccaggtgtttcgtgtattccagatgctggggtataacaagctagtcagctttgaactagccaggttatgcactatcctccccatagtttcagccaagcacaaattaaagccatggaagactaaattccccagaaaacccatcgattattactcggaacagctcatcgggaggttgccacagggggcacctaccagtcccatgctcgctaacttggcgatgagagacatcgacgaagagctgcagcatttggctgactctctcaagttagtgtacacacgatattccgatgacatcaccttcagcaccaagggcaaattcagtcggacagcggcatccgccgtgattaagcagactaccgctattctgaagcgcagaggactgtttccaaaccgtgcgaaaaccgctgttatacaccctggggcccgcaaaattgtgctggggcttctggtggaccaagagcaaccacgactgtcacgcaagtttcgggataggctgcggcagcacctctactaccttgagacaaggggtataactgcacacctggaggccagaggcttcgattctgctggcggcctctataggcatctgcggggattgatcgactatgccaatatggtcgaccagccgtacgcacagaagcaactgctccgattacaggcccttccttggggatctacacttaatgcaagtagctga

SEQ ID NO: 9033 - RNA, 1146 nt, unidentified
  source 1..1146: mol_type = other RNA; note = synthetic construct
atgctctggtcgcctcaacgttttctcgaagaaggcttgttaagagatcgggactactacgcgctccaggaagcgatcaagcagataactcgtatgagaagacgcgggcctggattgccagtggtactcaccctaggccacctggcgaataggacacgagtgccacatgagcacctccgtgatctagtggctcggaataccggccagcctgcctatagaacatttaggatttccaagcggtctggaggatctcgggtgatctctgtgccaggcccgcagttgaagaaagtgcaaacatggcttacccaacacgtcctgagaaaagtaaagccccatatcgcaagtcacgccttcagccccggtagcagtatcgctgattgtgcaagacaacacgccggcgctcgctggctcgttaaggtcgatatcgcggactttttcggtagcgtcaccgagattcaggtattccacgtgttcaggaggttaggatatagcgacctggtttccttcgagctggcccgactatgcaccacggtgccatttgccagcgctaaacacagcatgaaggcttggcaggtccgcttccctcgaagacgaatccacttctatagtgagaagctgatggggcggcttcctcagggagctcctacgtcacccatgcttgcaaacctggttatgagggaggccgacgaagagttgcagaacctcgccgactcttacggcctggtatacactcgatattctgacgacattaccttttccactcgcggcgaattttcaagggatcaggcagtcacagtggttaggcagtcagcaactatactgaaacggcggggtctgttccccaaccgcgccaaaactgccattgtgcatcccggagcccgccgtattgtcctggggttgcttgttgactccgatcaacccagactgagcagggcattccgcgataggcttcgccaacatctgtactatctggagacacggggcataatggcccatgtggaggctagggaatttgatagtgctggggggttatacagacatctccgggggcttatcgactatgccaatatggtggaccagccatacgcacagcagcagctgtccagactgctggccctgccgtggtcctcagtcgctcaggtgtga

SEQ ID NO: 9034 - RNA, 1185 nt, unidentified
  source 1..1185: mol_type = other RNA; note = synthetic construct
atgtggagctctcagcgatttatcaggcaaggcctggccagagggattagccagcagattctggatgctgcagtagagcaggttgaggctctcgccaagggacccatccgcctaccagcaattctcaccctgggtcacctggcccagagaacggatgtctcatatatcagtttgcggaggctggttgccgacgagtaccgacacccttacaggacctttaccattctgaagagaaaagctaacaagagtggctatcgcgggaggcgcgagatttctgtcccaactccagagttgctgaccgtccaacgctggctgtcagctcacgttctccggcaagtacggcctcaccctgcctcccatgcgttttctcctggaggtagcatagtgaaatgcgcctcagagcattgcaatgccaaatggctgatcaagctggacatcgctgatttcttcggcagcatatctgagatccagatttatcacgctttccgaaaattgggctaccagcccctgatttcgttcgagctcgcacgtttgtgtacagataggcctcgcaaaaatgttcccccagcctttgtaagaggaagaaatcggatgccgtccgggaaggtcaggtttaaggctcgtgtgatcgaccaatatgaccacaggtatataggctacctaccccagggtgcacccacatcccctatgctcgccaacttggtcatgcgagacatcgacgtgcagcttgctgccatcgcgagcagatacgaactgcggtacacacggtatagtgacgatattaatttcagcaccactgaaaacttctcacgcgacaaagcccatgaactcatccagcgagtggctaaatgcctgattaagaaggggcttggtctgaacaagtccaagacaacgatcgcaccacccggggccaagaagctagtgttaggactgcttgtggatactgcaaagccaagactctgtcatcagttcaaagacaggttaaggcagcatatctactacattgaacggtttggcatagaagcgcacgcacaacggcgtgccttcgatactaccgccggatttatccgccacataaaaggccttctcgattttgcctacatggtggaaccggcttatgcgctggacttaacagagagacttcaggtggcagtgttcagttgggacgattccttcgtgatctga

SEQ ID NO: 9035 - RNA, 1134 nt, unidentified
  source 1..1134: mol_type = other RNA; note = synthetic construct
atggacgaacctaccatccgagctgttattgcccaggtgaaagccaccgtggcacctccgttgcgactgccagctattctgacactgggccacttggcccaaagaagcggcgtctcctacgatgcactccggagactggtggcgggaactcagcatcactcttacaggcagttcaagattaggaagaagtctgaacaggcccggaaaaggcgatcctttcgcattatccacataccatgccccccactctttgaagtccagcgatggatatccacctacgtactgagagagttacccgtacatccttctagtcacgcctttagcccaggaagctccatcgtgaaatgtgcagagatccactgtaaggcacgctggctggtgaaactggacgtgcacgacttcttctcgagcgtgagcgagattcaggtttacagggtttttaggagccttaattatggggctcttatctctttcgagatggcccgtttgtgtacctatcggcctaaccgcgagacattcaagctggcactccctggaagattcagagtcccgtcaggtattgtcaggcacccaggccggggcatcaagtcctactcacacaaatacgtgggctatctgccccaaggtgcccccacgtccccaatgctcgctaatttagcaatgaaggacatagatgtggctatttctaagatcgccagcgatcacggattgcgctacactcgctactcagatgatctgactttttcaaccgagggggatttttctagagggaaggccctgaacgtaatccaagaagtggcgaagaaacttatcgttcatggcttaatgcttaataatcccaagacaacagtcgcgcctcctagtgctcggaagatagtactgggtctacttgtggacggagccgatccccgtctcatgaagagtttcaaagacaaagtccgccagcatctgtatttctgcgggaaatatggggttgaggagcatgctgcccgtaggaaatttgacagtgtcggcggcttcgtgagacatctgcggggactcatcgactttggtaacatggtggaaccctgctgggcagctgatatgtatgaccagatgtcgaaggtgctcgggtccaacaaattcgacctatga

SEQ ID NO: 9036 - RNA, 1191 nt, unidentified
  source 1..1191: mol_type = other RNA; note = synthetic construct
atgtggtcctcccagcactacaggatgaatgccaaagagcatggcctctctaaggagacaatcgacgccgcaattgcccagaccatcgccgtcgtcgaaggccctcataagctcccagccatactgaccctgggacatctggctctccgtactggtgtagactatgtggcattgcgtggcctgctgacaggaagctgttgccatcaataccggcatttcaagattagaaaacgcgtaaatggccccgagaagacgattagatatcgcaaaatcagcgtgccaaccccagatttatacagagtgcaacggtggatcgctgtccacgtgttacggtccgtgcctgtgcatggggcaagtcacgccttctctcccgggaatagtatcgtcaaatgtgcggagaagcactgtggagccaaatggatggtgaagctggacatcttggacttcttcggcagcatcagcgaaatgcaggcctacagggtgttccacagtctgggatatcaacccctggtatcttttgagatggctagattatgcacttacaggcccaagcacgacgtgcctccgaattttgtgctgccacggtatcagattccttccggccgcgtgaaaaagcgcaacagagttatcgaatcgtacaaccacccatacatggggattctaccgcagggtgcaccaacatctcccatgcttgctaatctcgccatgcgagatatcgatgaaaaaatcctgtccattgccaacaggttcggtctgcagtataccagatatagtgacgaccttaccttttcaacacgaaacgatttcgacagacagcaggcttctctcttgattcaggagattgctaacctactgataaagcgtggccttatgctgaataggcagaaaactgccattataccccctggagcgaggaagatcgtgctcgggctgctggttgatggggatcttccccggttgtcacgaccctttaaggatcgcatacggcaacacctttactatttggagaaattcggacctgaccagcacgttagcaagcgatgctttgatagcgttgggggtttctttcgccatctaaagggcctcatcgactttgctaacatgattgaaccacagtacgcgcgggagtcatacgtcaggctctgcgcagttgtctcagatgcacaaatcgaatcccctcagaaccagtga

SEQ ID NO: 9037 - RNA, 1146 nt, unidentified
  source 1..1146: mol_type = other RNA; note = synthetic construct
atgtggtcccctcagcattacagagagcgcggtaggcagctgggagcagatgatgacgtgattgaaagagccgctgccgccattgaatctttcattgacaagcacccaaaccgcccccctctgctcaccatcggacatttggcccgcaggtcaggcgtgagctggttccatctgcgtcaattcgtggaaggcagtaggagtgggatttacaggtacttccggattcgcaaacggagtgggggccaccgtcagatcagcgtcccagatcccaaacttatgatagtgcagcgatggatagcccggcatatactggcagcaatccccgttcaccgcgctagcttcgctttcgctcctcagtcatctatcgtaggttgcgcgagacagcattgccgggctaggtggctgatcaaactggacatttctggattttttggctccatctcagagatccaagtctacagggtgtttctgggggctggttatgcacccctggtagccttcgagcttgctaggctgtgtacccacgcgccatccggaagcaagcgatatgcaaaaaggacatggacagccgcactgaccgaacgtgcgattagaccctacacacagccccacattgggtatctgccgcaaggcgcccctactagtccaatgctctccaacttggtgatgcgcgagacagacaaacttgtcgcggctgtggctaccaaggccggagtgacatatacccgatacagcgatgatatgactttctcgaccatcggaagctttgatcgggaacgggccttggccgtcatacgggaagtcaccgccattctgagacgagctggcctctctgtgaatgagaagaagacgaagatcgtcccccctggcgcacgaaagcttgttttgggcctcttagttgacggggccgagccgagattaactcgcacgtttcgggacagactcaggcaacatctccactatttacagaaactaggacctgaggcccacagggcagctagagggttcgacactgtatcagggactcaccgccacgtgagaggcctgatcgactttgcgcagtctgtggacccagccctagccgagaagatgcgtgagaagtttgatgccgttgcatggtccctcgatcggccaggtgcagaatga

SEQ ID NO: 9038 - RNA, 1146 nt, unidentified
  source 1..1146: mol_type = other RNA; note = synthetic construct
atgtggtccccacaacattttcgggaaactggtcgacagcttggggccgatcatgacctcaccgagcgggcagccaccgctatcgagacatttaccgatcgtcacccaaccctaccccccatcctgacacttggccacctggcccatcgtactggcgtgtcctggttccagctccggttgattgtggagtcggggaggtggacaaactataccttcttccgaatcaggaagcgtagcggcggacataggcaaatcagcgttcccgacacaaagctgatgattgtgcagagatggatcgccggtcacatcctggcagccttacccgtgcacagagcctctttcgcatttgctcctaaatcctccattgtgggatgtgctgcacagcacactggtgctcggtggctgataaaattggacatcgctgggtttttcggcgcagtatctgagatccaggtttacagggtttttcttgatgctggctatgctccactggttgcctttgagctcgcgaggctatgcacacatgccccgagcggctcaaaacgctatggccgccaggagtggttagcccatgccacccaccgccctatatatgcataccgccacccccatattggatatttgcctcaaggggcccctacaagtcccatgttaagtaatctcgtgatgaggggtcctgaccgcaagatcgcaactctggctaccaaagccggactgacctacacccggtacagtgatgacataactttcagcactacaggggtgtttgatagagcgaaagcaatggccgtggtgagagagactactgccattctgagagctacgggactcgaagtgaacggacgcaagacccgcattgtcccacctggagccaggaaggtggttctggggcttctggtcgacggcaaggtcccacagctgacgcgagagttccgggatagagtccgacagcatctccactacctggaaaccagaggtccagaagctcacagggctgcgcggaacttcgacacggtagcagggctttacaggcacgtacggggcctgattgatttcgcgaattctgtcgacgcagtctttgccgatcgaatgttgacaaagttcgacgccgtgagatggtcactcgactcaccggaagatacatga

SEQ ID NO: 9039 - RNA, 1155 nt, unidentified
  source 1..1155: mol_type = other RNA; note = synthetic construct
atgtggtccccgcaacattaccacgaagcagggcagcagctcggccttgacgacgctatggtgcagagagccgctactgctatcgaggactttctagaccggcatcctaagttaccccccatcctcaccctgaaacatctcgcatctagaaccggtatctcttggtaccatctccggaagatggtgcttggcagccgggcaagtgattacaccttcttcaagatccgcaagcgatcgggtggacaccgtcagatttccgtgcccgatgcgaaactgatggccgttcaacggtggattgccgcgcacattctgagtgaactcccagtccaccgggcaagctttgcttttgcaccaaagtcttccataaggagatgtgccttacagcattgcggagctcgatggttgatcaaaatggacatttctgggttctttgggtctatctccgagcttaaggtgtatcgggtattcctggaggcaggctatagcccgctggttgccctggagctgactaggctctgcacacacgcccctagcggatcaaaacggtatgaccgccccgaatggttggcccacgcgacaaggcgaaagattcctgcctatcgccagtttcacatcggttatttgcctcaaggcgctccaacttccccaatgttgagcaacctggttatgagagagctggataaagaaattgcagctttagctgctagggccggcgtcacttacaccagatacagcgatgatatcacgtttagtacaaacggggattttgaccgcgccagagccatgctgctcgttcgacaggtgacagccaggctccgccgagtaggcctttccgtcaatggaaggaagacgtgtatcgtgccccccggagcccgtaaagtagtgctgggacttctggtggatggcgccgaacctaggctgacccgggagttccgcgaccacctacgtcagcatttgtactacttagagaaagtcggtccggaggcacaccgcgatgctagaaagttcgacaccgtctcaggcatgcacaggcatattagggggctgatagactatgcgaagtcaatagatgaggggttcgccgctaaaatgagactgaagttcgacagcgtgccatggagtcctgatgtggcaccaccctcagaagacgcctga

SEQ ID NO: 9040 - RNA, 1146 nt, unidentified
  source 1..1146: mol_type = other RNA; note = synthetic construct
atgtggtcgccccagcactacagggagataggcgagaaaagcggagccgaccccgtggtgactgacagagcagtcgcggccatcgacgcgtttatggagaagcagcctaagctgcccgctctgctgacattaggccacttggcccaacgtacaggcgtgagttggttccacctgcgccagtatgttgaaggacagagatccaccgaatacacctacttccacatacgaaaaaggagtggtggacacagacttatttccgtcccaggtcagcaactgatgatggtgcagcgctggatcgcagcacatattctcgccgagctgccagtgcatcgagcaagcttcgctttcgctcctaagtcttcaatcgtcaggtgtgccaagcagcattgcggggctagatggctgatcaagatggatatatccgggtttttcggctcaatcagcgagattcaggtctatcgggtgtttctccaggctgggtatgctcccctggtggccttcgaactcgcaaggctgtgcacccatgcccccaatggatcaaagaggtacgctcgggcagagtggttggcgcctactacctggcacccgattgttgcctataggcagccaatcctaggctatctccctcaaggagcgcctacctctccaatgcttagtaacctcgtaatgcgagatattgataagcagatcgctgcactcgccaacgctattgggttgacgtacacacggtactctgacgacattacatttagcactatgggtgaattcaacagagagagagccattcgggtggtaaggaagactacagccattttgcgacggataggactgaaagtaaacgacaataagaccagaatcatccccccgggtgcccgcaaacttgttctaggcctgttagtggatggcatcaaacccaaactgacgcggggctttcgtgatgggctgcgccaacacttatattaccttgaaaagcttggcccagaggctcacaggaaagcccgtaattttgacactgttaccgggctgtaccgccatgtccgggggatgatcgactatgccaaatctgtggacgagccattctttgatgaaatgcgcacaaagttcgaagccgtggcatggagcctcgattcccctgcagacgattga

SEQ ID NO: 9041 - RNA, 1149 nt, unidentified
  source 1..1149: mol_type = other RNA; note = synthetic construct
atgtggagcccccagcattaccgcgacaagggcattgagcaaggtcacgaagcagaactggtcagcagggccgcagccgctatagactccttcgtcgacgctcacccacagctgcccccgatcttgaccttgggccatctggcgagacggagcgatattagttattttcagttgcggcgactggccgaaggccctcgatggaatcactacacttttttccggatcagaaagcgctccgggggaagaaggctgatatctgttccagagcaccggctgatgattgtccaaaggtggatcgccgagcatgtgttgaagaaactgccagtgcatagggccagctcagccttcgcggatggtgcctctattgtgaaatgcgctaaacagcattgccgcgctagatggttaatcaagctagatatctctggctttttcggaagtatctccgagattcagatatatcgggtattcctcgccgccggatatgctccccttgtcgcgtttgagctggctcgtctgtgtacgcacgccccttccggttcagctcgatatgacagggcccagtggcgctctagagataactggcagctccccattatgcggtacagacagccacacattgggttcctcccgcaaggggcacctaccagcccaatgctaagtaacctcgttatggtgggaatggacaagctgcttgcagcactcgcaactgccgaaggattgacctacacaaggtactcagacgacatcactttttctaccacaggagcctacgaccgccagagagcgacagaagtgatcagaagtaccagcaggctcttacggaccatcggcctcaaagtcaatgatcaaaagacaagagttgtgccccctggcgctcggaaaattgtgcttgggctgctggtagataatcccgagcctcgactgtccagagactttcgcgaccgactgcgccagcacttacactatatagagaaattcggcccagaagcacatcgtgccgctcgtgggtttgatacggtgtcagggctttataggcacgtgcggggcctggttgatttcgcaaagtccgtggaccgcaactacgcctcggcaatgagggatcgtcttgatgctatcgcctggagccccgacttccctgtagagacttga

SEQ ID NO: 9042 - RNA, 1140 nt, unidentified
  source 1..1140: mol_type = other RNA; note = synthetic construct
atgtggagccctcagcgataccgggagttggggctggaaaaaggcgtagatcccgaagttgtggatcgatccgctgaggctataagtgactttctggactcctatgctacgctgccacctatcttgactcttggacacctcgctgcaagaaccggaattccttactacaagctccgcaaaatagtggtaggacagcggacattagaataccagtacttctggattagaaagaggagtggtgggaggagacttatctccgtgcccgagcctgacttgatgcacattcaacgctggatcgccggccaccttttagcccggcaacccgtgcatcgtgcatccgcagccttccgcccaaaggcgagtattagcaaatgtgcccggcagcactgtgaggccaggtggttgatcaagctcgatatctctggctttttcggctcaatttccgagatccaggtctacagagtcttccgaaggatggggtacgcgcccctagtcgcgttcgagctggctagactctgcactcatgcacccgcaaactcaaaacgttatcagcaagacagcaagtggctggttcggaagtgcgagtctaggaaattctacacccagtggggaataggctatctgccccagggtgccccgagttctccaatgctgtcaaaccttatcatggtggaggctgataagaagatcgcaaagctcgccacaaaccagggactgacatatacaaggtatagcgacgacattacttttagcaccaccagggggtatgatagggaacgcgccaaaaaaatcgtccgggacacaaccgcgattctgcggcgaatgggcctggcagtcaatgataaaaagacgagaattataccaccgggtggccgcaagattgtgctgggactacttgtggatgggtcgcatcctaaattaactcgtgatttcagagacaggctgcgccagcacctgtattacctgcaaaagtttggcccagaagctcaccagctcgaaagaggcttcgacaccgtttctgggctctatcgacatgtgcggggtctgatcgattttgctaagagcatcgacgccaattacgccgcccgcgtgcagaagaaatttgaggccatcaaatggtctttggatttttcagactga

SEQ ID NO: 9043 - RNA, 1131 nt, unidentified
  source 1..1131: mol_type = other RNA; note = synthetic construct
atgtggtcccctcagcgctacatcgaacacggcctgaccgagggctatgacgcagaactggttagaagcgcggccggtcagatagacgattttttggaaaagcaccccgatctaccaccgatcttaactctcggccacttaggaaaacggacctccctcccatatgcccggttgcgtaagctggtgtcaggactgcgatctaatgattacagctactttagaatcaggaagcggagtgggggtcaccgccagatttctgtccctgaagccgacttgatgtggctgcaaaggtgggtgtcagctcatatactttccaagctgaaacctcatagagcaagctatgcattcgctcccaaggccagtatcgtctcatgtgcgaaagcccactgcgaggccaggtggttaattaagcttgatatttctgggttcttcggctctgtgtcagagattcaagtgtacagagtctttctggccgctggatacgcccctatggtggcttttcagttggctcggctgactacccacgcaccttatttcagtatgaggtacaaacgtcccgagtggcgcgcagttccggatagggctcggttaccctacttgtttagaacacgtctgttgggatttctaccacaaggagccccttcctctccaatgctctccaacctcgtgatgaggcagatcgatgccaaactgcacgccatcgcgctgagtgctggactgacatatactaggtattccgacgatattaccttcagcacaagagggggtttcgacagagaacgcgcacgagcagttgtgagcaagacgcggcgcattctagccaaggaggggttcaccctgaacagcaaaaagacgaggatagtgcccccaggcgggcggaaactcgtacttggcctgctcgtcgatggcagtgagccaaaccttacccgcgccttcaaggactccctgagacagcatctccattacgtctgcacttttggccccgacgcgcatgccaaacgacgaggtttcgacacagtttcgagcctttaccgccacctgcttgggctcatcaattatgcaaaaagcgtggacgaggactacgctctgcgggctaggacaaagctcaattctgtacagtggtcactgtga

SEQ ID NO: 9044 - RNA, 1032 nt, unidentified
  source 1..1032: mol_type = other RNA; note = synthetic construct
atgaggctcgccagcgccctgccgctttttacctacggagaggtgaaggtgactatgagctggtcctcacagcattatatcacaaagggcctggcctctggcagagatagggagttgctggagactgcagcgaaagaaatagagcgggcagtctactcgaacccgactccactcccagccgtcataacacttaatcacttggctaggcgctgcggtgtgtcatataactctcttagagccatcgtcgcacgcaatggcaaacagtacagctacttccgaatacgcaaaaggtctggaggacatagactgataagcgtgcccgaggctgaattgttgcgggtgcagaaatggatccacacatacatcctgagccaggcaaaagcccacgaggcgtgtttttccttcctgcgtaagaagagtatccgggattgcgccgctgttcacagaggggctacgtgggtcatcaagattgacatttctgccttcttcggcagtatcagtgaacgagatgcctttgatattttcaagggttttgggtacaatccccttgtggcttttgagatggcacgcattgtaaccgacgccccactatatagtaagagataccaagccgtgccctggaaacgcgatcctggggagtatgaaattgcacaatatcggtccgctaaggtcgggtatctgccccagggagcacctactagccccctgctctcaaatctgttcatgatcaacatcgaccagcaactgcaggccctcgcagagcacaggaaactcagatactccagatattctgacgatatgacgttttccacccggggtgacttctcccgggaacgagctaaagaactaattcatgctgtggcggccatcattagggttaagggcttacgtattaacaccgctaagacaagaatcattccacctgacgggcgcaaggttgtgctgggattactcgtagacggcaccgcgcctcgtctgtcacgaaagctgcgggacaacttaaggatgcatatcttccacatgaggaaatga

SEQ ID NO: 9045 - RNA, 1140 nt, unidentified
  source 1..1140: mol_type = other RNA; note = synthetic construct
atggcctggagctcccagagatacatatcagccgggctaaagttggggttttcccctgacgtactcaacatcgcttctgagcaacttgaacaacacatcactggactgcctcccttcccagcgttgctcactctcaaccatctggctaagcggaccaacgtgccttacttggagctacggcctctggtcaggggccaaaagccagacgcctaccaccacttctatatccggaagaaatccggaggacaccgccgcatttccgtcccagaacccacactgatgcggatacagcagtggatcgcgacacacattcttaatattgcccctgttcatcaggccagttatgcttttagccccggaagcagcatctacaagtgcgcatatcagcatcggaaagcaagatggctcatcaaaatggatgtcactgggttctttggtagtatctctgaaatccaggtgtatcgagtgttccgcagtttcgggtaccagcctctcatcgcatttgagcttgctcgactcacaacatatgctcccatctcctcaccaaggtaccttctgaaggaatggcaggccaggactcactctagcccaatagatgactatcatcgggccaatattggctatctgccgcaaggtgctccgacctcgcccatgttatcaaatttagttatgcgctcagtggacgagcgtattgccaagattgccgagaagtacgggttgcgatacaccaggtacagtgatgatataaccttcagcacgactgcagagttcgacagaaagagggctagagatgtgattcgcagcgtgacgaaaatgctgacccgagtaggcctgcacgtcaacgcgggcaaaacagtggttgtgcccccaggaggcagaaaggtcgttcttggattactggtggacggtcccgaaccaaaactgtctcgtgatttccggtccaatctgcgccagcacatctttttcctcgagtcgttggggccgatggagcatgcaaaagcccgtggctttgaaaccatctctggcatgtataggcatattagaggcctgattgactttgccaatatggtggatgcagactacgccgcagagctgctgtctaggttccagagagtaaactggccttttgctataccctga

SEQ ID NO: 9046 - RNA, 1152 nt, unidentified
  source 1..1152: mol_type = other RNA; note = synthetic construct
atgtggtcatctcatatttataaaaagcaggggctaaccaaaggaatctctccatacctgttgacggaggctattacccagattgagttactggtttacagccagaataacctcccttctatcctttctctctcccatctggctaagagaacaggcgttgaatataagctgctccggtgctacgtgatgcggacaggggccacttccgtggagccttttgaaatctacaagaagttcagcatccgtaaaaggagcggcaataggcgctttattcacatccctacaccaaagctaatgcggactcagcgatggatttctgagcatatactggctaagctccctgtacacgccgccagccaagcctttaacaaaggtaactccatcaaaaaatgcgcatcgcgccactgcggagcgaaatggctaatcaagatcgacatagaggatttcttcagtagcatttccgagattcaggtgtatcgattcttcagatcactgaattatcaacctcttgtggcatttgaattggctcgcctctgtacagttggcacccacaacaagtccccccgcggagtctttagcaattggaaaatcattaaccccaacaatgccatcccttcctacaaccaaaaactgctcgggtatttgccacagggagcgcccacatcgccacttctggctaatctgataatgaatgactgtgacaaagctctgcaaacaatcgcgagaaagaacgatttgatctacacgaggtattcagatgacctgaccttcagcactaccgacaaaaaatttgataggagtaaggctaagaccttcatcttcgacgcatacaagattctgagtaagcacggtttcagaccccagtttcggaagaccactatagtcccacccgggtctaagaaaatcgtgttaggcctgaacgtcgacagtgaacagccgcggctggccaaacacactcgtgattccataagacagcacctttactacttagaaaaaatggatccagtgcagcatgcatttaatcgacagtttgattcagtatggggtcttaagatgcatctcaggggcctgattgactatgccaatatggtcgagcccgacttcgccaaggcatgtttggccaagttcaacgccattgagtggccggtgtga

SEQ ID NO: 9047 - RNA, 1152 nt, unidentified
  source 1..1152: mol_type = other RNA; note = synthetic construct
atgtggagttcgcagtcatataagaagcagggcttggccaacggtctgtccgtgccactgcttaatgaggccatagcacagtcagagcttctgctctactctgaatacactttgccctctatccttagcctgaagcatctggctaaacgcacgagtgttgagtacgagtggctacgatcctttgtcatccgtacagctataaatggtgtcgagaacttcgagatctacaaaaagttctccatcaggaaacgcagtggcgggcggaggttcattcacgtgcccagccccaagctgatgcacacgcaaagatggatctctgaacacatcctgaaggcactacccgtgcatccagcttcccacgctttccggaaagggaattcaattaaaaaatgtgctctcaggcattgtggagccaaatggttaatcaagattgacatcgcagacttcttctcgtcagtgtccgaaattcaggtgtatcggatctttcgttcactgaattatcaacctctcgtcgcctttgaactcacacgactgtgcacagtcggcacccctggtttgtccccacgagctaatttcccgcactggaagaccaaggaatttaacgaagcaataccactctaccaccagacaatgctcgggtacctgccccaaggagcacctacctctccatttttagccaatctggttatgaagaactgcgataagtctctcaacgcactggcccagaaaaacgggctcgtgtatactcggtatagtgacgatctgagctttagtaccagagacaaagatttcggcaggagcagagcgaaacactttgttttcgaggcctacaaaattatctctcaaagcggcttccgcccccagttcagaaagactaccattgtgcctcccgggggaaagaagataatccttggactaaatgttgaatccgagtttcctcgcttagctaagagcaccagagatactattcggcagcacctgtacttcttggagaaagtcggacctgtgcagcatgcctttaaccgcaagtttgacagcgtatggggccttaagtcccatgtgaggggcttgatcgattatgcgaacatgattgaaccggacttcgccgaggtgagcctggagaaatttcaggccattgagtggccagtatga

SEQ ID NO: 9048 - RNA, 1152 nt, unidentified
  source 1..1152: mol_type = other RNA; note = synthetic construct
atgtggtcttcacagacctataaacagcagggattggccaaggggttgtctgaatcgctactgactcaggccatctcccagagcgagctgttaatctacagcgagtacaatactccgagtatcctctctctgaaccacctggcaaagcggacaggtatagagtatgagtggctgcgctcttttgtcatgcgtaaggcaattaagggagtggaaaacttcgagttctacaacaagttctccatcagaaaaagatcaggcgggcggcggtttattcacgtgcctacaccaaagcttatgcgaacacagaggtggattaatgaacatatccttgcgaaactgcctgttcaccctgcctcccaggccttcaggaaggggaactcaataaaaaagtgcgccctgaggcattgtggcgctaagtggattatcaagattgacatcgcggatttctttagcagcgtctccgagatccaggtgtatcgaatttttcgcactctcggataccagcccttggtggcattcgaactggccagactctgcacgatcgatacgtattgcgaatctcccaggagaatctttccccagtggagaagcaagaaatccaacaaggctatacctagttacgatcaggagctccttggttatcttccacaaggggcgcctacatcccctaccttggccaatctgataatgaaggattgtgacaccgccctgcagacacttgctcgcaataatggattaatttatacccggtacagtgacgatctcgtgttttctaccaaggacaagaactttggccggtaccgcgctaaacaattcattttcgagtcctacaagattatcagcaaggcaggcttccgcccccaattaaggaaaactactattgtgccccccggcagcaaaaagatagtcctgggattgaatgttgagtcggaagtgccgagactaatgaaatgtaccagggataaaattcggcaacatctgtttttcctggaaaaagtaggtccagtacaacacgcttttaatcgacagtttgacagtgtgtgggggctcaaaatgtacgtccgtggcctgatcgactatgccaacatgatcgagccagaattctcaaaagcttgcctcgagaaattcaacgcaatcgagtggccagtttga

SEQ ID NO: 9049 - RNA, 1362 nt, unidentified
  source 1..1362: mol_type = other RNA; note = synthetic construct
atgacttccgcgagtgaaaggttcaagtttgcaccaagcggcgctaaagaggaccgctacactaccgtcagatggatgctgggctatggttttaggggtctgacagaaaagcctacccatggatggcggaggcgtacactaccgcacccagcatacgcaagcggccaccaaagtgctccctctcccgctgctacccaccggtcatccttcatgtggtcttctcagtcatataagaaccaggggctcgctaaaggggttagtgagactctgctggataatgccattgtacaatccgagttactcatctacagtgaactttcactgccttcaattctttcccttaatcatctggccaagaggacctgcgtagagtacgagtggctgcgggggtttgtgatgcgcagggctatgaacggtgtggaggacttcgaatcctacaaaaagttttctatccgtaaacgcagcggaggaagacgcttcatccacgtgcctacaccgaagcttatgcatacgcagcgatggataaatgagcatattctgaagggggtgcctgtgcatcctgcatctcaggccttcggaaagggcagttctataaagaaatgtgccagtcgacattgcggtgcgaagtggttgattaagatcgacatagccgacttctttagcagcgtttcggagatccaggtctttcggatcttcaggtcgttcggctaccagccgctcgtagccttcgagctggctcgtttgtgcaccgtcggaacctattgggaaagcccccgaggatctctccctcagtggaaaacacggcaccccaataaatccatcccactgtatgatcaaaagattttagggtacctacctcagggcgccccaacgagccctttactcgccaatctggccatgaaggactgtgaccgagctcttcaagcactcgctcacaaaaacgggctggcctacacacgctattcagacgatctgtcctttagcactaaggataagggcttttccagatcccagagcagggagtttgtctgtgatgcatatgcgatcctaagccgctcaggcttcagaccaaacctgagaaaaaccaccgtggtccccccaggatcccggaaaatagtgctcggcttgaatgtggaaactgagcaccccagattgacaaagtctatcagagatcggatccgccagcacctgcactttctcaaaaaagttggtcccgtggaacacgcattcaacagagaattcgattcagtgtgggggcttaaggcgcatctgaggggcttgattgactttgccaacatgattgagccagattttgccgaggccagtctgaaagaattcgacagcgtggaatggcccgtttga

SEQ ID NO: 9050 - RNA, 933 nt, unidentified
  source 1..933: mol_type = other RNA; note = synthetic construct
atgcacacccaaaggtggataaacgagcatatcctgaaagatgtgcccgtgcaccctgcctctcaggcctttggcaaaggaaacagtatcaagaagtgcgccagcagacactgcggtgccaaatggctaataaagattgatatcgcagacttcttctctagcgtatccgagattcaggtgtttcgggtttttaggtcactggggtaccaacctctggttgcatttgagctggctaggctctgtaccgtagaaacctactggaaaagtcccaggggatccttaccacaatggcgggcacggagatttaatgggagcatccctagctatcatcaggagatccttggatatcttccgcagggcgctcctacatccccactgctcgccaatctggcaatgaaggactgtgacaaaagcttgcagacactggcccagaagaacgggttggcttataccagatattcggacgatctcagtttctcaacgaaagataaaaacttcgaccgcacacagagccggaagttcgtttgcgacgtgtacagtgtcctgtctcgctcaggattccggccgaacctgcgcaagacgactatcgtccctcccggctctcgaaaaattgtgctgggccttaatgtcgaaactgaacatccacgtttaaccaagaatgcccgagatcgcattaggcaacatttgcactttctaaagaaggtgggtcccgtcgaacatgccttcaacagagagttcgattcagtctggggcctgaaggctcacctcagggggctcatagactttgccaatatgattgagccagacttcgctgcagcgccctcccgaaattttactcttttgtccggtcgttgtcgccacgcggctgtgctctgcgaaagacacttccaggcgatgaaatctaccactgtgcacacaatccagtactggtga

SEQ ID NO: 9051 - RNA, 1155 nt, unidentified
  source 1..1155: mol_type = other RNA; note = synthetic construct
atgtggagcagccacacatacgagctggaggccattgagctcggacgacccagggaaacaatcgacgcctcaattgagcagatcgagaacttaaatgagacaaaccctcccgcccctgccatcctgaccctgaatcatctagccaaacgcactggcgttggctatgaatggttacgtgcttttgtaatgcggcagctcatgcccggaatggatggcgacgccaggccgtatcggaaattctctatccgcaaacggtccggggggtacagaacaatccacatacctgagccaaagctaatgcatacccagaggtggataaattaccacatccttagagaagtttcccctcatagcgcatctcaagcctttacgaacggctgcagcattaagaaatgtgcgattaagcactgcggggctcagtggatgattaaaattgacctggaagacttcttcggatctgtcactgagatccaagtctatcgcgtgtttaggagtctgggctatcaggcgctcgtcagtttcgagttggcgcgcctgtgtactattacaccaggagacaggtcactgagaagccgtcacccacactggagagtgtggaagcctaacaaggaaatcccaacctactcgaagaaatacttggggtttctgccccagggtgccccaacgtcaccacgactcgctaaccttgttatgcgccggtgtgatcaggagatacagaagttagccaaatcctatggtctgaccttcacccggtactcagatgacttgtgcttctctaccagaactaaaaagtttaatcgacatgcagcttccaaattcatcggcgaagcatacatggtcctggccaaatatgggtaccaacccaacctgcgcaagacctccgtagtgcctccgggtgctaagaaggttgtgctcggcttgactgtggatgggcaggaacccaagatcagcaaggaagtgagagacaagattcggcaacatctctactaccttgcaaaagtcggcgctgctgaacatgcacacagaaggggttttgatagtgtgtggggactcaagtgccacctgaggggactgatcgactttgcacacatgatagatgaggatcttgcccagagttatattaaaaagttcaatgaggtggactggcccgtgtga

SEQ ID NO: 9052 - RNA, 1134 nt, unidentified
  source 1..1134: mol_type = other RNA; note = synthetic construct
atgtggctgccccagacctacattaaagaagcgaaaagcaagggacttgacagccagacgatagacgctgccgttgaccaagtggatacagtccttcgcaaggccgaaaacatcccgtctctgctcactctgaatcacctggccactcgggtgggggtgaacgttaaggaactcagacagtttgtcgatcgcaccgacctggacgcataccaacgtttctcaatcagaaagagaaggggaggcagacgatttattagtatcccggcacctcagctgatgaggacgcagcggtggatcaacgagttcattttaaagcctctccctgtgcatgggtcttcacacgcatttgagcgtcattcctctatcgtgaaagctgcctcagtgcactgtggagcccgatggctgataaaaatagatgtggaggacttcttcggatccattagcgaaatccaggtcttccggcttttccgctctctggagtaccaacccttggtgtccttcgagctcgctaggctctgcacaataggcaccagccctcatagtccaaggaaagaatatccaaactggagagtacacaagcgaaacaaaattatccaggggtattctcagcagctgttaggctacttgcctcaaggggccccttccagtcccaggctctcaaacctaattatgaaaccactggatgaggctctctatctagaggcaaagcagaagggcttgtactatacccgctatagtgatgatttgtgctttagctatcacaataccgacttcaatcgaagaaatgctacagagcttgtctccgcagtatacaggatcctgagttcagccggatacagacccaatatgcggaagactacagttgtcccgccaggttctaaaaagatcgtactgggtctgaacatcgagaatgatcagccccgcttaagcaagcccttttgtgacaaagtggatcagcacttgtactatattaagaaatacggccccgtggaacacagccatcgcaggaaattcgactccgtgtggggtatgaagagccatatccggggctccattgactttgcgaagatggttgagccagagcgttcggccgtttggctggaagattttaatcgggtggaatggccagtctga

SEQ ID NO: 9053 - RNA, 1152 nt, unidentified
  source 1..1152: mol_type = other RNA; note = synthetic construct
atgtggagcagccacaggtacagactcgaagctcggcagaagaatctgccggaatccgttgtgcaggccgcaattgcccaaagcgagaaactcctaacagccgaccctagcctcccatctattctcagcttaaaacatctagcagtgcgctgcgacgttccctactccgatcttcgcgagtttgctagcagaaggcccatcgacggaaatcagccaagtcttccctaccaaaacttttctatacgcaagcgctcaggggggcgccgtttcatccacgtgccgaatcccaagttaatggtggtacagaggtggataaacaaccatatactccaagaagtgaagccacaccgtgcttctcacgcgtttacgcgtaatagttcgatcaagaaatgtgctcagattcactgcggctccgcctggctggtgaagctcgacattgcggacttctttgaatccgtgtctgagattcaggtgtttagagtgttttccggtatgggctattccccgttggtagccttcgagctcgcacggatctgcacaatcaggacacctacacattctcctcgacagtatttcaagcagtgggtcgtgaggaacatcaaccatactatttacgcctacaatgatcggtacttaggctatttgccccagggtgcccctacctctccccttctggcgaatctggttatgcgacaatgtgacaaagaactgagtgaaattgcagctacttttgggatgcgatacaccagatatagcgacgatgtcactttctcaagtctggatcctgctctgggccgggatgcctgtcgaaagctgatcttcgaggcctatgctgtcctgagttcagccggctacagacctaacgctaggaaatccaccattgtacctccatcagcccggaaattggtcttgggccttaccatagacggtgccgagccagggctgaccaaggagttcaaggatagattgagacagcacctgtattttctggagaaactgggagcaatcgatcacgctttcaaccgcaagttcgattcagtgtggggaatgaaagcacatatcaagggactgattgacttcgcaaaaatgatcgagcccaactatgcggccgtctgccgggaaaggtttaatcttatcgactggccagtttga

SEQ ID NO: 9054 - RNA, 1152 nt, unidentified
  source 1..1152: mol_type = other RNA; note = synthetic construct
atgtggagtagccataggtatcggctcgaagcacgagaaaaacagctgtcagagactgtgatccaagccgctattctacaatccgaaaaattaatcacagctgaccccgctctgcctagcatcctatctttgaaccatctgtctgtcaggtgtggcatcccctactgggagctgcgggagttcgtgagtcgtagatcaatcgataagaacgaaccatcaatgccatacgagaacttttcaataaggaagcggtccggcggacgccggtttatacatgttcccaacaggcagctcatggctgtgcagcgatggatcaacaatcatatactgcaggacgtgaaaccccacattgccagccacgcatttagtcgaaagtccagcatcaaaaagtgcgcacaagtgcactgcggatccgcatggttgatcaaactggacatcagtgacttcttcgagagcgtgtctgagatccaggtgttcagagcttttcaggggatgggatacaccccactggtcgcctttgagcttgccaggatttgtaccattagaactcccgctcatagcccgaggcagcacttcaagcaatggttggtcaaaaaggcgaaccacacgatttacgcctataatgaccgttatctgggttacttgccacagggggcacccacatcccctctgcttgccaatctcgtcatgcgccagtgcgacaaggaattatctgaggttgcggcaagatttgggatgaaatatacacgctactccgatgatctcacattttcttcgcacgatccgaccctgggccgtgatccttgtagagaactcatcttcgaggcctatagcgtgctgagtagaccagggtaccgccctaatgcccgcaagtcaaccattgttcctccctccgctcgcaaactggtacctggcttgaccgtagacggcgccgagccaggactgactaaagaattcaaggaccgacttagacagcacctctacttcctggagaaactcggcccagtggatcatgccttcaatcggaagtttgactctgtctggggtatgaaggcgcacattaagggtcttattgatttcgccaaaatgatagagcctaagtatgcagctttatgcagggaacggtttcagaagattgattggcccgtttga

SEQ ID NO: 9055 - RNA, 1152 nt, unidentified
  source 1..1152: mol_type = other RNA; note = synthetic construct
atgtggagttcccatctgtacagagtcgatgctcggaagaagggactgtctgaggcgactatcgaggccgcaatctcccagtctgaaaaagttatcaacgccgatccatcactgccctcgatcctctccctgaagcatctggctagcaggtgcggagtgccgtacagcgaacttcgtgagttcgtctctagaagggccatgttcacaatagcaccctcgatgccatacaataaattctccattcagaagcggtctggaggccgccgattcatttacgtacccaaccgcagtttgatgaccgtgcagaggtggattaacacccatatacttgcccagatttcaccacacggtgcatcccacgcttttacgaagcggagtagcatcaagagatgtgctctcgtccactgtgggtctgcctggttggtaaaactcgacatcagcgacttctttgaaagcgtgagcgagattcaagtgtatcgttccttcaagtcaatgggctatacacccctagtggcctttgagcttgctcgcatttgcacaatccgcactcctcgtcattcacctcgggagcgatacgggcaatggcgcattcgggagctgaacgaggaaatatatgcctataacgagcatcttttggggtacttacctcagggcgccccgtcatctccattgctgtctaatattgttatgcgggattgcgatatgctgctaagccagatcgctgcaaaattcggcatgaaatacaccaggtatagtgacgatctcacatttagctccctcgaccctcaattcggccgagaggcgtgtagaaatctgatatttgaagcctatgctatcctgtccaaggccgggtacagacctaatgcaaggaagtgcactgtcgtgccacccagtggcaagaaaatagtcctgggcttacagattgatgggaccgagcctcgactgaccaaggactttaaagacaggatcaggcagcacctgtatttcttagaaaaatttggtcccctgaatcacgccttcgaaagaaaattcgacagcgtttggggaatgaaagcacacattaagggactcatcgattttgctaagatggtggaacccggttacgcggagatctgtcgccggagatttaacctcatcgactggccagtgtga

SEQ ID NO: 9056 - RNA, 1272 nt, unidentified
  source 1..1272: mol_type = other RNA; note = synthetic construct
atgtggtgggaagccggggtacccgtgctgtttgggaaggccctagccgagcgagaacacagccattctggtaatgtgccttccttggccagggtggctcgagcaactgttaggtccgggctcattggcgtcattgtgatgtggagtcccttgtcttataaaagaaaaggattggagatcggcatcgcagaggagctactcgactcagcaatcgaacagaccgagaatgtcatcgaggaaaaccccgatctgccatcaattctcacactgaaccatctgtcaacccgtacaaagacaagtctggagacattaaaggcctacatatctcgtgatgaaccggatgcataccggaaatttagcatagccaagcgctccggtggccgaaggtttatcagagttcctgcacctcaattagctcacgtccagaaatggatacatcaccacattctctcccatatttccccccacagagcgagctatggtttccggaagcggacttcgattaaggactgcgctcgtaaacactgcggagccagatggcttatcaagttggacatcgttaacttcttcgaaacgatttctgaaatccaggtgttcagcgtctttcaaaaactgggttaccagcctctcgtggccttcgaactggcgagactgtgtaccgtgagctcagatgagtactccccacgccgcaattacggaaactggtgggccttcaagtcttacaaggtgatcaggaattacgagcagaagctgttggggtatctgccccagggcgcctcgagttccccaatgcttagtaacctggttatgtggaagtgcgacgaacagattagtaagattgcgaaaaaaaacgggatgaaatacagcagatattccgacgacatagctttaagcacttctagcaaggactttaatagagctctcgctaaacaggtgatccaggaggtcaatcgggtgctttcacagtatggctacctgcctcacttcaaaaaatgtaaggtagtgccccctggcgcaaggaaggtcatcttgggccttaacgtggatggagccgttccagtcctgcaaagggaaaccaaagatcgcatacgccaacatctgtactttctgaagaagcacggacccgtggaacacgctctcgctcgagggttcgatagcgtatggggactacagtctcatctccgcggccttatcgactatgccaaggccattgagccggagtatgctgcaaaaaggctgcgggagttccgggagatcgactggccattttga

SEQ ID NO: 9057 - RNA, 1134 nt, unidentified
  source 1..1134: mol_type = other RNA; note = synthetic construct
atgtggtcaccgcagctctatctaaagttgggaattcaggagggtcatagcacagagttactggaaagagcaatttctcagtccgatgctgttatcaactctgaatactccttaccaagtatactgagcctgaaacacttggccgtccgaaccggggtgagctacgagtctctcaggtcgattgttagtcggtccgctccaaaaacctacaataagttcagtattcgcaagcgatccgggggacgacgctacatacacgtgccaagccttgagctcatgcacgcccaacgctggataaacgaacacatcctgaagaagatcaaagtgcaccccagttcacatgcgttcatcgaagggagctccatccaaaaatgtgcctccaaacattgcggcgcaaagtggctgatcaagcttgatatcaccgatttcttcgagagtatctccgagatacagatctttaggtcgttcaaggagctgggatatcagccccttgtttcttttgagctggctaggttatgcacggtgcccacacaccacaagtcacaacgcagacattatattcagtggaggtcttggtaccggaatgagtcaattacagactacaataagtctctgatcgggtatctacctcagggtgcccctacttctccactcctgtcaaacatcgtgatgagaaaaaacgacgaagagcttaagaaactcgctcacaaattcaaattgacgtatactcgttactccgacgacctttcattttctactaggagcaaaaatttcgacagatataaggccaaagagctggtgtttgaagtatacaggattctctcaaaaagcggatacctgccccaatacagaaagaccaaggtcattagtcctagcagcaagaaggtaatcttgggcctcaacgtcgacggcgatacaccccgtctgcagaaggaatttaaagaccgcctgcggcagcatttctattacatcaagaagctaggcctggacgaacatatcatcaatcgggagtttgattccgtgtggggcttcaagagccacctgcggggtatgattgattatgcaaacatgattgagccggaatatgccaaaaagcagttggaaacctttaaatccatagattggcctatttga

SEQ ID NO: 9058 - RNA, 1125 nt, unidentified
  source 1..1125: mol_type = other RNA; note = synthetic construct
atgtggagcccccagtcgtacaagaaaatcgggtctgagaaaggattatcagacgaactgttagaaaccgcaatcacacagtccaaggcagtcttctgtaatattccttcaattctcagtctgaggcaccttgcttgccgtaccggaatcagctacagaaagctgaggtgtttcgtagaacggtccagctatgtgccatataagaagttcagtatcaaaaagcggtctggcgggagaagatttatccacgttcccgatcccgaccttatgcatgtgcaacgatggtttaacgaatacgtttttaagctggttcctgtgcacccctcttcctacgccttcactaccggctcatccattaagaagtgtgctgcagaacattgcggcgcccagtggctgatcaaactggacatcacagactttttcgagtccgtaagcgagatacaagtgttccgcctattcaagggcctgggatatcaacccctcgtcagcttcgagatggcacgcctttgcacagtcttgatcctggataagagccctagaactcactacagtcagtggcacgttcggaaagagaataaaatcattccgcagtacaaccagaagatgctcggttacttgcctcaaggggccgcctccagtccattgataagtaatctggtgatgaaagagtgcgacgagaagttgactaacattgccaataggtacaagctaagctatacgcgatattctgacgatctcagcttctctacacgctcgaagaacttttgtcggtcaaaggctaaagacgtgattttcgaggtgtatgaggtcctctctaaagccggatatagacctcagctgcgtaaaaccaagatcatctcaccaagctcaaagaaaattatcctcggcctgaatgtggatggcgcggaaccgctgctccagaaggagtataaagataagattaggcagcacttatactacatagaaaaacttggtgtggcgaagcatgtggaaaaaaggggttttgactccatctgggggtttaaatctcatctgcgcgggatgattgattacgccaacatgattgaggaggactatgctaagaaatgcctggatcggttttccaacatagattggccagtctga

SEQ ID NO: 9059 - RNA, 1131 nt, unidentified
  source 1..1131: mol_type = other RNA; note = synthetic construct
atgtggagccctcacaactacaaagagcaagggttagagaaagggctctccgacgaacttctggaaagagccataagccagagcgaagatgtgatcgagcgaaaccacgatctcccatccattctcagtttaaaacatctgagcgtgcggacctgcacttctcaccagaaactcactcgcttcgtcgcccgcgaagaattttcatatgagaagttctccatcaagaagagatctgggggcaggcgttttatttacatacctgaacccacactactacatgtccagcggtggataaacgagtttatccttaagcccattcccgttcaccaggcctcttttgctttcaatccgggttctagtatacggaaatgtgcagcgaaacattgcggagccaagtggctgattaagctggatataactgacttcttcgagtcgattagcgaaattcaagtataccggctgtttagagaattcggataccagcctctggttgccttccagcttgcccgcatctgtacaatcgcgacaccagagatgtcacctaggcggaagttcaacaattggaaggtgaggcgaaagaataaaaatattccccgatacaaccaacgtattttgggctatcttccccaggggggcgctacctcccctatcatctcaaatttggtgatgcgcgaactggattcggagttttccaagatcgcacgcaagtaccgattggtgtacaccaggtacagcgacgacatcaccttctctacgcgggcaaatacctttgagagagacagcggcagaaggctgattacggaggtgtataacctcctgaacctgagtggctacaagccccagtatagaaagactaaaatcgtcccgccatcagcaaagaagattgtgttgggactgaacgtggatggtagggctccaagactgcagaaagagttcaaagacaatatccgtcaacacttttattacgttgagacactgggtctgagtgagcacattgtgaatcggggatttgactccgtttggggctttaaatgccatctcaaagggttaatcgattatgctaactctatcgaaccagagtatgcccgcaagctcgtcgtaaggttcaacaatatcgactggcctgtctga

SEQ ID NO: 9060 - RNA, 1134 nt, unidentified
  source 1..1134: mol_type = other RNA; note = synthetic construct
atgtggagtccgcatcagtacagagccgccgcgaaggaaaaaggactgtctgatgctacaattgaggctgccattgatcaaatcgaaaccgtagaacagggaacacctgaactgcccgctattcttagtctcaaccacttggccactcgagcacgtgtaccctaccagtaccttaggtcagtcgttagcagaagtgagccctcaacctatcgcaagttctccatcaataagcgctcaggcggaaggcgatttattcacgttcctgagcccccactcgcgcacgtccaaaagtggatcaatcgcttcatcttacgtcaggtgcccgtgcataaggcttctttcgcctttgctcccgggagctccataagcggttgcgctgcacgacactgtggggcacactggttgataaagatggacatcacagggtttttcgagagcgtgtccgagattcaggcctatcgctgctttgaagaactgggttaccagccgctggtggccttcgaactcgcaaggattgtcacagttgggccactagaccagagcccaaggcaccgcgatccagtgtggaaagtcagagagcctaacgcggccattccctcttatagttcaggcgcattgggctacctgcctcagggtgctccaacttcgcccatgttgtctaatatcgtgatgaaaccggttgacgaggagattgccgccgctgcgagaaaagccggcctcatatacacgaggtattccgacgacctcactttttccacgcctgccaaggagttcggacggtctgctgcgaccgattttgtgcatactgtggggcagatccttgcagccgccggctttcggccacaacatcggaaaaccaagatcatcccacccggtagcagaaagatagtactaggacttaacgtggaaggaaccgcccctaagctgagaaaggagtttaaagacaatctgcggctgcacctgcattacctggataaattcggcccagctgagcatgcaaaagcccggcagttcgaaaccatctgggggatgaaagcacacatcaggggcttaattgatttcgctaacatggtggaacctgtctatgcaaagggcatgctggaccagtatgagcaaatcgagtggcctttctga

SEQ ID NO: 9061 - RNA, 1143 nt, unidentified
  source 1..1143: mol_type = other RNA; note = synthetic construct
atgtggagctcccagcgctacctttccgagggcaaaaagaacggagcagcccaattggtgattgacaatgctatcagccaaattgaattagtcctggatcagaataacaatatccccgccatcttgagtctgaagcatttttcactgaggtcccacgtcgggtataaattcctgcggtctgtggtagagagggaggaggaagatgacaagcagggcgtgcaggtatatagatacttcaacatccggaagaaaagcgggggaacaagaaccatttctatcccacacccacaactcctcatcgcgcagaaatggctggctaccaatgttctgtccaaactctcagcctcaaactatagctttgccttttccccaggcagcaacattgtggcctgcgcaaagaagcacgtagaggcaaattggcttgttaagatggacgtgaaggacttcttcggttcgatcagtgaaatcgacgtctaccggcaattcaggaagctgaaatatcagccattggtggcgttcgaactctcccgaatcgtgacatggcccaagtccccccgagtcgattcgccaagatgggaattagatagcgtgcgcagcagtataggatcttacattcacaccgaaataggctgcttgcctcagggggctcctacttcacctatgctgagtaacctggttgctaacgcgctagatgaggagctgagtcgcgtggccaacaaatttggtgttaggtacacccggtattgtgacgatctgacttttagcactcgccggaaatcttttgaccgtaatcaggcaaaggcccttatagaagcagccacaatgacaatgctgcctctcggcttcagcccaaacgagaagaagacggtcgtgattcctcccggcgctaggaaacaggttctcgggcttaatgtcgacggcccggtgccgactctctctaaggagttcaagtccaaaattcgtcagcatttgttttttctgaccaaaaacggacccgccgctcatgctgctgatagagagttcgacacgatatggggtctaaagagacacttatatggacttgccgattacgcattcatggtcgaacctgagtacgggaagcatgtgaaatcagccctgtcttctatcaattggcccgtgtga

SEQ ID NO: 9062 - RNA, 1128 nt, unidentified
  source 1..1128: mol_type = other RNA; note = synthetic construct
atgtgggcatctcagcactactttcaggaagggaagtctctcggtgtggatgaggacatcctcgtgtccgctgtggatcaaatcgagagagtcttagacgttaacggcgacctcccaagtattctgacactcaaccacctagctacacgcgcgaaagtaggccacgcttttctgagacgcgtgatatcaagaacacagaatggggcctaccggcacttcgcggtcaaaaagcgaactgggggccagcgctggatctccgtaccacatcctcagctattgaatgtccagaggtggctggcaaaacatgtgctgaaccagattgatgcttccagacattcctacgcgtttgaaccggagtcttctataaagaaatgcgccgaacagcacatccacgccaagtggatggtcaagatggacgtcgaggacttcttctggagcattagtgaaatcgacgtgtatagacaatttgtgagcctgggctatcagcctctggtggctttcgagctcagccggttggctacctggcccttattcgcacatggtcccgctaaggccgccgtttggagggctaggccacgtgaaggtattcccacctattcctggggaaacatgggatgcctgccgcaaggagccccaacctcgcctatgctttcaaatcttgttatgcgagaactggacgacaggatccaccgcgcagcgcgaaagcacaggatggtgttcacgcggtatgccgatgaccttacctttagtagccgcgatgaaactcttgggcgggctgcctgtcgtgagctcattggcgaggtgggagacttgctgaggcagcgggggttcaacccaaagcataaaaaaactgttgtggtgcctcccggtgcacgcaaggttgtgctcggcctgaatgtcgatggagatgcccccaggctgccaaaggagttcaaaagcaaaatgcgacagcacctgtactacctgagaacagcaggacctgcagctcatgccgccaagagatcatttgataccgtgtggggccttcaacggcacttgcgtggcctggcagattttgcccatatggtagaacccgagtacgggagcgagttactgcgggccttgcaggccgtatcatggcctgtctga

SEQ ID NO: 9063 - RNA, 1188 nt, unidentified
  source 1..1188: mol_type = other RNA; note = synthetic construct
atggagttccccctgcacaactatttaaagtcccttagagacattggtgcgcgggacgggtacattaaagccatacagcgaaatgcaaaacccctggctgactgcggactgccagtgatccttacgttgggtcatctagcacacataactgatgttagccatggtattctcactgatatcatcaagaggcagatcgacccttacagggtattcgcgatcaggaagaggaatgggggtaagcgcttcatttgcgtcccagaaacgggattgctgaacgcccagcgttggattcatgatgaaattctctgcagccttgcggccacaaagaacctttcctgtcacgccaccgcctatgctccgggctgcagtcatgtgatcaacgctaagagacacgtgggggccgcctggatcttgaaattcgatattacccgtttcttcgagagtatctccgagcggcaggtgtaccgcgttttccgcggactgggctacaggtcacaggtggctttttgcttgacccgactgtgtaccagggtgctgcctacaaatgtcgaccatcggctgctccggcacaccaagagatggcaaactggggatcaaagaaatcagagaaacttttcaggagcccgggtcatcgggcacttaccccagggtgcaccaacttcccccatgctagccaatctcgtgtgtatccctctcgatactgacatgcagaatatcgctgcacgggagggcctgactttcacccgctacgcagatgatatgacattctctggggaaatgctcgaccgtgccgccgcagtaaagataagtagagaggtttctatagtggtgggccggtatggctttggcatcaacctccagaaaacatcgatagcgaaaaatggaggccgcaagattgttacaggccttagcgtcgacggcgacgtagtccgactgccgagagcatataaagacgctatccgccaggagctattttacttggacaagcacggcattcaggagcattgtgcccgcattggacacaaaaaccatctcagctatctgttaaggctggctggacggattcgatacgctacctctatcgagcctgtgatagggcagaggatgatgcacctgttcctgcgaatttttccaacatttcaagaaaccgaaagactgatctttcaagactttgtgtcagatgattga

SEQ ID NO: 9064 - RNA, 1188 nt, unidentified
  source 1..1188: mol_type = other RNA; note = synthetic construct
atggagttccccctgcacaattacctgaatagcctgcgggactctggggcgagagtagaatacatttccgcgattcgaagaaacgctcagcccctggtcgattgtggcttaccggtaatcttgacactggggcatctagcccacgtcacggacgtctcacatggcattctcgctgatattatcaaaagacaaatcgacccatatcgcgtgttcgccatcaggaagagatctggagggaaaaggtttatttgcgtgccagagaaggggctgcttacggttcagcggtggatccataaggaaatcctgtgcgccccggtcgccttgcgtaagctgtcttgccatgcaacagcctacgcgcccctcagttcacatattgtgaatgccaaaaggcacattggtgctgcctggatcttgaagctcgacataaccagatttttcgagtcggtgagcgaacgtcaggtctaccgcgtgttccggggcctgggatatagggctttggtggcattctgtctcacacggctgtgtactcgcgttttaccaagcaccgtggaccaccggcttaggctgagaaccaaaagatggcaaactggcgaccagagaaaccagaggaattttcccggcgcccgggttattggacacctgcctcaaggggctcctactagccctatgctcgccaacctcgtttgtgtgaagcttgacgcagatctacaaaagatcgccgcaagagaagggctaacctacactcgctacgcggatgacatgaccttttctggagaggtcgtagaccgagcagccgctatacggatctcccgcgagatatccatcgcagtgggtcactatggattcggtatcaaccttcagaagacctccatcgcaaaaaatgggggccgaaagatagtgacaggattgagtgtggatggcgaagtcgtacgacttcctcgggcttataaggatgccatccgtcaggaactcttttacttggataaacatggaattcagggccactgcgcaaggattggccacaaaaaccacctgagttatctgttacgcctcgccggccgcatccgatatgctatctcaatagagcccgttattggtcagaggatgatggagaagtttctgaggattttcccaacttttctggagacagagcagatggtggctcaggtgttcgtgaaagatgactga

SEQ ID NO: 9065 - RNA, 1167 nt, unidentified
  source 1..1167: mol_type = other RNA; note = synthetic construct
atggaattcccacttcacgcatatctgaatcatctccaaaccgagggtgcaagcggggaattcattgccgctgtgcgacgtaatgcaaagccactggcggacagggatcttcctgttattctcacccttggtcacctggcctacgccacagatgtgcggtatggaaccttgaacggtatcgtgcggcggcagatagatccctatagggtgttcgcgatacgtaagcgaaacggcgggaagaggagcatctgtgttcccgagcctgggctgctctcagtacaaaggtggatccacgagcatatcctgtgctcacactacgccctgagcaggctatctaaccagagtactgcttatgcccccggatgctcgcatctggccaatgcccgccggcatatttccgcagcctggctcctaaaactggacatcacgcggttcttcgagtccatcagtgagcggcaggtgtatagagtatttcgcggctttggataccgagcactcgtggctttttttctgaccaggttatgtacaagagtcctcccattcgcggttgacaggcgcctgaagcggcagattagaagatggcgcactggcgaacctcgacgttacttgaacgctgctgttgtgggtcatcttccgcaaggagccccaacatcaccaatgctcgcaaactttgtgtgcacagtgttggatgccgaattacagaccatcgctgtacgcgagggcctgacatacacaaggtacgctgacgatatgactttctccggcggcatcggagtcgcatgttctcctgccgagataatacgagaaatttctaccatcgtcgggaaatttgggtttggcatcaattcccagaagacgagcatcgctaaaaatgggagtcggaagattgtgaccgggctaagtgtcgagggcgatatgctgagactgccgcgctcttacaaagacgagctgagacaggaactgttcttcttgaaaaagtacggcattgcggaacactgcagcagaactaaccacaaaaaccacatgtcatatctcctgcgcttagccggaagaattaggtatgctgtctccgccgagcctattataggaaccagaatgatgcttcagttccagcacttgtttcccaattttactgagatcgaacaaagcctgttcgaccgcccctga

SEQ ID NO: 9066 - RNA, 1209 nt, unidentified
  source 1..1209: mol_type = other RNA; note = synthetic construct
atggagttctctctgcatacctatctgaacaggcttagaaccaggggagcctcggacgagtttgtcgagatcatccggaggcatgcgaaaccactgagcgacagagggttgccggtcatactatcactgggccatctggccttcgccacaagtaatagccatgaagtgctgcatggaattgtgaagcgggaagtggacccataccgggggttctggatacgaaaacgtagcggaggaaaacgatatatatgtgtacctgaaggggggttaatcaggacccagcgatggattcatgatcatattctttgttctacgtgggggaagaagtccctctccatggccgccacagcctatgtacccggctccagccacatcgacaacgcaaagcgccactccggcgctgattgcgtcctgaaattggacattaccaatttcttcgagacaatatctgaacgtcaggtgtaccacgtgtttcacggttttggatacagacctcttgtcgcgttctatttctcacgcctgtgcacacgcgtgctcgaccctaagcacgacgttcggagtcccactgtacgctgggcaggcaaaaagaagcgctggcaaactgaagccaaccgaaagaacaataattaccacacagtgggccaccttccacaaggagcccctactagcccaatgttagcaaatctcgtgtgctttggcctggacctagagctgcagcagatcgccgactcaatcaacctcgtgtataccagatacgctgatgatatgacctttagcggttcttttacgacaaaggagcagatatcccagttcatctgtcaggtgagtgctgtcgtcggtaagtttgggttctctatcaatcaacagaaaacctcactgagccggactggtggcaggaagattgtgaccggcttaagtgttgaaggagatgctttgcggctgccacgggcgtacaaagatgcaatccgccaggagctgtactacattgaaagatatgggctctctggtcaccttgagcgtgttggctatgccaaccacttgacgtatctgatgagactcaaaggaagaattcaatactggttttccattgagcccgctacagcaactcctagtatcgagcagtttagggctatcttccccaacttcaatgaaattaacgagctcgttaccggcgattcatccaggggcatcccggggactccctactga

SEQ ID NO: 9067 - RNA, 1368 nt, unidentified
  source 1..1368: mol_type = other RNA; note = synthetic construct
atggccagtcagtatccttgtagattgttcgagacacacgagcgaggatctgaaagcgctgtgttggataccgcttttctctccgcacggtgggtcgacgaccagttggagctccgcggactggcaattagacctagcagccatcacgcagagagggtgaaagcccgcaatatgaagttctcactacacgcctatctgaaaccgctgagggaaaacggcgctagccaggagtatattgaagctctggcaagaagcgcgaaaccgctggtggataatggcctccctgttcttttaactttaggacatctggctcacgtgtgtgacgttccatacggcatgctagtgggcattatctcccgtcatacaaacccttatagagtgttctcaataagaaagcgttctggcggaaagcgctttatctgcgtacccgagcctctgctaatgcaggtccaaaggtggatccacgaccaaattctgtgcagccccttcgcattggcaaggctgtctagacatgccactgcctacgctcctcagaatgggccagtgcccgccaatcagcgacggatagcagatcacgtgaagaacgcggaacgccatctgggcgccacatggattgtgaagctggatatctctaactttttcgaaagcataagtgaacggcagatctaccacgtattccgtgaatttggttaccgagcccttgtcgccttctgcttggctcgtctctgtaccagggtgttgcccctcacagctgataaaaggctgaggtcacgggcaaaaaggtggcacccaggtaaagagtataagatccttgccactaaggtagttgggcatctcccacagggagcacccacatctccaatgcttgccaacctggtttgcgtagaactcgatcgcaacctgcagtccattgctgtccgggaggctctgacgtatagtcgctacgccgacgatatgacgtttagtggtgagtttcatgaccggagcgacgcagttatcgtgttacgagaactttcccgagtcgtggcggcccagggcttctcaatcaatgccctgaaaaccaacattgccaagaacggtgggcggaagatcgtcaccgggctgtccgtggacggagactccataagggtgccccgggcctacaaggacaaaataaggcaagaactctattttatcggcaaacacgggctcaccgatcactgtaatagaatcgaccaacgcaatcagctgtcttacctgctccggctggctgggagaattcgctacgtcagttcagttgaggccgaggcgggcaatctcatgatgaagaagttactttcccttttcccaactctgttggataccgagagaatcctatcggagatttga

SEQ ID NO: 9068 - RNA, 1167 nt, unidentified
  source 1..1167: mol_type = other RNA; note = synthetic construct
atgaacttcagccttcattcgtatatcaaacacctccgtgatactgatgccagtgaggactatatcaagaccgtgcagagacatgcaagaactctcgtaaataacaacttgccagtgatattgacattaggccacctggcccactccacgaacagctttcacaacaccctcctcaatatcgttaagcgtgaggtcgacccttatcgggtgttttcaatcggcaagaaatccggaggcaagaggctgatctgcgctcccgagctcaacttgcttaacgttcagcgctggatcaatcagtacattctgaaatctgagctggccctgaagaaaatttcatccaacaccacggcttacgtgccaggggggagccatataaagaacgccgagcgacacgtcggtgcctcttggattatcaagatcgatatcgtgaacttctttgaatccatatcggaaaggcaagtgtactatgtatttcgggagcttgggtaccgcgcactggtggcattcaatctggctaggctgtgtacaaggattctgccccataaactggataaccggaagtacaataagaagcgatggcgatctaaaaagcagtacgcctattgtaattctaaggtcgcggggcacttaccgcaaggtgcacctactagcccaatgttggcgaatttggtgtgcgtgatgctggacgctaaactacagtgcattgccagtgaatacggcctttcttatacaagatacgctgacgacatgacattctctggccacttcgacgacaagaagactgcgctcatttttatgcgggagatcagtaataccgttatcaattacggtttctcaattaactcccagaaaagcagcatcgctaaggacggaggccgcaaaattgttacaggattaagcgtcgatggcgaacacattaggcttcctcgggcatataaagataagattaggcaggagatcttctacattaagaaatattccctcgaatcacattgtagtagaaccagaaaagggaatcgcttttcctacatcatgcatctggccggaaaaatacggtatgccatcctggtggaacccaccttcggaaataaaatgatgagcgagtttgtcaacatatttcccgatttcctagacatggaacaaatactgaagagttcaattcgctga

SEQ ID NO: 9069 - RNA, 1167 nt, unidentified
  source 1..1167: mol_type = other RNA; note = synthetic construct
atgaacttccctttgcacgcgtacgtacgcgctctgaaacgaagcggcgcctccgagcagtttatccagcaagtacgggacaaagctaagccactagtcgccactgggcttcccgtcatacttactttgggacagctcagtttcgccacagagattccatatcgcatactgctgagtatcatcggccgagcagtggatccgtataggctgttttccattaggaagcgggcgggcgggagacggtttatttgtgttcccgagcccaggatgatgttcgcccaaaggtggatccaccagaatatcttgagcgcgccttcagtgacggcaggaatgtcttgcgcagccatggcctacaagaattccgcctctcatgtggccaacgctcgtgctcacctcgctagcgactggattctaaagttggatgtgacacgtttcttcgagagtgttagcgagcggcaggtttatcatgtgtttcactcactggggtaccctgctcttgtggcattcggtctggctcggctgtgtacacgcgtgtctttcggctcacgtggtggtaggcatcccggagcaagtgcccgatggtcctctagagacaggtatgactttcttggctaccccgatctgggccacttaccgcagggagccccatcaagccctatgttagcgaacctcgtctgcattcccttggattcgcaaattgaaaagatcgccgaagagcacaacctcgtgtataccagatatgcagatgacctgaccctctctggatcacttatcggggccgacgaaacgctcgaggtgattcggaaggtgtccaatagcctaggccagttcgggttcggcgtcaatgtgcgaaaaacccgcgttgttcgcagagggaccagaatgatcgtaactggactctccgtggaaggagaaacactccgcgtcccacgggattacaaggaccgactgagacaagagctgtactacatagagaagtttggcctgagagagcattgtcagaggatcggtcagaggaattacgcagcttatctgcgcagattatctagtcggatcggatacgtctcctgcatagaacctgctactggcaagaaactggaagccaaatttaccaacctgtttccaggttttggggaactgaaagagcttattctgagcttcccttga

SEQ ID NO: 9070 - RNA, 1131 nt, unidentified
  source 1..1131: mol_type = other RNA; note = synthetic construct
atggaattcccaagaccagccaccgctgttccgctgccttttgatgccacgctcgcccagttagcccatgctactggaatgaccacggctcgactgcagggcattgtttcacgcaggattgatccctggcacacgttttccataaggaagcgtggcggcggtaggagaactatctgtgtccccgatgcagacttattggctctccaacgctgggtgcaccgacacctcctctgccatccccagtcgctggccaggctgatgccacaggcaactgcgtacagacccgggggcagccaccttgctaacgcagaagcacaccttggagcagggtggctgttgaaactggacctcgtgcggtttttcgagtcaatcagtgagcggcaggtgtggcacgtcttccgggcactgggctttgcccctagaaccgctctgctgctgacacgcgcatgcacacgggtccttcccctcgctgtcgaccgcagatattttgatcgtaccccgcggtggcggactggagcagaacgatccccgaatgagaaatttcaccctaggccacgtgtggttgggcatttaccacagggtgcgccctccagtcctatgctagccaaccttgtgtgtcacgctttggacgctcaactccagcagttggctcagagctgctctgagcacgctgttagatatactaggtacgccgacgatatcacattctctgggcctccaatgacagcggctgcgttgaatgccctttgcggccgcttgctaagggaggccaccagagccataacccgctatggattcggggtgcagtggcggaaggtacaactagtacgcagaggagcccgccgaatcgtgacaggtctgctggtcgacggagacgccttacatgtgccccgtccttctcgcgacgccctgagacaggccctctatcatctggagcaacaggggatcgaagggcattgtgcctggctccggattgatgacacccaggcctacctggctcggctgagaggtcagctggcctacctgaggagcattgaacctgtgaggggcgcacggatgcttgcgcaattcgataggctgatggccgcacgaggcacagtgggaactaccggccagatgaggaacgcatga

SEQ ID NO: 9071 - RNA, 1194 nt, unidentified
  source 1..1194: mol_type = other RNA; note = synthetic construct
atgactgctttcagtttgcacgattacctctctgtactaagggccgaagggagcccgagtgactatatcgaggccctgagaagaaatgcacagccacttgtgtcccgaggcctgccggtgttactgacccttggacatctggcctttgtcaccgacgtggattacagatatctgaatgcggtcgtgaggcgaacagtggacccctatcggatcttttccatcgcaaaacggtcaggggggaaacggtacatcgttgtcgcagaccgcaagttagccctggtgcagagctggatacatcgtaacattctgacgagcgcagcggccatgcgctctatttcctctgccgtcaccgcctacgtgccaggctcttctcatatagcgaacgccagtcgacatcgcaatgcatcctggctcatcaaagttgatgttgcccgcttttttgagtcaatttcagagagacaggtgtactacgtttttcgacaattgggctatcgcgctctgatggctttcgccctaactcggctatgtactagagtgctcgaaactaaggatttccgcgccagaaagaaaggaagatggcagaagagaacagttagccccgaccgacctctgggtattggacacctccctcagggtgctgcaacctcgcccatgctggctaacctcgtgtgcaggaagttggacagcagcctttcagagattgccgacgacaggggactcatatacacgcgctatgcggatgacatcaccatgagtggggaattccaggataggatggacgctgagtccactatcgggctgatcagtggattgctgggaggggtgggcttcggtattaaccaccaaaagacatccattgctaaagacggagggcggaaaattgtaacaggcctttcagtagatggcgataagctgcgtgtacctaggtcctataaggataatctcaggcagcacttatactacatcgagaagttcggtctgaatgaacactgcgtgaggatcggtcaggcccaccatcttgcattccttctccggctggctgggcagatccggtatgtcaggagcgtcgagccacctctcggagccgagatgctgaaccggctgcgtagagctgtgccagaatttgatgctatagacggcttggtcagcgcagcctacgatacagacaccgatccctctcaaggcggcggctga

SEQ ID NO: 9072 - RNA, 1176 nt, unidentified
  source 1..1176: mol_type = other RNA; note = synthetic construct
atgtctactcacaattacattacagagctgaacactccaggagtgaatccgacctataaacgggtcgtaaggcagctggttaccccccttctgcagaaaaatctgcctgtcatcctgagcctgaagcacctaagtgttctgctggacattccatatattgttgtgcataagatcgtgtatcgagacggagacttctataaggtgtttgctataaagaagcggtctggtggaaaaagatggatcacaattccagattacttcctcatgaaagcccaaaaatggatcaacaataacatcctcaatgctcaggaggcccaagccatgctatcgattaactcaaccgcatataagaagaagagcagccatatcgtgaacgcctcaatgcacttaggggagaagcagctgattaagctggatattctaaggttctttgaatccatctcagagcgacaagtgtttaatgtgttcaaaaagctcggctacaaaaactctgtcagtcttattcttgcacgcatctgcactcgtgtgatcccaatccatttagacaaacggttcatcaagaacgaacagaggtggaccacaaaatacaattacaagtacgatcagcagaagaacaaaatcaagcgcatcgggcacttgcctcaaggggcacccacttcccctgctcttgcgaactttgtatgttgtaatttggacgccgatatagaagacctgatagatcagttcaatctgaatagctatacgaggtatgctgacgacattattatatccggcaattttcaggacaaaaatacagccattagctgcatcttccgcgtctccagaatactgcggaactatggctttaagacaaactacctcaagaccaaatactgcggctctggcgacagaaaaatcgttacgggtatttgcataaacgatgagaatcagttacgggtccccatcgagtacaaaaacaaaattcgccaggagatttactacatcgataagtttggacttttgaaccactgtgagagactgaatataagtaaccccctcaactatctcatgaggttggagggcaagatcaactatatcaagaccgtggaattggataaggggatctacttcatgaacaagctcgaaaaagcgattcccaatatgaatgaaattcgtctgctgaacgatctcccttga

SEQ ID NO: 9073 - RNA, 1098 nt, unidentified
  source 1..1098: mol_type = other RNA; note = synthetic construct
atgagcacacacaactatctgaccgagttaaacaaacatgatgtcaacccttcttataagcgcgtagttagacagctggctactccccttcttcaaaaaaaacttcctgtgatcctaagtctgaaacacttatccgttctgcttgacataccttacattgtgctccataaaatcgtgtatcgggatggcgacttttataaggttttcgcaatcaaaaagcggagcgggggaaagcgctggatcacagtgcccaatcatttcctgatgaaggcgcaaaaatggattaacgagaacatcctgaatattcagtcaactcaggactttctgtcgatttcctctactgcctataagaaatcttcctcacacattatcaacgcttcaatgcacctgggtgagaagcagttaatcaagctggacatcctgaatttttttgagagcatatccgagaggcaggtcttcaaggtgtttaagaacttgggatacaagaacagtataagtctgatcttgactcggatttgtacaaggctgatccccctcaacaaggacaagagattcttcaagaaagaaaaaaggtggacaaccaaatacacctacaagtacgacaatcagaataataagctcaagagaattggtcacctcccccaaggcgctccaacatcccctattcttgccaatctggtctgtcaggatctggatagcgaaatccagaatctaacggaccaattgaacctcaattattacacccgttacgcagacgacattatcattagcgggaacttcataaacaaagaactggccattagctgcattcacaaggtaagtaaaatcctacgagagtacggattcaagaccaattttctcaaaacgaagtattgcggctctggggataggaagatcataactggcatctgtatcaacgatgagaatcagctgcgggtcccaatcgaatataaacgaaaagtgcgccaggaaatatactacattaagaaattcggcctcctcaatcattgcgagaagttgaaaatctataacccgcttaattacgtgttgagactggatggaaagattaactacatcaagaccatagaaccagattga

SEQ ID NO: 9074 - RNA, 1173 nt, unidentified
  source 1..1173: mol_type = other RNA; note = synthetic construct
atgagcaatcataattatcttacatcactccgtaactccgagaacatcaatagcgagtacaagaaaagcatttccaagtatgcgcggccactgatccgggaagagctgcctatcatcttatctctcaagcatctgtccgtcctaactgacgttccctacaatactttgtacaatatcgtgttccggaagattgagtcttaccgtattttcgccatcaaaaagagatcaggaggaaaacgctggattacagtgcctaccccttacctcatgcgcgtacagaaatggatcaataaaaacatcctcagcaattctcacgtgctaagttacatttcgaacaattcaatggcttacaagaaaaaatccagccacataaagaatgcccttgtgcaccatggcgaaactaaattgataaagctggacattaccaacttttttgagtccatatctgagaggcaagtgttccacgttttcaagaagatcgggtataaaaactcggtggctttcattctgaccaggctctgtaccagaattttgtctctgaataacgacattagactgttgaacaaggagaagcgctggttttctctttatcagtataagcacctcgataatgagaaaactatcaagcggcttgggcatctgccacaaggcgcacccacatcacccatgctggccaatttagtctgtcttgagttggacaaacagatcgaagatatgtgcctcctggaggactttaattatacccgatatgccgatgatattgtaatcagtggtgactttagcgacaaagaaaacgctattaaccacatctatgagatctccaagatattgagaacgcacggcttcaaaacaaactatctgaagaccaagtactgcggagcaggtgataggaaaattataacgggcctatgtattaacgaccctagtagcctgagagttccaagtcactataaaaaaaagatcaggcaggagatttactacataaagaagtacggcctgatcgaacattgcaggaaactcaacatcaagaacccgcttaattatttaaaccgcctggaaggaaaaatctactacctgatctgcgtcgaaaacgagaatgggaagaaggctctcgaaaacctggaggatgcaattcccaatatacatgaactgcgacagctggccgaaatctga

SEQ ID NO: 9075 - RNA, 1119 nt, unidentified
  source 1..1119: mol_type = other RNA; note = synthetic construct
atgcggaaggttcctgccgtgtttactctgatgcacctggctcaccttaccggcacttcttggcagagcttacggaataccattacacgccagcaagacgattacagagtattcgaaatcagaaaacgctccgggggaaataggaggatctgcgctccagcccccatgctgaaaagcgttcagttctggattcacaaaaacatactctgtagtctcggagcccgcgctctcttgcaagaagcgtcaaccgcgtatgcgcccggctcctcaatcaagaaaaatgctgctattcatgctggagcagcctggctgattaagctcgacatcaaggacttttttgagagcatctctgaacggcaggtgtatcacgtgttcaggagactgggttacccggccctgctgagcttcgagatggccagattatgtacaagggtggtgccgcctagagatgacaaagtcccccgccggagagaaaagatgtggcgctggacgaaccagacatgtaaacattttactccttatccatgcgagactgccgtcggacatttgccccaaggcgctccaaccagtgccatgcttgcaaatcttgtggcagtggagctggataaaaaaattcaggtcatcgctgatgccaacggagcatcgtacacaagatacgctgatgacattgttttgactctcgccgtggctaccagggtacagtgcgacacaatctttcgggccgttgcagatgtagtgagtcacagcggctttcgtgtgaacagaatcaagtctcacgtccgcgggcctggtgcacgtaaggtcgttaccgggctagtgattaacgatgtgaggccccggttggcacgatccatgcgagaggacataaagctagccttataccacataaagaagcatggcctgctggggcatgcagagcgcaggcattcaaagaacccacttggctatctgaatcacctcgtcgggctgatctatttcgcccggagcatagagcaggacttcggtgtatgggccctgtccgaactgcgaatcgcgatggacgaccacaaagatttgctctctatccttcgtacgttcgactcaagtcaagatcagaggtactcctaccgaaatatttga

SEQ ID NO: 9076 - RNA, 1059 nt, unidentified
  source 1..1059: mol_type = other RNA; note = synthetic construct
atgagggccacagtggctcgcagtaaagacaactacactacttttgagatacgcaagagaagcggaggcaatcgcaggatctgcgtccctgcacctgcgcttaagctggcacagggttggatacacaagcacatcctgtgttcgccaggggccttagcgctgctccaacaggcctctaccgcttatgctccagggagctccatcaaaatgaacgctagtgcccatgccggggctgcttggctcataaaactggacattaaggactttttcgaatcaatcagtgaacgacaggtttatcatgtcttcaagagccttttcgggtaccccgcacttttatcatttgagatggccagactgtgtacccgagtggtacccccaagaaatgacggagtggctaggcggcgcgagcgaatgtggagatggaccaaccgggcttctaaacatttttctccctactcttgcgtcacggcagtaggccacctaccgcagggagctcctacgtccgccatgctggccaacttagtggcagtggagatcgataagcagattcaggcgatcgcagatgcgaatgacgccacctacacccgctatgcagatgacattgtgctcactctgagcgatgggacacgctcccactgcgacgcgattctgcagaaggtggcccatgtggtgaacaccgcaggctttagggtgaatcggaaaaagtcctacgttcggggacctggcgcacgaaaggttgttacaggtctggtaatcaatgatgaccgtccaagattgacaaaagcctcccgggaggagataaaattggccctctaccatattaaaaagcacggtttgctgagtcattctgagcgtaggcactccaagaaccccctcggatatctaaatcacctcgtcggcctgatctacttcgccagatcaatcgaagaagatttcggcgccagggcccttattgaattgagaactatcatggctgaccacagggatctgctctcagtcctgcaaacattcgaggctatgccggccgaacgtgagagctatagctatcggagcatttga

SEQ ID NO: 9077 - RNA, 1146 nt, unidentified
  source 1..1146: mol_type = other RNA; note = synthetic construct
atgtctatcgctgaccaactgaccgagaataaggtgccattaatctttagccttatccacttggcccacgtatctggcgtcaagtggtctttactccggtctttcgtaagacgagactccgatttttatggctgttacgagatccggaaacgatcaggcggtaacaggcgcatctgcgtgccggaaccagctctcaaactgatccagaaatggattcatgcaaacattctgagatccacaggcgcactagctcggctccattctgcttcaaccgcttacgcgccaggtgccagtatcaagaaaaacgccgacagtcacgtaggggctgcctggctcataaagctggatataaaggacttcttcgagagcatctccgagcggcaggtgtactgggtttttagagatttaggctaccctgccctcctctcatttgaactagcgcgactgaccacaagagtggcaccccccaggagagatggtaccatgcgtcaccgcgacaaaatgtggaggtggagcaacaacgcgtcccaggcatatcccgcctataagcccggccgcgtcacaggaaaccttcctcagggggcccccacaagtgccatgctctcaaatcttgccgtgcgcgaattggacgtgcagatacagctgatcgctgcacggcaccatgctacgtatacacgctatgctgacgatattactttgactctggttcaaggcagtaggccggcctgtgcagagatatttaggagcgttgcagatgccattactcatgccggattcagagtgaataaatgcaagtcacggatctcggggccagggagcaggaagattattaccggactggtgattaccagtaaggcagctcgtgtggccaaaaatgtgcgttctgagattgaaatcgcccttcattacatcaagaagcatgggctgctggaccacattgaaagatgcggacacaagaatcctgtcggttacctgaactacctttatggacgcatctatttcgttaggtccatagagttcgacttcggcactcgggccctggaagagttgaatgcgctgattaaaacgtacgaggggttgggatggtccagcaagccttttaaaatcgtccgaagcgatctggtcttccactccgcaaaaaagtga

SEQ ID NO: 9078 - RNA, 1059 nt, unidentified
  source 1..1059: mol_type = other RNA; note = synthetic construct
atggtcgagagaaagatcgacgactatagagtcttcaccattcaaaaaagatccggaggtaacagaaggatttgttccccgagttcaaccctccggcgagtgcagacttggatccaccgtaatattttgtgcgccgccggctctctggccaaaattcacgccgcatccacggcttacgcacctggctcgtcaatcagagccaacgccaaagtgcataccggggctgcgtggatcatcaagatagacataaaagacttcttcgaaagcatatccgagcgtcaggcctactatgcttttaggagtctggcctatccggccctcctgtcctttgagctggcacggctttgtacaaggattgctcctccacgcgatgatggggctcaaagaaaacgcgatttactgtggcgctggaacaacgaccgggcaaagacaggcaatccatacgggctggtgcagtctgtggggcatctgcctcagggagcccctacttctgctatgcttgcaaacctggtattcgcagcgctcgacgtacgaatcaatgctatagcccagaagcacggtgctacatactcccgctacgcggacgatattgtgctaagtcttactagcggctgtcgggtggaatgcgcaaaaatttttcgcgatgtgacatctgttattagtcatgccggataccggatcaacagatctaaatcccgaatcaccccccctggcgctcggaagatcgttacgggcctggttactaacgatgtcacacccaggctgccacgagagatgaaagaagacatcatgctgtcaatctatcatatcaagaagcacggattactatcacacatggaacggaggaagtcttcgagccccttgggttatctcaatcacctcattggacgcattttgtttgcccagagcatcgagaacaagtttgggagctgcgctctcaatgagctccgtgtggccatggcaccctacagggacctgctggatatggccaggatgttaaatccaaagaccagcggcagcaatgatttcaccgcgctgtatcttttggtcttcccctga

SEQ ID NO: 9079 - RNA, 1215 nt, unidentified
  source 1..1215: mol_type = other RNA; note = synthetic construct
atgctgggaccttccctgcatgcaattgagttccatgcacgcggattcaacgagcagtatgtgaaagcccttgtggataccgccaaacacttgtcggctaagagagtgcctgtggtctttacagtgatgcatttggccactctcagcaaaaccagttggtcagctctcatgcagactatcgtgcggcaaagtgagaacgattaccgcgtctttagcatacgaaaaaagtctggcggttttcgtcgtatttgcgttcccgcgccccatcttatgcagacccagcgatggatacacgaccacatcctgaattcaaggggcgctctggactgcctccatggtgcgtcgactgcctacgggaagggcagctctattcttaacaatgcctctgctcacgcgggcagcaagtggctaatcaagatcgacattaaggatttcttcgagtccatcagcgaaagacagatctattacgtctttcggagattcggctacaaggccctgctggccttcgagcttactcggatatgcacgcgggccattccccctaggtatgatggtcgtccgaggcgacgagacaagacctggcgctggagcaattctcaagtcgtaggcaaggggccttatctggccaccgccacagtgggacacctgccacagggtgcacccacctctgccatgttggctaactacgcagttgcttcactagacgaaaaaattcaggcgatcgcagatggcgtcggggcaacttatacgaggtacgctgacgacatcgtactctccatgaccaactcctcccgggagttgtgtcaaacaatctttcggcaggtgtgtgtggaaattacgacaagtgggttccggctcaatgagaaaaagtgcttcgtgagaggcccaggcgacaggaaaatcgtaaccggactcatggttaatgatgtgaaaccaaggttaacaaagtctattaaggatgagatcgaagtcagcctgcactgtattgggaagtttgggctgctgtcccacatcaaacgcaagaagattaaaagtccgttaggatatctgaaccacttgaacgggttaatcaggtttgcttactccatagacgataggtttggcaattgggcaactaaagaacttgacagagttctggccccagaacgcgagacaatagaactcctgaaaaatttctcaggaagaccccgccctaacagacatatgttcggatga

SEQ ID NO: 9080 - RNA, 1215 nt, unidentified
  source 1..1215: mol_type = other RNA; note = synthetic construct
atgctgggcccgtcacttcatgcgatcaaagcacatgctcacggcctaaacgaacagtatgtgaaggtcctcgtagacacagcccgccagatgtcggtcaaacgagtgccagttgtttttacccttatgcacttcgccacattgagcaacaccccgtgggccgcgcttattcagactatcgggagaagggcagaaaatgattaccgggtgttcaacattcgaaagaagagcgggggatttcgaaggatttgcgtaccagtcccccacttgaagcgcgctcaacggtggatccatgaccagatcttaaagtccaggggagccctggattacctccacgaggcatctaaagcctatggggatggagactccatcctgaacaatgctagcgttcacgcaggctccgagtggattataaaggtggacataaaggacttcttcgagtcaatctctgagagacaagtctaccatgtatttaggaaattcggataccgagctctgctcgccttcgaattagcccgtctttgcaccagaaccgcccctcgaaggtacgacggtcagcctcggaggcgggacaagacatggaggtggggctcaccccaggttgcaggtaaggtgccatacagatcccgcacgactgttggccatctcccacagggagccccatcttccgcgatgctggccaactatgtcgccgcctccctcgatacaaaaatccagactattgcggacgcagccggggcagcttacactagatatgctgacgatattgtgctgagtctgacgaatagcgatagagagagctgtcaagagatctttcgccaggtctgtctggcagtgaccacagctggctttcgtctgaatgaaaagaaatgcctgatcagaggacccggcagtcggaaaatcgtgaccggtctggtggtcaatgatgtgaaacctcggctgactaagagcataaaagatgagattgaactgagcttgtactatattggcaaattcgggctgctatcacacgccaagaggagaaagaccaagtctcctcttggttatctcaaccatttgaccggcttgatacacttcgcccactctgtggacgatcgttttggggcttgggctcaaaaagaattcgaccgggtgctagctcctgagagggaaacagtggagctcctgcgcagttttagtggacgcccccggcccaatcgccacatgttagggtga

SEQ ID NO: 9081 - RNA, 1104 nt, unidentified
  source 1..1104: mol_type = other RNA; note = synthetic construct
atgctgctgtggacccctcacctattcgaaaaagcgggcattcagagaaagtacgatattccctacattgcaaggctcatcgattatggaaatcaactcagccagaggaacttaccagtgatatttagtctgaagcacttcagtcgcctgaccgacatcaactattcctatttacgggccgtgattgatagaactgaatacccatacaagacattcaaaatccgtaagaagacagagggattccggaggatctctgtgcctgactcaagacttctggtaatccagcagtggttgcataagcacattctttccaaaatccagccccatttttcgagtaccgcatttaatccaggctgctctatcatgcggaacgctcaaccccactgtggtgccaactggctcatcaagatcgatatcgaaaatttcttcgactccataagcgaacgacaggtctatacgcagttcaaggcactgggctattctaagtacttatgcttctgctttgccagactgtcaaccaggctagcctcccgagaggcaaaaaaatacaaaaaacctcgctggcaaaacaaacgccaccagtatcctgagttcattggcaacttgccacaaggagcccccacaagcccaattctcgccaatctcgtgtgtcgacagctcgacgcacaaattcatcagctgatccagcccatggggcttatatacaccaggtacgccgatgacattgtcatctccggcaacgcgctgactagaaaggatgcttctaagcttatccaggagataagcaagattttgaatcgcagcgggtttcagaaaaatagcctgaaaacacggatcctgtcaccgggggctcgcaagatcgttactggtctgaatgtcaatggcccaaatcctaccattcctaagaagctcaaatattcaattagggccgagcttcattacgctaaagtttttggggtggctgagcattgtaaaaaattgggttaccacaagatagacggatttcgtaaccagatccgggggaagattgattttgtaagaagtgtgaaccccaagctggccgacaagttctatgctcagctggacgacataaactggccgtga

SEQ ID NO: 9082 - RNA, 1026 nt, unidentified
  source 1..1026: mol_type = other RNA; note = synthetic construct
atgcttccgaacattattcccctgcagacaattggggaattagctaatatcaccggcgtgccctactcgtacatcaacaatatcattaagctcaaagaggactcttatcgatcttttagtatatccaaacgaagtagcaacacaaaacggaaaatcttcgttcctaagcctatgctaatgaaggtccagaaggctataaaccgctatatcctccagaatattcagccccacccaattgccaccgcgtactcatacggctccaacccaatcaagaacgctgcataccattgtaatagctctatcctcctgaagtttgatatcaaagacttcttccactccttcgatgagcgggatgtatactacctctttctgagctttggttataatagactcctgagctttcagctggcaagattgtgcactaagatcgtggagtccacctggttcccaaacgagtataaagaccactacatctatccaagtttgactatcaagaagaagtcaacttttctgcctcagggatgtccaacgagtcctatgctttctaaccttctgatgcgcacattcgataataagctggaaatgcttgccaataagttctccttgaagtgcactcgctattccgacgacctgacctttagctctgaaagcaagatgtcccaggattcaattaagattgtaatcgctgaagtgaacaaaatgttaggtaagaagttccgtatgaatagggagaaacaaaaagtttaccacaaagggcaaaggaagatcgtgacgggcctaattgttaacaacgacacacctaagttgaccaaagcattcaagaacgatctgcggatgcatgtccatttcatagccaaatatggatacgtggaacatgccctcaagaggaattgcgaccccttttctttttataatcacttcaatgggaggatgaaatgggccgagctgattgagccggcctttgtgaataaactgaaacacctgttagtcaacatatcaatacccttcacctacagcgcggagtga

SEQ ID NO: 9083 - RNA, 996 nt, unidentified
  source 1..996: mol_type = other RNA; note = synthetic construct
atgacccagtggaatcccaatctgtttcgcaaggagggacttagcaaaggctatgattcccattacttgactaggctggtggagcagggggaaactatcaacgagcgtaatctccctgttgtgtttagtttagcgcacctcgcgaacctgagccatacgttatacagcgatttgcatggcttcgtatccagaaacgagcttgagagaaaggacttcccctataaaaacttctctattagcaaacggaccggtgggaaacgctggatttctatcccaactccggccctaatggcagtgcaatactggataaaccagaacatcctgaatcgcgtgataccacacgctgccgcatacgcctatgtcccaaagcggaaaattatccagcacgcccagagacattgcggatctggttggctgatcaagatcgatatcaaggactttttcggaaacatttcagagcgtcaagtcttcgacgtttttcttaatctaggctatcccaaactcttgtcatttgagatggcccggctgtgtacaagggtaacgcctaagcggaaagggaagcgatggtgcaacaccaataacgaacacacaatcaccggctatgattcgaaatttgttggcagtctccctcagggtgcccccacaagtcctgcactgtcaaacctcgtgtgtattggattagataaacagctgacatccctggctatttcagaaggggctacttattccagatatgccgatgacatttgtttctccctgcccatggggtgccggaaaagtgcactgcacatcaagaaggaaatctctaaaatcctccatggctacggtttcagcgacaactccaagaagaccaggcttataccgcccggagctagaaaagtgctgaccggcctcaatgtcaataatgacacacctcgaattccaaaggaaataagggacagcgtgaggatgcacctgtactacgctaagaagaagtggtaccgcaattctttgtga

SEQ ID NO: 9084 - RNA, 1137 nt, unidentified
  source 1..1137: mol_type = other RNA; note = synthetic construct
atgactcagtggaatcccaacctgtacaggaaggaggggttaagtaagggatataacgttcactacctgaccagcctcgtggaacaaggcgagaaatccaacgagaagaattttcctgtagtgttctctctcgctcacctcgctaatttgtccagaaccttatactcagatctgcacatcttcgtgagccgaaccgcgatcaaacggaaagactttccttacaaaaacttcccaattgccaagagaacaggtggtaagaggtggatatcaattccgacaccagctctgatggcagtccagtactggattaatcagaatatcctcaacaaggcaacaccacactccgccgcttatgcctacgttcctaataagaaaatcatccagcacgctcagcgccattgtggagccgcgtggctgatcaaaattgatataaaggacttcttcggcaatatatcagaacggcaaatctttgacgtgtttcttgagctggggtatcccaaactgctctcttttgagatggcacgcctgtgtacccgagtcactcctaaaagaaagggcaagaggtggaggaacatcgtgactgagcacacaatatccgattatgatagccggttcgttgggagtctaccacaaggggcacctacgtcccccgcactgtcgaacctggtgtgcatgaacttagacaaaaaattgacgtctttcgccatttctcagggcgccacctactctcgctacgccgacgacctttgtttttcactgtccgacggttgccgtaaggatgccctttatattaagaaggagataagcaagatcctccgagaacatggtttcagcgataactctaagaaaacaagaatagtgccaccgggagctaggaaaatcttgaccggactgatcatcaacgacgaacttcccaaaatccctaaggagattcgggatagcgtccgtatgcatctatattacgccaaaaagaatggcatcgcgtcacattgcactattcgcgggttcagaagtgtaattggctttaagaactatttgagtgggatgattggatacatttccagcatcaatccccagcagggcaagaaactccggactgaattcaatagtctgccctggattgattttgacctgtga

SEQ ID NO: 9085 - RNA, 1137 nt, unidentified
  source 1..1137: mol_type = other RNA; note = synthetic construct
atgactcagtggaaccctaacctgtttcgcaaggaaggcaagagtaaaggcttcaaccctgagtatctgacagccctggtacagcagggggagaagacagatggcctgggcttccctgtggtgttcagccttgctcacttggcaaacctcagtcgcacactatactccgacctgcactctttagtctcccgcaatgagttggagaggaaggacttcccctacaagaactttcctatcagcaagcggaccggtgggaaacgctggatttcagtcccagtccctgcattgatggctgttcagtcctggatcaatcacaacattctttcaagaaccaaaccgcacgcagcagcctatgcgtacgtgcccaagaagaaaataattcagcacgcgcaaaggcattgcggtgccgactggctcgtcaaaattgatatcaaagacttctttgggtcaatctccgagagacaagtatacaatgtgtttcttggtctaggatatccaaaactgctgtcattcgaaatggccagactctgcacaagggctactccaaagcgacaggggaaaaaatggcggaatgagatctccacgtattcgatcagctcatacaattctgaattcgtcgggtctttaccccaaggagctcccacctctcccgcactctccaatctcgtgtgttttgaactggatgtggccctgacctctctggccaccagtctggacgctacttactctcggtacagcgatgatttgtgcttttccttgagcgaaggaaacaggaaatccgcccttaatattaaaaggcaggcctcgaaaatattacgggagcatggctttagtgataacagcagcaagacgcggattgttccaccgggagctagaaagatgctgactgggctgaatgtgaataacgccagtcctaagataccaaaggaggtgcgtgacagcgttcgtatgcatctttattattcaaagaagctgggaatcccccagcattgtaagaacagaggttttcgaagcatcatcggattcaaaaatcacctcagtggcgtgattggatatatatactctattgacaaggacctcggcaacaagtacaaaatcgaattcgattccctgccatggattgacttcggcatctga

SEQ ID NO: 9086 - RNA, 1137 nt, unidentified
  source 1..1137: mol_type = other RNA; note = synthetic construct
atgacccaatggaaccccaatctgtttcggaaggagggtatcagcaagggttacgcccctaactatctcgccgcactgattgagagagcggagaaaattaatgagaataatgttcctgtggtgttttcgctcgctcatttagccaacctctccgggaccttatatagcgacctccactctttcgtgtctagaaacgccctggaacagaaagactttccgtacagaaactttcccattaaaaagaggtcaggaggcaagcgttggatttcagtacccgtcccacccctaatggctgtgcagagctggatcaacacaaatatactgaacaagataacgccccacgcaagcgcttacgcctacgtgtgtaacaggaatttgattcaacatgcccagcgccattgtggcagtgattggatcatcaagatcgatatcaaggacttctttgggaacatcagcgaacgacaggtttactccgtctttgttgaactggggtacccgaaactgttgagtttcgagatggctcggttgtgcacaagggctaccccaaaaaggaaaggcaaaaagtggatcaactacgctaatgatcacactattgaatcgtataacacaccttatgtcggatccctgccacaaggcgccccaacctctcctgcgctctccaatcttgtcttctctatcgtggataaaaagctttcctctctggcgctgagccatggagcaacttactcaaggtatgcagacgacctatgcttcagcctcatacagggaaatcgacacatctctctggcactcaaaaaggaggtgtccaagatacttaacgagcatggcttcagtgacaatagcaaaaagactcgcatcatcccccctggagctcgcaagatggtaacagggttgtgcatcaattctagttcacccaaaattccaaaagaagtgcgtgacgccgtgcggatgcacttatattacgcaaagaagctgggcattgccagtcactgtatgagcagaggtttccgctccgtcatcggctttaaaaactatctggccggtatgattgcctacgtgtcctcagttgatgtgaagctggggaccaagtttcggcagcagttcaatcttctgccttggatagacttcgatatttga

SEQ ID NO: 9087 - RNA, 1134 nt, unidentified
  source 1..1134: mol_type = other RNA; note = synthetic construct
atgcaatggaacccaaacctgttccgaaaagaaggcaatgcaaggggctacgatgatctttacctgaacgccttagtgtcccagggacagaggactgccgctagagggctgccggtcgtgtttagcttggctcacctggcaaatctcagtaggaccctgtacgccgatttgcatggattcgtcagcagatcgggaatcgagtacccagactttccttataaaaacttccccattgccaagagaacgggcggcaaacggtggatatctatcccagtaccccagctgatggccgtgcagcagtggattaaccagaacattctgaacaaagtcgtgccgcatcctgcggcattcgcttatgttccaaagcgccgtctgatcgagcacgcttcactccactgtggggcggattggattatcaagatcgacattaaggacttctttagcaatatctccgagaagcaagtgtttaatgtgtttctcggtctagggtatccagccttgctctccttcgagatggcaagaatctgcacccgggtcacaccccttcgcaaaggcgctcggtggaagaatagcttcaaggcccattcaatttcaagctatgacagccgattcgttggctctctaccccaaggggctccaacatctcctgcacttagtaaccttgtttgtatgaaaatggacgaagagctgacagaatgggccatatctaaaagtgtgacatactcccgttacgccgacgacctgtgcttttcatttgttaacagcagccggcagtcagcatacgatttgcagagggaagtgaccaagatactccgcaagcacggtttttccgataatggaaaaaaaacccggatcatccctcctggcgccaggaagactctcactggactgaacattaatgccgcgtcccccagtatccctaaagaagtccgcgactctatcagactgcatttgtatttctccgagaagaatggtatatcggagcactgcgagaagcgcggattctactccattattggctttaagcatcacctcttcgggctgatcagttatgtgctgtctgtagacaagtctaaaggggagaagttccgacagcaatttaacgctttaccctggttagattttgaaaattga

SEQ ID NO: 9088 - RNA, 1137 nt, unidentified
  source 1..1137: mol_type = other RNA; note = synthetic construct
atgactcactggaatcccaacctgttccgcaaggaagggtccgccaagggttacgagctcgcgtatctgaatgctctcgtggagcagggggataaaagcacagcacttggggtgcctgttgtattcagtctcgctcatctggccaacctgtctcgaacactgtactccgatctccacggttttgtaaggagagcagagatctctcgggcagactttccgtataaaaactttccgatatcgaagcgtactggcgggaaacggtggatctcaattcccgtccctccactgatggcggtgcagcagtggattaaccaaaacatccttaatagggtggtccctcacgccgccgcatttgcctacgttcccaagcgcaaactgattgaccacgcaaagaggcattgcggcgccgactggctggtcaagattgacattaaagatttcttctccaacatcagcgagcggcaagtgtttgacgtgtttcttaagctgggctacccaaagctgctgagttttgaaatggctaggctctgtactcgtgttacccctaaaagaagaggcgccaggtggacccatgtgaccggagaacatgccatcagcgactatagctcccagtttgtcgggtccttaccccagggtgctcccacgtctccagctctctccaatttggtctgtattgaattggacaaagagttaacccagttggctacagcgctatcagcaacatattctcgctacgccgacgatttgtgcttctcatttgttggcggcagccgccaatcagcatttgatttgaagcgggaagtgagtaaagttctgtggaagcacgggttctcggagaacaccaagaagacgcgaatcgtaccccctggagcccggaaagtattaaccggcctcaacgtgaatgccagcttcccaacagttccaaaggaggtcagagatctagtgaggatgcacctgtactatgctaaacttcgaggtataccagatcactgcaaggagagaggattccgctctgtcatcggatttaaaaatcacctcttcggactgatcggctacgtggctactgtggacgtgactcatggagaaatattcctaagccagttcaatagtctgccttgggtgaatttcgatctttga

SEQ ID NO: 9089 - RNA, 1134 nt, unidentified
  source 1..1134: mol_type = other RNA; note = synthetic construct
atgcggtggaacccccacttttttaggcgcgaaggcgtcaacaaagggtacgactctaactacttggaggccctcgtccgccaggggaatctgtcgagcggagaacggttaccagtcatctttagcttgagtcatctggctaatctctccaaaactctgtacagcgatttgcacgggttcgtgtcccgagaggacatctttcgggaaaactttccctacaaaaacttcacaatagggaaacggtcgggaggacgcagatggatttccgtacccgttccgcctctcatggctgttcagaagtggattagtcagaatatcgtgaacagtgtgctgccacaccccgctgccttcgcatatgtgaggaatcggaggatcctggaccacgcttaccgacactgcggggcggactggatgctcaaaattgacattaaggatttcttcggcaatatctcagagaggcaggtttttaacgtcttccttagcctgaagtatactagactcctgtccttcgagatggccagactgtgcacaaaggcctctccgaatagacagggcgagagatggtgcaacgtggatcttgactattctgttagcggctatagttccaaatttatcggcagcttacctcaaggcgctcctacctctccaggattgtccaatcttgtcttttctcctattgatcatcaactttcagagctcgcccaggccgaaagcgcagtgtattcaagatacgccgatgatctttgtttctctttcaccgggtcctctcgtagtgcggcagttaagatgaagcgcgccgtagccgagatcctatggaacgctggtttttcagaaaacttgaagaaaacgcgtataatccctcccggggcacgcaagatcctaaccggcctgaatgtaaatgactccaccccaacaataccacgagaggtgcgcaacctggtgcggatgcacctgcattatgcgagggtgaacggcattccccagcattgtagggaacgtggatttaggtcagtcattggtttcagaaattacctcttaggcgtgataggttatgtggcaagcattaatgaccaggccggaaagaagttcctgtaccaattcaacgagctgaattggatcgattttggtctgtga

SEQ ID NO: 9090 - RNA, 1137 nt, unidentified
  source 1..1137: mol_type = other RNA; note = synthetic construct
atgactcgatggaatcccaatctgtttaggaaagacggcctggctaagggcttcaatccagaatatctcggagcgctcattgcgcagggagagtcgctggtgtcgaaccaaatgcctgtagtgtttagcctcgctcacctggctagcctgtcacgtacattatatagcgatcttcatggttttgttagtcgttccgatatccagcgcaaggacttcccctatagatcattcccgatagctaagcgctctggcggggtacgctggatttctatccctgcccctccacttatggcagtgcagcagtggatttgtcaaaatgtcttaaatcgggtggagccgcatgctgccgcttacgctttcgtgccacggaggaggctgttggaccacgcacagaggcactgcggtgccacatggttagtgaaggtggacattaaggactttttctctaacatctctgagaggcaggcttttcaggttttccttagactaggctacccgaaactgctgtccttcgagatggcccgactgtgtacccgagtcactcccagaaggaagggggcaaaatggaccaactccaacgacgatcattctatccccgagtatgattgccggttcgtcggcagccttccacagggagcaccaacgtcccccgcccttagtaatctggtgtgtatggacttggatcgcgacctcacagaactggccgtttccaaaagcgccaccttttcaagatacgccgacgacttgtgctttagcctaacctccggttcaagagaggccgccttcgccttgaaacgggatgtctctaaggttctctggaaacacgggtttagtgaaaaccctaagaaaacaagagttgtgcctcctggagcaagaatggtcttgactggactcctcgtaaacgctaatgtgcctaccgtcccccgcgaagtcagggatctggtgcggatgcacctgcactacgcaaagaagaatggtatacccatgcattgcaaagcgcggggctttcgcagtatcttcggctttaagaaccacctgctggggctaattgggtacgtggcaagcgtggataagaaacatggggccgacttctacgcccagttcaaccaactgccatggatcgaatttgatctctga

SEQ ID NO: 9091 - RNA, 1155 nt, unidentified
  source 1..1155: mol_type = other RNA; note = synthetic construct
atgacccgttggaaccctaatagttactacaaggagggtaaaaacaaaggatactcttccaactatctgaatagcttggtagtgcacgggaagaagatagctgccaataacatccctgtgatctacagcctgaaacatctggctcttcttagcgggacaaactacaatgaactgtaccagatcgtcagcagacttgacatcgaccccgagggcccttcccccaattacccttacaagatttttccaatacggaagcgcaggggagggaaacgccttattgcaatcccgtatcctactctgatggctgtgcagcgctgggtaagtcaagagatcctgaataaactgccagtgcacccagcggctttcgcctatgtcgccggtaagaagaatccgttgagggatcatgcaaagttgcactgtgatgctgactggattctgaagctagacatcaagaactttttctcgaacatatctgagcggcagatttataaggtgttcaaaacatgcaactactattccctcctctccttcgaaatggcaaggctgtgtactatgattgtccccagcaggagaaaacgccgatggaacaattcaaagcagttcaagaataagaacctgtatccatgcgatcacataggctttctgccacaaggtgcgcctacttctcccgccctgagcaatctcacatgtatcgacatggacaatgaactcaccaaattagccctcgaaaatggcgccaactactcccggtatgcagatgacttatgctttagttttaccatcagtacccgacgggaccttctaaaatttaaacgcacggcctgtgagctgctatggaagaatggcttctcagaaaacaaaacgaagacaaagattctgccacccggatctaaaaaagttatcaccgggctgattattaactccggcaagcccatgattcctaaggagctcagagatagagtgcgaatgcacttgtatttctcaaaaaagttaggcattcccgagcattgcaaacggagaggctttcgttctatcatcggattcaggaaccatctctatgggttgatactctacattaagtcaatcgatcccaagaaaggagaggtttttagggccgcattcaaagatctgccatgggttaatttcaacatctga

SEQ ID NO: 9092 - RNA, 1143 nt, unidentified
  source 1..1143: mol_type = other RNA; note = synthetic construct
atgaatagatggaatccgaatttctactacaaggaaggcataaaacgcggatttaacacagagtacctggataagctcatagagcaggggagaaaaatccaggagaataacatacctgttctatttagccttgcgcacttggcaagctgctcgcgcactcagtattccgagttgcatagcttcgtagctcgcaccgagtacgggccagagggatacccctataggaatttccctattcggaagagaagcggaggtaagcgatggatttctgtccctgctccacctttaatggcagtgcagtcatggatcaacaagaacattcttaacagcattcctacacacccgacagctttcgcttacgtgaacggaatcaagtcaccgctaaaggcccacgccgagaaacattgtgatgctgattgggtactgaaggttgacatcaagaatttcttctcgaacatatcagaacggcaggtgtatcgggtgtttagaagtctgagttactccaaacttctctcctttgagatggccagactctgcacgcgtatcacccccggaaggaccgggaaaaggtggaacatcgattggaatgaaagtggtgtcgagggctattcttgcacttgtttggggagtctgccccaaggtgccccaagttcccctgcactgtctaacctggtgtgttttgaactcgacacccaattgcatgaactcgccctgtcccggaacgccacatattcccgatacgccgacgacctgtgcttttccttcatcaaatcttcccgggacgaggtctatcagttcaaacgcgaagttaataaagcactttgggataacagcttcaccgaaaatcccaaaaaatctcatattatcccacctggtgccagaaagattgtgactggcctgatcgtgaattctgataagccaagcattccccgcgaattaattgacgcgatccgaatgcacctgttctattcagaaaagtttgggatccccgcacactgtaggaaacgtggctttcggagcgtcattggcttcaggaaccacctcaaaggcctgatcatgtacgtatactcaattgacccaaagaagggcaatgagtttttagagaagtataacaggctgccctggctggaatttgagatctga

SEQ ID NO: 9093 - RNA, 1146 nt, unidentified
  source 1..1146: mol_type = other RNA; note = synthetic construct
atgaaacggtggaatccgtatttttttagaaaacagggcgaagagctcaactacaacaagaactatttggacaaactcattcagataggatctcaaatcgatagcaaactgactcctgtcatattctccctcagtcatctttgtaagctggcttccgtgtcctatcaagaaatgcatgacatcatagcgaggaagaattttacgtccttcggctatccataccgtaatttcaccattaggaagcgatctggcggctaccgatggatcagcgtgccttgtccatcattgatgatcatacaacactggattgccagtgaaattctccgccagatgaaaccccaccaggccgcatacgcctatgtgaacaacctgaccagccccatcaagtcacacgtgcagaaccactgcggggccaaatggatactcaagctggacattgaggatttttttggtagcatctcggagaagcaggtttacaaggtgtttaagaattaccagtacccagatctactgtctttcgagatggcgcggttgtgtaccaaaattagtaggaataggaaaggcaaaaagtgggtcaatgacagaaagaataacgtggagctatcaagttatttctccaaatacattggctgtcttccccagggtgcccccacatccccagctttaagcaatctggtttgcatcaacatggatgaagagctgtctctgctgagccgcaacaacgacgccaattactcacggtatgcagatgatctgtgctttagcttctataccaccaatagacgcaatgtgtacatgtttaaaaagcaggtatgcgaaattctttggaaatatgggttccaagagaacatcaaaaagacacacattgttccgcccggggctagaaaaatcgtcactggacttatcatcaacgaacatgaaccaacaatcccccgggaggtaaaagacaacattaagatgcatctgtactacgcaaagaagtttgggatccctgaacactgcaaaaacaaggggttccgttcggtcattggattcaagaatcatttagagggactgatcaattacgtgacatctgtcaatcctgagcagggtaagaagtatgagaaggctttcctgactttgccttggttaaactataagctctga

SEQ ID NO: 9094 - RNA, 1140 nt, unidentified
  source 1..1140: mol_type = other RNA; note = synthetic construct
atgaaccgatggaatccaaacacttatcacagaaacggcctggaaaagggttttgacccagattaccttctgacactggtcaaatccggaaaggccatcaagagtaaacataagcccgtcatattcacgttgtctcatctcgccaactgtactgatacacaatattcagatctgcacgctttcgttagccggaaaggatactttagtgacaccaatccacactatcgcaccttttcaataaaaaaaaggactgggggtcagagaaccatacacgcacctcaccctgtgctgaagatcgtacaatcttggatcgctcgcaatatccttgctgatgcaaacatccacgaagccgcaaaagcgtacaagaagggcgagtccattgtagacaatgcttctcctcattgtgaggccgagtggctgctgaagctggatatttgcgacttttttcacaactgttccgagcgccaggtgtactacgttttcaagtcaatgaactactcatctctgctctctcttgagctcgcccggctatgtaccaaggtggacgacaaacgacccttacatagatggaataacaccaacaagcagtataaaattgaggaatactccagcttcagggtgggctcattaccccagggagcccctacaagtccggccttgtctaacctaatttgcgaaactctcgacgaaatcctgattatgctcagtttgaaatactccggatgctacactaggtatgcggatgatctgaccttctccttcaacaattccaccagggccaaagtgatggattttaaacgtcaggtgtcgaacgaactcaagaaatttgggttcgagatcaataagcagaagacacgtgtcatcccacccggcgcaagaaagatagttacagggttgaatgtgaatggaagtcagcctagcctgacacgggagttacgggacaagattaaagcagacctctattactgcaagaaatatggcgtcgtgaatcactgcgaaaagaataaatacaagagcattatcgggttcagcaaccatatgaagggtatgattagcttcgtctacagcgtgaatcccgagctggctggcaagtataaaatcaagtatgacgagcttgatcttccgacgttggttctgtga

SEQ ID NO: 9095 - RNA, 1140 nt, unidentified
  source 1..1140: mol_type = other RNA; note = synthetic construct
atgaatcgctggaatccgaacatctatcatcgtaatggcgtagacaaaggttttgagccagattacctgctgacgctcgtccagtccggcaaggctatcaacagcaaacataagcccgtgatattcactttgtcacacctcgcaaatgtgacggacacccaatattcgaccctgcatgagtttgtgagtagaaaaggatacttttccaatattgagccacactatcgcacctttagcattaaaaagaggacaggagggcacaggactatacacgccccccatcctgtcctgaaaaaagtgcagtcttggattgctcgaaatatactggcggatgcggacgtacacgaagccgctaaggcatataaacgaggggaatccatcgttgacaacgccctaccccactgtgaatctgagtggctgttaaaactggacatctgcgatttcttccacaactgttctgaaaggcaggtctactacgtgttcaaatacatgaactactcatccttgctctcttttgagctggctcgcctgtgcacaaagatcgatgataagaggccgctcagacggtggaataataccaacaagcaatataagatcgaggagtatgggagttttcgggttggatcactgcctcagggcgcccctacttctcccgcactgagtaatctcatctgtgagaagttagacgagatcctgttcatgttgtcccttaagtacagcgcctgttatacacgttacgccgacgacttaaccttttcatttaataactccagccgcgcaaaggttctggggttcaaatgccaggtcagcaatgaacttaaaaagttcggcttcgaaattaacaagaagaaaactcggattatccccccaggtgccagaaaaatcgtgaccggactgaatgtgaacggaaacaaacctagcttgacacgggaacttagagataagattaaggctgacctttactactgcaaaaagtatggtgttgtgaaccactgcgaaaagaacaagtacaatagtatagtcggcttctctaaccatatgaacggcatgatttcattcgtgtatagcgtgaacccttccctcgccgagaagtacaagaaacagtatgaggagctcgatctaccaagtttggtactttga

SEQ ID NO: 9096 - RNA, 1140 nt, unidentified
  source 1..1140: mol_type = other RNA; note = synthetic construct
atgaatcggtggaaccccaacacatatcacaagaatggcatcgagcagggattcaaccccgattatctggtgaccctcgtgaaatctggcaacgcaatcaagtccaaaagaaagcccgtgatcttcaccttggcccatctggcaaattgtacagatacacagtattcggacttgtacgcctttgtttcaagaaagggttatttcagcgaatcagaacctcactatcgtaccttctccattaaaaaaaggagtggcggaaatcgaatcatacacgtgccacatccggtcctaaaaatcgcccagagttggatagctcgccacattttagatgatggagatgtccacgactgcgctaaagcttataaaagtggggaatccattatcgacaacgccagcccccactgcgaatctgaatggcttctgaaactggacatatgcgatttctttcataatatctcggagcgccaggtatactacgtgttcagaaagatgcaatactcttctctcttgagcctcgagctggcccggttatgtacaaagatcatagataaacggccaaaccacaggtggaataacaacccgaaaaactacaagatcaaagagtacagctccgatagagtcggttcactgcctcagggggctccaacttctccttccctgagcaatatcatctgtaaagacttggacgagactctgtttatgctcgccctggagtctaacgcttgttacactcgttacgcggacgacctcactttttcatttaataacaccaccaggaaggatattgtcaattttaagcgaaaggtttccaatgagctgattaagtatgggtttaagattaacgctaagaaaacccgcattgtggccccaggcgcgaggaagatagtaaccggcctgatcgtgaatggacctgtccccacgatccctcgcgaacttaaagacaagattaaagccgatctatactattgcaagaagttcggcgtggcaaatcattgcatcaagaacaagtaccaaagcatcattggtttctccaaccatatgcgggggatgattagtttcgtgaacagcgttgacaagaaactggcacttaaatacaagaaggcatatgacgagcttaatctgccaacgctcattttatga

SEQ ID NO: 9097 - RNA, 1140 nt, unidentified
  source 1..1140: mol_type = other RNA; note = synthetic construct
atgaataggtggattccaaacacataccataggaatggtctgatccaggggtatgacaagacatatctcaaaaatctggttcagactggaaatataatctcagggacccaccaccccgtgatctttacactaggacatctgtctaaatgcaccaacacacagtatgacgaccttcatagttttgtgagccgcaaggattacctgtcagaaatcgagcctcattacaggacgttcaacatcaaaaaacgcaccggagggtacagaaacatccatgtgcctcaccccgtgctgaagatcgtgcaatcatggattgcacggaacattctgagacaggtggatgttcacgattgtgccaaagcgtataaggtgggcgaatcaatttacgataatgccctcccacactgtggagctcagtggttgctgaagttagacatcaaagacttctttagcaacatttctgaacggcaagtgtattacgttttcaggaagatgaattatcctgcacttctatctttggagatggcgaagttatgcacgaaagtggatcatctcagagtcggcaagcggtggtctaacaccgagaagaattacgcagtcaaggaatacctgtttgataaggttggtagcctcccacagggtgcacctacttcccccgctctcagtaatattgtgttcaaggagttggacgaactgttattcatgctgtctctcaaccacgaggcctgctatacccgatacgccgacgacttgactttctccttccactcctccagccgtgccgaaatcatcgcctttaagcgccttgtaagtaaggagctgctgaagtttggctttaatataaaccccaagaaaactcgaatcgtcccacccggggctagaaaaattgtaacagggctgatagtcaatacccataaacctagcattccgaaggagatccgggataaggtaaaagctgacctttactactgtgagaaatacggcgtcattaaccactgcgtcaaaaacaactataaatcgatcataggcttcagcaatcacataagtggcatgatttccttcatttattccatcgacccagtgcagggaggcaagtttaagaaagtgtatgataagctcaacctgccgttgttcgttctttga

SEQ ID NO: 9098 - RNA, 1143 nt, unidentified
  source 1..1143: mol_type = other RNA; note = synthetic construct
atgtctatttggagtcccttgctgttcaatgcagagggcaagaagcaaggatatgattgcaggtacctgcataaactgaccgaccagggaaacaagctctccgactctggactgcctgttatttttacactagctcacttatgtgctatggccggtgtaagcttctccctgattcacagttgtgtgagcagaaaatatgacccttacagatcattcaccattaaaaaacgttcaggagggtacaggcagatcgtggtgcctgagcccgagctaatgcatctccagcgatggatcaatgaattcatccttaaaagggccaaagttcacagctgcgccgccgcttatatcagtggctcagacatcaagatgaacgcttccaagcatttgggcgcaaactggttaatcaagcttgacattcagagatttttcgagagcattagcgaacttcaagtctactacatattccatcgactcgggtaccccaaactgctgtcctttgagatggccagaatctgcactagagtcgacacacagtccaataggcactttcgccccagatggaataatcgcatccaccacttcgaaatactcgaatattgtgatagccgtgttggatacctccctcagggcgcccctacttctccatcactctctaacctgacatgccggaaactggataaagagatttatgatctgtcatgccgctctgactgtaggtacacccggtatgcggatgatttcgccttcagctttatcgacttagatcgagagaaagcatccaactttgtaaaccaggtgtcgcggataatcagcagttatggatttaggaagaatgcccgcaaaactaagatcattccaccaggctctaagaagattataacggggttggtgctgggtaacgggaaggtgcatctccagaaggagctgaaggactacatccggcaaaacatctactttgcaaccaagtacggggtggacgaacattgtaaaaagcgcggcttcgtctccattgatggcttctataatcacttggagggcattgtgaattttgcgcttttcatcgagccggatttcggggaaaaggcatttgaagaatttcgggctataaagtggccaagtctgatcgtcggtctgcacgcttga

SEQ ID NO: 9099 - RNA, 1113 nt, unidentified
  source 1..1113: mol_type = other RNA; note = synthetic construct
atgctaaatggcgggccttttaagtatataaaggagtccctgatcaagtcaaatagcatcctttacaagatcaagatctctatatacgtgcggaagttgtcctctaagaatctccctatactcttcaacctaaagcatctgtgtaacataatcaacgtgagctatgttaaaagcaaagacattgtgtcacggaaatattacgcctacaaacatttcactatcaagaaacgaagtggaggtgtaagacacattcacattcccaaggatgagttgaggctcattcagaaatgggtgcacaataacatactgctgaaaaactcttacgacgacagtgcttttgcgtacattagcgggagaaatatcaaaatgcatgccgaaaggcactgcatggctcgatgggtgctgaagattgatctggagaactttttcgaaaacacaaccgagagaaaagtcttccacatcttcaaaaaaatgggctatagcaatatcatgagtttcgatctggccagactgacgaccattcctgtcaatataaaagcaaaggagaagctgaagaagtggaagaacaaatcatcgatcaataaaagcgatcgcattcttggatctctcccacaaggtgccccgagcagtccattgctgtcaaatctctgcttcgccgacctggacagggaaattttttccatcgctaattccgctgaatttgtctatacacgttactccgacgatttgatcttctctacctttgaaggtgaccggatgaaagtgctaaacttactgaaggacgtcaggaaacttctgtcaattggggggtatcggatcaacaacaagaaagtaaagatcctgtctcctggcgcacgtaagatcattactggcctgaacatcaatcagggctttcccaaagtgaataaaagctacataatggaggtcaagaaacatctctattactgcctcaagttcggaccattgtcccactgtgagaagattaattttcgcaacatcgtttccttcaaagcattcttaaagggccgcatcaactacattaagttaatcgatcccgttgtgggacttaagcttagtcagaagtttgagctcattcattggcccattatctga

SEQ ID NO: 9100 - RNA, 963 nt, unidentified
  source 1..963: mol_type = other RNA; note = synthetic construct
atgaatgtctcctataccaaaaccaaggacatagtggatcgcaagagctatccatacaagcatttttcgatcaagaaacggaatgggggctttagaaatatccacattcctcaggacgagcttagactgatccagaaatggattcacaagaacatcctgcttaaaaacaattacaaggattgcgctttcgcatacattccgggcagaaatattaaaatgcacgccgaacggcactgcatggcacgatggcttttgaagatagatctggagaatttctttgagaatacaacagaaaggcgagtatttcatgtgttccgcaatatgggatattccaaaaagatgtccttcgacttcgccagattatctaccattcccatgaacatcaaaaaaaaagagtcaagcgggaaatggaaaaaccgttttccaatcgggcggctggacaggattctcggatctctgcctcaaggcgctcccagttcccccctcctgagcaacctatgctttagcgaactcgataggaaaatcatatcaatcgcggattctttcgaatttgtttacaccaggtacagcgacgacctggtgtttagttgtttcgagggtgaccgtattaaggttatcaagcttctcaagagtattagaaaactcctgtccatgtacggctaccgaatcaacaacaagaagatcaagataatcacaccaggagcccggaagatcataacaggcctgaacattaaccagaatacgcccaaagtcagtaagtcttacattactgaggtgaacaagcacctatattattgtaagaagttcggtccactcagccattgtgagcgcattaaattccgcaacactgtgtcatatagggatcatttaaaggggcggatagattatatccgcctgatcgaccctgtcgaaggaactaaactgttgcagaagttcgagttgatcaattggcctttgatttga

SEQ ID NO: 9101 - RNA, 1179 nt, unidentified
  source 1..1179: mol_type = other RNA; note = synthetic construct
atggagacatggagtacacatcagttgtatcagtcggctgtggcctcgctcgggcttgatgcagccgctgacctgcgggtatactgccaacggctccggttaaagggggtcgccgttgtttttacactgggccacctggctaggattacggacgtgaactatcagactctaagggaatccgtgaataggagaagagagtctgcaaactatagaatgtacgcagtaaagaagcggtccggcggacgcagattcatacacagtgtgtgcaccgatctgtttaaggtacagcgatttatcaatcaggaaatcctccagaaatgtatgccacaccctgcatcttttgccttccacaacagcggcggaatccggaagtgtgccgccatgcattgcggggctcgttggctgttccagtccgatttaacagatttcttctacaatgtgaccgagattgacgcttaccgagtgtttcaggagatcggctaccgacacgtcctggccttcgaactggctagactatgtacgaccacccaccttccacgaagccagatgaggaggctgtatgtggaggagtgggcgtacttcaacaagcatgcccgcaaacagaccggtgatggggaggatgactctgtcaccatgccctatgccgccagatttggcgtcgcgggtgtgttaccgcaaggcgcacctaccagccctatgctgtccaatcttgcagctgcgaaactcgacgaaagcctccaaaactttgccagtaagaatgggttcgtgtacactaggtatgccgacgatattacaatctccgcatcagacctgcccaaatctgtatcttccttgcatcgttcaatcgtccaaattatccgcaaaagcgggtttaaggagaatcgcaaaaagactaggatagcaggacccggatccaaaaaggttgtgctcggattgcttgtggacggtgatcagccccgtatatcaaaggagacttatagacgcattgatcggcacttgcatgctagtctgaaatacggacttgttgaaactgccgtccacgaaggtttcgactcagctttcggctttcataaccacctgtctggcctcgtggccttcgtcaaagacgttgacacaaagcgctgggaggaatttgcgctgcggctgagcaaggtgagggtgccatggagcgaaaactga

SEQ ID NO: 9102 - RNA, 1197 nt, unidentified
  source 1..1197: mol_type = other RNA; note = synthetic construct
atggagacatggagcgctcaccagctcttcactaccgccgaaagaagtatcggcaaaagcgccgcatacgccctgcagtcttacgcacagtccctggaagctaaaaagttgccagtggtcttcactctgcgccacttgtctacgatcacaggagtctcttaccgggttctgcaccagaccgtgaataggaagagggaggcatgtaactaccgcatgtatgccattaaaaagcggtccggtggtcgtagaataatccatagtgtctgtgaagacctcattcgggtgcaggactttgtaaacagagagattcttcagcggtgtcaacctcacccagcctcctttgcattccattcaagtggcggtataaaggaatgcgcttcgatgcattgtggcgcaaggtgggttttccagtttgatctcagtgacttcttctatgatgtaacggaaatcgatgtatatcggattttcgacgatttgggctacagatctctcctggcatttgaactggcgcgtctgtgcaccacaactaagctccccaggcaccttaaacacctgctctatcattgcgctaatcccgataacctgattcaggatttcgaagatgactttgagaaaccggggaatggggttcgccggcttccctatcctgagcgccatggggtggtgggtgtgttaccacaaggagcccctacctcaccaatgttatccaatctagctgctagacgtatggacgagctgctgcagagcttcgctttcgactccggctttgtgtataccaggtatgccgacgatctaacattttctgcagctcgattgcaagacaagcacggcgtgtgctctgtccgcagggaggtgatcgggctgatcagaaaaagcggatttaaggaaaacagtaagaagagcaggatagccgggcccggatcaaaaaaagtggttctgggccttttagtcgatggggacacccctcgaatttcccgcgagacttacagacgaatcgatcggctcctttacggcgccctgcagaatggcttcgagagcgcctccgcgttcaacaaatttgactcagcgttgggcttctacaatcacctagggggactgatcgccttcgtgaagtcagtcgacgagaagcgatggagcgagtttagcaacagaatgaggggaatcgagcaaaagtggggtgattttggagacatttga

SEQ ID NO: 9103 - RNA, 1185 nt, unidentified
  source 1..1185: mol_type = other RNA; note = synthetic construct
atggatgcgtggtcagtgcaccacttatacgagaacgccaagaatcaacgggatatgcagacagctgcgtctctgcgtgactatgcagcccagctcagatcgagtggcctgccagtgatatttacgctaggccatctggccaagatagttggcgtggagactgaaattctgcatgagactgtgaatcgacagcgcgagtctgccaactacagaatgtatgcagtagcaaagcgctcgggaggaaggcgatttattcacgcggtgaccccagaattgtttagggtccagcagtatctccacaaagagatactgtgtggggttaagccacatcctgctgccttcgcttttcattctagtggtggcatcagacagtgcgcttcccaacattgtggggctcgatggcttttccaatacgacctgaaggatttcttttatgagattagcgaggtcgacgtctataggatctttaacggtctggggtaccgcaagcttctgtcttttgaaattgctcggttgtgcaccaccacacggctacccatctcattcaagcggtatctcagggcctcctacagtgagaaacccaacttcgacaacgtggaactacttgatgatgcattctccggatacctgaaattcaagccctacctgcacagccagagaaccggggtattgcctcagggcgctccttcctctccgatgcttagcaatcttgcagcacgtcatctggacgaatccctgcacgaatatgcgtttcagctcggattcgtgtacactagatacgccgacgacattagcatttccgcatacgacttgccaagcaaaatgtccagaggtgatatccacagggccatcgtgcatcggatcaggaaagcccgtttcctcgagaacgaaaaaaagacacgcatcgccgggccgggcagtaaaaaattagtcttgggactcctggtggacggcgactcacctcgcctcagcaaggagacgtatatgaggattgatcgcctcctgtatgccgcaaataagtacggacttgtcaacaccgccaaacacgaaaatttttactcagcttacggcttctataatcacctgtctgggctggttgctttcgttaaggacgtagatatcaagagatgggccgaatttaaactccggttaagcgagctggatgtgccctgggagactacatga

SEQ ID NO: 9104 - RNA, 1137 nt, unidentified
  source 1..1137: mol_type = other RNA; note = synthetic construct
atggagacatggtcagctcaccaactcgtgactgcagcggagccctcgttgggtccagctatcgccgaacagctccggcgctattctactcagctgcgtaggcaagagctgccagtcatctttagtctgcagcatctggcgaaaattacaggggtccagtatcaaaccctccatgatacagttaggcgacggcgggaggctgccaactaccgaatgtacgcggtcagcaagcgcagcgggggaagaagatttattcatgccgtgtgcggcgagctgaaggccgtacagcagttcatcaatgccgagattcttcaacggtgtaagccacacccgtgtagttacgccttccattcctcaggtgggatacggcagtgcgcagctgcccattgtggcgctcgctggttatttcagtttgacctggccgactttttctacgacgttacagaagtggatgtgtataggatcttccacggcctgggttaccgacgtttgctggctttcgagatggccagattgtgcaccaccactcggttgccgaaaacctttcttcagctccccgcaacacgcaggagggacctcactcaggtgggagatcacgaggttgataggataagaccttatcagcgtcaccaacgaggggtgcttccacagggagccccttcctctcccatgctggccaatctagcagcagcagccctggattgcacgatcaccgaatatgcggataataacggcctcgtttacacgagatacgctgacgacattactctgagtgcccgagacttgagatacgaccgtgcaagaatccgccgccaggtgatttccatgatcaggaagtgcggattccgggagaaccctaacaaatgtagaatcgcagggcccggaagcaaaaaggtggtgctgggcctgctagtcgatggcgaatctcctagggcctccagggaaacctatcggcagattgatagattagtatacggggtccggaaatttggcggtaaggctgcagctgctcacttcggcttcgagagcgaatatggatttcgcaatcacttagccggcctggtggccttcattaagtctgtggacctcgacaggtggaacgaactttcagaagtccttcgccacgtaggaatatga

SEQ ID NO: 9105 - RNA, 1125 nt, unidentified
  source 1..1125: mol_type = other RNA; note = synthetic construct
atggaggattggtccgcccaccagctgtttcaggcagcctccgcaagcctggaccgtagtacggctacagccctgtctgcctatgccaggaccctccagagcgctaaactcccagtggtgttctctctgcgacacctgtccgggattgtcggggtcagttacaagatgcttagagaaagcgtaaggcgcaagcgtgaggcagctaactatcgcatttaccgcatcgccaaaagagacggcactttcaggcacatccatgaagttacctctgatctgtttcgcgtgcagacgtttctggcccatgaaatactggcaaaagtgtctccccaccccgccgctttcgctttccacgctggtggtggcataaagaaatgcgcagcacaacattgcggagcgcggtggatctttcagtacgacttgtcgaacttcttttacagtatcaacgaggccgatgtgtatagattattctgtcatctcggctaccggccactactggcgtttgaattcgcccgactgtctacaaccatccgcatgcctccatatatggcggggattattaatatggtgtcaccagaccacaggggaatgccttatgcagatgcttgcaataaactgggggtcttgccccaaggagctcctagctcgcctgccatctcaaatctggtcgccaaagatctcgacgacaggcttacaaaggtggccgtccactacaagcttgtatacactaggtatgctgatgatataactatttccgccatggacgttggcaagggccggtcaagaggcgagattcatcggagcgttatccatgcgattcgaaaatcagggttcgtggagaacgagagtaagacaagaatcgccgggcccggatccaagaaattggttctgggccttctcgtagatggcccccagccaaggctgagcagacagatgtacgaacgggtggatacccgcttatatgcatgtagaaaattcggactcgaggctaccgccgacttttacaagtttgactccgcgtatggtttctacaatcacctagctggattgctctcttttatcaaggacgtggacccgttaagctggaactccttcgcaccgcggtttaaggagatacctcctccctga

SEQ ID NO: 9106 - RNA, 1173 nt, unidentified
  source 1..1173: mol_type = other RNA; note = synthetic construct
atggaaacatggtccactcatcacctgtacaatgatgctctagctgtacacgacactgatactgccctggagataaggtcatacgcccagaatcttatcactaagggtcaccccgtcgtgttcagtctcgaacatctgagccgtatcacacatgtatcatatgccatgctccgcgctacgatagagcgaaaccgggagagcgctaattaccgcatgttcgccgtgagcaaaagaagtggagggctcagatttattcacgctgtgactggcgatttgcagattgtccaaaggttcatcaatcaggagatcttgcagaactgccgaaaccaccctgcgagctttgcattccattcaagtggcggaatcagaaaatgtgcagcgcagcactgcggggccaaatggctgttccagttcgatctctccgactttttttacgcagttaacgaagcacaggtgtttagaatcttccgtgagatggggtacagggagcttctggccttcgagctgggccggttatgcaccaccaccagattgccacgtaacaagcatatgtatcttaagtggcggcctggtcccccactgtttcctcgattcggaggcgaagcaagaggcgaaggccttccctacccacaatcctctgggcagctgggcgttcttccacagggagcccctacctcgccgatgctcagtaatttggccgctggtaagctcgacgaatccctgtctgccttcgccaacgacctgggatttgtctatacgcgctatgcagatgatatcacaatctccgccaccaacattccccgaggtgtggcaattggaacaatatgtcaccgcgttatcgactgtattcgcaaggctggtttcaccgagaatcgcgagaaaattaggattgccgggccggggtctaagaaggtcgtgctgggcttactggttgatgggccccagccccggatcagcagggaaacatataagaggatagacagacacttacacgctgccaaaatctacgggctagaggcgaccgctcaacatgagggatttgactcagcgtttggctttcataatcatctcaccggcctggtgaggttcgtgcacgacgtcgacttgaaacggtgggccgatttttctcaacggctgacaagcattgaagtgccatggcaggcaatgccttga

SEQ ID NO: 9107 - RNA, 1167 nt, unidentified
  source 1..1167: mol_type = other RNA; note = synthetic construct
atggaggtgtggtcagtccatcagttgtttgaacaggctaaggccgaccttggtgtcgacaggtcctctgagctgagaaagtatgcgcagtacctgatccatagtggcctacctgtgattttcagcctcaaacatctaagtaagatcacccgggtgaattatggagttctcagagacactgtggggaggcgcagagagagcgcaaattatcggatgtttcctgtgaagaaacgatccgggggcagacgcttcatccacgctgtttcaggccagctgttttcagtacaacagtttatcaacgccgatatcctgcaaaatgtggctccccacacttccagctttgcattccactggaatggtggaatccaaaagtgtgctgccatgcattgtggcgcaaagtggctgtttcagttcgatctcagcgattttttctacgacataaatgaaatcgacgtgttccgcattttccagcaacttggttacagaaagttactggcttttgaactcgcccgcatatgcaccacaatacacctgcccgcacacctgaagtgcaccttcaaggtccatagatatttccctgagtgccatcccccatacggagtgagctacgatgctggggttttaccacagggcgccccgacatctcccatgttgtccaacctggccgcccgagaactggatgaaagactgtttgaattcgctgtcgcgaacgggtttgtatatacaaggtacgccgatgacattaccttgtctgcccgtgagctgccgtctcgggttagcgttggagacattcacaggcagtcgacccacatcatacgaacctgtggctttcgtgaaaacaagaaaaaaacccgcgtggctggaccaggaagtaggaaaattgtcttggggctgctcatcgacggcgatcaacctcggattagtcgcgagacttacaaccggatcgataggcacctttacgcagccactaaattcgggattgtagagacggcatcccacgagggattcgacagcgcctacggcttctataatcatcttgcagggctcatctcattcgtgaacgatgtggacaagaaaaggtggactgagtttcacgcgcggttatccaaaattacggtcccctggcagacaccatcgggcacacagtatggtgagttctctcagtga

SEQ ID NO: 9108 - RNA, 1185 nt, unidentified
  source 1..1185: mol_type = other RNA; note = synthetic construct
atggaggagtggtccgtgcatcagtttcagcaaggcgcaattgccgcctcagctccgtgcgtggatgacctcgtgaggtacgcccgactgttaaaaaacaatggcttgccagtgatattctcactggggcacctgtgtaaaatcacccgcagcaactataaattcctgcataacattgtcaacagaaaggtcgattcacagaattacagacttttccccatcaaaaagcggagtggtggaatacgccacattcatgctgtggcgggcaaactgtacaaggtccatgactacatcaataatgatatcctgcagtcttgttctcctcacccaagctcctacgcatttcatcgttcgggggggatcttcaagtgcgctaaacagcactgtgagtctaggtggatttttcaatttgacctgaaggacttcttctactccatcagcgaagctatggtcttcacagcgttgaaaaacctgggatacaaaaagctgttggcattcgagctggcccgaatctgcacgactaggcaccttccagcgaataaaattcggtacacagctagattttctaagagcctccccagttattacaacaataagccttatagagagacttatcatcacggcgtgcttccccagggtgcaccaagcagccccatgttgtcaaacttagttgccctaaggttagatgaaacgttgtctgcctacgccgacgaaaatggcctgacctataccaggtacgccgacgatatcacactatccactctcgctctgccttccaaggtaagcgtgggcggaataaagcgcgccgtgattaagattatacgccgcgcaggatttatagagaaccccaagaagatccgagtcgcaggtcctggatcaaggaaaaccgttctcgggctccttgtggaccagtcgagtcctcggatttctagacacacctataagcgtatcgaccggctgctctattccatcagtcagtataaactggccggtgttgccgaacacgatggatttgattcatctttcggcctctataatcaccttcatgggctgatcaactacgtgaaagacgtagactattcccggtgggaagaattcagcaagcagtttcaaccgattaaggagcagttcgagagcgagtttgatgtttccaacacagctcaatttatgctaagtagtacttga

SEQ ID NO: 9109 - RNA, 1188 nt, unidentified
  source 1..1188: mol_type = other RNA; note = synthetic construct
atggaaacctggtcagcgcatcagctctacaccgaagcggaaagctctctcggtgaggcagccgctagaaatcttcaggcttactcagagcagttaagagccaagggactccctgtcatcttctctcttcgccacctggcggagctgagcggagttcgttattggtttctgcatgagactgtcaacaggatgcgcgaggtagccaattatcggatgttcgccattaaaaaacggtccgggggccgcagacatattcatagtgtgagcaacgagttgggcagggtgcagcaatggattaaccaacacttactgcagaactgcaagccgcacgctgctagttttgccttccataaggagggagggattcgtcagtgtgcggagcgacactgtggagccaggtggctcttccagttcgacctggtggatttcttttacgacgtttcggaaagagactgctttaacgtctttaaagggttgggctatcgtcctctgctggcattcgagctcgctcgcatctgcacaaccactaggctgccagcctggtgtccacgggcagaattccatggcgagcaactccgatgggaaaacatctggtgtgaagatgatttaaatcctgtgaaccccaatacatccagaaactttccgtattacgagaggttcggaagacttggcgccctgcctcaaggtgcaccaaccagtcccatgctatcaaacctcgccgcaaagtatctcgatgaatctctgcagcacttcgctaataagaacgggctgatatatacgcgctacgctgacgacatcacttttagtgcttgcaggctaggggtggcaagaggcagggtgctgtggcaggtaaaggatcttataaaacgggcacactttgccgtgaatcccaagaagacacggattgccggccccgggtccaagaaactagttctgggattgcttgttgacggtagcaccccacgcatctctcgagagacatacaaacggatcgaacgactgctgtacggcgccaagcagtttggcttcgaggccgctgccagccactttaaattcgatagcgcatacggtttccacaatcacctgtccggattggtggcatttgtcaaagatgtggacaggaagcggtggcaggaatttaacgccgtgttgctgaatgctaaatcctcatgggggaatgacgtctga

SEQ ID NO: 9110 - RNA, 1134 nt, unidentified
  source 1..1134: mol_type = other RNA; note = synthetic construct
atggaggactggtcgacacatcagctcaaagagaatgcgataatcaagctgggaagcgagaaggccaacgatctgcagaagtatacaacgaacttgaaaatccagtcactgcccgtaatatttaccctaaatcatctggggattatcaccaataccgaatattcctttctctataagactgtctgtcgcgagagagaatacgtgaactatagaatgtttccgatcaagaaacgctccggaggtactaggttcattcatgcagtgtctaagaaactctcaatagtgcagacctttatcaacaatatcatcttgcagagtcagcagcctcacaactgctcatatgcctaccaccctagtggcgggataaaaaaatgcgcagccatgcactgtaatgccaagtggctatttcagtttgatcttgctgatttcttctaccgcattaacgagattgacgtgtataacattttccagaggatgggctacaggaagctgcttagttttgaactcgctcgactatgcactacgatccgtctcccaagacagctgcaatctatgttaaagcaattcaagagcttcagcctggacgactacccattctataataacgatttcattggcgtgttgccccaaggctcaccaacatcccccatgctcagcaatcttgccgcgatggaactggacgaggacctgtacgtctttgctctgaaaaacgggttcatctatacaagatacgctgacgacctcaccttttccgcaatcaatctgcctcagggcatgagcataggcaagattcggtggcaaatcattcagattattcggaaaaactgcttcaaggagaattctaataagattcggatcgcaggtcccggcgccaaaaaaattgtgctggggctcttagttgatggtaatcaacctcgaatctctaaagagatgtacaaaaggatcgaaaagatcttctactacgtcaaccggtttaagtttgagaacaccgccaaacaccttggtttcaactccacttttggattaatcaatcacctgcttgggttgataagctacctgaaggacgttgatagtgatcgttatggattgttcaacaagaagttcaatgaactgatgctgtctctgggatgttga

SEQ ID NO: 9111 - RNA, 1131 nt, unidentified
  source 1..1131: mol_type = other RNA; note = synthetic construct
atggaagcatggtctacccaccatttggctcagcaagccgcaaagactctcggcagtgatgctgcagccagcctccagagctacgcgcaggtcctcatatccaaaggtttggcagtcgtgtttaccctgggccatctcagccggattaccggggtttcttaccaagtcctgcgggatacagtcgatagaaaacgcgacagcgccaattatcggatgtacgccatcaataagcgcagtggagggttacgcttcatccattcagtctctagggacttacttatcgtgcagcgtttcattaatcagcacattctgcagaagtgtgccccccatccgagctcctttgcctatcatccttccggaggcatcaagaagtgtgccaccatgcactgcggagctagatggcttttccatttcgacctgaaagatttcttttacgacatcaccgaaattgacgtattccacatatttaaggctatggggtaccgtaatttgctcgcctttgagcttgcgcgactgtgcacaacgacatgcttgcctaaaggccaagaacgactgctgtttcactcgacgaattcgaaatacaacgtgtatagggatcccaacggaatagtgggcgtgctgccacagggggcacctacttcacccatgctctccaacctggctgcccagaagctcgacgaggaactgagcagttttgcactaatgcatgggtttgtgtatactcgatatgctgacgacattaccttctctgcatcatacatacctaaggggttgaatatcggtaacattcaaaggcagatcatccacattatcagaacaaccgggttcgaggagaacaatcagaaaatccacattgctggcccaggctccaaaaaggtagtgctgggcctgctggtggatggtaacgaaccaaggatctcccgggagatgtaccaccgcatcgagaggtatttatacgcgatcgagaagtacggcctacggaacgtggcctgtcatgagggatttattagtgcttatggattcttcaaccacctgacaggtcttatcgcctttgttaaggacgttgatcagaaacgctgggaagagttcagctctagaatttcaagaatacagactccctggcacctttga

SEQ ID NO: 9112 - RNA, 1149 nt, unidentified
  source 1..1149: mol_type = other RNA; note = synthetic construct
atggagacttggtcggcccatcagctgtataatgacgctaagcaccgctttaaagatatcgaaaaggccagtagcctgcgatcttatgcacagttccttatcgacaagaacctcccagtcatattctctctgaagcacctggccaagataaacgacttgaactacagctttctgagacttaccgttgagcgccgtcgggaatccagcaattataggatgtacgccgtgaaaaagagagcgggtggacgccgattcattcacagtgtgacgaaaaagctgctgaaggtgcagactttcattaacactgagatcttacagtactgtctgccgcaccccagctcatttgctttccacccttcaggaggtattaggcggtgcgcagaacaacactgcagcgctcggtggatgtttcagttcgacattctcaatttcttccatgcaatcaatgaggttgaggtcttcaacatctttacaggtttgggatatagaccattggtcgcgtttgagatggctcgtatctgcacaaccacgcacgtcccaaaccatttaaagccgctcctgtttaggaagtctaacaacacaccctacaacttctatgcgaataagtctggggccatcggcgtgcttccacaaggggcacctacaagtcccatgttggctaatctggtggctaagaaactcgacgaggaactatcgtccttcgtgcggaagcatggctttacatacacccggtacgccgacgacatcactatctcagccgtagacttacccgacaatctctccattggggaaatacacagaagcgtgatcagcattattcgccggtgtaagtttcgcgagaatataaagaaaacccgagtagccgggcccggaagtaaaaaactggtgttgggcctgctggtcgacggcgataaacctaggatctccagagagatgtataaaagaattgataggaacctccatgctctggagaaataccctattgccgatgtggcaaaatacgaaggcttcgattcatcttttgggttcttcaatcatgtatccggactagtggcctttaccaaagatgttgataccgagaggtgggaaaagtttaagaaacgtatagatggcatcgagctcccttgggaatccaagcttgttacttga

SEQ ID NO: 9113 - RNA, 1143 nt, unidentified
  source 1..1143: mol_type = other RNA; note = synthetic construct
atggaaacctggtctgtacaccatctgagccagcaagctacaagcgtgctgggcaagtcaattgcccaggatctgactagctatgcacagcgattacgaagatccggccttcccgtcgtgtttactctgcgtcaccttagccgcatcgtcggcgtcgattatagtctgctgcgcgctagcgttgagagacggagggagtcagcaaactatcgcatgtttgccattaaaaagaggtctggtggccgacgccatatccatgccataaccggtgacttgttcaaggcacagcagttcataaacgccgaaatccttcagaagttgaatccccacccggctagttttgcctttcacccaggaggtggaatcagggcctgtgccgcagctcattgcggagctcgctggctgttccagtacgatctgtccgacttctttcacagtatctctgaggccgatgcatataaagtgttcttcaccgccgggtacagaccccttctagcttttgaactcgcccggatttgcactaccaccagactccccgaccacctgaagcatcatctttgggcgcacagagcatggagggactataaattctacggagatcacactcatgccatgggtgttctcccgcaaggtgcgcctacctcccctatgctctctaatctcgcggcccaccacctggatatcgtgttaacagagtttgcagacaggcatgggatgtcctacacaaggtatgccgacgacctgacattgtcgacgagctcggacctgccagatggcatgtccatcggcaatattcaccgtgctgtcattgggatcatccggaaatccgggttccaggaaaacaaaaagaagattcggatcgctggaccagggtcaaagaagattgtgctcggcctattagtggatgggacggcacctcgtctctcaaaagaaacttacaagcggattgacagacacctgcatgctacacaaaagtacgggttggccaacgtcgcgagccatgagggcttcgatagtcctctaggattttacaaccacttgtccggcctgatagcttttgtgaaagacgttgatctggtacggtggaaagagttccacgaccagttctctaaaatagagtctccaatgaatggaggcgtgtga

SEQ ID NO: 9114 - RNA, 1152 nt, unidentified
  source 1..1152: mol_type = other RNA; note = synthetic construct
atggaggcatggagtgtgcatcatctgagccaagctgtgactccagtcctaggcaaaagcgccgctgaccaccttaaagactacgcacagcgcctccggagagcaaatttgcctgtgatttttaccctgcggcacttggctaaaatcaccgctgttgaatatggagtcctaagggcgacagtcgaaagaaggcgcgagtccgctaattaccgcatatttgcagtgaaaaagaggtcaggaggcagaagacacattcacgccgtgagcggggacctgttcaaggtccagcaattcatcaacctggagctgctacagaagctccgtccgcatcctgcctcttatgcgtttcatgccgagggtgggattcataagtgtgcctcagtgcactgcggagccaggtggctgtttcagtacgacttagaaaacttctttcacgctttgagtgagtcagatgcctatcgggtattcatgaaagcgggctaccggcctttactggcttttgaactcgcccgcctttgcactacaacccggctccccgcccatctcaaacatcacttaagacccaagcgtcacgccgcctccatgaaagcctatcagttttacgtcgagaggtctggggcaacgggggttctgccccaaggtgctcccacatccccaatgctttccaaccttgcagctttcgacttggatgaaaagttgaccgcattcgccgatctgcacggtttcacttatacgcgatatgctgacgatctcaccttttctgcaggcggcgaactgccagagcgaatgagtattggagatatccatcgaactattgtgggcgttatccgtaaatgtggctttcgcgaaaacaccaagaagacacgcgtggcaggacccgggagcaaaaaggtggtgctcggacttctggtcgatggtaccgtgcctaggctcccgagagagacatacaagcgaatcgataggcacctgcacgccacacagaagtacgggctggttgcggtagctgcccacgaatcttttgactcggcgatcggattccataatcatctggctggcctgatagcattcgtaaaggacgtggacaccgccagatgggaggagttccaccggcagttcagcatgatccctgccccaatgtccgccggcacttga

SEQ ID NO: 9115 - RNA, 1149 nt, unidentified
  source 1..1149: mol_type = other RNA; note = synthetic construct
atggaagattggtcagtgcaccatctgcacaaggccgccgagttgaagctgggtgcgagcgaggcagcgcagattagaatctatgcacagcaactcattaggaaaaagatgcccgtaattttcaccttaaagcacttgtctatgattgccggggtggactatctcgccttgaggcggaccgtggagagacgacgtgaggcagccaattatcgcatgttcgctataaaaaaacgtagcggaggcagacgattcatccactctgtcactgaaccccttcaccggacacagcaatttatcaacagcgaaatcctccagaagatcgaaccacacccagcttcatttgcgttccattcaagtggtggcattaggaagtgcgccgaagtccattgtggagccagatggatctttagcttcgatcttgccgatttttttttcaagatatccgaagccaaagcatatgagatcttccataaagccggctacaggcccctgctggcattcgagctggctagaatttgcactaccacccgcttgcccaagaaactgcactacctgcttcgcaacacagacaacgcttggtgtcagaatgagaactgggggaaatatcaaatctatagtaggcatgcctactcaataggtgtcctccctcagggcgctcctaccagtccaatgttatccaatctggccgccctgaagctggacgttgccctaacagaatttgctgataagtacggctttagctacacacggtatgctgatgacctgtccatttcttcttgctcggaccttccatcttccttaagcatcgcaaggatatgtcggattgttatcgggatcatccgcaagtgcggatttgaggagaatcagaagaaaactcggatcgcgggccctggcgctaaaaaaattgtgctagggctcctcgttgatgggcccacgccgagaattagtaaggagacttacaaacgaattgaccggcacctgcacgcaattcagaagtacgggttcgctgaagtagcaacgcatgagaagttcgactcccctataggtctgtacaaccacatccatggattgatctcctttgtgaaagatgtggacccgaagcgctggggagagttcaattgtcagctgctcgctatgccagccccttga

SEQ ID NO: 9116 - RNA, 1149 nt, unidentified
  source 1..1149: mol_type = other RNA; note = synthetic construct
atggaggcttggagcgtgcatcacctcagtcaaaaggcagagcctatcctcggacaggctgccgccgatgacctaaaaacttacgcactccgattgcggcaagccggtctgcccgtcatcttctccctggggcacttgtctagaattaccggggtggactacagcctgttaagggcgaccgtcgagcgaagacgcgaaagcgccaattatcgcatgttcgccattaaaaagagaagcggcggccggaggcacattcatgccgttacaggcgaactgttcaaagcccaccagttcataaacactgagatcctgcagaagctggagcctcatgttgcttccttcgcctttcatgccgacggagggatcaggacttgtgcatccgagcattgcggcgcacagtggctctttcagtttgacctggccaactttttctacagtgttaacgaagcagatgtgtatggagttttcgtgggtcttggatatcgacctctcctggcatttgagatggcgagaatatgcacgactacaagattgcctaagcacttattgccccatctttggacccaccggtcacacaagtctcacggctatcagttttatgctgataggtcaggagctatgggggtcctaccccaaggcgcaccaacgagtccgatgctgtcaaatctggtcgcacgcagactggatgagaagttgaccgaatttagtacccagtatgggtttgtgtacactcgctacgccgacgatctgacactgtcttgtggcgggaatctgccacgtggaatggctattggaaacctccaccggaaggtgaccggcattatccgcaaaaacggtttcagagagaatcttgacaaaacacgcatcgctggaccaggcagcaagaaggtggtactgggcctcttagtggatggcgaggggccgaggatctccaaggaaacatttaagcggatagataggcacctccacgcctccgaaaaatacggtctacccgacgtggcgaaacacgaaaaattcgacagcccctctgggttctacaaccatcttgctggtctgattgcttttgtaaaagacgtggataaggtccggtgggaagagttccatgcccgtttctcgaggcttcagtccccaatgaattcttcagcgtga

SEQ ID NO: 9117 - RNA, 1149 nt, unidentified
  source 1..1149: mol_type = other RNA; note = synthetic construct
atggaagcatggtcagtacaccacctgtctcagaaagccgaacctctcctaggacaggcagccgccgatgatctcaaggcatatgctttgcgcttacgtcaggccggcctgcccgtgatttttagcctcggccatctcagtaaaatcgtgggagtagattacagcctgcttcgtgcaagtgtggagcgcaggagggaggcggctaactataggatgttcgccataaaaaaatgttccggtgggcgccgacacattcacgcggttaccggggagctcttcaaagtccaacagttcatcaattccgagatcctccagaagcggaagcctcatgcagcctcattcgctttccatccggacggcgggattagagcttgcgccagcgaacactgtggcgccaggtggttgttccagttcgacctttctaatttcttttattcagtgagcgaggctgacgtttatggtgtgctcgcagagctggggtactcccccttgctggcctttgaaatggcgaggatctgcactacaaccaggcttccagagcacctgaaacgctacctgtggtctgccctgtcgcataaggtgcgggattatcggctgtacgtagacagatccggagccatgggcgtccttccacaaggtgcccccaccagcccaatgctaagcaatctggctgcgcgaaatctcgacaaagcactgactgccttttcgacacaatatgggtttgtctatactagatacgctgacgatattacattatccagcggaggaaacctgccggagggtatgagtatcggatctatccataggtctgtgataggggttattcggaagaatgggtttagagaaaaccctgacaaaaccagaatcgctggcccaggctccaagaagctggtgctgggacttctggtcgacggcgaggtgcctcgaatctccaaggagacgttcaagagaattgaccgccacctacacgccgcagaacggtacgggttagtcgatgtggccaagcatgagaagtttgattctcccataggtttttacaaccacttggaaggcctgattgctttcgtgaaggatgtcgaacgggagcgctggaaggtgttgtacgacagatttagtaaactgcaggctcccatgaacgttggctcatga

SEQ ID NO: 9118 - RNA, 1185 nt, unidentified
  source 1..1185: mol_type = other RNA; note = synthetic construct
atggaaacctggtctgtccaccagctctctactgccgcgaagtctacattagatgagagcagcgtggtacatctaaaatcatatgctcagtccctgaagagaagcggcctgccagtaatctttaccctgggacacctcagtaaaattatagacatcgactactcgtttctccgagctaccgtcgagagaaggagggagtccgccaactatcgtatgttcgcaattaaaaaacggtctggcggcagacgccatattcatagtgtcacaggagggctattacaggctcagcaattcataaacagcgagattttgcagaagatcgagccccactcggcgtccttcgcttttcacaaaaaagggggaatcagagcttgcgccagtatgcactgtggggccaggtggatgtttcaatacgacctagccgattttttctacagtgtgaacgaggccaatgtctacggcatctttagtgccctcggttatcgacctcttttggcctttgaaatggcgcgcatctgcacgacacttcggctgccaaatcacctcggacacctgctcattgatccacgcactaaggtgaagggcaagttttataacctgtaccagcgttatatggaagtgccggggttcggcacaatgccctacatgtcttctatgggggttctgccccaaggtgcacctacctcaccgatgctgagcaatcttgcagcccggaatctggacgtggaactcactgattatgcagaccagaacggccttatctatactaggtatgcagatgacctcaccctgtccagctcagaaaacttcccagagggtctgtcaatcggagacatccacagatccatagtgggtataatccgcaggaacaagttcaaagagaacaggaagaaaacgcgtgtggccggccccggctctaagaaattggtgctggggctgctggtcgatggggattcccctcggctttccaaggagacatacaaacgaattgacagacatttgtacagcatccagaaatacggcattttgtcagttagcaagcatgaaaagttcgactcccctctgggattctataatcacctttcaggactgattgcttacgtgaaggatgttgacaccaatcggtggaaggaattccatcggcgcctgttagagatcagctaccccattgaaatgaattactga

SEQ ID NO: 9119 - RNA, 1164 nt, unidentified
  source 1..1164: mol_type = other RNA; note = synthetic construct
atggagatctggtcagcccatcagttgtatcagaacgcagagtcttctcttgggaaaactcaggcacttaatctgcggaattatgctagcaatctgaagaagaacaacctaccggtaattttcactctcaggcacctttccaaaatcaccggtgtggactaccggctgctcaggagtacggtcagtcgacgcagagaatccgctaattaccgtatgttcgcaataaaaaagagatctggaggcagaaggcacatccatgccgtgaccggggaaatttttaaggtccagcacttcatcaacagcgagatactgaagaaactggtccctcataatacatcatttgccttccatcccaatggtggcatcaggaaatgtgccgaacagcactgcggagctaagtggctcttccagttcgatataagcgacttcttttacagtattaacgagtcagatgtgtatatggtttttaagaatgccggctatcggcctctcatcgcatttgagttatctcgtttgtgtactaccattcggctcccacagcacctgcaatcgttgatttccgtacccaaacattccacaaaggagtacaagctttacgggcaaaacaaggaaaagaacctgttctgggacatcagcgaaccctggcccttgggggtactgcctcaaggagctccgtcctccccaatgttatctaatctggccaccgtgaagctcgacatcagtctgtctgagtacgcgaacaaatatgggttcacttacacaagatacgccgatgacattacactgtcttgcggaggaacgctacctgactccgtcagcgtgggcaagatcaagaacaacattatcagcatcattcgcaaacaccactttaaagagaatgtgtcgaaaatccgagtggcaggcccaggctcaaagaaaatagttttggggctgttagtggatggcaacgtgccccgccttagcaaacagacctataagcggatagagagacacctgtacagcatcaagaagtttggactgagcgaggtcgctcgccatgaaaaatttgattcacccattggcttctataaccatgtggcgggtctgatcgctttcgttaaagacgttgataatgccaggtggctcgaattttcccagaagtttgtgagtattgaacacccatga

SEQ ID NO: 9120 - RNA, 1164 nt, unidentified
  source 1..1164: mol_type = other RNA; note = synthetic construct
atggagatatggagcgttcatcagctctaccaagaggcggaagccagtctggacaaggaatctgccctaaacctcaggaattatgctaacaatctgaaaaagaggaactttcccgtgatcttttcactgcggcacttgtccatcattacgggcgtggattacagcgtacttagatcaacagtggccagaagaagagagagcgcaaactataggatgtttgccattaaaaaacgctccggcggtcggcgccatatccatgcagtcacatccgaactctttaaggtgcagcactttatcaactctgtgatactccaaaagatcaagcctcacaatgctagttacgcctttcactctgacggcggggtacggaagtgcgcagaacagcactgcggagcgcggtggttgtttcagttcgatattgcagatttcttctactcgatcaacgagtcagacatatacaatatcttcgtctctgccgggtatcggccactgttggcgttcgaactgtctcgcctgtgtacaaccctcagacttccaactcaccttagatccctaatcttactgcctaaatattccgtgaaagagtacaagttctacaaccagtacaataccaatcacaattcgcgaataatccctgagccatttcccttgggcgttctgccccaaggcgctccaagcagcccgatgctcagtaacctggccagtgagaagctggacgtgtcactggcagattacgctgacaaaaatggcttcatttatactcggtacgctgatgatattaccttcagttgtggaaatgacctcgccgacggcgtatccgttaagaaggttcgccgagacgtgatctctatcattaggaagcatcatttcattgagaacactaacaagatcaggatctcaggaccggggagcaagaaagtggtcttggggcttttagtggacggaaacgccccccgtctgagcaaagaaacctataaacgtattgatcgacatctttacgctatccagaagtttggtttaaacgaggtcgccaaatatgaaaaattcgatagccccattgggttttataatcacgtcgccggtctgattgcttatgtgaaggatgtcgacaatgcacgctggctgcagttccaccagaggttctccattataaaccatccttga

SEQ ID NO: 9121 - RNA, 1173 nt, unidentified
  source 1..1173: mol_type = other RNA; note = synthetic construct
atggaaacatggtccacccaccatctctcccaggaggcagaggtactgctaggcaaagaatctgccttgaagttaacccggtattctaacaagttaaagcggaatgatctgcccgttatatttaccttgcgccacctgtctaagatcgtgaaagtagactacaagttgctgcgatccactgttaatcgccaacgggaaagcgccaactaccgtatgtttgcgattaaaaagaggagtggaggcaggagacatatccatgcggtgactggcgaactgttcaaagtgcagcacttcataaattctgagattctccagaagatcaagccgcacaacctctcgtttgcattccacactaatggtgggattcgcaaatgtgctgagatgcattgtggagcccgttggcttttccaattcgatattgagaacttcttctacagcattaacgaatccgacgtctacaaaatattcctggctgccggatacaggccacttttatcatttgagttggccagaatttgcacaactctgtgcctgcccgcacaccttgccagcctgatacagcgaaacgctcacagtaggaagaagtacaaactctacaatcccaacaaaaactgtagcagttcctttctcgacgagtataggccgaagccaatgggagtgctgcctcagggtgccccttcaagtcccatgatctccaatcttgtggctaaggagctggatatttctatggaggaatacgctgacaagaattccctgatatacacccggtatgcagacgatatcacgttgagctcatcttccgatctgcctaaaggggtcagcacagggaagattagacgggacatcatcgagatcatccgcaagaatcacttcaaggaaaacagaaataagaccagaattgccgggcccggcagcaaaaaaattgttctcggtctactcgtggatagcgaacggcctcgcctgtcaaaggagacatataaacgaatcacaagacacatctatgcaatcgaaaaatttggaatcgaggaagtggccaagtatgagaaatttgatagtgctcttggcttttataaccatatctgcggcctgatttcatttgtcaaagacgtcgaccatgagaggtggaatgacttccataagaagatctcgaaaattaccccaccaacgaactga

SEQ ID NO: 9122 - RNA, 1176 nt, unidentified
  source 1..1176: mol_type = other RNA; note = synthetic construct
atggtgagttggtccgcccatcagctttacatggaggctaagagtaagcttggtacccaacaggccaccaatctgagacagtatgcccgcgtgctgcagcgaaagaacctgcctgtcgtttttacattgaatcacctggccaagatcacagggatttctcacaccctgctgagggataccgtggagagagggcgagagcgcaagaactctaggatctactccataaagaaaagcagcggcggcgagagattcatccacgtgatcaacgacgacttggcatttgttcagaagttcattaactctgagatcctccagaaactgacaccgcacccttgtagctacgcatttcatgaatcaggcggcgtccgggagtgtgctgaaatacattgcggggccaggtggctgtttaaatttgacctatgcgacttcttctaccacataaatgaaagacacgtcttcgaagtgttcctgaatgctggttatcgcaacttaatcgcatttgagatggccaggctgtgtacaaccacccggatgcccagcaacttacattacctgcttaagccaaacaagtcaggaatcgagacgcaagacaagaaataccgtttttacaaccagcataatgagaaattaggattgctcccccaaggagcgcctacttcgcctatgctctcaaatctcgtggcgttcaagctagatcagaaacttgaaacgttcgccagggaacatgggctcacctatacccgctatgctgacgatattactttttcgactagtgacgacctgccagagaaaacaagtattggatacatccagcggtccgtcatcaaaattatcagccaatgcggctttcggaataatacgggcaaaatgcacgtggcaggaccaggcagcagaaaaattgtgttggggctgctggtggacggagagaaggctaggatttccaaggccacattcaagcgtgtagatcgcctgctccactctatcaaagtatatggcctcgatgcagtgtccgtacacgagcagtttaagtccccagtcggtctatatgaacatctccggggtctgcttgctttcgttaaggatgttgacactgcccgatgggatgaattcaaaattcagttccaccaggtcacttctccctggactgatgaacccatagtgtcagggagcttgtga

SEQ ID NO: 9123 - RNA, 1149 nt, unidentified
  source 1..1149: mol_type = other RNA; note = synthetic construct
atggaaacttggtctgctcaccagctctttaataaagctacagacaagttggacaacgccgcctctaaaaagcttagatcttatgctctggccctcaaaaatagaaaactgcctgtgatctttacactccggcacctatcccacataaccgatgtggactacagcctgttgaggaagaccgtcatgcggcggcgcgagatggccaattataggatgtttcccgtgcggaagcattcagggggctggcgttacatccaccaagtatcccgcgatttattcaaggtgcagcagttcatcaattccgagatcctccagaaactgagcccacatccgtccagtttcgcattccatagtaacggaggaataaaggcatgcgcatcacagcactgtaatgcccgatggctctttcaatacgatctaaaggatttcttctacttcattaacgagaagaacatttacacgctcttcaaggacagcggctatcgcagcctcctggcatttgaactggcgaggctgtgcacaaccacacatcttcctaatcacctgttgcattatatcaaacaggattcccactttttcaacaactacaatttctacaacgacatcaaatcccgaattggtgtgctgcctcagggagcccccacttctcccatgttatctaatcttgtggcatataagctcgatgaactgctgactaagctgagcgaggaatatggtctggtttacaccagatatgcggacgatattacattctcaagtattgacgactactcagtccaacactcccgctttcgccttcacagggaaattgtgaaaatcatccgtcagaatggtttttgtgagaatacgaagaaaactcggataagtggccccggggccagaaagctagttttgggcttgctggtagatgggtgcgagcctcgacttagcaaagagatgtataagagaattgagaggcttctgtacgccagcaacaagtacggaatcattgaggtcgctaaaaacgaaaagtttgacaccccatatgggttatacaaccatttggctggcctggtttcttttgtcaacgatgtggataaaaacaggtggcaggaatttaatgacctcttctcgaagatcaataacccattcgacctgaaaaccatatga

SEQ ID NO: 9124 - RNA, 1146 nt, unidentified
  source 1..1146: mol_type = other RNA; note = synthetic construct
atggaaacatggagtgcccaccagctgctcaagaaaacgtcactcaagttcgatgacattactgcccaatcactcctaaagtattgccaagaactccagaacaaaaatctcccagtcatttttacccttagacatttaagcaagatcaccaataccgattatttggtgctgaggaagacaatcatgaggagaagggagttagcaaattaccgcatatttagcattagaaagcggtctgggggacgccgatatatccaccaggttacaaaagagttatttcaggtgcagcagtttatcaacactgagatactgcagaaaattcaaccccaccctgctagtttcgccttttactctaatcggggaatcaaatcatgtgctctgaaacactgcggtgcccgctggttgtttcagtacgacctcaaggatttcttttacaccatcaatgagaagaacatctacaagattttctacaaacacggatatcgttcgctgttggcctttgagctggctcggatctgtacgacaacccacctgccgaagcatcttctgtgctacatacatcaggagtacaactattttaacctcgattcctacaagttctacgccgacagccaacagggcgttcttcctcagggtgccccaactagccccatgctgtctaatctggtggcatttaacttggatgaaagcttgtccaagttcgctaatgagcggggcttgatctatactcgctacgcggacgacattacactgtcctcctacaaaaaaagctacactaagtatgagaggttcaatatccataagaacatcgtcaagattatcagacagcatgacttcctggtcaacccaaaaaaaacccgtataattggccctggagcacggaaaatagtgctagggctgcttgtagatggcgacgtgcccagaattcccaaagaaacatataaacgaatcgaacgcctcctgtacgctagtaacaagtatggccttctggaaaccgcacgacacgaaaagttcgacaccccttatgggttctataatcacctgtctgggctgctagcgttcatcaaggacgtggataatagtaggtggatttacctttccaaactcttctcaaacatcgagaacccattttataagaagatttga

SEQ ID NO: 9125 - RNA, 1137 nt, unidentified
  source 1..1137: mol_type = other RNA; note = synthetic construct
atggagatcttcagtgcgcatcagctcttcaataaagcctcatctaaactgggcgacgtgtccgccaagaagttggtatcatattaccagaatttgcagacgcagaatctgccaattatctttacacttagacacctaagcaaaatcaccagtactcactatctggtcctgagaaagactattatgcggaggcgggaacgcgtcaattatcgtatattctctatccgcaagaggagcggtggctaccggtacatccatcaagtgaacaaggagctgttcaaagtacagcagtttattaacagcgagatattacagaagacactgcctcacccggcctcttttgcattccactccaatggcggggtgaaacgctgtgcccttaaacactgcggagccaagtggctgttccaatatgacctgaaggactttttctacacgattaatgagaaaaacgtgtacgagatcttttacaatcttggatacagaagcctccttgcctttgaacttgcaaggatttgcactaccactcgcctccctaaatgcctgaagaactacataaattcctattccaactgtatcaactacaagttctataacaaccatctcctcggcatcctaccccaaggcgcaccaacaagccccatgctgagtaacttggcggcctttgaactggatactctgctgacagacctggctaaaaagcacgatttagtttacacccgatatgctgacgacatcaccttctccacctatttagataagcgtaaggagaaattcaccattcataaggatatcgtcaagaccattgtggaaagtggtttcatcattaacaacaagaagactcgaatagctggacctggggctaggaaaatagtgctggggttgttggtggacggcgagaaacccagggttcctaaggaaacctacaagagaattgaacggctcctatatgcctcaaacaaatatggtctgattgagacagcaaaacacgaaaattttgacacaccatacgggttctacaatcatatctctggactcatggcttttgttaaagatgtcgattttgagagatggaagtatctgaataacgtgttctcgaagatcgaggatcccctcaacatctttattcagaattga

SEQ ID NO: 9126 - RNA, 1167 nt, unidentified
  source 1..1167: mol_type = other RNA; note = synthetic construct
atggagaattggtccgctcatcacctgtttcaaaagtctatcccaattctggggaataggtcaagccaggagttgaagaattatgccatctctctgcatcgccgaaagctgcctgtgatttttacactgcggcatctaagcaaaatcacaaacgttgattacttgctgctcagaaagaccgtgatgcggcaccgcgagatggctaactacagagtgtttactatcaagaagcgcagcggcggacggagatatattcacagagtctcaaaagagctgtttaaggtccagcagttcataaatttcgagatcctgcagaagatcacacctcaccatgcatcattcgcctttcattcaaaagggggcatccatgcctgtgcactttcgcactgcggcgctcgatggctctttcagtatgatttaaaggacttcttctacagcatcaacgagatcgacatttacaacatattcaaggacaatgggtataggccacttttagctttcgaattggctcgcatttgcacaacgaccgccttgcccaaagacttcttcaaactacagaattacctgaactacatcagcaattacaagttcaacaacctgcagaactataaattttacaacaacaggtctgggcttatcggagtactgccccaaggtgcgcccaccagtccaatgctttccaatctagcggcgtttaaactcgacaattccctgactgaactcgcagacaaatacggactcatctacactaggtatgccgatgatattaccttcagttccagctctagtttgcccaggggcaaaataattacggatatccacaaggcaattattaacgcaatcagaaagaacgacttctatgaaaacgccaagaaaacccggattgcaggaccgggcgctcgtaagctcgtgcttgggctgttagtggatggtgccgttccccgtatcccgaaagaaacttataaacgcattgaacgactcttgtacgccataaaagagtacaatctgctcgaagtcgccaagcacgagaagttcgacacaccttatggcctgtataatcacctctccggtctgctggcctttgtaaaagacgttgatatagtgcggtggaggaagtttcagcagctttttctggagatagctccacctaacaatcaaaccatttga

SEQ ID NO: 9127 - RNA, 1134 nt, unidentified
  source 1..1134: mol_type = other RNA; note = synthetic construct
atggaagcctggtccatacatcacctcatcaaggaagccaataggcagggaaatctgagcaaagagagcattatagatctccaatgctacgcacaaaacttgatcaaaaacgacgtacccgttatttttaccctaatgcacctggccttcatcacgaatcttaattatgatttcctgtacggcacagtgagccgcaggtttgacaaatcgaactaccgaatgttttcaatcaggaagcgaaatggtaaacaccgctttattcatgccgcaatcaaaaacctgcatatactgcacaactacatcaacaaagagatcttgaagaacattcctattcacccctgtgcctatgctttcaataggaatggcggaattctgaagtgtgctcaaaagcattgcggatgtgaatggctgttacagtttgatcttaaggacttcttcttcagcataacagagtctaatgtctacaatgtgtttaaatccatcgggtataaggacatattggccttcgagctggcccgcatttgcacaaccaccagattaccccgcagctacaacatgccaagaaacaaaaacgcgtataactataagcagtataagtacgacctcatcggcgtgcttccacagggtgcggcaaccagtcccgcattgtccaatctggtcgccaagaatctagatgaggaacttcaggagtatgctaaaaatctcggttttgtgtacactcggtatgctgatgacctgactttctctaccgtaagtctgcctaacaatttatccattgacactatacggagacagatcatcaagattattcgtaagaaccacttcattgaaaacaaagagaagtcaagaatcgcagggccaggggcgaaaaagctcgttctcggcctgctggtcgatggaaagcagcctcgtatcagtaaggaggggtttaaacggattgagggcctgctttacattatcaagaaatttgggttgcagtccgtggccaaggaacggggcttttattctacatacggcctcatgaaccatctgatcggactgatggcttacctgaaagacgtggatatcgctaaatacaataagatcgaaccgctattctctgagatcaagtcaaggtatggtgaactcttctga

SEQ ID NO: 9128 - RNA, 1131 nt, unidentified
  source 1..1131: mol_type = other RNA; note = synthetic construct
atggagacgtggtccgctcatcacctttttcaagaggctagcaagcagcttgattgtgacactatattcctgttacagaattatgcgctggatttgcgtagtaaaaagcttcccgtaatctttagtcttgggcatctgggaaaaatcaccggtatcgactacgactttttgtataggagtgttaaccggaaatacgaatccatcaactacaacatgttctcaattaggaagagaagcggcgggaacagatttattcatgctgtaaatggcaagctctttaagctccagaagtacctcaatgaagaaatcctgcagaagattaatccacacccaagttcatttgccttccacgcctctggaggcattcggcagtgcgcaaaccaacactgcggatgtaggtggttatttcagttcgacctgaaagactttttctatacaatcgcagagccccacgtgttcaaaattttcaaggagattgggtacaagaagatactcgcctttgaactcgcccgcctgtgcaccacaatccgcttacccaaaaccaagagctcctatatcaagtacaacaaatatgtgtctgagaatactccctacttcccacagaattatattggagtgctgccgcaaggcgcacctacatcccctatgctgtcaaatcttgccgcacgcagactggacgaaatgctgtacgactattctcaaaactacggtctagtttacacgcgatatgctgacgatctggcattctcggcctctgtgctgcctccccataaatcaatcgcgcgaataaagagggatattattagcataatccgccgcaataacttcttcgagaacaacaagaagatcagaatcgccggtcctgggagcagaaagaccatcctcggactgctcgtggatggggagaagccacggctgaccaaacagctccggaacaggatcgaacggaacattttcagcatcgagaaattcggcattcgtgaagtcgccaatcatgacaaattcgagtctgtctacggcttttttaatcacctgtccggcctaatgtccttcattcacgatgtcgatttgactttgtggaataaactacagccgcgatttgctacaataaaaaagttggtggagctgtga

SEQ ID NO: 9129 - RNA, 1125 nt, unidentified
  source 1..1125: mol_type = other RNA; note = synthetic construct
atggagacatggagcgctcaccaccttttcagcgccgccgcaacaaagatcggagttgctcgagctggcagacttgcagcttacgttgccaagctgcaacgccgaaatctgcctgttataaccactctagggcaccttgctgagatcgtgggcgtgtcctatagtttcctgagacagactgtcgagcggaagagagaggccgcaaactataagctgtttgccatctctaaacggtctggcggtcgacggtttattcacgaggtgggcacgcagcttttgatcgtccagcgcttccttaatcaggaagtgctgcagggaatcgcaccacatcccgctagctttgctttccatagtactggaggtattaggaagtgcgctcagatgcactgtggagcctcgtggctcctacacttcgacctcaaggactttttttacagtatcagtgagtggtcagtctatgaagtctttgccagcctccagtatcgccctctgctgtcgttcgagttagcccggctctgcacaacgctgcatttgccgggagcctcccaagcgtatctgcgaccttcaactgccgcccagaggtattccttctaccggaaagacgtgatgggagtgctgccccaaggcgcaccaacctctcctatgttggccaacctggcggcacacgatctcgacgcgcgtctacaggacttcgccgatgccgccggaatgatttacaccaggtacgccgacgacctcaccttctccacagtgcgtctctccgcgccgatctctcagttgcaatacgaagtaagccggcagattgggctgaccggcttttcagaaaataaaaggaaacgcagagtggcaggtccagggtcacgtcgcacagttttaggtttgctcgtggatggcgccgaaccaaagctgagcaggcaatttattgctcgggtagataggcatctgtacgcggccaaaaaatacggccttgaggccgcagcatctagggcagcttttgatagcgctttcggctttcataaccacctgggggggctggtggcttattccatggatgccgagagaaagagaggggcaatgttcttagaaagactgcgcgaaatacccgtcccctggcagaccgcttga

SEQ ID NO: 9130 - RNA, 1143 nt, unidentified
  source 1..1143: mol_type = other RNA; note = synthetic construct
atggagagctggtccgcccaccatctgaataagaaggctctggagacgctatccaatgatgaggtaaaagacttgacgttttacgcccggaatctcattagcaagaatacccccgttatatttacactgaaacatctgagcgagatcatggaaaagcgatatacattcctgcgctctaccgtcgagaggaagagagaacactctaactacaagatgttctcaatttcgaagcgatccggaggcaggaggtttattcatgctgtgtccaatcagttacaacctgtgcaacaatggatcaatacggaaatactgcagaagcaaaaacctcacaacgccagctttgcattccacgcaaatgggggcataaaaaaatgcgcggccatgcattgcggagcgaggtggatactaaagttcgacattagcaactttttctactgtatcaacgaaacagacgtgtaccagttctttgtgagcctcggttaccgtccgctcctggcttttgagttagctcgtatttgtactaccctgcggctgcccatccagcaccagaaatatatcaggtcaagaaattcgagtagattggagtacaagttctattatcaaccagagggctgtcgcggagtcttaccgcagggagctcctacctcaccaatgctgtctaacctgatcgccactaaacttgacgagcagctcacccagtacgccctggaaaacggctttacatatacacggtacgcggatgatctcgccttcagtgcaatcgacttgccagagaaaaagtctattggcaagatccagtttgaaatcacaggtattatgaaggcacagggcttcaaggagaacgaaaagaagacctctgttgccgggcctgggtcaaaaaagatgatccttgggctgcttgtggatggagagcagccccgcttgagtaaacagatgtataagaaactcgaccgctacctctacgcaattgaaaaatttggtctggacagcgtcgccactcacgaaaaattcgattccaccttcggcttttataaccatctttgcggttatatcagtttcgtaaagtccgtggatgctccaagaggggaggagttcgaaaaacggatgaacaacattactcccccctggacttctcacccttga

SEQ ID NO: 9131 - RNA, 1146 nt, unidentified
  source 1..1146: mol_type = other RNA; note = synthetic construct
atggaaatttggtcgttacaccaattgcattccgcctctgtcgaaaaactgggcctctcccaagctaatagcttaagacagtattcagagaatcttaaagagaacaacctacccacaatttttacactgaatcacctggctaagatcactggggtaacatatcacttcctccgctcaacagttctgagaaaccgggagcttgccaactacaagatgtacgcgatcaataaaaaatctggtggtcgtcgacatatccacagtgtgaatggcaagctcctcaaagtgcagacgttcattaacgaggagatactccagaacatcatcacttctaaatccagctatgccttctctaaaggaaaggggataaaaagttgcgcacaagcacattgtggcgcaagatggatcttcaagtttgaccttgaaaacttcttttacagcattaatgaggcccaggtatacacaatttttaatagtctgggctacacaagtctgctgtcctttgaactggcccggatctgcacaactacccggctacctgttgaattgagcaagctgctgaaaagggggacctttgatccctttaactccatcaattcgtacactatttacaacaagaactgttttctcggagttctgccacagggtgccccgacgtcccctatgttatcaaatttggtggctaagtcacttgacaccgtcctgaaggaactggcttctacctacggactgacctataccaggtatgccgatgacctcaccttcagcactagtatggatctaccaaagaatctgtccatcggggaacttcagaggcagatcatacagcaaattcgcaagcagggattcaaggagaattctaagaaaacggtggtgttgggccccggaagccgaaaaattgtgctcggcctgcttgtggatactgccgagcctcgcctgtcaaaagcgatgttaaaaaggatcgacagattggtgtatgcaagcagtaagttcgggatcatagaggcagctgagcatgaaggtttcgactcacccattggctttttcaaccacgtctctgggctcatcagctttgtcaagcatattgacaaccggaagtatcagtactttagctccaagttcccagatttcgatttgcacctgacctga

SEQ ID NO: 9132 - RNA, 1137 nt, unidentified
  source 1..1137: mol_type = other RNA; note = synthetic construct
atggagacttggagtttgcatagactgtatacgtgcagcgcagaaaaactaggcgctgacaaagccaccaaattgaaacgctattccgaaaacttgaaacgcaaaaatctccctaccatctttacccttaatcatctggccaagatcaccggcgtggactatcattttttacggtctacagttctccgtaacagggaaatagcaaactacaagatgtacgcgatcagaaaacgatctgggggcaggaggcacattcattctgtcaatgggaagctcctgaaagttcaaaccttcattaatgaggagattcttcagaatatccctgtctccagttcgtcttacgcctttaagaaaaatagcggcattaaggagtgcgcccaagctcattgtgaagcgaagtggatctttaagttcgacctggaaaactttttctactcaatcaacgagcaccaggtctataagatcttcaaggacctcggttacactagcctcttaagcttcgaaatcgctaagatttgtaccactactagactgccaacaaacttatccaaccttctgaaggtgaagaacaatagtgacttcaattcgtaccgcttctaccagaacaactattgcctaggcgtgctgccccagggatcacccacgagtccaatgctgtctaacctggtagctcagaacctggacaacgcactgataggtttggcctccaattacaatctcacatataccaggtatgctgatgatctgaccttttctactccgataaaccttcctcagaatctgagcatcggaaagctccagcgggaaatcttttatgaaattcgtcgccacgggttcaaagagaataaaaaaaagaccgtgatcctaggacccggcagccggaagatagtgttgggactgctggttgatacatccgagccaagactgtccaaggcaatgctcaaacgaatcgatcggctggtgtacgccgcccacaagttcggtatcattgaggccgcagagcacgagggatttgagagccctattgggttctttaatcacgtgaatgggcttatttccttcgtaaagcacatagatatcaacaaataccactacttctcatcaaagtttcccattttcgagtttgataacttttga

SEQ ID NO: 9133 - RNA, 1140 nt, unidentified
  source 1..1140: mol_type = other RNA; note = synthetic construct
atggaggtgtggtcactgcaccagctgtacacagaatcagtggagaaacttggagctaataaggcgaaacagttgcgtaagtactcgacgaacttaaaggagaacaatctgcctaccatatttactcttaaccaccttgccaagattaccggcgtgacctaccatttcctgagatctacggtgttacggaaccgggaaatcgccaattacaaaatgtatgctatccataagcgcaatggtgggctgagacatatccatagcgtgaacggaaagctgctaaaggtgcagactttcctgaatgaggagattctgcaacacactactgtaagtcgctcttcctatgccttcagcaagaatgggggtattaaaccatgcgcacaggttcactgtggcgcaaaatggatcttcaaatttgacctagagaacttcttttacagcataaacgagtaccaggtatataagatattcaaagacctgggctatacccctctcttgagcttcgaactagcccggatttgcacaaccataagattgcccacaaacatgcattctctgctcaaggaatcaaacaacaccttctttaaggactacaagttttaccagaacaattcgcgactgggcgtgcttccacaaggagcgcccacaagccctatgttgagtaatcttgtagcacgacacctggacaatgccctcaaagaactcgctgataactggggtctgacatacaccaggtatgctgatgatctcactttttctactccgacaaatctgccatccaacctttccatcggcgaactccaaaggaaggtcatctccacgattaggaagcatgggtttaaggagaataaagaaaagaccgtcgttctgggccccggcagtcggaaaatcgtcttaggactcctcgtggatacacacgagccacgcctctcaaaagtcatgttgaagaggattgacagactggttcacgcaagcaataaatatgggattgtcgccgttgccaaacatgagggatttaagtcccccatcggttttttcaaccacgtgagcgggttgatcagtttcgtgaaacacatcgatatgaacaagtatcagtacttttcctctaagttccctgacttcaaatttaatgatctgtcttga

SEQ ID NO: 9134 - RNA, 1143 nt, unidentified
  source 1..1143: mol_type = other RNA; note = synthetic construct
atggagacatggagtgcgcaccacctgttcaagaaagcgacggcccagctgaatgacagcgtcgctttagatttgagtcgctacgcacagtgcctccgtaaccaggagctgccggtgatctttaccttgggtcatcttgctaaaataaccggcattgactacagatttctgcacgccactgtgaacagggaaagagaagccgcaaattaccgtatgtttgctatccgaaagagatctgggggaaaaaggttcatccacgcggtgtccaatactcttagcagcgtccatgagttcctaaaccgggaggtactgtcaaaggtcgatcctcaccccgcctcctatgcataccaccggagtggtggcattagagcctgtgcccaaaggcattgcggcgccaggtggctgctgcattttgaccttaaagacttcttctttacgatacatgaggccaaagtgtaccagattttccgggagatgggctacagagaattgctgtcgttcgagctggctcgcctgtgtacaaccaccagactcccaaggcacttatcacacctgactaagccttccgatccctgtttcaagctgaacgaacttccttatcgaagatatcactctatcggtgttcttccccagggggcctctaccagccccatgctatcaaatctcgctgcaaggcacctggaccaagatctgtacctctttgcaaaggagttgggcttagtgtatacccgttatgccgacgacctcacatttagcgcatatgacctccctcggggctggtccattggaaagttgaagttttacgtggaaaagaccatccggaagcatggattccgcacaaatccgtcaaaattttccgtgtgcggtccagggagtcgcaaaattgttctcgggctacttgttgatggagatcatccacgattgtccaagtggactcggcatcggatcgataggttactgtatagcgtcgacaagttcggatgggaaaaagtagccgagttcgatgagtttgattctctgtatgggtttttcaaccacctgcgcggactgatcgcttacgctaaagacgctgacccaatgcacggcgaacagtaccgctctaggttcgaagagctcatagaacgatttcccgtggagctctga

SEQ ID NO: 9135 - RNA, 1110 nt, unidentified
  source 1..1110: mol_type = other RNA; note = synthetic construct
atggagaattggagtttacacactcttaaccagaaattggaggaagacttctctgatgagcagctgaacacatggattcaatatgcaagaaatctcagaaaacagaatctgcccattatcttcaacctaaaacatctatccaagatcaccaatatcaatcagcatttactttactctgtgatctgcaggtttaaagagaaggactattacaagatcttccgaataaagaagaagactgggggctacagattcatccattcacctaacaatgaattgaagaaggttcagtactttatcaacaagtacatcctctctaaattggatatacacaagtcctgttttagttatcacaaagatggcggggtgctgcggtgcgctgaacaacatactaatgccaagatcctcttcaaatacgacctgaaggacttctttttttgcattaacgagatgtccgtgtatcatctcttcaaaagcttgggctacaccaaaaaactgtcgtttcaaatggcgaggctgtgtacaataatactgattaaagatcacgggaagtacattaagaagtacaaggtcaaggataaagaaattgaactgggagtgctcccacagggagctccgactagcccaatgctgtccaatctgcttgccaatcagctcgacgttaaactgtcacagctggccgacacgaacaacctgatatatacccggtatgctgacgatctcacgttcagctcaaacaaaaagctttctaaaatcgagatccgaaccattaactccaagattctgaagatcattaagtacgaaaagttcatcatcaacaagaacaagatctccattagccgccagggaagccgcaaacaagtcctcgggctgattgtaaacaatgatacccccaagctgagcaaagatcgcaaaaagaagatagacacattcctttacgccatcgagaagttcggttgggagagtacaaccgagcactatggttttcgtgatagtttaggcttttttcaccacttggacggcattatcatctatgcagaacacattgacaaagacctaggaaagaagtatcggaataaactggataaacttctccctaaattgtttaggtga

SEQ ID NO: 9136 - RNA, 1143 nt, unidentified
  source 1..1143: mol_type = other RNA; note = synthetic construct
atgaccatcgtgcccagtcatttgtattacctgggaggcataaaagccaaaagaattcctgccgtgttatccgctacaatggctaaagcagccaagttcctgatcaacgatgtcgtctacatccacaatctgcaacacttagtgaagctaagctctgtggataaggtgtacttggatgacatcatcctcagaaggaagaacgagtatgagcactatactgtcgaaaaaaagagcggagggagccgctttatctcggcccccaaagaggatcttaagcagcttcagaggtggattaattactatatcctccggaacctcaagccgcacccctgctgctactcttaccacaaaaatagctctatatactcctgcgcaatggttcactgttcctcacagtggctagttaagctcgacgtggagaacttttttgacatgacgagtgaacgctcagtgtatgaacagtttatcctcatcggatattccccaatcgtctcatttgcattggcacggatatgtacctatcaacccacctttctgacaaaaaaccactccaagtgggttctctataaaaggaagaatcgtgagttagcgtactcacgagacaacattaagtatattggtcgactgcctcaaggggcgccaacctcacccatgctttctaacatggtgtttttcgagctggacaagattatcttcaaactggtgcagtcccatggcgggctgtacacacggtacgccgatgatcttttcattagcttcccaaagaaagacatgaacaggtctgatattagcaaaatcataggcagagtggttgactacctgcggaaaaagggatattctctcaataagactaagatcaaggtaagtccgccaggggcaaagaagattgtactgggattgaatgtggacaaacatattcctcacttgtccaaagagttcaaaaaaagcatcgattcccatctttatgctctgagcgaatttggccctgtcgcccatgctcgcttcagaggtttcaatagtgtatacgggatgctggagcatattaagggtaagatattcttcgctaagactatcagtcaggactacggcctgaagtgtattcaggaattctacgccgccctggaaaaacacggctttaattga

SEQ ID NO: 9137 - RNA, 1143 nt, unidentified
  source 1..1143: mol_type = other RNA; note = synthetic construct
atgactatcgtgccttctcacttatattatcttgggggtgttaaagcacgcagaaccccagctgtgttgtccgcgataatggctaaatcagcccagtttcatacaaacgacatcgtctacatccataacttgcagcatctggttaagttgacctctgtagagaagacatattttgatagagtgatactacgtgaggtccacgaatacgagcattattcgattgctaagaaaagtggaggctaccggtacatatccgctccgaaagaagacctcaaaaagctgcagcgatggatcaacttctacgtgctgaaaaatctgaatccacatccctgctgtttttcataccacaagaattcttccatctataattgtgcgcttgctcactgcgccagtaaatggctgattaaactcgatattgagaactttttcgacatgactagcgaaaggaacgtatatgaccagttccggctgattggctacagccctattgttagcttcgccctggcaaggatctgtacttaccagcccaagtatttaaataagaatcatgaccggtgggtgctgtacaagcgagatacccaggaactggtgtacagcaagaagaatgtcaagtacctagggagattgccccaaggggcacccaccagtccaatgctctccaatgttgtgttctacgagttggatgagctgatttataagcttgtccaggagaatggaggcctctacacacgctacgccgacgatatttttatctccttccctaagaaggaaatgggtaggaatgacgtaagcaagatcatcggcagggtgatagggtacctcagaaagaaaggttattccctgaacaagaccaaaattaaggtgtccccccctggggccaaaaaaattatccttggcctgaacgtgaacggtgatacgccgcaactctcaaaggactttaaaaacagcatcaactctcacctgtacagcctcgaaacatatggaccagtccttcacgcccaataccgcggctttgattctgtctatggaatgttagagcacatcaagggcaagattagtttcgcaaaaaacatctcgtatgactacggggtgaaatgctatgatgaattctattcagccctggagaaacacggattcaactga

SEQ ID NO: 9138 - RNA, 1143 nt, unidentified
  source 1..1143: mol_type = other RNA; note = synthetic construct
atgaccatcgtccctagccacctctactatcttgagggcatccaggcacgcagaactccgagcgttttatcagccgtgatggcaaagagcgcaagatttcatatcgacgggatcacttatatccacaatctgcagcacttggtgaaactttccttgatagacaagaagtatctgaatgacttgatcttgagaaagacccatgactatgagcacttctcaattaaaaagaagagcggaggacatcgttatattagcgcacccaaggaagatctaaaaaggctccagaaatgggtaaacttctatgtacttaagaacctcagtcctcacccttgttgctatagttatcacaagaactcttccatttacaaatgtgctctggctcattgctcatcgaaatggctcataaagctggacatagagtccttttttgacatgacctctgagttatcagtctacaagcaattcaaatctatcggctatagtccaattgtctctttcgctctaacaagaatttgcacgtatcagcccaaatttctgaccaataaccacgatcgctggattctgtacaagaggaaaaataaggacttcatctacccccgggaagggatcaagtacataggaaggctgccccaaggtgcccctacctctccgatgctgtccaatatgattttctataagacagatgagctgatctacaattttatcaagaaacggggaggcatctacactcgatacgccgatgacattttcatctccttttcagaagaggaattcactcgcgatgatgttagcaacattatcggcaggattgtggggtacttaaaaagcaacggctacagtctcaacaagacgaaaatcaaaatatcccccccaggagcgcgaaaaacaatactgtccttcaatgtgaatgaatctaccccaaagctgagcaaagagtttaagaagagcattgagtcccatctgtacgccctgaacacatttgggccagtgctccatgcgcagtaccggggtttcgattctgtgtatggcatgctcgagcacattaagggcaaaattttcttcgccaagagtatctaccttgaatacgggatcgcctgttttaatgagtttaactcggctctggaaaaacacggttttaactga

SEQ ID NO: 9139 - RNA, 1143 nt, unidentified
  source 1..1143: mol_type = other RNA; note = synthetic construct
atgactattgtcccttcacatctctactttataggaggcgtggaggctagacgcgaaccagccgtgctaaagagcctgatggctaaatctagcaagttccacgatcacggcctcacatacattcactccatccagcatctgtctaaactgatttacaccgatgagaactatttgaagagcatcatattgcggaaatcttctgaatacgaccactattcgatccccaagaagagcgggggaagcagattcatcagtgctccccgggacgagttgaagaagatccaacattggatcaacttcaacgtcctgaaaaatctaacgccacatccttgttgctactcctaccacaaaaaagcaagcatctacaaatgcgcagctatacactgctcatctaaatggctccttaagctggacctcgagacattctttgacatgacatcagaggtgcatgtttataaacagttcaccagcattggctattcaccgatcgtatcatttgcattggccaggatttgtacgtatcagccgaagaagctgactgcgcactattccacctggaagctccatagccgggtaaaccgcaaagaacccttttcccgatcagggatctcctacatcggaagactgccccaagggtcccctaccagcccaatgcttagtaatatggccttctataatctcgacgagaaaatctattcgctggtcaagtattacggtgggctgtattctaggtacgccgatgatattttcatttctttctccagtgctgatattaacaggactcttatatccaagcttgtgggccgtctgatcaatcacctgaaaaaggaaggctacaagctgaacaagaccaagataaaactttctccacctggttcccgaaaaattgtgctaggattgaatgtggacagtgaaacacctaagctcagtaaagagtttaaacgcagcatcgactcacatttatacgcattagcgaagcacgggcccaaactgcacgccttagagcggaactttcagagtgttttcggcatgctggaacatattaagggcaagatcctgtttgccagatctattagtagggaatatggtgataagaagctcaatgagttttacagcgccctggagtcccacggattcaattga

SEQ ID NO: 9140 - RNA, 1140 nt, unidentified
  source 1..1140: mol_type = other RNA; note = synthetic construct
atgacgatagttccgactcacctgtattacatagagggggtgaagaagggacggcctagcagtctccttaaaaaactcgtttataagtctgggctgttggccgagcgtaatctgccctacattcattctgtaaaacacctgtcactactcacaggatgtgacgagaactatctgctttccattatcaacagatcaaataggacatatagcttttacactgtgccaaaacgcagcggtggtgtcaggttcatccacgcacctgatgaagagctgaaaaaactgcagcaatggattaatgcacaaattctgatcaacgtgcccgttcatccctgttgttattctttccacaaggatagctccattaagaagtgcgctgaaaagcactgtggcgtcaagtggcttatcaagatagatatcgagaacttctttgagatggtgagcgaaatagagatctacaaggttttcatcaagttagggtacaagcccataatcagtttagctctggcccgcatctgcacctatgagccgagatacctcactgggttctataacaaatgggtgatctacaaaaagagcaagcgactcccatttacatcagaaaatgctagattctttggcagactaccccagggagctcctacctcccctatgctgtcgaacttggtgctcagtagtctggatgagcgaattaaccgtctgatcaaatacaaaaacggagtgtattctcggtacgccgacgacatctttatcagctttggcgataaagacattaaccgcgtctaccttgaaaaggtcatcggacgggtgacccggtatctggaagactttggctataaagccaacaaaaccaagataaggctgatctcccctagggcactcaaaattattctaggcctgaatgtgggaggggagatcgtaaagctgaattccaattacaagaaggacttacagtgccacttctacggcattaataagttcggcctgatttcccatgcctctcatcgcaagtttaattcagtgcttggtatgttggaacatatcaaaggtaaagtcaatttcgcgtgccagatcgagccagattatggcattccattgaaggaggaattgaaaaacattctcaataagaacgggctttactga

SEQ ID NO: 9141 - RNA, 1143 nt, unidentified
  source 1..1143: mol_type = other RNA; note = synthetic construct
atgacaatcgtccctagccatctctattacattgagggcgtgaaaaaagggagatccccgtccattcttaaaagcttaatcgtgaagagttccttcttcaactacaagaacattccctatatacatgacgtgaagcacctgtcacatctgctgggatgtagccagatcgatctgacttccattattaaacggaactattctggatatcgcttctacacggtgcccaaatacagtggcggtgtccggtttattaattctcccaacgactttctgaagaagattcaaagatggatcaatttcaacatcctcagcaaagtagaggtgcacccttcctgttatagctttcataagaacagcagcattaaaaattgcgcggagaagcactgcggagccaaatggcttgtgaagatcgatatcgagaatttctttgaaatggtttccgaagtcgaggtgtacaagcaatttaggaaattagggtacaaaccgattgtttcgtttgccctttctcgcatatgcacttacgaacctacccacctggtaaacttccagcataagtggattaattacaattcacggaccgattcactgccattctcccgaagaaatgtgaatttctttggacgcctgccacagggtgctccaacaagtcccatgttgagtaacctcgtgctgtcaagtttggatgagaaggttacaaggctaatccggaacaaaaatggtatatatacccgatatgctgacgacatcttcattagcttttccgaaatggccgtggacaggaaattcctcaggcagatcatcgggaagctgatttcgtatttaaactctttcggataccaggctaataagactaagatcaagataatctcaccaagaagcaccaaactcgtactagggctcaatgttgcagaggataaagtctttctgcagaagaagtacaaaaataacctcgagtctcacatctacggcatgaaaaagtttggtttggtgctgcatgccaaacaccgtaagttcaactctgtcctgggcatgattgaccacataaacggcatggtcaactatgcatcttacatcgaacctatgtatggcaacaagttgaaggaaaagataaagcacatcgtgaatatcaatggccttgggtga

SEQ ID NO: 9142 - RNA, 1143 nt, unidentified
  source 1..1143: mol_type = other RNA; note = synthetic construct
atgacaatcgtgagcactcactcgtacttccaaggtggaattaaaaagggccacagtgcgaaacacctgtattctttaatgagcaaggctcataagctcgagtgctatgatataccctatgtgcactccatctatcatttggctatgctgtcaagactccctgttcatctcctgcactcctttaccgacaggaagtcaatccactatacatcttactccattccgaagcgcagtggtgggtgtcggtttctacacgcaccctcagacgagttaaaatccgcccagcggtggattaatgacaagatactgtcccaactgccggtccatagctcctgttacagctaccattccaaggggagtatcttggaatgcgcccagaagcattgcagctcaaagtggctcatcaaactggacatcgagaactttttcgatgaaatatcggaggtggacgtgtacaaagtgttcagaaccattggctataagccaatggtcgcctttattcttgcccgcatctgcacctacgagccttatactgtccggaataacaaacactcttgggtccagtacaataagaactcagacgatctgccctacggaaagaaacatattaagcttttcggccgagtgccccagggagctcctacaagtccaatgttgagcaatctggttctgtacaagcttgacgagaaactctcccacttcgcacagtcaaggggaggcatctattctcgttatgcagatgatctgttcatctcctttggatctgatgattttgataggactaaagctagccaggtcattggtagctgtttaagttctgtgcgcagctatgggtacaaactgaacagaacgaaaattaaggttgtgcctccaggcagtaacaaggtagtactcggccttaacgtaaatggtgacgaggttcgactgacaaagacctacaagaagaaaatagagtctcacatttacggcatcaaaaaatttgggatcgataagcacgccttgcacaggggattcgacagcgtgttctctatgattgaccacatcatcggcctaatcaaccatgccaaaagagtggaaccagaattcggggcggacaagcatgtggaatttcagcggatactcaccaatctgggcctggggtga

SEQ ID NO: 9143 - RNA, 1071 nt, unidentified
  source 1..1071: mol_type = other RNA; note = synthetic construct
atggcccaggctcacaagcttgaatgtctgggcatcccatacattcattcatttctccactttgctcatctgaccaaactgcccgagtcctatcttagaagcgtggtcaatcgacacaacgccagctacacatcgtatgcgattccgaagaggtccggcgggtcccgttaccttcagatcccctcagatgaactgaagggcctgcaaaggtggattaactgtgaaatcctcaacagattgccagtgcactcctcctgctactcctaccacaagaattcttccatcgttcagtgtgccgagagacattgcagttcgaactggctcataaagcttgacattgagaatttctttgacacgattaacgaagtagaagtgtacaaggtattccgtaagatcggatacaaaccattaattgcctttgggttggctcggatttgcacatatcagcccataagcgtattacaaaacaagaaaaactgggtgcaattcaataagaatagtgacgagatgcctttccagaagaaacacatccggcacttcgggagggttccacaaggggcacccacctcacctatgctcagtaatctcgtgttagcggatctagatgagaaactgagttcttatgcacagaaacggggggggatctacactcgctatgccgacgacctcttcatctcttttagccaaaataacttcgaccgacagcaggcttcccaggtcataggaagcgttttgggacatgtgaaatcttacggctataacctgaaaaagtcaaagatcaaggtgattcctcctggatctaacaaggtgattctgggattgtctgttaatgataagcaggtccgcctgaccaagcagtatcgccagaaaatcaatagccacatctatggcattgtgaagtttggtgtggataaacatgcaatacacaggggctttgacagcgtcttcggtatgatcgatcatgtctttggtctgatcaactacgccaaaaccgtggagccggacttcggtcatacaaaataccaggagctgcaggatagcctgagaagttctggcctatcatgcacttga

SEQ ID NO: 9144 - RNA, 1065 nt, unidentified
  source 1..1065: mol_type = other RNA; note = synthetic construct
atgtataaggctcacaaaatggaaaggtggggtattccatatgtgcatagcatttatcacttggcgatcctgtcaggcctttccgtgaacaaactgaattctatcgtcggtcggcaaaagcaatactacactgcctacgccatccccaaacgaagtggaggctcgaggtttcttcacgcaccagatgacgagctgaaaaaactacagcggtggataaatagcgagatcctgattaagttgcccgtgcacccttcatgctttagctatcacacaggcagttcgatcgttggctgtgccgagaagcattgcagctcatcctggcttataaaattcgacatcgaaaacttcttcgatagcatctccgaagtagacgtatataaagttttccggaagttcgggtacaaacccatgataagccttatcctggcacgcatttgtacgtaccagagcgagtcaattagcggagatatcctgcattgggtccaatataacaagaattccgacgaactgccttttaagaaaaagcacattcggttttttgggagagttccgcagggtgctcccacctctccaatgattagcaatctggtgctgtcctctctcgacgaaatgttaagtcagtacgcccagaaaaggggtggaatctactcaaggtatgctgatgatctgtttatatccttctcccagaaggattttgatcgtgttcaggcaagtcaggtgatcggccgagtcttaaactacgtgaagtcttacgggtacaagttgaacaagaccaaaatcaaggtgattccacctggatcaaataaagtggtcctcggcctcaacgtcaatggcgactctgtattgctcacaaagacttacaagaagagaatcgagtctcacatatatggagtgggaaaatttggcattgagcagcatgccctgcatcgcgggttcgactccgtgttcagtatgattgaccacatcaccgggctcattaaccatgctagactaatcgagcctaccttcggggagaagaaacacgaagagttcaagcgcctgctgagtacattaggcctctcttga

SEQ ID NO: 9145 - RNA, 1068 nt, unidentified
  source 1..1068: mol_type = other RNA; note = synthetic construct
atgtccaaggctcatcacatgcagagatggggaacgccctacatacacagcatcgtgcatctatcacatctgagcaacagccgtatcgaactcattaaaagtattgtggaccgaaaggaagatttctacaccgcgtacacaatccctaaacgcagtggagggtctaggtttattcacgcccctaatgctgagctgaagtccctgcagaggtggatcaataccgaaatactttacagactgccagtacacaattgttgcttctcctatcaccgagactcgtctataatcgactgtgctaaaaagcattgcgcctcaagatggttgataaagttcgacattgaaaacttcttccataccataaaggacgtcgatgtttacaaagtgtttaggatgtacggctacaagcctcttatttcctttatgctggcacggatctgcacttatcaaccaaaggtggtcatagagaacaagctcaactggattcttttcaataccaagagtgacgatttagtgtattccaaaaagcacgtgaattttttcggtcgggtcccccaaggtgctccaacttcaccgatgttgtctaatttagtcctgagagagctcgatgagacactgaaccagtatgcccagaaacgcggaggcatttattcccgttacgcagacgacatgttcatttctttttctcaggacaactttgatcgcaagcaagcctcacaggtaatcgggagagtgtttacacatgtccggaaatacggctacaacctcaataagaccaagatcaaagttatcccccccggccaaaacaaagtgatcttggggctcaacgttaacgggcgggatgtgctgcttacacgggagttcaaacagaggattgagagccacatttatggcattaagaagttcggcgtgaaagagcatatgaaatacagggggtttaatagcatctatggaatgatcgagcacatctttggcctgatcaattatgcacgccaggttgatttcagttatggtgagatcaagcacattgaactgacggaacagctgcaggccactggactatggagctga

SEQ ID NO: 9146 - RNA, 1143 nt, unidentified
  source 1..1143: mol_type = other RNA; note = synthetic construct
atgactatcgttagttcacagccctactttagtcaggggatcatcaaaggtcgaaacccccaaaagctgaacgctctgatgagcaaagctcggaaaatgcaagcccagggccttccttatattcattcactccaccatctggcccttcttacgaacacaacagtagattatttgaacaccatcgtttgcagagcctatgacgactacacatcttatcggatccagaaaagatcagggggaagccgcttcattaacgccccatctgatgagttaaaactactccagcgctggattaacaataatatcctgtataacgtgccctcccactggtgctgcttttcctaccataagaatgcgtctattatcgattgtgctcagcgacactgtcagtcaaagtggctgattaagttggacatagagaacttcttcgacactattaacgaagtccaggtatacgagacatttcactccttagggtataagccgatgattgcattttttctggccagaatatgtacctacgagcctaactggataagcacagacaaaaagtattgggtcagttacaacaccaattccgatgaactcccctatagcaagaagaatattaagtactttggcagggttccccagggagctcctacctcaccaatcattagcaatatggtcatgttcagcctggatgacgaaatcagcaacctgatccaaaataaaggggggatatacacccgctatagcgatgacatattcgtgtccttctctcagcctaacttcaataggaacgacgtgagcaaggtgataggcaaaatcttccaaaaatcaaagcggtacggttacaagatcaataagacgaagatcaaagtgcttcctccaggctcgaagaaaatcatcttgggactgaatgtgaatcaacgtaaaccggaactgaccaaggagtacaagaacagaattgaatctcatctgtatggaatgtccaagttcggaatttccaatcatgcacagcacaggaaatttgactctatcttttcgatgattgagcacatcaaaggcttgatcaattatgcaaggcagatttctccaaagtacggtactagtaagtacactgagctcagtgatattctaatgaaagagggcctctcctga

SEQ ID NO: 9147 - RNA, 1155 nt, unidentified
  source 1..1155: mol_type = other RNA; note = synthetic construct
atgggcatcaacctgtctcacgcctatttaaaccaaggcgctagtctcggatatagcatcgaaaaaatagagtccctgcttatcgagtcttatgagctgataaagtcaggctttcctcccttgttctctctgaaccacctggcgaagaactccgacgtagacttttacaatctgaggaaagtgatccagcgaaaatgcacagacttcaaatacttatacgacatccataagatcccaaaaagatctgggggatttaggtttatccattccccgggttctcagatcaaacgggtgcagcgctggatcaatgagtgtatcctctataacagcaagcctcactggcgctgtttctccttccatcccggaggctcaatacttgattgcgcttcaattcactgtgaatctaagtggctaattaagatcgatattgagcggttttttgacagtattaccgagaaacaagtctatgaagttttcgtcgagctcgggtacaagccactgatcagcttcgaactcgcacgtatttgcaccgtcaatcacaagaagaaaatcaagaaacactactacaagaagtgggtgatgtttaataccgacaagggcatgccctataagaaagatgagattaagacaattgggtacctacctcagggtgccccaacaagcccacagttgagcaacctggtgttcaagaaacacgatgagcacattttcgaagtggcaaagaagaacgacttacagtatactagatatgcagatgatatgaccttttccaccgttaagaaaaatttcagcagagagaaagccgttactttcgtgaaggaactgtattcgtacctgagtaagtacgggtttagccccaatcacacgaaattgaaaatagtgcctccgggcgcccataaggtagtgctgggattgaatgtcaatagtaacactcccagactgtcacgtgtgttcaaaaaccgcgtcgagaaccatctgcggtgcatcgagaaatacggcttggaaagtcacaggattcatatccagttcaattccatttttgctctcatagaccatattcgagggcttataaactacgcccttcaaattgatacaaactacggtcacaagctctcccatcggtatctcgaacttctgaggtcaaatggattttga

SEQ ID NO: 9148 - RNA, 1287 nt, unidentified
  source 1..1287: mol_type = other RNA; note = synthetic construct
atgctgagcgtcttttacgagaagtgtctggccctcattcggagccctctgctgcatcagagtctcgtccgtagccttccttccatcaacgaggccgttctgggttccatcaaaggatcttgcatgactatcggtcctactcacacctatatacaagagggactcgagaaaggcatatccgagcagaagctgaaggggattgtgtacgagtctttgaaacgcattaacccgagtgtgccctacctcttttcgttaaaccagatttgtcacattactggagtgtcttatccctaccttcgagagatcgttaggaggaattccactccatacaacttccacagaattcctaagaaatctgggggtcacaggttcttgacgattcccagaacggaactcaaactggttcaaacatggatacataaggaaattctggcctcacaagcaccccactttaggtgctatagctaccactcccagtccagcatcttcaattgtgcccgggaacactgctcctcgaaatggcttatcaagatggatatcgaatcattcttcgactcaatctcagaggtcatggtgtacaaggtatttcgcaaactggggtacaagccccttgtggctttcgaactgggccggatttgcacataccagccaacccacctgcggatcagcaataccctgaagtggaggaatttcaatactaatagtgctgagtatccgtataaacgcaaaggcgtcagtttttttggcagactgccacagggagcgcctacaagcccaatgctatcaaatttggtgtttcaggagattgatgagcagctgcactcctatgcaacagaaaacgggttagtgtatacccgttatgcagatgaccttacattcagcaccatcgacaaccgctttagtcgggagagagcgataaagttcgtatcctacgtaaagaaggtgctacgaacagaaaatttcaacaccaacaaaaccaagctaaagatcatccctcccggcagcaggaagattgtgctgggcctcaatgtcgaagcccaagagccattactctcaaaggggttcaaaaaaagagtggaaggacatttgcgcggaatcgagaaatttggcattcttcagcatgttgaacatagacggtttgacaccatctttggtatgctctctcatatcaacggactgataggctatgccaagcagatcgataacgcttacggcttccgattggaggcttggttcagttctattctgactcagaacgggatagtgaatgagtcttttcaggaatga

SEQ ID NO: 9149 - RNA, 1164 nt, unidentified
  source 1..1164: mol_type = other RNA; note = synthetic construct
atgacaattggccccacccacacgtacatacaggagggcctggaaaaggggattccagagaacaaactgcgaagtatagtgcgagaatccctttcaagaagcaacacgagcgtgccttttgtgttctctcttaagcacgtctgtcattttactggcgcaagttacccctacctgcgggaaatcatcaggcggcgtcagacaccatatagtttccacaagatccccaaaaagcggggaggacataggttccttaccgttccggatatcaagctgaaaagggttcagaattggataaaccgagacatcctggccagtcaaatcccgcacttcagatgttacagctatcactcaaaaagctcaatatttaactgcgctcgcgaacactgtagctctaagtggttgattaagatcgacgtggagaatttctttgactccatcagtgaggtcatggtgtataaggtgtttaggtctttgggttacaaacctctgctcgcttttgagctcggccgcatctgcacctatcaacctacccatctgtccattaaaaacactctcaggtggtgcaatttcaacaagaatagctcgtcctacccatataagcgcatcgagattaatttcttcggccgtttgcctcagggagccccaacctctcctatgctgagcaatttagtctttcaggacatcgatgaggaactacactcttacgcctcttccaatggcgtggtatacactagatatgcagatgacctcacattctcaacaagtaatcgccagttttcaaggaaaaaggcgctcatcttcgtcaacaaggtgaaaaagattttacggactcggaatttcagcacaaacaagtccaaactaaagatcatccccccaggctcccggaaggtcgttttaggattgaacattgatgggcccaatcccctgctcctgaaagggtttaagaaaagactggaggggcacttgcgcggcattgagaaattcgggatacagcagcacctggagcataaacattttcagaccgtatttggaatgatctcccatattaacgggcttattggttatgcttcgcaaattgattacgaatacggtaatagactgaaggccaaattcagcgacattctcactcagaacggaatagtgaacgaatcatttcaatcttga

SEQ ID NO: 9150 - RNA, 1164 nt, unidentified
  source 1..1164: mol_type = other RNA; note = synthetic construct
atgactatcgggcccacacatacctatattcaggaaggacttgagaaaggcatctccgaaaagagattgcagggaattgtgtatgagagcttaaagagatcaaacacttccgttcccttcgtcttctcactcaatcacatctgccacataaccggcgcttcatatccttcgttgagggagattgtcaggagaaatgagacaccgtactgctttcataggatacgcaagaagtctgggggacaccggtttctcacagttcctaatgccgaactcaaggtggtacagacgtggataaacaaggaaatccttgcgagtcaggcccctcactttcggtgctactcatatcatagcaagtctagtatcttcaaatgtgccgaagagcactgttctagcaagtggctgatcaaaattgacattgagaactttttcgacagcatcagtgaagttatggtgtataaggtgttcagaaaactaggttacaaacctctgctggcttttgagttgggccgcatctgtacctaccagcccactcatctgcggattaaaaacacactgaaatggcgctctttcaacacaaactctgcagagtacccgtacaagcgaaaaggcgtgtccttttttggaaggcttccccaaggagcccctacttcccccatgttatccaatctcgtatttcaggaaatcgatgaggagctccatagctacgcctccgaaaacggcctggtatatactcgctacgctgacgatctgacattcagtaccattgatagacgattcagcagagagcgggctatcaagtttgttcggcacgtcaagaaggtgctgagggccggtaatttcagtacgaacaagagcaagctcaaaatcattccaccagggtgccgtaaggtggtgctcggtctgaatatagacggacaaaaaccactgttgtccaagggcttcaaaaaacggttagaggggcacctgcgcgggatcgaaaagttcggcataccacagcacctagagcacaaacgatttcagaccgtcttcggcatggtgtcacatctgaatggtcttattggctacgcaaaacaaatcgattatgagtacgggaataggatggaagcacgtttcagcaacgtcctgacccagaatgggattgtgaacgaatcttttcaaacctga

SEQ ID NO: 9151 - RNA, 1149 nt, unidentified
  source 1..1149: mol_type = other RNA; note = synthetic construct
atggccatcggacctgcacacatctatctgaaaaagggcatcgagaaaggaattgagaaagaaaatcttctcgccatttacaactcatctttgcctcagaaaaggaacttccagacatacatccactctctaggacatctgtgtcattttagcggcgtaaattaccactacctccgcagagtgattaaacgcgaaatcgactgttacgacgtctatccgatcgcgaagagatccggtggttccaggtatatctctgcacccgaggatgagttgaaagacgtccaaagatggatcaatcgctatgtgctgtccaatgttaagccacactggcggtgctttagttatcacgctgaggccagcatatacaacgcggccaaggagcactgtgggagtaagtggatcataaagttagacattgagaacttcttcgatagcgtgagtgagattgctgtgtacaaactgttccgtgaacttgggtataacccactcctttctttcgagttggccagggtgagcaccattgaaccattgcggattaataaaaagatggcagccaagtgggtcaattacaacacctcatccgatgagctaccttattcaaggagaaacgtgaaatactttggacggctcccccaaggggctccaacaagtccgtcgattagtaacctggtctttaagggcatcgacgaggaattccagtttttcagcgaaaagaacaatctgatctacacgcgctacgccgacgatatttgcttttcttcacacgaaaaatccttcaaccgagagtcagcgcagcaggtggtatcttattgcagctccgtcctgcgggctaatgggtatgccaccaaaaagctgaagactaagataattccccctggcgtgaggaaagttgttcttggctttaatgtggaccacgatgagcccaagctgacaaaagcctataagaagcgactggaaagccatataagaggcgtcgaaaaatttggggcaatcgctcacgctaagcataagaagttcgattccgtgctgggtatgctcgagcatgtgctcgggttagttaaccatgctaagttagtggaatacggatacgccgtaggcctgaaaaataagctggacactgcaaaacagcgtcagggattcatcggctga

SEQ ID NO: 9152 - RNA, 1071 nt, unidentified
  source 1..1071: mol_type = other RNA; note = synthetic construct
atgacgataaattccacccacagttacatagctacaggactttcgaagaacattgacttgacatttctcgagaatatcatctccgagtcaaatagccagaagtttaacaatcggacctatatacacgggctgaatcacatttctcacctaactggagttgactatttcttcctgcacgatattatgacccgcaaggagaacccttacaagatattcttcattcgcaagaacttagggaaccgcgagatcaaagaacctaatcagcggctgaaattggtgcaacgaaccatcaatcagcaagtgctgtctaaaatcccagtgcactggagatgtttctcttaccataagggggcttcaattgtcaaatgcgcatccgagcatttaggggccaaaagtctggtgaaattcgacatctccgacttcttcggcaacataaatgagctcctggtttacaaatccctcatcaaactcaagtatagcggtagctcgtcttatgccatggccaggttgtgcacacatccgaattccgagaacgataactttggcgtgttgccccaaggagcgcccactagtccaagcttaagtaatctcgtctttttcgatgtagactgcaagcttcagaggctggcacacaaaaacaatctaatctactcccgatacgccgatgacattactttttcaagcttcaacgatctctcccgtcaggagttcctggatttgaagctgagcgtggtaaaaatcctgaagtatcataacttcgaactgaatagggacaagatcaaatttatctcatctagcactcccaaatttgtgctgggaattaatgtgggcggcgaaaccctaaagctgagcaagcggtacaagaacgatattgactgtcatatttacggactgaaaaagtatgggctcgtcgagcacatgaggcatagagagtttacgtctgtttttggcatgattcaggaactttttggtaagatcaaccacgctaagagcgtcgaagaatcttttggtctttcaagagaaagtgaacttagaaacttcatccagacaaagggcctgtttttcaactga

SEQ ID NO: 9153 - RNA, 1065 nt, unidentified
  source 1..1065: mol_type = other RNA; note = synthetic construct
atggctatatcatcaacccatagctatcactcagtgggcttgcggaagaacattaatcccgctcttctgaagaagatcatcttagagagcaatagccagaagctccacaaccgcacatatatccacgatctgaaccacatatctcacctcagcggagtggactctctcttcctgtacgacgttatgatgcgaaacaataaaccgtaccatagcttcgagatgaaaaaaaaaaacggcacacggaccataaaagtccctaacgataagctgaaagtcgtccagcgggtcatcaatcaggaagttctgtctaagattccagtgcactggagatgtttttcctaccacaaaggtgcaagcatcgtgaaatgcgcaagtgagcatctaggggcacaatccttgattaaattggacatctccgacttttttggtagcatagatgagtttactgtgtataaggccctgcttaagctcaaatattccccacccagtagctttgctatggcgaggctgtgcacacaccccaataagagtggcgaagtctccgttctaccacagggcgcccccacatccccttccctttctaatatcatcttcttcgacattgactgtaaactgcagaagttagcctctaagaataaccttatctacagtcgatacgccgatgatatcactttcagctcgttctataagatggatcgttcgaccttcctggagattaagctctcagtagttaagattctgaactactacaggttctctctgaacaagaaaaaggtgagattcattcactccggaatgcctaagtttgtgttagggataaatgtgtctgggactacgctgaagttgtccaaaaaatacaaaaacgacatcgattgccatatttacggcgtaatcaagtatggtctgcaccaccatagtctgcatagagaattcgctagtgtgttttgtatgatccagcatgtgttcggaaagatttatcatgccaagtcagtagactacgacttcgggatttcaagggagcaggaatttcgcaattatctccacacccaaggactctttttttga

SEQ ID NO: 9154 - RNA, 1146 nt, unidentified
  source 1..1146: mol_type = other RNA; note = synthetic construct
atgacaataggccccactcactcctacctaaagaccggattaagtaaaggatttagcaaggagaaactgcttacaatactcgagagcagccatgagaaagaatccaagagtctgagttatattcactctctgaagcacatttcacacatcaccggagttcattacatcgtgctgcgaaatattgtgttgcggaactcgaacccctacctggtgtacaatctcaaaaagaaggtatcaggctatagggatattagttcgccaaatgacgatttgaaactcgtccaaaagtggattgctcagaatatccttatcaacattgaaccccactggcgttgctatagctaccacaagggcgcctccatcatcaagtgtgcccaagagcatgtggagagcaaatggcttatcaagctggacattaacaatttcttcgggtctattcaggaatcccaggtctacgacgtgttcaagtcccagaattacaactctttagtcagctttgagatggcgagattgtgcacaatcaatacggagtttgatcactccagctcaatcaagcattgggttaaataccggaataagcgctctaccagcccttattcatcactcaaaataaagagattcgggcatctgccgcaagggagcccaactagtcctcacctgtccaacattatatttaagtccgccgacatcgaactccagtctattgcccagcgctatagcctcgtgtacaccaggtacagtgatgacctgtctttttccacaggtgacaagaagttcaatagaaagcatgcaaaagctttcatcactgaagtgagtaagatcctgaaaaagcaccactatcagttgaactctaagaaaaccaaaatcatccccccttcaaagtctaaagttattctaggcctgaatgtagatggtgatacgccaaaactgactaaaagctttaagcagaggttaaacttccatattcggggcatacaggaatttgggataatagaacactctcagcattcccacttcaattccatttttggcatgatcaacattatctcagggaaaatcaacttcgcaaagagcgtcgacattaactatggaaacaaaaccgagctgatcttcaaaaagatcctccaacaggagggtcttatctga

SEQ ID NO: 9155 - RNA, 1215 nt, unidentified
  source 1..1215: mol_type = other RNA; note = synthetic construct
atggtgttcagctactctaactcgtccgtggtcgtcagcgtgatcgttggggtggctgagcagaacctgagtatcaagggaagctttgtaaccataggacccacccacacctatatctacgaggggattagaaaggggtacagcgaaaatcaattgttggagattatttcccgatcttcaatacagaagtcaaatggtgtgagctatcttcacagcctgaaccatatatcatacatcaccggcactcactacctgttccttcggagtgtcgtggataggaccacactgccctataagcagtttaccatccctaagaaaaacggaggggaaaggaatgtgtcctcaccagttaagcagctaaaaattgtccagcgctggatttgcacacacatcctcgccgacaaaattccacactggaggtgtttctcttttcataagaaggcaagcatcctgaattgtgcacgagaacactcaggtgcgaagtggttaatcaagatcgacatagagaactttttcgatagcatcaaggaaaatcaaatctactccgtgtttaaatccatgggctacaattccctcgtgagcttcgaattggctagactttgcacgctgtccagtgaaatcagtacttccgagctgatcaattctaacaccaagcagctcccttataaacggcaggaaaactttacaacaggtagactgcctcaagggtcacccacttctcccatgctctcgaaccttgtattcgacagtctggatgtaatcttccagcggctcgccgagaaaaaaagcttcgtgtatacaagatacgccgatgacatttgcttcagcagttgccagcgctcactgggccgggaagagtgtttgcagattatcaagattgtgtccaggattcttcggtctaataactaccaaatcaaccgcaaaaagttgaaaatcatcccgcctgctaccactaaatccgttctcggcctgaacgttgattgggacacgccaaaactgtctaagcagtttaaaaagcgttgtcaatttcatgtgagaggtattactactttcggactggccgagcatgctaaatatcgtaggtttgaaagtgtctacggcatgattaagcatgtttatggcctcataaattactgcaagcaggtcgagccatcttatggcgcacgcttagagattctactgataacagccttagagaaagagggattctcctga

SEQ ID NO: 9156 - RNA, 1140 nt, unidentified
  source 1..1140: mol_type = other RNA; note = synthetic construct
atgaccattggccccacccacacatatatacaggaaggaattaggaacggctacagtgaggcacagcttagtgacctgctaaaactgagctcattgcagaaggaaaaaggtattagctatcttcattcgcttaaccacattagccacattaccggggctcattatctgttcttacgagcaatcgtcgacaggacctctagtccttacaaacagttctcaattccaaagaagaacggtgggactcgcaatgtctcggcacccgacgaacagctgaaaattgtgcagcggtggatctgctctaacatccttagcaaggccccccctcattggagatgcttttctttccacaagaaggcatctatcataaagtgtgctagagaacatagtggagccaaatggctggtgaagatagacatcgagaatttcttcgatagcatcaaggagacgcagatctactccgtttttaaatctatgggctataactccctcgttagctttgagttggctcgcctgtccaccgcgctatctgaaagcccggctgacgagacaaataacgaattctccagagcttccatcgagagtctgccttataaaaggcagcaggggttgttaggaggcaggctcccacaaggcgcacccacatcccccatgctgtccaacttggtctttgagaaactggataatatcttccaacggctcgccgaaaagaaaagttttgtgtatacacgttacgctgatgatctgtgtttttcatcctgcaagacttcacttaagcgtaatgattgcttgcagatcatcaagatagtatcacgagttctccgggcgaactcataccaaatcaaccaaaagaagctgaagatcattcctccagggactaccaaatctgtgctggggctgaatgtggactggaatagcccaaagctctctaaacagtacaaaaagagatgtcagttccatgtaaggggtatagccgagttcggcctggccgagcacgccaaatatcgccggtttgaaagcgtgtttggtatgattaaccacgtgtacggactcattaattactgtaaggatgtcgagccatcctttggagccaatttagagacgctcttcactaacgccctggaaaaagagggcgtgcgctga

SEQ ID NO: 9157 - RNA, 1179 nt, unidentified
  source 1..1179: mol_type = other RNA; note = synthetic construct
atgcaacgtgtaagtcctaaccagatacataggtgcgccgagctgaagtcatctaatgaggagtttatccaaaaactggtgaaggatagcagaaagctatattccaaaggcctccctatcatctttactctgaggcacctgagcaagctcacagatgtgaattttaagtacctgcactctattgtcggcaagaagattaacccctacaataatttcagcatcaacaaagcacgcggcgggaaaagaaatatatcgtcacccaacttttacctgagacgcgtgcaggactttatcaaacaggagattttggacactaactatgtatcgtcccagattagtgagagcgtttttagctatagaaaggcattatccatagtcgataatgctaaattccacataggggcgaaatggattattaagacagacatcgagaacttctttgatagcattaaggaatatcacatctaccatttcttccattctctggggtacgcatctttactttccctagagctctcccggctggtgacctggccgtcatttgatattaacttcgatctcggcctgagccaggatcggtccctgaatgaggatattacttttacctccaagtacaagttctactgttcttctgatgttattggctccttgccccaaggagcgcccactagtccacagctcagtaacattatcttcagccctattgacgaaaaattcaaaatccttagcgaagagtatggatacatttatacacgctatgccgatgacctctttttttcaacccgaaataacatcgacatcaactcagcccgaaacctgcttaatgaagtgcgttacatactaaacagttccaactacaagatgaacaacaagaagacgaaaatcatcctgccacgggctaagaaggtgataaccggaatcgtcatcaccgacgacaaaattctgttagacaggaagttcaaggacgaaatcaagatgaatatcttctttgccgagaaaaatggacttgaagctcagaggaaattcatcaagttccacggtaacacacataccttccttaaatatctcttggggaaattgaatttcgctaaccaggtggaaccagactttgccaatatctggaaaaaacggctgttgaatctggccaagaattctggtttcacgatgatatactattga

SEQ ID NO: 9158 - RNA, 1173 nt, unidentified
  source 1..1173: mol_type = other RNA; note = synthetic construct
atgcagcagctgagtccttatacctttttggatctcgctgaagcgcgtggatactctgaagcatacaaagacgctatttccaatacggctgacgcactgtcacgctccggttgtccaatcatcttcacgttggggcatctcgcagccctagctgatgcagactatagctacctgcacagcatagtctccaggacaatcgatccatactgtcactttagtatccccaaacgcaacggggacagacgagccataagcgccccgcacgataagcttaaatccatccagaaattcattctggatacaatcctcaacagcagtggtgttgtggccaaaatctcacagttttctttttcctatcgggagaagatttctatatactctcatgctgagaaacacgtcggcgccaaatgggtggtcaaaattgacatcaaggacttcttccccagttttaccgagattgacgtgtacagactcatgtgttcactggggtatgcccccttgctctccttagaaattagtaggattctgacctggcccaaaaacgatctttttcttcaggatgaggaggccgagactaatcatcaaaaactcttagagtccaagtataagctgtataacggcagcgttaagaagatcggagtattgcctcagggcgcccctacatctcccatgctctcaaatctgctgttcaaggaatgcgacctgttgattaacgaagcggcgaaagaatatggctgcctatacacacgatacgccgacgatctgattttttcggccaatcgcctgagcaagcaaaaagctaaggagctgatcagctatctgcggattatcctcaagtgcaacaagtttgaaatgaatgacagcaaaactagggtgtactttcctgggtctaaaaagatcataactggcctttacgtgaataacaaccggccaacccttggtaagaagtacagagatgctattaagaagcacattttcttcatcgagaaattcggaatccagaagcaagccgatcatgctggatcaaaagacgcaaataccttcctagcccacctgatcggcaagatcaacttcgccctccatatagagccaaattttgcattatcccagctgcaaaagctgaaaaatgctcttaagaaggcaaactacataaaccagaagttctatccgtga

SEQ ID NO: 9159 - RNA, 1143 nt, unidentified
  source 1..1143: mol_type = other RNA; note = synthetic construct
atgaaaatctggcagcccgccttatatcgaaaaaccgctctgaagaaaggattgtccctgtcaattatcaataacgccatcaagatttacacgcactttagcaagactcctttcccctgtatcttgacaatcaaccatctatccaagatactgaacatcccctacccggcactgaagagatatacatacaatcagatcgacaactacaaacatttctctatccggaaacgctccggcggaactcggcgcatctacagcccaaactataacttactcagaatacagcagtggattaatcgagagattctgcagaaagatactaacatctccgatttcagttacgcctttaggaagggactcagcattagagattgcgcatcaatccactgtaaccaatcttggctcattaagttcgacattaagaactactttgagagtatatctgagatcgatgtgtacaattacttccataaactcggctacaataaattacttagcttccaactcgcgcgcatttgcactgtcaatgacagcagaaataaaaccattgatacactgccatcgaaattcatctatcacaagaataagcagtacaaattcctgcagaatagtgaaataggcttccttccccaaggcgccgccacctctcctatgctcgctaacctgatcacatcacagctagacgaggacatcaataactttctgcagagcatcgatcttgacttcaattatagtaggtacgcagacgatatttttatctccaccaatagcaagcaaatagacgatacacacattaggaaggtactgaactctgtgtattccataataatcagtcatggttttgagccaaacaaaaataagaccaagatatttcggcctggcaaatgcaaaaacattctggggattaacgtgaactcatccgacgtgaagttgacaaaacactttcgtaatatcctcgaatgtcaccttttctatttcaagaaggataagattcagcataccctgaatagggggtttaatactgtttttggggctacggcttatattcacggtctgttgtcatatgccgaacagattgactctaactatgtcaagaagctgaaaaagaagtaccagatcgataccgacttctttaacatctga

SEQ ID NO: 9160 - RNA, 1008 nt, unidentified
  source 1..1008: mol_type = other RNA; note = synthetic construct
ttgactctgtcccacctcgctcgagagacagagactaagtggggataccttagaagcattgtccagcgccaaatcgacgactacacagcaatccgaagactgaaacgagatgggacgtacagagcaatctgggccccaatgccctctttgatgcatgtgcagcggtggatcttgagtaatgtcctttcgggtttaaagtttcacgacgcggcctacgcttatcgtaggggccgctgtataagagattgtgccgaacaacacatcggggcccggtggctgctaaagatggacctgcataattttttcggaaccattgaggaagcaagggtgtatggcgccctgagggggatgggttatcccgctctgctggccttcgagatggcaaggatttgcaccaaacctctctggctcgatgccgacaagaggtggctcgaagggaggggtgttgatgcctatggttccccactacggggcgtattaccgcagggagctcccacctcaggggcattggctaacgctgtcgcctttagcatggatgcgatgctgcgccgcctggctgacagtaatggcctgtcttacaccagatacagcgacgatctgaccttctctagctccgggccttttgaacgtgcaagtatagtgaagctggtgacagaggtggaacgggccatttccctggctggcttcgttgtccatagaaaaaaaacacgcgttgtcccgcctggagcgcgcaagatcgttctcggcttgatgctcacggagcgggaggtacgtctggtgccagaattccggtctaggttagacaatcacatccggtgcgtggacaaatatggcccagctggccatgcagccgccagaagattcgattcagccctgtcaatgataaactacgtggatggatgcctcgcttttgcacttgacattgagcctgagtggactgccgatcgcaaccagaggtggcttgatgcgctttatcgacacggacaccccgtgaaccgagacggctga

SEQ ID NO: 9161 - RNA, 939 nt, unidentified
  source 1..939: mol_type = other RNA; note = synthetic construct
atgaacgagtactccagtataagaaggcgcaagcaggatggcagctttcgggaaatttctgccccaaaccccaatttgatgcacgtgcagcgttggatgctgtcgaatgtcctgactggcctccagtttcacgacgccgcgtttgcttacagaagaggcctatctataaaacattgtgcggaagtccacgtgggcgccaattggctgctgaaaatggacttgcataatttcttcggcagcatcgaggaaagcagggtgtacggtgtgttgcgtcggcttgggtatcctgctttgctggcactggagatggcccgaatctgcaccaagcccatcacccttcctggtatgaccaagccgcgcctcagtggtaggggagttgaagcttattccacaccaaataggggggtgctgccgcaaggagctccaaccagtggggccctggctaacgctatcgcatttcgactggatactatgctcgcttctatcgccgacgaaggcggactgacatacacgcggtacagcgacgacctgacctttagctcatatgagggactctcacggacagccgtctcaaagttaatcctgcagattgagcatgccatatctctcgccgggttcgatgttcacaatgggaaaacacgtattgtaacccccggagccagacaaatcgttcttggtctgatgctgactcctgaggccgtgaggctattaccagagttccgccaccagcttgataaccacattagatgcgtggagcgatacggccccgctgcacatgcgaacacgagacgcttcgactccgccctctccatgattaactatgtagacggatgtctcgccttcgcagtggatatcgaacctgactggactgctcggcgcaagattaggtggcgggcagcattagggcagcatggccaccccgtcgcacaggatgcgtga

SEQ ID NO: 9162 - RNA, 1128 nt, unidentified
  source 1..1128: mol_type = other RNA; note = synthetic construct
atgtcaaccccttctccccatttgtatcagaaggctgcgattgcagctggagtgagtgcgagcgtggccaggagagcaggatccgtgtcacgggatattcaggccagtggggctttccctgtcctgacactgagacatctagctcacgagacgggcgcctcttacggctatttaaggagaattgttaaaaggtatgccgacgagtaccagagcatccggcgaatcaagcgcgacggcactttcaggctcataagcgcccctaaccccatgttgatggacgtgcaacgctggatcctggaacatatcctgaataccctgccacgacaccccggtagtttcgcctatcaccggggcatcggtataagacagtgtgcagagctccatgtgggctctaggtggctagtaaagatggatctgcacaatttcttcggtgagattagggaaaaccgggtataccgcgtcttccgccaactcaattacccagccttgctgagtttcgagatggctcggctttgcactcgcctggatcgaatcgacccttttactgaagcagtcgagcgcggcgtcggctcttatgacgatggacgcctgggaagacttccgcagggagctcccacatctggggctctggcgaatagggtggccaccgatctggacaatgaactgcagaacctggctgacggatcggggtttatctattcacggtactcagatgacctcacctttagcagccctgccccattttcccgacccgaagggatgcgtctcatttccgcagttagccgggctgcctctttagccggcttcgagccccaccgtagaaagacaagactcgtgccgccaggcgcccgaaagatcgtgcttggattactggttagcgacacaggcgtgaaacttttgccagagtttaggagacaaactcagaaccacatacgggccgcaggtaagtttgggatccagcagcactcctccaaacgtaacttccattccgtactttccatgataaatcacgtcgatgggaggctcgcgtttgcatacggtattgatccagagtggacgattcctgaaatgctggcctggaccgaggtgttggaaatgaacgggtacccctcggttgcaaaagcttga

SEQ ID NO: 9163 - RNA, 1125 nt, unidentified
  source 1..1125: mol_type = other RNA; note = synthetic construct
atgaccaagctttcctctcacctgtatctggctaacggaactcagctgggacgcgatgccgaggtgttacggagggcatctatcgctaatgccgcaatggtgaaatcaggggtcagacctattcttaccctgaggcatttcgccagggacagcgaactctcttatgactacttgcgcaaggtagtccggagaggcgtagatgactacgagactattaaacgcaagaaagatgatgggtctttcaggtttatctcctctccccgacccgacttgatgcatgcccagcgatggctcctcgagcatgtcctgggaaatctagatctgcacgaggctgcctttgcctatcgtaaaggagtgtcaatagtccactgcgcagaagttcacgtcggggcaaaatggctggtgaagatggacttacataacttcttcggcgaaatttcagaatcccgggtctatagcgtcttccgaaacctgaatctctccccattgttgtccttcgaaatcgcccggatttgtacaagagtgccgagtgaagcagagatgacaggcaaggtgcgtctgtttagcgcttacagtcagcacgctgagggagtactccctcagggtgcgcctacgagcggtgctattgcaaacgctgtagctactgcccttgatgtgaaactcgacgcgatagcctctcggcgcggctttgtgtacactaggtactccgacgacctcaccatgtcgacacatgaaaagatctccagagatgatgcgagtaagctgatcgccgactttgcgcgcgctatacacggcgccggatttcgcgttcatagtaataaaacgagagtgatcacaccaggcgcccgcaaggttgtgttagggctgctcgtcggtgataggaacgttagactgctgcccgagtttaagcggcaagtgttgaaccacatcagaggggtgaggaataatggcctggttgcacacgccgcacataggcggttccgaagctcactaagcatggttaattacctagacggctgccttgccttcgcccacggtgtggacagagagtgggctgctgcagccaccagctcatggcgtgaggcccttaccaacgatggcttcctggacagtgcaggggtgtga

SEQ ID NO: 9164 - RNA, 1014 nt, unidentified
  source 1..1014: mol_type = other RNA; note = synthetic construct
atgagcaaggacccagcttcagtggcatcactcggcgagctggccaccctgacagaaacgccttactggtacttgcgtagcattgtcgagcgccgcactgacccctacatgtctcttcaaagggccaagagaggaggtggcgtgcgcccaatttcagctccagagcctccgctgatgcacgtccagcggtggatacttcacaatgtactagatggactagatgaacactctgccagttacgcgtaccgccgaggccgatccatagctcactgtgccaaagcccatgtcggggcaaggtggctcgttaagatggacatccataactttttcgggactgttaccgaacagagagtgtataaagttttccgggacctggggtacgagcggcttatcagtctggaaatggcacggttatgtacacgagaggagatgaagtcttccacaagagctccgggtttccgatatacagcagttccctcctacgtcagtggcaccattggcgtgttgccccagggagcaccaacttccggggctttggccaatgcagtggctaccagaattgacagggccttaagtgggctgctgggcgaccgtggcattacttatacccgctatagcgacgatcttacgttctctaccagggatggtttcgatcgcgtgcgtgccagcgacctcatctcccaggtaactggcgtcgtacagagctgcgggtttcaggtgcacaagaaaaaaacccacgtggtgcccccaggagcgagacatgtggtgctcggattgctggtgacagaaaacaacgtgaggctgctccctgaaatcaggaggagaatcgagcaacacgtcagaggggtcgagggctttggtgtgcggcatcatgctgaccaccggggatttgatgatccttcggccatgatcggctatgttggaggttgcctgtcttttgcgctctcagtagatcctgactgggccgcacccatgtataggcggtggatgaaggccctgagcgctccctggtga

SEQ ID NO: 9165 - RNA, 1131 nt, unidentified
  source 1..1131: mol_type = other RNA; note = synthetic construct
atgagtattgacgcgccacatctctaccggaaggcagcacttgctgcgggacgctcaaatgcagcagttgaagccactctttcacgtgcccacaccacagctctccggggtgctgtgcccatctttagcttaggccacctcgcccggctgtccaatgttgattatcagtttctccatgatgtggtgtgcaggaaggtggacccctatcagtccatcacaatgcggaagccatctggaaagattagacccatttcagccccgaatcaggaattaaaagcagtacaacaggtcatcctgtatagagccttacgcaacctcgacccgaatcccagcagctttgcctacaccaaaaacttgtcggttctggactgtgcgaaacggcacgtaggcgctaggtgggtgataaaaatggacctgagggatttcttctcatccgtggatgaacgaagcgcttaccgcacgttcatcaaacgtggttacgctagtctgatggcgttcgagatggcaaggatctgcactcgggataggagccctagaaggggagctagagagtatgtggaccgctaccctagaattcccgggtatgcatgcggctctgtgggcatgctacctcagggcgcgcctaccagtggtgccctagctaatgaggccgccagaccactggaccgaaagctggcctccttggccgcatcatctggcggcatctacaccaggtattccgatgacctggccttcagctgggcccaggacgtcgatcgctctcatctgcatgggtttgtctctaacgtcaccgagctttgtgctttgcagggcttttccgtgcacaggagaaagacacggatcctgtcccctgggagccgtaaggtcattctcggactcctggtcgatgagagttctgttcgactgttgccagagtttaaacggcgcgtggataaccacataagatgcgtagctaaattcggggctagcaagcacgcagaagagcgcggtttcatgagcattttcgaaatggtgaaccacgtggacggatgtcttgcctacagtcatgggatcgaaccagggtggacagaggttcgaaacacgaagtggaaggaggccctgtcgaaatccggaatacaatctgccacttga

SEQ ID NO: 9166 - RNA, 1092 nt, unidentified
  source 1..1092: mol_type = other RNA; note = synthetic construct
atggccgacggtggcgacccttcggtggtgaatcgcgctacagccgaactcgcacggctgaaggcccaaggcgcttatccggttctatcgcttgcccacctcgcccacgagacaggtgcatcttactcatatctgagggaaatcgtgaaccgaacccgagacgcctacgcctctgtggctcttcccaaacggtccgggggcactcggcctatttccgtgcctgagccaatactgatggatgtccaacgctggctgctgtccaacgtgctgaatagagtgcccgagcatccagcttccttcgcatacaggcagggggtgagcatcgtgcagtgtgctgagcaacacgtaggcgcgcagtggatggtaaagatggacttgcataactttttcggaaccgtacttgagagctccgtttaccgcgtgttcagaaccctcgggtatagcaagctcgtggcttttgagctggccagaattaccactcgtgcggaaggaaatatacgggcatcaggcagtgagcacgtaattggagattacagtatgcataaccagggtgttttgccccagggaggccctacttctggccagctcgccaatgcagccgctggtcgtctggaccgcctgttacaggcctatgcgacgagatctggcctggtgtatacaaggtacagtgatgacctggccttctcaggacatagtacctttagcaggatgaaggcgagcggcgttatcggggaggtgtctggactggtgagaagggctgggttcgaagcccacagaacgaaatccaggttagtcccaccaggggctcgcaaaatcgtcctaggtctgcttgtcgacgatagcgttcgtctccttccggaggatcgacggcgaatcgaagtccacctgcggggctgcgaaatctttgggttggcaaagcatgccgcacaccgcggatttgattccgtgttctcattcattgatcacctagacgggtggatctcttttgcattgggcgtcgaacgggccagagctacagtttggcggcagaggctccgccagattttgagcgcagatggactgcccgccgacttactcaggagagtcgcttga

SEQ ID NO: 9167 - RNA, 1125 nt, unidentified
  source 1..1125: mol_type = other RNA; note = synthetic construct
atgcgcccacctcatttgtattacagagacgggattgccctaggggttgatcccgacgtgttggaacgtgcagccgatgagagggctcgcctgagggctcaaggtgcctaccccctcttatccttggcacatctggctcacgagactggtgcctcctacacatatctgcgggaagtcgtgtcaagaacaagagatccttaccaggatgtagcgattcccaaagcagacgggggaaccaggcctatctccgctcccgaacccatactcatggatgtgcagcgctggatcctgaagcatctgctggagaggaccccaacacacccggccagcttcgcctatcggccaggaaccagtatagtgcattgtgcagaacagcacgcaggcgcatcctggatggtcaagatggaccttcatgacttctttggcactgtgactgaaacgtctgtgtatcgggtgttccgccgtcttggctacgcaaaactagtgagcttcgagctcgcgcggatcacaactcgagcccagaacgcaaggtacgccccatggctcgccggaaaccggaccatcagggcctacagcgttgacgcagagggggtgcttcctcagggaggtccgagctcaggtcagctggccaatgctgctgccacaagactggatagactgatacagtcgtttgctctcgaggctgggctgacctatacgcggtattctgacgacctgatgttttcttcccacgccgcgtttcgaagggtcgatgcagtgaatgtaatccggagagttagcggactgacccgtgccgctggctttagccctcaccgcaacaaatcacgcatcgttccacctggcgcccgaagggtggtattgggcttactggtggatgacagtgtccgcctgcttcccgaacacaggaggagaattgaagttcacatccgggcttgcgagaagtttggattggccgagcatgctgcgcatagaggattcgactctgtgttcagttttgtcgatcaccttgacgggtggattagtttcgccctgggcgtcgagcgggatcgagctatggtgtggagatctcgattcaatcacgtcctctcaggcgccggcctcttatccgctattcaacgcgtatga

SEQ ID NO: 9168 - RNA, 1125 nt, unidentified
  source 1..1125: mol_type = other RNA; note = synthetic construct
atgatccctccacatctttaccatcagcagggggtcaatttaggcattgaaccatctgcccttaagagagcttccgctgagagggccagactccgagctcagggagcctatcccatcctgtcactgggccatctggcctcggagacaggggcaagttactcctacctccgcgagatcgtaagccgcagccgcgatccgtatcgtagcattgccatacccaaagccaccggagggacccgacccatttctgccccagaacctattcttatggacgtccaaagatggatcctgagaaacatccttgataaattgcctatgcaccccgcctcctatgcgtaccggtcaaagacctccatagtgcagtgcgcatctcagcacatgggtgcaagatggcttgtgaagatggacctacacgatttttttggaactgtgggcgaacagtcggtgtaccgcgtattccgtaagctcggatacaataaactcgtttctttcgaactagcccggattaccacacgtactgaggacctggagagggcaccttggctcgctgctaacaccgtcataggatcctacgcggttgccggtatgggggtacttccacaagggggcccgacatccggaagtctggctaacgccgccgctacgcggttggatcagctcttgcagaagttctcactgcagcggagcctgaactatactagatatagcgacgatctcaccttttcaagcctggacgcattcgaccgactcacagcggaaagtgtggtgcaagaggtgagtggcttggtgaggaaggccggcttcgtaactcaccgcgctaagacgcggattgtcccacccggatctaggaaggtggtcctggggctgttggttgacgactccgtgcgcctgatgccagaacacaggcggaggatcgaagtgcacttgaggggctgtgagaaatttggcctggcgaaccacgctgagcataggaaattcaattctgtttttgctctggtcgatcacttagcaggctggctcgccttcgcattaggtgtggataaggttgtcgcactaagctggtgccggagatttaataaaatcctggagcgagagggtctgccccctatgcctcatctggtgtga

SEQ ID NO: 9169 - RNA, 1131 nt, unidentified
  source 1..1131: mol_type = other RNA; note = synthetic construct
atggcggacgcaagtccacatctgtatattgcacagggtttggcacaggggcatgcagctgaagtggtgtctagagcctccatcgtgcggtcccgccttctcgctaatggcgtccctcctatcctgagcctgcgtcatttagcacagctgaccggcgtgtcatacggttacttgcgagagattgtagggcgagtgcgggatccttacctcgatatcaaccgccggaagagagatggcggcattcgggagatatccagtcccgaaccggtgctaatggatgtgcagaggtggctgctccacaatgttttttcgagcgtccccatgcatcccgccagcttcgcataccagcgggatagatccatcgtccagtgtgctgaacagcacgtgggggcgaggtggctggttaagcttgacctgcacgactttttcggcagcattcaggagaagagaatatttgacttgttgttgcgcctgggatactccaaactggtgtccctggaaatcgcccgcatttgtactcgcctccgaggccccagatatgaaggctatcagaacttttgggcctataacgccattcctagttacgtggtgggtagccaaggggtgcttccccagggagcccctacctcaggagctctggccaatacagtggcatctaatcttgacgccaaactccacgatctggctgctagtagaggacttgggtacacacgttatagcgacgacctcacgttcagcgccggtccagattacgataggaaacaagctaccgctctaatagcccaagtgaggaacatcgttagggaccagcacttcgtcttacacgagaaaaagactcatgttgtgccgccaggcgccagaacagttgtcctcggcttgctggtcgactctcagggcgtgcggctcttaccagagtacaagcgcaggctgcaagtacatgttagaggagtagggaagttcggactagttgagcacgcctctcaccgtggttttgagtcagtgctgtcattcgtcaaccacgtcgacgggctcatcgcatttgctgccggagtagaaagggagtatgcgcaacatgctcgacgggcctggaatgatgccctggcgaggtctgggtatccactggaggtctga

SEQ ID NO: 9170 - RNA, 1143 nt, unidentified
  source 1..1143: mol_type = other RNA; note = synthetic construct
atgactcgggactcaccccacctgtacttcaaaactggacgcgctctgggccgcgatgaggctacacttaacagtgctattgaacggtccagactgattcaggagacaaacagaagaccagttctgtctctggggcacctcgcagctctgacagggacacggtatgcatatctgcgagagatcgtggaacgcactagcgacccctattcagaacataccagggcaaagagcggagggggttcgaggccaattagtgtgcctgatccactgctgatgcaggtccagcgatggatcttggagcacgtgctgggcagtacacggacccaccccaattccttcgcatataccactggcgtgtctatcaaggattgcgcgaacgtgcatctaggggcatcctggttgattaagctcgatctcaggaactttttcggatctatcgacgagaatgccgtgtactccgcctttagaaggctggggtacggtccgctcgtttcacttgaaatggctagaatatgtacacgtcccgccggtccgcgaatgcaatccctgggtggaaagcggcgttacgcgagcgtaccatcatacgccgtcgaatcccgcggtgtattgccccagggtgccccaacttctggcgctcttgcgaatttagtcgcccttcggttagaccagcagctcagtgagctcgcgaccacaaggggggtggctgtgacgaggtactccgatgacatcgccataagcgccggccctggattcacccgacgagatgcctcagagctgatcgctagagtcgccaggatcgccgccggaaacggctttgagctacaggataccaaaaccagagtgattcctcctggggcccgccatgtggttctcggattattggtggacggcgacagcgtgagactggtccctgaatttaaacgccggatctctacccatgttaggggagtatctgagttcgggctggttgcccacacgaatcaccggggcttcagaagcgcatttagccttattaatcatgtcgacggctgcatagcctttagtcaaggcattgaacccgcttatgctgcaagcgtccgcgcccgttggactgcagctttgaatgcgaccaactaccctgcaggaatcggctcggagaggtga

SEQ ID NO: 9171 - RNA, 1125 nt, unidentified
  source 1..1125: mol_type = other RNA; note = synthetic construct
atgaatccttctacactccaccagtacgtagaagcaggccggtctgcaggggtgcctcttgacgtccttcgcgcatctgtggctcaggcttctgcgacacgtagcagaggcgccggacccattttgtccttgggccacctcgcccatctgactggtacgccatacctgtacctacgcgaaattgtacaaaggcaaagggacccatatgacgacgtcattttaagtaagagatccggagggacccggtctataagcgcgccagagcctgtcctgatggatgtgcatagaactgtccttcatcgggccctctccaacttaccgctccacccattctcatacgcttatacagccggccgaagtgtccagcagtgtgcagagcagcatctgggggcccagtggatgattaagtttgacttgcacgacttcttcggtcagatacaggagagagacgttttccgagtgttcgagggccggggatatagtaagctcgtcagcttcgaactggcgcggctgtgcactcgcctcaccgtattcgatcgccccgaaagaggctccggtcggtaccaagccatccctggctacgaggttcaggtgtctggctgcctgccacaaggtgctcccacctcaggcgcactgagcaatatggtggccactcccctagattatgacatggctgggttcgccgctaggagtggctttacatatacccgttattcggatgatatggtgctgtccaccactctgaacggattcgaccgcacccaggccaagtcgatcattagagaggtgtcagagatcatcgggttccacaggtttcagctgcaccagaaaaaaacaagggttgtacctccgggggcccgtaggatcgtgttagggctgctggtggacggagatagacttcgcttgacccccgaatttcggcgaagagtggaggtccatatccgaggggttagcaagtttggtattgctcaccatgctacacataggcgctttgattccatgcttagctttgtttcacacatagacggatgtatcgcatacgcccacagcgtgcaacccgattgggcggatgcaaggcagcatgaatggctggtggccctccggaaacacggatttcctacgtga

SEQ ID NO: 9172 - RNA, 1119 nt, unidentified
  source 1..1119: mol_type = other RNA; note = synthetic construct
atgaaccaccccgctccccatcgctactttaggctgggccaggaatcgggagttccagagcaggttttgcaagcctctgctgcgagaaatgccataacacaggcccacggcgccgaacctattctgagcttgggccatctggcccatcttagcggcgcaccatacttgtatttaaggcagattgtacagcgcacgcgcgatccatacggggatattagcaggcagaaaaaaactgggggcataagactgatcagtgctcccgagcctgtccttatggatgtccaacgcctgatcctacggagagcattgcgaaatctgcctttacacccgttctgttacgcctaccgtgagggacgcaccatccaggcatgtgcacagcagcaccttggtgcaaagtggatgattaagttcgacctgcacaatttctttggacagattgaagagagggatgtctatagagtatttgacagttgcggttattccgcccttgtgtcattcgaactcgctcgcatatgcacgcgttcccgggtggctgactttcactcccgaagtggcagatactccgctattaccacatacgacgtggacgtgacaggtagacttccacaaggggcgcctacttctggggccctctccaacgcggtggctacaccactagactataccctgcatgagttcgccactggggcaggttttgtgtatactcggtattcagatgatatggtgctgtctacatgccaggacttcaaccgcgcccaggcagtgaccatcatccgagaggtgagccacctcgttgcaacccataggttccggctgcatcgtaaaaagactcgggtcattccccccggggctagacatgtcgtgctaggcctgctggtggacggcggagaagtgaggctgaccccggaatttaggcgaagggttgaggttcacatcaggggagtacgggagttcgggctgtcagagcacagtgaccacagaaagtttcgatccctgctcagctttatcaaccatgtcgagggatctctcgctttcgccagatcaatccaacctgcgtgggccgatgaaaagcgggccgaatggcggtctatcttgggcagcttaggactcaccctctga

SEQ ID NO: 9173 - RNA, 1119 nt, unidentified
  source 1..1119: mol_type = other RNA; note = synthetic construct
atgaatcactcctctcctcaccactactctagagcaggcagggaggctggcgttagtgaaagcgtggtgagagcagcattggcccagtcgcatttgatcgaggaatccggatcatttcccatcctgagtctgggacatctggctcacctgtctggagcgccttacctgtacttacgagagatcgtacagcgcgtccgagatccttatcaagacatttcccaacggaaaaagagtggtggaacacgcccaatctcagctcctgagccagtcctgatggatgtgcaccggttcatactcgacagggcgttggcatcagtgccactacaccccgctagcttcgcatacactagaggtcgcaatataaagcagtgcgccgagcgacatctcggggccaaatggctgtttaagttcgacattaccaacttcttcggtcaggtgaaagaaccctccgtttttagggtgttcaggcgacaggggtatagtcgcctcgtgtccctcgaactcacgaggatatgcacccgggccccactgagtaaaaacctcggcagccgttctcggtacgatgtcattccttcgtatagcgtagaccagcggggatggcttcctcagggagctccaaccagtggcgcgttatccaacgctgtcgcagccccacttgatcacgatctgacatcactggccgaccgtcatggcctggtgtacagccgatattccgatgacatgtttttttctgccgggcaaggcttttcccgtcccaaagcaaaggctttggtaagagaagtggaccggacagttcaaaggcacagattcctgctgcataggaagaagactagggttatcccgcccggtgcccgccatattgtgttggggttacttgtggacagcggccaggttcgcctactcccggagtttagaagacgggtagaagtccacatccgcggcgtgggaagattcgggcttgattcacatgtcgagcacagggggttccggtcaatgtttagctttatcagccatgtcgacggctgtcttgctttcgcctctagcgtggaacccgactgggccgagtcttgtagagttcgctgggaggccgtgctgaaggatcaggggttccccatttga

SEQ ID NO: 9174 - RNA, 1125 nt, unidentified
  source 1..1125: mol_type = other RNA; note = synthetic construct
atggatcattcatcgccccatctgtaccgccaggcaggcttagccgcaggggttgaacgggctgtgttggaccatgctctggaacagatggtccggaatgaggctagggacgccctcccaatcttgtctctcaagcatctcgcccacctgacaggtgctccctacctgtacctgagagatatcgtcgcccgcgtggcagatccctacaccgacattgtagcccctaaacgcagtggaggaaagaggcatatttctgcaccagagccgggactgatggacgtgcaaagagtaatcctcaagcgcgcccttggaaacattccacaacaccctagctcctttgcgtatagacagggtatttccatcgttgagtgcgcaagaaggcatctgggagccaggtggctggtcaaactcgatcttcacgacttttttggcagcatttcagagagacaggtgtatctcgtgttcagggcccggggttatagccgtctcatgagcctagagctggcccggctctgtacacgtgctgggcttagcggatcacagcgcgtgggctccactcggtattccgctatcccctcttatgcagttaacactgtggggtatttaccacagggggggcctacctccggtgcattggctaacgctgtggccactccgatggactacgctcttgcaggccttgcacaggagtgggggttggtctacacaaggtactctgacgatctggtcttctctgcgggccacggctttaatcgggccatagccgtgagaataatcggcaaagcgacaagcgctgtgcgatcacaggggtttattttacatgaacgcaagacgcgaatcatccctcccggagccagacacattgtcctgggtctgttagtggacggcgatgtggttcgactgaccccagagttcagacgtcggatcaatgtacacttgcgcggagttgataagttcggcctgaggtcccacgctatccaccgaggcttccgaagtctgttcagcttcgtgaaccacatagacgggtgcctagcctttgccatgagtgtcgagcctgaatgggccagggaaaccgtgagtgcatggaggcaaatactgcgggcgcaggccttccccgtaaattga

SEQ ID NO: 9175 - RNA, 1128 nt, unidentified
  source 1..1128: mol_type = other RNA; note = synthetic construct
atgtcacagcctccaccccatcggtatctggctagaggaagggccgatggcgttagtgaaactgtcctcagggccgctgttaagaataccactaagacggatgctcatgatgctctctctatcctttcattggggcacttgagccacttgactggagctccatacttatacctgaggggcatagtgcaacgcacatcggatccatacgacgacattatgagaaaaaagcagacgggcggaagcaggctcatctctgcccctgagcccgtcctgatggacgtgcaaaggctgattctcgaaagagccctgactggaaccccgatgcatccagcctccttcgcttaccgtcgaaagcgcagtaccctgatgtgcgcacagcagcatgttggggcccgctggatgcttaaatttgatctgcacgacttcttcggcagtattacagaagtgcaggtctataaagtgtttagatcaagggggtatgagcctctggtgtcctttgagctagcgcggttgtgcacgcgctccacaacaatgccctcatggtctacccggcaccaagtgcggtatcccgtgatccagtcttacaacggccggaccttaggttccctgcctcagggaggtcctacatcaggggcactggcgaatgccgtagctacaccactcgataattccttaagcgacctcagccatgaccatggcttcacttacaccagatattctgacgacctcgtgttctccagcgccaacaagttcgacaggacagtcgcccgggccataattaacgcagtgagacgctgtgtctctggtcagggctttcgacttcacgccaagaaaaccagaatcatcccccctggggcgcgccacattgttctaggccttatgctgagtgatgacggtgttaggctgacccccgagttccgccgacgaatcgaagtccacgtacacggggtgagcacttttgggctgttggctcacgcagaattccgtagattcaggagcgtgttttccttcatcaaccatgtcgatggatgtctggcctttgcagagagcgtggagagtccgtgggcacttcggctgcgtggagagtggcagcgagtactacggaaagagggctttccagcaatgtga

SEQ ID NO: 9176 - RNA, 1110 nt, unidentified
  source 1..1110: mol_type = other RNA; note = synthetic construct
atgaacaattttagccctaatctgtatatcaaccagcggccaaatgaaatgcccgggcgtgtcgcgaaaatcgcctggaggggaatcgtgtcccagagggatcgggggcttacccctattctgaccttagggcatctggcctcagccaccggaattgatcatgcattccttcgatccgtggtggacagaagttgggacccttaccaggaaattaaaatctcaaaaaagcggggcggtactcgcaaattggccagaccacacccactgcttatggaggcccagcgttggatcctgtataacgtcctgccaaacctggagctcaatgatgcaagttttgcatatacatcaggcagatccatcgtggattgcgcgcagcgacatgtaggtgcccggtggattttgaagctggacctcaaagacttcttcgactctgtttctgaaaagagcatatatcggatcttcctcaaccttggctacgagaagctggtcagtctagaactagccaggttatgcactcgcgtaacacctaatagtcctaggtttggtggtaacctggataagtacgagactatatttgactatcgccaccccgcacaagggcaattgccacaaggagccccgacatccggggcactagctaatgcggctatgtttagaatagactgtgctctgcagaagctggccagaaaacacagctacacgtacacccgatacagcgacgatctcgttttctccacaggcgaaaaagcttcacgatctcagctgatcaccctcaagaagaaaatccagcacgagattgttagcactcgtttccaacttcgcaaagacaagacaagaattattaccccgggcgcccgcaagatagtgttgggacttctgattactgaaagcgaggtccggctgacgcccgagtttaagaggaggatcctcgtccacctcagaggcgtggagaagttcggactgtactcccatgtgcagcaccgcaatttcgattcgaccctcagctttatcaaccacttggaaggcctcattgagtttgcttctaatgtggagcccgaattcgctcatgagtctttaaggaactggcgggagatggtgcccctgatctga

SEQ ID NO: 9177 - RNA, 1143 nt, unidentified
  source 1..1143: mol_type = other RNA; note = synthetic construct
atgactagcgctccacacctgaactgggcacgcacagtggattttggcgctgcccccggaattgccgacgctatgttccacaggagcgagatcctcagacgcaccggagccccagttatcctgtctctgaaacatttagctctgtccgccagcgtggattacggctttctgctgggcgttattaggcgatctgctcccgcatacagagctattcgtattccaaagaatacaggggggttcagagatctcctgtcaccttcagagtccctcatggccgtgcagagatggatccttcatgaggttttgacacaccagccgcggcatcgtaacaactttgcgtactttcccggagtgacagccagggaatgtgctgcccgacacgctggggcaaaatggatgatcaagacagaccttcacaattacttcccttctattaccgaaaaaaaggtgttcgaggtgtttgaagggttggggtattcccgcctcgttgccttcgaactggctcgcctgtgcacttggacgataagtcagacccccacagccgtcactacagtgcaacagagggcccgcagctccactggcttgccttatccggtgatgctagagggagtactgcctcaaggagcacctacctcgggcgcccttgcaaatgcctcaaccttcagcttagacgagaaactgtccgacctggcaattaagagcaacctagtatatacccgttactctgacgacatgactttctcgtcagcaagtcccctggatcgggatgtcgctcgcctggtgatcaggcacatccggactatagtcggtaagtccggcttagaactccacgataaaaagacgaaattgataccacacggagcaaggaagattgtgctcggtatgctgatcaccgaggacggtgtgagtgtactgcccgaacagaggcggatgatcgacctgcatatccatgcggtcggtaagtttgggccagtcgcctacgccacgcagcgaagattcgagtctgtgctatcttttgtcaatcacgtggagggctggcttgcgtatttgagtcatatagacagagattggaccgcccagagacggctcgcatggaacgctgcgctcgatcggcatcacgtttccgtcatgagccttggctga

SEQ ID NO: 9178 - RNA, 1143 nt, unidentified
  source 1..1143: mol_type = other RNA; note = synthetic construct
atgcgaaacgaggcacatctgtcctgggccatcacaagcatgagcggggaacgccctgccttggctgatgccatgatgcgccaatctgaaacgcttcggcggacaggcgctccggttctgtattctctgaagcatctagcattaactaccggcgtcgagtacggctacctccgccatgtcattcagagaaacgccccagcttataaggcaattcgcattccaaaaaatacaggcggatacagagatctgctctcccctacagacagcctgaagcatgtgcagagatggatcctgcacgagattctcgacaccgtccctaggcatatcaataacttcgcatattttcgagacgtaacagctagggaatgcgccatccgccacgctggtgcgacttggatgatcaagacggacctgcaccagtattttccctctatcagtgagaaattggtgtacgaagtgttccaaggcttaggttacagtcggctccttagtttcgagctcgccaggctgtgtacctggaataagttagggcgacttgcacccaccggagcagttcccagatcacacgggagtgtgcgttctctgccttacccacccgcccctttgggctttcttccccagggtgctccgacttctggggctctggctaatgcagccacccggaggctagatgacgccctctcagatttcgcgatagccaaccacctgatttacactcgctatagcgatgatatgacattttcatccccctcagccttcagcaggacagtcgcctcagagtttgtggttcagatacggaaaatagtgaccgcgagcggtcttgccctgcactcccagaagaccaaagtgatcccacctggcgcaagaaaaattgttctgggaatgctgatcaccccaggaggggtgggaatactcccagagcagcgtaggactattgacctgtatgtgcatgccgtatccacgtacgggcccgtagattatgctgccagaagaggctttgacagcgtgttctccttcatcaaccacgtggaaggatggctggcgtacctgtctcacattgacgcattgtggactgccggcaggtcgcgttcctggaatgacgctctacggaagcacctcatcgaggtcagcagtttgggatga

SEQ ID NO: 9179 - RNA, 1137 nt, unidentified
  source 1..1137: mol_type = other RNA; note = synthetic construct
atgagcactgatgcccacctaagctgggctcctcccgtaattagcgggggcgatggcccagccctagcaaatgccatgatgtttagggaagaaactctgaggcaacatggcgctcctgtgctgtacagcctgaaacatctggcacttagtacaggagtagactatggttttctcagaggagtgatcagacgcaatacccaggcgtacaaggcgattaggattcctaaaaataccggcgggttcagggatctgctgtccccagcacctgctctgatgcaggtccagcgatggatcttgcatgaaatcctgtctaaggtgccccgccagataaactcattcgcctactttgctaagatcacgccgaaagagtgcgttgaacggcacgctggggcatcatggctcatcaaaaccgacctgcacaattatttcccctcgatttctgagaagagtgtatatacagtgttcttgaatatggggtatagtgacttggtcagtttcgagctttctcgcatctgcacttgggtgcggcccggtgttcagttagaggccactgagagcgccattactgattctgagatcccttatccaaggaccccccttggctacctgcctcaaggatcccccacatccggcgcacttgctaatgcctgtacaagacagctggataacgacctgtccacgctcgcgttgaacgctcacctccgctacacacgctacagcgacgacatgacatttagctccagaggtccgctcgatagagcaagggccgcggagttcataggacaagtccgacggctcgtgaccgcctccggattaacgttacacgcaaagaagaccaagataattccaccaggtgccagaaaaattgttctaggaatgctggtgaccgacaccggggtgggaatcctgcgggaacagcgcaggatggttgatctccatatacacgctgtcgccaaatatgggccaattgattacgctgaacgacgtaactttgacagcgtcttgtcctacatcaaccacgtggagggctggcttgcctatctctcacacatcgatggcgactggacatcacggcgtagacgggactggacctctgccctgtctgtgcataacgtcagtgtgacttcactgggctga

SEQ ID NO: 9180 - RNA, 930 nt, unidentified
  source 1..930: mol_type = other RNA; note = synthetic construct
atgcgaattccaaagaatacggggggtcacagaacattacatgccccggccgacagcttgcgcatcgttcaacgctggattctccatgagattctccatgtcattgataggcacgaaaacaattacgcatattttcctcaggtgacggtgaaggagtgcgccagcaggcacatcggcgcatcctggatgatcaaaaccgacatacacaactacttcccgagtgtttccgcacgctccgtctatggcgtgtttttgggtctgggctacgctcccctggtagcctatgaactctcaaggctttgtacctggccaatcggcgggcccgatttatcccatctggcgaccctggaacccccaaccgacagcgacttggtctacccatctttatggtcagaagcccttccccagggcgctcctactagcggagcccttgcaaatgcctgcacacgggaaatggacgcacggctctctagcttcgctataaaaaaccggctagtatacactcggtacagcgatgatatggtattctctggaatcgggtcgttcagtagaagcctaatctcagagctgatgacagaggtccgaaaaatagtcgtcagcaatggcttcgctttgcatctgaagaagactagagtggtgtctcctgggtcccggaaaatcgtgcttggactgctcgtgcaggaagagtctattgctctgctgcctgagcatcgccgtatgattgacctgtacattcacgcgacatctcgatatggacccgtgggttacgctggggttaggaagtttgaaagtgtgatctcatttatcaaccacgttgagggctggctgtcctattcaagtcacatagacgaggagtggacccgtgagagaagtgtgagatggagggccgccctggataagcaccaggtgtatgtggattccctcggatga

SEQ ID NO: 9181 - RNA, 1545 nt, unidentified
  source 1..1545: mol_type = other RNA; note = synthetic construct
atggtgtccgcctcacctcacctttacctgcggagcgtgcccgaaaggcgatctgcacggactgctaaacgcgccctgcggcaagccgctgacgttagagctcatggtctgcccccactggtgacactgggccacttggcccacgtaaccggtgtcccctatggcactctgagacgagtcgtcgagcgccgtggcttcctctatgaccctgtgcataaacccggcaaagccgatcgcggaccaaggaagctgctcgcccctgaccccgagctcatgaccgttcagcggtggctcctccatcacgtcctcgacccccttcctgtgcacccagatgcatacgcatacgtgcgtggccgctccgtcgctgattgtgctaggcggcatttgggagccagatggctgatcaaaatcgatataagggacttctttggcagtgtcggggaaagacgcgtgcatcgggtctttcgaacccacgggtatcagcccctggttgcatttgaacttgcaaggctttgcacttgggacgataggcacgccggcattgaccccgctagacgtgacaggtaccctaaggtgacagcctaccaaggagggtgggggggtttcctaccccagggtgcaccaacaagcggcgcccttgcgaatctcgctgtgcgaccgatggatgacaggctaagccacatcgcggcccgccatggtctggtgtataccagatactcggacgatatggtcttttctgcgggcacgacattcgtacgcaggagcgcggtcgccatgttgcgcgaatttacccacgccatccagggctatggcttcgccgtccacccgagaaagacccggattgtagccccgggggcacgtagatccgtgttagggctcttggtagacggcgatacccctcggctgacgccagacttcaagtctcgggtgctcagtcatgtttacggcgtggagaagtttgggctgccatcccatcagcagcatagaggcttcgcctcactggccgggttggtgcaccacgtggatggcctaattgcttacgcacgtggaacagagcctgagtgggcagagcctttacgcgcaagatggagagctgccctggaggctcagggatggtcaagcgcatatgctgatgatagagccgagggcccaccaggagggaatccatgccgcagaccttctggaggcggtccccacatactggggagtgtgcggccggtttttgctgcagtggctgccgtagctggtggcggaggagcagagggtgctgtcgcagtcgtggcgggattagaaggacgagacggagatgccggtgcgggagagtgtggagaagtggttgacgcgaggcgacgacggcgcaagcaattcggcgagcccgtgcttgaggagttcggaggggtcctggaaggggttgggagggtggtaggcgaaggggttgccgatggtgtgggggctggagctgcctttgagcctggtagggacgccggcgatcagctgactgacgtggtgctgggggaaagggaattgcggtgcgttacagcctga

SEQ ID NO: 9182 - RNA, 1128 nt, unidentified
  source 1..1128: mol_type = other RNA; note = synthetic construct
atggtatctgcctccccacacctgtatttgcgctccgtgccggccagccgttctttagggacagcccggcgagcactgtcacagtcagctgacgccggaactagagggttaccccccgttgtgactctgggacacctggcccaccttaccgggatcccgtaccggacattacgaggcgcggtcgaacggaggggctaccattataccccaattcacctccccgggaagcctgatagagggcctcggaaactgctggtgccccaacctgaactgatggccgcccaacggtggttgcttcatcaccttctcgatctcctcccagtccaccctcacgcctttgcttacgttaaaggccgatcagttgctgagtgcgccagacgtcatcttggcgcacagtggctgatcaagatcgatatacaggacttcttcggcgctattggtgagagaagggtccatcaggtttttagagctcaggggtaccagccgctggtggcttacgagctcagccggctgtgtacatgggatgatagacgagatgacgtagaccccgtgcggaaggataggtatccaaaaatcacggcctaccaaggaggttggggaggcagtctgccccagggtgcaccaactagtggagtgcttgcgaacttggcagtgaggcccatggacgaccgcctcagcgacattgcggcacgtcatggcctggtgtataccaggtactcggatgatatgatcctcagttccggagatcctttctccaggcccgccgctgttgcagctcttagagagctcacccacgcggtgcagggctatggcttcgagcctcatgcccgaaaaacacgcatagtgcctcctggagctaggcgcgcagtcttgggcctgttggtcgacggcgacgtgctacgcctgactccagcctttaagtctcgcctgctggcccatctgtacgggattgagaagtttggtctaagggcccatcagcaacaccgcgacttcgcttctctggctggtttggtgcaccacgtcgacggccttgtagcatatgcactgggagccgaaaccgactgggcccacccagtccaggaaagatggagggggatgctacgggcacagggatggagcctcgattga

SEQ ID NO: 9183 - RNA, 1155 nt, unidentified
  source 1..1155: mol_type = other RNA; note = synthetic construct
atgacaatagggagcccgcacctgtaccggagggatggacgagccgagggcaaaccagaggcactactggacgccgctttggctcaggcctatgctgtagaggcaaatgggttagcagccgtcctaactctgaaccatctcgccgtgcgaacaggggtgagctacaattacctccgtggcattgtgtctcgcaccttcgacccctacgcagacttggtaattgaacgtagaaacggcaggaagatgcgacctatcagcgttcccgatccaccattgatgcgggtgcagagatggattctgcaccgcatagcgtccagaattccggtccacacagattcctatgcttatcaggcaggcagctcgattcgggcttgtgcaatgcggcacgctggagctaggtggctggtgaagcttgatatccgcaacttcttcgaaacgataaatgagagacaggtattttcgctctttcatgaggctggctacgtccgcctggtttcactggaactggcccggctgtgcactaggagtgcagcccacgccagtcatgtggacgtgaggcattttggcggggatgtgagagacagggtgatccagtcttataatcagcctgtcctgggctttgttcctcaaggcgcgcccacttctggagctcttgctaatgcaatcttccacgagctggacgtgacattctccacccttgcccacagagagcgcatggtgtataccagatacgccgacgacttgaccttctccagtatcgaagagttcgatcgttcacgcgccgcgcaattgattcggaaggtggggagcgagctacggtctgagggattcagccttcatcagcagaaaaccagaatcgtccctccaggtggaaggaagctcgtcctgggcctgctcgtcgatagggacgacgttaggttatcaagatcaatgcggtcccgcatcgctgaaaatgtgcgcggtgttgaaaaatttggattagccacccacgtactgcatcggcgattctcttccctcgacgggtttgtgagacatgttagtggtcttctggccttcgccactgatgtggaacccggttgggcacgacacatgagcaagcgttggcaagccgcgctcagggccaacaactggctcgattttacgtttaaccgctga

SEQ ID NO: 9184 - RNA, 1149 nt, unidentified
  source 1..1149: mol_type = other RNA; note = synthetic construct
atgaccaccggctcaccacacctctatcggagagaggggcgagcaaggggaaaacctgaagcactgctagacgcggccttaacccaaacacagagcgttgaggcgaacggcctggctgctgtcctgaccctcaatcatttagcagtccgtacaggcgtgtcctacaactaccttcgagggattgttgagcgcaaatgggacccctatgatgacatagtgctgaagaggagaaacggtagggggatgcggcctatttctgccccccactctcctctgatgagagtgcagcgctggatcctccacagaattgtcgatcgggtaccagtccacgcggacagctacgcatatcaggcggggtctagtataagatcatgtgccagtcgccatgccggagcccgttggttagttaaactggacatccgtaatttcttcgagactatcgatgaaaggcgcgtgtacactgtattccacaaagccggatacgttcagcttgtggccttggagttggcccgcctttgcactcgttctgcggcccatgcctcccacgtggatagccacaggtttctttcgaatatgagggatcgcgtgattagtccgtatagccaggccgttctgggctttcttccgcaaggtgctcccaccagcggcgcattggctaacctgatcttttatgaactggacacaacattctccaggatcgctcaactcgagagaatggtgtacacccggtacgctgacgacctcaccttctcgactatcgaagagttctcacggagccaggctactagtctgatacgcgaagtggggacggaactgagacgagctggattttctctacatgagaagaagacgaggattgtgcccccaggcgctcggaaggcagtactaggcctcctggtagataataataaggtgcggttgaacaggatcgtccggggccggattacagataacgtgcgaggagtggagaagtttggtctggccgcccatgtcgcacatcgccgattctccagcttggacggttttgtgagacatgtttcaggactcctggcatttgctgccgatgtcgaaccagagtgggcacacgctctgggggagcagtggagaacagccctccacgccaataactggtccgaaccttccttctga

SEQ ID NO: 9185 - RNA, 1158 nt, unidentified
  source 1..1158: mol_type = other RNA; note = synthetic construct
atgataacggactccccccacttataccgtaggaatggagttatcaactcagtgcctgaggaggttttgtctaatagccttatgcaggcaggccgggtcgaacaatatgggctggccagtatactgaccctcaagcacttggcagtacaagcaagatcctcatacggatttctgcgcgggattgtggagcgcaagttcgacccttatactgacatcaagatcaagagaactaacggcagaataatgaggcctgtgtcaagtcctagtcccgggttaatgcccattcagcggtggatcctggcccatatcgtcagtcgcctgggaacccaccccaacagcttcgcatatacccgaaataagagcataaagtcttgcgctagtaagcatctgggcgccaattggctcgttcgcctcgatgtgcagaatttctttgaatctatcgacgagagcagcgtgtatcgcgtgtttgctgaggctggatatcagcctctggccgcttttgaactcgctaggatttgtactcgatacgccccacatgctcaccacgtcgatgccgaaagattccgatctaaaagccactacgccacgattcgtcaatacaacatgccgtacatgggctttgtgccacaaggcgcaccaacatccggtgccctcgccaatctggtcgcgaaagatctcgaccttaccttaacccaggttgctgaaaaatatggcgcagcctacacaagatattccgatgatatgacattctcatccactagcaagttcactagatctaaagccctctcgcttattgaagaatcccggaccgcacttttcatgaacggcttcaggttgcatgacaagaagacccagatccagccacccggcgctaggaaaacaattctggggttgctggtggatggtgattcggtgcacctgaataagcggattcgttccaggatcgagaaccacgtacggggggccgagaaatttggtctgcgatctcattactcacatgtaaactttgcgagcctagagggattcgtcaatcacgtgtctggactgatcgcgttttggctggacatcgacccggagaactcccaggacattcagaaaaggtggaaagagacactacggcgcgatgggtggcatcaggtggactactggagaatgtga

SEQ ID NO: 9186 - RNA, 1242 nt, unidentified
  source 1..1242: mol_type = other RNA; note = synthetic construct
atgatcaccggaagcccacacctgtatcggagccggggcatcaagaggaacgtggcaaccagtgtcatcgataacgctattgccgcggccgaacgagtagagaaaaatgggctcgccgcggttctaacgttgaatcatctcgcacattctacaggtgctgattatggctacctgagacagatcgtgacccgctcaattgatccgtacaccgacattgtaatagcacggagaaacggcagaaaaatgaggacagtgagctctcctgaaccctcactcctgcaagtccagcagtggattttgaggtccatcgccgaaaagatcccaacacacagttcaagttatgcctattctcctggtaggagcgtgaagcagtgcgcgtctaggcacgtaggggctaagtggctgataaagcttgacattagaaacttcttcgagtccattactgaggtccctgtctaccgagtcttcaggagagtggggtacgaacccctgcccgcactggaacttgctcgggtgtgtactagatacgacgagagggaccccggcatgcgcttagatcgggtgctagtcagggctaaagagtacagttccattcaagtttatcggaaaccactcctgggatttctcccgcaaggtgcacctacgagcggagcccttgcaaaccaggttgccatgccactggatgaacgcctttccgccatcgctgactctcgcggcctgatctacaccagatacgccgatgacatgacattttccagcggcggacctttcaccagaagtgcggcccttacactaattaatcaggtaagcggagcaatccggcagcggggattcgctgtgcacgaccaaaagactcgtatagtgacccccggcgctcgcaaagtggttctcgggttattagttgacggtgaccgggtgcgcctgactaaaaaaatgaggcagcgtatctctttgcatgttcgaggagtcgagactttcgggtttatcgatcacgcaaagcatgtcaagttttcctccgtggatgggttggtgctgcacgtgagcggcctgatatcgtatgcttcagacattgagcccgcctgggccgatgagtttaagcagcgatggcgtaatgttgtggccgaaaaactggacgtggagctgccatcctttaatcgtgatgtcggcggcaagtcatataagtcggggcagatcagacacctcgtgcctttgtctgcccgcctgcatcgccgagagaactga

SEQ ID NO: 9187 - RNA, 1230 nt, unidentified
  source 1..1230: mol_type = other RNA; note = synthetic construct
atgcggaccgacagcccacatttatacagacgcgagggacgacgccggggattgtccaacgaagtgatcgaccgggtagagatggccagcgcacggctacttgcacacggcgtagccgttgtgcttacactggggcacctggcctggagaagtggagctccctacccatacctgaggaaggtcgtggagcggtctattgatccttaccatgcgtttgctataaacagacgggctggcaagaatcctcgcctgattagctctcctagcccccttctgatggacgtgcaacgttggattctcgctcgcatccttgatcatgtgaccccacaccctgcctcatacgcatatcggcggggggtcagcatcagaatgtgtgctgagcaacatctcggcgcgaggtggctggttaaaatggacctccacaacttttttcacaccatagatgagcgccaggtgttcaaggttttcgcagatcttggatatgccccgctgcttgccctggagttagcacggctgtgcacacgccgtgcatgggatggtttcccccacccgaccaggttccaggtgcgaaatcatcgtcactcagttattcctacttattcggcagatgccatcggcttcgttccacagggcgctcccacttccggtgctatcgctaatctggcagtcagaccactggacgaagccttggccgctctaggctctgcccacaggctcgtgtacactagatatgcagatgacatcgtcttttctagtgctggagcctttgatcgacgagccgccgccagcctgatgcacaaggctcgacacgaaatagcggcctgcgggttcgcagcgcatgacaaaaaaacacgcctgacaccacctggcgctaggcgtattgtattggggctcctcgtggacggcgacaaggtcagactcccctccgaaatgaggtcacgcattgccacacacgtgcatgctgccgagaaattcgggttgagggaacatcagctctccaggggtttcacttccgtgttagggctcgctaggcacgtggatggattgctagcatttgcgtcagacgtcgatcccgcatggactgatgacctgcggaccagatggagacgcaccttgctgcgagacgcctctgccctgggtgcctttgagatcagtgacgtctacaggcagagagacgacggcacgaccgctgcgtatacagtggccgccacgccctgggatgcactgtga

SEQ ID NO: 9188 - RNA, 1200 nt, unidentified
  source 1..1200: mol_type = other RNA; note = synthetic construct
atgaccattggccctccacatctctataggcttcacggacgggttcgccagcaggacgaacacatgctgcaggcggccatcgaacaggctgctagggtggagcgcagggggttagcgcatgtcctgactctcaatcacctagcccaccgtactggcgcaccctacccctatctccgcgaaattgtcgaacggaagagagatccgtatcacgtttttgaaatccgaagaagggttggcggttctggcagggtgattagctcccccgacccgacactgatgcacgtacaacggtggatcctgtcgagaattctgaatcatgtccctgtgcatccagcgagcttcgcatatagaactggcttctccatccgggcatgcgcctctcaacacttaggggccgactggctggtgaaacttgacttgcataactttttccacaccattgatgagcggcaagtgtaccaggtgatcaggcaggctggctatacgaggctcgtcgctctggagatagcccggctctgcactagacagagcacaggaaccttccctggtagtcgtcggtttcacgctatgcgcattcatgatcgtgtgatcgctaactacacgacaaattgtctggggttcctaccccaaggtgcccccacatcaggcgcccttgcaaacttagtggctcgcccccttgacgatcgcttgaccgccattgccgacgatcaccagctggtgtacaccagatacgccgatgacattgtactctccggactggggccattcaatcgggctcatgcagcatccattatacgactcgcaggcaccgccatccgagagtcagggttcgagcctcacgatggtaaaacccgagtggttcctcccggcgcccgtagaatcgtcttggggctgctgatcgacggcgagaggttgcgcgtaccacgcgacactcgatctcgcatagaggcacacgtgtacggagccgagagatttggacttgtgcatcaccagataaacaggaagttcgcttcagccttgggactggtcagatacgtggatggactcctggcttttgctcatgacgtcgatcctacatgggctacaccctggtgggaaaggtggcggagacttgtactggatcaggccgccgcaatcgcgccatttgggccagacagtatcgttcgggcaccaaccagcgccgacagtcctgatcagtga

SEQ ID NO: 9189 - RNA, 1251 nt, unidentified
  source 1..1251: mol_type = other RNA; note = synthetic construct
atggacaaactgagcaacgcctggatggtgagaggtgctcgggctcctacaggagtgtggcgagctacgagaacaagccccccaggccgcgatacgccaaaagtgggccacccaattgacagccccgcactgtatagatcacttgggcggcgcaatggggttacatcgtctgttatcgacgaggccctcgagcagatgaggcgagtacgcagacaggggctcacccctgtactgaccctggggcatctagcgcaccaaacgggcgcaccctatctgtatctgcggagggtcgttcaacggcggcaggatccctacactgagttctcccgccccaaacgtgagccgggcaagtctaggaccattgctgcgccggcacccgtactgatggatgtgcagcgttggctgttggctaacgtggtcagcccaattcctccccacggggcctcttatgcataccagcagggaagatccgcagtgcagtgcgcacagcttcacttgggggcgagctggttactcaagttcgacctccacgatttcttccattccgtcaacgaaagggccgtgcagagcatcctacgctcagtcgggtacaactcattgatatcttttgagatcgcccgagtgtgtaccagagtgcctggaggcatcacctggccccactttagatccgcctatcaagccatacctggctactccgcccctgtgctcggttaccttcctcagggtggcccagctagtggcgctcttgccaatctagccgcacggccactggacgaagcactgtcttcggtggccgaccgctaccggatgacatatacccgctatgctgacgacatgactttttccactctgcgctccttagatcgaagtacacttactcggtgcgtgagcgaaatcagtgccaccgtttctgcagccagatttcggctccacaggaagaaaacacgtatcgtcccacccggcgctaggaagattgtgctgggcttactggccgatggtgagagactccgactccctcgtcataccaggagaggactggaggatcacatcaggggggtagcaaagttcggtctgggggcccataaagagcatgccggatactcaagtgtccaaggatttgtgcatcacattgacggattgctcgcttacggccatggcgtcgatccagtttggactaagccgctggctgctcagtgggaaaggttgatgaatgcagcgggacttactgcccaggaacgcaggctgtggtga

SEQ ID NO: 9190 - RNA, 1023 nt, unidentified
  source 1..1023: mol_type = other RNA; note = synthetic construct
atgctcacgctcgcccacttagctcaccaaacgggcgcgccatatatctatctccgcgagattgtgcagagggtgcgggacccctacgcagaattttcacgcccgaaaagagaaccaggtaaggccagagttatcgcagcacctgatggggtgctgatggatgttcagcgatggttgctcgctggtctgttcggacgcattcagccccaccgcgcctcttacgcctaccagcaagggcgatctgcagtgcagtgcgcccagcgacacctaggagcctcctggttgctgaagttcgatctgcacgatttctttcacagcatcgacgaaagagccgtccaagccctcgtccgggaatcaggctacaatcggctggtgagttttgagattgctagagtgtgtaccaggctgcccggcggaaatacagtgccttatactaggagcgcctaccagggtatacccacctataggaccgggacacttggcttcttgccacaaggggcacctaccagcggcgctatcgctaacctgattgcccggactctcgacgacagtcttgtcgccatagctgaccggtacgatatgacctatactaggtacgccgatgacatgaccttgtctacctcccgcaatctggatagatcagtcttaactagatgcgtagctgagattagcgctaccgttgcgcgaacacgctttaggctgcaccgcaaaaagactaggatcgtgccacctggcgcccggaagatcgtactcggactgctagttgacggtgatcgtgtccggctgccgcgtcatacaagaaggcggttggaagaccatattagagggacaacaagtttcggactgactgcccatgtagcgcatgccggctattcctccttgcaggggtttgtgaaccatatcgacggccttttatcgtacgctcgaggagtggacgcagcgtgggcagatcagctgaaggcaaaatgggaggacgctatggccgcagagggactgaacggccttgagcgtcacgcttggtga

SEQ ID NO: 9191 - RNA, 1056 nt, unidentified
  source 1..1056: mol_type = other RNA; note = synthetic construct
atgcgtggcttagatgcacgcgggctcacacctgtcctcacgctggctcacctggctcatctcactggtgccccctatttgtatctgcgggagattgtgcagcgccggcgagatccttacacagagttctctcgacctaaaagagagatcgggaagactcgaacgattgcggcaccggaccctgtcctgatggacgtgcagaggtggctgcttcggcacgtgtttggaaggctcaccccccaccaggcttcatacgcataccagcagggccgcagcgctgtccaatgtgcccaacgccatctgggtgccacttggctcctcaaattcgatctgcataatttcttcccaagcattaacgaacgagcggttcaggccgtggtacacgccgctggatacaataaactgatatcgtttgagatcgcgaggctttgcacaagagtgccctgggtcgtggagtggccatattctggctcctcataccaaaccatagacacctatcggacaccccgtgtaggccgcttgcctcaaggggcaccaacaagcggagctttagctaacctggttgccaggccccttgacgaaacgttatccgctctagccgagaggtatgacctgacttatactcggtacgccgatgacatgaccttttctgctttcagacgctttgaacgacctgccctgacccggtgtgtggcagaaatcacccaggccgtcgcagcaactagctttacactgcataggaagaagacaagagtagtgccaccgggcgccaggaaaattgtgctaggcttgttggtggacggggatgaggtgaggcttccccgtcagaccagaaagcgcctagaagaccacatcagaggggtggcaaagtttggctttaccgcccacgtcgaacacatcaggttctccagtctccagggtttcacccatcacgttgacggtctgttggcgtacgcccagggagttgatgccgcatgggccagaccacttacccggcagtgggaggatctgctgactgctgagggattctccatcctcgaaagaagtcggtggtga

SEQ ID NO: 9192 - RNA, 1170 nt, unidentified
  source 1..1170: mol_type = other RNA; note = synthetic construct
atgagcaccgactctcccgcggcctatcagagaatcggccggcagagaggggtgccagatgtagtggtggaggcagcactggaacaaattcgccgggtgagggctgtcaatctgacaccggttctctctctgaaacacctggctcatcttaccggcgctagctacatctatttgcgtgagactgtccagcgaaagcgcgacccatatgtcgaattcagccgtccaaaacgggctgagggccagttgcgcacaatcagtgcccctgatccgcccctcatggccgttcagagatggatattgcagagaattttctcaagactgcacccccactcagcatcttacgcctaccaagcgggaaggtccgctcggcagtgtgccgaacagcaccttggcgccaggtggctgctcaagtttgacctacacagcttcttccactccattaacgaacgcgccgtttttggaattctagcaggacagggttataacaggctggtttcgtttgaaatcgccagactgtgcacgaggtacgcggggcatgtgagaggcctcaatttcagcaagtttcgggccaccgccagttggcctcaccacttcacaatcccttcttactcggtgccatggctggggttcttaccccagggagcacccaccagcggagccatagctaatatgactgctttgcagctggacgagctgctgtccgacgtagccgatcggtatggccttgtttacacaaggtacgctgatgatttaaccttttcaactgtgggaaggctagcgcgcagtgctgcccgaagatgcgttggggaggtacaggctgcaacggcccaggcaggcttccaactccatcaacgaaagacccgtgtggtccctcctggttctcgcaaaattgtgcttggtctgttggtggactcagactgtgtccgactcccagctgacgcccggagtaggctggagacacatgtgcggggtgtagcgaggttcggccttgtcgcacacgctcagcattggaagtataactccctcactgggctgatccatcgagtggacggcctgctggcacatgcacgcgatgtggatcctctctgggtcgcccccttatggcgcagctggaacgatgccttggaggcccaggggttttccgacgtggagtttagacaatggtcctga

SEQ ID NO: 9193 - RNA, 1095 nt, unidentified
  source 1..1095: mol_type = other RNA; note = synthetic construct
atggagggagctggccgcgcagcaatcctgaccctaggccacctggcacaccttactggcgtgagttcacacttcctcagacaggttgttgagcggaggagagatccatatcatgccttttccatttcaaagcggagtcccgagcgagggaaacggacgatttcagccccctccgccgagatgatgagcgtccagaagtggctcctgaagcgagtcctaaaccctgccatcggccatcccaacagcttcgcttatgagccgggtaggtcaattaggcaatgtgcggcacggcactgtggcgccagatggatcgtgtccctggacctgcacgacttttttcatagtgtggacgagaaaagggtgttccaggtcttcgagacactcgggtacaatcgcctggtaagctttgaattgtcccgcatatgcacccggctaattggaagaaatatcaagcctagtaacgtacggcccgagacttactccattagcgcatacgtttctgaaaacctcggatttctgcctcagggcgcgccaacttctgggaaactcgccaacctggttgctgcggacctggacgagagattactgtctctcgccacagaataccgccttgtgtataccaggtatgctgacgacttatttttttctagttctggcgacttcgacagagccgtggccgtgagattaatccgagaaatcggtgatctggtggctgtcagcggattcgagatacacaggaagaaaacccgagtccttacccccgggtcgcgtaagcagatactgggtcttctggtggatgatcttgccggtccaagattgacaaggcgcactagagctcaaattgaggcgcacctgcgaggggtcgagacattcggagtcgtggcccaccgcgaacatcggaggttcgatagcacgtggggattcgtggctcatgtatggggcctcttggcctttgctgcttcaatcgaacctgattgggcacgtccagcccgtttccgctgggaaaatgcattgagccgggatgggtggggctctgatgtgtttaggccggacctgtacttcgttaattcccatttggcagaacgcgaatcctga

SEQ ID NO: 9194 - RNA, 1128 nt, unidentified
  source 1..1128: mol_type = other RNA; note = synthetic construct
atgattactgacagccctcacctctatgtaaggaacgggttggccgctggcctccctatcgagctacttgacttgtttgtgaggcgggcccaagccacagaacagcagggaatcagggcagttctgacgctgaaacacctggctcaccagacgggagctgatcatcgatacctgagagatattgtggggcgtgagatagatccttatactgagttcgaactgcgcgggaagcgacgtattagctctccacgcgctcccctcctagcagtccagaagtggatgttaactcacatactcaatcatgtgccctgccacccctccagctttgcatacgagcggcaaaagtcggtggcgcagtgcgcgagaagacacttgggggctaattggctcgtgaagctggacatgcatgatttcttcgccagtattgatgagaggcagatctttcacgtttttagtgagttaggctttgggcgccttgtctccttcgaactagcaaggctgtgtaccagaccaggaatcggagccagacattctgtcgcggctgaaaaagctgcctcaagcgctgactacacagtgattgataagtaccagaccgccgtcggcttaggcttcctgccgcaaggatcacccacctccggagcccttgccaacctggtgatgcgcgatgccgacatgcagatcgctgaggcagtagccggcacaggtattgtgtacaccagatatgcagacgatatagcgttctcaacatcccggaagttctctcggagggaagccagcgagctgatccggatgactgatcatattttgggacgctctggcttcctgagacacaataaaaagacccaggttattcctccaggcgcacgaaaaatagtgctgggcctgcttgttgacggggaccgtttgaggatcccggtcgacgctcggaaccgcatcatcaacgacatctggggtgctgaacggtttgggctgccagcccatgcaagacatcggggtttctccagcaccatcagttttggcgaacgactcgccggtatgctcgcctactgtcacgatgtggaccctaaatggacagcacccctttggcgcaggtgggccaaaatcctgtctgactatgagattcgatga

SEQ ID NO: 9195 - RNA, 1149 nt, unidentified
  source 1..1149: mol_type = other RNA; note = synthetic construct
atgataaccgactccccgcacttgtatagggtccgaggcctactcgccgaccactcaacagccttgattgagaacgctatcgcccaggcacatcaggtcgaggctaggggacttgaagctgttctgagcctgaatcatctggctcggcgtactggggcgaccaggaattatctccgggacatagtcgagagaagactggacccatatactgagttccagaagacctccagtacgagagcacgcacaatcagcgcccctaggcaacctctgatggaagtgcaacgctggattctgagaaacatcctaggccgagtgcctgctggccccttctcctttgcgtacgagcataacaaaagcatcactatgtgtgcccgacgccatttaggctgcaagtggctgatcaaagttgatctccacgatttctttagttctatcgacgaagtcgcagtgtacgccatttttcatgggttaggataccaggcactcccatctctcgagcttgcccgcatttgcacccgtcagggtgtgggcgcgtctcacaagcgtcactttccctcagccagccgcgtagacaggtaccagcggatccccgcctatctgagtagggcgctgggattccttccccagggttcacccacatcaggcgctctggctaatcttgtaatgaagtccctggacgaacacatagccgcattgagccacccgttcggatttgtctacacacggtacgcagacgacctggttttcagctccgcagatagatttgacaggaagatcgcaattgggctgattcaccgagtgactgatcttttacgcacgcacgagttcattgtccacagggccaaaacaagagtggtgcctcctggggctaaaaaaatcgttctcggattgcaagtggatggtgatagagtgcgcctcccaccagatgcacggaggagaataaccgaaaacatcagaggtgttgaacgattcggcctaaccgaccatgtggcccatcgccattatagttctgtggtgggctttgtcgagcggatgcgggggctgctggctttctcgtacgatgtagataaggagtggaccgccccagtgtggattcggtggggagaagccttggaaagggccgggtattgggagcggactgcttggtga

SEQ ID NO: 9196 - RNA, 1140 nt, unidentified
  source 1..1140: mol_type = other RNA; note = synthetic construct
atgaccctggactccccgcatttgtatcgagccgccgctgctcggctaggtatctctgcggagactgccaacaatgcgattcgcgaaacggagttactccgggatgccggcgctacaccagtgttaaccctcggccatctggctcacctgactggggccaagcattcatacctgagagccattgtggaaagaaggattgatccctatgaggagtttaccagaatgcgacgtaatggagggaagatgcggatgataagcagccccgagcctgtactgatggaagtgcagcgctggatactcaccaacgttcttacgcgagcaaaaccacaccatgccagctacgcctatactagagacagatccgttgcggcctgcgctcgtcgacatgtaggagctcgcttcatgattaagcttgacctgcacgacttttttcacagcatcaatgaataccgtgtttatagtctctatagaaacctgggctacaatcggctggtcagtttggagctgtctcggattacaacccgatacagtgaattcgctctgcaaactccgatccctgcccctaggacgggggattacccaatgatccccaggtacagggtcaactatctcggctttctgccacagggtggagcctcgagtggagccgtggctaatctggtagtccgccggatggaccacgaaattcagtccatggcgtccgaccattcattaacatatacccgctacgctgatgatcttgtgttgtccggcgcaggagagttctctcgcgatacatgtcgcgatgtggtgcggttgatccggaggatcgtgtctcacaacggcttccatctgcacgaaaaaaaaacaaggcttactagccccggggggaggaaggttgttctcggagtcacagtcaccgacagcggcattaaactttcaagagagatcaaggcaagattggccaaccatctgtacggcgccgggaagtttggaatcggcagacacgcatcctctcgcgggttcacttcaacagtgggttttgtcaggcacatgaggggcctactcgcatacgcccacgacatcgaccctgatttcgctgcacccctggcagcacgttggagggaggtggaggtgagagacggtacccggatagcatga

SEQ ID NO: 9197 - RNA, 1134 nt, unidentified
  source 1..1134: mol_type = other RNA; note = synthetic construct
atgacctacgattcacctcatctgtacagaaaactcggacgcgagcgtggggtggacgatcaggtcctggatagggccatgcgccagatatcccgcttgagggcagccggagttacgccagtcctgactttgaatcacctggctcaccttaccggcgccaagtatgggtatcttcggagaatcgtggcccgggaactcgacccctacaccgaattcactagacaacgaaggacaggcgggaaaatgcgactgatatcagccccccagcctgttctgcgggacgtacaaaggtgggtgctggaccgcatcctccaccggatcccggttcacccagctgcatacgcttacgtgcccggaagaagcgtagcagcttgcgcccgctgccatattggcgctcggtacttattgaagttcgatctgcatgactttttccagtctatatcagagtaccgcgtgtttagtgtctacagatctcttggatatcagccactgattagcctcgagcttgctcgcctatgcactcgggatagcgccgcagtgtttgggcgacgtaccttgaccgcccctcaagtggagagataccaggctattcctgcatatcggtctggctcccttggttttgtccctcaaggctcccccaccagtggagcgatcgctaatcttgtgactcgcaggctggacaccggactgcagcgactagccgtatccgccgggctgacttatacgaggtacgccgatgatatcgtcctgggagggagcgatgccttcgacagggaacattgtcgtaaattggtgagagaagtccggaagatcgtgaggcacaacggtttttgtctgcaggaaaagaagctgagaatcataccgcccggggctaggcgtatcgtcttaggcgttgttctcacagacgacgggattacaattagtagggaggttaaggatcggctcgccaaacatctcttcggcgcagaccgattcggtattcatcgccacgcggagcactatggctttacatcggtgttcggctttgcgaaccacgtgacaggtctgctcgcattcgcggctgatatcgacccaggttatgccagaccattaatcagacagtggcaggcaattgagagccggtctggcgtgtga

SEQ ID NO: 9198 - RNA, 957 nt, unidentified
  source 1..957: mol_type = other RNA; note = synthetic construct
atgatttccgacagcccacaccaatatcgccttcagggcgcatcccgagaggtgcctgcccaagttatcgagaactctattgcccaggctcaggtgactgaatccagaaacctgagagctgtcctcagtctgaagcaccttgcccaccagaccggttgctcttatatttacctgagggaaatcgtacagagagtcagggacccctattcaaccttctcacgccgtagaaggtcgggcgtgagaatgagaagcatatcatcccctaacccgccattgatggcggtgcagcgatggatcctgcgtaatatccttaaccatgtggaccctcatccctcttccttcgcataccagaggaataggagcattgtacagtgcgcctctcggcatataggggccgattggctgctcaagctggatctctttgactactttccaagcatctccgaagaggtggtgtactgggagttccgacgatctggatatagccggctcgtcgccttcgaactggctcggatctgtacaaggccaacgaatgagtcacccccgatccggagtcgcagcaaatatcgcgccattcccagctacgcctcagcaaaagaggccggcattttgcctcagggggctcctacatctggagcgatcgcgaatttagtgtcacgccaattagatattagcctgacgcggttggccaacgcaagcggtctaacatacactaggtactctgatgacctggtttttagtgggacaggacccctaaatcgcgacaccgcaactcagaaaatccgggagatcgacaacattatatcctcttgcggctttgaaacccaccggaagaagacaaggatagttacccctgggggcagtaaagattgtagcggaccctcaagtaatagtgtccgctccccaactgcttccagagtccaagctaaggatcaggacacccactcgagacgttga

SEQ ID NO: 9199 - RNA, 1122 nt, unidentified
  source 1..1122: mol_type = other RNA; note = synthetic construct
atggtgattgattctccccatgcatatagactccggggccttcagcaggggcacgatccagaattgctccgaagagcggtggccgaggctgacagagtagaggggcgtgggctgacatcagtactgaccctaaagcacctcgcccaccagacgggcgcaacctacatctacctgagggagatagtgcaacgcaagcgggatccctataccgagattttaaggtcccgggcaaatggcaggcccatgagactgattagcgcccccgatccagtgctgatgtcagttcagcgatggatcctggaaaacattgtgggacgactcacggtgcatcctgcttctgctgcatacgggaagggtaacagtgtggcggcttgcgccaggcgacatgttggtgcctcctggctcgttaagatggatgtccacaacttctttcacagcatcgacgagcgcgccatatacaaaattttccagaacgtcggctattcttcactggtggctttcgagctctccaggatatgtactagacctgttccaggaagcccccatatccacccagtaaggcgcgacagagtgatcgaatcttattccacagctaacttaggcatcctgcctcagggagcccctacttcaggcgtgcttgccaatatcagtttttttgcttgcgatgaaatcttgagcagtctggcagaatcgtgtggattggtctacacccggtacgcagatgacattgtcttttccgccggagaaagttttacacgaagagacgcagacgcgctgatagagatcgcgcgtgacgccttacttgcccatgggctaactcctcaccgtggcaaaacacaggtggtgccgccgggtgggaggcatatcgtccttggccttttggtagacggcgaccgcgttcgcctcaccagagagttccgccaacgggtccaaacacatattagaggagtggaaaacttcggtctggctacccaccggaggcaccggaaattcgcaagcactgctggcctgattaatcatgtgaatggactgctggccttcgcctttgacgtcgatccagcttgggccggggagattcgcgcacactgggctagcatcttggccgcccagatgaatcggtga

SEQ ID NO: 9200 - RNA, 1149 nt, unidentified
  source 1..1149: mol_type = other RNA; note = synthetic construct
atgactgtggcatctcctcatctgtatcggcggcacgccccagagaatacagatcgtcagctggttgaaagggccctggctcagagctccgcccctctttccaaggggctcccttctatcctaactctgaggcaccttggccatctgaccggggctgattacaagtatctgagatcggtggtgcaacgtgaatacgacggctacaggaccttcagtatcagaaagaggtcgggcggtacccggttgattgcatccccagagcctgtgctgggcgaggtacagagatggattgccagtaaagttctcaataaggtcagcgttcacaaaaattctttcgcttataagcccggctcaaaccccaaaaagtgcgcgtccgtacatcttggggcttcatggcttataaaaatcgatatccacgacttctttgagtccataaccgagaggcgcgtgtactattctttcctggactgtggatatcaacccctggttgcatttgaactgagtcgcctgtgcacacgcgtgttcaccggaaaaccgaacgtggggccgcagtggtccacaagacgaagacacgggtcaagagtctatgcaacttctgaactgggtcacctcccacagggggcacccacaagtcccatgttaagcaatatggtgtccttcgagcttgaccacaagctcagcaccctcgccaacgattacggttttgtgtacaccaggtactcagatgatctggccttcagttctggagagaagttcactcataaagctgccggagagtttgtccaaaatattgaccggatcctaaagagctttggccatgtaatacatcagcggaagacaacgattgccccacctggagccagaaaagtcgtcttaggactgttggtggacggaagcagcccccgactctccaaagaactcagggctcgagtgtcagaccacgtgcgtggcatcgagaagtttggcttagcaatgcacgcttccgaacgccattttgcgagtatctgggggatggtcaaccacgtgaacggtctaatcagccatgtccgcggcgttgacccagaactgggcagcaacttgcgctctcggttgacgactgccttggcgattcaggggtggtcagctgagacaattgccggtcacccttga

SEQ ID NO: 9201 - RNA, 1167 nt, unidentified
  source 1..1167: mol_type = other RNA; note = synthetic construct
atgacctctatccccccacacctataccgaaagctggccccaaaagaactggatcctgtcattgtagatcgggccctggaccaactgttagctgtagaggctaaccgcttgcccggcatcttatcccttagacacttggccgccctaacccgtagtgactacctgtacctgagatccatcgtggcccgggagacagacgcctatcgtacctttactattaggaaacgctctggtggaggcaggctcatcgcagctcctcagcccgaattgatggccctccagcggtggatttcaaaggaaatactggcaaatataacgccccatgtggcgagccacgcttatgcacgcaagagctcaccactgaagtgtgcgaatctgcacgtgggcgctagttggctcataaaggtggacattcacgatttctttgaatcaatcactgagcggagagtgttcttcgcatttcgacagatggggtaccagcctatcgtcgcctttgaactggctcgcatttgcacacgtgtgcggattgatctgcccctaagggaccgaaggtttgccgccgcgcgaaggacagtcggaattgctaaatatgggcattcacagatgggctatcttccgcaaggcgcaccgacgtctcccatgctcgcaaatctcgtcagcttcgagatggatagaaaactgaccgagtttggggctgagaagggcctgacttacactagatactccgacgaccttatattctccagcggacgaagtctcagccacaagaccgcagagacatatgtggcgatcatctctaggatcatcaatagcttcgggcatgacgtgcatgaacgcaaaaccaccattgcccctccaggcgcgcggaaagttgttctgggtctgctcgttgacgacacaggggtgagactgcttagggagacacgcgatagagctgccgatcacgtgaggggcattgagaagttcggactggcagcccacgctactgagcgccattttgcttccctgtggggaatggttcggcatatccacggattgctgaggcatatgaacagtgtgcagcctgaggtcgccggtccactcttagcccggttggaagccgtacttgcaagagaaaagtggcaggggtcgttggatgacaacttctggctcaacgatcttttatga

SEQ ID NO: 9202 - RNA, 1149 nt, unidentified
  source 1..1149: mol_type = other RNA; note = synthetic construct
atgatttctgccagtccccaccagtatcgtgcgtcggcattagcccgcggaattacacaacaaaccgtgcagcacgccttggaccaggccgaacaggctgagaagaggggagcgcctgctatcctgacgctgcgtcatctggcccacgtgactggggcggattataaatacctgcggctgattgtctcaaggtctgaagacgggtataagccttttaccataaggaagaaaagcgggggtggacggctaatcgcagcaccagagccccaactcctttccgtacagcggtggattagccgcaatgttttggccaacaggccagttcactctagcagtatggcctacgccccaggtgctagtcccctgaaatgcgccgctcgacatgtaggggctagatggctgctcaaatttgatatccatgacttctttgagagcattagtgaggacagggtatactgggcattcagatcctgtgggtatcagcctttgatcgcattcgaactcgcccgcatctgcaccagagtacacagcccgtacgtccagatagattcaagatggcggtctggccggactcatggtcctgcagaaatcaccgcctactctgatgatcgcctcggccatcttgcacagggggctccaacatctcccatgctgtccaacctggtgagcgagccaatggacgacctcttggcgaagattgcacgggaaaggggcctggtgtatacgcgatactcagacgacgtggtgtttagtaccggcactaccatcactcggcgcgaggtgagaaacctggttcacgatgtgaagcgcgtgttcaattccttcggccacctgttgcatcggaagaaagttgtgatcgctccgcctggagcgcgaaagctcgtcttaggcttacttgtcgatggagacgaggtgcgtctttcaagagagtacagagcccgagtggaatcccacgtcagggggattgagaaattcggcctggccgagcatgctgcatctaggcattttacatccgtctggggaatggtccgccacgtgggtggccttatagctcacagcagagctgttgatcaaacatatggcgacagcatgcagctacgactctcagctgccctggaagcctcgggatggtccgatgcctccccctga

SEQ ID NO: 9203 - RNA, 1233 nt, unidentified
  source 1..1233: mol_type = other RNA; note = synthetic construct
atgatttctgcctccccaaatctctatcggtctgaaggagctgagcgctcaattgaccccctgattgtcgagcatgcattgcagcaggccttgcccgttgagcggaaaagactccctgccatcttgacactcggacacctggcacaccttacaggcattaactacgcctacctccgagcaatcgtggagaggcatgccgacccttacactcctttcagaatcggcaagcgcaaggggggctctagattgatctcagcacccgagccgctacttctcgccctccaacgctggctggcgaggaacgtgctgaataacatagaagtgcatcatgccagctgcgcatatgcacaggactgcagtccagcccggtgtgctacgagacatctgggcgctgcctggctgatcaaggttgacatccacgactttttcgagagtattactgagcgtgctgcctggcgggtctttaggagcgccggttatcagcccctgataagcctggaactggccagactgtgtacgaggcaacctcacggacgggagatagtgaacccaaagtggcacgtggaggatgcagggtcctattcgatccgtccttacagaactcgaatgatgggtcatctgccgcagggcgccccaacaagtccaatgcttgctaatctggcctcttttcgattggacgaagctttagaggctttgggggggcgctatggcatggtgtacacccgctattctgacgatatcgcattcagcaccggaggcaccttcgatcgcaaaagagctggtcagcttattatagaagtcgaacgtatcttcagatccttcggtcacgctctgcaccggaagaaaatcagcgtagcgccacctggagcgaggaaggtcgtcctggggcttctcgttcatgggtcacgactccggctaaccggcccgtacagacgcaggctagctgaccacgtgcgcggagtggaacagtttgggctgtccgctcacaaagctcacaggcactttgccagtctttggggcatggtgcggcatattcagggactgctgggatacgccgagagcgtggaggggaaagcagcgcacgcggatatgcgagccaggctcgatgccgcattagccagggatggttggcccgacggaatgcctcccgaaacccccatgccagcacagcaacccccacctgatgtaggctccgcagctgttacatcatccgctttacctcccgccggctga

SEQ ID NO: 9204 - RNA, 1152 nt, unidentified
  source 1..1152: mol_type = other RNA; note = synthetic construct
atgatctcggcctctcctcaccagtatagggccgatggcagggcaagaggtagaccagagccggttcttgatgctgcgctagctcaagcagcggggccagaattacagggcgctcctgccatcctgacactgatgcatcttgctaagcgaatggacgtgtcctacaaatttctgcggagcgtgatcgcgagtaaggagggtacccactatagggactttcacatttctaaacgcgacggcgggggacgaagaatcgctgttcctagtcccgaactgatggcagtgcaacggtggatcgtccgcgaaatcctgcgtgataggcccgtacaccgggccagcttcgcttatgcacggggttgcagcatctacgcttgtgcacggaggcacgcttcagcggggtggttactcaagctggacattcacgacttcttcgagagcattcccgagaaggccgtctatagggtctttcgagagataggatacgcccgcctggtgtcctttgagctagcccgcttgtgcacacggccttgggtggcacctccaagagggaagagagccgagaggaccgtcgccaatcccagcagaagaggaattgaaatataccgccgcgagttgaccggttacctgccacagggcgcccctacttccccgatgctcagtaacttggtgttccgagttctcgacgaacatctttcacagcttgccaccaggcacgggctcatttacactcgctattctgatgacctgaccttctccggacccgcctctggatttagccgcgatcgcgccacggaaataatctcagaagttagggatttgcttgccactcggcgattcaggctgcatgagagaaaaattacaattgtgccacccggaggccgcaaagtagtgttagacctactcgtcgaccgggccgcaccacgtctgtcaagggagctgcgtgggcggctcgaagatcatgtgcggggcatagagaagttcggaattgcgccacatgcagcagctagaggcttcgcttccgcaacaggcatgatcaaccatatcgctgggctcctgagatttgcaggccacatccagccagctttcgccgatcccctgagagcccgatttgccgctgctttggcccgttggcggtggagtcctgtggactga

SEQ ID NO: 9205 - RNA, 1029 nt, unidentified
  source 1..1029: mol_type = other RNA; note = synthetic construct
atgataagtgctagcccacaccagtatagagccgatgggagggcactaggacgtcccgaaccggtactggacgcagctttagcccaggctggtagagcagaagcgtcaggcgccccagcgattctaactctgatgcacctagccaagcgcatggacgtgagccatacatttctcaggtctgtggttggttccaaagaaggtacccactaccgggaatttcacatcagcaaacgcgacggaggcggcagaaggatcgccgtaccttcacctgaactgatggccgttcagcgatggattgtccgggaaatcctgagggaccgacctgtccatcccgcctctttcgcatacgccagagggagtagcatctacgcctgtgcaagacagcatgcaggggccgggtggctgctcaagttggatatacacgattttttcgagtccatttccgagaagagcatttaccgggtgtttagggagatcggctacggacggttggtggcattcgagcttgccagactgtgcacacgtccgtgggtggctcctccaaggggaacgagggcagctcgatccgttgctaacgcctcaagacggggaatcgagttctatcggcgggacctcacaggatacctcccccagggggctccaacttctcccatgcttagtaatcttgtgttcagggtgctcgatgaacgactgtctcaattagctgcaaggaacggccttatctatacccgctatagcgatgacttgaccttttcaggcccagcctccggcttctcgagagccaatgctgccgccttcattggccaagtccgtgagttactggctacccgtagattccggctgcacgagcgcaagattaacattgtgcccccgggcggacgaaaagttgtgctggggttgctcgtggatcgctccgtgccacgcctgtctagggagctgcgcaatagactggaggaccatgtccgcagcgcgataccccctgcgatggtcgtacggatcggtcctcccatctcgactttttctagttga

SEQ ID NO: 9206 - RNA, 1170 nt, unidentified
  source 1..1170: mol_type = other RNA; note = synthetic construct
atgatcggggccagcccccatcgctatgttgtggatggtcgggccagcggccgaagcgatgaactactagttcgcgctctggcacaggctagatccgttgaggtcgctggagcccccgccatagtgacactgcggcacttggccgcgagaatgggcgtggactaccgatatttgcggtctgtaattgcgaacagatcaggagatcggtacagagacttctccatttctaaacgaggtggaggagggagacggattgccgtgcccgaaccaacacttatggcggtgcagcggtggatcgtgcgagagatactccgtggacgcccagtacatcctgactctcacgcctatgccgctggctcctccatagtggcttgtgcacgcagacattgcatggccggctggttactgaaattggacattcacgacttcttcgagagtgtaccggaacgctccgtgtacgatgtgttcaggaccatcgggtaccagccactggtgagcttcgagctggcccgtctgtgcactcggccatgggtggatccccctcaggataggcgggcagccagaaccgtatcaaatcacgccaacagaggcattgacctttaccgcagagaactgaccggctttctcccccaaggagcaccgaccagtcccatgctgtcaaacttagcctgtgtcggcctcgacggcaggctgtctagcttagcacgctcagctggtctgacttatacgcggtacagcgatgaccttacatttagtggtcctcccggaactttcgacaggagccacgcggtcgctatggttgacggggtccgtgatgtcctgagggatcacggctttcgaatgcatgagagaaagattagtatcgtgcctcctggtgggcgtaaggttgtcctcggactgctggtggacagggataggccgcgacttcctggggggcttcgccaaaggttgtctgatcacgtgcggggaatcgagggattcggcatcgccgcgcatgcagccgagagaaattttgaggccgttacagggatggtcaatcatatcgctggcctgctccggtttgcaagggacgtggagcctgccttcgcagacagactcagggtccgctttgaagctgcactcgctaggcacggttggggcgctgcaccagaatcggggtccgaaccatga

SEQ ID NO: 9207 - RNA, 2118 nt, unidentified
  source 1..2118: mol_type = other RNA; note = synthetic construct
atgactactacagacgacttcgccgacctgacaccagagcaattcctcgaggccgtcgtgtcagggtcaatccacccatacaccgaacataggattcctaagagaagaggcggactacgcaccttgcatgctcccgtgcctcgcctttccgagatacagcaggccgtcctggctaggctggaaaccctgccagccgaagtgcaaccccatccggcagcttttgcttaccgcagaggtaggagtgtagtcgactgcgccaccgtacatctccgagcccacactgtgataaggctggacattgcagatttctttggcagcattcgagagcgccacgtccacgctgctctgaaggatgcttggacacgtcccacggagcctgagtaccgggtgggtttagtgaaggatgacaacggaagaaggaaaattggcctgcggcgggatggccgtacactggatacctatatcacagcaagattggttaccgtttctccgcccgaaccgagccagacttggaccaatcggggaactggaaggcgctcagtgtatttggcagcgacagggcaggaattctccgtgcggaggccacatttggtgtatcggcacacgcgtgagggctttctccctcagggcgcaccgacctctgggtacctcagcaacatcgtgatgcgcgacgtcgacgaggttgtagcccatcaggcagaaagccttgggctgagatatacccgctactctgatgacatgtatttcagcagtcgaggcctcgtgcggcatgatgacgttgatcgcctggttgccggcgtcaaagaggcacttgaacccctggggatgaagctgaacgccgagaaaacctacgtcgccagacctggagccaggcggtcagtactcggaatccttgtagacgggcctactccacgattgacaagggagtacaagcgccggattacgaagcacgttcgcggggccgcgagctttggcattgagcagcacagaaggcaccaggaattcgaggatctggcagaactggatgctcatgtgaccgggctcctctcttttgctcatatgatcgaacctgcctgggccgagaagcagctgactgcttggaagcgactgcgagggattcccctggagcacgaagaaccagtgtctgcgcagcacggcctcgacctaccatgggaggaggagatggaggtcagccaggccgacctggctaaggattccatcgacgatctgatcaggggcgcgcagaggtataggagctcttcagattatctccagatgctggaattcgttgggagatttaaacggtacgctccttttaatgccatggtcgtgcatatccagaaacccggtgcaaggtatgtattaccctccagtgagtgggagtccaagtaccgtcgcgtgcttaagccaggtgcgaagcctcttttgatatttcaacccagaggcccctacctgctggtgtacgacgtgggcgataccgaagcactacctggcgcactgccattgcctcgcgggattaccgcgcctgtgtcagtgtcgtccagagccggagaaagagaggtgctagaagtgtggcaccacaccgagactaacctcgccccattaggaattcgactgacattagttgaccatggagccagctcctgtgggagaacctatagaagtcggtccggcgggtctgtcaaacgtcccggaggtagacgaggagatcccccagagacttaccccacactattcgagatcgaagtcaatggtaatctccctctgctggaccggtatgcaacactggctcacgaacttggccacttattctgcggacacttaggggccggacccggtgaaacatggccagatcggcagctgcggcctctgagtgaagaagatgccgtgaaggcacatgctcggaatgaggtggaggctgagagtatcgcctacatggttcttaaacgtcttgacccagacgtccgcatgggagactatataacgggtcacctcggcccagacaggcaagtgcccgagacggtcgcattgaacctcactttcaaagccgccggccttatcatcgagatgggtaaaaagaggctctcctcggctaaattgcaaaaaccgaagaaatga

SEQ ID NO: 9208 - RNA, 2118 nt, unidentified
  source 1..2118: mol_type = other RNA; note = synthetic construct
atgaccgcagcagatgatttctgggacctgaggcccgaggccttcatccacgccgtggtaagcggcagtatttacccctacacagaacatcggattcctaaacctcggggtggactgcggaccttacacgcacctattagacggctcagctggatacagcaggagatactggcacgcctgggcacactaccagctaggttccaaccacacccggccgcatttgcgtatagaaagggacgaagcgtcgtggactgtgctgctgtgcacctaagagcccatactgtgatccgcttggatgtggcagatttctttggcagtatccgggaacgtcatgtgcacgccgctcttaaaggtgcttggccccgaacagcagggcctgagtacaggatcgaactggtggaaggtgacgacgggtcaccggagatcggtctgcgcagggtgggacgaactctgggggcatacaccacagctcggttggtcaccgtctccccccctgagtcgaaccacacgtggcccaatagaggcacagggcggagggatgtgcgtctcgaagccactggtcagcgctttagtgtacgccggcccaccctggtccatcagcacactcacgaggggtttctcccccaaggggcacccacttctggttacttgtctaatatggtgatgagagacgttgacgcagtgctcgcgcataaggccgaatcctggggcctgagatatactcgatacagcgatgacttgtacttcagctcacgcggaccagtcagacctgaacgcgtagacaggctagttacagaagtgaagcgagcgctagagcctctgggaatgagactcaatgctaagaagacctatgtagcccggcctggggccagacgctctgtacttggcatactggtggatggcagcacaccacggttgaccagggcgtataaacgcaggatcacactccacgtcagaggcgccgcttccttcggcgtgatgcagcactgctatcatcagaagttcgaagatcttgccgaattggatgctcatgtgaccggtctgctgagttttgcccacatggttgagcctaggtgggcaggggagcaattggccgcctggaagaggctgcgggaaataccgctcgagcacgaggaacccgtgatgactcaacatggcctcgacctcctcttcgatgaggaggtcgacgtcagtcaggctgacttagctaaggcctccatcgacgatttggttcgtggcgcacagcgctatagatcttccgcggattatgtccaactgttagacttcgtgggcagatttaaacggtacgccccattcaacgcgatggttgtccatatccagcgccctggggcacggtacgttctgagcagcgctgagtggaaatcaaagttccttcgagtgcttcgtcctggcgcccagccgcttcttatttttcagccaaggggcccctatatgctggtgtacgatgtaggcgacaccgaggcgttacctggggcaaggcctttgcccagggaggtgacctcacccgtggctgttacctcgagggctggagccaagaaggtcgccgaagtgtggcatcatacagaagccaatctggccccactgggtgtgagactgacactggtcgatcacgccgcatcttcctatgggagaacttatccatcacgatccgatgggttcgtgagccgcccaggaggacgaccaggagatcgaccagagaagtaccccatcctttttgagattgaagttaacaggaacctctctctcctggaccggtatacgaccctggcccacgagctcggacacctgttttgcggtcatctgggcgctggaccaggagacgcttggcctgacagacgttggaggccccgctctgatgaggaacgcattgctgcccacgctcgtgacgaggttgaggccgaatccattgcgtacatggttcttaaaaggctggacccagatgtccaaatgggcgactacatcacgggacacttagggccggaccagcaggtgcccgactcagttgcactgaaccttacgtttcgggctgccggcctgattatcgagatggggcagaaaagagtgccagccgccaaactccagaaaactaagaaatga

SEQ ID NO: 9209 - RNA, 2118 nt, unidentified
  source 1..2118: mol_type = other RNA; note = synthetic construct
atgacaacagctgatgatttcgtggatctggaccccgcccagttcctgaaggcagtcgtgagtggttcgatctttccatatacggaacaccgtatccccaagcatagcggcgggatccgaactctgcatgctcccgttcctcgcttgtcggaacttcaacaggggatcctcgccagattggagacactccctgccaggtttcagccccacccagctgcgtttgcctatcggggcggtcgtagtgtcgtggattgtgctgcaattcatcttagagcccacacagtgatcagactcgatattgcagacttctttggttcaataagagagaggcatatccacgccgcccttaaagacgcatgggcgaggcctaccgaaagagagtatcgcatagacttggttaaggatggggacggatgccgggaagtagggctccgacggataggaaggaccttgtcaacatacacaaccgcaagactcgtcacggtatcccctccaggaagcagccgtacatggaccaatagggggactggaagacgctccgtatacttggaggccacaggccaaagcttcacagtctcccgcccggaactgttatataaggacacgagagaggggtttctgcctcagggggctcctacttctggttatctgtctaatatcgtgatgagagatgtggatgccgcagtgacgcacttagcagagagccttggcctgcggtacacacggtactcagatgatatgtacttcagctctaggagactggttaggcatgagaaagccgaccggctcgttgacggcgtgaaaaaagccctgataccccttggaatgcgcctcaacactaaaaaaacctatgtcgcccgccctggagcgagacgaagtgttctgggaatcctcgtagatggccccactccaaggctcactcgggaatacaaacgccgcattaccaagcatgtcagaggcgccgcttcctttggcattgagcagcactcccgccaccagggattcaagggcctggctgagcttgatgcacacgtcacagggctgctgtctttcgcccacatggtggagcctggctgggctgaagaacagctggccgactggaagcggttaagggaaattccattcgaacacgaagagccggttatcgcccagcacggtctggactggtatggcgacgaagaggtggaggtgtcccagagcgacctggccaaagcaagcatagatgatctcgtccgaggcgcccagaggtaccgaagttccgccgattacctacagatgcttgagttcgtgggaagatttaaaagatacgctcctttcaatgcgatggtcgtgcatattcagaagcctggtgctcgacacgtgctgtccagttcagaatggatgagtaagtatcgtcgagtactgaaacccggcgcccagcccttactgattttccagccccgaggaccctacatgctggtctacgacgttggcgacactgaggcacttccaggcgctcaaccacttccacgtactgtgactgctccagcatccgtcagtagccgggtgggggagaagaaactagtggagatttggcatcacaccggtaccaacctggcacctctgggaatcaggctgaccttggtgaacgacggggccagctcttatggacggacctaccgcaccaggtcagacggctttgtgcaacggccgggatcaaggccaggagacaggcctgaacggtatcccagattgtttgaaatcgaggtaaaccgcaacctgcccctactggaccgctacgccaccctagctcacgagctcggacatctgttttgcgggcatcttggcgcagggccaggtgacttctggccggatcgcaggtcaagacccagctctgacgaggaacgggtgaccgcacacgcgaggaatgaagtcgaggccgagtctattgcttacatggttctcaagcggctggatccagacgttcaaatgggcgattatatcatcggccatctcggtgtggggcaacaggtgccggagtctgtggctctcaatttgacttttaaggctgccgggctgatcattgagatgggcgggcgtcggttatccgcgaccaagttgcagaagcccaagaaatga

SEQ ID NO: 9210 - RNA, 2097 nt, unidentified
  source 1..2097: mol_type = other RNA; note = synthetic construct
atggcagatgacttcgccgatctctcccaggcgcagtttcggaaagcggtggtgagtggctcgatctatccctacaccgaacaccaaattcccaagcgcaggggaggcctgcgcattctgcacacaccagtcagaaggctgtctgagatgcagcgggggatcctcgctcggctggaacatctgcctgccggattccagccacatcctgccgcttgcgcctacaggtcaggcaggagcgtcgtggactgcgctgcagtgcacctcagagcgcacactgtgatacgtctggacatcgcggatttcttcggttcaattcgggagcggcacatccatgctgcactcaaagatgcctggtcccatctggccggacgggagtacagaatcgacttagtggaagatgggaatggtcgccaagaaattgggctcaggaggaccggcaggacacttaggacttttaccctggcgcgtcttgtaaccgtgtcccctcccggaccgaaccgcacttggacgaacagagggaccggaaggcgctctgtccacttggaggcaactggtcagtcatttagcgtttcacgaccagaccttgtgtataaacacacccgcgaaggattccttcctcagggcgctcccacctctgggtatgtcagtaacctggtcatgagagacttcgacgcggtgatcacgcatctggccgaatccctgggtctgcgatacacacgctattccgatgacatgtacttttcttcccgcaggctcgtccggcacgagcatgttgacagattgctggctggagtaaaagaggcactggagtccttggggatgcgactgaacacaaagaagacttatgtggcaaggcccggggcacgtagatccgtgttgggaatcctggtagacggcccagcccccaggctaacaagagagtataagcgccggatcacaaagcacttgcgaggcgccgccgcgttcggtatagaacagcaccggagacatcaggaatttaaggatctggtggaactcgatgcccatgtcacaggactattaagctttgcacacatggtagagcccggctgggccggtgaacagttggaggactggaaacgtctgcgggagatacctctagggcacgacgagcccgtgaccgtgcaacacggacttgatctaccttgggccgccgaagtagaagcctctcaggccgagttagctaaaacctcgatagatgatctcgtgcggggggcacaacgttatagaagctcttccgactatttggagatgcttgagttcgtcggtcgatttaagcgttacgctccttttaatgcaatggtggtgcacatccagaaaccaggcgccaggtacgtccttccaagcagcgagtggaagagcaagtaccagagagttcttcgccccggcgctcagcccttgctgattttccaaccgcgcggcccctatctgctggtgtacgatgttggcgacacggaggcactccctggcgctttgccactccctaaggccattactgctcccgtctctgtagcatctagagctagcgaaaaggaactggctgaagtgtggcattacactcaagttaatttagcccctctgggaattcggctgacactggttggccacggggccagtagctgtggacggacttatcgatcaacaagtgatgggttcgttgagcgaccgggaagtcggcccggtgatcatccagagaagtaccccactctgttcgagatcgaggtgaattggaatctgccgttactcgacagatatgtgacccttgcccatgagctggggcacctcctttgtggccatctcggctcagggccagaagatgcttggcctgaccgatttctgcctaaaacggtggaagttcacgctcgcaacgaagttgaggcagagagtattgcttacatggtcctcaagaggctggatcctgacgtccagatgggagactacatcaccgggcatttaggcccgaaccagcaggtgccagagacagtggcactcgacctggcctttaaagccgccggcttgatcatagagatgggtaaaagaaggattccagctaccaaactacagaaaccaaagaagtga

SEQ ID NO: 9211 - RNA, 2103 nt, unidentified
  source 1..2103: mol_type = other RNA; note = synthetic construct
atggctgacgattttgcagacctcgcccctgcccagtttctggaggccattgtcagcgggtctatctacccctacaccgagcataggatccccaaacgccgggggggaatcagaactctgcatgctcccatccctcggcttagcagaatacagcaggaaatcctgacatgtctcgaggcactgcctgcgagactccagccacatccagctgctttcgcctaccggtctgggagaagcgttgccgactgtgccgcagtgcatctgagggcacacacagtgatacgcttagacattgccgactttttcggaaatatccgagagcggcatgtgcacgctgcgcttaaagacgcttggacccgtcctaccgagagagagtacaggatagatctcgttgaggatgaccacggcggacaggaaattggtttgcggcgcactgggaggactctgggtacatatgctatggctcgcctcgtaactgtgagcccacctgagccctcagagacttggaccaatagaggaacaggcaggcggatcgtccgcttagaggctaccggccaggacttcagtgtccatagaccctccctagtctaccagcacacgcgcgagggttttctgccccaaggtgccccaacatccgggtatttgtccaatatggtgatgcgggaagtagacgccgcagtgactaacctggctgaatcaatgcaattacgctacaccagatatagcgatgacatgtatttcagctccagacggcttgttcggcacgacgacgttgatcggttggtggccggggtgaaaagagcactcgtctctcttggcatgaaactcaacgccaagaaaacatacgtggccaggcccggcgcacgtagatcagtcctaggcattctggttgacggccccaccccccgacttaccagagagtataagagacgaatcacaaaccatgtgcgtggcgccgcagctttcggcattgagcaacacagagatcaccagaaattcaaagacctggccgctctggacgctcatgtcaccggactcctgtcgtttgcccacgtcgttgagccaggatgggctgataaacagctgacggattggaagcgacttcgacgcatcccggaacaggaggagcctgtgattgtgcaacatgggctggaattgccgtgggacgaagaagtggaggtatctcaggagaatctggcaaaagcgtcaatcgacgatctggtgaggggagcccagcgatacaggagttcgtccgaatatttacacatgcttgagttcgtgggccgattcaagcgttacgcgcctttcaatgccatggtggtacacattcagaggccaggagcgcgctatgtgttgccaagctccgaatggaggtctaagtatcgacgggttctgaagccaggggcacagcccctgctcatctttcaacctcgcggaccctacatgctggtctacgacgtcggcgataccgaagccttgcctggggcctggcccttaccaaaagcgattacagcccccgtgtctgtgtcaagtcgggccgatgagagggatgtagccgagctgtggcacaacaccgagacaaatctggcaccgcttgggatccggctgacactggttgataatgccgctagttcctgcggccgtacgtatccaagcagaagtcgcgggttcgtagaacgccctggttctaggccgggcgaccgatcagagacataccctactctttttgagatagaagttaaccggaatctgccccgcctcgataggtatgccactttggctcatgagctgggccatctattttgcggacacctcggtgctggaccaggggaaacgtggccggatagaaggctccggtccagttctgaggccaccaacgtccacgcaaggaacgaagtggaagcagaatccattgcatatatggtcctgaagcgcgtggatcctgaagtgaggatgggcgattacatcaccggtcacttgggaccagaccagcgggtgccagaactagtggcgctgaacctaacttttaaggccgccggtttgataatcgagatgggcaagaagcgtattcctgcaagcaagctccaaaaggctaagaagtga

SEQ ID NO: 9212 - RNA, 1983 nt, unidentified
  source 1..1983: mol_type = other RNA; note = synthetic construct
atgagacttgtcgggtttagatcacacgagtacggagaatgcattaccgtggtgaccgacgcggcccataaggaatttctgtctgccgttgtctcaggcgccgtttacccctacgttgagcacgtagtcgccaagcgcaccagcggagtgagaactctccatgcgcccgtagagcagctagccagggagcagcgcatgatcctgacacaactacgggagcgtgggggatctgtccatccggcagcctacgcctataggacgggctattccgttgtcgattgtgcccaggtgcacatgaacgcgcatactgtggtaagactggacattgccgacttttttggatccatccgagaacggcatgtctatgaagtgttcgaggaactgcgtgatggacctacgcggtcgtatgagctgaccaggctgactacagtaagtcctccaacaagcaccgcttggcggaatcggggaactggcccgtctgtcaagagcggggtgatcgagagatcgccccgttacatgcataacagagagggattcctgcctcagggggcacccacttcagggattctgagcaatttagtgatgcgagccgtcgacgctcatctccatagttacgctgaaagacagggttggcgatataccagatactcagatgacctgtacttctcctcacgcaaactcgcggatcaccgtcagattgatcggctcattagagaggtgaaaaggaggctggggcttctgggtttgcacttgaacgataagaagacctgggtggctcgcccaggtgctaggagatccgtactcgggatcctagtggatggaccagtgctccggcttccgcagagctacaagcggcgaatcacaatgcacgttcgcggcgtatcttcttttggcatagctcatcatgcagaccacgctggctttataacggtggacgacctggattctcacgtgaccggtctgctatcatttgcacaccaggtggaacccgagtgggccgcagaacagctgcataagtggaggcgactcaggcgcttagctctgacccccagcgtgagtactgatgctgccgacctagttctcgctggcgccacggaggctaaagccagtatcgacgctcttgtggcaggcgcacaccgatatagatctgcacgcagctatgccgacctgttaagcttcgtgggcgcgttcaaaaggtactccccctttaatgccatgttgattagtctccaacgaccaggagcaaggtatgtcttaacagaggcccggtggcggtccgatttcagacgcgtattggagcctggcgcccaaccgctggtgatactgcagccaggtgggcccttcatggtggtgtatgacgttggcgacaccgaagcactgccaggcgcattggcccttccccctgaggttaccgacccagtgagcgtcagggccactatcacagctgccgacctccagcaaaggtgggattggaccgtgaataatctcgcccccttggggatccgtctgacttccgtcgatcacgccaattccagctgtggctccacataccgcgccaggacccagggtactgtcaaccgtctggcagccacagggcggacacaacctgaagagttccctctcttgttcgagatcgaggtgaacaaaaatcttaagccaattgacaggtatgcaaccgtcgtgcacgaactggctcaccttttttgcgggcacctcggcacgagtcccattacaaaatggcctgaccgccgaggaggtgctcagtctcggaacgaagtggaggctgaaagtataacccacatggttctgtccaggttagatccagacgtcgctatgggggattacatcctgggctacgttcggcgggcggatgatatgcctgacgtggcacttaacctgatgttcaaggcagcgggagaaatcattgaactgggctcaggaagaatccctactacaaaattgcgcgccgagcgcagagcttga

SEQ ID NO: 9213 - RNA, 1974 nt, unidentified
  source 1..1974: mol_type = other RNA; note = synthetic construct
atgcactatatgactatggcttccgccgtcggaaagagtgccccagacaggggtgctaccgaacgctttctcgcccaggtcgtgaggggagaagtctttccttacacagaattcccagtggcaaaacgtacgagcgggattcgcgtgttacatgcgccagtgcctgagctggccgctaagcaactggagatcctggggcgccttcagagaacagccgtaaccgatccagccgcctttgcctatcgggcaggctattccgtggtggactgtgcaagagtgcacctgcgggctcacaccgtggtgagactggatgtggcgaatttcttcggcagtatcctggagaggcacgtctactcagccctccaagaggtcgacgatgcaccctggtccaactatacaactactcgcttgaccactgtttctccccctgggtcgcctgcttggcgaaatcgagggacaggtgagcttgtgaaagatggttcagtcgagcgcagtgaccggtacatgcataatagggaaggcttcttgccccagggagccccaacgagcggaatgctgtctaatctggttatgagaaaggtcgacgaggccctgagagcgtacgcagagcatgagggcctccgctacacaaggtattccgatgatctctattttagctcccgaacctttgtggctcaccggcaggtagatgcattagtcaggaaggtgagacagagcctggcagagttagggctccgtctgaacgatcgtaagacatgggttgcacgccctgggcatcgtagatccgtgctgggcatcctcgtagacggcccgactccgagactgagtcgggattacaagcgaaaagtgacagttcacctgagaggggctgctgccttcggtgtggccgatcacgcctcatttcggggttttagcgctgccgagcagttggacgcacacctgaccggacttctgtccttcgcacatcaagtggaaccagcctgggccgctgaaagacttgcgacctggaagcggctcaggtcactggggacttcgcacggcactgaagccctagctgaccccgctcaccagctatctggggctgccgaggccaaagccagcatcgatgccctggtggccggtgctcatcgataccggggatctcaagcatatgtagaactcctgaagttcgtcggaacttttaagcggtattctccctacaacgcaatgctgataaacttgcagaaacctggcgctcggtacgccttgaccgaacctcgatggcggactgagtacggccgggttcttgaaccaggggcacagcccttggtgattctccagcctggcggcccattcatggtggtttatgatgtgggagacaccgaagctctacgaggcgcccatccccttccgcctgagataacaaacccagtcgctgttcagtcccgcatcagtgaccccgagcttaagcagaggtgggactggacactcaataatttagccccgctgggagttaggctcaccctggtaagccacgcgaactcatcatgcggaagcacttaccccgccagaaggtctggtacggtgaccaggcttagcgcgaccggcaagacacgccctgaagaattctccctgctcttcgaaatcgaagtaaatacccaccttgccctggtcgacaagtacgctaccttggtgcacgagctggctcatctcttctgcgggcatgcaggcccaagtcctgttgcctcttggcccgataggcgtggcggctcaaaagcgcgcaacgaagtcgaggcagagagcgtggcacatatggtgctggggagattggaccccgacgtaacaatgggcgattatattctgggtcacttagacaaagatggagacatgcccgaggttgcgctcaacgtgatgtttaaagtcgctggagacattatcgagctagggtctggccgcattgcaacgaataagttgaggaaagagctaggaagatga

SEQ ID NO: 9214 - RNA, 1338 nt, unidentified
  source 1..1338: mol_type = other RNA; note = synthetic construct
atggcggtggttcatatctccaaccaggggggagcaagccgaaggccaactcccactgctttcgtacagcaagtggccagaagagtggacgttcccgtcacatacgccagagacgtgctgactcgcagcatttttccatatcgccgggtggaggtgagaaagaggaccggcggacaacggattcttcattctcccgaattgcctctgatgaggatgcagcgcctgcttcttgacgacctccttccttctgctccgacgcacgcatcaagctacggctatgtgcctggtgcgtctgtgctcgactgcgccagcgtgcacttgcggtcccatacagtagtgcgcatcgatatcgccgacttcttctcttccataacggagcgccacatcttccgggccctaagcaccacagggtggccttcgcacattggtgggccagttgctggagcccggaccagtcacgtaggaccacggatgagtaggctgttggcctatgagcttgccgtgctcacaacggtcagtcccccaggctctgcaacttggcccaataggggcaccggctctcgcgtcatagacgaagattccgctatcccgcgagcacacccttatagcggccagactgaggggttcctgccacagggctcccctacctcaggagctctgagtaacctggtgatgaggccaatcgatgatctcgttcatgatgtcgcacgcaggatgcatctgagatttagcaggtacagcgacgacttgtttttctcatcaacccggcccatcactcccgataccgtggccagactcgttcacgaagtgcgcgcagccctgcagattattgggttacacgtaaacgactccaaaacacgcgtggcccgtcccggtagtagacgcacagtcctgggtgttctcgtggatcagagcgcgcccagagtcggacgggacgttcataggcgaatcgacatgcatctacacggatccagaaggtttggcatcgatgagcacgctgaacaccgtggctttattgatcctgaagatttccggtcccacatgcaagggttaatatcctggattcagatcgtcgagccgggtcgtggacacagatacgccgaagattgggctcgggccatacgacattctcgtctctacgcatctccagacctggctctgggggagtcgattgcggccctgtcacctgtgaatccacctaccgagtcagctgctaagcagtccatcgacgatctgatcgtcgcaggcgtccggtaccgaagcaccgtagagtacttggaattactgaggtttattgagcgattccatcattatgcccccagtacaagatgttcatga

SEQ ID NO: 9215 - RNA, 1947 nt, unidentified
  source 1..1947: mol_type = other RNA; note = synthetic construct
atggccgccgattccggactggatggcgacaggctcactgccttactgaaccgctctacttggccctacagtgtgctgcagcacaggaagccgggtgggggtagtcgcaccctactcaccccggcacccgatctgatgcggctacagaggcgggtccttgatgaggtactagcccaccacgctgtgcaccctgcggcttatgcttatcggccgagaaggagcgtcgtagaatgcgctcaggtgcactgtagggctcatactgtggtgaggctggacgtggctgggttttttgacaacatacgggagcggcatgtgtacgcctctttgcgcagacggcccgcaattggaggtcccctgtctgccgtgcaagcctacgagctcaccctcctgtgtaccactactccacctgacagcgaatcctggatcaatcgcggtacaggggccaggcgacttgggcaaagaagcacggacccacttgtcgcccgggcctatccatatcaggaccagcgcgagggcttccttcctcagggtgcacccacatccggggcgttgtcgaatctagttatgtacgaagtagatgtggagctttctggactcgctgatcgattgggcctgcggtacacgaggtacgccgacgatttaatctggtcaagcagggcgttggttccgcggcgcattattgcccagctggtgaccgatgtgcgtacagttctggctactaaagtgggcctccacctcaatgatgctaaaacgcgtgtgtcacggccaggaagtaggcgtctcgtcctgggactcctggttgatggatccgccccccgcgttccacgcgaaacatacagaaggctcgagtgccatgtccgaggagtgcgcatcgcagggttacgcgcacatgcggctcatatggggtttgagactcctgaggcggcccgcaacgctgttgatggcctgctgagctgggtgcggttcgtcgaaccagcaaagggccgtctgctgaccgatgcatggtcacgagcactggaagtaggcgatgtcgaactgttgggggaccccacctccaccgaactgccaagtgatttagacacgggcgaagcacgtgaaagcattgccgccctgcttcgccacggttctgaatatagatcgtcagctgagttcgcagacttgatgagattcatcggggggttccatagatacgccccttttaatgccatggtggtgcgactacagcgcccaggctctacattcgtacttaccgaggccagatggcggcgggagtataggagagttcccaagcccggagcccagcgcataatgatttttcagccgaggggaccctacatggttacttatgacgtgggcgacacagaacccttgcgagaggcccctccactgcctcacggtgttacagacccagtcagtatcagaacagctatccctgtacaggctctggaaaccgcttggtccaccctcctggataactccgttagatggggggtgagggtgactctggtggaccatgccgcaagcgcctgcggtagaacctataggacgcaaatgaccgaccaacttgtccgaagacccggccctaggggcaaaggagaggacgtccggcctctccggtttgaggtcgaggtgaatagaaacctcccagtcccagatcgcctcgcaaccctggtgcatgagctggcccacctgagctgtggccacctaggaaagcaccctgaacttccttggctggaccgacgtggcgggaccagaaggagagacgaggtcgaggcagaggcgacaacatacttagtgttgagccgattggaccccacactgactactgacgactacctcttaggccacttgggagagggcacagagctccctgatgacctgcggcttgatttgatggtgtcttgcgcttcaagactgctggaaatgctgctttcccgtcagccctga

SEQ ID NO: 9216 - RNA, 1917 nt, unidentified
  source 1..1917: mol_type = other RNA; note = synthetic construct
atgcgtgatgtcttggccaggcgacgctcaccgtaccggcagtttgcaatacccaaacgggctgggggcatgcgtgtgatacacgcacctgaacccgagctgcagatcctcttacgcagagtgctgcggacagcactagaccaactgccacagcatccaatggcgttcgcctataggaaccgtacttccatcgtcgagtgtgcacacgttcacctccgggccgacacagtgatcaggctagatattgcagacttctttacctccgtacgtgagcgttatgtgtttgaagctctgatggccctgactgacgacgagtggttaccattggggcgaccttctaggcttgctgcacacgaaatggcgagactaacaactgtcacgcctgacgatagtggggcttggcttaacagaggcaccggcacgcttaccgttgacgaccgagcccgcccaaggagctacccttataagggccagcgagaaggctttcttccccagggcgccccaacctctggtgctatctctaatctcgtgatgcgccccgtcgatgaggccatctttcaagtggcggaaaagctggggctgcggtatacaaggtactcagacgatctgtacttctcttccagacgccgggtgctgcaccacactgtcgatgctctggtgtctggagtgaggccacccctcgctgagctcggactacacttaaacgcgcacaaaacaagagtagctaggggcggggcaaggcggacagtacttggtatgctggttgatgggcatactctccggctgcctcgcgagcaacataggaatattgaactgcacctcagaggagcagatcgccacggcctggagcaccatgccgaatcgagaggatttgacagtgtcgaatctctggagcgccatgtgtcaggcttgatcggctgggctcaacacgtggagcctatgaaaggtgccacctaccggagtcactggcacaggacaaggtcacggagcagcgcggctgcaaatccccaggtggagcatgccgacccaaccgtgtccgtggatgacagcgccagagcttcaatcgatcggctgctcgcccagggccatgccttcagacagagcaaggactatgcagagtttattgggttcatcggccgcttccgaggatactctccattcaatgccgccatggtgagactgcagaagcctgggagtcgcttcgtggccaccgaacagaagtggagaactaagtatcggcgcgtaattcgaccgggtgggcagcctctggtgatgctcagacccgggggaccctatatggttgtgtacgatgtgtccgatacagaggcgcttccgggctccaaacccctccctagacacgttactgatccgctggctgccgactccagcttaaacagcgccacggtggaacgcctgtggaaggtcacaatcgacaacgctatcaggcatggcatacgtgtgaccttggtagacaattcccccgctcacgccggttcggctagatggtcacgcctggagggacatgttactcggcccggaaagaaatccggggccacccctgaaacctacagcttgacccatgaaatagaggtttcacgaaagttatccgcagtggaccagtacgtcactctggtccacgagcttgcacatatctactgcggacatcttggtacgcctgatgtggccctgtggccaagtagaaggggtggagttgtacgggatgaggttgaagcagagagcgtcgctttcattgtcatgtgcaggttggacccacagtttacaatgggcgactatctcctgggctacttgagtaacagtaccgaaattcccgatggagtcagcctccagaggatgatgcaagtggcctctgatattatgcaaatgggacagcggcgattgaaagccggggagatttga

SEQ ID NO: 9217 - RNA, 1089 nt, unidentified
  source 1..1089: mol_type = other RNA; note = synthetic construct
atgtggctggccgaccctcgggactttctgctgggcctgaaactggcccgacttttgggggacgctggtctgggcgcagagagaaccagagccataatccgcagagaggtcgatccgtaccgcgttctgactgtgcccagaatccgtgccgccgccagagaaatccggaagcctgacgcagatctgatggcctttcagagggccctcctcgctgaatggacaccaggacacgttgcgcatccccgcgcattcgcctacgcaaggggtaggtccattgtagactgtgctcggctgcacctgggagcagagctggtggtgaggctcgacatttcaaatttctttcacagcattacggaaaggcacgttttccgggcacttcccgggccacactcccgtaattccttcgacgctgcccagataacccgcttagtcacagcaccctctaccagcccattatcatggaaccagcggagaacaggagccatccagttgtgcaatcccaggcagtgccgctgttggccccttagatgcgagaaggtgcgtgctaattattttggacacgcgccagagggctttctaccacaaggcgcccctacctccgggctgctttctaatttggtaatgcgggaattcgatcagagaatgtatgaatgggccgaggcgaacaggtgggtgtactctaggtatagcgatgacatgcatttcagttcgcggcgacctcgagctcacacagatacggatagactcgtgactcacgtgcggcgggagttaggacggctaggcatgcacctgaacgataaaaagaccacagtagctcgccgcggtgctcgaagacaagtcctggggttgctcgtcgatgggcatcacctgagactcacccgcgaatataaaagggagttggagctccatacacgcggcgttagtgagttcggtttggaaccgcatgcccatcactgggggtttgagaacgcaggcgcacttgtgactcacgtcaacggcaggctcgcgcatgccactcatgctgaacctgactggggagtgcctgctcgagagcgttggctggccgctaccactcattacagcgtgtga

SEQ ID NO: 9218 - RNA, 1122 nt, unidentified
  source 1..1122: mol_type = other RNA; note = synthetic construct
atggtcgaaagactggatcctaacctgagatcatacttcgatctctccagcctggtccaggtgagcggggctgattctggctttatcgaggacgtggtggaccggagactgtctccatactacgtttctgccgtgcccaaacgaactggaggcaagaggcatatcgaaaaaccgaatgccgagattctggctatccagcaacctattctacgcgacatcctgatgactaggagtcccagcgagaaagtgttctcatacgttaaaggtcgctctcctgtgcagtgcgcacgtcaacatctgggcgcgcggtggttgctgagagtagacctcaaggcctttttctactccattagtgaggtggacatttactacctgttcctgaaggaattcggtttcaagcagctgaccgcattccagttagcccggttggtgaccgtagtatccgacgattccctggaggtgtctgaggtggatcttcttaaagcccacccacacgtcagtaagtatcggagcaggtatgtcgcgggttatactccccaggttctcggccatctgccacatggtgcccccaccagtggggctctgagtaatctggtttcaaggcaactagaccacgccattgctgccctcgcggtacagcatgaattggtgtttgcacgctattcagatgacatctatctcagcgcaaggaggcctattacaaggactcaatcaacgaaagtcctctccgacttgagcggagtgatacgaggaaacgggtttgtggttaaccagacaaaaacgcggatgagcttcgaggatgacaagaagttagtgcttggaatacacgtcgacggcgatcgcctaaggctccgtcgagagtaccgggatcgcatcgactatgaattgcacatgatcgaaacccacggcgcagagtctcacgctcagaagcgaggggataagggagtcgcttttctcctggggcgcgtttccggccttatcgcccatgcccaggatgtggatccagaatggggccggggacgacgtgcaagatttagagccatactcatggacgggaaatcgacagaagctcttttacacaagcacctgaccgagcgcagagagcggcttagatccacatga

SEQ ID NO: 9219 - RNA, 1194 nt, unidentified
  source 1..1194: mol_type = other RNA; note = synthetic construct
atggagagcccacatctatatcgctccaaagccccgattgggctggacccagctgtgatagaacgcgcaatccgcctcagcacgacacagtctgccaacggggtgcaacccattctgactctgaagcacctggccaaccaagccggagtcggcttcgtcttcctggaacgggtgtgcgatcgaagcatagacccctatgttatctatggagtgaggaagcgagttggcagctcacgcaggatgatagcagcccctgaggagcagctgcgggttgtgcagcgttggttactggatcatgtgttcaccaatatgcacgtgcactctagtgctttcgcttatgtgaaggggagaagcgctcctatggcagccaggctgcacctcggggctaactggatgctcaaactggacgtgcgcaatttttttcacgccttcgacgaacgacaggtatacgatgtcctggcgggcacaggctactccgacttggtgcgcctccaggtggctcggatttctactagacacgttagggagtatctcccttggcttcccgagaaatacagagagtcccgttcccaggaaggtgcatccgccgcacggtttgctcataccgcggctgagatagatgcatttgagcttacagcgttacctcatgatggaggatcacggctcggatacctaccacaaggagcccccagttcgggtgccatctctaaccttctgtcacgggaacttgacagggacttggccgaactgggcatctctagaggcttggtttacacccggtacgccgacgacatcgcactgagcgctagtaccccgttttcaagaaaagaagcggaggcgctcatgcacgatgcttccagggccctgcgcaagcacgggttagagccaaatcatactaagacccgtattgtgcgccccggattgcccatcgagttgctcggggtgagggtcgatggcgaatacacaagggtcagtagaagagtacgggagaaaattgagttccatattcgagccatcgagaagtttggtcttgcagcccatgccgcccacgcaggtttcggagatgcaatcggctgtgcaaatcacgtaatcggcctggtcagatacgctcatgacgtcgaaccacagagagccggcgcttatttcgctcggattgaacgagccatccctgggctacaggttaggcctctgtga

SEQ ID NO: 9220 - RNA, 1194 nt, unidentified
  source 1..1194: mol_type = other RNA; note = synthetic construct
atggagagcccgcacctttataggcgtaacgcaccaacggatacagaagccagcgtgatagacagagcgatccagttgatgtctctgcagtcacggagtggggccaccccaatcctaaccctcaagcaccttgctgtgcagtctggcgttaggctctcattccttgagagaatcgcagacagggaactcgatgcatacgacgttcacgaagtgaaaaaaagagggcgctcctccaagaggctgattgctgctccccacgacgagctgctgagggctcagcgatggctcctggataacgtctttgcccacgccagcattcacagcgccagctacgcctaccagactggaagatctgcaaaattgtgtgcgcagcaacatttaggcgctcggtgggctatcaaactcgatgcgaaggatttctttcaccagtatgatgagtttcaggtgtttaacctgctgcgcggctttgggtactcacccttagttcgcctggagatcgcccggatttgcacaagacatgtaagtaccgaccaggactggctccctgataagtataggcaaccgactcgtctgaggtcgataccagagctgcctccagctgaatacatgtggagtggacctgacctgattgacgtggaagcatatgcacacctgccacatagtcagggacgacgcttgggttatctaccccagggagcccctacctcaggcgcaatttctaatgctttggcttacgatctcgaccagtcgtttgagaaacttgcagaagctaatcgaatgacctacactaggtacgccgatgacattttcctgtctagctacagtatcttcgagcggcccagcgcggagcagatagtgcatcaagcccattccattttcgaacaacacgagttgcagcctcacgcccgcaagtcccggatactgacaccaggtcgacccatcgagctgcttggcatccgggtcgacggcgagtccacacaactacctaagcgcattaaaagcaagatcgaatttcacatccgcggagtcgaatcattcggggtccatgtgcacgcctctcattccggcttcagagagggtctggggttcgtaaactatctggaaggcatgatccgatatgccatcaatattgagcccgaaagaggaagaagatggaatcggaggctccggcatgccttatccgggcgtgtgtga

SEQ ID NO: 9221 - RNA, 1191 nt, unidentified
  source 1..1191: mol_type = other RNA; note = synthetic construct
atggaatcccctcacttatatagaaagaatgcgccttctgacctggacccggcagtcgttgagagggccatccaactgtcacaggctcaagaggccgcaggagtggcgccaatactgtcgcttaatcatctggccgtgcaggcaaacgcccccctgaaagtactggaaagaattgctgcccgagctgtggatgcataccatatccacgagattcgaaagagagatcgggtgtccaagaggatgatcgccgctccaacacccgagcttcggcaggtacagcgctggttgctcgataacgtttttgccagggttcccgtgtcaccgtacgcctttgcatacgtggaaggtcgctctgcacctcaatgcgcccggagacatgtaggcgctacttggctagtcaagctcgatgtgaaagacttcttccatgagttcgatgaggcccaggtgttctcagtgctgcgcagcgttcagtattcggccctggtgtctttggagattagccgtatcgttaccagacatgtctccacccctcaggcttggctgcctaagaaatatgccagtactagcccacgccgcccaatgccagatgccgaactggtccctgacctctttgatcatgcagacgatgcgcctgagtacctgagccacccccagggagtgcgactagggtacctacctcagggcagtccctcttccggcgcaataagcaacatcttgtcccggcagctggacgaggaactcgctgctttagcaagtgcccgtgggcttactttcacacggtacgcagatgacataacgctgtcttccggtgaaattttcaacagggggagagctgaaaagatcctccacgaggcgaccgccattttgcacagaaataggcttacaccaaatcggcggaaatctaggatcgtgacccccgggcttcccttggaggttgtaggagtccgcgtcgacggtgacgaatcacggctgccgcgtcgactgagagacaggattgagttccatctccgaggaatcgaacagttcggctttgccgctcactccaggcacgtgggctttgatgacgtgctcggatttagcaactttctgtatggcctcattaggtacgctcacgacgtgcaaccaagcttagccgccgcctatttcgctcgcgctgatgcgcactttcccgcagcccaggtcgggagttga

SEQ ID NO: 9222 - RNA, 987 nt, unidentified
  source 1..987: mol_type = other RNA; note = synthetic construct
atgtctggggtgtcctacgccttcctgcgccgagttgtcgagcgggagagtgacccatacaatatttataccattcggaaaagggatgggaaatcgctgagaagcattgccgctccttctgaggctctggccgccgttcagcgttggctgctggatcaaacttttgctagaatgccatccaccccttggagcttcgcttacgaaaaggacaatagctccgtcaagtgcgcccaggaacatctgggtgctacatggctgttgaagatggacttgaaagactttttccatcaaacagacgagcgtgacgtgtaccacctcctacgaaagtatcgctactcagaattagtagcatttgagcttgcacgcatcgtgacacggtctgtaagggatcctcaggattggctgccccccaaatatgcgtcaaccgttgaatggcgacgcggagccggatttccgtacggcaagagggtgcggctcggatatttgccccagggtgcgtctacctccggggcaatcgccaacgtccttgcctccggacttgacagagccctacacgagctcgctatctcccacggcacaacgtacactagatatgccgatgatttaacctttagcggcggtccatatgaccgggcctcagctagagagtttgcaagcagcgtcactagtgcaatcttcgcagctggctacactcctaataagaaaaaaacgcgcttgatcgcccctggaaggcgtctggaagtgctgggggtgcttgtgaacggcagtaagctcagggtgcccgctagattccgaaagcgggtggaagcacatctctacgggctcgagagccacggcgttatgggccacctgcattctcgcggtttcagagacatagatggaatgtctaggcacatactgggcttaattgcccatgtacacgcggtggattcatcgctggcgaaggtctattacaccaggttcgccagtgcattcccaaacccctga

SEQ ID NO: 9223 - RNA, 1155 nt, unidentified
  source 1..1155: mol_type = other RNA; note = synthetic construct
atgaatctgtccccgcatctgtaccgcaaaaacgctccctctggattggacggcgccgtggtagagagggccattaagctcacctccgagcagagagctaggggtgtggaacctattctgactctgaaccacctcgccgccctttcaggaaccagcggcaattatctccatgccgtcgtggaccgccaagtggacggttacgacctcttcaatattcgcaaacgagcatccgggcggcggcgttcaatagctgtcccacaccccgaattggccaaggtgcagaaatggctgcttacagatgttttcagcaaagtcactgtacactctgactgctttagttacaggcacgggatcagcattaaggactgcgcaagtcggcatcttcatgctgagtggatgttaaaagtcgacctaagtgacttctttcaccagatagatgagagacacgtcttcggggtggcctcgtccctgtatgaacccctagtggccttcgaagtgtcacgaatcgtgacaagacagcctcacgtgggccaaccctggcttccgaagaagtatctgcggacagttcaccagattccaaccaagtcttcttacccttataagcgatcagaaaagatcggctacctcccacagggggcatccactagcggctatatcagtaacctggtcgctaaacccctggataccgcccttagctctatcgcggcggcactggagttgacctatactcgttactccgatgacctggcctttagctccgctcgcgtgctctcaagaagtcaggggctggatgttttgcgcgaggtcgcaagaatggtgggcaaaacgggctttcacatcaatgagtctaagacgagattttctacacgtgccaacggcctgaatctactgggactgaccgtagatggggaatcgctcaggctccaaaggcatctgcggacaagaattgagtttcacgttagtggagttgaaaggttcggagctaacgcgcattcaattcactgtggattccgggatgtgctgggcatgagccatcacatcctgggtcttttggcttacgcaagccatatcgagccagccaaggcctccatatggcgcgcaaggttagatgccagccgagacgcattgctcttcggtgcgcctttagctgagtga

SEQ ID NO: 9224 - RNA, 1029 nt, unidentified
  source 1..1029: mol_type = other RNA; note = synthetic construct
atgttcatatccaagaggcctatccctgacctggagcaccttgccctggctgttggactgcggcctgagtacctgagagatgtcgccgctaggcgctctgacccgtatcatgagttccaggtcgccaaagctcgaggctccgttcggaccatagccgcaccagagcccgatctcgctaaggcgcagagatggattctcgataatatgttcctcggttctcacgctggagggcgcagcttcgcctataggaaaggggtgagcgtaaaggactgtgcaactgttcacgtaggggcaagatggctggtcaaactcgacttacaggacttttttcacagcatcgattccaggagagtggcgcgtatcttccgaaaggtgggctgcgacgaggtgacctcggtgcaactggctcggctgtgcactcgtcggaactcaggcagtattggacagctcgccggtccaaccccgcttgattatttgccccagggcgcccccactagtggaatgcttgccaatctggccgccgagaacctggacaggtcgatgtcccgcttagcatcacggacagccctgaaatacacacgttacagcgatgatcttacctttagtagcgaagaggacttttctagagcaagcgcatttgcactgattcggggtgctagaggagaaatcgcccggaaccacttctcaatgcacgaagataagattaggatcagtcctcccggctcccgcctcgtagtcttgggattgctggtcgactccgatagggttcgcctgcgcggggactttaaaaagacacttaaatggcatgtgtacggctgtgctagattcggccccaatgaatacagtgcttctcgagggtacgccagcgtggaggactatcagagccatgtgggcggtctattcgcgcatgccgtggatatcgaaccagagtgggctgccccattgcagcgatcttggaaggaactaacggcggcacaagccgaagccgcttctgctgggtccttagtggtgtcagcatcaggcgactga

SEQ ID NO: 9225 - RNA, 981 nt, unidentified
  source 1..981: mol_type = other RNA; note = synthetic construct
atgcttatcaataagaggcctattcctgacctggaacatcttgcgttagccgtcgggttgcgtcccgcctatctaagagacgtcgctgcccgatcgatcgacccataccgtgaatttcaggttgccaaggcccggggttccgtgaggacaattgcagcaccagagccggatctcgcaaaagctcaaaggtggattctggagcacatgttccttggctcgcacgccggagccagcagtttcgcatatcgaaagggtgtgtccgttggggattgtgcgagggtgcatgtgggagcccgttggctggtcaagctcgatctgaaggatttctttcacagcgtcgacgcacggagggttgcgaccatatttcgcaaggtgggctgcgatgacgtgacgtctgttctgctagccaaactgtgcacaaggagaaaaaatggatctcggggtactctgacaggagccaccccactcgattacttgccgcagggcgcccctacctctggtatgctggctaatcttgccgctgaaaacctggacagatcaatgagtcggcttgctagtcggtacaggctcatgtacacccgctattccgatgacctcaccttctcctcaaacagagatttctcacgcgcttccgctttcgcgttagtcaggagcgcccgcggcgagatcgcaagaaaccattttagcatgcatgaggacaaaattagaattagcccacctgggagccggctggtagtgttgggcctgctggtggattctgagcgagtgcggatgcgcggcgacttcaagaaaactctcaactggcacgtgtacgggtgtactagatttggacccgacaaatatagtgcatctttgggcttctcctcaataagcgagtaccaggcacacgtaaatgggctatttgcccacgctatcgacatcgaacccgagtgggcaggagctctgcatgcccgatggaaggaaatcacagctccccgctga

SEQ ID NO: 9226 - RNA, 981 nt, unidentified
  source 1..981: mol_type = other RNA; note = synthetic construct
atggaactaacaaacctgcagcagctcatgcagaaaacacaggtgagtgaaaccgctttgtttgatctcatgcgcggacaggttgatccttatactgagttccggattcccaagggccgtaatggggccttcagaattatagctgccccctcaagggacctggggaagttgcaacgaagcatcctggacaatatcctgagcgctcctcagagagcctcccaatctttcgcctatcacagaggagtctctattacggactgtgcacgcgttcattcaccggcaagatggctcgtgaagctggacttaaaggacttttttggctctgtgtctgccgtccgagtggccgctgccttttccagtattggacttactgaagaattcagttcacaactcgcgttcatttgcactcgtcgtgcaggggaagagggtaccaggttccttccacagggtgcgccaaccagcggtttgcttgcgaacttagtggcagccgctttagacgagtcgctcgtgctgtttgctcagcacctgaacctgcggtactcgcgctacagtgatgatctgatcttctcctccagtggaacattctccaggagcaaggccttgcgcatagtcaggcaggtgcgcagcaaagtcgcagctcacggctttaccctaaatgaggacaaaatccgcatcagaccaccgggctcccgacttctcgtgctcggaatgctggttgactcagagtaccccagactgaggcacgatttcaaacggcttatcgagtggcatgtatatggcagcgagcggtttggcatcgccgaatattcagcgtctagagggtttgcatccattgagagctacctgcggcatgtagatgggctgctggcccacgccttggacgtccaacccgattgggctgcacctatgcggcagaagtggaacttcataagctctgccccagctggcggtctgctaaggcctcctagggaggtgccctga

SEQ ID NO: 9227 - RNA, 1230 nt, unidentified
  source 1..1230: mol_type = other RNA; note = synthetic construct
atggagctgctgccctttaatcctattgtcaaaccgtctcgcgtggctccagcgcaaattaacagcttacgctaccttctcagactccacaacctggagaatcctgaggagagtatcctgtacccatccgcccatgtggccatatcatcccacaacaccgccgagatttggcttgatcacgagaagacaactagcctccgtaaggtacccttatactataaatatcgatctgtgcctaagcacagtggcggcaggcggattctgtcagaacctagtagctcactcaagtctctacagcggtggatcctcagacactgtttcaccgacgatatggtgtcgccagccgcctatgcgtatcgacccggcagaagcatccaggactgcgcagctgtgcatatcggggctaagtggctcttgaagctcgacttaaaagatttcttcgggggtatttccgaagcccgtgtgtatgaactgtttagggctatcggatacaaggagctggtcgcattcgagctggctaggctgacgacttttctccctgacaagaatatcaggagaaatattcaggccctatacaacgaaaaatttgagatcaccccagccgcccggaactacacaaaactcgaaatcagtatcgacagctcctcaggcccgtaccctagatatcgcgggagcgctggcaagataatacggggagttttgccccaaggcgccccaacgtccggcatcatcgctaatatttgcgccggggaactggataaagaacttgccagtctggcactatataatggattgaggtactcccggtattgtgacgacctgtttttcagccccagacccgaccatgaacatttcgataggtcttttgcaggattaattattcgagacgtcaatagagcagtgctgaaacacgggtttcgcatcaaccagggtaaaactcgcgtggttccacccggatccaaaaagttgattctgggccttcaagttgacgattctgtgaggttggatactgctttcaaaaagaacatagattaccacatacgagggatcgcaaagttcggattgcagcagcatgtcgcacataccaaggggaccccacctcccgttctgtctttcctgaatcacctgcagggtcttattgcttttgcgaaaggcatcgagtactggtacggagagacacgggagacaaacctgaagcgtgccctttcagtaggtgaagtcacacgctga

SEQ ID NO: 9228 - RNA, 1068 nt, unidentified
  source 1..1068: mol_type = other RNA; note = synthetic construct
atgtccaacagggggggcagtcgcaatctgttccgcgaaatccagaaggtgaatcatgattgctcgaagttcggcgtttctccgatatatactttgacccatctgtgcgttgtggccaaggtcgcacacaaagacgcgagggatgtcatcttcaaccatcaggctcattataagagcaggaggataaagaagaaaagcggcagcggctaccggaccatctatgaaccaagtccccagctgaagagccttcagaaaacaatcctgcataactgtctccctacggccccagctagtgagttgtcctttgccttcgaaactggccggaatacactggcagcagcagggcaacacgtaggcgccagagcgatgatccacgtggacgtgagagatttttttacctccgtggcctctaaacagatttactctgtgtttcacaatctcggatatcccgagctgctgtctctcgaaatggcactgatttccaccgtagggcacacggtcactctgcgccaattcgtggaagacggcctggtgtacgagattctagaccctggatatctcccccaaggagcttccacatcaggtaaactgagcaatatggtttgtgctgacttggatgagaaactgtccgcgatctcacataaatggggaggggtgattacaaggtacgccgacgatatcacttttagttcaccagtccccctttctcgtagcaagtgtacatcaatataccacgatctccgtaaagctctgcttcagagtgggttcgttaccaactctcggaaaactaagatcttccctaacgtccgagagttcaaaatgttaggtttatgcgtcggccaggagaatgtatggctcaacaagtcgtataaaaagaccctcagagcacacctatacagccttgagaagtttggaatttttaagcacagcgtgtctcggaacttcgactccgacttagagtttatgtcctacatgtggggtcactacgcttattgcgccaatgtggataagaaattcgccggggagttgagatcacgactggaagccgccggaattcgcaagatttga

SEQ ID NO: 9229 - RNA, 975 nt, unidentified
  source 1..975: mol_type = other RNA; note = synthetic construct
atgacacacctctgcgttattgcaagagtctcgcatgaggtcgcacgtgacgtgatcttcaaccatcgtgtgcattataagagcaggcggctggcaaaacggccaggccatgggtacagaactatctacgaaccctcagctccacttaaaagtttacagcgcgctatcttgcagaattgtctgcctaaagcgagccttaccgacctgagcttcgcctttgagacaggcagatcaacgtctggagctgcacggcgacacatcggagctagaagtatgattcacgtggacatccaggacttctttgactccattcgatctaggcgcgtgtattcagtcttcgctcaactggggtacccggaactgctggccttggagatggcggtgatagccagcgtaggccacgaagtggccctcaggggagagaacgataaggggttcacctatgaatttcttgaagaaggccgcttaccacagggtgcctccacttctggaaagctatccaacctcgtgtgcctccgcttggacgatctcctgctgcagattagtgatcgatggggtggtgtagttacacggtacgctgacgatatttcgttttctacccctcgccccctttccagaaaggagtgtgccagtatatactttgagatccaagatgccgttcatcgttccgggttccagctgaaccctagaaagactaggatactgccccggggcaatgagtttagaatgttaggcctatgcgtgggacagaagcacgtctggctgaacaaaaattacaaaagcgcaatcagggctcacctgtatggggtggaagagtttggaatatcagcacacgccatttctcgggggtttgatagcgactatgagttcatgaatttcatctggggccactacgcctattgtgtcgacgttgatgtgaccttcgcgcgcgaattgaggtccaggctcgagatcgccggcgtaagccgaatttga

SEQ ID NO: 9230 - RNA, 1005 nt, unidentified
  source 1..1005: mol_type = other RNA; note = synthetic construct
atgacccataatgtggtaccggtctatacgctggcccacctctgtgtcattgcgaaagtgccatacgaggccgcacgcgacgttattttcaaccaccgagctcactacaccagccgcaagctcgtcaaacgctccggtctgggattccggactatccatgagccgagtccccagctgaaatctctccaacgggctatcttgcagaactgtttgcctagggatgcaagttctgctttatcatttgcctttgaagcagggcggaatacttctcaggcggcccgacaccatataggggctagggcaatgatccacgtggacattcaggattttttcggatccataggaagcaggagggtctacagcattttcgctaaactcggctacccagagctgctggccttggagatggcctttatcacatccgttggtcacgaagtgacactgagaggccctgatgacagaggcgtgccttatgaattcttaaaggaaggccggcttccccaaggtgcctccacctcagggaaaatcagtaatcttttgtgcagagaacttgacaatttactcagcgagatcgctgtgaagagaggtggcgtggttacccgatacgcagatgatatcagcttttcgtggcctaacccactgattagatccgagagtgggactattctggctgaaatagaccgggcagtcagtgaggccggcttctctctgaaccggaagaagacaagggtaatcccaaagtctcacgagttcaggatgctgggcctatgcgtaggacaggaaggaatctggcttaaccgcaattacaagtcccatatacgcgcccacctgtacggcgttgaggagttcgggctatctgagcatgccatttcccgtgggtttcactcagacctcgagtttatttcattcatctggggacattatgcttattcagcctatatcgatcccagctttgcgagcgaagtgagagcacgtctggaaatggccggcgtgcccgacgtgtga

SEQ ID NO: 9231 - RNA, 1068 nt, unidentified
  source 1..1068: mol_type = other RNA; note = synthetic construct
atgaaaaggcgaaatgcgacggaagcactgattcggagtgtcagacggatcgaaaatgactgttcccgcagcggcgtgcttcctatttttaccctggtgcacctgtgcgttgtgtccaaaactccctataataccgccagagatgtgatcttcgatccgagggtacattactcgacccgccgcatggccaaaaggagtggttcaggctttcgctcaatccatgagccatctcctcctctgaaggcactgcacagggccattctcgagaattgcctcccggtgagtggcgttagtgacatggcttacgcgtttcaccctggccgagatacgctagccgccgtacgggcacacgtaggagctcagtcaatgattagagtggacatcaaggacttctttggatctatcgggacaagaagagttgcagccatttttatgaatctgggttaccccgagttgctggctcttgagatggccttactgactacagtgggccacgaagtgattctgagaggcgagcacgacagcgggccaatatatgagattcataaggaggggcggttgccacagggagctagcaccagcggtctactcgccaacttgatatgcgcacccttagaccagcttctgagcatggtggctctccaatgggatggggtcatcacccgttacgcggatgacatctgtttctcatcccacactccaacatctcgtgaaaaatgccaggatatactgcgggacatcatttgtgccatcgaatctcaggggtttaagctgaacagcaagaagactaggatacaccccaaaggtaaagtgttccgcatcttagggctctgtgtcggcgagtccgacgtctggctgaaccgaaactataagcggtctttggagtctcatatccatggagtcaagaagttcggactcatcaaccattcctactcgaggggatacggctccgatcttgaattcattgagttcatgtggggccactatgcttattccatacatgttgatcccacattcgggatctacctcaaaaatcagctgcaagaaaacaacatcgtgagcatttga

SEQ ID NO: 9232 - RNA, 1107 nt, unidentified
  source 1..1107: mol_type = other RNA; note = synthetic construct
atggtcgggatcgccagtccccatgcctatagtgcagccctgtcagctagggggggtagccctcagctgttgcgcgagatacgtgagatcgacaggctgacccgctcttcacatgtaattccgctatatactttaactcatctctgcacagtggccaaagtcccttacgaggccgccagagatgtaattttcaaccacagagctcactactctgcccgtaagctgaagaaacacagtggaaaaggctttcggaccatacacgctccctctccacatctcaagagcctccagctggctatcttggagaattgcctacccaaacggcccacttctgatttgagttacgcttatgagccacgccggaacacccttgaagcagccagaagacacatcggcgcaaagacgatgatccagcttgatctcgccgacttctttggctccatatcaagcaccgccctgtacaagacatttgttgggttcggctaccctaaactgctggcattcgaaatgtccctgattagctctgtgggacatgaagttacgctgcgtggcccagatgagaaaggagtggtctatgaactcctgaagtccggtaggctccctcaaggagcgtcaacctccggtaagctaagcaacctggtgtgtattggcctggaccagctcctgggggaagttgctacagcctggggaggcattatcacacggtacgcggacgacatcacattttccactggtcacgcagtgagcagatcggagtgtaatagcatattgagagacttaaagtccgctatccacgtgtccggcttcactatgaatgagcggaagacccgagttacccgcagtggacaagagcaccgagtgctcggactttgtgtggggcaggattctgtatggctgaatcgcaactataagaattcgattagggcacatctttacgggttggagaaaaacggccttgctgaccacgggattcacagggggttttccagcgatcaggaatttatgtcattcatctggggacattacgcctattgcgtctatgtggatccagacttcggcgcagaaatgcgagcgaggctggagttagcgggtgtggaacgggtctga

SEQ ID NO: 9233 - RNA, 1113 nt, unidentified
  source 1..1113: mol_type = other RNA; note = synthetic construct
atggtggaaaagatcgcaccgcatgaatactttaaggagcttagcgagagggggggctctcggcagctgcaaaaagtgattacgaaggtaaaccaggaatgtgctgaaaataatgtcctgcccgtgtatacattgaatcacctttccgtcatttccaagatccctttattcgtgaccaaggacatcatcttcgaccacagtaaatactacacaaggcaaaaggtggcgaagagatcctctcccggctttaggacaatttatgcccccaagttccctctgaaacaactgcagcgtgctatattgtctaactgcctgcctaacaatggacaggttggcatctcgtatgccttccagaagggatcaaatgccataagtgcttgccgacagcacctgggtgcacggggaatggttaaactcgacgttgctaacttttacgggtccatctctaccccctccatttaccgaatcttccacagcttaggttatccagagctgatgtcaattgaaatggccctcatttgtagcgtggggcaagtagtggagatgcgccccgatgaccagagcggaaagatctataaaatcaagaaacgggggcgtctcactcagggatcaccagcctctggtctgctgagcaatatccattgccgcaagcttgatagaaccctagagttgatagcaagagatcacggtgccatcgtgacacggtatgctgatgacattactttttcaactcgggagccaatgtcccagtacgtagtcaactctataattggcagtagtatccatgcgctcaaaaggcagaggctgaacttgaaccgccgcaaaacgtccgtcattagaaacgggcgcagcttcaacctacttggcctgagggtggcagatgacggcctgcatctcaattccggatataaatctaccgtgagaaatcacctgaagaaggccagcctgcagggggttagtaaatactccttgagtctcggctacagctcagacttagagttcatctttatgctgtggggccattacgcatacagcatgggcgtcgaaaaggattttgccgctgagatatcgtcaaaactacacaccctcgggattcctcgacttactgcctga

SEQ ID NO: 9234 - RNA, 1134 nt, unidentified
  source 1..1134: mol_type = other RNA; note = synthetic construct
atgtcagtgtcatctcacgctttcacggagggactgttcgccgcaggcggttctcctgctctactcaggcagattcacagggtcaattttgactgcggtaacgccggggtcaccccactgtacaccttgggacatcttgcgttcttatctgcagttccacatggggtgctgcgcaggatgctgctcgaaactaagtcacactatactgaacagcgcctcgcaaagaaaaagccaggtactggatacagaacaatccgcataccaagtccggcactgctgaaagttcagcggtttattctgggcagatgccttcctcctggtccctcctcccctattagttacgcgtatactaggggacggggaatccgcgatgccgcagaacgacacgttggggccagaaccgttatcaagttagattacagcgacttcttttcctctgtgggcagcaaggcggtatatagagtcttcgagagtgccggctaccccgagcttctggcttttgagatggctatgctttgtacttatggtgccactatacagctcaacaatgaggtcaatgggaatagaccttataagaacgtgtccaggcggtttctagcccaaggggcccccacatcaggagctttgtcaaacttcgctcttcgatccctggataagagcttgggcgagtttgagttgagcggcttcacattaacaaggtatgctgatgatatcaccatcagctcaccgcgcaccatgacccagaaagaagtaggctcccttatccggaacatcaccgaactgagctcgacgtacaatctgtcgctgaacaaatctaaaacacaggtgctccggaataagaattctttccgtatcctcggactctctgtcacatctagcggcgtggggctcacccgaccctataagcgtagttttgaatcagagctgttcggcatcaaaaaaggaggcttgtccaaccaggctatttaccgggggtacagcagccctatggactacattgcattcctgtgggggcatgtggccttcgccaagggaatagacccaatttggtcccaacgtatgagtgaaagactggagtccatgggggtgccctttatcgacgccattggcgtgtttggcagcagtctgccctga

SEQ ID NO: 9235 - RNA, 1086 nt, unidentified
  source 1..1086: mol_type = other RNA; note = synthetic construct
atggaggcgcagcaccgcggattggacaaggatacgattgaggcatccatccgtcagtaccagtcaatgttggactgtgggatcctgccgatcttatcactcaagcatttcgctaaactcgttaacgtggactacagctatctgcggaggatcgtgggcagaaagattgatccatataaaaccattgagcagcagaaacgatccggcggtaccaggcttattagcgcccccgagaagcacctccaggatacacaaagatggatcctggattatgtcttatccgatgctaagactcatccccttagtttcgcctacgaaaatgggaaatccatcttgaagtgtgctaaaatccatgtaggaatgcgatggatgattaaactggacctgcggaacttctttgatagcattaaagaaaaccggatttacaaagtgttcagggaactcggctaccctagtctggttagctttgagatgacccgcatctgcacaaggtcacaaggctttaactcgatcaaaaaggtcgcaaataagtatcctgttatccatacttacctgtatggagcctccgggtgccttccacaaggtgcaccaacaagtgggaagttggcaaacatagtgtgttatggcctagatgaggagattaaccggcttgccataagaaatcgttttacctactctaggtactctgacgacattttcctctccacatgtgattcttttaatcgcaagaaagctcaacagataattagctgcgtgaacaatttcatccataaggaaggattctctctacagaaaaagaagactcacattataactcctggggcgagaaaaatcgtcctgggtctgaccgtcaccgaccaaggcgtcaagcccatgcggggatttcgaaagcagatagagagtgacattcacggcgtgaagaaattcggtctggtgcagcatgtgcagcaccgccactatcacagcatcttttcattcatcaatcacgtggatggctgcatagcctttgtatacggaatcgacagccagctgggggacagatacaagaagcagtggggcgaagccctctctaggtataatctgtga

SEQ ID NO: 9236 - RNA, 1110 nt, unidentified
  source 1..1110: mol_type = other RNA; note = synthetic construct
atgtcgcctccacacctgtcatcagcgaacgaagaaacttcatgcgaggaagctgcaattgttagccgaatgcgggagatcagtggcatcatagagtccaacgatgcccatcccatcttcaccctgaatcatctcgcgtacgaggccggtgtctcctacggcttcattagatcggtggtcgccagaagaatcaatccctaccgccattacgagatgcggaaaagaaggggaggctatcgtgttatctcttccccagtacctgacctagcacgggtccaacgctttatcctgcggaagatcctgtctgtgcaaagggacaatccagctagctacgcctatagagaaggtaagagcatcaaggattgcgcatcaaggcacataggaagccgctggatgatcaagatggatatcgaagacttcttcgggagtgtgaattctaagcaggtgtactttctgtttagggacctgggttatagctccttggtaagcttcgagctttctagactggtgacatggggctgttctcccactgcaatgaattggcagccttacgactacaagatctcagattatcgacatagcatagtgggatccttacctcagggcgcccctacaagcggcaaaatagctaacctaattgctagggatcttgacaagtctcttcacggattagcaaaaacctatggcgccatttacacccgttattccgacgatattatattttccttccggcgcaacattacgaggcccgaggctcgcgtgatcgtcaagaagtcctatgatctcatgagggccaacgggttctctccgaacctcaaaaaaaccgccgtaattcccccaggagcacgaaagattgcggttgggctcgtggtgtcagacaacgtgtacttgagtcgcgagtttaagcgacgtactgagaggttggttcacggggtctataaggagggcgtggtcccgtttagtgaaagagccaagttccgcagtccaattgggctgattaattacatcgaaggaagcctggcctttgctgcccacattgacagaaaatgggctgaagggcagcagcagaaactgctctccagtatgcggaaaaatacaaaaatccggtga

SEQ ID NO: 9237 - RNA, 1023 nt, unidentified
  source 1..1023: mol_type = other RNA; note = synthetic construct
atgcgctcagtggaggagtggaaacacttcttcctgtctcgaggaatcgccaatgaactgatcgagcgctacctgaagcaaatttccctgctgtccaacactaaatccccaatcattttcgaattggagcacctgtccctactggttggggtcaaatatgaagtgttgctcaacatgatacgagggtcaagcagctattatcgtacctttagcatcaaaaagagggctggaggcgagcgggtcattgaggcaccatacccctccctgttgcagtgtcaaacgtggatctatcaccagatactgttaaagagccctgtccatgattgtgcgcatggctacgtccccgggaggagtatctttacaaacgctaccgtacacctggggtgcaagaccctgctcaaaatggatttcaaaaacttcttcccttcagtgggtataggttgggttattaagttcttcagcgagctgggctacgataagaatgtggcttacgcacttgcagccctctgctgtaatcgagggcgtgtggttcagggcgcctccacatcaccctacctcaccaatattctcctatacaacctggatgaccggcttttcaagctttcttcgagatccggactcaggtacacaagatatgcagacgatctgacttttagcggaggttacatttctacgaaattcgtggacttagtcagttctatggtaagcgaatttggcttggtgatcaacgattcaaagacaagactgctgatcgaaaagaataagaaattggtgactggcctatctgtgagtggaagttctcttcgcataacccgcgaaatgcggagatcgattactaaggacgtgttctatattgagaagtacggcctctttagccatgtttctcagatgaagatcaaagaccctttttatcttgagagcattgcgggaaaagtggctttttggatccaggccgaaccgctgaattcctttgccctccggtgcagggacatcttagccggtaactttagtagagtagagtga

SEQ ID NO: 9238 - RNA, 1083 nt, unidentified
  source 1..1083: mol_type = other RNA; note = synthetic construct
atgaaaaaaatcgacgagtggaagcggttttttgagaagaggggggtgatccccgaactcattgaaaaatatttggaccagatcgctcgcttaaacaagagtggggcaccaatcatttttgaggttgagcatctaagtctcttgatcggtataaagtacgatacactgctgaaaatgatacacgggggcagcagtttctaccgaaagttcaccattaaaaagaaaagcgggggagacagagtcatcgaggccccctacccaagtcttatgcagtgtcagaactggatctatgaaaatatactcctcaagtgcgaggtgcatccgtctgcccacggttacgtgcgggggaagagtatcttcacaaatgcgtcccctcacctgaacaggtcctcactgcttaagatggattttgagaacttcttcccctctattaagattggctgggttgtgtctttcttctcccgtctcggatacagcaagaaagtatcatttgctttggcctccctgtgttgcaacgatggatgcctggttcagggtgccccaacctcgccatatttgaccaatatcctgctgagaagactggacaaaaagctttttcaactggctgccaagtctgatattgcttacactcgctatgcagatgatattacatttagcgcgcagctcattccttcctatttccctggattggtggcctctatctgtgcccggtacgcccttaagatcaatagcaacaaaacgcagttgctggtcaacaaaaataaacgggtcgtaaccggcctttcagtgtcgggcgagtcactcaggattactcgtgaattaaggcgaaaaatcaagcaagacctgttttacatagaaaaatacggcttactgagccatatctcctcccaaaagatcaaagaccccttctatctcgactctattctgggaaaggtcaatttctggctacaggctgagcctgctaacgaagaagcactgtcatataaggaaatactgctgagctactttagcaattctaaggtggacgtgctccttaaacgcaagtccactagacgcagcgtcggcctactggcagcagagtga

SEQ ID NO: 9239 - RNA, 1026 nt, unidentified
  source 1..1026: mol_type = other RNA; note = synthetic construct
atgaagaaacttagcgagtggaaacaatttttcttgtctagaggactgagtcaagaactgatacaacgctatcttgatcagataaaaatgctggcaggctcaggatctccggttatcttcgagctggagcacttgagcctgctggtcgggattgattcaaagacagtgctagccatggtgcatggctcttctagtttctaccgagcatttaccatcaagaaacggtccgggggggagaggatcattaatgccccctacccaagcttactccagtgccagaactggatctatacgaacattctactgaattgtcccgtgcatgataatgcccatggctatgtccgcggacgctccatcttcacgaacgccagcccccacctgaattgcgctgtactccttaagatggacttaaaggatttcttcccttccattggaatcaactgggtgataaatttcttttccgatctcggttatagtaaagtggtcgctcaacttctggcagcgctctgttgtaatagaggcgccctggtgcagggtgctagtacatcaccatacctcaccaatattctgctccgtcggctggacgaacgcttcagcaggctcgcccagaagaataacctgaattacactaggtatgccgacgatatgacatttagcggtggatacatttccaagaatctacctcagcttatttcctctattaccctcgactacgggttgaccgttaacgacgctaaaaccagactgatgatcaacaaaaacaagaagatcgttactggcctgtctgtggctggcactagtttaaaaattaccagggatttgaagcggacaatcaagcaggacgtattctatattgaacggtacgggtttctctcccacgtgtcacagcagaagatcactgacccattctaccttgactcgatctttgggaaagtcaacttttggctgcagacagaacctggcaacgcggaggcaatcagatgccgtgacatcttgcaccccaactttggtataagccgactgtga

SEQ ID NO: 9240 - RNA, 1029 nt, unidentified
  source 1..1029: mol_type = other RNA; note = synthetic construct
atgaagaagataaacgagtggaaaagatttttccttagtagaggtattcctcagaagacaatagaccaatatctggatcagattaagttgctaactgtgagcaattcccccataatctttgaggtagagcaccttagtctccttctgggaatcgaatatctgactattcaggctatgatcaacgggacaccgaagttctaccgcgagttcatcattaagaaaagggcaggaggaaaccgaacaatacacgctccttatccaagcctgctgcattgtcaggactggatataccagaacatcctactcaattgtgccgtgcataataatgcccacggctatatccccaagaggtccatctttacgaacgccagcccacacctgaattgcaaagtcctgctgaagatggacttgaaagactttttcccctccatcggtatcgggtgggtcgttaacctctttagcggcctgggctattctcatggtgtttcatacgctctcgcctcattatgctgcaacaatggatgccttgtacaaggggcgtccacgtccccttatttgaccaatgttctgctccatggcctggacgaacggttaaccaaacttgccagtaaatctaatctgaaatacacccggtatgccgatgatatgaccttctcagggggatacattagcaacaaaatgcctgcgttaattgaatcaattgtcaatgactacgggctggtcgtgaatgccacaaagaccaaactgatgatcaacaagaacaagaagattgtgactggcctctccgtggcagcagatgctttgagaatcactagggagctccgacgcagcatcaagcaggctgtgcattacattgaacgttacggttttctgtctcacgtgtctcaggagaaaattaaggacccattctacctggatagtatcctcggcaaagtgaatttctggctgcaagcagaaccccactcgtctgatgcaaaaaactgtcgggacgtcttgctaccatatttcggcaagaactaccaggcctga

SEQ ID NO: 9241 - RNA, 1080 nt, unidentified
  source 1..1080: mol_type = other RNA; note = synthetic construct
atgaatgaggccgtcgttaagacctggagaaaacattttgaaagacgcgggatcagtcgagagttaattgaaagttacctgccctacattcagaaattgtgtaaaacctcctctcctgttatctttgagtttgaacatctctcgctgctcataggggtggaacagcatgagctgcgtaaaatggtaaacgctccacacgctttctacaggtccttccagatcaaaaaaaggagcgggggtttgcggaaaatttgcgccccttacccatccatgttaatgtgtcaggattggatctataacaacatcctcatcaacaaaccggtccacagcgcagcccatgggtttgtgcccggaagatctatctttagcaatgccagtgcccaccttaactcaaagtgccttatgaagatggacttgaaggatttcttcccttccattccaatcaattgggtggtgaactacttcctgtcattgggatatgcagacaacgtgtctttctatctggccgctctttgctgtagcgagggtcgcctagtgcagggatctagcacatccccctatctgacaaatattctgctgaagaatctcgatgagcgaatctcgctgctggcaaaatcatacaacctcaattttaccaggtatgctgacgacctaacattcagcggcgaatacatcccgcacaagctgattggggtcgttactaagataattgttcagtacggactggcagtgaacgataaaaaaacgcggctccaaatcggctccaatcaacgcatagtcactggcctgtcagtagccggttcaatgttggctgtcccccggaccttcaagagggaccttaagttagaactgcacttcatcaagaagtatggttatggcagtcacgtgtctaagatgaagatccggaatccttactacatagagagtctaataggcaagctcaacttttggctccaggtggagccatctaacatggacgcgctgtccgggattaagcttctcaaaggcattcagcaaggcgagattagcttgctgcaaagatccgtgggagatagcgatcagcttaatctgcatgcgtga

SEQ ID NO: 9242 - RNA, 1047 nt, unidentified
  source 1..1047: mol_type = other RNA; note = synthetic construct
atgactaagtctgtcaaggactggctgaaacacttcgagaggcgaggtatatcacgggatctcgttgaatcctacctgccgtacattaaaaagctgaatcaaacatcttcccctgtcatcttcgagttcgagcatttgagcttactgataggtgtggaccagcatgaacttcgcaagatggtgaacgcccctcacgccttctaccactcctttcagatcaagaaacgcagcgggggcatgaggaaaatccacgcaccgtatccctccatgctcatgtgccaggactggatctacaaaaatgtgttgatcaacaagcccgtacactcagccgctcatggcttcgtaccaggccgtagtatctttacaaatgcgagcgtgcacctgggcagcaaatgcctgatgaaaatggacctgaaggatttttttccatcagttcccatcaattgggtcatcaactatttcctgagcctcggttatgccgataatgtctccttttatttaggggccttgtgttgttgcgagggaagattagttcaaggctcggcgaccagtccttatctcacgaatatactcctgaaaggtctggacgagcggatctctttgctggccaaagcatacggactgcgctttacaagatacgccgatgatctcaccttttcaggaaactatatcccccataagcttataggcgtggttagtgaaattattgtccagtatggcctgcgggtgaacgacaaaaaaaccaagcttcaggtaggggctaatcaaaagattgtgactggactatccgtgtctggcaatgcactcgcacttcctagaaaattcaagagggaactgaagatggagctgcacttcattaagaagtacggatacgtgtcccatgcttctaagaagaaaattaggaacccatactacattgattcggtgattgggaagttgaacttctggctacaggtggagccagctaacatggaggctcttagtggactggaactcatgcgagggatccagctggggcatgtctctagcctacagagccacgtgtga

SEQ ID NO: 9243 - RNA, 1023 nt, unidentified
  source 1..1023: mol_type = other RNA; note = synthetic construct
atgaaaaaaatatcctacgagagttggagaaagtattttcttagcagagggatcagtcccgactacattcaggcctatctgagctacattgagaagctgagctccacatcttcgcctgtgatctttgagttcgaacatctctccaagctgatcgggattgagtacgacgcccttaggtccatggtgaattcaccatcttcatactacagggtcttcaatatcaagaagcgggccggaggccttcgtgaaatacatgccccctacccaagcctcctgatgtgtcaggattggatctatcgaaacatcctcttatcaaagccggtgcacgcagcagcacatggcttcgtaccttcacgatccattttttccaatgctagcaaacacctggggaagaaatgtctactcaagatggatatcaaggactttttcccatccatcaagatcaactgggtgattaagtatttccagactatcgggtatgccgacaacgttagcttttatctggcttccttgtgctgcagcgacggcgcactggtgcaaggctctagtgcgtctccctacatatctaacctgttgctgtacggtctggatgcgcgcctgagtcgtttagctaaaagttacggtgtcgaatatacacggtatgctgatgatttgaccttctcaggggactatatacctcatttctttatcggattcgttaccgagattgtgggtgattacggactttctgtcaatgaaggcaaaactagattgaagattggagacggtcaaaaaatcgtgacgggcttaagcgttgcaggagagaaactaaaaattccccgcgagcacaaacgccggatgaagcaggaactccactttattaggaaatatgggtacctctcgcacatggccaagcagaaacggagggacccattcgccctggaaagccttctgggcaggttttcattctggttgcaggccgagcctgacagttccgatgctcgcggcggagtagagtacctcaagtctataagatggctgtga

SEQ ID NO: 9244 - RNA, 1035 nt, unidentified
  source 1..1035: mol_type = other RNA; note = synthetic construct
atgaataataacacaattgtgaagaactggctcggctattttcgacaacggggcgtgtcaggactgcttattgaggtctatgccgagtacatcaaaacactggttgggaactccgtccctgtgattttcgagttcgaacacctgtcgcggctgattggtatagatcaggctagatttagggccatggtgaattcacctagtagcttctacaggaccttccacatcaaaaaacgccttgggggtctgcgcgaaatatcttcgccctttccctccttactgatctgccaggactggatatacaagaacatcctactgaacatcccagtccactcctgtgtgcacggatatgttcccggacggagtattttcaccaatgcgactccacatttgaatgcgcggtgcctcttgaagatggatataaagaactttttccctagcatcaagattgactgggtggcaaacctgtttaatcagatgggctatgccgataacgtctccttttacctggccagcttatgttgcaaaaacgggcgccttgtacaaggcgccagcaccagcccgtatcttacgaatatcctgctgagaggcttggaccacaggctctctagcttagcaaaatcctacaacatggaatacactaggtatgcagatgatctgaccttctctggcgaatatattcctcattctgttatcggagtggtgggggccatcatctcagactttggcctggagccaaacgtggagaaaactagactccagatcgcacgtaatcagaaaatcgtcacaggattgagtgtagctggggaatcactaggcgtgccgcgaagcttcaagcgcgagttgaaaaaggacctgcattttattcagaagtttgggttcgagtctcacctcgctaagaaaaagataaggaagccattctacattgacagtctcatcggtaaggttaatttctggctgcaggcagaacccgctgatcagtacgctatgcaagccctttccatgctccagggaattcatgagcgtagagccgtatga

SEQ ID NO: 9245 - RNA, 1032 nt, unidentified
  source 1..1032: mol_type = other RNA; note = synthetic construct
atgaatgaagcactcattaaacagtggctggcacattttagaaaaagaggcgtgtcaggtcccctcatagatgtctacgctgtttatatccggaccctgattggtaatagtgtccctgttatctttgagtttgagcacctgagcagactgattgggatcgaccaggccagattcagggcgatggtgaatagttcctctagcttttacaggacctttcatattaagaaacggttgggtgggctgcgagagatctcttctccgttcccttcactccttatttgccaggactggatctataagaacattttgctgaacatccctgtgcatagctgtgttcacggatatgtgcccggacgatcgattttcactaacgccgctccccatctcaactccaaatgtattctcaagatggacatcaaagatttcttcccatctatcaagattgactgggtggccaacttcttcaaccagttggggtatgccgataacgtctccttttaccttgcagctctgtgctgcaaggatggctgtctcgtgcaaggcgcatccacaagcccatacctaacaaatatactgatgaggggcctggatcaccggttgtacaaattagcccagagttattcaatgaagtacacccgctacgctgatgacttaacatttagtggggaatacatcccacatactgtcatcgaggttgtggatagcattgtgtccgactttgggttagaagtgaacactgacaagacgcggctgcaaatcgaccgtaatcagaagatcgtaaccggactgtccgtcgctggcaagagtatttcaatgcctcgctcttttaaaagggaacttaagaaagagctccacttcatccaaaaatatggctatcagtcacacctgagcaagaagaaaatccgcaagcccttctacatcgattctcttataggaaaggtaaatttctggctgcaggccgaaccagcggacacatacgccataaaaagcctgttcatgctacacgagatacagaagggaaattccatttga

SEQ ID NO: 9246 - RNA, 1032 nt, unidentified
  source 1..1032: mol_type = other RNA; note = synthetic construct
atgaacgacattaaaatacgtaactggctgtctcatttcaggcaacgaggcgtctccgaggccctggttgagatatacgctgagtatatcaaaacgctcgtgggaaactctgtcccagtgatcttcgagttcgaacacttaagcagattaatgggcgtggatcagacccggttcagagctatggttaattcaccctctagtttctatcgcacattctacatcaagaaaaggcttggcggcctgcgggaaatttcatcgccgttccccagcctcttaatgtgccaggactggatttacaagaacattctgatcaacattcccatccacccgtgtgctcatggattcgcacctgaaaaatctattttcactaacgctacacctcacctgaaggcgcgctgcctgcttaaaatggacatcaaggacttttttccatccataaagatcaattgggtggccaacttttttaatcagatcgggtacgcagacaacgtcagcttttatctggcaagcctgtgttgcaaagaaggtcgtctggttcaaggcagtagtacttccccctatctcaccaacattctcctctacggtctggatcagagactttttggacttgccaagacctataatatgacctatacacggtacgccgatgacttgacgttctctggtgagtatatcccacacactgtaatagacatcgtgaagtcaatcatattggattttgggctgaagcctaattccgaaaagactaggctgcagattgataaaaatcagaagatcgtcacaggcttgtcagtagccggggacagcctaagcgcgcctagatccttcaagcgcgagctaaaaaaggaactccacttcatccgaaagtttggatacgagagccatttggccaagaagaaaattaggaaacccttttaccttgattccctcatcgggaaagtgaatttttggctgcaagccgagccaaatgatcagcatgctaaacaggcactggtgaccttgcgggagctgtacgaaagtcgaaagatttga

SEQ ID NO: 9247 - RNA, 1050 nt, unidentified
  source 1..1050: mol_type = other RNA; note = synthetic construct
atgattaagaagacatttgacaacaacagttcattagactcaaaagtaaacaactggattgagtacttcaataatcgaggtgtcagtctggaactgatcgacgaatataagaccttcattcttaacctgatctccaaggatctgcccgtgatattcgaacttgagcatctctccttgctgctgggaatccagtactctgagttcctcaagataattaacaacccagatgagtattacaggaagtttgacataaagaagagaaaggggggaaaacgggaaatactagcaccactgccgagcctgcttcactgtcagaggtggatctataaggagattcttacaaagtctaagacgcacaataacgctcatggcttcattagcaacagatcaatcatcactaatgcgtcactgcaccttaacaagaaatgcatcctgaaaatggacatcaaagactttttcccctcgatccccattaattgggtgattaattactttagctccctgggatatcctaacaacatttcctactatctatcagccatctgttgctgcaacgattctctccctcagggcgcagctacaagcccatatctgagcaatatcttgctgttttccctggatgatcggttgaccaagttgagcaagaagtacaatctggtgtactctcgttacgctgacgatatgaattttagtggggagtacatcccttcccacttctcggaaatcgtttctgagatcattctctcctatgggctcgaagcaaataaaaacaaaactcaactcctcaccaaaaaaggaaaacggattattactggcctgtctgtcagcggcgagaaactgaccttgccacgcaacaaaaaaagagaaatacgcaaggaggtgcactacatcgagaagtttgggtatctcagtcatgccgccaagctaaaaatcaagaatcctgcctacattgactccttagagggtaaattaacattctggctgcaggttgagcccaataatgccttcgctaaaagtggcttgctccttatcaagagcataagggaatga

SEQ ID NO: 9248 - RNA, 1047 nt, unidentified
  source 1..1047: mol_type = other RNA; note = synthetic construct
atgaccttccaaaagctggataaggtgcaggaattgaagataaattcctggtacctgtatctcaagaaccgcggattgccttcagacctcatcgacgagtacatttcttatatcatatccctgatcgacaagaacttgcccattatatttgaactggagcatctcagtaaactgctgagcatcaactacatcgagttgttaaagatcattaactctcccgagaactattacagagagttcaatatcccaaaacgaaaaggtgggactcgtaatatactaagtccttacccatctctgctccactgtcagaagtggatctacaagaatattttatcgaagatcgccatccatgatgccgctcacggcttcattaagaaacggtccatcatgtccaacgcagaaaaacacgtcgagaagaaatgcatcctgaagatggacatgtctgatttttttccaagtatccccattaactgggtgataaacttcttccatagtcttggctatagtaacaacgtctctttttacctgagctcaatatgttgcttgaacaatggcctacctcagggtggggcaacaagcccgtatctctcaaatattctcctggtaagcctggacaggcgacttaccaacctgagcaaaagctataagctggactacactcggtacgcagacgacatgacttttagcggcgattacatccctctgaagttctccgaaatcgtgtcacagattattgacaatttcgggcttcacattaataacgataagacgcagcttatcaccaaacccggcaaaagaattatcacaggagtttcagtggctggaagcaagatgaccctgccgcgcgataaaaaaagagagattcggaaggaagttcactacatcaaaaaatttgggtatctctctcatgcgtccaagatgaaaattaggaatccagcctatctatccgtgttagagggaaagctcaatttttggcttcaagtggagcccgataatgaatatgctaaacaggccattgtcttcatcaggacactgaagaatatatga

SEQ ID NO: 9249 - RNA, 1032 nt, unidentified
  source 1..1032: mol_type = other RNA; note = synthetic construct
atgaagaagaacaacacgattgaatattggatctcctacctgatcagccacggcgtgtcactggatataatcgaggagtacaccccctacattaccaatctggttgacaaaaatctccctgttatcttcgagcttgagcatctgagcttactaatcggaatcaagtacttggaactcctcaagatgatccacagcccagattccttttaccgagaatttgacattcctaaaaagaaaggtggggtgagacatattgtgtccccatatccgtctctcttgagctgccagaagtggatctataataacatcctgaagaagatctccatccaccctgccgcacatgggtttaatctgaatcattcaattgtcacgaacgcccaaagtcacttaaataagaagtgcctgctgcagatggatgtgaaagacttcttcccatctctgcccattaactgggtcattaatctgttttcttcacttggctactcacacaatgtctcgttcaatctggcgagtctttgttgtttaaacgacaagctgcctcaaggagcagccacatctccctatctttccaacattttgctcgtgggattggataaaaggctgtcacttctcagtactagctaccagttaacttacacaagatatgctgatgacctctgtttcagtggcgagtatatcccgcacgaactgattcaaaccatagagagcattattatcgactacaatctgacccccaacaagaacaagacaaggctacagcttaataacaataagcggatagtaactggcatctccgttagcggtccaaaagctacaatacctcgccagctcaaacgggagctgaaacaggagctctattatattcagaagcatggctacctctcccacgtgactaaaatgaagataagtaaccccaaatgcctacagtccttggaagggaagttctctttctggttgcaggtagaaccagacaacgattttgccaagaaatctctgatgtttctgatcaaactgcgtaaagagaacacctga

SEQ ID NO: 9250 - RNA, 1035 nt, unidentified
  source 1..1035: mol_type = other RNA; note = synthetic construct
atgaataagaaatacaatatcccatactggaagaagttctatcgctctagaggcctgtcagatgaaatcatcagtatttatcttccgtacatcaaaaagttgcagaaaaataacgcacccgtgatcttcgaatttgagcatctgagcaagcttttagggctcaagcgagctgagcttagcaaaatagttaactcaccagagtccttccacaggaaattcacaattcctaagaagaaaggtggccagcgggaaattgtttctccttatccttccctgctgcactgtcaaaagtggatttatagaaacatactcctgccgcagcccattcacgattcggcgcacgggttcgtcccaaaccggtctatctttacttacgctagcatgcatttgtctaagaaagccctgctgaagatggacttgaaggacttcttccctagcatcagcataaactgggtaatttgttacttctcttccctcggatatgccaacaatgtgagcttttacttagctagtctgtgctgctacaagggacatttgtcccagggcagctccacatcaccctacctcacaaatatcttactgaaaggtctggataagcgactgcagaaactatccacaacctatcagctcatttattctagatatgcagatgacttgacctttagtgggaagtatataccccacagctacattgagattgtcaacgcctgcatcgtggactatgggctggaggtcaatgaagataagactcggctacataccaaacccggccaaaggatagtgacgggactgagtatcagtggagatgaactcaaactgcctcgtaaaactaaacgcgagctcaaacaagaaatccattacatcaagacctttggttacatctcacacattagcaagaacaaaatttccaatccatactacctcgagtcactgatcggcaaggtgaacttttggctgcaggccgagccagacaatctgtttgccaaggactccttgaaccaccttcttgagatcaagaggtcggcactatcttga

SEQ ID NO: 9251 - RNA, 1005 nt, unidentified
  source 1..1005: mol_type = other RNA; note = synthetic construct
atgaaagactgggaaaagtacttcatcgatagaggccttccaactgacactatatcaacctatctgtcctatattagccagttgtcggagaatcaggtgcccgttatttttgagttcgagcacctcaccaaactgctgggattgaagagaaacgtcctagccaaaatcgtgaacagcccagaacactttcatcgtaaatttagcatccgcaagcggtcaggtggcaaacggattattgtgagcccttatccaagtctcctgtactgccagaagtggatctacgtcaacctcctgttaaaacagaaggttcacacagcagcacacgggtttgtgcctggaaaaagcattttctctaacgctaagctccacctgtccaaaagaagcatgttaaagatggatcttaagaacttcttcccaagtatccctatgtcatgggtcatcaatttctttcacgacctaggctacgctaaaaatgtgtcatcctatctggccagcctctgctgttacgagcataggttatctcagggagcggccacatctccctacctgagtaatcttctccttaagaatttggatgatcgcctgagttcgatatctaactcctatcgcctccaatactctcgatacgctgatgacataacttttagtggggactatatcccgtccaagttgattaagatcattgaggagatcgtagatgactacggtctggcaattaatcagaagaagacacggctgcataccaaaccgggacaacgaatcgttacggggctatctgtggtaggcgaggaactgaccatccccaggaagatgaaaagggacctgaggcaggaagtgcacttcatacggaagtatggttaccttagccatatctccaaaatgaagattaaccatcccttctacttggaatccattgctgggagatttcagttttggctgcaggccgagcctgaaaatgagttcgccaaagaatcactgacatatctccaaaagatcaagggctga

SEQ ID NO: 9252 - RNA, 1005 nt, unidentified
  source 1..1005: mol_type = other RNA; note = synthetic construct
atgttcgaacagtggatcgattttcttaacgatcgcggagtgaagaccgaagtcatagagagcctttccccgatcattcagacactgtcttccaacaagttgcctgttatatttgagtttgagcatctcgctaagattctcggattcaatgaagcttcgctcgcctctatgattaactccccaagcaatttttatcggacattctatatccccaaaaggcggggtggaaagcgagaaatatgtagcccctatccttctctactggagtgccagcgttggatctacaagaatatcctgctgaaactggatatccattcggccgctcacggctttgcaccaggcaggagtatcataaccaatgcaaaatgccacttgagtaaaaacgcggtgcttaaaattgatctgaaggacttcttcaactcaatccccatcaattgggtaataaacctgttctactccctcggctatcctagaaacatctcattctatctagcttctttgtgttgcctcgaaggcagcttatctcaaggggccgtgacgtccccctacctctcaaacctgcttgttaaacaactcgacagcagactgaccaacctgtcattaaaacatcacctggtgtactctaggtacgcagacgatatgtcctttagcggggcgtacgttagtaagaacttcattagctcagtgggggaagtcatcactgatttcggtcttatggtgaatcattctaaaactagcctgcgcaccggaaatagcaaaaaggccatcacaggtatcatcgtgagtgggaatcgactcagggccagtaagcagttaaagagaaagttgtcccaggaggtacactacattaagaaattcggctttctatcccacattaataagctgaagattcgcgaccctaactataaactgtcactgattggcaagctcaattttctgaaacaggtcgagccagacaacgagtttgctattgacgcccttaattacctgcggaagttggagtga

SEQ ID NO: 9253 - RNA, 1035 nt, unidentified
  source 1..1035: mol_type = other RNA; note = synthetic construct
atgcacaaagagaagcacattatcagggcctgggaggagcacttcaaagaccggggcatcagcagcgacctcatcgtgcagtataccacttatataaagaagttgagcgaaaacgacctcccaatcatctttgaaatcgagcatctgtcccttctgataggaatcaacctgccctcattacgaaagattattaatgctcctgagaagttctatcgcactttttcaatccccaagagacggggtggagagcgggagatatccgctcccctgccttcactactagcctgccaagattggatttacaagaatcttctcgcaaaaattagcatacacgatagcgcgcatgggtttgtccctggccggagtatcctcacgaatgcaagtccacatctggcccaaaaagccctgttgaaaatggacttgaagaacttcttcccttcgatccccattaactgggttatgaagttatttagtgacttcggttacgccaacaatgtcgcgttctaccttgcctcaatttgctgtctgaacgaaagtctggcacagggatctgctacatctccctatctcagcaatattctggtgaaagggttagacaagagactgaaggctctttctgattcctatcatttggaatacaccaggtacgccgatgacctgaccttcagcggaaattatattccacatacatttccctccaccgtagaggagatcgtgtccgactttgggctggaagtgaatattgaaaaaacccgcctgcacactaagccaggccagaggattgttacagggatatcagtggcgggtgctacaccgtctctgcctcgagccagtaagcgtcaaattagacaggaggctcactttattcagaaatacggccttatctctcacatctctaagaaaaagatccgtgcaccaacgtacatcgattccatcgaaggcaaactcgccttctggttgcaggtcgagccgaacaacgagttcgcacgcgaaagcctctcccacatcaggaaaatacgcagagatcatcagtga

SEQ ID NO: 9254 - RNA, 951 nt, unidentified
  source 1..951: mol_type = other RNA; note = synthetic construct
atggttacgacttctctgaagaacgccgtcctgttgcaggatttgccagtgatatttgagctggagcatttgagcaagattattggtgtggagatcaggaccttgcagaaaatgatctactgcagccgaaagttttatagatcctttagcatacccaagcggaatggcagtcgccggcagatcgacgcaccttatccaactctgttactctgccagaagtggatctacgaaaacatcctgaagaaaacatcggttcaccatagcgcacacgggtttatcgagaaaaaaagcattatcaccaacgccttacctcataaaaacaagaagactctcctgaagattgacctgaaagactttttcccctcaatccccctgaattgggtcgttaaccacttccttagcctgggctacgccaacaacgtatccttttacctagcgtctctttgctcgttggaagggaatctatgtcagggagcgccaacatctccctacctgagtaacattcttctaaccggcctggataaccggttaacgaaactggccgcatcatattgtctcgagtacacacgctatgctgacgatatgacattctctggaaattatattccgcacactctcatcgtgaccatagagaatgtgatctcctcctatggcctttccgtgaattcagaaaagaccagactccatctgaagaaggggcagaggattgtcaccggaatatctgtaagtggcgattccctgagtgtgcctagagagtacaaacgcgctctcaagcaagaaattcacttcattgagaggtacggttacatctcacacgtgagcaaacttaaaataaacgaccctctgtatctcgaaaagctgatcgggaaagtcaatttctggctccaagtggaaccagagaataatttcgctaagcatgccctcaagctgcttcgtgctgcccgaaaatga

SEQ ID NO: 9255 - RNA, 1026 nt, unidentified
  source 1..1026: mol_type = other RNA; note = synthetic construct
atgaaaaataataagatcaagtcctggatcgatttttttgccgatcgcggagtcagtaatgagcaggccaacctttacatccagtatatttctggccttcttgactcaaattcacctattatattcgagaaacagcatctgagccaccttatcgggattgatgaagccacactggatcggatgatatccagtagcaaagacttctatcgtgaatttaacatcccaaagaagaagggtggcatgcgcaaaatcgtcagcccatatccttcactcctcatgtgtcaaaagtggatctacaagaacatattgctgaatgacaaaccccatgacgcctgtcatggatttacacctgctaaaagcatcatcaccaacgcttctattcatctgaacaagccatgcctcctaaagatggacctgaaagactttttcccctctattccgataaactgggtgataaattacttcaaacacctggggtatacgaacaacgtatctttttacttagcatccttatgctgttatgacaggaaattggcacagggtgcgtccactagcccgtacctgtcaaacttgctgcttaagggcctggacaacagattaaataatctgagcaagaagtaccggctgagttatagtaggtacgcagatgacatgtgcttctccggcagttacatccctaacaaaattatcggagtgattacagagatcatcaaaaagttcggcttgtctataaacgaggaaaaaaccagcctcctgattcactccaacaaaaaaattatcaccggcctgagcgtttccggtcaacagttgtcactccccagggagtataagagaaagctgaagaatgaactccacttcattatgaagtatggatacatttcgcacattactcagcaaaagatcaaagatcccaattacctgttttccatcctagggcgagtggggttctggctgcaggtggagccaaacaatgaactggctatctcttcgagagattacctcctaagcattctcaagtctaattga

SEQ ID NO: 9256 - RNA, 1029 nt, unidentified
  source 1..1029: mol_type = other RNA; note = synthetic construct
atgaagaataatgacatcaatagttggatggagttttttcttgacagaggagtgagctcggatcagatcaattattacatcccgtacattgctaaattgctgaaaaccaactctcctataattttcgaaaagcagcatctggcccatcttatcggtatcgacgagtctattctagacaagatcatcagttcccccaaccatttctacagagagttttttatcccgaagaagcgcggtggactccgaaaaattacttgtccctacccaagtttgttgatgtgtcagaagtggatatacaaaaacatcctcctcaacgatactccccacgtcagctgtcacggattcacaccttcaaagagcattattacaaacgcctcactgcacctgaagcagaagtgcctccttaaaatggatgttaaggacttctttccctccataccaataaactgggtcatcaattactttaagggcctggggtattctgataacctgagcttttatatgagctccctgtgctgccacgacaagaagcttgctcaaggcgcgagcacgtctccatacttgtccaacttactattgaaagggctcgataaccgtctgaataatctatccagaaagtacaggctgacctattcacgatacgctgacgatatgcacttctccggagattatattccttcagatctggtaggcgtgataacttctataattaacaactatgggctctcagtgaacgaaaaaaaaacagccctttatatcaagagcaataaacggatcatcaccggcatctctgtggccggcgacgagctgagtctgccaagggattataagcgcaaactgaagaatgaactgcacttcattgagaaattcggttacatttcccatatcacccagaagaaaattaaagaccccaactacctctacagcattctcgggagggtgaatttctggttacaaatcgaacctgacaacgacgcagcaattaaaggccgggattatctgatgcgggttctgaagaataatttatga

SEQ ID NO: 9257 - RNA, 1026 nt, unidentified
  source 1..1026: mol_type = other RNA; note = synthetic construct
atgaagaataacaatatttccgcatgggtcgactttttcgctgaccgcggcgttagtgatgagcaaactgacttatacatacagtacatcaccgtgctcctgagcagcgaggtgccaatcatattcgagaaacaacatctttcacacctgattggaattgatgaatctatcctggataaaatggttagctcctcaaagaacttctacagggagtttaacattcgaaaaaagaagggaggtgagcggaaaatagtatctccataccccagcctcctgatgtgccagaagtggatctataagaatatccttctcaaggacaaacctcacgaagcctgccatggctttacaccctctaaaagtataatcaccaatgcctctatccatctggacaaggcctgtctgcttaagatggatctcaaagatttctttccgagcattcccattaactgggtgattaactattttagacagctgggttacagtaataacatctcattctacctggcaagcctatgctgttacgagaaaaaacttgctcagggagcaagtaccagcccttatcttagtaatttgctcctgaaggggttagacaatcgcttgtccaacctgtcaaagaagtatcagttatcttactcacgttatgccgatgacctgtgtttcagcgggaagtatatccctaataagatcatcggagtgatcacgaacataattgcgaactacggcctccaggtgaattccgacaagactagcttgctgattaaggccaacaaaaagatcatcaccgggatttccgtcacagggcaaaaaccatccctaccaagggaatacaaaaggaagttgaaaaacgagctgcacttcattaaaaagtacggctatctctctcacatttcgcagcagaaaatcaaggatcccaattatctgctttccattttgggcagagtgtccttttggctgcaggtcgaacctcacaatgaactcgctataacatcgcgggactatctactgtctatcctgaagaacaactga

SEQ ID NO: 9258 - RNA, 1026 nt, unidentified
  source 1..1026: mol_type = other RNA; note = synthetic construct
atgaaaaacaatgaactggcgtcatgggtggacttctttgctgataggggtgtgactgatgaacagattaacatctacattccgtacattaagaagattctggagagtaaggtccctgttatttttgagaagcagcacttggcccatctcatcggcatcgacgagaacactctcgacaaaatggtgtcttcgccagactccttttatcgggagttcaatatactgaaaaagagagggggcacacgcaagatcgtaagtccttatcccagcctacttatgtgccaaaagtggatttacaagaacatcctccttaaggactcacccgacaaagcatgtcatggcttcaatccatccaaaagcattatcacaaatgcatccgtgcacttgggaaaagcgtcactcttaaagatcgacatcaagaatttcttccccaccattcctataaactgggtgatcaactactttaagaagcttggatacgcagacaacgtcagcttttacctctcagcactatgctgttacgaaaaaaaattagctcagggcgctgccacctccccctatctttctaacctattacttaagaagctggatgatcgtctggagaaactgtccaaagcctaccatctcagctattctagatatgccgatgatatgtgctttagcggggactatatcccgtacaacattatcaacattatcacggagattatcgagtcctatggactcttcgtcaacaaggataaaactagcttgctgatcaatgccaacaagaaaataataaccgggatttctgttagtggcgaaaccctgtctctgcctcgggagtataaaaggaagctgaaatcagatctccacttcatagaaaaatacgggtacatcagccacattagtcgaaagaaaataaaggaccccaattatctgttgtctatcttgggtaaggtgaatttctggctgcagatcgaaccatccaatgagacagccattaatggaagggatatgctgctggctatcctgcgcgaacactga

SEQ ID NO: 9259 - RNA, 1035 nt, unidentified
  source 1..1035: mol_type = other RNA; note = synthetic construct
atgaaaaaaaatgagaatgaactgaccctctggatcgacttcctgatagatagagggatcagttccgaacagatagccctgtatgtcccctacattagcaagctcttggaaagcaatctgcctatcatttttgagaaacagcaccttgctcatctaattgggatcgatgagaatactctcaacaagatgacgtcctctccacactcgttctatcgaaactttaacattccgaagaaaaggggaggctttagagagatttttagtccttatccctccctgcacatgtgtcagaagtggatatacaagaacattctgctgaatgacaagccacacaatgcatgccatggctttactccatccaaatccatcattacaaatgccgccatccatataggccaaagctcactgctcaagattgacctcaaaaacttctttccaagcattcccatcaactggataatcaactttttcaagcggaaaggctacacacataatgtgagtttttacttagcctcactgtgttgcaataacaaggtaatggcccagggcgcaccgacctcaccttacctttcaaaccttctgctgaaagggttggataaacgcttatacaacttaaccaagaagtacaacatcaaatacagtcggtatgctgacgacatgttcttttctggaaactacatcccctatgatttcattcgcgtgatcactaatatcatagaagactacggtctgaacatcaataaagataagacagcgttccttatcaacgcaaataagaagatcattaccggcatttctgtgaacaataatacactaagcctgcccagggagtataaacgcaaattgaaaaatgagttgcacttcatcaagaagtatggttacttgagccacattaacaaacaaaagatcaaggatcccaattatctcttctccattctcggaaaaataaacttctggcttcaggttgaacctatgtctaagaaagctatcgagagcaagaagctgatcatttctatcctgaagatgggggcttga

SEQ ID NO: 9260 - RNA, 1032 nt, unidentified
  source 1..1032: mol_type = other RNA; note = synthetic construct
atgaacatgaaaaaaaatacgctggagcactggagcgagttttttcacgatcgaggtatctcctatgagctgttcgaaatttacctcgtctacattcagaagctgatcagcaccgattcacccatcatctttgagaaggaacatttgagtcagctcctgggcataaacgacagcattctgaataagatgatcaactcccctaataatttctatcggaagttcacaatcccaaagaagaggggcggcgatcggaatattgtggcgccgtacccttctctgctgtcctgccaacactggatctacaaaaacattctcttaacagagcagcctcactattcgtgtcatggattcactcccaaaaagagtatcatatcaaacgccaaaatccatatcgggtctaaaaccctgctaaaaatggacctggaggattttttcccttccattccaattaattgggtggtccgctactttcagcaaagaggctatgcaaacaatgttagcttttatctggctgctctgtgctgttacgacgaacacttggcacagggcgccgccacaagtccgtatctttcaaatctgttactaaagggtcttgatgagagacttacaaacctctgcctgaaatataatctgaagtattccagatacgccgatgaccttacgatcagcggagaatacgttccccatactttaatcgaggtcatcaccgagatagtatctgactacggactgaaagtgaacataaaaaagaccgctctcttgatcaacgctcgcaagaagattattactgggatcgccgtaactgaagacaatatacgagtgccacggtcttttaggagggaacttaagaacaccatgaatttcatcctgaaatacgggttcatttcacacgtgacccaattgaagattaaggacccctactatctcttctctctaattgggaaagtgaacttcttgatgcaggttgaaccagagaacaaaaacgcacgtgaatggaagagtacactcattaatatactcaagagccagtga

SEQ ID NO: 9261 - RNA, 1026 nt, unidentified
  source 1..1026: mol_type = other RNA; note = synthetic construct
atgaacaaaaatgatatccatagttggttggtcttttttcaagaccgaggtctaagccacgacctgattaacaagtacattccctatatcatcaagttgcagaagaacaacatccctgttattttcgagaagcaacacctatctcatctgattgggatccaggagcgggtcttagataaaattatcatcagccctagtaagttctatagggagttctctattcctaaaaaacagggcggcgtgcgggatattaagtcaccatacccctccctcctcatgtgccagagatggatctacaagaatatcttactgaaggattccctgcaccccaattgtcatggtttcacccctagtaaatccatcttcacaaatgcaaacctacatacaaacaagaagtgcattctcaaaatggacctcgaaaatttctttccctcaataccaatgagctgggtaatcaactacttcatgaaaatcggctatactcataacgtgtcatttagccttgcctctatttgctgttacgatcgccacctggcgcagggagcagctacatcgccgtacctgtccaacttactgctcaagaagtttgacgctagaatagaggccctctgtgtcaagtataacgtgacttacagcaggtatgccgacgacctgactttttctggggagtacatacctcaccggttctcatccattgttgaagagataatcgagaattacgggcttacccccaataaagaaaagacccgtctcttgataaatgctaaccagaaaatagtgaccggcatctccgttagtggagagaatattgcacttccacgcaagtacaagagaaagctgaagaacgaaattcactttgtgattacgtacggctatgtcagccacatcaacaatttgaagatcaaagaccccaattatcttctggccctgttgggaaaagtgaacttctggctgcaggtagaacccaaaaatccactggccctgcgagggaaagaatatctgtctaaagtgcttagggataaatga

SEQ ID NO: 9262 - RNA, 1014 nt, unidentified
  source 1..1014: mol_type = other RNA; note = synthetic construct
atgaaaacgaacgagtggagggcttactttgaagaccggggagtgagcacagccagaatcgataagtacgtgtcttatattgagtgcctcagcaagaagaatcagcctgttatctttgagctggaccacctcagtagtttactgggtatccagatcgagtatctgtcaaagatgattgcctcttcacactctttctataggaaattcagtattcctaagcggagtggcgggaaaagagagattcttgcgccgtacgagtccttgttgacatgtcagcagtggatcctgaaaaacatcctcaaaaacattcctctgcattccgccgcacacggcttcagatcagggaagagcataaagaccaatgccctggcacatatcaatggaaaggcactgctcaaaatggacctaaaagactttttccccagcatccccctgtcttggatcattaagacctttcaggacataggctatgcgccaaatgtagcctactacttagcttcattatgttgctacgatgagaaactggcccaaggggctgctacctccccagctctgtccaatatcgtcctgacaagcctagacaagcgtcttgatcgcctcgccaaaaagtgctctataacttatacccgatacgccgatgatctgactttcagtggggaacacatccactcaagctttagcaagcttgtgactaagattgtcgacgaatatggcctcgttgtgaacacggacaagacacgcctcaaagtgaaaaacggcactcgcattgtgaccggtatcggaattcttaacggcaggttgtccatcccccgggaatataagcgagaactgaaaaacgagatattcttcatcaggaaattcggatttgtctcgcatctctcgaacaaaaagataagcaaccccaattacattaactccttgttgggtaagatttccttttggctatacatagaaccagataatcaacttgcaattgactctcataagctggtactgcagctgatcaatgattga

SEQ ID NO: 9263 - RNA, 1014 nt, unidentified
  source 1..1014: mol_type = other RNA; note = synthetic construct
atgacacttctcgagtggaagaactactttcaggacagggggatcgagccagacctggccaagaaatatctggcctacataaaaggactgcagaagaacaattgccccgtgattttcgaactcgatcatttatcacaactcttggagattgacctgaattacctggcgaggatgatctctgcatccggcaacttttatcgtagctttcacatccctaagcgttcaggaggtgttcgagaaatctgtgcaccacaccatagcttactaagctgccaaaggtggatcctgcagaacatcctgaataacatcgatttgcaccctgcggcccatggattcactgctggaaagtccatcaagaccaatgcaatttcgcatctcaattccagcgctattctcaagatggacctggagaacttcttcccatctatccctcaggcttgggtcatccaggtgtttaaagagttcggctatgcgcccaatgtgagctattatctgtctgccctgtgttgttgcgacggggcattggcacagggagccgctaccagtccggctctgagcaatcttattcttagatcactggataagcgcctgtccaagctcgctagaacatgcagcctgatatacacacggtatgccgatgatcttacgttctcaggtaaacgcatccactttagtctcccaatcaaggtggaagagattgtcaaggagttcgggctaaaagtgaacacgaaaaaaactcgattgaaattgactcacggcgcccgcatagtaaccgggatttgtataacaaacggcaagctgtctgtgccccgggaatacaagcgcgagattaaaaacgacctctttttcatacggaaatttggttacctgtcccacattgccaacagaaaaattaagaatcccaactacctttcctctttacttggccggatcagtttctggctattcgttgaacctaccaatgagtttgccatcaagggcaggaataccgtcctcgaactgatgagaagttga

SEQ ID NO: 9264 - RNA, 1014 nt, unidentified
  source 1..1014: mol_type = other RNA; note = synthetic construct
atggagtcgacacaatggaggtcttatttccgagatcgcgggatacctaacgaactgaccaaaagctacgtctcttatgctggcagcctccagaaaaagaacttacccgttatctttgaattcgagcacctgagccttctgctcggattaaacattgagccactggcacgcatgatcgcctctccttcaagcttttacagggagtttgcaatccccaagcggagtggcggaaaacgcaatatttgcgcccctcatgagagtctgcttctagcacaaagatggatcctgaagaacattctggaaaagtccgaagtgcacgtagcagcgcagggtttcttgcccgggaggagcattaaatccaatgccctgatccatctgaactcgaagaatctcttgaaaatggacttacgggatttctttccgtccatcccaatgtcctgggtaatcaatgtttttaaggattgtggatacgccccaaacgtcgcctactatctggcctctttgtgctgtcactcagaggctctcgcacagggtgctgcgacgtcacccgctctgtctaatattattctaaagagcttcgacaagcgtcttactaggttggccaataagtgcggcctcaaatattcacgctatgcagatgacctgaccttctcaggggagactattcatcacagttttagtggcgctgtggagaagatcactgctgagtacgggctggccgtgaataaggagaaaacacggcttaagataggccacggagctcgggtggttaccggcatcagtattcagggagggagactggccgtgcctagcaaattcaaacgtgaactccagaatgaggtctttttcattcgaaagttcggtctgcttagccatctgtccaacagaaagatatccaatccaaactacctgaactctctcctcggcagggtgtccttttggctacacatcgaaccggaaaacgaaaaagcccagcttgcgagaaaattgatcatggacacaatgaagatatga

SEQ ID NO: 9265 - RNA, 1014 nt, unidentified
  source 1..1014: mol_type = other RNA; note = synthetic construct
atgaatatttccgaatggagatcatactttctggaccggggaatcaaggaagacctcctggggatttacctgtcatatattcgcaagctcaacaagttcaaggttcctgtgattttcgaactcgatcacctcagctcactcctagggatcaatgtgaaatttctgacacgcatgatctccagtccagaggacttctatagaaatttcctcatcccaaagagatctggcgggaaacgagagattagtgcgcctcaccagagtattctgtattgccagcgttggatactcgtgaatatcttaacccatattcccatccactattccgctcatggcttttgtgctggcaaatccatcaaaagcaatgcacagatccaccttaacagcaagtcccttctaaagatggacctgaaagattttttcccctctatacccaaaagctggataatcaacattttctcagatttgggttacgcgcccaatgtgagctactacctggcaagtttatgttgctataacgatcacttggcccaaggtgctgcaaccagccctgccctgtctaatatagtcctgaggggattagataacaggctgcagtcgcttgccgataaatgcggcttgagatactctcgctacgccgacgacctgacattttccggagataaaatctccgtaaactttccagaactcgtcgaggggatcatacataattatggacttaccgtgaacaaggacaagacgcggctaaaagccaagtttgggagcaggatagtaactggcgtctccatctcaggtggctctctgagcgttccacgggaatataagaggaacctgaaaaacgagattttcttcattcgaaagttcggcatcctttcgcatgtgagtaagaaaaagatcaagaaccccaactacatttattctttgctgggaaaactggctttttggtcttacattgagccggagaatgaataccctatcgaggccaaaaagttcctggttgagttgatcaaggactga

SEQ ID NO: 9266 - RNA, 1011 nt, unidentified
  source 1..1011: mol_type = other RNA; note = synthetic construct
atggagtgcacttggaataactatttctcagatcgcggcttaagtccggacattattaagcagtacgtagcgtatgccaataacctcgagcgaggtaatctgcccgtagtgttcgagatcgagcatcttgcaaacctgatcgggatcaagtaccctgaaatcaacaatattatcttcggagccaagagtttttacaggaccttcaagataccaaaacgacgcgggggctgcagagttatacagagcccatatccaagcttactcagctgtcagaagtggatatacaacaacattctcaagaaagtccagacacatccttgcgcctatgcatacaaggaaaacatttccatcattcacaatgcgtccatccacctaaacgcagattttgtgttaaagttggatttgtcggacttttttcattcaatcccaaaatcctgggtggtgaattttttttccgaactgggttatgccaataacgtctccgtggcccttgctagcctgtgttgtgttaatgacagcctccctcaaggcggcgtgaccagtccagctctctctaatatattggtcagctcactggatgagcggttgaacaggcttgctcacacgttcgatctgtcttactctagatacgcagacgacatggttttttccggcaagcggattcccgccaccatcattaaatatgtgacaggcattatcgagtcttttggattcgccatcaacgatgagaaaacaaaactactcatcaaggaacggcagaaaataattactgggatcgacactaccggacccaaactgacacttccccgcaatcggcgtagagaaattaagaaagccatgttcttcatcaacaagcacggactggtcgctcacatgaacaatgagaaaatcaggaaccctaattacctcctgtcactggaaggtaaaattaggttctggctgcaaatagaccccgaaaataacgaggctaagaagttcctgggggacatcattagaatcaagctgaattga

SEQ ID NO: 9267 - RNA, 1011 nt, unidentified
  source 1..1011: mol_type = other RNA; note = synthetic construct
atgaacaaaacgtggcgacattattttatcgataggggcattaatgatgaccttttagaccagtatgtgatttacgccgataatttggagaaaaatggtcttccagttattttcgaagttgaacacctgagcaacttagtcggcattaagtaccctgaaatcaacaacctgatttttggaaccaagtctttctatcgggagtttaaaatcccaaaaagacgcggcgggtacaggactattcagagtccctaccctagtctgctctcttgccaaaagtggatttacgacaacatattgcagaaaattgagacacacccatgtgcttacgcctacaaaaagaattgcagcatcatcaaaaacgcaagcgtacatctaaatgaaaatgtggtcctgaagctagacttgtcagactttttcatgtccatacccaaatcatgggtgattaacttcttctcaaatatcggctatagcgggaatgtatctatagccctcgcctctctctgttgcctgaatgacagtctgcctcagggagcagtgacatccccggcactgtccaacattctggtgagctcccttgacgagagattatatagactggctagcgtgttccagctgaattatactcggtacgccgatgatatggttttctctggaaagaagatttctaagtcgatcatcaagtatatcgcggagatcatagaatcctttggatttaccctgaacaccaagaaaacaaagctcctgatcaaaaaaaagcagaagatcgtcaccgggatcgacattacggggagtaaacttacactgccccgtaacacccggagggaaatccgaaagactatgttcttcataaagaagtacggcctgatctcacacatgaacaatgagaagatcaagaatgtcaactaccttagctcgctcgagggtaagatacgcttttggttgcaggtggatcccgagaacatccaagctaaagagtttctccatgatctcattcgcatcaaattctcctga

SEQ ID NO: 9268 - RNA, 1014 nt, unidentified
  source 1..1014: mol_type = other RNA; note = synthetic construct
atgaataataactggcatgattatttagccgatagaggtctgaacaatgcacttatcgaagagtacctggcttatattaatcgtctggaagagaattcgatccctgtgatatttgagaatgaacatctctccagactcctcggcattaagtaccctgaattcaacaagcttatttttgggactcacaagttctatcggaagtttaaaattcccaaaagaaagggaggctacaggatcattgcaagcccttacccaagtctgtttagctgccaaaagtggatatacaataacatcctcaagaagattcccacacacgtttgtgctcaggcctataaaaaggaccatagcattatcaagaacgctaacctgcacctcaataacgacgtgatgttgaagatggacatcaacaatttcttttcggaaattccgattaactgggtgatcaagctgttttccgatctgggatattctaaaaatgtttctttcgccctggcatcactttgctgtttggacggcgtattgccacaggggggagtgacttcccctgctctaagtaacattctaatgctgagcctggataacaggcttcataaattagcggagaagttcgacttaatttacacccgctatgccgatgatatgtttttctccgggaagaaaatatccagcaagctgatcaattacatcaagaatattgtcgaggagtataacttgagtatcaatgaaagcaagacgaaacttctgaccaaagagaaaaggaaaatagtcacaggcatcgacacctcatcctctaagctaacactcccacgagccacccggcgcaacatcaaaaagtctatgcacttcatcattaagtacgggctcatcggtcacatgaacaatgtcaaaataaaaaaccccaactacctgctgtcactggagggcaaaatacggttctggctccaggtggaacccgagaatcaggaagccctgtacttcctgaacgagatcttgaagatcaaaaaactttcttga

SEQ ID NO: 9269 - RNA, 1017 nt, unidentified
  source 1..1017: mol_type = other RNA; note = synthetic construct
atgaaaaataattggaaggacttctttgagtcccgtggaatcaaggacgattttattgacaactatctcaagtacatcgagtacatcaacaaaaatgagataccggtgatctttgaggttgagcatcttagccacctcattggcatcaaataccctgaaatcaacaatatcatctactcaccctctgacttctacagaaagttcgaaattccaaagcggaatgggggcagcagggaaatttctactccctaccccaccttgatgaaatgccaaaggtggatctatgaaaacatattgtcaaagatcccgactcatcagtgtgcttatgcctataagaaagaccactccatcataaagaatgccagccagcacgttaacaacaagaacatcattaagatcgatctgaagaatttcttcccatcgattcctattaactgggtgattaacctttttgtcaagctgggatactccaataacattccttttattcttgctgcattgtgctgtaatgagaattgcttacctcagggggccgtaacaagccccagtctcagcaatatcctgctgtatagtctcgatgacaggctgtttaaattaagtgaaaaactgggcctgacttatacaagatatgcggacgatatgatattctcagggaagcacgtgtccccaaaaattatcgagtacatccgccacatcatcgagacatatggtttcgagctgaacaatagcaagaccaaaatactatctgcagacaaacgcaaaataattaccggcgtcgatatctctaacaatgagctgaaactaccccggcgcaccaagcgagaagtgcggaaggtgatgttctttattaagaagtacggtctgatgaaccatatgagtaatctcaaaatcaagaaccctaattaccttctctccttagagggaaaaattaacttctggctgcagatcgaaccaacgaacgaggaagccttgtcatacagagatattatacgtgtcctgaaaaagtggatttattga

SEQ ID NO: 9270 - RNA, 1017 nt, unidentified
  source 1..1017: mol_type = other RNA; note = synthetic construct
atggagcagaactgggaagagttttttaaaagtcgcggcatcaaagaaagttacatcgagttgtacctccagtatattaagtctatcgacaagaacgacttacccgtgattttcgaaattgaacatctaagccacatgatcggcattaaataccctgagataaacagcctgatttatggaaccaagaatttctaccgaaactttaagatacccaagcgaaacggcggcgttcgcatcatcgatagcccatatccaagtctcatgaaatgtcaaaggtggatttatacgaatatcctgcttaagctgagtgtccaccactgcgcctacgcctataagaaggacacatccattgtcaaaaatgcttctcagcacttgggaaatgagtgcattttgaagctggacatcaccgacttcttttcttcgatcaaaattaactgggtgattaacctgttctcacgcctgggttattccaagaaaatctcttttagcttagcggcactgtgttgtcttcataataagctgccccaaggggctgtgaccagcccttgcttgtcgaatatattactttactcactcgatgagagactcttccggctgtcagttaaacttaagctgaagtatacaaggtacgccgatgatattgtattctcaggagacaatattcatcccaacactatcatctacatccgttccattattgattctttcggctttagcatcaacgagagaaagaccaaactcctgaacaataagaagcggaagataattactgggatcgacatctctaataataatctcagcctgccgcggaagactaaaagggagctaaggaaatccttccattacatcaacaaattcgggttgatagggcacatgaactccctgaagataaagaacccaaattacatccagtcccttgaaggtaaagtgagattttggctgcagatagaacctgataataaagaggcactagactatctctttttgctgaagaaactcaacctgctgacaatctga

SEQ ID NO: 9271 - RNA, 1005 nt, unidentified
  source 1..1005: mol_type = other RNA; note = synthetic construct
atgagaagagaatgggaggatttctacctcgagaaaggcataaacaccaatttcattagcacctatcttgactatatcaaagcactggagtcccgcaatattcctgtgatttttgaggtagagcacctctctaaattaatcggaatcaaataccctgagattaatgacattgtgttcggtacaaagtcgttctatagggaattcaagattcctaagaaaaagggcggatatcggaaaatctccagtccctatccatctttacgaaagtgccagacctggatacacgaaaaaatactttattctctgcgaacccataaaaacgcctttgcatacaaaaagggaaaatcaatcatcgacaatgccgagcagcatctaaataaccactttctcctcaaagtcgacattaaagattttttctccagcatcccaattaattgggtgatcaaactctttgatagcctaggttacgcgaagaatgtgtcctacgccctggctagcctctgctgtttgaacggctgtcttccccaggggggcatcacttcaccctccctgtcaaacattctgctgtatccactggacgaaaggctgtccaaattggcactgaagttcaacttgaaatacagtcggtatgctgatgatatggtctttagcggggaagctatcccgtctaagttcatttcttacgtcactgacattatcgagagttacgggttcattctgaacaaggaaaagacgaaattgctgaataatactaagcagaagatcgttacagggatcgacgtgtcaaaggataagctgcaacttcctcggaagacaagacgcgagataaaaaagatcatgtactacgtgaagaagtatggcatctttagtcatatcaacaacgagaagatcaaggatccaaactacattaaaagcttagagggaaagatacgtttttggctgcaggttgaacccgacaaccaggaggccaggagctacatagaacacatcaatcaaatgaagtga

SEQ ID NO: 9272 - RNA, 1029 nt, unidentified
  source 1..1029: mol_type = other RNA; note = synthetic construct
atgaagaagaggaaagagctaactaccaaactctgggaggattatttcttggatcgggggctgagcagtgagctgaggaagacctaccttgaatacataaacttcatctccgagaaggacttaccagtgatctttgaaactgagcatctctcgaatctcattgggattaactatcagtcactgaacagcatggtgaacaatcctgattctttctaccgcagtttcaagattaaaaagaaaagggggggctcaagagaaatctccgctccctatccgtctcttatgatgtgccaaacctggatctatgagaatattcttgtggactatcctatacaccactgtgcacaggcataccggtctaagcacagtatagtgaccaatgctaaaattcacctgggctccagaacaatcctgaaaatggacctcaaggatttcttttctagcatccctatcaattgggtcatacagttctttagcaacctgggttaccccaataatctgagctatgcattagcctccctgtgctgcttagaagattgtctgccacagggcgccccaacaagtcctgccttgtcgaatatcttgctaataagcctcgatcggcgactgtatcggttgggaaaaaaatacaacctctcctacacaaggtacgccgacgacctggtcttttcagggagttacatcccacataaatttatcaaggtggttgccaatatcgttacaaacttcggtctgaccattaacgacgagaaatcacagctaataatcggagacaagcaaaagattgtcacgggtatttctatttcaggctccagcccctgtatcccccgcaagactaagcgcgagatcaagaaggagctccatttcattaaaaagtacggactggtgtctcacgtaggaaagatgaagattagaaacccaaactatctggcttccctggaaggcaaaatccgattctggttgcaggtagaacccaacaataaatttgcgctcgaatcccttctttttattagaagcaaacgtgcttga

SEQ ID NO: 9273 - RNA, 1023 nt, unidentified
  source 1..1023: mol_type = other RNA; note = synthetic construct
atgaataagaccctcaaggaatggaagagcttttttgaggatcgcggcattgagctagagctgattaaggaatatctggaatacatcgatcggctggaaactaatgactgcccagtcatattcgaagtggagcatctctccaaattgatcggcatcaactatgaggacctgaataaaatgatcttcggggagaaatctttctaccgcacattctatatcaaaaagcggtctggtaataaacgggagattagcgctccctacccttcactggccctgtgccagttgtggattaaggaaaacattctatcactggataagtctcatttctgttcccacagctatactaagaagcgcagcattctgtcaaacgcaaaaatccacatcaactccaattcaatactgaagctggacattagagacttcttccctagtattaagataaactgggtgatcaactactttagctcactcggttattccgaaaatgtcgcctttgccctggctagcctttgttgcctcaatgatacgcttccacagggaggaagaacctcgcctgacttatccaatctccttttaaaatccctggacaagaggctgtacaggctggccaaaaaattttcctttaagtacaccaggtacgcggatgacatcacattttctggcgatgacattcccgcaattttcataaactacgttagtgacatcctggtgaattatggctttgtgttgaacaacaacaaaattcgactcatcaagggcgataagcaaaagattatcacagggctcgacgtatctggagagaaggttcgtttacccagaaaaatgaggcgagatcttaagaagcaagtgtactacatcaagaattatgggctattgagtcacgtctctaaacagaaaatcaaagatccgaactacatccagagcctcttgggaaaactggctttctggatgtatgtggagaagagtaacaaagaagtaaaagggatgtatgagttcataaagagtcttaacagagacaattga

SEQ ID NO: 9274 - RNA, 1023 nt, unidentified
  source 1..1023: mol_type = other RNA; note = synthetic construct
atgaacaatactctcaaggaatggaaacgcttttttgaggatagggggatcgagcctcggataatatccgagtatttaaagtacatcgacaaactcgaatccagcgggtaccctgtcatttttgaagtggagcacttgtccaagcttataggaatccgttatgaagacttgaataagatgatcttcggctctgagagcttctatcgaacgtttaaaatcaaaaagcggtcaggagggaaaagagaaatttccgccccctatccgtctctggcactgtgtcagtcatggattaaggagaatatactagagctcgacaagtctcatttctgtaatcattcctatgcgcgcaaaaggtccatcgttacaaatgctaaaatccacgtaaactctaacagcgttctgaagctggacattagagacttcttcccaagtatcaagatcaactgggtgattaactatttcttttctctcggctatagtgagaatgtggccttcggtcttgcctcgctttgctgcctgagcgatagtttgccacagggtgctcgtacttcgccagatctgtctaacctgctgctcaagtccctggacaagagactgtataggctgagttcaaagttctcctttaaatatacccggtacgccgatgatattaccttttcaggcgacgacattcctgtagtctttattaagtacgtcaaggatatcctggtggattacggcttcgaacttaacgagaataagataaggctcatcaagggtgagaaacagaaaatcgtgacaggactggacatcagcagcaacgatatcagattacccagaaagacccgacgcgatttgaaacgccaagtgtactacattaggaagtacggactcctaagccacgtttctaaacaaaagattaaagaccccaactacattcagtcacttctgggcaaattggcattctggagctacgtggagaaaaataacaatgaggctaaggaaatgtacgaatacatcaagagtttaaaccggaatgggtga

SEQ ID NO: 9275 - RNA, 1119 nt, unidentified
  source 1..1119: mol_type = other RNA; note = synthetic construct
atggctcttaagtcccctatctttcgcgaacgcaatctgaaagattttaacgcgatgcacagccttgagggatcgttctacaagtcattccccatgaaacggtcgcaggagatcaaaaactggcaggtgttttttgcagacaggggggtcagcgagagtctcatagagcaatatatgccatatgttgagaaacttctcgtagctgacttgccaatcattttcgaactcgagcacctctctaagctgatcgggatcgaaatttccgaactgcataagatgattggaaattcctccaaattctacagggaattttctattgccaagaaacgggggggccggcgtactgtttatgccccatatcccagccttctgatgtgtcagacgtggatttatgagaatattctgaagtctaggacagtgcatttttgctgtcacgcatatagacacaagcgctccattataaccaacgctacacctcatttgaacaagagagcaattttgaagatggatatggagaacttctttccctccatacccattaactgggtcatcagattcttctctgatctgggctactccaataacgtggcatactacctggccgccatctgttgcgttgaaggttccctgccccaaggggccagtacaagccctgcgttgtccaatatccttctgaaacatctcgataaccggctgtatcagctgagcatcaagtacaacctgtcatacacccgctacgccgacgacctaactttctcaggcgagtacatcccaaataggttaatcaacgtaatcagcaacattgtgagcgactgcagcctgagtgtcaatgaacgaaaaacctcactgataataggcgataaacaaaagatcgtgaccggaatttctgtccagggcgaaaatttaagcctgcctagagcttctcgacgtcagatcaagaaggagattcattacatcaaacagtatggactagtgtcacacatcagtaagttgaagatcaaaaatccgtactatctgcactctctcgagggtaagctaaggttttggctccagattgaaccggagaatgaaagtgtgctggagaacttaaatttcatcctcgagcttaaagacatatga

SEQ ID NO: 9276 - RNA, 1032 nt, unidentified
  source 1..1032: mol_type = other RNA; note = synthetic construct
atgaaaaagaaacaggagctcgagatcaagtcctgggagttatttttcatcgatcgcgggatcagtgaacatttaattgcacagtacatgccttatgtaagaaacttgacacaagccaacctgcccgtcattttcgaaatagaacatttgagcaagctgatgggcgtggaactaagtgagcttcagaagatgattgcaaacccccgaaggttttatcgggaattctctatccctaagaagcgtggcggtagaagacccgttagcgccccctacccaagcctgctgctttgccagacatggatatatgagaacattctcaaagctatctctgtgcacttctgctgtcatgcctacatcgagaaaaagtctataatctccaatgccactccacacctcggaaagaccgctatactcaaaatggacatggaagagtttttcccgagcatcccgatcaattgggtgattaacctgttctcaaacctgggatacgctcacaatgttagttattatctggccagcctatgctgtcttaatggggtcctgccacaaggagcatccacatctcctgctttgtccaatattttgctgaaacaccttgactcacgcttgtataagctcagcaagaagtataagctggcgtacacccgatacgcggacgatctcactttttccggagactatatcccacataaacttatcgatgtgattagtgacgttataacagataccgggctctctgtaaacaagcaaaagacgagcctcataattggcaacaaaaagaaaatcgtgactggtatcagtgtgcagggcaataatctgaccttaccccggtcatcaaaaaggcagattaagcaggagatccactacattaaacagtacggcctgatttcacacatcagcaaactgaagattaagaatccttactacatccaatccctggaaggtaaactacggttctggctgcagctggagcctgataacgaatttgcatcggagtctcttgcctttatttccaaactgaggaaggtctga

SEQ ID NO: 9277 - RNA, 1038 nt, unidentified
  source 1..1038: mol_type = other RNA; note = synthetic construct
atgaacagcaagaagacggaacaagtggtcaacgagtggaaattctatttccttgaccgggggattagcgatcacctgattccacagtatttgagctatgtggagaagctcacaaatcagcagctcccaattattttcgaggtggagcatctgtcagttctaatcggcattgaatatggcgaactaaataaaatggtgcatgatagttccaagttttaccgtgagtttgaaataccgaaacgcagcggaggtaagagatgcatttcagccccatacccctctctcctgatgtgccaggattggatatacaacaatatcctcaaaagtcggaacttacacttttgcgcccatgcttacagaaccaagaaaagtatagtgaccaacgccaaaaaacatttgggaaagaatgccctattaaagatggacatgcaggactttttcccttcgattcctataaactggatcgtcaattttttctcgggcctgggatatagcgacaacgtggcatactctctggcgtccctttgttgtctgaatgacggtcttccacagggagcttccacaagccccgctctctctaacattctccttgtgtctctggacagtaggctgtataaactgtctaagtcctacaatatctcctatacaagatacgcagatgatatggccttttcaggcgattacgtcccccacaagatcatagaggttatcaccgatatcatctatgacttcggattcaaagtcaatgagaagaagaccaagttgatcattggggacaaacagaagatcgtaactgggatctccgttcaaggcgaattcctcactctgcctcgcaagactcggaggctgatcaaacaagagatccactacattaacacatttggcctggtgagccacataggtaagatgaagattcgaaaacccaattacttgttatcactcgaagggaagctgttgttctggaggcagatcgagcctaacaatgagtacgtacttaacaacctggaaaaaatttcctctatcaaatgggggctgtga

SEQ ID NO: 9278 - RNA, 1032 nt, unidentified
  source 1..1032: mol_type = other RNA; note = synthetic construct
atgcccgactatcaaattcaaaaatggaagaccttcttccatgaccgtgggatatctgattatctgatcgtgcaatacctcccttatatcgaaacgctcgtgtcaaataaggttccggtgatttttgaaatcgaacacttgtcaagactaattggcgtcgacataactcaactgcggaagatgatcaactctcctcagcatttctatagagaattctccatcccaaaaaggcgggggggacatagaaaaatcctggccccatacccgagtctgttaatgtgccagacctggatatatgagaacattctcaagtctattcccatacacagttctgctcacggatatgtgaaagagcgctcaattctcagcaatgccacaattcatctgaagcaaaatgccctgctaaaggtcgatctgaaagacttttttccaagcatctccatcaactgggtgattaatctgttttccagtttaggctattccaacaacgtaagttactacctcgcagctatctgttgctgcgatgagtgtcttcctcagggtgcagctacttcaccatacctctccaatattctgctggtaaacttggattacaggttgcataagcttagctctaagtaccacctaaattatacacggtacgccgacgacttggttttctctggtaaatacataccccacaacctgatcaacatcatcagctccattatcgcggattttggactgaacgttaaccaggccaagacaagtttaatcatcggcaataagcagaaaatcattaccggcctgagcgtccagaaaaacgaacttcagcttcctcgcagcaaaaaacgacagatcaaacaggagatctattatatcaagaagtacgggcttattagccacatatccaagctgaagattaataagctcaattaccaccagtccattgagggcaaacttaggttttggctccaggtggagcccaacaataagttcgcactggagtcattgaattacattcactcgctgcagaacatcctgataaattga

SEQ ID NO: 9279 - RNA, 999 nt, unidentified
  source 1..999: mol_type = other RNA; note = synthetic construct
atgaaaaaaatttctctgcgcatgcaagaatgggagctgttcttcaaaaataaaggagtgtcgacggacctgattaacatctatctgccctacattgagtacttggagagccagaatcttccggtagttttcgaagcagaacatctgagtaacttacttggtattaagccagtcattttatacaagatggtgagttccccatcgtctttttaccggtcctttgatatcagcaagaaaaagggaggcaagcgacgtatctcttccccttaccctagcctcctaatttgtcagaaatggatctatgagaacatcctcatgggcttaaaaacacactattgcgcccatggttacatcaaatccaagtcaatcgtgtcaaatgccaaggctcacctgaatgagagagtcgttctcaaaatggacctgcaagatttctttgacaccattacaatcaactgggtgattaacctcttctcaaagctcggatacgcgaacaacgtgagttatatcctggccagcctatgctgttttaatggggctttgcctcaaggagccgccacatctccagcactgtctaatattcttctggtgcaccttgacatgagaatttatcgcttggctaagaaatacagcctcacctatactcggtatgctgatgatctgacattcagcgggaactacataccccatacctttatcgagatcgtaaacgagataatagtggacttcggcttgaacgtcaataagcagaaaaccaagctaataatcgggaataagcagaagattgtcactggcattagtgtcaagaattcacggcttcagctccctaggaagacgaggagaaccttgaaacaggagctcttctatatcaagaaatatgggctgatctcccacatatccaagctgaaaatcaagaaacccaactacctggatagcctgcagggcaagttcgcattttggacttacgtggaaccccataatgaatttgccaggcacgtttga

SEQ ID NO: 9280 - RNA, 1029 nt, unidentified
  source 1..1029: mol_type = other RNA; note = synthetic construct
atgaattcaatccacaaaaatcagattgcgtcctggaacagattctttgatgataggggcatatcctctcatctaacacagcaatacattgactacatcagtaaccttatctgcgccgacctgcccatcatatttgaactggaacaccttagtaaacttacgggaattaatatcgacacgctgtgcaaaattatcggtgacagcagccatttttatagggatttctccattgctaagcgccgaggagggaaacgtctcatttccgctccttatccaagcttaatgacttgtcagacctggatctatgagaacattttgaagaaaagtccatctcacttttgtagccacgggtactcacctaacaagagcattattaccaatgccaggcctcaccttgggaacaaagcaatcctgaagatcgacatcagagattttttcccctcaatatctatcaactgggtcatcaagtatttctcagacctgggatattccaacaatgtggcatattacctggcatctatatgctgtctaaataaagccttaccccaaggggctccgacatctcctgccctgtcaaacatcctgctgcgtggcctcgatcggcgcctgtacaagctgagcaagtgctacaatctgacctacactaggtatgccgatgacctcactttctctggagaacatctcccatataaggtgattagtatcatctcacagatcgtgtctgactacggtctgagtgttaacgagaaaaagacctcgttgattattggcgataagcaaaagatcgtaacagggctatccgtcagaggcgatacattacagctcccccgatcctcgcggcgggagattaagaaagagatttactacatacgcaagttcggcctcttgagccatatcagcaagctgaaaatacggaagaccaattacctggactccttggagggcaagcttagattttggttgcagatagaaccaggtaataaattcgtgcaggagagtctcatcctcattctgagcatcaaaaactga

SEQ ID NO: 9281 - RNA, 1029 nt, unidentified
  source 1..1029: mol_type = other RNA; note = synthetic construct
atgaaaaacacccacaagaataaaattgcaggctggactaagttctttgatgaccggggggtttcaagtcacctctctgagcagtacattggctacatatctaacctgatatgcagtgacttgcccgtaatctttgagcttgagcatttatcaaagctgactggtatcaacatcgataccttatgcaagattatcggaaacagtaatcacttctaccgcgaattttcaattaataagcgcagaggcgggacaagactcattagcagcccatatccgtctcttatgacctgtcaaacctggatatacgaaaacatccttaaaaagtcccctatccaccactgctcgcacggatactctcccgataaatccattatcactaatgcccatcctcatctggggaagaaggccatcctcaagctcgatataaaagacttcttcccctccattccaatcaactgggtgattaaatacttcagcgacatcgggtattctaataatgttgcttattacctagcgagtatctgttgtttggatgaagcactgcctcagggcgccccaacaagcccaatgctgagcaacattctcctgaggagcttggatagacgtctgtataagctatcaaaaacgtacaatctcacatatacccgatatgccgacgatttgacattttccggaaaccatattccccataagatcacttctgtcatcgagcaaatcgtcctggactatggtcttctcgtgaacgaaaaaaaaacgtgcctgataatcggcgacaaacagaagattatcaccggcctatccgtgcggggtgacaggttaaagctgccgagggcatccagacgcgagattaagaaggagatttactacatacgaaagtacgggctgctgtcgcacatatccaagctgaaaatccggaaaacaaattatttggctagcctcgagggaaagctgaggttttggcttcaggtggaacctgaaaacaatttcgctcaggagagtctgactctgatcctgagcattaaatcatga

SEQ ID NO: 9282 - RNA, 1041 nt, unidentified
  source 1..1041: mol_type = other RNA; note = synthetic construct
atgaccaaaagcgccgaggaaattaagaaggagatcaacgactggaagaagttcttcattgaccatgggctggagacaaatctcatcagtgactacttgagctatatctctagtctgatcgagaataatgcccccgtgatctttgagataaaacacctctcccaactaataggaatcaacacgagcgagttactgaaaatgatttactccccaagcgatttttaccgggaattcgaaattgctaagaggagcggcggaaaacggaaaatcagcacgccatatccatctcttaagaaatgccagaggtggatttacgagaatattttgaagaagcagtccgtctcgtcacatgcacacgggtacgttcaatctaagagtatcattaccaacgctacaatccacgccggcaaaaataacctgctcaagatggacatcaaagatttctttccctccatcagtattaactgggtcattgtgtttttcaagaaactgggatatgcacatgacatctcattctatctcgcgagcctgtgttgcctgaaaaaccatcttccccagggtgccgtgacttccccgtgtttgtccaacatcctgtctctttcattggataatcgactcggcaaactgtcaaagaagtataaggtcacttatacccgttacgcagatgatctttttttctccggcgataagattcctttaagcctaatcaagtccgttactaacattgtaacaagttatggtctgaacgtaaatactgaaaaaacccacctcatcagaacaagcaaacgcaagatagttacaggggtggctgtgcataacgaagtgattaccctgccccgcacctacaaaaagaatataactaacaccctgtaccacatcaaaaagcacgggtatttgtctcacgtctcaaaactgaaggtgagaaatccttactaccttgagtctttaattggcaagctgaatttttggcagcagatcgaacctgacaacaagttcgtggaaaaatctatatcgtacctcaaggagataaaaaagcagtga

SEQ ID NO: 9283 - RNA, 1041 nt, unidentified
  source 1..1041: mol_type = other RNA; note = synthetic construct
atggccatgacagccgatgcaattaagaaggaaatctccaattgggaatccttcttcgtcgaccatgggattgaagagaaatttacttcggactatatgtcctacataagcccgctcattgcaaataacgtaccagtcatattcgagattaagcacctgagccagctgataggcattaacgctcccgagctcctgaaaatgatttacagcccttccaatttttaccgggaattcgagatcgccaagcggaccggaggcaaacgcaaaatttctaccccatacccctcactgaaaaagtgtcagagttggatctacgagaatatcctgaagaatcgcacaatcagcccgtatgcgcatggatatgtgcaaacaaggtctatcatcacgaatgctaaaatgcacgtcggcaagaacaacttactgaagatggacatcaaaaatttcttcccatcaatcagtatcaactgggtgatcgtgtttttcaaaaagttgggctatgcccatgatatatctttttacttggctagtctgtgctgtctgaataacagactaccacagggggcagtgacttctccctgcctttctaacattctcaccctcagcttagataatcgtttgggcaagctgagtgaaaaataccaggtcacatacaccagatacgcagacgacctgttctttttcggagaaaaaatccctcttagcttgattaagtcagtgactaacatagttacgtcctatggacttaacgtgaacattgagaaaacccacctgatcagggcttcaaagcgaaagattgttactggtgtcgccgtacataatgatgttatcaccctgcctagggcgtataagaaaaacatagccaacaccttttaccacattaagaagcacggttatctctcccacatctccaagttaaaagtgaaaaacccctattacctcgagagcctcatcgggaaacttaatttttggcagcaaatcgagcctgataatgagtttgtgaagaactcgatttcttatctaaagaagctgaagaaacagtga

SEQ ID NO: 9284 - RNA, 1050 nt, unidentified
  source 1..1050: mol_type = other RNA; note = synthetic construct
atgaaaaacgaatttctgattagtccattgaggcagaatctcgatgattggaaagactttttcaatgacagagggcttgaagaatccttaatcaacgactacatctcatatatcaagcccctgctcaggaataacgtgcctgtaatattcgagattcaacatttgagtctgctgattggcgtgccagttatagagttgaaaaagatgatcttcagccctaatcatttttaccgcaccttcgagatacctaaaaagagtgggggctcccggcagatcacaacaccgtatccgtccctgaaaaggtgccaaaaatggatctacaacaatatcctgaagaagaatagagtccatcagaatgcccatgggtacgtcttgagcaaatcaattctctccaacgccgccacccatgtcaaccagaagaatatcataaagattgacatcaaggacttctttcccagcttgaaaataaactgggtcgttaactatttcaagagacttggatacagccacgatatttctttctatctgtctagtctatgctgtctgaataattctctcccccagggtgcggtgacttctccctatctgtctaacattctgactctttcccttgatcggaagttaagcaaatatgcagaaaatcacggtctgaattatagccggtatgccgacgatatttttctgtcgggcaactttgtgccactcgattgtttctccgaggttaaaaagatcattaagggatacgggtttaacataaataacggcaaaagccgattcctgaatgagaacaaacgtaagatcgtgaccggaatcgctgtgcacaacgaattcatgacgctcccccgaacaaaaaagaaggagctgatgaacgtgttttaccacattaagaagtatggctacatctcacacgtagcaaagatgaagatcaaaaacccttactacatcgactcacttatcggacgcttcggtttttggaaacagattgagccaaataataccttagtgattcactgcctcgcttacctaaagaacattaagtcgaacatctga

SEQ ID NO: 9285 - RNA, 1035 nt, unidentified
  source 1..1035: mol_type = other RNA; note = synthetic construct
atgtcccatgaaatcgagcaggtgaaaacaccaaaacaatggcgtctgtattttgatgatatcggactgaaggaggagtacatcgagctttatattgacatcgttgaaaggctgtacaagaacaaaaacccaatcatcttcgagatagaacatttctctaaactggtgggcgtagaggtgcaaaccttattttcaatgatattcagcgaagagaacttctatcggcagttcgctatcaaaaagaagctggggggcgaaagaatcatcactattccgagccccagtctgatgcttgtgcagagatggatctataaatacattctgaagaccaagaaggtccattatgccgctcacgggtttaacttcaacaaatcaatcatcacgaacgccaaaatgcacgtcgggcacaaagtttttctgaagatcgacctgaaggacttctttccttcgattccaatatcttggatcgtgaactactttaatcaacagggctatccccccaaaatatcctactatctagcaagcttttgtactttcaatgaatgcttgcctcagggcgcaccaactagtcccatactttccaacattttgttctaccaactagacaagaagttgtacaagtacagcaagaagaataatctcacctataccaggtatgcggacgacctcattttttctggagactatattcctctgaaattccggaattttgtcatatacctcattaagcagtacggttttaaagtaaaccctaagaagacaagtctcaaagtgaatgccggacagaacattgttacaggcatcctgattaaggatgatatcttcgtgcctaaaaaatacaaacgcaagattagacaggagatgttctacatcaataagtatgacttactctctcacatctcaaacgccaatattaaggatccgaattacatttactccttgcaggggaggattaactttgtcatttccgtggaacccgagaatgaggaattcatacgctacaaaaatgagattgatcgaatcatcaagggttga

SEQ ID NO: 9286 - RNA, 1038 nt, unidentified
  source 1..1038: mol_type = other RNA; note = synthetic construct
atgtcatatacgatagaaagtgtcaaaactccgaaagagtggcttatttattttgaggatatggggatcaaggaggagtacatcagtatctacattgagataatcgagaagctatacaaaaacaagaaccccattatcttcgaaatcgaacacttcagcaaactggtgggggtcgaagtcgacgtgctgctgtctatgattttcagcaagaagaacttttaccgacagttcaagattaagaaaaagcttggaggcgacaggctgattacagtgccttccccaagcctgatgatggttcagaaatggatttacaacaacatactcattgacaagaagatccactatagcgcccatggctttaactttaacaagtccattatcaccaacgcgaaaatgcatgttggacataaggttttcctgaagatagacctgaaagatttctttccatccattcctatcaattggatcatcaactactttaagcagcaaggatatcccccaaagattgctttttatttggcaagtctctgcacactggataattcattacctcagggggctcccacctctcccattctctcaaatatcctgttctataaccttgacaagaccctctacaagttcagtaagaaaaacaaccttacatacacaaggtacgcagatgacctcgtcttctctggtgactacatctctttgaaatttcgtaacttcgtgattttcctgatcaagaaatacggctttaaggtcaactccaaaaaaaccagcttgaaaattaacgccggtcagaatatagtaactggaattctcgtaaaggattccgtgttcgtgccaaagaaatataaaagaaaactgcggcaagagatgttcttcatcaataagtttggcatcttgagccacatagccacttcgaatatccgcgatcctaattatttatattccctaatggggcggatcaattttgtgctgtctgtggaacccaataatgaagagtttatagagtaccagaacaaaatcaaggccatcattaagaaaggctga

SEQ ID NO: 9287 - RNA, 1041 nt, unidentified
  source 1..1041: mol_type = other RNA; note = synthetic construct
atgttatattccatcgaacctgttaagtctccgcaggaatggagaacatacttcgacaatatcggattaaaggaggagtatattgagatctatctccagatcatcgaggagttgtatagaaagaagaatcctatcatcttcgaaattgagcacttctccaagctagtcggcgtggaagtgaccgtgctgctgagcatgatttttagcaaggagaaattctaccgccagtttaaaatcccgaaaaaaaaaggtggcgagcgcactatcacagtccccagcccatccctgatgttggtgcagaaatggatctacaactacattctcatcaacaagaaaatccattactccgctcacggcttcaacttcaatcgatccataataactaacgctaaaatgcatgtagggaataaggcattcctgaagattgatctgaaagatttctttccctctatacctattggctggatagtcaattactttaagcagcaaggttatccacccaaaatcagtttctacctggcctcactgtgcactctcaaagatagtcttccacagggggcccctacatcgcccattctcagcaatattatcttctacaaccttgacaaggtgctgtacaagttttcaaaaaaaaacgcccttacctataccaggtatgcagatgaccttgtattcagcgggaagtatatcagtctgaagtttaggaacttcgtgatcttcctgattcggaaatacggatttcaaataaacagcaagaagacgtctttgaaggtcaatgccggccaaaacattatcacaggaatactagtcaaggacaccatttttgttcctaaaaagtataagcggaagctgcgacaggagatgttttacattaagaaatttgggctgctctctcacatagcgactaccaatattcgggacccaaattatgtgtattcactgatgggacgtttaaactttgtgttgaccgttgaacccgagaacgaagaattcatcgaataccagaattacatcaagaggattctcaaaaaagctgattga

SEQ ID NO: 9288 - RNA, 1020 nt, unidentified
  source 1..1020: mol_type = other RNA; note = synthetic construct
atggacaaaaaggagatcaagaagtggacaaactatttcctggatgtgggcttaaaggacgaatatatcatcgagtaccaggacctgattaccaatttaattaagaatgacgtgccagtcatctttgagattgatcatctgtccaagttggtaggcatcaatgtcagcacgctgtacgccatgattttcagtactgaaaaattctaccggacttttgaaattcccaaaaagaacggaggcatgcgcactataacgacaccccataagtctctgaaactggtacagaaatggatacaccacaacatattgaaatacaagtacgtgcacaaatcagctcatgggttcgtcaaaaataggtccatcattaccaatgcactgatccataaggagagtaaagtgttcctgcaactagacatcaagaacttttttcctagtattccactgaactggataatcaactatttctacaagcttggctattcaaagaagatttcattttacctcgcaaagttgtgttgttatgagaatagcctatgccaaggcgcgcctacatcccctatactgagcaatcttgtgttctttgccctggataagaagcttaatcactatgctgacaagaacaacataatctacacaagatacgccgacgacatcgttttttctggtgataacatcccactctctttcaagaacttctgcatctttctcatcaaggatttcgggttcaaaatcaactcgaaaaagaccaaattgaagatcgaggtcggacagaatatcattgccggtatacagatcaaggattccgatatttgggttcccaaaaaatacaagaagaaactcacccaggaactgtattacattcagaagtatgggctgatttctcacatcagcaaacgtcgaattaaagacccgaactatgtttattccttactcgggaaagtgaattttattcttagtgtggagcccggaaataccaaatttctcgaatacaagaacctgctcaatagcatcattaaatga

SEQ ID NO: 9289 - RNA, 1020 nt, unidentified
  source 1..1020: mol_type = other RNA; note = synthetic construct
atgacaaagcacatcgccaagaactggactaagtattttgaggatataggactgaaagacgaatacattgaggaatattccgaagtgatcaagaaactcgtcggaaacaatgtccccgtgattttcgaaatcgaacacctgagtaaactcgtggggattaacgtttccaccttatattcaatgatcttcagtacggagaaattctatcgttcatttgatattctccagaagaatggagagaatagacgaataacaactcccttcaaaagcttaaagaaggttcagaaatggatttaccagagtatactgaaacaaggctacatccataaatctgcccatgggttcgtagagaagaaaagcattattaccaatgcctccgtgcacaaaagctctaaagtttttctgcaactggatatacggaagtttttcccatctatccctctctcctgggtgattaattacttccataagctcggctattctaagaaactttccttttatctggctaaactatgttgctataaggaaagcttggcacagggcgctccaaccagccctgctctgagtaatttgatcttctttggccttgacaaaaagttgaacaactacgccattaagaacaatattctctacacaaggtacgcagatgacatggtattttcaggtaccgagatcagcctgaacttcaagaatttctgcatcttccttataaagaagtacggatttaaggtgaactccgaaaaaacacgcctgaagataaacgtcaatcagaatatcatcactggcgtccagattaagaataataacatctttgcgccgaaaaagtacaaaagggagctgattcaggacctatactacatcaagaagtttggtcttatctctcacgtctcgaaaaagagaattaaagaccctaactatgtgtacagcttgttagggaaaattaacttcgtgctgtcaatcgaacccgagaatctggagtttatcaactataagaacatcctgaagaacatcatagagtga

SEQ ID NO: 9290 - RNA, 1017 nt, unidentified
  source 1..1017: mol_type = other RNA; note = synthetic construct
atgtctaataaggctaaagagtgggtggcctatttcaatgatgtgggactccaagaggcctacattaatgagtatgggctggtcgtggagaaactcctgaagaacaaagttcccgtgattttcgaaattgaacacttgtctaagctggttggtatcaatgtaaaaactctgtacagcatgattttcagccctgaaaagttttatcgggagtttgagatcccgaaaaagaaaggaggtactagaaagatcaacgccccctttaaatccttaaaaaaggtccagcaatggatctacatcaacatcctcaaagtgaagaataagaacgcatatgctcacggctttcttgacgggaaaagtatcatcacaaatgcacgcgaacacattaatagctccgtgtttttacatctggacatcaaagactttttcagcagtatacctataggctggattgtgaatttcttctattctctgggctatagcaaaaaaatatccttctacctgtcgcgtctgtgttgctttaaggactgcctggtgcaggggtcttcatgtagtccagcattgtccaacatactccttgtcaaccttgatcggaagttaaacaaatatgcgttgaagaacaaccttaagtacagcaggtatgccgatgatctggtgttttcagggaactacatttcactctcttttaggaatttctgcagctttttgatcaaaaactacggcttcaagattaacaccaaaaaaacacgactcaaagtcaatgcctcccagaatataattacgggcattcagatcaagggtaatatcttgtcagtgcctaagcagtataagagaaagctaaaacaggagatctactacattgagaagtacggattcatttcccatgttaacaagaagaagatcaagaacccagactacctcgctagtctgatcggacgcgtaaatttcgtcctgaatgttgagcccaacaacctggaattcaccgaatacaagaagatactatcgaatctgatccagtga

SEQ ID NO: 9291 - RNA, 1023 nt, unidentified
  source 1..1023: mol_type = other RNA; note = synthetic construct
atgcaactctctcagtgggagacatattttcaggacattgggattagcgagcagtacattgacgaatacttggagattatttcgaaactctccaagaagaaattgcccattatcttcgagattgaacaattctccaaacttgtcgggatcgagctgaatatactgtacaagatgatattctcacccgagagcttctaccacgagttttatatcaaaaagaagaagggcgggcgtaggaagatagtggtccctttcccctcattactgctcattcaacgatggatttacaagaatatcctgctcaagtgcacatgtcacagcaacatccacggattcatacagaagaagtctatcatcactaacgccaaggcacatattgggggaagagatttcctgaaactggatcttcaaaacttctttccctctatcagtctgaattgggtggtgaggtattttaatgaactagggtacccgaagaagatatcattttacctggctcgcttatgttgctacgaagagggtctaggtcagggagccccaaccagccctttcttgtctaacctgttgttattttccctggacaaacgcctcaacaatctggcgaaaaagaatgagagcacttatacacggtacgctgacgatattgtgtttagcggtgaaaagatcaccaagggattttatagtctcgttgaaagtatcgtaggagatttcggcctcactctgaatgagtccaaaacccagctccggaaaaataaaacccagaacatcattacgggcatagttgtagtgaatgatggcattaaaatccctaagacctacaagaagaagatcagacaggagatctactatatcaacaaatatggcctgatgtcccatctgtctaaaatcaggaacaaaaacccaacatatctactttccttgcttggcaaaatcaattatgtcctttcagtggagaatgacaaccaggaatttaaagactaccagaagaagatggaaaacttcatcaaaaacccactgaactga

SEQ ID NO: 9292 - RNA, 1014 nt, unidentified
  source 1..1014: mol_type = other RNA; note = synthetic construct
atgaaactcaagtcccctaaggagtgggagggctatataaagagtcgggggctggagccagaattagagaagacactttcagcatacgcatcaaatctgtcttctaaaaacttgcctgttatcttcgagctagaacatttgtccaacatattagacatcgaacatgacgagatgcgcgttatggtgaatgggagcgactggttttatagagagtttgagattcccaagcgcaggggtggtgtccgcgtgataaaagtgccctattccagcctgatgcacgcccaatactggctgaaagaggccattctcgacaaagaattcatccactctaaagctcacggcttcgctaacggaaagagcatcaaaagtcatgtggagtgccattgtcactctctccacattctcaaactcgatatcaaggattttttcccgacctttaaaaagagctgggtagccaactactttaaccagctgggctacgcaccgaatgtggctttctatctggctaatcttactaccgataccgtgagtcttgtgcagggagcgccaactagccctgttctgtccaacatcctttttcgtaaagccgatcgggcattaaataagatcgcggtcaaatacgaactttcttactcaagatacgccgacgatatgtgtttttccggcaattacattcccaagaagctgttgcggctcgttgagcgtattctaagatatttcgggttccagttgaattcgaggaaaacgtatctggggcctgtgaacggttgccacattacaggcattaaggtcgtcgacggccagttgaaggtcagtaggaagctgaagagagaactgcgcaaacaaatacacttcattgggaagtatggactgctctcacatgtgaacaagaaacggatccgagatgtattcttcgtggagcgactgatgggacagctcaatttctggaagtttatcgaacccgagcacgaatttccaatcgaagccctaagcctgctgaggcagaagctgtga

SEQ ID NO: 9293 - RNA, 1095 nt, unidentified
  source 1..1095: mol_type = other RNA; note = synthetic construct
atgagagcggccaaccgaaagttatttgatcatttgctgtttctcctgacaaatatgtcgaaacagaaagagatcaacaaatggaagacattcttcaagaatcggggcctctcagaagagatttctgacaagtacattaactacatcacaaagctgcttgagaaccgaaccccaataatcttcgagtttaatcacttggcactgctgctaggaagacagcccttctacctcgcctccgtggttaatgcacctaacaatcactatcgtagcttcaagctgaaaaaaagaagcggcggctttagggagattaccacacccttcccggcgcttctcgagatgcaatactggatcttcaacaacatcctaaaaaacgttagtatcaacccttgcgctcacggctttgctcacaagaaatctatcattacgaatgccaccttacatgccggccagaatgaattgctgaaactggatctgaaagacttctttccgagcatcaacatcaatcgcattatttatgtgttcaagtccctggggtaccccaatgaaatagcattctatctcgcatctatttgttcctacgaagaatcacttccacagggggcccctactagcccagtgctgtccaacatcattgccaaacagctggataagcgcctgattaacctggctaagaaatacaacctcaaatttacccggtatgctgacgatctcacttttagtggaaaaaacattccagcaaagttcattgagtatatcaaggtcatcatagaagaagaggggttcgaccttaacgaggctaagactaggttatacaagtcaaatcgtaagagaatcgtgaccggaatcagtgtgttggaaaaggagataaagatacccagggagtacaaacggaacctgcgccaggaactacactttatcttcaagtatagcttcgagtctcatataaagaagaagaagattcggaaatccaattatcttgagagcctgattggtaaagtaaatttttggttgtcagtcgaacccaagaatggttttgccctggacgccaaaaaaaggctctttgagatctacaagaattattaccctcaacagtga

SEQ ID NO: 9294 - RNA, 1035 nt, unidentified
  source 1..1035: mol_type = other RNA; note = synthetic construct
atgaccagcgacgccattatcgagaagtggaacaatttctttactcggaagggcattaaccagaccttacacgacaagtatatagagtacatcaaaattctcgtcaagaacaatgtgcctataatctttgacttcaatcacttgcgactgctcatgggacgatcggatctgtattttactagcgtaattaatagccctgagaaccactaccgtagttttaagcttaaaaaacggaacggggggtttagagaaatattggccccttatcccgctttgctggaaatgcaatactggatctacaataacattctcaagaaaatcccgatcagcccctactctcatggcttcgcccataaaaagtccatcatcaccaatgctaagattcatttagggcagaaagaactgctgaagcttgatttgaaggacttcttcccatccataaagatcaacagaatcatctatgtgttcaaatccctgggctacacaaatcaagtcgccttttacctcgctagtctgtgctcatataatgaaacacttccacagggcgcacccacgtcaccataccttagcaacattatcgcaaaaaaactcgacaaaaggttaattaggctgtctaagaagtacaagctacattataccaggtatgctgatgatctgacgttctcaggtgattctatcccagccaaactgatcgagtacattaataacatagtgaacagcgagggatttacattgaacagtgagaaaactcgcctctacaagcatggtgggaaacgcattgttaccggaatttccgtgaacggaaaggagctgaaactacctaaggattataagagaaacctacggcaggagctgtacttcataatgaaatatggttacgagtcacacatcaagaagaaaaagatccgcaaggttaactatctgaatattcttctcggcaaggtgaatttctggctgtctgtcgaaccctccaataaattcgcgctggacgcacacagttttctgctcgaaacatataaaaagcacaataagtga

SEQ ID NO: 9295 - RNA, 1020 nt, unidentified
  source 1..1020: mol_type = other RNA; note = synthetic construct
atggctaaagaccttattaaggagtggtacgatttctttactgtcaagggaattgagccccagctgcgcgacatttacatcgattatatctcactcctatcagagaataacgtgccaatcatctttgaatttaaccacctggcattattattgggcaggaaacagcattacctggcctccgtagttaacagccctgagaatcattaccgtgaatttaagctgcctaagcgaaagggggggtatagggagattagtgccccgtatcctgcactcatggagatgcaatactggatctaccagaacatcctgaagtctatccggatacactccagtgcgcacggattcatcaatagcaagtctattatcaccaacgccaagatacacaccggccagacagagctgctcaagctggacctgaaggacttctttccaagcatttctctgaatagaatcatttccgtgttcaaaaatgtgggttatccaaaccagatagctttttaccttgccaaaatctgcacttatgaagagtgtctgcctcaaggagcccccacatcaccctgcctgtccaatattatcgccaaaaacctggataaaaggctaatgaaattggccaagagcctgaacctgaggtacacgcgctatgctgatgacctcacatttagtggaaataagatccccgcaaaagtgatagagtacatcagcactataattgtcgatgagggcttcgtgattaatcaggacaagacccggttgtataagaacaagggtcagagaattgtgaccgggatctccgttctggagaaagaacttaaactcccgcgggaatacaagcgcgtccttcgacaggaactgttcttcatcgaaaagtacggcttaaaatcgcatttggctaagaagaaacagagaaaagcgaactatatcttcagccttataggcaagctgaatttttggctctctattgaaccagaaaatcaattcgcactcaaaaacattgagaaattgaagctcatcctaaactga

SEQ ID NO: 9296 - RNA, 1023 nt, unidentified
  source 1..1023: mol_type = other RNA; note = synthetic construct
atgaaagatgaccagtactcccagtggaaaaagtattacgagagccgaggaatcctgccagagattcaggacaaactcctcaactacgctaagatccacatagataataacacacccgtgatctttaatttcgagcatctaacactgcttctgggacgtgagaagaattatctgtcctcagtagtgaattcccctgactcgcactatcggaagtttaagataaagaagagatcagggggcgagagagaaataaccgccccatacttgtcattgttggagatgcaatactggatttacaggaacatcctcatcaatgttaagattcactatgccgcgcacggctttgcacaggataaatctatcatcacgaacagtagaaaccatcttggtcagaaacacctcctgaaaatggatttaaaagacttcttcccttccataaagctgaacaggatcatttacattttcaagagcctcggctatccaaacattatcgccttttacctggcaagtatctgctcttataagggccatcttccacagggatcacccacctcccccatactcagcaacattgtttctattaccctggacaatcgcctggtcaaatttgcccggaaaatgaaattgagatacagcaggtatgctgacgaccttactttcagtggtgataagatcccgacaaattacattaagtacatcaccgacatcatcaatgatgaagggtttgaagtgaatgatactaagacaaagctgtatcttaaggccggtaaacgaattgtgactggaattagcgtgatagggaatgatcctaaactgcctagggagtataaacggaaactcaaacaagaattgcactacattttcacctacgggatcggctctcatatggccaaaaagaagattaagaagatcaactacctgtatcgcatcattggcaaagtcaacttctggctgaacatagaacccgacaacgagtatgctcgcaacgcaaaggctaagttactattactgatcgacaattga

SEQ ID NO: 9297 - RNA, 1020 nt, unidentified
  source 1..1020: mol_type = other RNA; note = synthetic construct
atgtctaacaaagagactttcaataaatggcagagttatctagagagccgaagggttcaggaggatgtgaaagaacaatacctttcatacatccggatcctcctggataagaatgttcctatcatcttcacttttgaccacctgtcccttttactaggaaggagcaaaaattacctcgcttctgtagtcaattcacctgacaaccattatagagaattcaagatcaagaagcggagtggcggatttagaaaaatcaccaccccattccccgctctgctcgaaatgcagtactggatctacaacaacattttaaagaagatccccattcatagttcggcccacggttttacacacaaaaagtccatcattacgaattccaagattcacgcaggcgaaaatcatctcctgaaaatagaccttaaggacttttttcccaatattgacatcaaccgaatcattttcatctttaaggaactgggctaccctaacattatagcgttttatttggctcagatttgttgctttgacggcaccctgccgcaaggagccccaacatcccccattctgagcaacatcgtaaccagacgcttcgataagagactgatacatttagcaaagaagttcaacttgaagtacacccgttatgcagacgatttgacattctcagggagcacgatttctgccatttttatatcttacgtgaacgacattgtgatcgatgagggtttcgtgataaatgattccaagactaggttgtatcagaagaaaagtaaacgcatagtgacagggatcagcgttattgagaaagagatcaagatcccacgcaactataaacgggatctcaagcaggaactgcactatatcttcaaattcgggctcaaatctcacatgtcaaagaacaagataaggaaagccaattacctgttcgtgatccttggcaaagtcaatttttggctgagcgtcgagcctaagaacgaatacgccctcgaggccaaaactaagctgaaagagctgatttga

SEQ ID NO: 9298 - RNA, 1053 nt, unidentified
  source 1..1053: mol_type = other RNA; note = synthetic construct
atgacgaaaaaagagattttacgggaatggagactgtatttcgaaaataggcaggttagaaaggacatttacgagaagtacattgtatacatcggagttctgttggagaacaatgtgcccattattttcaatttcgaccatctctgccttcttcttgggcgaagcaatgagtatttgagttccgtcattaattgtagttctaaccacttccgagactttgaaatcaagaagagatcagggggacaccgggccattacagcaccttatccagccctcatggaaatgcagtactggatatacaacaatattctcaaagccatacccataaattcctcagcacacgggtttactcataagaagtccattatcactaactctaacatccataaaggacagaaggaactgcttaagctggacctcaaaaacttttttccgtcgattagcatcaacaggatcatctacatcttcaaacagctgggctaccctaataacatcgccttctacctctccagcatctgctgttatgataatttcctaccacagggtgctccaacatctccaatattaagtaacatcgtaagccgcaagttggataagaggcttattaccctcgctaaaaagtttgccctgaaatataccagatatgcggatgatctaaccttttcaggcgatattatccctgctaaattcatcgactatgttacagctatcgtgtgcgacgaggggttcgaagtgaatataaacaagacacgcttgtacaagtccaaaggcaaacgtatcgtgactggtatatcagtgagtggagacgtcatcaaggtgccccgcgattataagaggaagttgaaactggaactgcactttattaagaagtatggcctggagtctcacatcgccaaaaagaaaatacggaagtacaactacctgttcagcctggtgggcaaagtcaacttttggctgagcgtggagcctaagaatcaggaggcactggattatcaaattctgctgaacgagtacgtcaaaaagatccaacagcccttagacatcaccctctga

SEQ ID NO: 9299 - RNA, 1095 nt, unidentified
  source 1..1095: mol_type = other RNA; note = synthetic construct
atgcttaagcataagaaagaggtggcacaccacttgtttttggacatgacaaagaaccaaatctacgagtcctggaagtgcttcttcattgagcgcggccttgatgaaaaatatagcagaccatatctagtgtacatcaaaaagatgttgtctaatgggttgcctattatattcgaaacggagcacctgagccttctactgggacggagtgcttcatatctgaactcagtggccttctctccttcatcccactaccgccagttcaaactgaagaaaagaagtggaggctttaggactattgacgttccttatccggctttactggaatgtcagtattggatctaccgtaatatcttatccgtggttcctctgaattactgtgctcatgggtttgtccccaaaaaaagtatcatcactaacgcaaaggtccatcttggtcaaaatgtcctcttaaaactggacatcgaagatttctttccaagcatctctaaagatcgagtaataggcgtatttaactttctcgggtaccccccaaaggtgtcatacttcctcgcatctctgtgttgccttaatgaatgcgttccccaaggggcccctaccagtccgaccttgtctaatattatatcctacaacctggacaagaggatcctggccttctccaaaaattttgagcttaagtacaccaggtatgccgatgacctggccatctctggtaagaacctcccaacaaagtatattgattacctccgggtcatcgtggaagatgagggatttaaaattaacgtgagtaagacccagctgtttactagacagagcaagcggattctgacaggcgtcagcattggcagcggcaagctgaaagcgcccaaagaatataaacgagtgctgtttcaggagctcttctacattaagaagttcggtctaaattcccacatatcgaagatgaaaatccgcaatcccaactatatacagagcctcgtgggaaagctgaattatatcctgtcaattgagaaggacaacttcaaagctattaactatctcaactacctcaaggagaactacaattcccagattatcaagatagacatctactga

SEQ ID NO: 9300 - RNA, 1053 nt, unidentified
  source 1..1053: mol_type = other RNA; note = synthetic construct
atgacgaaccacaaaattatctacaacaagtgggaggactacttctcaaatcggggactggaaaaaaacttgctagacagttatctggtttacatcgacggactcctgaccaataacctccctataatttttgagtccgagcacttaagtcttctgcttgggaggaacgaggtgtaccttaactcagtcgtcttctccaccgagctccattaccgggattttaaactgagaaagagaaaaggcgggttcagaatcatctctgtaccctatcctgccctgctcgaatgccagaagtggatccataagaacatactgtccaaggtcaagatatctccctacgcccatggctttgccaagaagaagtcgatcgttaccaatgcccgaaagcatactaaccaggagcaccttttaaagatcgatctaaaggatttcttcccaagcatcaagaagggtcgtgtgatagctatgttttgcaagctcggatactctacagaggtgtccttttatcttgcgtccatatgttgtaaaatggactgcctgccacaaggtgctcccacttctcctagcatcagcaatattattgcaaagagcttggataataggctattcgctctcagccagaaatttgaaattcggtatacaagatacgccgacgatctggcattctcaggcggtaacatcccagcaaggttcattgattatgtgacagaaatcgtcaccactgaatcattcgagatcaataatagtaagactcaactgcacaaaagcaaggggaaacgcattatcaccggcgttgccgtgaatggagaaattgtaaaagcgcctaagtcttacaaacgaaaattgtttcagacgctgtactacatcgaaatttttggcttaaacagccacaggacaaaattgaaaattcgcaaccccaactatttggagtccctgatagggaaactgaattatgtgctcactattgaaccggacaattctaaggctaaaaactatctgaccatgctgattgagatcgacaagagtcgcacacacaattcggtgtataaatga

SEQ ID NO: 9301 - RNA, 1041 nt, unidentified
  source 1..1041: mol_type = other RNA; note = synthetic construct
atgagtaaaaaaaggattctgagcaactggtctaatttctttgagcagagaggtatccctgaggacattcgggaaatatacctcaggtatattaagaagctgcttgtgaaggacgtgccaatcatatttgatttcaatcacctgtccaaactggtgggacggcagcagtggtatctggcatcagtcgttaataacacttcatctcactaccgaacattcaatctgaaaaaaagatccggagggtttcgggagatcagtgtcccctaccccgccttactgggcgttcagtactgggtgtataagaatatcctgcagaagattccaatcaataacagctctcatggcttcgcgaaaaacaagagcattatcacaaacagcaaaatccacctaggacagtctaatctcctgaagatggatttgaaagattttttcccatccatacacctggcccgtgttatcaaggtgttcaaagctctgggctacacgaccaaggtcagttactatttagcatccgtttgctgtattaatgattgcttaccccagggggctcccacctcacctatactttctaacattatttccttcgaccttgatcgacgcctgtatttgttcgccaagaagtttaacctcaagtactcaagatatgccgacgatcttaccttttcgggcgaaaatatcaacgtcaagatgattcactacatcagcgagattatcgtatcggaaggttttatcgtgaacgacaaaaaaaccaggctgcacaaggaatccgctaaacgcatagtaacagggatctctgtggcaggaagcgagctcaagctgcctaagaaatataaacgcgacctcaagcaagaactctattacataaacaagtacgggatccatagtcatgtgagctcagtgaacattaaacatactaactacatcgacgtgttgattggcaagcttaatttctggctatccgtagagcctggtgacgagtttgtggtcgagcaactcaagatgttgtacagtattaagtatccagaaagcatcccgaaatga

SEQ ID NO: 9302 - RNA, 1026 nt, unidentified
  source 1..1026: mol_type = other RNA; note = synthetic construct
atgagcaagaaagacctgtttttctggaactcatcctttactaaggctaagatcaatgatgagatcaagcaaaactatctgagatatattgaggtgctgctgaacaacaaagtccctatcatttttgacttctttcacctcacacttctgttgggtcgcaattcaaaatacctatcgtctgttgtgaatagcaatatttcacattaccgagagtttgaaatccctaaaaaaaagggcggaacccgcaagatcaccgcaccctatcccgccctcttggattgccagaggtggatttacaacaacatcctcaagaacattaagattcacccctgcgcgcagggtttcacaaagaaaaagagcattatcacgaacgcgaagatacatgtgaaccaagacgaattcctcaagatcgatatcaaggattttttcccgtccataactatcaaccaggtgattaatatcttcaaatcctttgggtacacacagaaggttagcttctatttagcctccatatgctgttacgaccagaaccttccccagggcgctcctacaagtcctattctatctaatttagtcgctattaccctggacaaaagacttttcgcattcgccaagaaatttgacctgaagtatactcggtacgccgacgatttggccttttctggaaaaaagataaccagcaaacaccttgagtatatcaaagagatcatttcagagtgtggattcgaggctaacgacgaaaagaccttcctgcaacagaaaaagagtaaaaggattatcaccgggataagtatcagcgataatacgattaaggtgccaaagcaatataaacggaaactgaaacaggaagtgcattttatccgtaaatttggcgcattgaatgtcatacggaggaataagatcaagaatccaaattacctctactctatcattgggaagctgaatttttggatgtccgtagaaccaaataatcagttcgccaagaaagcatacaacgatctgaagcagttcataaactacaactga

SEQ ID NO: 9303 - RNA, 1020 nt, unidentified
  source 1..1020: mol_type = other RNA; note = synthetic construct
atgagcaacaaaataatccagggttggaaaagttttttcattaaggccaagatttccgtcgaagcccgggagatctacctgaagtatatcagtacactcttatccaataaggttccgatcatttttgacttctatcatctgaccctgttgctcggaaggaactcggagtatctcgcctcagtgattaatagcaacacatcacattaccgcgaatttcagatcccaaaaaagctggggggctttagaaccatcctggctccataccccgcgctcatggacatgcagaactggatttacaagaacatcttaaacgatgtgaagatacacccatgcgcgcaagggttcactaataagaagtcaattgtcacgaatgcaaagattcacatcaatcagaaggaattcctaaagattgaccttgagaatttcttccctacaatcacaataaatcaggtaatcaacgtgttcaagaatcttggttacactcataaggtgtccttctatctggccagcatctgctgttataataagaatctgcctcagggagctcctacgtctcccattctcagtaacattattgcacttacccttgataaaaggctcttcgcattagcccagaaattcaatctcaaatatacccgatacgccgatgaccttgcctttagcggcgatgagataaacctgaagcacattgactacattaagaacataatcaacgagtgtgggtttactctaaatgaggctaaaaccgtgctgcaaaagaacaagaacaaacggatattgaccggcatttccatcgctggcgaaactgtcaaagtgcccaaaaactataaacgcaaactgaaacaggaagttcactttatcaggaaatttggcatcctgaactatatccgtagaaataagatcaagaaccccaattacttgtactctatcctgggaaaattgaatttctggctgtctgtagagcctaagaacgagtttgcaaaaaaagcctacaatgatctgaagcaacaaatacagtga

SEQ ID NO: 9304 - RNA, 1029 nt, unidentified
  source 1..1029: mol_type = other RNA; note = synthetic construct
atgagtaagctgaagctgtacaattactggtatagcaacttcgagaagagcgggatcaaatccgagttcgtcgaaaaatatatggcatatgtctctaagctgttaaacaacaatgtgcccatcatttttgactttaatcacctctgcctgctgttgggtcgaaacggccactacttggcctcagttgtgaattctaatgtatcccactaccggatatttcagatccccaaacgttcggggggacataggaacataagcgctccttatcccgccctcctcgaatgtcagtcctggatttacgaaaatatcctggcaaagattaagatccaccccgccgcccaagggtttaccacgaaaaagtccatcattacaaacgccaagatacacataaaccaaaaccatttcctcaagatcgacctgaaagacttttttccttccatcactatcaatcaggtgattaacgtgttcaagtcaattggatacaccaacaaagttgcctattatcttgctagcatctgttgctgtgaaaacgtcctgccacaaggcgctcctacatctccagccttgtccaacatagtaggtaagacattagataaacggctctacagtttcgctaggacttacgacctgaaatatagcagatatgcggatgatcttgcatttagtggcgagcagattccatcaaagtttattgagtacatcagcgacattatccgatcttgcggattctctgttaatgaccggaaaacaatccttcagcagcagaaaaatcgcagacgcataatcaccggcattagtatctcggatgatgctataaagatccctagagagtacaagagaaaacttaagcaggagatccactgtattcgcaagttcgggatttcaagccatatcaggaggcaaaagattaagaaaaccgactacctgctgtgcgtgattggcaaagtgaaattctggctatctgtggaaccggagaatcagttcgcaactcatgccctcaatgatttgctaaacatcgcgcagcagtga

SEQ ID NO: 9305 - RNA, 1065 nt, unidentified
  source 1..1065: mol_type = other RNA; note = synthetic construct
atgaataccagggagcagaatattatcctgaagaattgggaacagttctataacagcagaggagtcgagcccgagctgattaaagtgtacatgagttatgtggagaaacttgtgaatcagtctctgcctcctatctttgatttccggcacctgtcacttttgctgaacattaacgagtatgacttagcgagtatcgtgaacagccccagcaactattatcgcacattcgatatacctaagagaaatggaggctttcgtaccattaccgccccttacccctcattgaaaaatatccagaagtggatttaccacaacattctctccaatattaagatacatggctgcgctcatgggttcgccacttcaaggtccattctcactaacgcaaatgtccacattaatcaaaagtgcctcctcaagatagacttgaaagacttttttccctccatcccaatgtcttatgtcctccagctgtttaagtcgctcggatatgcaccgaaggttgcgttttatttgtcgagtctgtgttgttacgacgaatgtttggcccaagggtccccggtgagcccagctatatctaacatcgtagctaaacacttagatcgccggctttaccgaatcgcaaagaagtataatcttaactacagcaggtacgctgatgatatcgccttcagcggggaaagcataaacgtaaagttcatcgagtacatcaaagagataattacagattgcgggtttttcgttaatgaaaacaagatcaggctgtataaagaatacggcaacaaaatcctgacgggaatctctctagccaccggtgtgccaagactgccacgggactaccgacgctctctggagaaagagctctttttcatctacaagtacggcatcaaaggtcacatcagtcataacaaaatccggaaatccaattacctggagtcaattattggcaaggtgagatattggctgatgatcgaacccaacaatacattcgcccagcaaatgtacgaaaagctatatgcagagtacaagcttcagctgaacacttccgacattgaagttttatga

SEQ ID NO: 9306 - RNA, 1047 nt, unidentified
  source 1..1047: mol_type = other RNA; note = synthetic construct
atgactgacttgcagctgcaaaaaatgatggaactgtggaaggcctactatagatcacgcgggattgccccggagtttgcaaatcagtgtctcgcctacgctcgttcacttctcaaacaggatatgcctgtgatcttcgatttgcctcacctgtgcctactgctcggcctagacgtgagttacctgcattccatcgtgtacggtgctgataagcactatcggaactttttcatcaggaaaaaaagcggaggcgtgcgtgagctgagtgcaccacactataccctaaaatacgtgcagacttggatatatgagaacatcctctctaaggtgaaggttaactactgcgcccacggattctgccctaagaagagtattgtaaccaacgccagggtccacgttagtaataaatacctgttgaaactcgatctgaaggatttttttccctccattacccagaatcaggtgattaatgttttcaggagcctgggctacagcaatcacgtcgcattttatctgggctctatttgttgtgttgacggccaccttccacaaggggcacccacatctccagcgctttcaaacattattgctcatcacctggataaccgcctcctgggggtggctaagaaaatgggctacaagtatacgcggtatgctgacgacctcgctttctccggagacttaatcaagcccgtgttcgtccagtacgtcgtgcgaatcatctcggaatgccatttcatagtcaatgcctccaaggtgaaactgtacaaaggaaacggggcgaagatactgacaggagtatccttagccaatggtcaaatccgcgtccccagagagtataggcggaaacttgaacaagagctttactacatcagcaactatggtttaggcgagcatataagacgccggagaatcaagaatcctcattatctggagagcgtaattgggaagacagaattttggctgatgttggagccagaaaatgaattcgcaaagcagtctctggagtacttgcgagccctctacaaccagaaatataaccagtga

SEQ ID NO: 9307 - RNA, 1044 nt, unidentified
  source 1..1044: mol_type = other RNA; note = synthetic construct
atgatcaagaagtatccacacgagtggaaaaagtattttgactctcgctgtattcctcagaatgtgcaggatgagtacttgtcttacattaagaacctgcatgaccaagatattcccatcatatttgaaatagagcatcttgctctgctgcttggaatggagatcagcgtgctgaatcgcatgatatttggtacaaaaagtttctatcggacgtttgaaataccaaagaaatccaaggatagcgttagaattatcgacgccccttatccctctttattgtctgtccagcagtggattctaaagaacatcttgaagaacattcacatcgatgattcagcccacgcgtatatgaagaagaagtcaatactcactaacgtcacccctcacctgaacaataaagtcctcctgaaaatcgacctcaagaatttcttccccaacatagaaaaaaaccgaattatcgctgtattcctcaagctgggctacacacaaaacatttcctttgccctggcatctctatgcaccttaaataaccacttgcctcagggcgcacccacgagtccgacactttcaaacattattgcttataggctggatcggaggctttccagcctgtgcaaaaagagcgacatggtgtatactcggtacgccgacgacatggtgatcaccagtaagtacattagccttaaaacaaaggacctgattatcactatcatcgaagattgtggtttcatcgtgaataaggataaaacctacttatccaccaatcagaacaaacgaatcatcactggaatatccatccaagacggcactaccaaaattccaaggaagctcaaaagagagatcaaacaggagatgtactatctgaataaatacgggttctactcccatatcaacaagcgcaaaattacaaatcccttttacttggaaaggatcagagggcagatcctcttctggaatttcattgaatcagatagtaccctggcaaaggagatgctgtcggacatcaatcgtatcattgagatagttgagaacctcagccagtga

SEQ ID NO: 9308 - RNA, 1032 nt, unidentified
  source 1..1032: mol_type = other RNA; note = synthetic construct
atgaacaatactaaaatcatctcgatcaaggagtggaagagcttcttcaagagccgcggaattgagcagtcacttattaacgaatacatttccaacatcgagaaattaaaggacaagaatctgccaattatctttgaaatagagcacctgtcatacttagtcaatatcaacattgagatcctcaataagatgatcttctctaataagagcttctaccaggaatttaagattcccaaaaggaataaaggagagtttcgtgagatccatgcaccctatcccagcctgaaatgtgttcaggattggatctataacaacattctacagtacgcaaagatccattacaacgcccacggctacgtgaaaaacaagagtatcaagacaaacgctaagaaacacctgaacaagaaggagctgttcaaaatagacctgaaagacttctttcctactattaagataccgaggatcattgaacaatttaaacggctcggttattccaaaaatatgagtctgtgcctggccaccttgtgctgtcagaatgattatctgacacagggcagccctacttctcctgccttatccaatctggtggcttacaaactggataaaagacttacagccctcgctaaacggaataatttggtctatacacgctatgtggatgatattgcgatctcaggggacgatatccatcactttctccagaaacttatttgcgagataatcgaagaggagggttttattgtgaactacgagaagacctatctgaacaaggaaaacagcaataagagactcttgacgggcataataattaaggatgacaagctgaccattccacgagaaaccaagaggaaactcaaacaagagatctattacatcagtaagttcgggataaagtctcaccttatctccatcaataacaagaatccctactactatgaatctctcttgggaaaactacaatactggaaattcattgaaccaacctccaaagacgtagacaagctgatcaagattcttaacgactcaatatga

SEQ ID NO: 9309 - RNA, 1056 nt, unidentified
  source 1..1056: mol_type = other RNA; note = synthetic construct
atggacgaacaaattgacagcacagccgatagatgggtggagcatctgggcggaaccattaagtcacgcccattcagagaggcttgcacagcctacgcatccaggttagttgagaacggctttccggtcgtgttcaatctccagcatttggcgaaagtgaccgggcttaagacgagagtcgttggcagccaagtttttagaaccgaacggtactataggaagtttagcattcctaaaaggactggagggctgaggactatccataccccctacccgtccctgctactatgtcagaggtggattaactaccgggtgctcaccggaatccgggtgcacaagcacgctcatgggttcgtgagtggccggagcgtgctgtcgaatgctctgccacacctccagaaaagatggatgcttaagatggatatcaaggactttttcccttccatctccatacgcaggatcgtaccaatttttcggaggtgcgggtattctcgagacgtgtcatacttcctgtccagacagtgttgcctcgaggacgtccttccccaaggcgctgctactagtccaactctgagtaatattgtcttgaagcgcactgatagtcggctcacagctttagccgagtctttcgccgccacctacacgcgttacgccgatgacttgacattctctggggattatctccccgcacgaataatagacatcgtatcaaggattgtcactgatgaaggattccgcgtgaacaccgcgaaaacgagactggttggccctaaaggccgcaagatcgtgactggtgtgagcgtctctggtgcatctccccgactgccaagacagacaaaacgggtgcttcggcaggaattgtttcacctgcacaccaagggttatgcaaagcacaccgccgtccgccagatcctggatcctttgtatgccgagcgactgctggggaaactgtcattctggctgcagatcgagcccgacagcccttttgcgcgtcaggccctcgactggatggcagaagtacgcggaacattacaagttcttggtcgtcatacatga

SEQ ID NO: 9310 - RNA, 1029 nt, unidentified
  source 1..1029: mol_type = other RNA; note = synthetic construct
atggaaaaagatgagatccagctttggaataagaacattagcgaagccgtaagttctaaacggtgggtcaaggcttattcaaaatacatagacgtgctgtccgaaaactccgtgccggtgatttttgagatcgatcacttggccgagatcctgggcttacggagcgatctgctggtgagggccgttaacagcgtggaaagattctaccgcccattcgaaattcctaaaagtagcggcggaacacgaaagatcaacgcaccctatcccgtgctgcttgatatccagcgttggatcggagcccatatattgagtcaggtcagaatctccgaacaggcacacggatttgtaaagaataggagcatcatccgaaacgcaagagagcatctcggtaaggaatgtatgctgaaaatggacatctccgacttcttccccgcgatatctcttaagcgggtgatcacaattttcctgtttctggggtactcaccttctgttagctattatctctctgtcctttgctgcctcgagaatcaattgccccaaggtggggcagcctcaccacagatctgtaatatcatcgctaccccgctggataggcgcctgatgtcactcgctctagcttactctttaaattacacacgatacgccgacgacctgacgttttcggggcgctacatccctattaagttcatcaaaattgtggagtccatcgccagcgatgagggctttgagattaataacaagaaaaccaagctcatgagagctaaaggccggcggattgtgactggaataagcattgggaccggggagttgaaactaccaaaaagtactaagaggtccttaaggcaggaagtctactggttggaacgtaatggtatttttgcggagagtggaagagacggcatattcgaccctctttatgtcgaccgcctcctcggcaagctgaacttctggcgctctattgagccagagaacacctatgttattgagaagattgataggctgaaggaactgatcatatcagagtcctga

SEQ ID NO: 9311 - RNA, 1053 nt, unidentified
  source 1..1053: mol_type = other RNA; note = synthetic construct
atgtccgccaaaaaccggctgggatctagtgcttggagaaaacattttgacagcatcggatgcccatcggatcttaagagtacgtatttggcctatatcgatcgaatgaccggacgggggttcccccccattctggacttcgggcatctggctagcctccttggacgcactccagcttatctggccagcgcaatcaatggcaccaagtgtcactacagacagttcgtcattccaaaaagacgcggtggagcccgaacaatctcagctccgtatcccgctctgctcgaatgtcagcagtggataaatcgagagatcctcgagcacatagacgtgcactctgctgcccacggctttcgtagaaagcggtcaattgcgactaatgccagccagcacctgaacaaggcctgtctgctcaaaatggacattaaggacttcttccccagcataaagctgaggagggtcattgccgtgtttcgcgacttagggtatcctaaaaacatttccgtgtacttgggcaggctctgctcactcgatgggcaattgcctcagggcgcagcaacctctcctgccatgtctaacatcatcgcgaagcagctggattgccggctactgggtgtcgcaaagaaatggagactgaggtacacaaggtatgctgacgacctttgcttctcgggccctcatatctccatccagttccctaagctggtgagcaggatatgtgaagaagagggcttacagattaatgcatccaaaacacagctctgccggtctaaggggagacgcattgtaaccggactttctgtttccggcgaacgtttacgagtaccccgggcgtttaaaagagaggttcgtcaagagatgcactacatcaaggttcacgggtactggtcccatgtgagtaagcgcaagatccgcaacccattctacttgcaatcattgtacggcaaactaatgttttggaggtggattgaaccggataatagtttcgtgaacagcgcctttgatgtcctgcggaatctggtgcatgagaacggtgagtttgagaaagattga

SEQ ID NO: 9312 - RNA, 1044 nt, unidentified
  source 1..1044: mol_type = other RNA; note = synthetic construct
atgattgaaaaaaacataaacatcgagccatgggctaatctgatcgctcgccgggttaggcgccctagcattagaaccgcagcgcttaaatatattgagcgtttaatcgccgtgggcgtcccacccattttcgactttgaacacttatcagagctggtaggtgtgcaccgtgccatcctcgctggattcgttgagtctgctggcagcttttacagaacgtttaaaatccccaagcagtccggtggttttcgcgaaatttcttccccggtgccttcgttgctcatggtccagcggtggatcaaggaaaacatcctggatgaaataccagtccacgacgccgcccacgggtttgtgaaggggaaatccgtggtgaccttcgcgcagccccatgtaaataaggctgcactgcttcatatcgacgtatcggactttttccctagcattgatttgaagagggtttacgtgttgttcaggaatataggatatgcccccaatgtcagcctcttcctcgccagactgtgctgtgtgaacgggcgattaccgcaaggggccccaactagtcctagcatctccaacattattttctcaagtatcgatgctcggctcattggactgggttgcgttgccaagctggactatactagatacgcagacaacattgtcttttctgggaattacatcaacatcaagttcctagacatcgtgagtgagatccttagcgagaactctttcaaagtgaaccggaaaaagacatttctgagtacaaaaaaaggcaagaggataattgcgggaatctcagtgtccggcgagcggattagcctcccacgagacacccgccgaaatctcaggcaacaggtccatgggctgctgaagttcggcttttttgagcatacagcccacatcggagatttggatcctatatacgcagagagagtcctgggccgcctgctattctggaagtacgtggaacccaataattcatatgttgcatcctctatacaggccctgaggggcatgcagatggatcttgattctcaggtgtga

SEQ ID NO: 9313 - RNA, 1134 nt, unidentified
  source 1..1134: mol_type = other RNA; note = synthetic construct
atggatgggatcctcataacgatactgattatcaccggctttcttatctacaagatgatcagcagctctagaaaacaggagggttacaagaggtggaaggccaccgctagcgggggtaaggaggagagcgcctcaaagtctgagagcgggcacggagcttggttaagacgagcactgggggttacagcgccgcagtctccttatgttcccaaatttgacgacgagtccgtagtctggtgcgcctcactgctaggcgtggaggctaacaagctcaaagaaatcctcgagaatattccgacacactaccatgaattttgggtgcgtaagcggagaggagggtatcgcatgatttcagccccccttaaggaactgcaaagtatccagactaccattaacagccgcatcttgtctagtgtgactaccatccaccccgcggccgttggctttaggtgtggaagaagtgtagtggataacgcctcacctcatctcggaaagcgttacgtcctgaagatggatattcacgacttcttcttctccattcggtcccctcgcgtaaaggccaccttcgaaaaaatgggttacccagctaacgtcgcaaaagtgttccgcactctgtgctgcctacacaactccctcccacaaggagcacccaccagccctgccctctctaatatcgtcggctatgagatggacaaaaaactggctgcactggccgcggagtacggcttaacttatacaaggtacgctgatgacttaacattctcgggggatgtgttccccaaagaacagattatcccacgcatcaagcagattattcgggacgagaagtttgagccaaatcataaaaagacccggtttttgcacgaatatgaccgaaaaatcataacaggcgtgtccgtttcctctggcgtgaagttgacgattccaaagactaggaaaagggagatccggaaaaacgtctacttcatactgacaaaaggccttgtggagcatcagcggagaattggtagtaatgatcctgcctatcttaaaaggttgattggagaactgtgttattggcgatccatcgaacccgacaatacctacgtgagtgattcaataatcgcactgaagagactggaaaagcattactga

SEQ ID NO: 9314 - RNA, 1131 nt, unidentified
  source 1..1131: mol_type = other RNA; note = synthetic construct
atggatggcattctgattacaatcattgtcattacagccttcctggtttataaaatgatctcctcaagcagaaagcaagaggggtataagagatggaaagctacatcaagtggcaaggaggaaaaaaccaccaaagtaaagtgggagcacggtgcctggctgcgacatgcactgggggaaactgttccacgcgtgcagtacgtgcagaggttcgacgagtccgccgtcgtgtggtgtgccaacctgctcggcgtcgagactgctcaactaaaggagattctccgtgatgtctcggagcattaccgtgagttttggatgcggaaaaggaaaggcggctacaggatgatctctgccccggataaagaacttcagagtatacaaacgacgattaattcacggatcctgtcttctgtgacaatgattcaccctgctgccgtggggttcagatccggtcacagcgtagtagataatgcttcaccacatctcggcaagcgatgcgtgctcaagatggacattcacgacttctttttttccattaggagccggagggtcaaaaaaacctttgagaaaatcggatatccggagaatgtgtccaaggtgttgggtgttctctgttgcctgtatcggcatcttcctcagggcgctccaacctctcctgcacttagcaacatcgtcggctatgagatggacaagaagctagcggccttagcggtggaatacggattgacctatacaagatacgcagacgatctgaccttcagcggagacgtgtttcccaaggaacagataatcccacggataaagcagattattcgcgatgaaaagtttgaacccaatcacaaaaagactagcttcatcaacgagtacggtcggaagatcatcaccggggtgtccgtttcttcgggagccaaacttactatccccaaagctcgcaaaagggaaatacgtaagaatgtctacttcatcctcactaaaggactggcagaacaccagagacgaatcggaagtagcgatcccgtgtacctgaagcgcctgatcggggaattgtgctattggagatccatcgagcctgacaacgcatacgtttctgacagtataaaccgcttaaagtgtttggagaaggggtactga

SEQ ID NO: 9315 - RNA, 1131 nt, unidentified
  source 1..1131: mol_type = other RNA; note = synthetic construct
atgaataagatcctgattaccatcctgatcattacagggttcctgatatacaaaatgatctcttcttcccgacgccaggagggctacaagcgatggaaagctactgggggagggaaagaggagaaggtggacaagactaagtgggaacggggcagctggttatctcatgccatgggcgtaacaaccccagtcgccccatatacccctaggtttgagaaagaagcagtaatctggtgcgccgccctcctcggagttgaagtgaatcgcttggaggaaattctgaataacgtctcaggtcactaccaggaattttggatgcggaagagaagcggcggatacagaatgatttccgcccccgataaggatctccaagccattcagagcacgatctattcacgcatcctgagctccgtgacaatcgtgcatccggtggccgtgggattccgatgcggtaggtctgttgtcgataacgctgcgccacatcttggcaagcggtatgcgctgaaaatggacatccacgacttttttggtagtatccgtagccccagagtgagacagacctttaagaagattggttatcctgagaatgtgagtaaggtgcttggagccctatgttgtttgcacagacacctaccccaaggagcaccaacaagtccggctctgtccaacatcgtggggtatgaaatggatcgcaaattggcagcactggctgcggaatatgggctgacttacactagatacgccgacgacctcacgttcagcggggacgttttccctaaagagcagataattcctcaggtaaagaggattattagggacgaaaaattcgagcccaatcacaagaaaacccattttatgaaccagtcttcacgcaagatcatcaccggcgtctccgtcgcttcaggagttaaactcaccatacccaagtccaagaaaagggagatacgtaaaaacgtgtacttcattctcacaaaggggcttgcagagcatcaacggcggatcggcagtcacgatccagcttatctgaaacggctgataggcatgttgtgctactggcgtgccatcgagcctgataacacttacgcttcggacagcattgcagccttaaaaaggcttgagaagggctactga

SEQ ID NO: 9316 - RNA, 1134 nt, unidentified
  source 1..1134: mol_type = other RNA; note = synthetic construct
atggacggtcttctcatcaccattctgatagtcacagggttcctcgtgtataagatgattagctcctctaggaagcaggaaggctacaagaggtggaaggctacggggtctggagacacagcgaacgaagaaaccgcgggtaataaatggaagcatggagcctggctgcgacatgccctcggtgtgacgactccaaaggcccgcacctatccagtatttgatgaggaggccgtggtgtggtgcgccggacttctaggcgttgaagcggtccgcctgaaagagatcttacaggatgtttcctcacactaccgcgagttctggattcgtaagcgaaagggcgggtaccgtatgattagtgcccccgacaaagaactgaagtcaatacaggatactatctatcaccgcatcttactgcccgtaaacgtgcaccccgtagcaaccggctttcgcaggcaacactcgatcgtggataatgtcagaccccacctcggaaaaagatgtgtgctgaagactgatatccacgactttttcctgagcatacgttctccacgagttaaacaaacctttgagaacattgggtaccctaagaacatttccaaggttctgggggagttatgctgccggagacggcatctgcctcagggagcatcaacatctcctgctctgagcaatatcattgcatatgagatggataggaagctggctgctatggccgaagaattcggccttgcctacacccggtatgcagacgacttgaccttttccggcgacgtgttcccgaaagagcaggtgctcgtcagagtcaaagagataatcagagaggaaaagtttgagccgaatcatgaaaagacccgattcttgaacgaatacgaccgcaaaattatcacagggatcagcgtgagtagcggcgtgaaactaactataccaaaagcacggaaaagagagattaggaaaaacgtgtacttcatcctgacaaagggtctggctgagcaccagaggagaatcggctcacatgatcctgcctatctcaaacggttgattggcacactttgttactggaggagtatcgagcccgataatacttatgtcagcgactccatcgctgccttgaagcggctccagaagggagactga

SEQ ID NO: 9317 - RNA, 1185 nt, unidentified
  source 1..1185: mol_type = other RNA; note = synthetic construct
atgaacaccacaatttatatctctaagtactccagttcttcattcttcatccctatcgacacaatgaatggcattctgatcgcagtcttcatcgtgacgtgcctgcttgtgtacaaaattatatcctcctctaggaaacaggaaggttacaaaagatggaaagccggcaatagagacaatactgagcacactgctaacgccgggaccacacgtaagggatggtttagccagttattcgaaacttccgccccccggatctccccttggtttaaagaggaggccatctcccagtgcgccaatcttctgggagtggaggaggtaaagctcaaggagattctgaaagacgtgagtgctcactatcgagaattctggatcggcaaaaggagagggggttaccggatgatctctgcacccgacgatgagctcaagcccattcagggggctatcaaccacaggattctaagctttgtcaacgtccatccggcagctaccggatttcgctgtaaaatgagcatagcggataatgtgcggccccacttaggcaagcagtgcgtcctcaagaccgacatacacgattttttttcctctatccgaagcccaagagtgcggaacacattcgaagctatggggtaccccccagacattgccaaggttctggggaccctttgttgtctacatagatgcttacctcagggcgcgtctacatcgccagccctgtcaaacattatcagctatgagatggataagaaattgtcagccctggccgctaagtacggcctgacctatacgcggtatgctgatgatctgaccttcagcggaaatgtgttcccaggagagcagattctgtcccaagtaaaacaaatcgttcgcgaggaaaagtttgaactcaaccataagaagacaaggttcttgaaggagcatagtcgtaagataattaccggtgtttcgatatcttcaggagtgaagctcactattccgaaagcacgcaaaagggaaatccgcaagaacgtccactatattctgactaaaggcttggcagaacaccaaaggcgaatcgggagccatgaccctgcgtaccttaagagactgattggcacgctgtgttactggcgcagtatcgagcctgacaatgcctacgtgagtgattcaataactgcactcaagagcttggaaaaaaaatattga

SEQ ID NO: 9318 - RNA, 1122 nt, unidentified
  source 1..1122: mol_type = other RNA; note = synthetic construct
atgaatggcattttgatcgctgttctgattgtaaccggactgctaatttacaagataatctcatcctcccggaaacaggaggggtataagaggtggaaggcaggaaatcgatctaacactgaggacacaactgatactgaaaccacacgtaaaggatggttcagccggtattttggcaccagtgcgctcatcacaattccgtggttcgatgaggaagctgtggtgaagtgtgcaaatttgctgggcgtggaggaggctgttctgaaagagatcttaaaggatataccgggccattaccgggagttttggataggcaaaagaaagggcggttataggatgatctctgcccctgacaaggatctgaaggccattcaagatacgataaatcacagagtcctcagcttcgtcaacttgcaccccgccgctacggggttccgatgtaaaatgtctatctctgataacgtgcggccacacctcggcaagccctatgtgcttaaaacagacattcatgacttctttgggagcattcgcgggctcagggtgcgcaaaatgttcgaaaacatgggctatccacccaaaattgcgcgtgtacttgcggccctgtgctgcgtcaggcgatgtcttccccaaggtgcttcgactagccctgccctgtcaaatatcatcagctacgagatggacaaaaagctcgccgccttagcaaccgagtataacttagtgtacactcggtacgcagacgacctgacatttagcggtgacgtgtttccagcccagcagatcctgcctctcatcaaacagatcattcgcgaagagaagtttgaaatcaaccataagaagaccagattcctctcagggcacaagagaaaaatcatcaccggtgtctccattagttcaggggttaagttgaccatcccaaaagctaaaaaacgggaaatacgcaagaacgtgcacttcatcctgacaaagggacttgccgaacaccagcgcaggattggatcccatgatcctgcatacctgaagaggctgatcggaatactatgctattggagaagtattgagcccgacaatgcatacgtcagtgattccattgccgctctgaagggcctggaaaaagagtactga

SEQ ID NO: 9319 - RNA, 1116 nt, unidentified
  source 1..1116: mol_type = other RNA; note = synthetic construct
atggagctgttgttctgtatagtgactgttatcaccgctcttctggtcttcattatcatccggagtagtaaatctcaggagggctataagcggtggaaagccgggaactacgtgtctgacaccccttatgcaaaggaaaaaaagacaagcgccttgtttcctagatctttgttcggaaaagatgccaatttcttcggagccaaaaggtttaaagctgaagctgtttcatggtgcgccaatctcctggcagtcgaggaggacgctctcagggaggtcctggactatgtgcctcgccaatataagctgttttacattcggaagcgctccggcgggttccgtgcaattactgctccagaagataagttaagagtgatgcagcagaccatctaccaacggatcctgctgcttgcccacgttcacccagcggtaaccgggttctgcccaggcaaatccgtagcagataatgctcaggcacatctcggcagaaagaacgtgctcaaggtggacattcacgatttttttccttcgatcagaagccccaaagtccgcgcagctttccgggagatgggttattccggaccgattgccaaggtgctgggagagttatgttgctgctacaagtgtttgccacagggagcaccaacatcccccgccctgagtaatataattgcgtatccgatggacaaaaagatgatggctcttgccgacgagtacgggctagtgtacaccaggtatgccgatgacttaacattcagcggcgactacctgcccaaagacgaggtgctggcgcgtatccatggcatagtaagggaagaagggtttacgattaatgccaaaaagacacgctttctgtcagagtacaaaagaaagatcatcactggggtgtccgtcagctcaggcgaaaaaatgacgatacccaaggtgaagaagagggagattcgaaagaacgtccactacgtgctaaccaagggactcgttggtcaccaggaacatattggtagcacagatcccgtctacctgaagcgactgttgggcaacctctgttactggcgatctatcgaacctgataacaggtatgttagcgatagtatcactgcccttaaacgcctcatgtga

SEQ ID NO: 9320 - RNA, 1116 nt, unidentified
  source 1..1116: mol_type = other RNA; note = synthetic construct
atggaactactcctcgccatcgttatagtggtaacaggctggctggtgttcagtattatccgaagcagtaagggccaagagggttataaacgttggaaagccggtaactacgcaggcgagaatccttatgctaaggagaaaaaggagtccgttagcagcctcaaaaacatattcggcagaaaggccgtagcctttgggtccaagagattcgatgcgggcgctgtgtcttggtgcgccagtctgcttggcgtgaaggaagacacactccgggaagtgttggactatgtacctaggcagtacacgcagttttatattaagaagcggtcagggggtgtgcgcattatcaccgctccacaggggcaactccgtgtaatgcagcagaccatttaccaaagggtcctgttactggccaatgttcatccagccgtgaccggattctgccccgggaaatcagtgtctgataacgcgcgcgtccacctgggaagaaaaaatgtgctgaaggtggatttgcacgacttctttccgagcattcggtcgccgaaagtgcgggcgacctttcgcgaaatgggctacagtagacctatagccaaggtcctagccgagttatgttgttgcaatcgctgtctgccccagggagctccaacttctccagctttgtccaatattatcgcatatcctatggataagaagatgatggcattagcagacgagtacggactggtctacactcggtacgcagacgatcttactttctccggggacttcctgccaaaggataaggttctgtcgaggatcgatcaggttattcgagaggaaggatttactatgaacgtgaaaaagactcgctttctgcccgagcataagagaaaaattatcacaggcgtcagcgtgtcctctggcacaaagatgaccatccctaagacgaaaaaaagggaaatcaggaaaaatgtgcactacgtcttgaccaaaggtctggcttctcatcaggagcacatagggtccacagaccccgtctacctgaaaaggcttctcggaaacctgtgctattggagaagcatcgaacccgacaaccgatatgtttcagacagcatcgccgctcttaagtcactcatgtga

SEQ ID NO: 9321 - RNA, 1113 nt, unidentified
  source 1..1113: mol_type = other RNA; note = synthetic construct
atggaactgcttctcgggatagtgattgtggtgacatgctggatggtggtcaggatcatccgcagctcaaaaaatcaagaaggctacaagagatggcgggctggtaactacgcctctgaaaacccatatgcgaaggagaaagcatccggtcccctctcgcagggatttttttccaaacgcatcaggacatcaggggctaggcgctttgatgacggcgccatcaggtggtgtgctaacctgctggcgacggaggaaagtcgcctacgagaggtcctcgattatatcccaaggcagtacacatgtttccatgtgcgaaaaaggtccggtggcttccgctacatctctgcccctgccggggacttccgaagcatgcagcagaccatttaccataggatcctgttactggccaatattcaccccgcagtaaccggcttctgcccaggcaagtccgttagcgacaatgcacgtgtccacttaggcagaaagaacgtgctgaaagtagatttgcacgactttttccccagtattcgctcaccaagagtaagagctgcctttcgggagatgggatactccagaccgatagctaaagtgctggccgaactgtgctgtctgagatgctgtctgcctcaaggggcccctacctctccagccctttctaacatcatcgcttaccctatggacaaaaagatgatggcgttagccggcgaatacggtcttgtgtatactagatatgcagatgatttgactttcagtggggactatctccctaaagacgaggtgctcgttagaattcatcgtataattcgcgaagagggatttaccatgaatgttaagaagacccggttcctgtccgagcataagcgtaagattattactggcgtcagcgttagcagtggaaagaagatgaccctgcccaaggttaagaagcgggagatacggaaaaacgtgcactacgtcttgactaagggactggtggggcaccaggagcacatcggcagcacggatccggtctatctaaaacgactcttgggaagcctctgctattggaggtcaatcgagcccgataatcggtacgtgtctgactcaattacagcactgaaacggcttatgtga

SEQ ID NO: 9322 - RNA, 1080 nt, unidentified
  source 1..1080: mol_type = other RNA; note = synthetic construct
atgactgtaatcctcgttactatcctgatcttcatttgtggcatgatcctcctgataatcagagagaagaagaaagagaaagacctgctgaatcggcacttgcctaatgacaactcgtttagaaatggcagtgtgttttatcatactggtatttgtaggcaggcagtgtatgacccggaagccttgaagtggtgcgccaccttcctgaacattggcgaaaaggaactatcatccttcctgcatcaccctagcgagtggtacagcctgttctggctggctaagcgaggagggggctaccgaatgatagccgcgcccaagaaggagcttaaagctgtgcatcggaccatctacgagaagatactgatcaattctgagatccaccccagtgccactggctttcgcaggaataaatccattgtggagaacgtgaggcctcacctagggaacgcccaagttcttaaggttgacattcatgacttctttggttccatccgcaaacacacggttcgtcgtacattcaagcagcttggatacgaatctggtgtagctaaaatcctggcagccctgtgctgcaaatccggacgcctgccacaaggggcccctacaagtccagcattgtctaatattatcgtcgcaggaatggatgaacagctcgcggctataagcagaagcgtcgggttgacttatacacggtacgctgatgacttgaccttttcagggaatctctccagtcatcatgcctttttagcgcaggtggaaaaggtcgtcgcagagcacaaattcgccttaaacagaaaaaagacacgcttccttgatatgtcacaccggaagatcattacagggatttccgtgagcagcggtaccaagcttaccatcccaaaggtgtttaggcgggagattcgaaagcaggtctatcacgtgctgaccaaaggcctggctgaacaccagaaatatattggctcttcagatcccgcatacctcaaaaggctcataggaagattaagctactggcatgccgtagagcccgataacacgtatgtgatccgctctctaaaagctctcaaggaactgaaccactga

SEQ ID NO: 9323 - RNA, 1167 nt, unidentified
  source 1..1167: mol_type = other RNA; note = synthetic construct
atgaacatcaacattgtaatcctgattatcgtcttaggactgtggttgttgtacaagttgttttcctcagggcgtaaggacgattataacaggaatacttcctcatacaatcgcaatgctgataactacgacaagggggaagagaagaagaagaaccataggaagttcatcttcagtttcctgcagagagaaaaaaataagacagaggtgaaagcgaaaagacaaggttttctgaccagaattttctcgactcccctcccttttgacgatgcagcgatcacctggtgtgctaacttcctgatcgtcgagaagaaaacactgatcgagatcctgaaggatacctcagatcactatacacacttcaaactgggaaaacggagtggcgggtatcgcacgattagcgccccaaataagactctgctcaacattcagcgcgtgatctacaaaaggattctgctatctgtcaacttgaatcctgcctccatgggttttcgacagaacatttccgtggctcataatgccaaagcccacctcggaaataagcagattctcaaagtagacatcgttgacttttttggctccattaaaaagcaaaggataattgagacgttcgggaaaattggctatccctctaatatcagcgaggtgctggcagaactctgcaccctcgagggcaagttaccccagggtgctgccaccagcccgactttatctaacattgtggcccatgaaatggacgtcaagcttgtgagcatcgcccagaaaaataatcttacctacacacgctatgcagacgaccttacgtttagcggagagaatatctttttcgagctgatatttagtgagatcaacaacatagtccgggaaggcaagtttatcatacagcgtaagaagaccaggttcctaaccgagaaaagacggaaaatagttacaggtatatcagtgagttccggcaaaaaacttatgatcccaaaagccaagaaacgagaaatccggaagaatgttcactacattcttactaagggcctggctgaacaccaacggttcattgggagcactgatccttcttacatgaaaagactcatgggatacttgaacttctggctgatggtggagccagataacgaatatgtgaagaagtctataacagcactgaagaagatctga

SEQ ID NO: 9324 - RNA, 1167 nt, unidentified
  source 1..1167: mol_type = other RNA; note = synthetic construct
atgaacaccattcttgttatcctcatcatcgctctcgggttatggctgctttataagctatttaactctggaggcaaagatgattataacaggaacacatccggctataacaggaacgccgacaattacgatagaggagaaacgaagaaggagaataacaaaaagtcaatcttctctttcctgcacaaaaagaaaagcaacacagaaaaaaaggctaaaaggcagagcatcttcgctcgtatattctccgagcccttgccttttgacgatggcgcaataacatggtgtgccaattttctgatcatcgacaagaataccctcattgggattctaaaagacactagcgatcattattcccattttaagctggggaagcgatcaggcggctacagaaccatttccgcccctgatgctactctgctgaatgttcagaagatcatctacaagcgcattctgctctcagtgaacgtccacccagccagcatgggtttccgtcagaatattagcgttacgcacaacgcgaaaacccatttaggtaataagcagatcttgaaggcagacatcacggatttcttcgggtcaattaagaagcaccgcatcattaaagcttttaggagaatcggatatccggccaatatcagtcaagtgctggccgagttgtgcacattggagaacaaattaccccagggtgcggtcactagtcctaccctttcgaatattatagcctacgacatggacatgaaactggcttccgtcgcagaaaaatctaatctgacttacacccgatacgcagatgaccttactttcagtggcgagaacatcagttttgaactgaccctgtccgagatagacaggattattcgcgaggagaaatttgtgctgcagcggaagaagacaagattcctcacagaaaagaagagaaagatcgtaacaggcataagcgtctcttctggagagaaactgatgataccaaaggcaaaaaagcgggaagtgcgcaaaaacgtacattatattctcaccaaggggctggccgaacaccaacggtttattagttccactgacccatcttacatgaaacggctaatgggatatttgaatttctggctcatggtggaacccgataatgagtacgtgaaaaaaagcatcgcggcccttaagaaggtgtga

SEQ ID NO: 9325 - RNA, 1083 nt, unidentified
  source 1..1083: mol_type = other RNA; note = synthetic construct
atgaatattatccttgtggtcttctttatcgtactgatgctctggttgctgtttcggttgttaaacttcgatggaaacaacgtggatgtggagaagaaagaaaacggctccgtgttaaaagctaaaaagcagtctttcctcgcccggattttcagcaagcccctcccttatgatgacgaagctataacttggtgcgctaatttcctaatcatagacaagaataccctgatctccattttgagaaatacttctgcgtattactcacatttcaaactggcgaaacgtagtggcggctacagaaccatcagtgcacctaatgaagccatgttgaacatccaaaggatcatctataagagaacactgctgactgtcaacattcatccagcctcaatggggttccgcaagaatttttccgtgactcacaatgcaaaggctcacctcggcaataaccacattttgaaggtggatctctttgacttctttggctcaatcaagaaggacagagttatcaagacatttgagaagatcgggtatcctgtgaacattagccaggtcctcgccgagctatgtactctgggaggaaaattaccacagggcgcccccacaagcccgactcttagcaacattatcgcatttaacatggacatagaacttgcttcaatcgcacagaagaattctctgaggtacacacgctacgccgacgatcttaccttttcgggaacggatatagccttcgagcccctgctgacagacatcgatgtaattattcggaaggagaactttatcattcagaggaaaaagacacgtttcctgaccgaaaagaaacgaaaaatagtgaccggggtcagcattagttccgggcagaaaatgaccattcctcgggccaagcgacgcgagataagaaaaaatatgcactacatcctgaccaagggtctggtcgagcatcagcgcttccggggttctacggacccagtttatctacaaaggctgatgggttacctgaacttttggcttatggttgagcccgagaatgaatacgtgaagaggtccatcgcagctctcaaaaaactcaaaattacctga

SEQ ID NO: 9326 - RNA, 1146 nt, unidentified
  source 1..1146: mol_type = other RNA; note = synthetic construct
atgaacaccacactgattatcctgctaatttgcttagggctctggctcctttataaagttctgaattacagaggtggggatgtcgacaattataaccgaaatattgactcctacgacaaaggagagaaaaacaaatctaagtccaggatcttctcttccaggaagtctgactccgacttcagcagtaatcctgccaaaaagcagggcttctttgcccggttattcagtgtccagctgccatttgatgacgaggcaataacctggtgtgcaaactttctgatcattgaaaaggacgtcttgatcggaatccttcggaatacgtcacagcattactcgcactttcgaatcagcaagcgctcaggtggtgtgcggatcatttctgcgcctagccccgccctcatgagcttgcagaagaccatctacaagagaattttggtatccgtgaatattcacccagcggccactgggtttaggtccaatacaagtatcgtacagaatgccaaagctcatcttggaaaaagccagatccttaaggtggacatcaccaacttcttcgggtcaatcaaaaagaggaaggtcataaaagtctttgagaacataggatatccccccaacatatcacaggtgctggctgaactgtgcaccctggacaacaaattaccgcagggggctccaacttcccctgtgctgagcaacatcattgcctcggacgttgatgtgaagcttgctgccctgagccaaaagaaagagctctcatatactagatacgcagatgatttgaccttcagtggctctaacattgatttcgaaacaacgctagccgaaattgacgaaattctgtttaaggagcggttcatcatccaaagaaagaaaaccaggcatataactgagaaacgccgcaaaattgttacaggaatcagtatctcttccggcgagaagatgacaattcctaagagcaccaaacgcgagctcagaaagaacgtgtactttatacagactaagggcctggctgagcaccaacgtttcattggctctactgatcccacatatttgaagcgtatcataggccaactgtcattctggcacatggtggaaccagataatgattttgtgaagaagagcctcagtgcactcaaaaagctgtga

SEQ ID NO: 9327 - RNA, 1173 nt, unidentified
  source 1..1173: mol_type = other RNA; note = synthetic construct
atgaatattgctctcgtgattttgatcattttcctggtcctgtggatcttttacaagctcctgaattactccggaggagacgaatactctagggatacacgtaactacaacaggaaccctgataactatgacaagggtgaagaggtaaaaacaaccccgaaaaaaagcattttctcagtgttttccagggagaaaaaagttaaacaggcaaagaggcagagctttttcgagcggatctttagcgctcccctgccattcgatgacgccgcgattacttggtgtgccaatttcctggctgtcgagaagaatgaactcattgacattcttaagaacacgagtatccagtactcacacttcaagctaggtaaacgttctggcgggtgccggaccatcagtgcaccaaacaacgtactcctgaatatccaaaagaccatctacaagcgcatactgttgtccgtttccatacacagcgctgccactgggttcagacaaaatgtgtcggtgatccataatgcgaaggtccatctggggaagacgcaaatcattaaagtcgatcttgctgacttctttgggagtataaagaaaccccggatcattacagcctttgagaagattggataccccagtaacatcagtaaagtgctggcagaactttgcagccttgacggcaaactgccacagggggcggcaacttcccctacactctctaacataatcgcttatgacatggatgtgaaacttatagccttggcccgaaaacataatttaacatactcgcgctatgccgacgatttgactttcagcggcgaggatatcgcatttgagctgttcttgtccgaaatcgatggtattgtgcgggaggaaaagtttgtgatccagagaaagaaaacccgctttctcaccgagaataagaagaagataatcaccggagtttctgtctcctcaggcgagaagctgaccatccctaaaagcaagaaacgagagataagaaagaacgtgcactatattctcacaaaaggtctagccggccaccagaagtttattggatcaactgaccctagctatctgaagagaattgtaggctatctaaacttctggttaatggttgaacccgactccgaatatgtgaagaagtcattaatcgccctgtctaagctgcagggcaaatcttga

SEQ ID NO: 9328 - RNA, 1164 nt, unidentified
  source 1..1164: mol_type = other RNA; note = synthetic construct
atgaacatcctgttgggcattctggccatcgcactgctgtatctcctgtacaagttgttctataagaagcgcggagacgagtattcacgcgatacatctgggtacgaccgcgggaccaattcgaacgagaaggaagagaggcctaaagaccagccaaaaaagtccgtcttcagtttttttggccggaagaatattgaaaaaccgcaaatcgccaagcgtcaggggttgatagccaggctgttcctggccccattgccctttgacgataaagccattacgtggtgcgccaatttccttgtgattgagaagaacatcctgatcgatatacttagggacacctctaaatattactctagattcaggctgggaaagcggagcggaggttttagagagatatcagcccccgtcacagctctgctgaatatccagaagaccatttacaagagaacactactctccgcaaacgtacatactagttgtaccggcttccgacaaaacgtgtccgttgttgacaacgcgaaaccgcacctcgggaagccccacgtcctcaaagtggacatcgtggattttttcggtagcattaagaagagccggataatcaaagtgtttgagtcctttggctacccaagtaatatatcacaagtactggccgagctgtgcagctttgaaggcaaacttcctcagggcgctgcgactagcccagcactgtcaaatattgtggcatatgatatggacgtgaagcttatgagtatcgctcagaagcacaacttcacgtacacacgctacgctgatgatttaacattctctggcgagaatattctattcgaggaagtcttatctgaagtgaacaatatcgtgaaggatgaaaaattcgtgatccagagaaagaagaccagattcctgactgagaaaaaaaggaagattgtaaccggtatcagcatctcatccgggaagaaactcatgatccctaaaagtaagaagcgagaagtgcggaaaaacgtccattatatcctcactaaaggactcaccgaccatcagcgttttattggtagcactgacccttcttatttgaaacggctgctcggatacctaaacttttggttaatggttgaacccgacaatgattacgttaagaaatccattgcttccctgaaaaagctttga

SEQ ID NO: 9329 - RNA, 1083 nt, unidentified
  source 1..1083: mol_type = other RNA; note = synthetic construct
atggacatcctcatatacttcgccattgccatcattatcatttgggcaatcttcaaattgctgaattacgacaattcagccgaaaaagacaagacaagaatcaacaacaaacctcagagtccagggctgtggcagcggattacagcccctcacgtgccatacgataaccaaagtttaagctggtgctctaaattgctggcggtggatgttgttgaactcaagaaaatcctggcctacagggacattcactataaatctttccgcattggaaaacggtctgggggctatcgcactatcagcgcaccaaacgagcagttactgaacattcagaaaaccatctacaaccgcatcctgcttcccgtgggtctgcatccagcagcaactggatttaggaaggacacctcaatcaaagataatgctaagccccatctcggcaagcgactggttctaaaaatggatatcgtcgacttcttcggctccatccatgagtatagagtacgaaaaatcttccaggctattggataccccgtcaatgtctctgacgtgttggctgccctctgctgtctcagacagcgtctcccgcaaggtgcacccacaagccctgccctgagcaatatagctgcccttgagatggataagaaattggccgctctggctaccaagtataaccttacctacagcaggtatgcggacgacatgacctttagtggtgatgagtttgagaaggacaagctgataaaaatagtgaccaaggccgtgcaatcggaaaactttgcagtaaagaggtccaagacgcgctatatgggagaaaagcagcggaagattgtcactgggatttccattagctcaggcgagaagatgactatacccaaatcaaaaaagagacaggtccgacagcaagtgcactatattctgacgagggggcttgatgcccaccagcgtcacatcggcaataatgatcctgcttacctaaagcggctcgtgggctacctgaatttttggttatccgtggaaccggagaaccggtacgtgagaaactccatcaaggctctggcgaagataaagacagtagggatcgtttga

SEQ ID NO: 9330 - RNA, 1164 nt, unidentified
  source 1..1164: mol_type = other RNA; note = synthetic construct
atgacaggtcttgtcatcatcagcgtcgctgtaattatcatttggctgatctacaagtacagtcgcaaagaagatgactattctaggaccacggaccactacaatcggaacccgaaggggtataacaaagagattaatacgtctccttcttatgccaataatcgtaaacactctacaccccctcccaaggtggagaagaaggggatattctcacagctgttcgagagaaagccaagcctgcccttcgatgataaggctataacctggtgtgccaacttcttatcagtggacgaaaacgcgctgcggttaattctcgcctaccagagtaactattacaagaaattcctattgggcaagaggagcgggggttacaggacaataagtgcaccacaggaaccactgataagcattcagcgcaccatctacaggcggatcctggctcctgttaatatccatccagcagctaccgggtttcggcataagaaatcagtcgcggataatgcccgcccccacctcggaaaagactacatgctcaaagttgacatcatcgatttttttggctcgattaaacgtgacactatacgcaagacatttcagaagatcggttatcccctaaatattgcagaagtgctcactttcctgtgctgcttgcgaggccaactccctcaaggagcccccacttcccctgccctttccaacattgtggcctatgagatggatcagcagctgtatgccttggcaacagaaaataacctgacctacaccagatacgcagacgatattactttatccggaaactccttggccaaagatgagatcctgcccgctattcagagaattgtgggcgaagctcgatttaggataaagcacaagaagacccggtatatgaccccaaacagaagaaagatcatcacaggcatcagcgtgagctcaggcgaaaagctgaccatcccgaaaacaactaaacgtgagattcggaaaaacgttcatttcatcacgactcgcggactcaatcgccaccagcaacacattaaatcccaagacccttcctatctgaaacgactgatagggcagctctgtttttggcatagtattgagccacagaacgagtacgtgcagaagtctcttgacgtacttaagaagatcgagaaaaggatcagatga

SEQ ID NO: 9331 - RNA, 1092 nt, unidentified
  source 1..1092: mol_type = other RNA; note = synthetic construct
atgactactaccctcctcacaacactggctattctctttgggatcctcatgctggtgttgacccttagggaaaagcagagggagcggaggaaactttccggttccacacctgacgcgccctacagacaacagccaccacccgccaaccccccatctacagatcgagatccattgaatgacatatatggagcagatgcgattgctcggtgcgcggcccaactgtgcactactgagggcgagctcagggacgtactacgcgacatcagatgggctggctatactacattctggatggccaaacgccggggtgggtaccgcaatatcgaagccccaaatccgcaccttaaagccattcagagagcaattctggacagacttttgacccctctacccgtgcataccgccgctacgggctttaggcctgggttgagcatcgcagataatgcaaggccgcatctgggccgacgacgtgctctaaagactgatctgcatgatttcttcggatccattcgcagacccgcaatccgccgggtctttagggatatgggctttgatgcacacatcaccaaagtcctggttgacctgtgctcacaccggaacagattacctcaaggagccccgactagccccgccttatccaacttggtcgcagccaagatggacgaaagacttaccgctctgtcactccgccgcggcttaacgtacaccaggtatgctgacgacctgacattttcgggcgacagtttcaatagaaatgagttgattgcggacatcaagcacattgccgcctgtgatggtttcaccctcaacgcaaaaaagacgaggctcatggcttctagccgccgaatagtgaccggactgtcaataggaagtggtgagaagctgacactgccccgtgaacggaaacgagagatacggaagaacgtgcatttcgtactgaagtacggggtgaccgagcacagagagcggatccattctagcgatcctgcctatgtgaagcggctcatcggggaactttgtttctggcgtagtatcgaacctgagcacccatttgttaaccgtgctctgagacagctgcgcgccctgaggtga

SEQ ID NO: 9332 - RNA, 1032 nt, unidentified
  source 1..1032: mol_type = other RNA; note = synthetic construct
atgaaggagcattatcagatttggctaaaggccatcgaagagtccaatactatgagcgagaacgacaagaacgcattctcaaaagtggtaattgctctctccaaatctggcgccccagtgattttcaatgtcaagcacctggctctcctgattggcgtcgatttccgggccctaaaacggatgttatatgtcagagacaggttttaccgctctttcagcataaagaaacgcaatgggggtgagcggctgatcgaggcaccttaccctagcttaaagatggttcagcgatggatactggacaacatccttgttcccagtgcgttcgtacatccctgctcggtggggtttattagcaagaaaaccatcacagataacgcccggccacacctgggacattcagtgctcctgaagatggatatcaaggattttttccccagcgtaaccgaagagttagtgagatcctacttctccaacctcgggtaccgcagcgatcttgcctccacgctggcctatctgtgttgcaaagacggacgccttccccagggaagtcctacttcaccaatgctcagtaacgtcctgttttatgagatggacaatcaactctctaagattgctttctgggacggtctttcttataccagatacgctgacgacctggccttttcaggggatagaatacggatctccatcatcgataacgtggctgccatagtccttaagtacggcctccgaatcaataatgagaagacaaggcgctccggcagcacctctagaaaaattattactggcgtttccgtgtcttcaggagaaaagttgacaattcctcgtgaagttaaacgagtcatcaggcaaaaagtgttttacgtgctcaaatacggcttgacagaccacctgaagcacatccagtcgcgtgatttgctggcaggctacaggctgctggggctgctagcgtattggcacagtgtggagccggaaaataaatatgtgttggacagtagcaaggcactgggagaaatgttgaggggtgaatga

SEQ ID NO: 9333 - RNA, 1068 nt, unidentified
  source 1..1068: mol_type = other RNA; note = synthetic construct
atggtatggaaactgctgaagagtcttttttctacgtctttccataaggaagatgtgccagacgttcacgccgacacccaggtgcagaacaacaaaatcaactctaagtcactgaggccttctgtcgaatatctccttactaaagacctaggtcacctgtgtgaacttctcgagatcgataataaaacccagttagccccaattctactgcaccccgaggagtactaccgaacatttcgtattcccaaacgcaatggcaaaagtcgattgatttccgctcccttcacgccactgtacaggatccagaagaagatttacgagaagatcttgatccatgcccgggtccacagcgctgcaaaagggttttgcataaataccagcattgtgcataacgcaaaggagcacttacacgcaaaggatctgctgaaagtagacattaggaatttcttccctagcattcatcagagtcgcgtggtggctatattccggaatctcgggtatgagtacactttggcttatcagctcgcgtatctgtgctgtctgaatggaaagctcccacaagggtcccctacatcccctgccctgtctaacctagctctgttaagattggatagtaaactttcggagatagccggcaacagacagctcatttatacacgttacgccgacgatctcagcttctccggtaatatccttagcaagaacgaacttctcgctgagatctcaaaaaccgttcaggaggaaaagtttatcctgaacaagaagaagaccagatttatcaccggagcaaaaaggaagatcattactggcatctcgatttcaagcggaaagctgacaattcccaagtccaaaaagagagagatccgcaaagtgatctactatataaagactcgcggcatagccaagcatttgttgcacattaattccaaagatgcagaagactggtacctggagaaaatcctcggctatctgtcattttggcgggccgtcgaaccggaaaacgcgtacgttttacagtctgtgaagtatatccaaagcctgcggaaacaactgctgtacaaaaagtga

SEQ ID NO: 9334 - RNA, 1026 nt, unidentified
  source 1..1026: mol_type = other RNA; note = synthetic construct
atgaatgagcagcaaaataatatagagatctggtaccacgagatagataaggcaaatgatttaacaagcaggcagaattcctatgccaaaaagtatgtggccacacttttgaagaataatgcggtagttatcttcgatttgtatcatttggcctgcctgatcggcatcaagtaccacatactactgaagatgtctcatagcagtaagcacttttactacgacttcaccattaaaaagagaaacggcgacgaccgtgttatatcagctccatttccgagcctgaaatacacccagaagtggatttaccaaaacatcctggcaaaagcccccatttccccgcatgccaaagggttcgtgccaaatctgagcctcctgaataacgctgaaccccaccttcatcaaaacgccatattacagatggacattgccaacttttttccatcgatcagctggaagagggtctataacgtgttcaagaacatcggttataataaccggatctccgccgctctcacaaatctatgctgtaaacacaacagtctgcctcagggagctccaactagtcctatactcagcaacattatcctgtcgaagctcgacaaacgcctttccaaactcgcagagaaacactcccttacttatactagatacgctgatgacattacattctctgggtatattatccccaatgagctgatcaacatcataagctacatcattgaagatgaaggatttattgtgaacaacaacaagacgagaattgcgcgcggaaacaagaagaaaatcgtcaccgggatttctgtgaattctgaatacctgaccatccctaggaaaaagaagcgggagatccggcaggcaatttactatatcaaaaccaaaggcctctcctctcatatggagaatatcaataacagtgaccctatttacatctatcgattattgggttacctgaatttttggaagttcattgagcccgaaaactcatatgtcatcgattcaatccgcattattaagtcacagctgtga

SEQ ID NO: 9335 - RNA, 1077 nt, unidentified
  source 1..1077: mol_type = other RNA; note = synthetic construct
atgtcatatgacagcgaggagaacattgaacagaagctgaaaattatccgaaagtacagcaaacagaaaaatcactacgaatcgctcctgaaggatatctcaatcatggaacagaaaggatccatcctgattatcaataacaagcacctggctgacctcgtgggtatttccttcgacgggatcttgaagatcattaacagcagtcaaagcttttattacagcttctctatccccaaaaagaatggcgggtatagagtgatctcaatgcccttcccctcactgatgaaagttcaacgttggatatacgaaaatgtcttgttgaagcaccagattcataaggtagccaagggcttcgtgaaagagttatctatcaaggataatgcatctgaacacttgggatccaaggagcttctcaagatggacatccaggacttttttcctagtattagcaaaaagcgcattatctccatattcaaacgcctgggctacaacaataaagtttcttattcgctggccagcatctgttgcctcaaccagtgccttcctcagggagcaccaacatcccccaccctgagcaacatcatagcctacaagttagataatcggatccagggcttagcgaataaattcaacattatctacaccaggtacgcagatgatctgacatttagtggtgatacattccctccgtttttttattccactatacagagaatcctcctggaagagggcttcaacgtcaataaggacaagaccagactaattaaagaaggtcgccagaagattgtgactgggatatctatcagttccgacaaaatgaccatcccaaaaattaaaaagcgggagatcaggcatgctgtctatttcattctcaagcgagggctatttgctcaccaacaagccattggaaactatgacccaatatacatcgataggattattggctaccttcatttctggcagttcgtagagcctgagaatgagtttgtgcggaaaagtattatcgagataaagacgaaccttgcctcactggaagaggagtttaaggtgtatatagactctaacctgaagtactga

SEQ ID NO: 9336 - RNA, 1071 nt, unidentified
  source 1..1071: mol_type = other RNA; note = synthetic construct
atgtacgaggccctcaacaactgggatctgtacttagacagtaagataaaggacgcaaaagttagatctgtgttaaagaagtacgttaagaacttgctgtcaaataacaccgtgatcattttcgagttcaatcacctgagtaagctcctgggcatagaaaaatcctacctcagccgactggtcttcggcactcactatttttaccagagctttaccattcccaagtctaatggggaggaaagactgatcaacgcccccaaggatattctgctggacattcagcggtggatttactataacatcttgaagggtatttccctcaatgacaattgcgtcgggtatagagagggatattccattcgcaacaatgtcgaaaagcatctgaataaagagtacctattgaagctagacctgaaggactttttccctagcatcaatattgagagggtaatcgctgtgtttaaaaatctgggctatactccatccatttcttacattctcgcttctatctgtacacttgatggatacctgcctcagggctcgcccacaagcccatgtctttctaatattattgccaaaaggcttgatgcgaggatcaatggtctgtgcaagaaattcgacctggactatagcagatatgccgatgatattacgatttcagggaataagttgccaaaaaagatgatctcctacatagagaacatcatagtggacgaaggttttgaaatcaacctaaacaaaaagcggctgctgtacaaaaacaaccaacgtatcattaccggcgtgtcaatctccagcgggtaccttaccatccctaaaaaaaagaaacgcgagttacgacaaatcatgttctatattgagtgctatggactgagtaaccatttgtttaaaaaggggctcaacgatcctatctatctcgaacgcataataggctacctttacttttggaaattcctcgagcccaacaacaaggatatcatcaggtatttcagtatcatcaagaaggagatgatcaaacagaatgaatacttcacagactttcggatcccgaatttcgaatttataggatga

SEQ ID NO: 9337 - RNA, 915 nt, unidentified
  source 1..915: mol_type = other RNA; note = synthetic construct
atgaaccaggatctagattattggttcttctttatcgacaagagcttcagaaagatcaaggtgcggaaggccctgaaaatatacgtggagaaaattctgagcaccaacagtccaatcattttcgaattcaaccatctttccctcctgttgggcatagagaaggattatctcgccaagatcgcaaacaaaagcgctctcttttatcacgagtttcacatccctaaaagaaatggggaactgaggatcattaacagtcccaatacaatccttctgggcattcagaggtggatttatcagaatatcctgagccatattcagctgcacgagtcttgcacaggatttcgcaaagactacaacattaagcataacgcgagcaaacacttaaactctaacgtaatcctgaaaatggaccttaaagacttttttccctcaattaacaagcgacgcgtcatttcagtctttaagaacatcggttatacccggaatatttcgtacaccttggcatcattatgttgtaaggacgactctctaccacaaggtgccccgacttctcctttcctgagtaatatcatagctaaacgcctcgaccggaggttgaatgctctgtgccagaagttcaatttgaattacacaagatacgccgatgatctgaccatctccggagatacgatatccaagaagcttataagctatatctccgatatcattaacgacgaggggtttatcgtgaatcaggataaaactaggctcctctacaaaaataatcgtaagatcatcactggaatcagtatttcctctgacaaactgacaattcccaagaaacgtaagcgggaaattcgacactcaatttacttcatcaagaagtacggcatattcgaacatgttaacagacaacagaaagtggacataatctga

SEQ ID NO: 9338 - RNA, 1074 nt, unidentified
  source 1..1074: mol_type = other RNA; note = synthetic construct
atggaaaccgccaaatacaaccttaatatccagagactgatagaagataccttccggggagagaaaaccctcaatgccttgaatatatactccaagggcctgattaacaagaatcttcctatcatcctctctaaggaccacctcgctagcttgctaggccacccattaaatctgatcaacaacgtaatctactcaccagaatctttctatcggtccttctatatccctaaaaagaacaataacggtaagcgagtaatccacgcccccaaggggatccttctggacctgcagcagaagatttacgagtacatactcagtgctatacctgttcacgaaaaagcgacgggctacgtcgcaaacaagactataaaagataacgctattccacatctgaataccaatgaaatcctcaaggtggacctgaaagactttttcccctccattaactttaaccgagtgatcaatgtctttctgaaagccggctacactagggatattagtttcagcctcgcacgcatctgcacattgcataattcgctacctcaaggtgccccaaccagcccgatcctaagtaacctcatcattaagcgtttagatattcgccttgagaagctctctaaaaaactgaagctgaactatacaaggtatgctgacgacctgacatttagcggagattccattaccatttcattccttcattacgtgaagagcattattaattccgagggatttaaggtcaataagaagaaattgcggatcctgcgcaagtctcacaagaaagtgatcactgggattagtattacgaacaacgaactgaaagtgcccagggagaaaaagagaatagtgaggcaggccgtttactttattaagaaacacgggttccttaatcacttggagcatatagacagattcgaccccatcatgctggaaaagctcctgggctatgcgtattattggaaattcattgaggatagcgagtcctctaagtcaatcatctctgttctgaagctggagatcgcaaaattgaactccagcacatcaaatttacatactcacctggagtttgtgaaatga

SEQ ID NO: 9339 - RNA, 1083 nt, unidentified
  source 1..1083: mol_type = other RNA; note = synthetic construct
atgaaggtggtcagcccctcatccttcttcaccatcatgacacaggagcaggagtttgagatcaataaatggaatggattcatcagcgagaacattaaaggggataagacgaagaaagcccttagcctatacgttgagaaactgattcaaaaggataccgtggttatcattgactttaaccatctggccatgcttcttggtattcaagcaaatactttcgcatccatcatcgctaatacagagagcttttattacaacttcgaaatacccaaaaggtctggaggcacccggactatatctgcgccataccccgtgcttttaaacgcacagaagtggatttatgacaacatcctgaacaaaatcaaggtgcatgataacgccaaaggttttataaagaagacatcaattgccgacaatgcccgagtgcacttagatcgcgactacatcctgaaaatggacatcgaaaacttttttccttccattaagatgaaccgggtgatgtccatcttccgaaatctcgggtataccaaaaagatatcctactacctatcgtctatttgctgtctccacggatttttgcctcagggagcagtcacttcaccttgcttgagtaacattatcgctaaaagaatggatgctcggatcaccggactcgccgctaggttcgcgctcaactatacgcgctacgccgacgatttcacactgagtggggacattctgccacccaaaattatcgactatattgaggaaatcgtgaatcaggaaggcttcctgatcaataagaagaagacctcactcatcggtaaagggaagcagaagataataactggcatttctatctccagtggcgagctgaagatccctagggagaagaagcgtgaggtgagacagagcgttcactacgtcctgcgcaatggcttatttgaacatcaaaagcacattgactcttttgatccgatctatgtagaaagactgctggggtatctgttcttctggttgagtgtagaaccagacaataattttgtcaagagctccataagcaaactcaaagattacacaaaagtcttggatggcattaactga

SEQ ID NO: 9340 - RNA, 1041 nt, unidentified
  source 1..1041: mol_type = other RNA; note = synthetic construct
atgaacgacaacaaaaatatcctcgtgaaagaatgggacgcatttatttctgagaacatcaggggcgctaaaacacagattgccgtcaagacgtacgtgaataagctgatatccaacaataccgtggtgattcttgactttaatcacttggctctcttgctaggcatcgaagttgatgttctggcccgcattacatcacacagcgagagcttctactacgactttgaaatccccaaaagggatggcaaatctcgtaacattagcgcgccttatccagtacttctgcagagtcagcggtggatatacaaaaatatcctgtctaagcagcctatccatgactgctctaaggggttcaaaaagaatacctccatagtcgacaacgcaaaagtgcacctcaaccagaagattctcttaaagatggatatagaggacttcttcccctctattaaactgaaccgggtaatcagcgtgtttcgcgtgctcgggtatactaagaagatttcatactatcttgccagcatttgctgttataagggggctcttccacaaggcggagtcacttcgccctccctctccaacattattaccaagagattagattaccgcctgaatggtttagccagcaagtttgacctgaagtacactcgatacgcagacgatttcacattcagtggtgaatatctaccgatcaagatcatagactacattaagtccatcgtctctaatgagggatttaagatcaaggatagcaagacaaagatgataggttccaagcgacagaaaatcgttaccggcatctcaatctcctcagggaaaatgactatcccaagaaaaaccaagagggagctgagaaagaacgtgcattatttgctgaaaaatggactgagcaaacatttggagcacaatcggattaatgatcccatctacacggagagaatgatcggatatctgcatttctggcacagtgtggaacctaacaacaaatatgtcaaagagagtctgaaaaagctcaaagattacagtatccaactggattcatga

SEQ ID NO: 9341 - RNA, 951 nt, unidentified
  source 1..951: mol_type = other RNA; note = synthetic construct
atgcagatcgattcacacgtacacatgcttctcggcattagtaccgaggaggaattgagcgtgctgtctagaattatagctagcccaagcaatttttatcgggagttcaaagtgcccaaaaagagcggtggaacacgcaccattagctcaccgtacccgtctttagccatcatccagagtaacatcctcaataacctttttttcccatttgaggctaattcttccgcctacgcttatgtgaaaggcaaaagcgctattgatcatgcacgaatccatgtcaacgggagtgaactgttaaagttggatatcaaggacttctttccctctatttctcggcaaatggtctttgaggccctgcaaagatcaggcgccaaggccgacgtttgcttctacacgagtttgatttgcatcctagataatgggttgcctcagggggcctgtacatcccccgcactgagcaatctggtgttttcacctatcgatgtgaggctgactggcctggcgaatttcttcggcctgaagtactcgcgatacgctgacgacctggcgttctcaggggagtttattcctcgtgatttggcatcccttgtcggagagattctcctggaatacgactttcacctcaaccacaaaaagacccagttaaaactggcggggaggaaaaagatagtgactggcgtgtctatttcctccggtcaggtcagagctccaaagtccttcaaaaggaagctacgcgcccagatttatgaacttgagaagaacatcggaagtctggcaaggctgcccgacttcgacccacttatatatgaacgcctcatcggacggataaactatctgctacaaatcgagcctgaaaacaattatgcaaaggtaaaaaaggcctacctcagcaagtgtcatcaggacttcctcggtctggttgatgaacagatcatctccgcctttgtttga

SEQ ID NO: 9342 - RNA, 954 nt, unidentified
  source 1..954: mol_type = other RNA; note = synthetic construct
atgcagatggacagccatatccttaaattgctggggatatcctcaaaggaaaaccttgccatcctctcacgtatcattgcttctcctccatctttctatcgcgaattcaagatccccaagcggagcggaggtgtccggactatatctgcaccatatccttccctgtcttacatccagagtaacattttcaactcgttcctaagctccgtagagtgtaatctctcagcctacgcgtatgttaagggtaaatccgcaattgatcacgctcgcgtgcatattaacggaaaagaactcttgaagctggatataaaggatttctttccaagcatcagcaaacagatggtctttgaagctctgcaaagagaaggcggcgagaattctgcctgcttttatatctccaacctgtgcacattaaacgatgagttgccacagggggcctgtacctctcccgttctgagtaatctagtattttccccgatcgacattcggctaagtgccctggctaagtttctcgggatcgactactccaggtacgcggatgaccttgctttctctggcgactttatccctcgcgacctggcatccctggtgggcaagattatactggagtacgggttctttttgaacgaaaaaaaaacccagttcaagcttgacggccgaaagaagattgtgacaggagtttcaatttcgagtggtgagctcaaagcaccccgggtgttcaagaggaaactcagggcacagatttacgaactggagcgaaatgtgagcaatttagccaggctgcctagctttgaccccttggtgtacgagagactgctcggaagactgaattatctgttgcaaatcgagccggaaaatcagtatgccaaagccaagaaaaagaccatcagtgagagccaccagagattcctgggcctcgtggatgagcagcaagtcgtctcacttctgttatga

SEQ ID NO: 9343 - RNA, 948 nt, unidentified
  source 1..948: mol_type = other RNA; note = synthetic construct
atggaatttgaagtgtatcccattctggggattggtagcgtggaagagcgtgccatcctgtcgaggatcatagctgaccctcccagcttctaccgacggttcaacatccctaagagacgcggaggagtgagagtgattcacagccctttcccatccctggccaatgtgcaaaagtctattctgactaacgtgcttgcagacataccagtctcagaatacgcatttgcctatgtcagtgggcgcaatgcaattctgcacgctaaagtgcacagggagagccctgagctgctgaaactcgacatcaataggtttttcccctcgatcacgcggcagatggtttttgaggcgctgcagtctcatggattgagctctaaggtgtcatatttcctctcttggctttgcacacataagaacgagcttccccagggcgcctgtacatccccagtcctcagcaatatcgtctttagcactatggactttcgtctttcccgccttgccagtgaagtaggcctaagctactccaggtacgctgatgatatggctttctccgggggctacgtacccagaaacttatcacggtccatctctaaaattctgttggagggtggcttctacctgaacgagtccaaaacccagttaaagctagccgggagtaaaaagattttggttggggtcagtatctccaccggatgcctaaaggccccaaaggaattcaaacgaaagctgagggcccagatctacgagctcgagaaacactcaggaaatttgagtgaagtgaacgattttgacccgctgatctatgagcgggttctgggtcggataaactatctcttgcagatagagccggataatagatatgctctcgaaaaaaagagagaattatctgagatgcatcaacgcttcctctctctgggcgcaggcttttcagaggcgctgaattggatgtga

SEQ ID NO: 9344 - RNA, 969 nt, unidentified
  source 1..969: mol_type = other RNA; note = synthetic construct
atggataatattgagtctcagattgaagtgtccgggctgatggccttgtacagagatttaaacctctccgtcgaggatctagctattgtgtcccgtatgattgcccgaactgacctgttttaccggtcctttcggatccccaagcgaagaggcgggacacgcttaataagtagcccctatccgaccctcgacaaaattcaaaagagcattctgcagaatgtactggaagactatctgccacatgattctgcctatgcctacgttaaaaacaagtgcgctgtgggccatgccagatatcaccttggtagccgggagatccttcagcttgatattaaggagtatttcccttcgatctccagacagatgatcttcggagccctatcccgcaatggctgcgatcccaagaaggcttcatacatctcaatactctgcactctgaagaatgcactccctcagggagcatgtacaagccctatgctttcaaacctggtgttttttccgatcgatgtacggttctcaaaactggcatcgagtttgcgcctgagatacagcaggtacgcggacgacatagtttttagcggtggaaaggtgccaagggacttaccaggcctggtgaggaaaatcctgctggaccaccacttttgtctgaacgaagataagacccagttcaaaattttcggggctaagaaaatcataacgggagtcagcatctctagtggtgtcctcaaagcacctaaggcgttcaaacgtaatttgagggctcaaattcatgagctagaacggaacaaattccacctgtctagtcagaaggagtttgaccccctggtttttgagcgcatcctcgggagggtgaactacttgctccaaatcgagccagacaatattttcgcccttcagaagaaaaaggtcctctctttccatcaccaggaattcttgggcctgatcgatgacttttgtctggacatctga

SEQ ID NO: 9345 - RNA, 969 nt, unidentified
  source 1..969: mol_type = other RNA; note = synthetic construct
atggacaacattgaggatatctactcctatcagggagatgtccaggccttgtgtatggctttggagctcgatcatacgcagtccctgatactgccgagggcaatcgctcgaccagatctgttctatagattcttctctattccaaagaggaccggcggtctgcggaaaattcgcgccccctatccagcgctggcatctattcagaagaggatcctcgactgtctcctggctgagaagcatgttcaccacctctcatttgcttacgtaaagaataaatcagcgatcgataacgccaaggtccatcttacaagcaaggagattctgaaactggacatccaagattacttccctagcatcgactctcagatggttatagaggctctcatgagaaatggcttctccagcgcaaccgccttttatatatccaggctatgtacagtggacggagcactccctcagggcgcttgcactagtccgatccttagcaatctcgtgtttaatcccatcgacaatcgacttgcaaagttggccgaaaggctgaaccttcgctactcacgttacgccgacgacatcgtcattagtggggagcgggtgccccgcaacctgataaaccttatccgaaagattctgatcgagcggcggttcagtctaaacgaaaaaaaatgccagttgaaactgtctggctcaaagaaaattataaccggtgtatcgattagttccggagtgatgaaggcccctaaagcctttaagagagagctgcgcagccagatctttgccttagaaaaatattccggcgacttaagcaaattgagagaattcgatcccttatttttcgaaagagtggtggggcgtctgaattacctactccaaatcgaaccctacaacgagtacgctcggaaaaagaaggcgactatttgctcttatcaccaaaagctgctggggctgcacccaatggcccaacctcagtga

SEQ ID NO: 9346 - RNA, 969 nt, unidentified
  source 1..969: mol_type = other RNA; note = synthetic construct
atgacctctttaagcgcctttgcaactgatctgaacctgtgggagattaaggacttctccattcagatcctgtacgggattctcgcagattcttcaaaatattatcggagcttcgagattcccaagcgtagaggaggcaataggactatccacagtccatacccggttctggcgcagatccagaaggagttgttgttgattctacaagaccggtgcgggactagcgaatatgcatacgcttactgccgggggaaaaatgcaattatgcatgcttctgcccatctgggctgtgacgagctcctcacagtggatgtggaaaactttttcggctccaccacgcgacagcaggttcaccaagccctgctgggagcctcattcgagaacgactttgcacatttggcatcattggtagccaccctccacggcgtccttccacagggtgcttccacatcccccctcttaagcaatgtggtgttcagaccccttgacggacgcttagctaggctcgccagccatcttcagataaaatacacccggtacgctgacgatctagcatttagtggtgataagatccctagaaatctccctaagctgatcggaaaaatcatctctgagaaggggtataaactgaatcccggaaagacagccctgaaaataaggggggccaagaaaattataaccggcgtctcaattagcagtggcacgtccaaggcgccacgacagtttgtcagggccactcgtgccgctgtgcacaaccttgaaaagaacatcggaaagctgagtgctaccaacattctggaccctcttgcctatgaacgcacactgggtaagataaattattggctgcagatcgaacctcacaactactacgccgctaaaaagaaaaaaatcctgtcggaggctcaccaacgctttcttgaactcggcgcgggtttcaacctggataattatatcgagaatagagcctga

SEQ ID NO: 9347 - RNA, 969 nt, unidentified
  source 1..969: mol_type = other RNA; note = synthetic construct
atgacaatcctttctctgttttccgctaccatgaacctgtgggagattgaggatttcagcactcagatcctagggggaatcctggccgacagcgaaaagtactataggtcttttcaattacccaagcggaaggggggcatgcgggaaattaactccccgtaccccgtcctagctcagatacaacaggcgttgactaaatatcttcgcgatcagtgcttcgtgagtgagcatgcatacgcctattgcagaggtcgaaatgccgtaatgcatgcaaccagccacctgggatgtgacgaattgctcactgtggacattcacgacttttttggatccattacacgccagcagattcaccagtcgttgctgaagaattcaatcgatgcttcctattcccatatcatatcagtcctcgccacccggaaaggcattttaccccaaggtgcgcccacgtctcctctgcttagtaatatcgttttcagccccctcgatctgaggtttagccggctcgccatcaagctgggcataaactatagcaggtatgccgatgatttggctttttctggaccaaggatccctagaaatctgccaaagctcgtagaaaagattctgtctgaaaagaactacaagctgaatccgcaaaagaccacactgaaaattaaaggcgctaagaagatcattaccggggtgagtatcagtggtggcacgcctaaacctccaagaaaattcgtgcgctcagtcagagcagaggtgtaccaggtggagaaaaatattaacaagctgagctctctcagcacaatagaccctctatcatacgagcgtgttttagggaagcttaactattggctccagatcgagccacacaacaaatacgccttggacaaaaaaaacctgatcagtgaggcacaccagaatttccttaatctgtcctcatccttcgaccgaaacgaatacctccagcagctgatctga

SEQ ID NO: 9348 - RNA, 969 nt, unidentified
  source 1..969: mol_type = other RNA; note = synthetic construct
atggacatcctggagagcttttccaaagaactgaacctgttctccctcgacggtttttcagtccagctcctggctggcgccatagcagactcttctaagttctatcggtcttttaagatacctaagagacggggtggaaaccgcgagattagtgcaccctttcctttcctggccaacatccagaaggccatcgcgaataaactgagagatagaatccccagttcggacaatgcctttgcttacagggaaggacgaaacgctatcatgcatgccagtacgcaccttgggaacagggagctcttgaccgtggatattcgggatttcttcggctcaattacacgtcagcagatccatcagtcattgttggagtgcaattttgatgggaacttctcccacatttcttccctgctaagcactttacacggaacactgccccaggggggttgtgctagcccaattctatctaatctcgtgttctacagcctggacataaggctcgcccgcctagccagcgctttagacattacttactccaggtacgcagatgatctggccttttctggcgattatatcccacgaaatctgcctagaatggtggaaaagatcatcaaggaaaagggatttgcgttgaacaacgagaagaccaagcttaaaatcttcggcgcccgcaagattattaccggggtcagtatatccagcgggaaaccgaaagctccacggcaatttgtgcgagcacttcgcgctgaggttcatgcccttgagaacaacaaaaataggttgcactcacttacagtgttcgaccccctgcggtacgagagagtactgggcaaactgaattattggctccaaattgaacctaacaatagttacgccatagaaaagcgtatcggaatcagcatcgcacaccagaaattcctgggcttatccgcgaatttcaaactcgaggactatattcaactcgttgcatga

SEQ ID NO: 9349 - RNA, 975 nt, unidentified
  source 1..975: mol_type = other RNA; note = synthetic construct
atgcctgaaagcgaggacttgctggcgctgctgaacatctgtgaaatcgagtcgtccaacacccccgtcctgttctctgtcttgggcagtcctgataagttttaccgtagctttaaaatccccaagcggaacggaggttttcgcgtgatagacagtccttatccttcactagagataatccagagaagtatactgcggaatgtgctctccaacttcccagcacacccgaacgcgtatgctttcataaaggggcgtaatgccattactcacgcctcacatcacttagcctgtcgagagctcattaccctcgatatcaaagacttctttccaagcatcacccgccagatggttatagatgcactaattgagaacggcctggccaatggggtggctaattatatcagcctgctctgctgcctgaatggcacacttccacagggggcatgcacaagccccgccttgtctaatctggttttcgaaaggatcgatgagcgactctcacggttagctaagaccctcaagctgaaatactctagatacgccgacgatctggccttttccggcgatgccattcctagggacatgccacaactgatcgagagaatcctcgagtcacgggatctgaagctaaacaaggaaaaaattcgccttaagattgctggcgctaagaagatcattactggtgtatccatttccagtggaacactgaaagcacccagagaattcaaaaggctcctgaggacgcagatttatgaattagagaagaatatcgacgacatcagccaaatgcgctcgttcgatccccttgtgtacgaaagagtgcttgggcggttgaactacttgctgcagattgagcccaaaaatgcttttgccctgcagaaaaaagccagcttgtcccagcatcatcaaaggtttcttgcactctcttctggacagtggccagcgcttttcccggacgcagacctggccgcttga

SEQ ID NO: 9350 - RNA, 945 nt, unidentified
  source 1..945: mol_type = other RNA; note = synthetic construct
atgacaattaatgatgaaacccttgcggaactggtaagacacctcgagattgatgaacaccttctcctgaccctcgtggctgccatctctagtcccaataagttctataggtcattcgctatcccaaaaaggagaggagggatccgagagatcgagtcaccataccctagcctgggatccatccagaaggccattttgcgcaaaatacttgatggctttagtgtccatccctgtgcccacgcctttacgcgtaaaaaaaaggctctggaccacgctgcataccaccttggctgcaaagagctgattacattggacatcaagaacttctttccttccatcacccggcaaatggtatttcaggccctcaataacagcggcttatccagtcatttctctttctatatatcgctgctgtgttgcttaaacgacgtgctccctcaaggagcttgcacaagtccagcgctgtccaacgtcgtttttagccagctcgacgaacgcctacaccggttagcaatacatctgggtctaaagtatagcaggtacgcagacgatttggcctttagcggcgagaaaatcccgagaaatatgatcaagaccgttcagaaagttctcgccacaaaggggttcgaactcaatactgagaaaacgcggctaaaggtctttggtgcaaagaagatcattactggggtgtccatcactagcggcattccaaaggcccccagatcattcaaacgatccttgcgcgtgaagattcatgaactggagaaacatattgacaacttggcttctatgaagaagtttgatcccctggtgttcgagaggaccctcgggaagctgaattacctgcttcaaatagaacctggaaacgagttcgcactgaaaaaaaaaaagcttctgtctgagcagcaccagaagttcctgtctctgggtcggcaggtgcagtga

SEQ ID NO: 9351 - RNA, 933 nt, unidentified
  source 1..933: mol_type = other RNA; note = synthetic construct
tccctgaaaaacatcctgtctaagtttgagatcccaataagccgcgaaaacgtgagcatcttcaacaagatgatttcagagccctcggcattctatcgagaatttaagattccgaaacgcaaaggtggcattagaaccattacagccccatacccaaccctgagctacattcagaagctcattagcgagcggtatctgactaaagtcaaccccagcgaacacgccttcgcttatgtgaaaggccggtccgtagttgatcacgccagggtgcatctcaactccacagagctcttgacagttgacattaagtcctttttcgacagtatccggcagcagactatatttgagatctaccaatctctcggcctttcgtactctgaagctgcctatctgacccgcatttccactctaaatggcgggttacctcagggggcctgcacctcacctatcctgagcaatatcgcgttttaccctttggatgttagacttaacaatctcgcagaaaagctgggcttaaagtattcaaggtacgctgacgacctggcattttcaggaaccgtcgtgcccaagaatctgcatcgtacgattgatagtataatcaagtcctacaacttcgaactgaatcagtcaaaaacgaaatataagctcgaaaagagcaagaaaatcattaccggtgtgtccatctctagtggagtcttaaaggccccaaaaagtttcaagcgagcgctaagagctgaagtgtacaaactggagaaatacaaagataatctgtctgacatggatgggttcgagccccttatctatgagaaaaccataggaaagttgaacttcgtgttgcaagtagagcctaacaatctctatgcacaggagaagaggaaaacacttatcagtgactacaaggtcttttctagcaaggccactaatctgatctga

SEQ ID NO: 9352 - RNA, 933 nt, unidentified
  source 1..933: mol_type = other RNA; note = synthetic construct
atgcattacaataacgatttcagcattttcatccagaacctcggactcgaggcttcccatgagacacgcgctatcgtatcctccatcatacatgccagcgaaaaccactatcgatcctttaatatacctaagaggaagggaggctatcgtaaaattgatagcccatatcctacgctgaaacacctccacggcgttattctggacgtgtttcaggacaaacttaagtgccacaaaaattcgtttgcgttcatgaaaggtaacagtgccatcggtcatgcaaagcaccacctcgattgtgaagagctcctgacagttgacatcgagaacttctttccaagcatatctagacagatgatattcgaagtcctacacagcgtgggcatgaagactaacgattccaactacatctcttatatctgcaccttgcggaactctttacctcaaggggcctcgacctcaccaatccttagtaatgccgtgttttaccctattgatattatactggaacagatcgctcttaagtttgacctgaaatatagtcggtacgcagacgatctcgcatttagcggaattaatattccccgaaatctgccctcactgatcgagaaaattcttatgaatagggggtttaacctaaacaaatccaaaaccaagttgaagatcaagggagccaggaagatcatcactggcattagtatttcatcaggcaaactgaaggtgccgcggtcttttaaaagagacttacgcgccaatgtcttcgagttagaaaagttcaaacataacctgttcgagatgaacaatttcgaccccttgatctatgagagaacaatcgggaagctgaattacttgctgcaagtggaacccgaaagcaagtacgctaaaattaagattaagctgctgctggagtcttacaaggacttccagctctcttga

SEQ ID NO: 9353 - RNA, 939 nt, unidentified
  source 1..939: mol_type = other RNA; note = synthetic construct
atgacagacaacaatattgtgaatttgctggaggtcatctcaatcaagaatacctcccacaacataaaaatcattaccaacatcctgaactcaaacaaaaactattaccgcttcttctccataactaaacggaaggggggcgtcagggagatctcttctccatatcccaccttgaaattcattcaacagaacatcaagaagaacatattggaaaagatcgtggtaaatgacaatgcctatgcctacattaagaataagtcctacattgaccatgcaaaaatacactgcgatagcaatgaactcctcacactggatatcaaagactttttccctaacatttaccgacaggatgttttcaacattttttctcagtacgggttttgtgatctgcagagcaattatctatcatacctgtgcaccctaaataatacactgcctcagggtgcttgtactagtcccattatctccaacatcatctttaacaagatcgacaaccggttatataagcttgctctttcttttggactgaaatattctaggtatgccgatgacttagccttttccggtaagaagattccgtcaaagatcatcaaattggtggctctcatcctggaggaatacgatttcatcgttaacgagagcaaaaccaaactgaagaagaagggcagtaaaaaaatcataactggggtgagcataagtaacggagaaattaaagcccctaagagttttaaacgtaatctgagagcggtgatttacgagctcgagaagaataaagacaacatcttcaaaatgccaaacttcgaaccacttatttacgaaaaaacgattggcaaactgaattatctcctgcaaatcgagcccgagaataagtacgcaaaggaaaagaaggagaagctcatatcgaattacaaggagttcattagcagccccatgctttga

SEQ ID NO: 9354 - RNA, 912 nt, unidentified
  source 1..912: mol_type = other RNA; note = synthetic construct
atgaataaagataacctgtttgagttactcgaaatcgacgagtcctttattaacgctgttaatgccatctcctatagccccgagcatttctacagaaaattccacatcccaaagaaaaagggagggtttagagaaattcatgctccctatcctagtcttctggctttacaaaagatcatcagcgaaaaaatccagccttatttgaaaatccaccgaagctgcttttcataccggaaaaacatcagcttcattgacaacgccgcccaccatctcggaagtaaagaaatcctgtccctcgacattgaggacttcttcggcaatatatcccgccagaaagtgttcgacgtcttaagtcagtcgggcttcaataaccacctgagcaatgagattacttatctggtcacctacaaagattatctaccacagggagcccctacatcccccatcatctctaactcaatcttctacaagatagatgcgcgactgtataaattgagcgagaagctgaatcttaagtactccaggtatgccgacgatattacaatttctggtgaaaagatcccgtctaattttccgcgttacattgaggatatattgttgcaacatggcttctcactgaacaaggggaagacgcgcctgaaaaaaggtcaccagaagaagattataacaggcgtatcaataacctctgggcgggtgatggctcctaggatatttaagagaaatctgaggaccgagatttatcacctcgagcgcaacaattacgcaatctctagtcccatcgatccaatgctgtacgaacggctcatcggcaaacttaactttcttctccaggtggaaccagagaacacttacgcaattgaaaagaagaaggcactaattgagaagtacaagaagattatcctgatgatctga

SEQ ID NO: 9355 - RNA, 906 nt, unidentified
  source 1..906: mol_type = other RNA; note = synthetic construct
atgaaccaggacatcttcgagtttctggccatttctgaacaacaaagcccaaatctgttcgccatctcacatagtccatcttctttctatcgcacctttagaatcaaaaaaagaagcggtggctacagggagttaaagtcgccctaccccctactattagaactccaaaggataatcttagagaagtcatctcagctcctgaagatacatgacgtgtgcttctcctaccggaaggaaaagtccttcattgataacgccaaatatcatttgaacggagagtgcatcctgacgatggatattgaagattttttcgggagtataacccggcagatggtcctggacacatttttgtttaacggtttgacactggagctgagtcagcagctttcttacctgactacctgtaataattcgctcccccagggggctccaacttcaccaattctgtccaatgccattttttatcgtatagatgtgagacttagcgctctgagcaaaagccttgggctgaagtattcacgctacgcggacgacctcgtattctctggcaaaaacatccctaaaaacttccctagttacatcagcaatatccttaggcagcacggctttagcttgaataacgagaagactaagctgaaactcaagtctagccggaaaatcattaccggaatttccatttcctctggaacactcaaagtgcccaagccgttcaagagaagcctacggtccctgatccacaatttcgaaaggagttccttttccgtttccagctcacgcaaccctatgatttttgaggagataatcggcaagctgaactacctcttgcaggtcgaacctcacaataactatgcacaggaaaagcgaaaactgttcctttcagagtaccgaaagtttatcagttattga

SEQ ID NO: 9356 - RNA, 1029 nt, unidentified
  source 1..1029: mol_type = other RNA; note = synthetic construct
atgacggatgaaactctcgctggagcgcttagggaaaggggcgtcccagtgcgatggatcgatgcttatgagagttatgcacagcgactcacagagaacggggtaccggtcatcttcgaactgaaacatctggccatcctgaccgagatcgacttgagttttgttctctcttgcgtctacgccacaaatattcactaccgaatcttcattatccccaagaagacaggtggtaccagagagatatgcgcccctctaccagcccttctaagtatccagaggtggattaatcaccaaattctggagaagttcgcggtgagtgagttcgctcacgcatacgtgaatggacgctctatcgtttcacacgcccagaaccacagaagcgggagagtgcttctgaagatggatcttcaaaatttctttggatctatcaccttgtccatggtgttgggcatttttagggccgctggttactcacgtaatttaagcttcgacctggctaaaatttgtactttaggcgattttgcacctcagggcgcagctacatcaccaagcattagcaacattatcttctaccatatcgaccaggcgattggctcgatctgtgccaaaaacgagttaatctatagccggtattctgacgacatatgcatttctggcaggcatatctcaaaggagataattgcaacgctgcgcgaactcatcgaatccaatggctttgctatcaatgataaaaagaccaagctggccaccagcgcagggagacggatcgtgaccgggatatccattgggtccggacgtatgctgcctactcgcgctttccgcaaggacgtcaagcggaggttggcccggatccggaagataggggtgaactccgccatggtagaggacggagatccctttgttctggacagactggtcggtaaactgcatttttggagccacattgaccccgataacaaaagaatacgcgtggccctcaacgaaatgatttccctcgccaaaggagaatcgcagactactggcacatga

SEQ ID NO: 9357 - RNA, 1026 nt, unidentified
  source 1..1026: mol_type = other RNA; note = synthetic construct
atgatcaactctgatccgctggaaagtgcgcttgttgagctccgcgtgcccagccattggattaaatcctacttgcagtacagagatcgactggagagctccggctttccctgtatcttcgaactggaccatctggcttaccacctttcattcgagccttccgccctaagagtcctggtgcacaatccccaggggtcttataactttatcgagattccgaagaaacgcggtggaatacggaaaattagcgcacctttacccgcattactgtacgcccaaaggtggattaagaacaatattgtcgacaagctcaatatagatgaaagtgcccatgcttacgtgcgtacacggtcgatcgtcacccacgcacggcttcacattgaaggacgtgtcatctatagaacagatataagggacttctttggttccatctcattcgactctgtggtaagtctcatctacagtctggggtattcccaggacgttctgtttgatattgccagcatctgctgcttgcatggcagtctccctcagggcgcctctacctcgccagctctctccaacgttattttctataaaactgacagggctttgtccacgctggccagctcttttgggctgagatatagccgctacgcggatgacctctgtttttcaggagaacacattccacgaaagttcattgataagagcacctccatcttgaacgcagacggatacatcctcaattctgagaaaacacggcttgaaacaagcagatcacgcagagtcatttgcggcctgagcataggtgatgggagggtaaagccagtgaagtcattccgcagggctgtgagagccgagactaacaactttttaaagcaaactaaggagcgctctgtggtatattgggaagttaccccattctttatcgaccggcttctgggccgactaaatttctggaaatcagtggagcctgacaataaatggatagtggagcacgaacagatcgtgcggcgtaggatcaggaccatcctggagatgtga

SEQ ID NO: 9358 - RNA, 933 nt, unidentified
  source 1..933: mol_type = other RNA; note = synthetic construct
atgtacagggctggccagattctttctctcattcatgagatttgtgaaaagtctggtctacctaaagataaaatcactgccttggcctataggaatcgcccacgctatcgtattttccatatacacactgggaaaaagcagcgactcattaaagcccccattccaagcctcagagcagcccagaaggcccttgctgctatcataagcgagaagctcaagcctgaggagtgcgctcatggctatgtgactgacaggagcgtgatcacccacgccgcgagtcacctgggcaaaaaagccttctttaagacagacatcgttgactgcttcggaagtattaattttcccgaaatagccaacaccctacgagaggcaaaatacaacagcgttgactcatttattgcagcttccatcgcgacggatgaaggctccctgcctcaaggggctccgagttctcccctgttatgcaaccttgttctgcggtccgtggaccgtccactgtctaaactggccgataagttgtgtgccacatatacccggtacggagatgatattgtcatgagcgcagacgattttgacatcaacatcatctcaatcgtaaggaatgtactgtccagacacggctttaagatgaatgaggacaaaacctacatcgcaatcgaacctcagcaaaacatcattaccggaatcagtatcgcaacagggtaccccaaggtgcggaagtcattcaagcgccaggtgagattagaaacacacctgctgctgaagaagggaatagtctcatacctcgagtccgatggttatatcgaccccttcgccgcggatagagtcttgggtaagctgacgtggtggtcgcacgtggaaccagacgctgagttcccgaaaaagcattctataatgattcggagcatgatgaaagaggtggctcgcgggtga

SEQ ID NO: 9359 - RNA, 1005 nt, unidentified
  source 1..1005: mol_type = other RNA; note = synthetic construct
atgaatacagttaacgaatgggcggagttctttagggatcaacaggtgcctgaggatctgatactgaggtacctgccatatatagagagacttctgacgaagaatgtcccgattattttcgagggtaagcacttgcggaaacttttaggaatcgagagctccatgttgcgcagcttagtgttcaatgggtccgctttttaccggtctttctccatccccaaaaggtctggcggcgagcgaacgatcactgccccatatccagagcttgccaatgcacaggcctggattaagcaggagatcctagacaacctgaaagccacccccagcgcgactgcatatgttcaagggaagtcgatcctggaaaacgccaacgaacacgtaggcaagaagatgctgctgaaactggacgtcgaagattttttcgggtccatagacgtgaagaaaattaccgctatttttgagtcatgcggatacaccaacaaagtgtcttatctcctggccagtatttgtaccttagatggtagccttccccagggcgcacctaccagtcctcagctatccaatctggcttcaatccccctcgacaatcgtatccatgccttggccaaaaagttggaactcacatacacacgctacgccgacgacattgcattgtcaggagagttcattcatagtaacgttatctcctacgtggaagatatcctcaagtcagagggcctgaagctgaacagtaataagactcagctcaagcagcccgggaaaaggaagatactcacaggaatcagcgtatctagcgagaagccaatgattcctagagcgtataagagacaactacgggctgaagtctttaacgccctgcataaagctcagcacgaacttccattcgatcctctcaacatagaacgcctgatcggtaaacttaatttcgtgctgcacgtggaaccggagaaccagtttgcacgaagatctctggaggctctcaaacaaaaaaagatcgctccctga

SEQ ID NO: 9360 - RNA, 1029 nt, unidentified
  source 1..1029: mol_type = other RNA; note = synthetic construct
atgaccgagattatcaaatcaagctgggatcatcttgttggcaccaagagccctgacggacgacagaaagagattttcaagaagtacattcaggacctggagaagaatggtctacccgtgatatttgagtttgaacactttgcgtatctcctcggaatgaccacaagtactctggcccaaactatcatcaatccggaaaagagctacagatccttccacattaagaaaaaaagagggggctcacggctcatcaatgcaccctatcctctaatctcgtatatccagaaatggataaacaccaacatcctcagtaaaatcaagaaccatgaatcctccttcgcctacaaaaagaattctaatgcctacttgcacgctctgcagcacatagacaccaacgaaacactgaaggtcgatattgtagacttcttcgggagcatcaagaaaatcgatattgttcgcctgttcagagaactgggctatgcagataatgtgagtctgtatctggcttctgcttgcacatatgccaactcattaccacaaggggcagtgacgtccccaaatttgagcaatatcatcttctactctctcgataacaggttttatcacttggccattaaacttaaccttacttactcaaggtacgctgacgacttattcttttcaggtgagaaaatcccatctaacctgtacaagtctatcaagagtattctccaatctagtggcttcagcattaacaaggagaaaacacggcatatcactaatggcaaacagaagatcattacggggctcgccgtgaaggaaaattccgtgcggatacccaaatcctaccgcaggaaattttgtcaggaggcctacatttttatcaagaacgagaagtccaatagcagcatggagaacattaatttcgatcctatactgattgaccgtttgatcggaaaagcgaactatattcttaaagtcgagaagaacaacgaacgaataatgaagttactgaagcagctgaatgaaataaagctgaacaccttttga

SEQ ID NO: 9361 - RNA, 1035 nt, unidentified
  source 1..1035: mol_type = other RNA; note = synthetic construct
atgaaccagctgtcctacgaaacatggttagattttctaaagaaggaagggtacggacataaacagtcggaaaaactggccgcctacgcacacaaactggcctcaaacaatgtacccattatcttcgaaatagaacatctggcaaagttactcggagtggaactgagcctgttgtcgcgcatttacggggtgagttcctacttttaccggtccttctctattaaaaaaagatcagggggagcccgcaacatcaagctaccataccctaagctgaagtatattcagcagtggattaagcaagagatcttggataatctaacagtggacgagaatgctttcgcatatgtcaagggaaaatccaacatcgagaatgctaagctgcacattggctccaatgagctcttgaaactggacattaaggatttctttggaaacgtgaaggtggagtctatcgaatcaatctttcgatcttgcggctatactgatgacgtaagttatctcctcgcccgtctgtgcacatgttttgggttcctgccacaaggcgcacccacctctcctacgctttccaacctcgttttacaggcgttggacaagaacctcgctcattttgcgaatatcaactcacttaccttctctagatatgccgacgatatttttcttagcggcaaactgatcaccaaggagataaaacaagacgctgtcgaaattgtcgaaaagagcggcctgccgatcaatcacaacaaaactaaaatcatcagggggaacacctgtaaaataattacaggcttgatcgtcaccgacagtactgtgagagtgccaaagaagatcaggcgagagttccggaagaatagcttcttcatgctcaaaaataagagtagccagatggatggttctagggccaagctcaaccctctgctgattgatgagataataggcgttggtaactacatcatccgggtggagcccagcaataagtatgttgagagcgtccttggtgagcttcaggagctgaaaaaagacctgtttggtaagtga

SEQ ID NO: 9362 - RNA, 1032 nt, unidentified
  source 1..1032: mol_type = other RNA; note = synthetic construct
atgaagcccatctacgacaagtggtttaattttctcaaggccagtaatctgtcattacagcaatctgaagccctcgccaagtacgcttcccgactggaaaatagtaattttccggtcatttttgagcaaaaacacttcagcaaactgctcggtctagagcttaacctgcttagccgtatgactggcgcttctagcaatttctaccgctccttcgaatttaagaagaagaaaggcggcattagagctataagatccccatacccaaaactggcgtatgtgcagaagtggattaagaaagaaatccttgaagaaatccccatttccaagagcgcattcgcatacgtcaagggaaggtcccatatagacaacgccaaaaaacacatcggaagcaaagacctgtttaagatcgacataatcgactttttcgaccagattaagttcgaaaagatctataacgcctttattgcttgcgggtattctcataaggtgagtttcgacctgacacagttatgtactttctggggaaagttgccccagggtgcaccaacctctccttccttgtccaatatcgtcttgaagaaactggatgatgagctctttaatgtgtgcaaggcctcgtcactcacctacacaaggtatgccgacgatattagcgtgtctgggatagagatctctcctaagatcagaaacgagatcattgaggtagtcgagaacaacgggtatcccgtgaatcacaagaaaacctatttcgctcagggtaaagccaaaaaagtggttacagggctgattgttaccgatagcgaggtgcgcgtgtcaaaatcgatgcggcgggatttcaggaagaagtcatttttcctgttgaaaaacggagtaaacgagctcaatggcaaaaataagcctatcaacccactgtatatcgatgagattataggcctagcaagttacatcctgaaagtcgaacctaacaataagtacgttgcgacggagctgaagaacctcaaaaaactgaagcaggatttattccttaactga

SEQ ID NO: 9363 - RNA, 1032 nt, unidentified
  source 1..1032: mol_type = other RNA; note = synthetic construct
atggcagataacaatctggatcgaaagatcttctttaagaaaaatggcctatcggagagccagagtataaagttggacatctatgctaagaacctcgaatctaaaaatctgcctatcatctacgaactcaaacatttgtcaaaattgctgggaatggaatatgctctgctgtcgcggatgtctgggatcaatcggttcttttacaggagcttctccattaaaaagcgcaacgggggccgtcgcataatcaattccccttaccctaagatttcctatgtgcagaactggataaaagacaagatcctctcacaagtgcccatttccaacaatgcctatgcatacgtcaatggcctctctcacattgagcatgcgagacagcacattggaagcgatgttttccttaagattgacctcctggattttttcggccagatttccgaccagagagtcaagaagattttttctgagttaggatacacagacaagttgagtcttcaactcgcgcggctatgcacttgtaatagcagcattgctcagggagccccatcctcacccatcctgagcaatatcgtactgaaagaactggacgaaactctgtttacgatcgccaatagcaactctattttatacacacgctatgcagatgacatctattttagtggaaaacacgtgtcaaaaggcttcttctcaaaaatcaagggcgtgattaacaacttcggtatggtcatcaacgaggagaagagcaagatatacaagtctcaccacaagaaaatcgtaaccggtataatcgtgaaccagaaagagattcgagccccaaagcatatgaggaggagatttagaaccgagtcctacattcttctcaaagataagttcaaggttttcaacggggagagggggctgtttaacccgaactacatagacgagattctggggttaggtatgtacatcctgagtgttgaaccccagaatgcctatgtgatcaagatcgtgaaaagtcttaaagccctgaaaaaggaatttgctcaatattga

SEQ ID NO: 9364 - RNA, 1032 nt, unidentified
  source 1..1032: mol_type = other RNA; note = synthetic construct
atgatggaacagagccggtggtttaagtttttcatagagaacgacctcaataagagccaggcccagctccttaccaaatacgcgcagattctagaactgaagagcctgcccgtgatctttgagcttgagcacttaagtaaactgctcggagttgaattgtcacttctgtcaagaatttgtacactcaatgaacggttctaccgattgttctccttagaaaagaaacatgagggatttagacacattgagtcaccctatcctaagctgaaatacatacaaaggtggatcaatgataacattctgtccgtgctcgccgtgcacgacaatgtgtattcatacctccagggtaagtcgcatatcgataatgctaaaatgcacattggctgtaagcagatgctgaagctggacttagtgaacttctttgggcatatcactatttcccaaattgagaaagtcttcatcgaatgcggatatacaaaggacttgtccaacaaactggccaagatctgtacctactatgatcaccttcctcagggggctcccacctctccagcactgtccaatatcatcttctacgagctggattgcatcctttacgacatctcccagtccaacggtttaatttatactcggtatgccgacgatctgtgctttagcggcgacaatattagtcagtacgttgtggacgacattttgtcacacctgaagtctcatggctttagtatcaacgatgaaaaaagcagactgctaacgggcaaccagaggaaggtcgtaacagggcttctggtgcaatctgatacaatcagggtcccaaaaaaggttcgacgcaagttccgtaaagattcttactacctcatcaagaacggatatgacaacctcggtaatgagcgcctgttcaatctattggaagtagatgagctgataggcatagggagttacatcaaaaaagtcgagccgcaaaatagctatgtgtctaatgcattgattgagctcaacaacataaagaactctctgatgactagtaccagctga

SEQ ID NO: 9365 - RNA, 1032 nt, unidentified
  source 1..1032: mol_type = other RNA; note = synthetic construct
atggtgtttcaggagtcccgatggttccaattcttcattgagcacaagttgtctagcagacaggctgccttgctgaccgagtacgccattaacctggaatgtaattcggtgcctgtcatctttgagatcgaacatctttccaaactgttgggaatcgaactgtctttagtgagcagaatgacaggcgtgagcaatctgttttaccggcagttcccactaaaaaagagatcaggcggaataagaacaatagaatcgccctatccaaagctagcttatgttcagcgctggataaagaatcacatcctcgaaattaaaccgatctcttccaacgccctcgcgtacgtgcaggggtcctctcacatcgaaaatgcaaaacgacacatcggggccaaagaactcctcaagatcgaccttgttgactttttcgagtacatcaaactatctacggtcaagtcaatattcactgagtgtgggtatactgaaaaggtgtcccaccagctggctaagctctgcacacttcgggacaggctcccacaaggagccccttcaagtcccgttatttccaaccttgtgttggtggagctggacaagaggctccagagcatttctaagaagcatgaactggtctacacccgctatgctgatgatctgtgcttcagcggccatgcaatttcagatgagttctttagtctggtgaaagatgagattgaaagtgaagggtttgtagtgaaccaaaacaaaagcggggttgtacggggacacaaacgcaagctgataaccggattagtcgtgtccgagtacggcgtcagggtgcccaagaaaatgcggagggagtatcgtaaacaagcacattacatgctgaaaaatggcattgagcagttaaacggtaatatgggtatgctgaatccccttcatattgatgaggtcatcggcaagggtcagtacatcctgagcgttgagcctggcaacgcctatgtaaaagacagtctgtgcatgctgctcaagctgaagaacaagttgcttatcaagtga

SEQ ID NO: 9366 - RNA, 1029 nt, unidentified
  source 1..1029: mol_type = other RNA; note = synthetic construct
atggcttatcaagagagccgatggtttaaatttttcaacgagcaacagttgtccgcaaaccaagccacccttttggctaaatatgcacagacccttgaatccaattcagtgccagtgatttttgaaatcgagcatctcagcaaactcctgggcatggagctgagcctgctgagtcggatgaccggggccagctcgctgttttacaggcagttctccctgaaaaagagaagcggaggcgtccggttcattgacagcccctaccccaaacttgcctacgtccagaggtggatcaagaacaatatcctggagacacgcccagtcagttctagtgctttcgcctacgtgcagggaggtagccacatagagaacgcacgaaagcacattggggccaaagagttactcaagatcgacctggtagattttttcgggcacatttccttctctagcatcgtcagtatatttgaagagtgtgggtactcaagatctgtctccacacagctcgccaagctgtgtactttgtggggcaaacttcctcagggggcgcctacttcacccgtgatctcaaatctggttctcctggcccttgataagcgtttgcaaaatctctccgataagaacggcttagtgttcacaaggtacgctgatgacctgtgcttttctgggaacgaaattaccgaagaattctattcctctgtttatgacactttggagaatgagggctttgtggtgaatgagaagaagtctggattcgttctgggtaataagagaaaactcattacgggactggtagtgtctgaaagcggagttagggtgccaaaaaagatgcgccgcgaataccggaaacaggcgcattacatgataaagaacggcatagagcagctgaacggagaactaggcatcttcgacccgctctatatcgatgaagtcatcggcaagggtcagtatattttaagtgtagagcctgataatgcatatgtgaaagagtcgctatgcaaactgtcaaagcttaagtccgacctgctagtgtga

SEQ ID NO: 9367 - RNA, 1035 nt, unidentified
  source 1..1035: mol_type = other RNA; note = synthetic construct
atgacagaagaaaaatccccatggtacgagtttttcttgaagaataacatcggatcccggcaagccaccgcgttatctgagtatgctagtaggctggattgtaacggggtccccgttatttttgaaatgaagcacttcagcaagatcctcggactagagttttcacttctgagcagaatgtgcggagtcaactcttactattaccgggccttctacattaaaaagaggcgaggcggtgtccgggtgatccagtctccctatccgaaactgtcctatgtgcagggctggattaaggataatatactcgacaaaaaccggatcagcaaacatgcttttgcatacagcaaaggcaaatcgcatatagataatgccaaatgtcacattggaagtagcgagttgttgaaaatcgacctggagaacttcttcgaccaaatttccataagtgcagtccaggaaatctttctgcgctttgggtacaccgaaaacatatcatttaaactcgccaagctctgcactcttagggacacattaccacagggtgctccctcaagccccgcaatttccaacattttcctatacgagctggacaacttccttgccagttattcagagatcaacaagctgacgtatacccgctatgcggatgatattgtcttttccggcgagcgaatttctaatgagtctatcgtggatatcaagaaatacatcacatcctacgggctgaagataaatgagaagaagagtagattggtgaagggtgcccagagaaagatcgtaactggcatcctggttggcgacaccgacgtgagagtaccaaaaaaactgaagcgtcaatatagggcccaggcttttaacatcattgaaaatggtttctcggtgttcgatgggagcatcgggaagcctaatcctctctacattgacgaggtgttcggcaagggacagtacatcctttccgttgagccttggaataagaaagtggtggaactgcagtcttcactgcgcgagctcatgaaggaaatgagcgaaaatatttga

SEQ ID NO: 9368 - RNA, 1035 nt, unidentified
  source 1..1035: mol_type = other RNA; note = synthetic construct
atgtcttccgagtatattcggtggctggactacctgagaagcaatggtgtacaaaataaacaagccaggatactagcagaatatgcgcacaatctagttaagagtaatctgcccgtcatcttcgaaatcgagcatttctctaagctgcttgggatcgaactttccctgctctcacggatgagtggtgccagctccctgttttataggggcttctcaatccctaagaaacggaaaggagtgaggaagatagacagtccttatccaaaacttgcatacgtgcagctgtggatcaagtctaacattctggaaagactgcccatttcggacaatgcctacgcgtacaccaagggtcgatctcatatccagaacgctagagcccacatcggcgccaaggagttgctcaagctggacatgcgtgattttttcaaccgcattagcaggttgcaggtggagcaggtctttctcaagtgcgggtattcagataacgtggctagcgtattgagcaatctctgctcctacaacggagtccttccacagggcgcctctacctcccccattcttagtaacattgtgctgaaggagttggatgacgtcatacagcacgttgctgagaagtattctcttatctacacaaggtacgcagatgacatcaccctctcgggaaatagcatcagcaaaaacgtgtgtaacgaagttatgcaatacatagaggaattcggcttgccggttaatgaggaaaaagtacatctgctgaaacagaacgataaaaagatcgtcacagggctgatcgtgactgactcatctctccgtgtgtccaagcagatgcgcagagcttaccggcaggaaagttactatctgattaaaaacggagagacgcaatttgatggctccactaaaccattaaagcccctatatctcgacgaggtgattggcaaagggtcctacattttacaggtggagcctgagaatgactatgtccgaaatacactgcgcgatctgagcaaattaaagtcacgcctctttagcaacgtgtga

SEQ ID NO: 9369 - RNA, 1035 nt, unidentified
  source 1..1035: mol_type = other RNA; note = synthetic construct
atgtcacctgagtacatccgttggctggattacttatgtagcaacggggtccacactaaacaggcgaacgtgcttgctgaatatgccaataacctggccatttccaacctgcccgtcatcttcgaggtggagcacctttctaagctcctgggaatcgagctggggctgcttagcaggatgtccggcgctcctagcctgttctacagatcttttcgcatccctaaaaagagaggcggtgttcggggcattaggtccccataccctaaactcgcttatgtccaaagttggttgaaggaaaatatcttagagtgtcttaccatctccgacaacgcatacgcctacaccaagggccgctcacatattgagaacgccagagcccacattggtgcgcgcgagttactcaagctggacatcaaagactttttcaatcggatatccaagagccaggtacgacaagtttatataaactgtgggtacgctgagaacgtagcatccgtcctgagtaatctatgcacatataatggaactctaccccagggtgcctgcaccagtcccatcttgagcaatataatactgaaggaactggacgagacactgcaggatatcagtggccagtattcattgacttatacccgatatgcagacgacattacgttctctggaaattcgatctctgacgatgtctgctccgaactcattcaccatattgaggaatttgggttgccagtgaacgaagataaggtgcggctcctcaagccaaaggacaaaaaaatagtgacaggactcatcgtgacagataggtcactcagggtgtctaaaaagatgagacgcgcataccggcaagaaagctactacctcattcgtaaccgggagcgacagtttgatggaagcatcaaacccctaaagccgctgtacttggatgaagtgattggcagagggagttatattctgcatatcgagccaaacaatgactatgttagggattcgctgaaggaacttctggagttgaaatcacagctgttctctaatagctga

SEQ ID NO: 9370 - RNA, 1035 nt, unidentified
  source 1..1035: mol_type = other RNA; note = synthetic construct
atgtctccggagtataaaaagtggttcgaattcctttgcacaaacgatgtgtcagaaaagcaggccacacttctagcggcctatgcagacaggttgctcaaatctaatctgcccgtgatttttgagattgaacacctgagcaaactgctcggcatagaactgagcctcttaagtcggatgtcaggaatgcctccctttttttatcgtaactttcagattcccaagaaacgagagggttttagagagatttgctcaccttacccaaaacttgcgtacgtccagtcttggctgaaagagaatatcctggatggactcactatctccgataacgcttacgcttacaccgagggacgatctaacatccgcaatgcccgggcacatattggtgcacgcgaacttttgaagctggacatcagaaacttcttctataacatcaagactttgcaggtcaagagggtgtacctgaattgcgggtactccaacaatgtcgctagcgtactctctaacctgtgtacgtacaatggccgtttgcctcagggggcctgtacaagtccaatactcagtaatatcatcctgaaggaactggatgacgctctccagaacatctcagagaaatattccctgacctatactagatacgccgacgacctaacctttagtgggaattcgattagcgatgatgtgcaaaatgaaatcaaggccaacatcgaaggcttcgggctaccaataaatgaggacaaggtgcggttactcaagcccaaccaacgcaaggttgtcaccggcctgcttgttggtgatagctccctgagggttccgaagaaaatgaggcgcgcataccggcaggagtcatattacctgatcaaaagcgggaaaagtcaattcgatggcagcattaaaccattaaagcctctgtacttggacgaggtaattggcaggggatcctatatattgcaggtggagcccgataacgactatgtgagagactctctcaaggagctgtccaagctgaaatcccaccttttcagcattgactga

SEQ ID NO: 9371 - RNA, 1038 nt, unidentified
  source 1..1038: mol_type = other RNA; note = synthetic construct
atgaaatctaatgagcgggaatggatcgatttctttattgagcgcaaggtagacttaaatcaggcaaaaatcctgaccagctacgcaataaacctgcaggaaaagagcctccccgtgatctttgagatcgagcacttcagcaagcttctcgggattgaactaagccttgcgtcaaggatcgttacaaaacctgaacgattctaccgggtgttcaatgtcaagaagagacgtggtggatcacgtgtgatttcatctccttaccccaagctgtactacgtgcaatcttggatcaaagataacattctccagaagattcgggtacatgagtcagcctttgcctataaaaagaacactagccacatcgacaatgccagggtacactgtttttcggacgaaatgttgaaggtggacatctccaaattcttcgacaatattctcaagtccaacattgtggacatatttgtgaagtgcgggtactccaaaaaactttccgagcaattggcctcattttgttcgcaaggagatcatctgcctcaaggggctccaacaagcccagtcatatctaacatcttcatgttcgagctggacaatagactctccaaggtcgccgaggagaacaacttgaagtatagtcggtacgcagatgatatctgcttttccggaaagagaatctctcagaaccttctggagctggttaaccgcgctataactgattatggatttcagctgaacaaccgcaagaccaggctgtataagagccaggacgtgaaaagtgttaccggcatcgtcgtgagtaatggcaagttgcgaacacccaaaagaattagaagggaattcagggctgactgccaccatttactgtctaatggttacctccagttcaatggcgaactgggcgtgtttaatccgctgatgttggatgaggttattggcaaagggcgctatatactgagtgtggagccagaaaaccagttcgtctctgatcagatgtccaaactggctacgcttcggagcaaatatctctccctaagtttatga

SEQ ID NO: 9372 - RNA, 1038 nt, unidentified
  source 1..1038: mol_type = other RNA; note = synthetic construct
atgaaaattaatgaaaaaaggtggatcgacttcttcattaaaaacaacgtggacctggaacaggccaagatcttgaccctatatgcagtcaatatacagaaaaagtccctgccagtaatttttgagatcgagcacttctccaaattgctgggaattgaactgtctctggcttcccgcatcgccacgaaacctgaaagattctaccgacttttcaatatctcgaaaaagcgagggggaagccgcgccatttcaagcccctaccccaagttgaactacatccagctgtggattaaggaaaacatactcgaaaagtgtcctattcacgatagcgccttcgcatatcggaagaatagaagtcatatagacaacgcacgtatgcactgcgacgcgatagagatgctcaaggtcgacatctctggctttttcgataacatatctgcctcatatatcgtaaagatcttcgagaaatgcggatatagtaagaagctatcagagcaattagctaacttttgttctcactctgatctacttccccagggtgctccgacatccccaataattagcaacattcatatgtacgagcttgacaagaaactctcagatgtgtcctcagagcataatctcatttacactagatatgctgacgatatctgtttttccgggagggagatcagcgttaatctcctgaacatcgtgaataagctggtcaacgagcacggccttaagttgaataaaaacaaaactcggctgtacaagagccagcatatcaaaagtgtgacaggcattatcattagtgatggcaagctgcgcacccctaaaaaaatcaggagggagtttcggttggattgccattacctgcttaagtacgggtatctgcaattcaacggagaatttggcccatttaatcccctgctcctggacgaggttatcggtaaggggagatacatcctgtctgtggagcctgaaaaccacttcgtgaagtgccagttaagcaaactcattaccctccggaattcctatttatcgtttaatgaatga

SEQ ID NO: 9373 - RNA, 1029 nt, unidentified
  source 1..1029: mol_type = other RNA; note = synthetic construct
atgttgaatttcagtcaatggaagtcattcctccagtctgaggggatttctgagcaacagagcgagcacctggccaactatgctgaaagattggcaaataggggcttcccagttatcttcgaattagaacatctgagtcgcctgctgggtgtggaaaagaactacctttaccgtgtgatgttcaaagggagcgagttttacaggacctttgaaataaacggacgacgcaagaaacgattgatctccagcccctacccaatacttagttacattcagtcctggattaaagaacagattctggagaagttcgtggtaagcgaacatgcctatggctatgtgaagtccagatctatcctagataatgcaaagtttcatctcggctgcacagagctcctcaaactggacatcaaggattactttgctcacatttcccgggctatggtcaaccgcgttttcaatgaggccggctttacccccaagctttcgtaccagctgtccaagctgtgttgcgtttatggctctttgccacaaggagctccctcaagtccgaccctaagcaacctggtcatgagggagttagatcagagcctgttctatctctcagacttctacaacatcaagttttcacgctacgccgacgatcttgcatttagtggtaaggccataccttctgattttatcgtaaaagccgtcaagcagatcgagaactatggcttcatgctgaaccacgaaaaattcacgcaccgtaagattaatcaagggaaaatgatttctgggctctccatttcaggtgactttgtcagagtgcctaagaagactaggcgggagttcagacagaaacaccactatatgatgcttaacaaagagaaatccttcaatggcgtgcatggagactttgacctgttgagcctagacaagttaatcgggctcggacagtttatcaaattcatcgagcctaacaatacttttgtgatccgggcggtggatgacctgaatctgctgaagaaagaaatattccggacaggatga

SEQ ID NO: 9374 - RNA, 1029 nt, unidentified
  source 1..1029: mol_type = other RNA; note = synthetic construct
atgttgaactctagtcaatggaagagctttttagtgaacgaaggaataagtgtggagcagagtgacctgctcgctaattacactgagcagctgacgagttccggtttcccggttatcttcgaactagagcactttgccgtgctgttgggtgtggagaagaattacctctacagaatgatgtataagtcaagagagttttacaggactttcaagatctccggcaaaaagaagaagcgtctcatcaacttcccttacccaattctgtcttacgtgcaaagctggataaaggagcacatccttgaaaacatcgaagtctcagaacaggcttatgggtatgtcaaaagccgatccatcttggataatgcaaagctgcacctggggtgcacacagctgcttaaattggacttcaaggactttttcggccacattagcatccatgatgtgaagcgggttttcagggacgttggatttacaccaaagctctcatatcagatggccaagatttgctcagtaaatgggtgtctaccccaaggagcgccctctagtcctattctttctaatcttatcatgcggaaactggataacgaactggcccatctcagcaagttccacaatattaagttttcccgctacgcagacgatttagctttctcaggtgaaatcattcctagctcgttcatcgtcatgattgtcaaaataattgagtccaacggatttaccctgaaccataagaaattcgcccataaaaagtccggccagaaaaaaatggtgaccggcttatgtatcaccggcgatcgggttcgcgtgctgaaaaagacacgacgcgaatttaggcagaagcatcactatctgatgctcaataaagagaaatctttcaacggggactacggagacttggatgtgctatatctggataagattatcggcctggggagatttattaaattcatcgagcccaataacacctttgtctccaaagcagtggaggaccttgcctctctcaaaaaggagctgtttagcatagtatga

SEQ ID NO: 9375 - RNA, 1041 nt, unidentified
  source 1..1041: mol_type = other RNA; note = synthetic construct
atgagcgctaattatcagattaaagattgggaggagctcatcaacaactcttccttatcaaagaaggagaagaaggaaaaactattcttcatcaggtccgcctaccacaacggagtaccagtcattctggatcttgaccatttagctcatctgttggggcttaaggtgggggtgctgtcagcgatgatcaaaaagcctctgagattttatcggcagttcaagatccccaagaaacggggcgggtttcgtgacattgtgaccccttatgagagcttacttgaagttcaacaatggatcgtggaacacgtactgagcaaattccaggtacacgacgcagcacatgcttatgtcaaaaagcgcaatatcgcccagaatgccagtattcatgtgggttgtgatgaaatgctcaaaatcgacctgaaggactttttcccatccattaagataccccgagtccgggaattgtttaacagggttggttactctaaagaagtgagttactacctcacaaatctctgttgcttgaacggatcaattccccagggggcagcttccagcccgatgatctcaaacatcatactgttcaacctggacaaacgcctgtcggttttcagtaagaatcacggagtcaaatacagccgttatgcggatgacctggtcttcagtggcaactttcagtcttttggtttcaagaacctggttatcatgaatattgaggacgagggatttaaagccaacaccgataaaacaagagaatactgcgaaggccacaggaagatgattactggcattgtggtggagaaagatcgcattcgcctccctaaggccaagaggcgggagatcagaaccgaagtgtattttcttatgaagtacggcattttcgaccaagtgaaacgatataacgatatctactacgccgatagggtgctgggcagattgaattactggaagcagatcgagcccaataatgagtacgtcatagactctataaagtccatcaagaaactctatgaggagacgctaaagcagataagcacttga

SEQ ID NO: 9376 - RNA, 1032 nt, unidentified
  source 1..1032: mol_type = other RNA; note = synthetic construct
atgaaggtggagtataaaatctcggactgggaggatctgattaatgagagctcactgacgaaaaaagaaaaggtagagaagatgctgttcataaagaaggcttacgacaataatgtccctgtgatattggacttggaccacctttctcatctctttggactcaaaaaagggatagtcgcctccatgatcaatagcagccagagcttttatagagagttcaagatcccaaaaaagcgtggcggttaccgcgacattgtgaccccttaccagagtctgctggaggcccagcagtggattattgaacacatcctgtccaaattcaaggtacatgatgccgctcacgcttacgtgaagaagcggaacgtcgccatgaatgcaatgaggcatatagggtgtgatgaaatgctaaaaatagacctcaaagacttctttccctctattaagatcccacgcgtccgggagctatttaatagagtgggttattctaaggcggttgccggatatttgacaaagctttgctgcctgaatggttcaattcctcaaggcgcagccacttcccccatgatctccaatattatcctgaatagtctggacaggaggctttatgtgcttagcaagaacattggcgtgaaatacagtcgatatgcagatgatttggtgttttcaggggaacacatcccccacgaatttgctctcaacgtggtgaagaacattgaggattatggcttcaacatcaacattgttaagtccaggcactacaagtcacaacagagaaaaatgattaccggaatagttgtcggcgatgacaacatccgcctcccgaaggtcaaacgtcgagaaatcaagaaggaggtacattacttaaagaaattcggggtgctggatcaggttaaacggtataacgacatctactacatcgatcgggtgttaggaagactgagtttctggaaacagatcgagccagacaacatctacgttctcaacagcatcaaagaaattaagaagatgtacgaagagttcctgaaatcttga

SEQ ID NO: 9377 - RNA, 1050 nt, unidentified
  source 1..1050: mol_type = other RNA; note = synthetic construct
atgtcatacacaatcaatgattggaagaagactatagagacgtctaatctgtccaaaatcgagaagattgagcggatgcagtatgtagaaagtgccttcaaaaacaaggtccccgtcattatcgacactaaacacctgagccagctactcggactgaagatcggagtgctcacctctatggtccagagcccgtcaagcttctaccgggaatttaagatacctaagaggaaaggtggatatcgcgacattgtcaccccatacaaaagcttgctcgaagtgcagcaatggatagccaaacacattttaagttgcttcgagatacacccttcggcttacgcatatgtgaaaggcaagaatatagcccaaaatgcaaagctccatatcggtagctctgaaatgctcaaaatcgatctaaaggacttctttccatcaatcaaaattccccgcgttcgagaactcttcaagaggctgggctacaacaaggaggtgacttactacctgtccaaattatgctgtctgaaggaacaattaccacagggcgccgcttcctcccccttgatcagcaacattatactgagcaacctggacaagaggctgttcaagttcgcctcgaacaaccaacttatctatagtagatatgcggatgacttggtgttttcaggggacgctatcccatctgactttcggatccttgtggctatgaacatccaggatgaagggttttcccttaatcctgataaaaccatcgaatattctgagaatcagcgaaaactgattacaggcgttgttgtaaagaaggattccattagactgcctaaagatttgaggcgcgagattaaacagcaggcacattatattctgaagtttggcattctcgaccaggtcaagagatacaatgacattttctacgtggatagaatccttgggcgtcttagttattggaaacagatcgagcccaagaacgagtacgtgatcaataccctgaaggagattatcctgatgtacaaagagacaatgaataacatccagaacaacgatgacggagagtga

SEQ ID NO: 9378 - RNA, 1041 nt, unidentified
  source 1..1041: mol_type = other RNA; note = synthetic construct
atggacaacaattataagtacgaagattggaaagagatcattgaatcgtctaatctgccgaacgaagttaaagtggaccggatggatcttgtcaggaatctctataagaacaatgtacccgttatcgtggacctgaaacacctgagcaacctactgggaattaagtacactgtcttggcgtccatgatttttagtacgagttctttttaccgagagttcaaaatccctaaaaagtccggcggtttacgtacaatagttacgccatataaaagcctcttgactgtgcagaaatggatcgtcaaaaacattttgtcccaattcaagatccacgatgacgcttatgcctatgtcaaaaatcgaaatatcgccctgaacgccaaacagcatattgggaacccagaaatgttaaaaattgacctcaaggacttctttcacaccattaaaataccccgcgtcagggagctgttcaacaggctgggttattccaaggaagtcgctggctacctgtcaaatctgtgttgccttaatgaggcacttcctcagggcgcaggctcctctcctatcatatctaacattatcctcagaaccttagataacagactgtcaaatatcgcctctaagtcagagattgtgtattcaagatacgctgatgacctcgtgttcagcgggagcaagattccactcgatttcgaggtagttctgacccagaagataaatgactttggattcaagctcaatctgaagaaaaccaagttctacaagaagggggatcgcaaacttgtgactggagtggtagtgaatagtgatggcattcggctgcccaaaagtaaacgcaagcagatcaagaaggaggtgtactatctgaagaaatacgggatccaggaccaagtgtttagacataacgacgtgttttacattgaccggatcctaggaaagcttagcttttggaagcagatagaacccaagaacgagttcgtgttgacaagcatcatcgagatcaggaatatgtacgataaaaccatgaagaacaacaaggattga

SEQ ID NO: 9379 - RNA, 1158 nt, unidentified
  source 1..1158: mol_type = other RNA; note = synthetic construct
atgattaaggcccctaaaagcttttataggaccttcaaaatcccaaaaaagagaggcggcaccaggacaattgtgaccccgcacaattccctaaaagagatccagcgatggatactggacaatattctgagtcaattcatgattcacgaggctgcctttgcttacgaggttaagaaaaatgtggccatgaatgccagcattcatttagggcaggatgaaatgctcaaaatcgatctcaaggacttttttcccagtatcaagtctcccagaatccgggaactgttcacaagggtgggatattcaaaggaggttagttacttcctcaacgccctgtgctcacttgacggatgtttgccccaaggggcagtcaccagccctaagatcagcaacatcatcctctattaccttgataagaacctgtctaccctgtgccacaataacgaggtgaagtatagccgctacgctgatgacttggtgttctccgcgaacgagctccccattaatcttaaatcaatagtcagctcttccatcatcgagaacggttttgagatcaactacgctaaactgacagaatactcctctgagcagaggaaactcgtgactgggattgtgataaaagagaaaggactgacgctgccaagatcgaagaaactgtcaatcagaaacgacgtgtttttcctcctgaaatatggcatcgaagatcagatccagaaatacaacgacattttttatctggatcgggtacaaggccgcttatcgtactggaagcagatagagccaaacaataagttcgtactggattctattgacaagttgaagtcccttcataaggattacctaaaccaggcactggacaagttgaattttctcaagattcagaagacgaatcctctcaacaattacaaggaatacattcaccaggtcgctttcgttgcctctggtttgaaaatacagatccagatcgaagatctgcgccagagcatgaattacttaggctatcgtactaaaaagggagcaaagtatctaaaaggacgaggctttcatcggcttatagggctgacattcaagtggctggagaagcaaaataagaacgaagaagccgacaaggtcgcgttgactttcattaacgcagacggtagttattcctataaaaaatga

SEQ ID NO: 9380 - RNA, 1047 nt, unidentified
  source 1..1047: mol_type = other RNA; note = synthetic construct
atgaaaaacaactactccattgaggattgggagaaacatattctcgagaacaccgaggcaaatgggttagagcgagtgtactacctggaaactgtgaaaatcgcctatcagaataatgtgcctgtaatcctggacgtcaaccatctcgccaaactgttaggacttaaggtgggcatcgtgaccagcatgatatatggaccccatagcttctaccggacgttcgatattccaaagaagaagggtggcgtacgtaccatagtggcaccgtacacctcactgctgtattgtcaacgttggataagcgatgaaatcctgtccagatttttcgtgcacgacgcagcttatgcctataggcccaatagaaacattgttatgaatgcggagaaacacgtgggccagaagtacatgcttaagcttgatttggttgacttctttggaaatatcactgaaagtcgcgtcaggagtctgtttcaggagaatggctatgacaaggggatgtctttttttctcgctgggctgtgttgcctggatggagtgttgcctcaaggggctgcgacttctccttccatcagcaatatcgtactgaacgaactcgatcacaagttcgattatctgtgcgacaagtatggagtggtctatacccgctacgctgacgacttggtcttctccagtgactctcccctggaccacatcgtggatcacataggggacattattaaaggtgagggcttcacagtaaacatcgaaaagtcgaaaatttacacagccggtgccaataagttagttacaggcttggcagttcaggaagaccgggtgcggctgccaaaacggaaacgcagaaagatcaggcaggaagtgtactttgttaagaagaacggtatcatgaaggaggtcgaaagatcttcagatttgtttgccctagagcgagtcctgggcaaactttacttctggaagcaggtcgagcccaacaacgaatacgtgctcggggagattctggaactaaagaaaatgcgaaaagagctcctcaggagccttacatcatcctga

SEQ ID NO: 9381 - RNA, 1050 nt, unidentified
  source 1..1050: mol_type = other RNA; note = synthetic construct
atgattaaatggagtgagaagttggcatccaatactagtaaacccaccgagttaacagaggcattgatcaagtactccaaaaagttggaaaaacagggttttcctgtgatttttgatcttgcccatctcgcgctgatactcggcatcgagaagttgacccttgcctctatcgtaaattcatcctctaagttctaccggagttttaaaatccctaagcgtcggcacaatacatttcgagagattaattccccctaccctgtgctaaagaagatccaagactggattaaagttgaaatcctggagaaaatcgaaatgtctcaccactgctatagctatcggaaaaatgtttccatcatagacaatgccagcgtccatctcggtaacgaagtgctgtataaactggacctggtggacttttttgacaacattaaagaggacagaatcctcagtatattcctgaactgtggctattcatataaagtcagctatttccttacctcactgtgtcttctgacgacaaagctaccacagggagcttcaacctctccgataatttcgaacataatcgctaagaggctggataagagactgtccgccctttgcagcaaatacaaaattaactatagccgctactctgatgatattactatctccggcaaattcgtaccaccattcctgcgactgatcattaagaacataatcgctgatgaggattttatcgtgaaccagaataaagagatcctcatcaatggactcaacaagaagaagatagtgaccgggatctcaattacaaacaacgttctgaagattccacgcgaaagcaagagaatcatcaaacaggaagtgttcaagttcctgaagtacgactttatgattaatcccaatgaacaggagttcgatccttacttcactgagaggctcatcggaaagctgaattactggattaatgtggaaaaggggaacgagaaccccattttcttattgcgcagtgtcattgagaaaaacaagttattcatgagcaggattatccaagaagactttaactcttga

SEQ ID NO: 9382 - RNA, 945 nt, unidentified
  source 1..945: mol_type = other RNA; note = synthetic construct
atgaacgagatttatcccaacattaagtcaattagggacctgagcatagccacagaaatcccaattaagaagatcgcgggaatgatctttagttccgagaaccactatagaattttcagcctccctaaacgcaattcagacggggtgagggtgatccattctccctatcccaatttatataaagtccagcgattcatcctggagcagattctcagaaacgtcgatggcaacaattattgctacagttacaaatcaggcgtgtccataaaggacaacgcaatgaggcatataggaaccaaagtgttctacaaaatagatctcgagaactttttcgagaacatcggttttaaaaaggtgattcgtgtctttaggaattgtggctacagcgatggtgtgtcttatatgctcacaaagctgtgcttgtgcaataacgggatcccccaaggagctcctacatccccattgttgagcaatattgtaaccagtaagcttgacaagcggctgagcggattatcgaccaaggaaaatttaacttactctcggtacgccgatgatctatttttctccggggaatacatctcaactaaatgtcgggaactgatcaaaacgattgtggaacaggagggcctaatcgtcaataacaaaaaggagctgttggtgatcggctaccacaagaaaaaaatcgttaccggtctgtccgtcactgagaagaatatttctctgacacgcaattacaagagagagctgcgacttaacgtgtataaatacctgaagtacaaccacaaggttaatccttataacgttgacttcgatcctctttacaaggagaaactcctggggcagctgtatttttggaaattcatcgaagaggacaatgaaatcccgaatattcttatcgaaaaggtacgcaacaaggaaattatatatccagacctggagctctga

SEQ ID NO: 9383 - RNA, 1053 nt, unidentified
  source 1..1053: mol_type = other RNA; note = synthetic construct
atgaagctgagttcaggatcagattggagaaaatactttgaggaaatcgggctggagagcgctcgtagcgcggaactgtgtagatatgctgccaccctggccgattcatctctccccgtgattttttccttcgagcatttggctgcgctcctggggcggactagacatcacctcgcgtccattatcttcgcctcagaacaccactacaggtcctttgatctaatcaaaaggagaggaggtactcggttaatagaggccccctacccttcacttttggagtgccagagatggatcctgaagaacattctgctgaagattcctacctcgaataatgtacattcttacctacacggcaaaaacataaaaacaaacgcactcgtacacgtcggggagaacagcatcctgaagatggacttacgaaatttctttcatagcatagagatgacccgcgtgcttaaactgttcgaaagtttggggtatgctccggagatagcctatttcctggccaaactgtgcgtgttgagggaccgacttccacaaggcgcagcaacttcccctatgctatctaatatcatcgcaagtacactcgactctaggctgaactctcttgctaagtcgcagaatctgaagtattctaggtacgccgatgacttagttttctccggcaacgatatttctccggcctttgtgggcgaaattcgcagcatttgtgaaggtgagggattctatgttaatgaggaaaagacgaagctcaaaacagggtccagccgtaagatcatcacgggcttgatcgtcggtgagaagaaggtcagcctgccacgaacatacaagcgcgaggtgcgccagcaggtgtattacattatcaagatgggccccctcgaatacctcaaaagaaatcgcctttcccctaccgcacttagtagtctggctggacggctggccttctggaacagcatcgaaccagacaacccatttgttcgggaatccttgcccattctgatgcggctcatgagcggagagcaaaatgagactcggaggataaaaaacacctga

SEQ ID NO: 9384 - RNA, 1041 nt, unidentified
  source 1..1041: mol_type = other RNA; note = synthetic construct
atgaagccctccgaaagcatcagcaagtggcatgatctccttaaggctgcgcctctgaacgaggatttgaaggacgctttgagcctctacatcagaagcatcatcaagagcgggtttccagttatcctaaatgtagaacacctgtcacatctagtgaggatagagtatatctttcttaagcgtatgatgaactcaagtgagtctttttactacgagttcgaaatccccaaacgaaggggagggaaacgtgtgattgaaaagccttatcccacactcatccttgtccagaaatggatcctccggcatatcctgcaaaaaaaggccgtacacaggtccgcctttggctttgtcaagggtaagagcatgattgataatgctaagtgtcacatcaacgggaagagcctgctgacaatcgatttaaaagacttcttccctaacattaagcttcctagagttatttccctctttcagagaattggatacccgtatcacatttcatacattctggcatccctgtgcgtcaagaatggccgcttaccgcagggagcacccaccagtccatacatatctaatctcgtgacccataaactggacagtcggttagacaagctgtgcgacaaattcgacatttgctatactcgctatgccgatgacatggctttctcgggcggcacaataaacctgactttcgtgaacttggtccggtctataattgccgatgaggggttcatcgtgaatgagggaaaagtgaaactcatccacggtttcgacaaacggaaaattattaccggcgtttccatatcctctaagaaaacaacgataccaaaatcaaccaagcgaaagtggaagctggaattgttttatctcattaagaacggcctggatgcccaaatgaaagtcctaaggatcaatgacccactgtaccttgaccgctgtattggtaagctgaatttctggctgcaggtggaacccgataacaaatttgccagagcatctttggatactgtgaccgagatgaagaaactgcgcagtatcgagtga

SEQ ID NO: 9385 - RNA, 1032 nt, unidentified
  source 1..1032: mol_type = other RNA; note = synthetic construct
atgaatcgggattattggatcgaatatatcaacctgaacatccaggacgaggagaagagacttatttactacgaactgctaaataggctcatagaaaacagcctgccaatcctcttaaagtttgagaacttcgaatttctgttcaagatcaagaaggaaatcttggcactcatttataaggacagtaggaagttttaccgcaccttcacaatccccaagaggaacggatcgcttcgtttcatacaaagccccctcccactactgcagtacattcagagatacattctcgacgagatcctgtctaaaataattacgcataacaacgcattcggcttcgtaaagcataaatcaatagttgacaacgtgaagcctcacttgaattcccacaccttactaaaactggacattgacaacttcttcccctctatcaagataaaacgtgttatcagcatctttcagagattaggttacagtaatcggatttccttcctgctggctaaattttgctgttacgatgactcacttccacagggtgctcctactagcccttatctcagcaatatcatcgcaaaacggctggactctaggttgtataatttggcgaaagagcaccatctgaaatattctcgatacgccgatgatatgacattttcgggcaatcacatctccaagaatttcatcgattttgcttacaagatcctcattgacgaagggttcacaccaaactacactaagagtaaacttattgtgggccgcggacggaagattattactgggctgtccatatccaacaaaaagattaccattcctcgcaacaaaaagcgcgagttgagatccaaagcctattcagtgctgtcaagcgatgccaagtacaaaatcaattacgccgctatcgacgatcccatctttgtcgagcgactgattgggcagttttctttctggaattttgtggagccggataacctgtatgccgtcaatacccttaagctgctcaaagaatatagtagccaactggataatttgatagagtga

SEQ ID NO: 9386 - RNA, 1044 nt, unidentified
  source 1..1044: mol_type = other RNA; note = synthetic construct
atgagaatcctgaatacaatcgaatcatgggaagcctacttcgaggacgtttgtcttcgcgaggatattgccgccgcccacctgaagattatctcagcccagttgaaaagcggtgtgccagtcatatttgatgtcgagcatctgagcctcctactgggagtctcttccacgtatctggcgtcggccgtatccgtgccccggtatcactacagagactttgcaattcctaagaagagaggaggcgtacggaccatttccgcccctagagcggcgttaaaaggcgtgcagcgctggattctggacaatatactcaactgcttccttcctcataaatgtgcattcgggttcagagctaagaagagcattctcaatcacgcccgtacccattgtactgctgggagaatattgaagttggatgtagccgagttttttccctctatcaaactggatcgggttatcggcctgtttaagagctttgggtacacccccggcgtggcttttactctcgcctctctgtgctgcctagaccgccagttgccgcaaggtgcaccaacatcgcccgccatcagtaatctggtttgccggaggcttgacaaccgactgcacgccttcgcatccaagaacaggttcaggtacagtcgatacgctgatgatattgcgctctcaggacgcgacctgaactccagtgtgattcagatcataagaggcatcctcgcagaagaagggttcgctctgagggacgataaaacccgtatctatggcgtgcactcaaaacggatcttaacaggtcttagcgcttccctcgacggcgtgaagctgccaagggaggatcgccgccaactgaggtctgtgtgccatcagattcggaagttcggatttctgagctacttggctaacaataaaatcagggacccaatgtttctcgcccgattaataggacggttctctttctggtgttatatcgagcctgagaacgctttcgctagcgaagccctagcacacctgaggggggtcgagagacagtttcttgcagcaaggagttga

SEQ ID NO: 9387 - RNA, 1017 nt, unidentified
  source 1..1017: mol_type = other RNA; note = synthetic construct
atgagagcactcacctctctagattcctggattgactatttcaaggatgttggactgtctgacgatgtggtcgagaagcacgcccggtatgtgggggagctgcttgccaggagcttgcccgtgatattcgatgtccagcacctgtgcctcctgctgggtgtaagcgagcgcttcgccgctgtggtactcaacgcttcacaaagttcttatagggagtttaagatcccgaaaagaagcggcggcagccggacaatcatcgcacctcggcgtgcccttaaagactgtcagaggtggattctggacaacattttagcacgtgtaggtgtgcacgccgctgctaaaggattcgttcagcgtagatccacaaagtcgcactgtagacctcacctcggcagggagtctctcttgaagttggactttcaggatttctttccctccataaagaagcgacgcgtcatcgcactgtttagatctatggggtactcagatagtgtgagcctgtacttagccgccttctgctgctttggtgaggtactaccacagggcggagtcacctcgcctgccatttctaatttaatatgtcggagactcgatgcaagactgtccgctctggcctcaagtaaacggtggcgctacagccgctatgctgacgacctggtcctgtccggcaggaatctgaattacgcagtggtgggcattgtggccaaaatcgctaaggaggaagggttccgacttaatgacggtaagactcggctatatcggggggaagcacgacccatcgtgaccggactggtgcttggagaatccgccctggcggtgccacgaacatttaaaagggaggtggtcaaacaagctcattacgtccttacttacggcgttctgagccatagtgccaagaccaaatccaggaacccatacctcgttcccacgttgctcgggaagctcaactattggatccatattgaacctgaaaaccagagagcggttaggctgcgcgaccgcttgtcagcgctttga

SEQ ID NO: 9388 - RNA, 1059 nt, unidentified
  source 1..1059: mol_type = other RNA; note = synthetic construct
atgaatgcttatgaaggcatgccagccagtatacctggactgcgcgtctggaggaagtattttgaagatcgagggctttcatctgaggtcgtggagctgtacatgggatatattgcgcctctataccgccgcaggctgcctgtgatctttgagtgggaacatttagggaagctgctgggaagaacgccacactacctggcaacagcgatcgcatcacccgctgctttttatcggacattccgtattccgaagaaatgcggcgggttcagggaaattcaggctccacacagatccctgctcgactgccagcggtggattgttgagaacatactcaagagggtacccgcccacgagtgtgcaatcggatatgtccaagggaagagcattatcgattacgtcaccccccacctccagtccgccgatatcttcgtaaccgatatttccgactttttccccagcatcaaaatccagagagtgatcggcctttttcaagggtttggctactccaattctgtttcgtacgccctggccagtatctgttgtttgggtggtgccctaccacaaggcgctcccacttctccttatctttctaacttgatctgcaagcatatggacaaaagattgtccggctacgcccgcaagcagaacatgatttatacccggtatgccgacgacatatgttttagcagccaggccatacggagcgtgaacaaaaatacaattcggcgtataatcttcgagtccgggttcagtgttaacaatctgaaaactcgaacttacatcggtaactcaacatcaaaaattgtggccggcatcaatttgagtggaggcaaaagaaccctccccaaagatttcacgaggccgttactgaccgaagtgtactacatcgaaaagttcggatatattagccaccgcaagaaaaagaagataaaggaccctctgcatcttatgcggctcctcgggagagcagcttactggaggtgggtggatccaggttctgagaaggcacagtactgctatggactgctggctggcatcttacgagagattgcgatttga

SEQ ID NO: 9389 - RNA, 1053 nt, unidentified
  source 1..1053: mol_type = other RNA; note = synthetic construct
atgtatgattttgtgccagctccccttcctagcctgcataaatggcggaagttttttatctcaaggggagtgcctgaacctcgtatccaggagctactcatttacattaagccgctcgtgaagaaccgagttccagtaattttcaatctagaacacctcgggagattgctcggccgaaaaaccgggtatctcgccaaaatcataaatagcaacgagcatttctacaggagtttccaaattccaaagaaaaatggagcccacaggatcattaatgctccctacccttcacttctggaatgtcagagatggataaacgataatatcttgagcatcgtgaagatacacgattgcgccaaagggtacctgaagaacactagtattatcgaccatgttgagccccacctgggaaacaacgtcgtgctccttttagacctgaaagacttcttcccaaatatcacaatcaatcggattatacccgtcttcagaaatctcggttactctcagcaggtcagcctggcattgagcaaaatatgtaccctcaatgacatccttcctcagggagctgcttccagtcccagcctgtccaacatcatttgcaaccgtctggacaagaggatagcatgttatagtgagaaaaacgacatcaactacacacggtatgccgatgatttatgcttttcttctaaacacatcgagccccacaagattaagatgatcctgaagatcatcaatagcgaaggctttctgattaactcctccaagtatagactgctgggcccgcagtcttcccagaaaataatcaccgggattaatatctcaaacggcgcaatgaagatctctaatacgtataaacgcgagctatccctggccatgtactgcattaaaaagtttggtattcgctctcatcttcaaaagttaaagattcgggatacctactatttggactcgttgtatggcaagattaattactggctgaacatcgaatcgacaaacaaaaaggcgaaattctacaagatgttcgtgcgctcactgatgcaaacttacgagccatga

SEQ ID NO: 9390 - RNA, 1059 nt, unidentified
  source 1..1059: mol_type = other RNA; note = synthetic construct
atgaaacgttcgcttacacaggtctgggagagttacttcgaggagattggcctggacactgagctgagcgcaaaatacattccctacatcgctcgatgcgcagacgctaagatacctcctatctttgagcaggaccatctggcacaactcttgggtcttgagctccccatgatgttatctatggttttcggcaccaaaagcttctaccggtcctttagcattcctaagcggagcggaggacggcgggaaattgtggctccttatccgagcctgctggaagcccagagatggattgcggaaaatatactggactcagtcaaggtgtcagtttgtgctaccggtttcaggagaggcaaatccattctcgataatgcccgactgcattgtgagcgagatcagattctcaagatcgacatcaaagacttctttccgtcgattagcttccagaggatcatgagggtgttcaccagcataggctacccaaacgaggtcgcctatcttctgtccaagatctgcaccctcggggatagtttgccacagggcgccgcaacgtctcctacactttctaatatagtctgccgcaggatggacgttagattttataaggtctgcaaaaggcacagactgcggtacacccgctatgccgatgatatcgccgtatccgggaagtctataccatctgggattgcccgtttattctttgagatcatcgaagatgaagggtttgaggtgaaccagcaaaaggtgcgatttctcggaaaggctgatcgcaaaatcatcacgggattggacatcacatccggggtgcccagagtaccacggaagttcagacgcgagctaaagaaggatgtgtattttgtatggagtgccggtttgtcaactcacgtgtcccgcagaaaaatcttcaacccccagtacattgaccacctaatgggaaggattgaattctggcgtcaagtcgaacccgaatgtgtgcagctggcgactgtgcagcgcagggttaacgagatcgtgagtcagcaaaaatcctattcaggcacatctaagtttcagctgtga

SEQ ID NO: 9391 - RNA, 1038 nt, unidentified
  source 1..1038: mol_type = other RNA; note = synthetic construct
atgaacgacaacctactgtacaagtggcaccagtatttcgaggacatcgggctgagatcggacctggtacgcagctacacaccctacatccggagatgtatttccaacggcgtaccacccatatttgagagcagtcacttagctgttttggtcgggaggaaccctgctgacctgtcagcaatgggatttggagccaagtcttattaccgcagcttcaaaatcagaaaaagatccggcggacttcgggagatccaggcaccctacccctccttattagaagtgcaaaggtggatcgttggcgaagttctaagttcagtcaggcttccggtttgcagtactggataccgggagggggtgagcattctggataatgctctggtgcattgcggccgcaaggaggttctgaaaatcgacctgaaggacttctttccatcaattggattttctcgtgtggtgaaggtgttcattgactttggctatccatctaacgtggcctttttgctcgcgaatctctgtacccttgatagaaaacttccgcaaggcgccgcttcctctcccctgctttcgaacattatctgccgcgacctcgatcagcgcattatgaagatttgtaaatcccgtaggttgagatacacaaggtacgcggatgatatcgtcatcagtggcaaggccatacctaaaggcatacggcgactctttttcgaagtcattgccagcgagggtttccaggtgaatgagaagaaagtccgatttctgtgcgagggtgataagaaaatcgtgacggggctggatatcaccagcgggaagcctcggccaactcggcaattccgcagagatctgaaacgagacgtgtatttcgtctggtctagcgggctgtcctcacacgtggcacggaggaggattttcttccctaattatatagagcagttggaaggtagagcccgtttttgggaacatatcgaacctgacaatgtacagatgaagaagaccatggagcgagtcgtggaactcaggaagctctatggacgccagcggtga

SEQ ID NO: 9392 - RNA, 1032 nt, unidentified
  source 1..1032: mol_type = other RNA; note = synthetic construct
atgaatcagaattcgatccagcaatggagctcatatctggaagacataggtatctatcccgatcttagggagcagtacatcgagtacgtaaaaaaatgcgtgaggtttggagtccctcctatatttgaacggacacaccttagtatgctgactggacgccacctcggggacctgatgtccatgattttcgccaccgagaagttctaccgcgagtttaagctgagaaaacggtctggcggttatcgacggatactcgccccctacccctccctgctggaagtccagcaatggattaaggacaacattctgtccaagtacgagttgcagaactgtgtcaccggatttcgtgacggatattcaatcgttgataatgcacgaatgcactgcgggagagacattctaatcaagattgacattagagacttcttcccgtcaattaacttcaaccaaatcatgggagtgtttcataaagccggctacgcgaataacgtttgcttttatctctcccgtttgacgactcttgacaatcagttacctcagggggcagccacttctccatctttatccaatatagtttgtcggaacatggataagcggttcctgctgttgagcaaaaaccacagacttcgctatacacgctacgccgatgacatcagcatttctggtaagcatatttctgatgggatgatcagactgttcttcgagatagtggaatcagaaggctttcgaattaataccgacaaattcaggatcctgaatgctaacgacaaaaagatcgtgacaggcctcgatatttccagtggccgaccacgggtaaccagagagttcaggagggatctccagcgggatatctattttgtctggagccaaggcctggctgctcatattgcacgtaggcgcatctttttcccaaattacgtggatcacctcacagggcgcgtgaacttttggaggagcgtggagcccgaaagcgctcagttgaaaaaggtgatcaacagactaaagatcatcaggagtcagtacatgatatga

SEQ ID NO: 9393 - RNA, 1047 nt, unidentified
  source 1..1047: mol_type = other RNA; note = synthetic construct
atggcaactattccttatcagcgcgaacatctgtcacgctggaaagcctatctctcagacataggggttcgcgacgacctcaaggctatttacctttttcacgtgaaaaagagcctggagaagggggtgccacctatctttgaacacgagcagctagctctgttgttggggattgatgtcgcccatctcatgaggatgctgtttggtcaaaaatccttctacagagaatttagtctcaaaaaaaggtctggtggatacaggactatcagagcccccctgccaacattactggagtgccagagatggattaacagcaatatcttatctgctgtgcaactggcgcagcctgcaatgggttttagggaaagacattctatagtcgataacgcccgcattcactgtggccgggaggagctctacaaaattgacctcaaggacttcttcccgagtatcggctttcggagagtgatgggggccttcgtgtcccttaactatccaaaacatgtggcgttctttctgtccacaatctgtacagtcgatgatgaactgccccagggcgccgctacaagtcccactttgtcgaatattatctgtaacaggctggacatgagattgcgagcaatatgccgcaaacgaaagctccgttatacgaggtacgccgacgacatcaccatctctggaaacaagatcaccgatgagcttaagtggatcgttcacaagattgtagaagatgaaggattcgtgataaatcgagagaagatccggcacgtgttcgcaggagagaaaaagattgtaaccggcttagacattaccagcggcgtcgtcagaatcccccggcagtacaggcgcgaggtaatgaaggatgtgtatttcgtttggtcctcaggcctgagcaaccacatggccaagaatcgtgctttcgagccgaattatatcgctcagctggcagggcggctgcagttttggaaacatgtggagccagaaaatcctcagatgctgaagtgccttaagcggttcaaatccgttatgctaagctaccaaaagtga

SEQ ID NO: 9394 - RNA, 1035 nt, unidentified
  source 1..1035: mol_type = other RNA; note = synthetic construct
atgtctaaatccagtgttgagaaatgggaggcctacttttccgatctgggcattaaccaggattacattcgggaatacatcgactatgcaggacctatgcttagggctggcgtgcccccaatatttgaggatgtacacttatcactgctaatcggtagggatctgggcaccttgtacgccatggttttcgggacaggaaaattttatcggagcttcaccattagaaagcgccgtggcggtaagagactgattcagtccccatacccctccatgctggagtgtcaaaaatggatatccgagcacatccttcagaaatctcaagtgtcgaggtgtgccacaggcttcagacggaatcaaagtatcttgcggaatgcatctctgcactgcaaacgggacgtcctcctgaagctagacatcaaggatttttttcccagtatctcagtgaatcgcgtgatagacatctttaacagctttggcttccctccaaatatttctttcctgctcggaaggctgtgcactctcaacgggagattaccccagggggcagcgacttctcctatcgtgtcaaacattatttgcaagcagatggacgaccgcctctatagcctctgcttgagcaagaaccttagatatacccgttatgctgatgacattgccatctcgggagtgcagatcgaggtgggaacaaactacttaatacgagagatcatcaacgcggaagggttcctgatcaacgaagaaaaaacacgcatttgtggacctagggacaaaaagattgtcacgggcctggacatcaccgccggtaaaccaagactcactcgatcctaccgcagagaacttcagcgggatgtctatttcgtttggagcgcagggctggccagccatttgtctaagcgcaagatattcaatcccaattacatggaacatctgcagggtaagatcgctttctgggagtcaattgagccggaaagtgctcagatgaagaagtgtaaggatcgagtaagcaagattaggaggctcatgaataaaatgtga

SEQ ID NO: 9395 - RNA, 957 nt, unidentified
  source 1..957: mol_type = other RNA; note = synthetic construct
atggcgtatgtggagccccttgtgagaaatagggtgcctgtgatctttggattcaagtccctctccgatcttctgggaatcgaggagagcaccctgagctccattattaacagcagctcttcattttacaggagtttcaagatcccgaagagatcgggcggacgacggcagattgatgctccataccccagcctcctgcattgccaacgttggatcgcacagaccattctaccctcttgtaaggtgtcatctgtagcacacgcttatctgcctgagaggagtatcctcacgaacgcaagagttcactgcggcgcacagttcctcctcaagatggactttaaagacttctttccatctatctccgagagaaggcttgtcggcctgttttctagcttagggtattcaactctggtatcggtctatctggcgaagatctgtacattgaaaggcgccacccctcaagggtcacctgcatccccaatgttgtcaaatgttgtggcccggcgcttcgatctgagattggtgggttatgctcggagtcgaggcctgaagtatactcggtacgccgacgacatagccatcagcggagaaatggatgccgacgaagtgcagagtttcgttacaacttgtgctgtatccgagggattccgcattaatcataagaaaacacgctacgtcgagagtggtcagaaaatggtcgtgacaggcctggatataagcaccgggacgccacggccgaccagaaaatttaggcgcgaggtggaaaaggacgtcttttacatatggcggtatggtgtggccgggcatgttaacgctgaaaaaatttacgatccctcttacattcttcgcctgaaagggaagctggatttctgggcccagatcgaacccgaccacccacgactcgtccgttgccgagaaaggttcttgtccgctgcccccgactacttacctctatga

SEQ ID NO: 9396 - RNA, 1152 nt, unidentified
  source 1..1152: mol_type = other RNA; note = synthetic construct
atgaatgatgtggatgagaaagtgtccccgccgccaatgagcattgatctggagcaatgggccgcattttttcttgataaagcaaaaggcaaccagcagctcatctcggggtatttgcattttcttaagcactgtaagcagaaggacatccctccaatttttgaggataatcacctatcccagctgctgggaatcaacatccgggacctcgccttctatctgtctggtgcccagggtcgttaccgaagctttcacatacctaaaagaaaggggggtgtgcggttgatcaatacccccactcctctgctgctccatattcaacagtggattctctcaaagattctgtacaaactccctgtgagcgaattcgctcatggcggggtgcccggaaggtccatcttctccaatgccaaagcccacctcggcgccagatgcgtgctcagaattgatctgaagggattctttgacacagtccctctggcgcttgggatctctatcttcagagctgctggttacagtcctaacgtcagccgttcactggctctcctgtgcttcgagaatggctgtcttccccagggagcagccacgagtagcaccctggccaacctggcagccaacagcttagacaagaggctctcagcattggctaaaaagtatggactgtcttatacacggtacgtagacgacctgacattcagtggcaggtccatcggcccaagattcgccatagcagtcaaaagtattgtggaacaatgccgctttgtggtgaacccccgcaagacccagcttatgagagggtctagcccaaaattcgtaacaggcttagccgttggaggccagaccttgagggtcccacgcgcttttcgacggaatgtgaagaaccaggcattccaactggtgaagaggggcgttgctggacaccttttggctactggggataatgatcctctaattctcgaacgcgttgctgggaaactggccttctggttgcaggcggaaccagaatcaaagaccgcgcggcaactatgtgcggcattagccgagtaccgaaagactgttgacactgatgtctctttaccgcagcccaggcgcatagtacccatcaactaccccgacgagctgttttccgacatagacctgtttacgacctga

SEQ ID NO: 9397 - RNA, 1140 nt, unidentified
  source 1..1140: mol_type = other RNA; note = synthetic construct
atgaattatgttaaccttaaagtcagtcccccaattatgccgatcagcgtcgaagactggcgggccttcttctctctgtcagtcaaacgcgattctaaactggtggaagggtatataaggttcattgaactctgcgaaaacaagggccttccacccatcttcgaggagcgtcacctggctcatctgattggaatcccatactccaacatggcctattttttttctgtggcatccggacgctaccggacatttaccatcccaaagaggcgaggcggcagaagggaaataaatgtgcctacgcccctgctgttggctatccagcaatggattctccataacatcctatacaagctgccaatgtctgagtttgctcatggtggcgtaccaggccggagcatcctctccaatgcccgtgctcaccttggggccaaagccgtcctgagagtggaccttaaacagtttttcgattcagtggaatttccgattggaatccccattttcgaagccgcaggctatagtcccaagatgtccaagagcctcgcgttactgtgctttgagaatgggcgactccctcaaggggctgccacctctagcacactggccaacctggcggccatcagcctggatattcgcttgtccaaactcgccaataagttcgagttgacttacaccagatacgtggacgacttgaccttctcaggtcggtcgattggccccgggttcatctcagctgttgagggagtggtggaacagtgtcggttcgtggttaacgccgaaaagacccagctggcaagaggaaagtcccccaaattcgtaacgggtctggcagtaggtggagatcgactccggatacctcgcgcatttcggagggaggtgaggaatcaggcttttcagatcactagacgtggggtccagaatcacctcgaggccatcgaaagtagtgaccctttgatcattgagaaggttcttggccaattagcgttttggctacaggtggagccagagagcgcaatggctcgcaagctgttcgcaaacctgtcgttataccgaaggactgtcagcacagacactctgctacctcctcccagaaggataatacagatcggcacaatgcctattgatgagagacgcaaagagtga

SEQ ID NO: 9398 - RNA, 1104 nt, unidentified
  source 1..1104: mol_type = other RNA; note = synthetic construct
atgagcgacaccgccgaacagtggcgagcattcttccaggagcacgtcaagcaggacacggccctggtgagagggtatctcgctttcattgaccagtgcattgtacggaatctgcctatcatcttcgaagagaggcatctgagccggctgatcggcgtcgactaccgggatatggccttttatttcacttcatctggggggcgatataggcaattcagaatacccaagaggctcgggggtactagggaaatcaacgtgccatcacccctcctgctagccattcaacagtggatacttcgaaacgtgctgtacaaactgccgatcacagatgccgctcacggaggtgtacccggacgttccattatcacgaacgccggtggacatttgggggctaggtcagtgctaaagatggatttacgaggcttctttgataccatattgctccctagaggtgtggctatttttgagtctgctggctacagtcctcatttgtctcgtagcctggctctgctctgttttgagggcgggagactccctcaaggagccgcaactagccccgcgcttgcaaatcttgcagcggtcgctctcgacgggagacttgaagccctggcacagaaatttggtttaatatactccaggtacgttgacgatttgacatttagcgggcattcaattggcgtgagattttccgcgatcgttcaggatattgttgaggacactggctttgtagttaattccgataaaacccggctgatgcgcggacagtcgccgaagttcgtgacaggactggctgtcggaggaggccgcttaagggtgcccagagcattcaagcgcgacgtgcggaaccgcgcattccagctggccaaacgtggcgtggagaggcaccttgaagccaccgagtcttccgacccactggtcctggagcaggtgaccggccaactggccttctggctacaggtcgagccagaaagcaagactgcccggcagctgtttgatgccttgaccgaatatcgcagaggcatgacaacaagtgtgaaactccctgacccacgccgggtcgctagtatcgacgattcccactggcgggttatccgcgatcactga

SEQ ID NO: 9399 - RNA, 1119 nt, unidentified
  source 1..1119: mol_type = other RNA; note = synthetic construct
atggacatggtagttgaggactggagtagcttttttagtaaggaaattggaaagggaagcaatctacgcggtagatcgcgaattctggtggacggctatatggcatttatcaaacactgcgccgatctcggggtgccacctatattcgagaatacacacctccgcttactgcttggcctggacgcggcccattttggggccttgcttaccgagcatccagggcggtatcgtaaattcaccatcccgaaaagaagcggtggcgaaagagtgatttcatctccaaacccggccttactccacgttcagaagtggatcttgcggcaaattctggacaacgccgaagtctctgatttcgcacacggcggaattgagggccgaagcatagttactaacgctagggagcacctgggggctgaagccctgttaaagctcgatatcgccgacttttacggctctgttgggttcggattcgggatctcgaccttccagaggttcggataccccagaaacgtggctctttctttgacacagttttgtttcgatggcggatctttgcctcagggtgcagcaacatccgcttcccttgcaaatctgtcatgtagactgctcgatcgtcgctgccatggcctggccaagaagtacaacctgacctatagtcggtactttgacgacatctcattttctgggtccttcataaatgaaagactggtggaaatcgtctccgaaatcgcaatggagagcggttttgaactgaacaagcgcaaaactcggcttctcctgggaaagagtactaagtatgtgaccggcatctccgtgggcggtgacaggctacgactgcccaaaaaaacaaggcgcgctattcgtaatagcgcctacctgttaacgaagactggggacgtgcaaggattcgccgagagcgcgaaagatcctctgatcattgaaaccgtcctgggccaggtagcgttttggcggcatgtcgaacctgaggacgatgtcgctgaggagctcttccaggcccttgtagagctcaggcgggagacggatgtgcccgtggaactccctgctccatggaggccctcccccataccagagttggatctagagaaagtgtcagattga

SEQ ID NO: 9400 - RNA, 1104 nt, unidentified
  source 1..1104: mol_type = other RNA; note = synthetic construct
atgtcagaatctagcagtgaaatcgccctaaagtggttgaccctgtgggatgagaagattcgacacaggaagtggttattcgactcttattcccggtatgtaggcaatctcgtcaggaatgggtttcccccagtgttcgagatgagacactttgcagcacttgtgggactggaggagacaacaatagcttggatgctagaaaaaaacgcgggattttaccgcaccctccagattccaaaaagactggggggtgtgcgagagatttcggctccgagccctaccttactgcatgtacagcggtggatcctccgaaatatcctggacaaagtgaaaccgcatgactgctgttatggatacataccccagaagtcagctattgagaatgccaagcaacacctgggcagcaaaacagtgttgaagatggatctggccaacttctttcctagtattgaactgcgtcgaggaatcgcgatcttccgcgccatcggatacaccggccgggtttcttactgcctggcactcctgtgcttcaaagatggcaaacttccacaggggggcgctgcatccccatctatttctaacatagtcggcaaacgcatggacctgaggctcagtactcttgccagcagaaataatctgcgctacactaggtacgccgatgatatgacgttctccggggatgaaatcagctggaagtttgtggctgccgtggagctgatcgcccgtgaagagggcttctgtgttaaccgggagaagacccgtttgatcagggagggaagagcaaaggtcatcactggtgtttcaattagcagtggggaggctcggctacctagacgcacagtgagagatattaagaacgaagcgtacaacatacttcggaacggcctcgagcagcacgctgagaggacccataattttgaccccatcgccattgaaaggctgctcggtagaatcaacttctggttgcaagtcgaacctacgaaccagactgcattgaattataggtatcggctgctcgagtatcagaagtttctggacgcccacggcctgggtttgcccgaagacagatccgaccgctcccttatattagggggaccctcatga

SEQ ID NO: 9401 - RNA, 1086 nt, unidentified
  source 1..1086: mol_type = other RNA; note = synthetic construct
atgaccgatagcattcgaacaatcgcatcaaactttcaggtggacgttcgtcagtggcagagtttcttcgaggaaaatggatccagaaggaaaagactgatcgccggctaccttcacttcatcgaagagatggcgtcccggggccttccacccatcttcgagggcagccatctcggaaaactgctaggaactacccctgttgaatttggccggctgacgagtgcacccgaacaccactacagatcttttaccataccaaagcggtcaggggacgaaaggactatcctcgctcccacccccctgcttctgcattgccagaggtgggtcgacgcttttatcctccgtaagttcccgacacactccgcagcccatgggtacgtggtaggccggtctaatatcacgaacgctcgagtgcatataggcaatgcccagattctctgtttggacattgcgaattttttcgagagtgtcggggtcaaaaagataaccgagattttctatgaagctggttatccacctaatgtggccttcctgctggccaggttatgctcctatatgggccaccttcctcagggaggggcctcttccccacaactaagcaacattgtgatgcgtgatttcgacgctaccatgcaaacttttgcagagaagagggggctcaggtttagccgatacgttgacgacattgcattatcaggtgatcgagtgagtgatcaggatatacaagctgtggaggaggcactggaagagacaggtttaacactgaacccccataaaatcagattccagcgcggacgcaagaaaatcgtgactgggattagcattggcagcggacgcatgttgctccctagagagctgcgcagacggtttcgcaaccaagcttttctggccctgaaaaacctggccgatgcggtggatgccgaccctattgcccttgagcgccacttgggtcggttcgcctattggaaatctgtcgaaccggataataagagggtacagatggtcttcgacagattgaatgagttgaagaacatcctggttaagcgggacacatcgctgtcagacaaggatggctttctctcttga

SEQ ID NO: 9402 - RNA, 1038 nt, unidentified
  source 1..1038: mol_type = other RNA; note = synthetic construct
atgattgactccattaggaccatagcttccaattttcggatagacgtgaatgattggcgcagctttttcgagattcacggagggaggcagaagcgcttgatagcaggttatctggccttcgtggaagagatggccacacacggcctcccgcccattttcgaggggcgacatcttaggaaactactcggagccacacaggctgaatttggatcgatgacgtctaatcctgagagtcattaccggagctttacaatccctaagagaaatgggggtgagcggaccatccttaccccaactcccctgctgctatactgccagagatggatcgatctttttatcctgcggaagatccccgtgcatgatgccgcacacggctacatcgccggacgttcaaatataagcaacgcgaaaatccatctgggctccgcccaactgttgtctgtcgacatcagcaactttttcgagaacgtgaacgctggcaaggttgcatacgtgttccagtccgctggatatcctccggccgtcgtcttcttgctgaccagactttgcacctataagggccacttgccacagggggctgccagttcaccccagttgtccaacctcgtgatgagagggtttgatgagactctgcagtcatacgcaaacgtccgcggcttaaggtatagcaggtacgtcgacgacattgtgctttctgggaggcacatcggcccaaacgacgttaacgctgtggaggaagcactgaagcaggtaggcctcgctctaaacccaaagaaaattcacttccaacgaggacgcaaaaagatcgttacaggtatctctatcggaagtggtcgactgctgctccccagagagctccggaggcgttaccgcaatgagactttcctcacactgaaaaacattaccgcggccactgaaagagatcctattgcgctcgaaagacatctggggcagctggcatattggacgaatattgaacctggcaatgaacgggccttacacctgttaaaacaagtacgctcagtgagcacttgttga

SEQ ID NO: 9403 - RNA, 1086 nt, unidentified
  source 1..1086: mol_type = other RNA; note = synthetic construct
atgaccgactctattaggagtgccgctagcagctatgagctggatattgaactgtggagttccttctatagcaaacgcgtagaaagaaacaagcagttggtggcaggatatctcaagttcatcgctgagatggcagacagaggcataccaccaatttttgaaggccatcacctggccaaactactgggcctttccctggcagagctgagtcgcttcaccgcaaaccccgagaagcagtacagaactttcgaaattcctaagaggagtgggggagcccgtgagataagcacaccctctcctgaattattggagtgccagaggtggatcgattggtatatactgaggcgcctgccagtccatgattgcgcccatggatacgtgacagggagaagcaaccgatccaatgccgtgacccacataggctcccgccaggtgctccacctcgatattagggacttctttgggtccataaagtttcggcgggtgatctctatctttcttaaatccggatacccgcgtaatgtcgcttttctgctagcacgcttgtgcacacaaggtggctgtgttccccaagggggtgcttcttctccccagttgtcgaacgtggtcatgtacgatctggacttggaaatcgccgagttttgtaaaagcaatggcctgatctactcacggtacgtggacgatatcgccatctcaggggacctcatccggacaactcacattgcggagatctcaaggattctcctggaaagcgggttcttactgaacgagaagaagacttctcttcagcggggtcgaaaaaaaatcgttacgggagttagtatcggctccggcaatccgaaggtacccagacagatgaggcgtcatttcaagaaccaggccttcattgcgctcaaaaatttagagcacggtgagcaaattgatgaaatgtcagaccctattcactttgagagatgtctgggacagctatcctattggtcgatgatcgaaccagagaacgaaaaggtcgccaaactgattgacgaaatcaagaatcgactttcagacctcgaggctagacttcggcctagccgcgctacccgatga

SEQ ID NO: 9404 - RNA, 1047 nt, unidentified
  source 1..1047: mol_type = other RNA; note = synthetic construct
atgagtaaatcatcagaagaatggcgccatttctttgaagaaaggggcgtgaaggataaaaaagcgctcttggggtatttgcagtacattgaggaaattgaggcaaaaggtctgcccccgatttttgagatgcaacatctctctgagctgatcggagtgaataagtcctacatcgccgctgttactaaggacagttctgctttttatagagactttgaggttaagaaacgatccggaggcgttagggttatctctgcccctcatcccacactgctgctctgtcagcgatggatcaacggtgagatactgcagcacgtgcctatacacgactcagcatttgggttcgcccagggccgttccgtggtggataacgccaagatgcacatcagtggcaatcaccttctgggaatggacatcaaggattttttccccagcattcacatagatactgtgagggatacctttctaggtcttggctaccctccgaacgtgtcggctatcatggcaagattgtgctgtaaagacgggcggctcccacagggagcacctacatcaccagccatcagtaacctggtgtgccggaacatggacaaagagatctcagatctggtcaagcctcggagtctcatctatacacgctatgccgacgacatcagcgtctctggcgaagatttgggctccgatgtgctggggaagattgagttcattcttaagtccttcgggttcctggtcaacgagggaaagacgcgcattagcaagggcgggcacaagaaaatagtgaccggaatatccattgggaccggaaggccaaagttacccaggaaagaggtaagatccatcaaggcggacgcccatgccttgttaagctacggtctattatcttacattgagcggagcgaaaagccagatccactggtcgtagaaagactgatgggccgcgtggctttctggcttcaagtcgaacccgagaattctaccgctgtaaaactgaaaagcaatctccaggacctcagcaatcagatggaccgtggccggttcagactgtga

SEQ ID NO: 9405 - RNA, 1056 nt, unidentified
  source 1..1056: mol_type = other RNA; note = synthetic construct
atgactgactttaattatgacgaatggcagtcgttctaccatgagagagttaagggggagcacgggctccaacttgtgagagggtacctcgctcatgcggccgctttgtccgccagaaacctacctcctatttttgagttcagccacttagcagccctgttgggagtcgacaaagtgacactggccaccatctgccactctccccataattactaccggactttcgcaattccaaagagaacaggcggccgccgggaaatatcagtccctcggccaatcctgatgaaactccagcgatggattttggctaacatcgtggagttggttaatgtgcatgacgctgcccacggcttcctgaagaatcggtccatcgtaactaatgcacgccagcacctgggctgtaacgagctgctgaaaatcgatattctgaacttcttcccatctatctctagcggcaaggtgcgaagtctgtttgccgagctcggctattccggttcagttgcaagcgctctcacccgaatatgcacaaaaaatgacgggcttccgcaaggagctcccaccagtccggctatatcaaacttagccgcaaaagcttttgatgtccgcatcgctgaccactgtgccgaagaggggctgacgtatacacgctacgccgacgatatcgccatttccggtgagaggatcgcccctcatgtgcggggaaaaatcattcagatcctcgccgataccgaactcaagattcaccccgtcaagagccgtctattcgggcccaaagataggaagattatcgccggcataagtattagctcaggaaagctgatgccacctaaggactttgtgaggtctgttcgtaaagatgtataccatgtgacgaccaagggtctgttagcacacatggcggcaattgaaaacttcgaccccatatatctggagaggcttcttggcaggatcgcattctggaagcacgtcactaaaaacagcgatcagtccctgagagcggaatttgcgttgaagcagtatatggtggtgagtggacttgccggagaatttcagtga

SEQ ID NO: 9406 - RNA, 1140 nt, unidentified
  source 1..1140: mol_type = other RNA; note = synthetic construct
atgaataacgtgaaggattgggaagagttcctcaggacacacctgagtcacgaacagcagcagctggagggagctatcggctacgtaaagcatttaatctcccaaagcctgcccccgatattcggtgaaaagcatttctccatcctcactggcgtgtcagagatctttcttaggaagctagccgataacagtgcccactattatcgcactttctcgatacctaagcggaaaggcgggtttcggaatatctcagtcccctcgcctaccctgttgcacgttcagagatggattgtcgcgaacatccttagaaagatacccgttcatgaggctgtgcacgggtacgtggcaagccgaagcgtaattaccaatgctaaggtccatagggaacaggagtctatactccggattgacatcaaagactttttccccacaatagagtcacagcaggtgcaggcactgttcgcagctattggataccggcccgagttatctgtcctgatgagtgacctgtgctgtcgcaataacgtgctacctcaaggggccgcaacctccccagctattagcaactgggcatttgcgccgttggatcgcaaactcaaggagttgtcccagaaatattcataccaatataccagatacgccgacgacatctttataagcggtaagcatatccacgatagaattgaatctgaggttgcccagatcctcctggaacaaaaattccgcattaatcgagccaaaacgcgatttatgggacctaacaggccaaagattcttgccggcgtgtctatcgcctccggccgtttgtgtctgccacgggagaaaaagagggaaatcaagcagaacgcctactatatcattaaatacggacttttcgagcactgcaattggaaagcaagtcgcgatccccttatcctggagaagctgttggggaaaattaacttctggctgatggtggaaccaaaaaacccaacagccttagaactccagcaaaaactgcgtgccatttccctcgaatttgataatagcctgtgggagaagttcgagcctaagagggcgcgggacatccaggacatttttaagcctactcccgctgctaactttgaattcccaagctctatgagaaattctaagtcctga

SEQ ID NO: 9407 - RNA, 1062 nt, unidentified
  source 1..1062: mol_type = other RNA; note = synthetic construct
atgaagcagtcgaagtataaatccgtgttgtgcggcgacctagtgcccgtccagccctactcgcaatttcttcaggaaaaaaccttccggtggccccttaaatatgcagccaaaagaggtttgatcgcctatgcagagagactggagtcccaggggctgccagtaatcctcgacattcagcatctcgcttggcattcaggactcgaagctaaattcatcgccagcgtggccctggataatagaagatactactccacacgcacaataccaaagcgccgaggaggggaacgatccttattcgtgcctcggccttttttagccggactacaaaggtggattctcgacgagattttatcaaagtttgggctgcaccaaagcgctttcggcttcgttaaaggcagaaggacgctcgataacgctcgacttcacgcagccagtaaatgtatcctgaaggtcgacattagggatttttttgggagtatcaagtatgcctccgtcagtgacatctttctgggcgctggatactctcctaaggtttcttactacctcagcaggatatgtactttggatgatgtaattccacagggggcccctacctccccctctatctcaaacatagccatgaggcaagtggacattcagattgcggaattctgtgctcagaataggctactgttcagtagatatgctgatgacatctgcctctctggcgactccatcccggaaagcgccttccctttcctgtcagattgcctgagcaagtttggccttgaaatcgcagaggagaagactgtgctggcgttcgaggggcagaagaagatcatcacaggcatcagcatctcatctggcgagctgcgcctgccaaaggtttatcgtcgggaacttcggaaaaccattcactacatttgccgctttggtctgaagagtcataagaacaaagcgggaatatctgaccccatctaccgctatcgtctgctgggacaggtggagtactggctgtccattgaaccgaataacagcatagcattgttgggtcgggagattctcaaagagagccggtga

SEQ ID NO: 9408 - RNA, 1062 nt, unidentified
  source 1..1062: mol_type = other RNA; note = synthetic construct
atgatcggtactatcatcctatgcgggaaccccgtgccggtccaactctactctgaatttttgcgagagagaacattcagatggcccctgaaaagcgcagccaagagaggattagtcgtctatgccgaacgactggagaataaaaatcttccggtgatcctcgatatgcagcatttgtcttggcacaccgggattaagtcacagtttatcgcgaatgttgtgttggatggggccaggtattaccgctcaaaggttattcctaagcgtagaggcggcgagcggatcttatttgtgccccgtcccttcctggcaggactgcagaggtggattctagacgaggccctcagcaagctgaagcctcactgctccgctttcgggttcataaaaggccgcggcatcgtcgagaacgctaaagtgcacgttaacagcaaatgcatcgtgaaagtggacataaaggacttctttggatccgtgagctatgtcaccgtatacgatatcttccttcaggctgggtatagtcctaagatcagctacttcctgtctaacatctgtaccctgaacgatgctcttccacaaggcgcacccaccagcccagctctgtccaatatggctatgttccaagccgacacacagattgccgaattctgctctcagaatgcactgttgtttactaggtatgcagatgacatatgtcttagtggtgatctgattccagagagcgcatttccatttctcagtgactgtctggccaagtttggctacgaagtggctgaagacaaaacggtgctcgcgtttgctggacaaaagaaaatcgttacaggaatctccatttcctctggaaaattaaagcttcctaaagagcagaggcgcaagttgagacaggccatacattatatctccaagcatggcattaactcgcacctggccaatctcgcaattctggacccaatttaccgctaccggctcgccggtcagatagatttctggctgtcaatcgagcctgacaacgaagtagcgaagctggggaggcggattattcggtcaactattagtgccggctga

SEQ ID NO: 9409 - RNA, 945 nt, unidentified
  source 1..945: mol_type = other RNA; note = synthetic construct
atggagctcaagttctcttttccccctccagccatccaaactctcgctgacctcgccgatgtactgaatgtcgagaggtggtgtctcggaaaagcaattaattccagcaggtcattttaccgcgttttccagttgccgaaacgctccggtggctaccggtctatatctgcacccgtgccatccctgctgagcgtgcagaagatcatttacaagtccatactcagtagcgtcgtatgttctgacagagcccacgggttcctgtcgggaaggagcgtgagaagccacgccgaggttcatcttaatgggcgagatttcctacttaccgacatcgaaaacttttccgatagcattaagattgaggacgtggttagcatcttcagcaagattgggtatgtgcatgagatcgctagtgctctggccttattatgcaccctggacggatctctgcctcagggatcgcctacatcacccgtcctgtccaatatatattccattaggctggacaatcggctgtcaaacatttgcagtgatttgaacatctcctatagtcggtatgcagatgacatggtgtttagtggggacaaaatgagcctcggctttctgcgcctcgcgcagtctattataaactcagagggtcttaacctaaatagtaagaagaccatgtttgccaaatctccctccaggctgataattacaggcatctctatttcaaacagaactttgaagttgcctaaagaaacgaaacgagctttaagattcaaagcgcactttattgcacgcaacggcatcctgtcagaactggaacgtcaagagacagccgatccgttttacatcgatcgtatcatcggccagctttgcttctggtcattcatcgagccagaaaatcggttccccaaaatttacaagaacgtgatcaagaacatcatcaacaataatccaagctga

SEQ ID NO: 9410 - RNA, 966 nt, unidentified
  source 1..966: mol_type = other RNA; note = synthetic construct
atggtaggtcgaatcgaactgccattcagaacaatacgcgggcttgcgcggcaagccgaagttaggcactctgtgctcagggctgtgctgtcaaagatcgaaagcaactatcgccttgtccgcattcctaaggccactcccggggagtacagatcgctctcaatcccaaaacccactctaaagcagattcagcgtacaatatacgactccgcattgaaaggaatcgcgatctcctccagcgctcatgcctatgcacctggccgctctattgtgtcgcacgcgcggattcacgccggaagcacagacttcatacagatcgacataaaagagttcttcccgagtgtgagcccagctagggttagagtactgttcgatgagttggggtttggcagcgacgtcgcccaagcactgacagctctctgtacgtttcagggcggtcttcctcagggcgctcccacttcccctagtatttctaatgcaatcttgaaacacctcgatgaggatttggacgcctacgccgtcagtagaagctgcagatattcccgttacgctgacgatctcgttatctcaggtagctctctcgacgtcgccgactttgaagccaccatagcactggtggcaaaacatggattccgcatcaatgatagaaagtctaggctgatgatgaacccatctaaggtaatcattaccgggatcagtatttccagtggggtccttaaggtgcccaaatctttcaagaggcagctgcggcagatgtcacaccggctgttagtctcccctcagctgaccattagcgaggatggacatgtggacccttttctgtttgatcgggtgatcggccgactgaccttttggcgaatggttgagccagaagccgtgtttccccggcgccaaattgagctattagtgtcaagatatccctccggcgttgtgtcaagcaggccagagaggctgccgttcgtgtga

SEQ ID NO: 9411 - RNA, 936 nt, unidentified
  source 1..936: mol_type = other RNA; note = synthetic construct
atgttcgaggagaacttggccatcggatccctgacacagctgagcctggccagtggaattccttccagtgtgatatcttccctggtattcgaacgagaggggagatatagaaagcactttattgctaagagagacgggggcgctcggaccatctctgtgccacttcctgccctattacaggttcagaagaccataaataaagagatcttgagtaccgtggatattcatgacgcggccgttgggttccgcaagcaccacagcatcatcgatcatgtcaaaccgcatctcggtaacaagaagtttgcaaagttcgacattaaagactgttttggcagtatagcctttaacgcagttttttcgatttacctgcggatcacaaatgaccccgccttagccaattccctcagcgagttgagcacagatgagggtaagctcccccagggcgcggctacttcaccatctttgtgcaacatctcattaaaattcctcgacgaacgcatcttcggactttgtcaacggcttggactgacttatacccggtacgctgatgatctgcttattagcggcactaagctcgacctctatatatatcgcacgctgaaatcgtacattgaagattgcggcttcctgacaaacgagaaatcccgcctgatggaagatcctcagaggctgatcatctgcggtatttctattagcgagtcagacctcaaattgccaaaacaaaagaagagggatattcgtcaggctgcccactttctggtgaatcgtcctatcgtgagcgaatccatttctgacgaactgtttgacccattccacgtcgacagggtcctagggagactgcagttctggcgattcgtggaacccgaggcagaatttcccatcaagtacattccgatcatcaaagagaggatcgcatcacagatagatacccaatga

SEQ ID NO: 9412 - RNA, 1044 nt, unidentified
  source 1..1044: mol_type = other RNA; note = synthetic construct
atgaccggtgaggatctgcgagagtggagagaactgtacaatagccggatttcagggaatcgagggagagctctcgctgatggctatataaaatatattgagagccttcaggccttgggaatcccacccatcttcgagtttagccacctcgcagacctggtagggattgagtatgaaacccttgccaaagtggcctcaagaccccaggacttctacagaactttcgccattccgaaacgttcaggaggtatccgcaagatcgatacccctaggccaatccttatgcagatccagcggtggctgctggaccagatagtgtctaaatctcgagtctccgaacaagctcatggttttgtagtgggccgcagcataatcactaacgcaagaacacacttgggctgccgtgagctgctgaagatggatcttaaggatttcttcccatccgtcaccgcctctactgttcactatatctttaaggatatgggttacccccctaacgtgtgtcgcgcactgtcccggctagtgaccctcggagcctgtctgcctcaaggagctccaacgagcccggcgctgtccaatatagcatgcgtggaattggatagcaacctgaataatctcgccctcaagtacgacctgacgtacacacgctacgcggacgacttaacttttagcggatcatcaattcctagtgatatgacttctctggtggcaaacctcacctctaaagctgggttttccacaaatgacaagaagaccatcttgtctcccgcggggcacaggaaaatcgtgacaggcattagtattagctccggcgagctgaagcttccccggacctatattcgcaacctgaggcagaggattcacctgctaatcaatcatggcatcctccatcccaacaacgactcgacagcctgggacccattagttctcgacaggctattaggcatggtcagtttctgggtcagtgtctgccctgagtccgaagccgccaaacgggcttacagtgaattgaagaacttcatgatgaagtttcagacagtttga

SEQ ID NO: 9413 - RNA, 972 nt, unidentified
  source 1..972: mol_type = other RNA; note = synthetic construct
atgaaatccgacatctggaagtattgcaacaaatcacatacgcgggagttcctgctgtcattgggcctgaccggcaagctcaatctgcctgaggagaaacagctgagcctactctacgggctctccaatcatgccgaagaacattaccaaaaagtacagattccaaaacggaatggaacttggcgtacactgtatgtcccggatagcctgcttaagtacatccagaagcagattctccacaagattctcatgcagttccccgtgtcttcctgcgcttctgcatacaagaagggttgtgcgctgaaagagaatgccgctccgcactctggaaagccaatcgtgttgaaaatggacatctgggacttttttgggaacatcaccttcataagcgtgtatcaacacgcattccctggtgagctgtttcccccctccgttcgaacactccttacgcacctgtgttgttacaaggactttttaccacaaggtgcccccacttcgccttacattagtaaccttgtcttagccccttttgatcattatatggaaaactggtgcaaaggcagaaatattacttacaccaggtattgcgacgatctcaccttctctgggaattttgaaccagagatgttaattcctaaggtaagctccttcctgctgaggatgggcttcgaagttaaccctaaaaagacaaaggtgtgtaggcagggccagcagcagatcatcactgggcttatagtcaacgaaaaagcccaggtgccaaaggcttaccgaagaagcttgagacaggagatttactacattgagaagttcggactgagtgagcacctggcacatatccattcagatctgacacccgagcgctatttggaaaagcttaaaggacgcatccggtatatcttgcagatcaacccccaagataaagtgtttcaagaagctttcacccacctaaataagatacacataagtcactga

SEQ ID NO: 9414 - RNA, 972 nt, unidentified
  source 1..972: mol_type = other RNA; note = synthetic construct
atgagttctgacatttggaagtactgtgacaagaaccactcgagagagttcttactgagcttaaatctcaccggcaacctgaacctgacaaaagagaagcagctgagcctcctttacgggcttagcaaccacactgaagagcactaccagaaaatccagatccccaaaaggaatggtgcttggcggaccctgtacgtccctgacagtctgctgaagtacgttcagaagcaaattcttcataaggtcctaacacaactgccggtttcatattgtgcctccgcatacaagaaaggatgctctctcaaggagaatgctgctcctcacacaggcaagtcaattgtcttgaaattggacatactggacttcttcggcaatattacgtatatctctgtgtatcaacacgcgttccccggagagctgtttccacccccagtgcggacactcctggcacatctgtgctgttatcgggattttctcccacagggtgcaccaacttccccgtacataagtaatcttgtgctgttccctttcgatcgatatatggagaggtggtgtaaaaaccagaatattacgtatactcggtactgcgatgatctaaccttttcaggatcctttgaacccgaagccgtgatccgcaaagtttccagcttcttgctgcgtatggggtttgaaatcaatcccaagaagatgaagatctgccctcaaggccagcgccaaataataaccggcatcgtagtgaacgaaaaaacccaggtgcccaaaacctaccgcaggaacctcagacaggagatttactacatcgagaaattcgggctcagcgagcatctggcccatattcacctggacttaactcctgaaaagtatctagaacacttgaaggggaaattgaggtatgtacttcagatcaatccacaggatcgagaatttcaggaggccctcgccagactgaacagaatttgcatctctcattga

SEQ ID NO: 9415 - RNA, 984 nt, unidentified
  source 1..984: mol_type = other RNA; note = synthetic construct
atgaattcagatctatggaagtattgcactggaagccagtgccgagacttcttactgtccctgaacctaaccggcaatatgaaattgagcgacgaaaaaaagctggcgttgctctatggactcgctaatcacacacaagaccactacaaaagagttgaaatacccaagaagaccggcggattccggacactgtatgtgccagacagcgtgctcaaatacgtgcagcggcagattctgtccaatgtcctgagtcagtttgccgtatccccttgtgcaacagcatatcagaaagggcactctctcatctgctccgccaaacctcatctgcagaagcccatgcttctgaaactggacatctcggacttctttgggtctatcacgtatatcagtgtttaccaacacgccttccccggcgagatttttccaccctcagtccgcaccctgcttactcatctgtgctgttttcaggatatgttaccgcaaggagctcctacaagcccttacatcagcaatctcgtcctggctccttttgacaaatatatggaaaagtggtgtagggatcgggcaatcacttataccaggtactgtgatgatatgacgtttagtggctccttcagcccagggcaagtgactgccaaagtgcgtgggtttttaggtaggctcggcttccagcttaacccggaaaagaccagagtcattcatcagggtcagaggcagattgtgacaggcattgttgtgaatgagaaagcccagaccgctaaggcctaccgacgcagacttcgccaagagatctactacatcgaaaagttcggaatatacgagcacttgaagaacatacattctagtcagaccccagaaaactatctgaagtctctcgaggggaaaattagatactgcctgcaaataaacccccaggatgtacagcttttgaacccatgggagaagttcaagaagatcaagactgagggtatttcagagtcatga

SEQ ID NO: 9416 - RNA, 975 nt, unidentified
  source 1..975: mol_type = other RNA; note = synthetic construct
atggccccaagcctgtggaaatactatacaaaggaacagacacaggactttctcttaagccttcatttgaccgagaatcttacacacacccctacagccgagatggctctcctgtacgcgctcgccaaccatgcggatgagcactacgaaaaaatctcgattcccaaacggaatggcaccaaacgaattctgcatgctccagattccgtcctgaagtatgtgcagactcagattctaagacaggtactcagagagttcccagtgtccggatatgcttgtgcatatcagaagggtatctcacttaggtctaatgcatttcctcaccaggcacagaaactggtgttgaaacttgacatacaggacttcttcgattccataagttatatttccgtgtaccaacacgggttcccttgtgagcggattccggattctgttcgtacgctgctggcccacctgtgctgctataaagaccgtctgccccaaggagcacctaccagcccctacctgtctaacctcgtcatgaagcccttcgatgagtacatgggcaactggtgtagagtgagggagatcgcttacactaggtattgtgacgatatgacgtttagcggagattttcacccgaaggaggtgctgaaaaaggccgaaggcttcttgaatagactaggctttgaactgaatcataagaaaactaggatctgcagtcagaagaaccggcaggagatcaccggcatagtcgccaatgaaaagctgcaggttccaaagaattatcgccggcgcctccgccaagagtgctactacatcaggaaatttgggcttgagaaccatttaagtcacattgagtatactggtgacaagcagaagtacttgcagcgcctcttagggaagatccaatacgtactgcaaattaaccccgaagacggagaattctgcgaatggaagcgatggatcaccaactcatttttcatccacgactga

SEQ ID NO: 9417 - RNA, 975 nt, unidentified
  source 1..975: mol_type = other RNA; note = synthetic construct
atgaattctagtctctgcaactactgcacggagaaccagattcaggactttctcctgagtttgcacctcaccggaaccctgacccactccccaaaagccgagttggcgctactttatgggctggctaaccacgctgaggaacactacgagagagtgctgttaccaaaaaaggacggaagcaagcggatattgcacgtgcccgacagcgtgctaaagcatgtgcaaaaacaaatcctgcgccaggtgttaatggagattccggtttcaagctattcttgcgcttatcagaagggctcatctctctctcagaatgccgccccccataaaggacagaagctcctgctgaagctggatattcatgatttcttcgggtcaatctcgtacatttcagtatatcagcacggattcccgtgcgaacgaatccccgaccctgtcaggaccctgttagcccatctgtgttgttacaaggatatgctgccccagggtgcaccagcctccccatacctcagcaacctggttatgaagccttttgatgaatatatgggtaattggtgtagggaacgggagatagcatatacacgttactgtgatgacctaacattctccggtgacttcaatcccaaggaagtttacagaaaggcaaaagggtttctcaatcggcttggctttgaagtgaactccaggaaaactcacatcattagtcagaaaaaccgccaagaagtgactggcatcacagtcaacgaaaaactgcaggtacctaagaattaccgacgccaactcaggcaagagtgctattatatccagaagtttgggctggagaatcatttgaaacaaactggctgtcaggacagctccgctaaataccttcagagacttcttggcaagatcgagtacgtcttgcaggtgaatcctgaggatatggagttccaggagctgaagaaaagaatgaaagtctaccggaagaacgacgaatga

SEQ ID NO: 9418 - RNA, 969 nt, unidentified
  source 1..969: mol_type = other RNA; note = synthetic construct
atggagaattctttgtggaagtataacactcataacgattctctagatttcctgcgttcactgcacctgacagacggactaaacctggcctcagacaatcagctcgcattcctctacgctctttcaaatcacgctcagaaccactacagccaagtatttattcccaaaaagaacggaaagaagcggaaattgctgatccccgactatctgttaaagcaagtgcagaccaacatcctgaaacacattttggttcaatttcccgtctcgccatacgcaacggcctacaaaagcggatgtagcactgtgttcaatgcctttccgcacctgaatcagaaactcctcctcaaattggacattcacgatttctttgggagcattacctatatcgacgtgtatcagaaagtgtttaagagtgaactctttccaccatccgtccgcacattactgacacatctatgctgctatcacgacgcccttccccagggtgctccttcttccccttatatttccaatctcatcctgaagcctttcgataactacatagggaactggtgtaagaagcagcagatcacgtacaccaggtattgcgatgatatgactttttcaggcgatttcaatcctgtcctggtgaagaaaaaggttcagagctttctgatgaggttaggcttctctttgaatccggagaaaacccacgtatgtagtcaaaagaaccgccaagaagtcaccggccttgtggtgaatcagaagctccagacttccaaagagtaccggcgaagaattagacaggagtgctactatataaagaaattcgggctgaaggaccatcttgcgcatatcggctacaagaagggtgaaacacattatctccagagcctgaactccaaaatcaattacatactttacgtgaacccaagcgacagtgaattcctgcttctgaaaaaggagctgtcttcctttttccaggtttga

SEQ ID NO: 9419 - RNA, 972 nt, unidentified
  source 1..972: mol_type = other RNA; note = synthetic construct
atgcagaatggactatggaaatactgcagctctgcccaggagactgagtacctgctgtcactggacttggcaggagccctgaccgcgtctcgcgagaaacaggcagctcttctgtatgctttgagcaaccacgcagaggaacactacagacgcgtcagaatacccaaaaagcacggcgggttcaggaccctcgatgtgcccgatagacttctcaagtccgtacagcaacgaattcttacacaggtgcttgaacatctcccagtgccagaatgtgccagggcatacagaaaaggcgtctccctgctggaaaatgcggagccacacgccggccaacgatgcgttttgaagctggacatccgcgacttctttggttccattacatacctgtcggtgtattctctggccttccctggtgagttctttcctcctgctgtgcgtactctgctcacccatctctgctgtctccatgattcattgcctcaaggggctcccacctctccctatatctccaacctagttatggccccctttgatagatatatctcgggctggtgcgaggctagggggatcacttacactcggtattgtgacgatctcacgtttagcggggacttcaacccgaacgaggtgaagagcgcagccgagggctttctgttacggctgggctttgaattaaacccagataagacgaggttcttctcaagttctcgtcgccaggaagtaacagggatcgtcgttaatgataggccgcacttaagcaagtcctacagaaggaagctgcgacaggagtggtacttcctgaaaaagtatggaaccgagaatcacctgcagcatatgggatcccccctaacacctgagaagtatcttcagtcactgaaaggtcggattttgtacgtgctcagcatagacccaagtgaccgggaatttgccgacatgctccgcgaattgagcgctgaacggagtagtatttga

SEQ ID NO: 9420 - RNA, 993 nt, unidentified
  source 1..993: mol_type = other RNA; note = synthetic construct
atgcattatgatatctggaaatattgtaccaaggatcaatggattcagtacctcttgagcatgaatcttactggtaatttgcgcctgtctgatgagaagaaattagctttgctgtacgagcttagtaatcacgctgaggaacattataccaccattcgcattcccaaacacagtgggggcctgcgcgtaattcggcagcctgacagcctgctgaagtatatccaacggcaaatcctcttcaggattctcgtgcaaatacccgtgtcagactgcgcattcgcctataggaaggggttttcagccgcagacaatgctcgaccacacgcaggcaaagataccgtcctcaaactcgatattcacgacttttacgagaacataactttcatggccgtgtaccagcacgcttttcccgaaactttgttcccgccacctatcagaacgctgcttacccatctgtgttgctacgattcaatcttaccacagggagcgcctacatccccttgtatctctaatctggtcatgcggccatttgacgagacaatgaaacagtggtgcggagaacagggcatcacgtacacgaggtactgtgacgacatgaccttttctgggcacttccccgggaacactgcccaggaagtcatagacaagaccagaggatttcttctgcggttgggcttcgagcttaatcagaagaagactagactgataagaagaggttgcaggcaagaggtgactggctataccgttaacgatcgggtgaggacttcgaaggactatcgccgaaagttaaggcaggagtggtactacattcgtaaatttggactggaagagcacctgaaaacactcctaggtaccagccatgtaacagatgcccagaagaacagctacctgcagtccttcacaggccgaatcgcgcatgttctccgcacagacccgcagaacacagtgttcctagccatccagaaggaagttaaactgatgcgtaactcctga

SEQ ID NO: 9421 - RNA, 1011 nt, unidentified
  source 1..1011: mol_type = other RNA; note = synthetic construct
atgagtcaggagctctggaaatattgtaccaaggaacagtgccgggattttcttctgtcattgcggctgacaggctctctgtgccacaccgatgagaaaagggtagccctcttgtatggcctgagcaatcatgtcgatgaacattatcatatccggaaattgcctaagcgcggtgggggatgccggacaatatgtgagcccgatcccctgctgaagtacgtgcaaaagcagatcctctgtagggtactatctcagttttcaccagctccgtgtgcttgcgcatatcgaaaaggtatgtccctgagggacaacgccctgcctcacacggggaaggagaaggtgttgaaactggacatccgggattttttcggcaacattacatactcttccatctatcaacacgtgtttccaggaactatatttcccccttccgtccgcacactcttaaccagcctgtgttgttacgacagcgtgcttccacaaggggctcccacctcaccgtgcattagtaatctggttatgaaaccctttgaccagtacatggagaactggtgcgccaaaagatccatctcctataccagatattgcgacgacttgacattcagcggcagcttcgatcatgtgcaggtgataaggaaggtgagatctttcctgaagcgtatggggttcgaactcaatactgggaaaacgaggattataactcgcggcagccgtcaggaagttactggactgaccgtcaacgactcgcctggagttccaagaccatacaagcgagcccttcgacaagaatggcactacatcaagaaatacggaatttcttcccacctcgaaagaaccagcggtatcagtagtattacattagaggcaaagaagcactacctaattcagttagcgggcaaggccggctacatccttcagatcgatcctcaaaacctcttcttccaggagatgcgccaggagatccttcagctgattcaggagactggttggcaggacgcatcacagaattga

SEQ ID NO: 9422 - RNA, 1065 nt, unidentified
  source 1..1065: mol_type = other RNA; note = synthetic construct
atgggagctgtactgatcaatcatgacacccagatagaggagaagcagagtgaggaaactactgatagtccagccggacacggcctgtggaagtattgcacacccgcccaatgcagggatttcatcctctccctcaacctgaccggaagtatgaggctcagctccgaaaagcagttagccttgctttacgggctctctaatcacaccgaggaccactacgcaaagaaaaagattcccaaacgcaacggcggcttcaggacactgtatgcccctgaccctctgctcaaatacgtgcagagacagattctgcggaaggttcttgtgcagttcccggtgagcggttgtgcttgcgcctaccgatcaggggcttctactcgggataatgccctgcctcatgtagggaaggaaaagattcttaagctagatatccacgattttttcggaagcattagctacatctcagtctgccagcacgcgttccccggcactatattccccccacaagtgcagacacttttggctagcctgtgttgctatgattccatgctcccacaaggcgcgccgacatccccctatatctccaatctggtgatgaagccatttgaccgctatatggaggaatggtgtcgtcagagagacatttcttacactcggtactgtgacgatatgaccttttcgggttcattcgacgctcgaaaagtgaccgcaaaagttcgggcgttcctgttgaggctggggtttgagctgaacgaaaagaaaaccagaatcataactcagtctggcaggcaagaagtcacaggtctagtcgtgaatgaccatatccaagttagcaaagcttatcgccgccgcttgagacaggagtggtactatattcggaagtacggcctcaaaggacatcttgcacgaattaactattcaaacacagaggaggcctacttagcctcttttagtgggaaagtcaaccacatcctgcagtgctgtcctgaggacgcatactttcaggaaatcaagttagccctgcagtcccgtaccgacaccagaacggatgcagccacgtatcattga

SEQ ID NO: 9423 - RNA, 987 nt, unidentified
  source 1..987: mol_type = other RNA; note = synthetic construct
atgtccggtgacctgtggaaatactcgactaaagagcactgggtgcgcttcctactgtcccttggccttaccgagccactgcaactctctgaatctggtgctttaccgcttctatacgagttaagcaaccatccggaagcccattacacgctgcaccggatccccaaacgcagcggaggcgttcggttgctccacgaaccagataccctcctgaagaccgtccagcggcagattttgaagaatgtgctcaaaccccagagcgttagtgattgtgcaagagcctatcgggatggggtgtccctgaaggacaacgccagtgcgcatactgggaaagctttgattcttaagctcgacattcacgactttttcggctccatatcatacctcaatgtgtttcagcacgccttcccaggcaccttatttcccccagcagtaagaacaatgctcacagcactatgttgctgtgatgacgcacttccccaaggggcgccaacatctccctatatctccaatctggtgatgaaaccttttgacaactacaccgatatatggtgcaggcagcgcggcatcagctatacacgttattgcgatgacttgactttctccggagactttgaccctagggaggtgcagtgcaagaccgaaatgttcctgctgagactgggtttcgagctcaatagaaagaagactaaagtcattcgatctagttcacgacaagaggtaacagggctgactgttaatgagaaggtcagcgtgcctaaggaatataggaggaaactccgtcaggagtggcattatatcgagaagtttggattggaagaacacctgaaacgaacggccggacctgatacagcctcacccgagttgaccaagaagtaccttctgtctctgtcagggaggatcggccatgtgctgcaggctgatcctgaaagtgcttacttccgcgagatggccagcaacgtcaagaccctgctgcagaacggatga

SEQ ID NO: 9424 - RNA, 1002 nt, unidentified
  source 1..1002: mol_type = other RNA; note = synthetic construct
atgcaggcagtctgtaggggagagcaagatatctggaagtattgtactaaagaacagtggaaggagatgatctgctccttcggcctgctgggcgatcccgagataccgcaagagattcaaatggcggttttgtacagatttagtcgtcatagtagttgctactatagggagaagaagatccctaagcggtttggcggtgtgcggtgtctgatgattcccgactctggactgaaagccgtccagcgccgaattctgaagcacatcctgtctgaaaggcccgtctctagctgcgcttgcgcatatagaaagggcgtggggattagagataacgcagccgcacacgttggacaggaatcggtgctgaaactggacattgaggactttttcggctctatcaccagctcagccgtgtacgggcttgcattccccggtactttgttcccaccacctatgcgcggactgctaacagctttgtgctgctgtaaggggcgtttaccccaagggagtcctgccagcccggccatatcaaaccttgtgatgaagccattcgacgactccatggacctctggtgtagacagcggggcattagatactcacgctattgtgatgatatgacattctccggtagctttgagccaggggaagttatcaggaaagtgcaatcataccttagcgagctggggatgcgactaaatagacgcaaaacaggcgtatatgcgaaaaactgccggcaggaggtgacgggcatcaccgtaaatcagaaagctcagcttagcaaggattacaggcgaaaactccgccaggaatgctattactgtagaaaatatggcatcgaatcccacatggagcggttaggggccggaggacaggaagccgaagagcaggtcctggctcggttgctcggtaagatagaatacctcctgtccgtggaccctgctaatagggagtttcaggcccagcgcgagtactttaggaagctcatgaagaccctccatacctga

SEQ ID NO: 9425 - RNA, 1014 nt, unidentified
  source 1..1014: mol_type = other RNA; note = synthetic construct
atgggagagacaggattgtggaaccactgttcaagcaggcaatgtgtggaaatgattctgtccatgaagttgctcggttacgcaagccttacagaagaacaggagctttcggtcttgtacgaactgtccaatcatgccagcagacattatcgtgaagctgtcatccctaaacgtaccgggggagttaggcacttaatggttccagatagtactctgaaagccgtgcagcgtaggatactgcggaacgtgctgtccggcctggagctatctgaacaggcttatgcttataggaaaggagtaggcatacgagaaaatgccgctgttcatactggccaggagaagattctgaagcttgacatccacgacttctttggtagtatcacctccagctcagtctacgggctggcattccccgggacggtctttcccccacaagtgcggggcctgctgacatcactctgttgtctccgagggcggttgccacaaggaagccctgcaagcccggccatctctaatctggtgatgcgccccttcgatgagcacatgggactctggtgccgggaaaggaatattagatactctcgatattgcgatgacatgaccttttccggtagcttcgacgcaggcaaggtgatccggaaggtgagtggcttcttaagtgagcgcggcatgcgcttgaattggaaaaaaaccggggtttacgggaagaactgccgacaggaggtaacaggcctgaccgtcaacgagaaggtgcagctccccaaagagcttaggcgccagcttagaatggagtgctactattgcagaaggttcggcactgaatcgcatatggagagactcggactcgccgagtctgagtccgaggagcactttctcatgagactactgggcagactggaatatgccctgtcagtgtctcctggtgccaaggaatttgagcaggaacgcgaatactttagagagcagttaaaagcgctacgggagcggcgcgcgcaaaagaaccagaaggggtga

SEQ ID NO: 9426 - RNA, 1053 nt, unidentified
  source 1..1053: mol_type = other RNA; note = synthetic construct
atgagtgggaatctctggaagtactgcacaaccgaccagtggcaagattatctcttatctctgcatctcggcggctcgaacctgcctctcaaaaaggaaatggccgtcctgtaccatttttcaaactgccaagaagaacactatcggaaaggtcgaatcccaaaaaagtctggggggtacaggactctgtggatcccggacggtcaactggcgggcatacagcgcagacttctaggccgtgtccttgaaaccatggaggttagtgagtatgcggcagcctataggaaagggatgggattagccgatggagcccgccctcacgtgggcaaaccggttgtagtgaagatggacgtaaaggatttcttcggctcaattggatatttgaccgtgtacagaaaggcttttcccccatggctgttccctgacccagtgagagggcttttcgccagcttgtgttgttttcgtgagacactaccccagggggctcctaccagcccatacatcagcaacttagtaatgcgggattttgactgcagcctgggctcatggtgtcgggaacgcggaattgcctatacgagatactgtgatgacctgactttttccggggactttgatcctggccaggttatccggaaggcaaccgcattcctcgaggctatggacttttccgtgaatagggagaagacacgagtgttcactagaggtgcacgtcaggaagtgacgggactggtggtgaatgagaaactccaggtgcccggcaagacaagaaggcgcctgcgccaggagtggcactattgcaggatgtacggggtcgaggagcacctgaaacaaacaggacttgaggagtccccagagcattacctggaaagactggcaggacgcattcagtacgtcttgtctgttgaccccggtaactccgtgttcggtcggatgaaagaagaagtcgctcgggagttggctgtccgaagggccactggcgccagtgaatccttcaggcccggaagcgagtctgatggcaagatacgaaccaagaatcggcagaaaatggattga

SEQ ID NO: 9427 - RNA, 987 nt, unidentified
  source 1..987: mol_type = other RNA; note = synthetic construct
atggacgaacggacaaacatttggaagtactgctcgcgcgagcagtccatggaattcctgttgagtctgagactgacagaagatttccgaggcgcccaagatcacaggttggctcagctatacgaaattagcaatcatccacagcgccattaccggaaagcagttataccaaagaaaactggaggcaaccgtgtcctctggatccccgataccgagctcgccattatccaacgtcgcattctgagaaacgtgctggaggagcgccccgtgagctcttatgcagccgcttatagaaggggccaagggcttaaagatcacgcggagtgtcacaggaaccagaaactgttagtgaaagtggacattcacgacttctttggttccatctcatggatgcaggtttaccagaaggctttcccctggtatctctttccaccgagtgtacgcaatctgttgaccaatctatgctgctttagggaagcactgccacagggagctccgacctcacctgccatctctaatcttgttatggcgtcatttgatgagagcatgggaggatggtgcgaggagagacaaatcagttatacacgctactgtgacgatatgactttctccggggaatttgaccccggcatggtcatacggaaagtgtccgcctatctcgaacaaatgggtatggtcctgaacaggaaaaaaacccgagtctacacccggggttctagacaggaggtgactggcctcacggtaaatgaacgggttcaggtccctagattctatcgaaagaagcttcggcaggagtggtactactgtaagaagtacggggtgaaggagcatatcaaggctctgagccttgaagcagaacctgccgcctatttagccggcctgatggggaaggtgcagtacgtgctccagattgaccctgaaaacagggagtttttgcagtatcgtaaggagatccaggaggagataacaaaaaactacgagaattga

SEQ ID NO: 9428 - RNA, 1020 nt, unidentified
  source 1..1020: mol_type = other RNA; note = synthetic construct
atgtccggcgaactgtggaaatactgtggaaaggaacaggagaaagcttttatcctgtctttaaatcttctgcccgcctctatgagagaacgtatgtcaggcgaggcgcagttagccctactttacgttatgtccaaccatgtcgaacagcactaccgcgaaaccagaataccgaagaagggtgggggctcacgcagacttctcgtgccagacggaatgctcaaaggcgtgcagaggaacatccttcatcactgtctggacggtcgatctgtttcacgtcacgcctgtgcctataggagggggctgtcgccggtcgataatgcagccccccatgccgggggagaaagggataagattctcctgaaactggatatacgaaacttcttcgattccatcctgttcccaggcgtgtatggagctgcttttcctgagagtctgtttccccctgccgcggctggattgttgacccacctctgctgctgccacgacagactccctcagggtgcgcccacgagtcctgcaatcagcaatctcgtcatgaagccattcgatgactacattggaaaatggtgtgaagaaagaaaggtgatttatacccgttactgcgatgatctggcatttagtggtcggttcgacgcaaaggaggtttacaggaaagtaagaggctttctcgcagcaatgggcttcgaattgaatgaagggaaaacagtgatcgccgggagaggtcgcaagcagactgtgacaggccttgtcgtgaacgagaggccccggacatctgcccaataccggcgaaagattcgccaagagatgtattactgccggaagttcggggtggaggagcatctacggatggccggattgctgaatggacgcgaagacgctggggagactagcgagaaagctgacgctttcctgcagtccctgagcggcaggatcggctatgtattacagatggagccagagaaccgcgagtttctggagtatcaagagatttgtcggaagatgatggacagccactga

SEQ ID NO: 9429 - RNA, 1029 nt, unidentified
  source 1..1029: mol_type = other RNA; note = synthetic construct
atgagttcgaaattgtggaaatactgcggaacccaacaggagaaggagtttctcctgtcattgaacctgctgccttctgggattagagagcgcatgtccggcgaagcccagcttgcattgctctatagcctcagtaatcacacgcaaaggcattaccgtgagacacgcattccaaagaaaggcggcggctctagacgactcctcgttcctgacggactgctgaagggtgttcagcgaaacatcctgcaccactgtcttgatggacgatccatcagcgcccacgcttgtgcttatcggaggggtagatctcccatcgataatgccgccccccatgcaggtggcgaaaaagggaggctgctgttaaagctggacatccgtaatttcttcgactccatcctattcccacgcgtgtacggggcggcatttccggagtccctatttccacctgcggccgctggcctgctgactcatttatgttgctgctacgacagactgccccagggcgctcccacaagtcctgctataagcaacctagtcatgaggccgttcgatgactacatcggtaagtggtgtgaggccagacagattacttatacacgctactgcgacgatctcgccttctcaggcgtgtttgatgccggggaggtatacaggaaggttcgtggaatgctcgaggctatgggattcgcacttaactcacgcaaaaccgtcgtggccaatcagggaatgagacagaccgtgacaggcctggtcgtgaacgaacgggtccgaacttctgcccaatataggcggaagatacggcaggaaatttactattgctgcaggtatggggtgcgcgagcacttaaaggcagtggggagcttgtcaggcaaagaaaccgagggagaggctgccactaaggaacaggcattcctgcagtccctttttggacggattgcgtacgtactgcaaaccgaaccagaaaatcaggaatttctcgaatatcgggatggttgtagaagcatgttgcttgagaaagagcgggggtga

SEQ ID NO: 9430 - RNA, 1050 nt, unidentified
  source 1..1050: mol_type = other RNA; note = synthetic construct
atgagtagtcaactctggaaatactgcggtacgcagcaggaaaaagagttcatcctgtcattaaacctgctacccgcgggaatgcgggaacgaatgagcggggaagcccagctgtcactgctgtacgccctgtcaaatcataccgagagacactatcgcagagcaagaatccctaagaagtccggaggttctagaagattgcttgtgcctgatgggcttctgaagagcgtccagaggaacatcttaaggcactgtctggatggccgatctgtgagcgcccatacatgtgcctaccgaaggggattaagcccgatagacaatgctgccccccatgcaggcggcgaaaaagataagattctcctgaagctcgacatccgggactttttcgattccatcttgtttccacgcgtttacggtgccgcgttccctgaaagtctgttcccaccagccgccgcaggactgctgacacacctatgctgttgctatgatagattgccccaaggtgcacccacctcccctgcgatttcgaacctggtaatgaagccgtttgacgagtatatcggcaaatggtgtgaggcccgtcagatttcctacacccgctattgcgacgatctcgccttcagcggggtgtttgacgtcggcgaggtgtacaggaaggttaggggcatgctcgaggctatgggcttcgaactgaaccggaaaaaaactgtggttgctcgccagggaatgcgccagtctgtcacaggcttggtggtgaatgaccgggtcagaacagatgctgcttacagaaggcgcataaggcaggaaatgtactattgcaccaagtttggggtccgggagcaccttaaagtggctgggaagcccgacgggatggaaactgaggctgagagggaagcagaaactgccgcagaggagtacgctttccttcagtctctccgtggccggattggatatgtacttcaaatggagccagagaaccgagaatttttggaatatctggaggagtggaaacgtctctgggaggaactagagaatcgcgagcggaagtga

SEQ ID NO: 9431 - RNA, 1038 nt, unidentified
  source 1..1038: mol_type = other RNA; note = synthetic construct
atgagctctaatatttggcatgcttgcacagacagacaggtgcgggagtttattctgagcctgaatctactgcccgacggctcacgggaggaactttcgggcgaaaagcaattagcactgttgtacgcgctgagcaaccaccccgagagacactatcgtaaggtcaggatccctaaacgctctggggggagcagacgactgctagtcccagatgggttacttaagggcgtacagaggaatatcctccaccattgtctggatgggaggagtgtctccgaacacgcgtgtgcctaccgacgcggagtgtcaccaatggcaggtgctgcccctcatgctggaggtggcaaagacaaggtcctgctgcggctcgacatccgggacttctttgacagtatcctgttccccagagtgtatggggctgccttccctgagtccctttacccgccagccgctgcagggcttctgacacacctctgttgcttctatgatagactcccgcagggtgctcccacatccccagcaatctcaaacctggtaatgaagccttttgatgattacatgggcaaatggtgcagggaacgcgagataacttatactcgctattgtgatgatctagccttttccggcgcgttcgacgttggcgaagtgtaccggaaagtcaggggactcttagaggctatgggatttgaactgaacagtggcaaaacagccgtgttgaagcagggtatgcggcaaaccgtgaccggacttgttgtgaacgagcgcgttaggaccagcgcccagtacagaagacgactcaggcaagagatctattactgtcggaggtacggggtgcgagaacatctcaaggcagttggcagactgaccggagccgagacggaggcagacgtgtctgccctggagactgcttacctttgctccttgttgggccgtatagggtacgtgctccagaccgagcccgagaatgcccagttcttggaatatcgcgaaatttgccgttctctgattgagggtgccgacgccgcagaatggggatga

SEQ ID NO: 9432 - RNA, 1086 nt, unidentified
  source 1..1086: mol_type = other RNA; note = synthetic construct
atgtccggtagactttggaagtacctgaccccccagcaggaacgggagttcatcctgagtttgaatctgttgcctgctagctgtagaaagcgcatgtcgggagaggcccagctcgccttgctgtacgccatcagtaatcacgtagaaagacattaccggaaagttcgcatacccaaaaaagatggcaagtcacggagattacttgttcctgacggactactaaaaggggtccagcggaatattcttcgtcactgcctcgacggccgttccgtgtctgagtacgcatgcgcctataggagaggattaagcgccgcggataacgctgccccacatgctggaggcgggaaggataaactgttactgaagctggatatccgggacttctttgattccattctgttctggcaggtgtatggggctgcctttcctgggtccctctttccaccggctgcagcgggactgctgacacacctgtgttgttgtggcgaccgccttcctcagggtgccccaacaagccccgccatatctaacctggttatgaagccctttgacgaattcatgggcgcatggtgtcgccagcgccaaattgtgtataccaggtattgcgatgacctcacgttctctggcgcattcgaccccaaggcggtctatcataaagctcgccacctcctggaagccatggggtttgcactgaacgccgaaaagacagcattgcgaaataggggtatgaggcagagcgtgaccggcctggtggtcaacgaacgagtgaggactggcgtaccgtaccggaggcggattcgccaggagatgtactactgtaggaaatatggagtgggcgagcaccttcaagctgtggggagattgaccgggactgagacacaagaggaggcagccgaagcggagcgagcctttctctgcgcccttctgggcaagatcggttatgtcctcctactcgaaccagagaaccgagaattcctggagtaccgggaaatctgcaggggaatgcaagcagaacaggagaaggcttcatgcccacctgcttgcggtgagagagagcagaaacgtagaggagggaaagagaagtga

SEQ ID NO: 9433 - RNA, 987 nt, unidentified
  source 1..987: mol_type = other RNA; note = synthetic construct
atgggaaatacccagctctggaagtattgcacgacacgacagtgtcaggatttcattctgtcgcttagactcattccaggtggagagaaaatgtcccgcgaaaaacagctggcctgtctgtacaccttgtcaaatcagggtattaagaattatcggcgggtgacaatcgctaagaagggcggtggcagcaggcaattactggtgccttgcggcctacttaaagcagtgcagcgcaacatactgcatcacgtcctcgacgagaggcccgtttccccctgtgcgttagcatacagaaaggggacggacattcgggctaacgcctcagcccacctcggcaagaataaggtgcttaaactcgacatttcccattttttcgatagcatcctttttccgagggtgtacggagcggcttttcctgacactctttttccgcccgccgctgcaatgctgttaaccagcttgtgctgttgtaaagagaggctgccacaaggatctccagcatcacctgccatctccaatctggttatgaggccatttgacgaatacatggaggggtggtgcagggagcgggagatcacctacacacgctactgcgatgatatgacctttagtggaagtttcgatgctcccgcgctgatcactaaagtgcgttcttacctagaagctatgggcttctctttgaacgaaaagaaaactaaactcctgactgagggggtccggcagagtgtcacaggcatagtcgttaacgagaaactgcaggtaagcagagactacagaaagaagttgagacaagaggtatattattgtcgtaagtatggaatagaggcccacctggcccgaattgaagccgccgaggggatccgctgggataaggaacgttatatcgggtctgtgttgggtcgcctgagattcgtgctccaaatcaaccctcaggacgaagaattcgcacgatattgccgggactggaaggagcagtacctgggctga

SEQ ID NO: 9434 - RNA, 984 nt, unidentified
  source 1..984: mol_type = other RNA; note = synthetic construct
atggggaattcgccactctggaaatattgtacccgggagcaatgtcaagacttcatactcagcttgagactcatccccggcggagaaaaaatgtcacgagaaaaacagctgagctgtctgtacacgttgtctaaccgtggcagtcgtaattatcgcagggtcaccatcgacaaaaaggatggaggttcccgaaccctattggtgccatgtgggctcttaaagggcgtgcagcggaatattcttcatcacgtgctggatgagaggccagtctccccttgcgccagggcatatcgcaagggaacagatattcggggtaacgccagctgtcacctgggtaaacgattggtgcttaagctggacatctctcattttttcgatagcattctgttccctagagtgtattcagccgcgtttccggaaacactcttcccaccggctgctgccatgctgctgacgagcctttgctgctgcaatgagagactgcctcagggctctcctgcttcccccgcaatctcaaacctagtgatgcggccctttgacatctacatggacgggtggtgtcgggaaagaggaatcgcatacacccgctattgcgacgatatgacattttcaggagattttgatgccgcagctctctgtagtaaagtcagatcctacctggaagccatgggtttcacccttaacgaaaagaagactaaattgctgacaggggacgttcgccagtccgtaactggcattgtggtcaatgataaactgcaggttagtcgtgagtacaggaagaagttaaggcaggaagtctattactgcaagaagtacggcatcgacgcgcatctcgagagagtggaagctgacactgggatacgctgggagaaagagctgtatatttgctctgttcagggccggttacacttcgtgcttcaagtaaacccccaggatgacgagttcgccggctactgcagggagtggaaggagctgtttatgtga

SEQ ID NO: 9435 - RNA, 987 nt, unidentified
  source 1..987: mol_type = other RNA; note = synthetic construct
atgagtaattcccagctttggaaatattgcactaaagagcagtgtcaggacttcattttgtctctcgacctcgtcccacactccgctgggatgtcccgcgagaagcaactggcctgcctttatatgctgagtaatagaggcgcagaaaactaccacaaggaaattctaaccaagaaagatggcgggacccgcacattgatggttccctgtagcctgctcaaggccgtccaacggaacattctccatcatgtgctggagcagaggcctgtgtcagactgcgcaagggcctaccggaaaggcacagacattttggcgaatgccggtcctcacactggcagaaagcaagttcttaaactggatatctctcacttcttcgattctatcctctttccgagggtcatatctgctgcttttcccgacaccctttttccaccggccgctgcagccctgctagcgaatctgtgctgttgtcgcgagaggctgccacagggtagccctgcaagtcccgcaatctcaaacctggtcatgaggcccttcgacgagagcatgcgaagatggtgcgaggctcgtcagatcgtatacacacggtactgtgatgacatgaccttttcgggagacttcgatcctgccgccgtgtatcacaaggtgaagtcctacctggaagccatggggttcagcttaaacgaaaaaaaaacgaaactgctgaaggatggggtacgccagagcgtgacaggaattgtggtcaacgaaaagccacaggtttcacgagactacagaaagaaactgaggcaggagatctactactgcatgaagtatggagtaaccggtcatttagagagattacgagagaagactggcaacgctgtggaggaacagcgttatatctgctccgttttgggaagaatccaatttgtgctccaggtgaatcccgaggatcgggagtttgcggaatattgtcgcatatggaaagaacggttcgtgaagtga

SEQ ID NO: 9436 - RNA, 1089 nt, unidentified
  source 1..1089: mol_type = other RNA; note = synthetic construct
atggacataggggaaagtggtggccagggaagtgcctggacggtttcaagaaaagacctgtggcgctattgtactgatgcccattgccaggagatgattttgtccttccgactgctgggcgagaatggctggccaagggaaaaggttatggcctgcctgtacgccttaagcaaccactctgaacgacactatgagagaatctcaattccaaaaaaagacgggagcaggcgtatcctgctggcccctgaccctttgctcaagcatgtgcagaagaacctgctccggcatgtcctcgaggggctgtctatagctggatgcgccactgcgtatcatcgccaagctgggatcatttgtaatgcgagtggacatgtggggaagcccctcgtcatgaagcttgacatcagagattttttcggctctatcaccttccctatggtgctctgtcacgcttttccggtaaagtactttccccctcccgtcggcgtgttgcttaccagcttatgctgttgtggagagtatttaccacagggtgctcccacctcgcctgcagtgagcaatctggtaatgaaaccatttgacgagtacatggccggctggtgtcgggagcgcaagatttcctacagcagatactgcgatgatatggctttttcaggagacttcgatgcttgggaggttcgccagaaagcagagaatttccttcgggccatgggtttcgagctgaaccgtaagaaaacaaaggttctgccacaaaatatgaggcaaacagtgaccggcctagtggtgaacgaacgggtccagacatccgcccaatacagacgcaaacttagacaggaattgtactattgccgaaaatttggggtggaaggccacttgagacagtctggtgaagcaaagcacttcctccttccggacggaagtctagataagcagcggtatttgcaggcactggcaggcaaggtgcggcacgtcctcctgacaaggcccgaagatgcgtggttcctggaggccaaggggtggctcctgactgagaggaaacgtcaggagggacgccagtccaggagggaaatgggcaccgaaaacggtatctga

SEQ ID NO: 9437 - RNA, 1062 nt, unidentified
  source 1..1062: mol_type = other RNA; note = synthetic construct
atgaaggaaaccgcaatctcctcatcaaaagacttgtggcactactgtaccgaggaccatgtgcgcacaatgctgctgtccttcagactgctaggcgacaacgattggccagaggagaagatactggcctgcctctactcactcagcaatcatactcaggaccactacaagagaatccagattcagaagaagagtggcggaaccaggacgctgttggccccagatcccctattgaagtacgtccagcgaaatctgttacatcatgtgctcgacggacttagtttggcagattgtgccaccgcctataggaaaaatagggatgacttatacaagcggggagggcaagaggacagggatggcagcgcctacaaggaatgcttcggtattgtgcccaacgctcggatccacgtaggaaaacctctcgtgatgaagctcgacattgttgacttctttgggaatatcacatttcccatggtgctccaccaagttttccctgcccgtatgtttcctccagctgtcgggaacctgcttaccagtctttgttgctgcggagagtacttgccccaaggcgctccgacttctcctgcagtctctaatcgcgtgatgaaacccttcgatgagttcatggaagcttggtgccgcgagaggggcatatcctatagcagatatagcgatgatctgaccttctctggggatttttcgcctaaagaagtcagaggaaaggtgaagggttttctgggcgcgtatggctttgaacttaaccgcaagaaaactcggattctgtctcttgggacacggcagaaagtaactggtttagtggttaacgaaaaagctcagacgtccaaagaataccgacgtaaactgcgacaggagatctattattgtaggcggtttggtgttaaggagcacctgcaattccagaacaagggggaaccggcatgtgaggcggaccaggagcggtatctctaccgcctgctgggcaaagtcaattacgtgagaatgacaagaccagaagacaaatggttcctggaggcccgtcagtggctaaagggcatgctctga

SEQ ID NO: 9438 - RNA, 969 nt, unidentified
  source 1..969: mol_type = other RNA; note = synthetic construct
atgcttctgagctttcatctgttaggagaaaatgactggtcggaggacaagattttagcctgcctctacgccctgggtaaccacggcgagaagcactataagaagatcagaatccctaagaagagcggaggctttagaattctgcttgcaccggaccccctcttgaaatacgtccagaagaacattctgcatcacgtattagagggcttctccgtttctgaccaggccacagcctacagaaagaaggggaatccagcgaatgccgtctgcggctgtgtggagaatgcatcccttcataggggcaagcctttgattatgaaactcgatgtcgagaacttcttcggcaacatcacgttccccatggtgctacactccgcatttcccatacagtacttccctcccgaggttgggaaacttctcgctgagctgtgttgctacctagaatatcttccccagggggctccaactagtccagcgatcagcaacctggtgatgaaaccattcgatgaatacatggccgagtggtgtcggaaccgcggaatcgtgtattcacggtattgcgatgatctcactttttctggtgacttcgatccggaggaagtgctcaagaaaagcgaggggtttctgaaagccatgggcttcgagctgaatcgtaagaaaaccagggtgctgtcaaaagctagtagacagaccgtcaccggcttggtggtaaacgaaaaggtccagccttcacgagaatacaggcggaaactgcgacaagagatccattattgtcgcaaatacggagttgaggaacacctgaggagacggggaacacagggaatgctgtttgcaggtaaagaagacgacagggggaagtatttgtattctctcctggggaaaataaattacgtgcggctaacccgccctgatgacacatggtttttggaggctgaaaagtgggtgcgcgaacaactgtccgaacgttga

SEQ ID NO: 9439 - RNA, 1008 nt, unidentified
  source 1..1008: mol_type = other RNA; note = synthetic construct
atggcgcgcactgatctgtggaagtactgttcggccgagcagtgcagggagatgatgatttcttttagattgataggcgcgggagactggcctcctgagaagattatggggtgtctgtacgctctttccaaccacgccgaaaaacattatcagagggtgaacatcccaaagagatccggcggctttcgcacgcttctggttcccgatcctttgctgaagaatgtccagcgtaatcttctccatcatgtcctagatggcttcaccgtgagcgatagcgcagccgcttaccggaaaggcgcttccgtagcggccaacgcaggcaagcaccaaggacggaaaatcgtgatgaagatggacattgaagacttttttggatcaatcaccttccccatggtcctacaccatgctttcccgactgcctatttcccccctgcagtgggggttatgctggcatcactgtgctgttgtcacgaccgattacctcagggcgccccaacatccccggccatttcaaacttggttatgaagccctttgatgaatacatggaggcatggtgtggggagcgcgagatcgtgtacagccgctactgcgacgatatgacctttagtggcgtgttcgatggaagcgaagtgaaaggcaaggtgtatggattcctccgtagtatgggtttcgaaccaaatctcaggaagactaggatactgacaagaggtaccagacaagtggtgaccgggttagtagtcaacgagcgggtacgcgttcccgccccatataggaggcggctgcgacaagagatctactattgcatgaagtatggggccaaagaacacctgactagaacaggtcgacaggcctatcttaatgatggtgacgggggcacacggagatacctcgagtctctgctgggaaaaacggcttacgtcctgctcgcttctggtgacggagacgcttggttccgggaagcacaggtgaaattgcgtgagatgctcgggcaggacatgtgcttatga

SEQ ID NO: 9440 - RNA, 999 nt, unidentified
  source 1..999: mol_type = other RNA; note = synthetic construct
atggcccaggccgacctgtggaaatactgttcaactgaacactgccgtgagatgctcctgtccttcagactgttaggtacacgcgactggccccctgaaaagataatgggatgcctttatgctctgtctaatcacgcgcagcgccactacagaaaggtccgcatacctaaaaggtccggcggctacaggactttgctggtgcccgactctctgctcaaagaagtccagaggaacttgctgcatcatgtgctcgacggatttgcggtgtctgctagcgccgcagcatacagaaagggcgccagcgctgccgcaaatgcagggatccatcaggggcggaagattgtgatgaaaatggacatcgaggacttcttcggaagtattacattccccatggtattgcaccacgcattcccggccgcttactttcctccacccgtaggcgccatgttagccgccctgtgttgttgccacgataggctacctcaaggcgcaccggctagcccagcagtttccaatttggtcatgaagcccttcgatgagtacatggaggcctggtgtggagaaagagatatcgcttatagtcgatactgcgacgatatgaccttttccggggtgtttgataccgccgaggtgaagggaaaggtgtatggctttctgcggagcatgggatttgaacctaaccagcgaaaaacgaggatcctgacccgaggaactcgccagacagtgaccgggcttgtcgttaacgaccgggtccaggtaccagcgccatacaggcgcagactccggcaagagatctattattgcttaaagtacggtgctgaagagcatctgcggcggacaggccgtgatgcctatctgaaggaaggcgacgcgggggttaaaaggtatctggagtcgctacttggcaaaaccgcttacgttcttctcgccggtgggggggatgcttggttcagagaggcacaagtgcgcctcaagtcaatggtgagacagggtatttga

SEQ ID NO: 9441 - RNA, 981 nt, unidentified
  source 1..981: mol_type = other RNA; note = synthetic construct
atgggcgatggcgaaatctggaagtattgcgggaaagagcaagcggtcgagatgattctgagcttacagctgttaccctcgtcaggttggcagagggaacgaattctcgcctgtctgtacgccctttccaatcaccctgaggagcactatcaccccgtgtggatccctaaacgtcgtggagggtaccggcgcctcgatgtgcctgaccctctactgaaacaggtacagcggaacattctccatcacgtgctggaaggcttttcagtgagccctgcagcagcggcctatcgaaagaaccgctgcgcagccgatggtgcagcggtacatattgggaagccccttgtcctcaagctggacatccatgacttcttcggcagtataaccttccccatggtgctggggtatggattccccgccgcctacttcccagaagaggttagggtcctgcttgctagcctgtgctgttgcagacagcgcttgccacaaggagccccaacgtctccggctctgagcaacctggtgatgaagcactttgatgaagccatggctgcctggtgtgggcctcaaaatatagcctacacaagatactgtgatgacatgactttttccggcgatttgaatccaggtgctgtcatcggaagggtcaggggttttctggaaacaatgggcatggaactgaatcattctaaaaccgctgtgtgttcccaattttctcggcagacagttaccggaatcactgtgaaccaggtgtgccaactccccagggaggaccggagaaaactccgacaggaggtatacctttgcttgcgctacggcaccggagagtccagaccagcagacagtgttagaaggctcgaacagatcctaggcaaagtgtcatatcttttacaggttcggccggacgaccgctggttcttggaacagcgggaggctctgaaggagatgttgaagaaggagagagggcaggtgtatgagagttga

SEQ ID NO: 9442 - RNA, 981 nt, unidentified
  source 1..981: mol_type = other RNA; note = synthetic construct
atggggaaaggggatgtgtggaaatattgcgagaagaatcagatcaccgagatgatactgtcactggagctgctgccttctagccgatgggagcgggaccaaatcctgagctgtctgtacgcgttgtcgaaccatccagaggagcattaccaccctgtttggatccccaaaagatccggaggcttccggcggttagatgtacctgatcccctgctcaagcaggtgcagaggaacatccttcggcacgtcctcgaaggatttagtgtgagccccgcagccgtggcatatcagaaaaacagatgtgccgccgatggcgctgttattcatagaggaaaacctctagtcctgaagctcgacatcaacgactttttcggatccatcactttcccattcgtcctggggtacgggttcccggctgcatattttccggaagaggtcagggttttgttggcctctttgtgctgttgtcgccagcgtctcccacaaggcgctccaagctcacctgctctctccaatctagtcatgcgaagctttgacgacatcatggtgtcctggtgcgctgcgcaaggcattgtgtacacgcgctactgcgacgatatgaccttcagtggtgactttaatcccgcccttgtgataggccgcgtgcgtggtttattggagcctatgggcatggaactgaatagaaagaagacagaggtttgctcacaggccgacaggcaggtagtcacaggtattactgtgaaccaggtgtgtcaactgccaagggaggacagacgtaagctgcgacaggaggtgtatctttgcctccgacacggcgccgaaggaattgaacccgccgcatctgttcgccggcttgagaggattctggggaaggtaagttacctgcttcaggtgcgccccgacgatcgctggtttttagaacggagggatatgctgaaggatatgctcagaaaggaaagaaaaagggtctatgaatcttga

SEQ ID NO: 9443 - RNA, 972 nt, unidentified
  source 1..972: mol_type = other RNA; note = synthetic construct
atgccagaacacttgggtctatggaagtactgcgataaagaacagtgcaaggacatgctgctctccttccgcttggtcgggtccgactcatggactgatgggaaaataattgcttgcttatacgctcttagcaatcatgctaaagagcactaccacaaaacggagctgcccaagaagcgcgggggaagacggatcctgatggtgcccgaccctctcctgaagcaagtccagagaaacttactgcatcacgtcctggagggcttctctgtgtcacctgccgcctgtgcttatagaaagggtgcaagtccacttgcaaacgcatcgttgcataccggcaagcggctggtcctcaaactcgatattcgggacttcttcggcagcataacatttcccatggtactacatcacgtgttccctagcacctattttccgcctgccgtgggaaccctgttagcctctctatgttgttatagggaccgacttcctcagggagcgcccacaagcccagccgtttcaaacctggtgatgaaaccgtttgatgatcatatgttggagtggtgtcgttccaggcgaattacatactcccggtattccgacgacatgacattcagtggagatttcgacccaggtgaggtgatcaggaaaaccgagagctttctcagggccatgggcatggaacttaaccgcgagaagactcgcgtctgtgccgctgggggtaggcagtctgtgaccggaatcgtagttaatgaaaagcccggcctcccccgtgattatagacgggctctgcgccaggagctgcactactgcatgatctacggggtggaagagaagtcagcagcctgcttgcgatctctgctgggcaagactgtttaccttctgagtgtgaatccagaagaccaatggtttcagggggcggaagcatttctgagagaggaactcaaaaaaatcgaggagaagggcgaagagaagtga

SEQ ID NO: 9444 - RNA, 954 nt, unidentified
  source 1..954: mol_type = other RNA; note = synthetic construct
atgaacaatatggatatatggaagtacgcctcggccgagcagtataaagacatgctgctcagcttcgccttgctgagtggcccagattggccacctaagaggattatggcttgcttatacgccctgtctaaccacccagaagcccattatcatgccctgagtgtacccaagaagtcagggggagtcaggcggttactcgcacctgatcccctgatgaaacaggtccagcggaatctacttcatcacgttctggaaggctttagtcccagcgaagcagcaatggcctaccgacgaggcgtgtcagcgaaagaccacgcagctagacattgcggccagcgggtggtgctgacgttggatatacaggatttcttcgattctatcacttttccccaagttcttgccagatgcttccccatcatttacttccccagacctgtgggagtgttgcttgcctctctctgttgtgcatatgaacgtctgcctcagggagctccgacctcccctgcagtgagcaacctggtaatgaagccattcgacgagcacatgctagcgtggtgcggcgagcgtgacatcacatactctcgctactgtgacgatatgaccttttcaggagactttgacttcagggaggtcaaggggaaagcggaaggttttctggaggctatgggtatggccctcaaccgcaaaaagactagggtgagctttagagggggacggcaggctgtcacaggcttagttgtgaatgaaagaccgggtgtcccacgtgagtacaagaggagattgcgccaagaaatttaccagtatcggaagtttgggctcccaggcaccgagacagactccgaaaaatatagggctcgactgctcgggaaaatccgctatgtgctgtccgttcaccccgaggacgcctggttcgctcaggctgagcaagagcttaagcgccggaatccttcctga

SEQ ID NO: 9445 - RNA, 987 nt, unidentified
  source 1..987: mol_type = other RNA; note = synthetic construct
atgtaccataccgatctctggaagtattgtacaaaggagtactgccgggacatgctgctctcattccgcctcctgggaaatacctcttggcccgaccaaaaagttatggcctgcttgtacgccttttcaaatcacaccgagaggcactatcgcacggtgagaatccccaagcgagatggaagacagcgctccctaatggtgcccgattacatgcttatgcgtatccagcggaatattctacaccatatcctggatggctacgccgttagctcgtctgcgactgcctaccataagggcgcaggggtggtaagcaatgctagggtacacacgggaaaacatgtcgtcgtgaaactggatatcaaagacttctttggctcaatttctttcccaatgatccttaagtccgtgtttcctgttcggtattttcatcctgctgtcgggactatgctgaccgcattgtgctgctgtaacgacttcttaccccagggggcaccaacatcccctgccgttagtaatttagtgatgaagcactttgacgaatcaatcaataaatggtgtgaaaacaaggggattagctatacccgatactgtgacgatatgactttcagtggtgatttcaacccaggcctcgtcattcggaaagtgagtggatttctcaactctatgggtttcgagctgaacgagacaaaaacaaggatactgtacaggaatgggagacaggctgtcactggcatagtagtgaacgaaaaactgcaagtgagccttgactatcgtcggaagttaaggcaggagatcttttattgccaaaaatacggagtcaactcccacctcaagagaattggtaacgcggctggcatcccggaaaatcagtacctgttgagcctgttgggccgcatacagtatattctgctggtgaaccctgaggaccaatggttccaggaggccgaacagaagctcctggcagtgcttggtagaaagtccgagtga

SEQ ID NO: 9446 - RNA, 987 nt, unidentified
  source 1..987: mol_type = other RNA; note = synthetic construct
atgtatcaaaccgatctttggaagtattgcacgccagactattgtcgcgacatgttgctttccttcaggctgttgggcaatacaaggtggcccgaccaaaaagtgatggcctgtctgtacgctttttccaaccatgctgagcgccactatggaatcgtactcatacccaagaagaacgggaagagcagaaagctgctggtgcctgactacatgctgatgaagatccagaggaatattctgcatcacatactcgatgggtactccgtttcaggctgtgccactgcataccataagggagccggtgtggtgtctaatgcagcagttcatagagggaagaacgtcgtcgtcaaattggatatcaaagacttctttgggagcatctccttccctatggtcctgagcagtgccttccctgttcagtattttcccacaagtgtggggaccatgctaacagccctctgctgctgtaacgatttcctaccacagggagcgccgacaagtcccgccgtatctaatttagtgatgaaacactttgacgagagcatcaacaagtggtgcgagggaaaaggcataagctatacccgttactgcgacgatatgactttttcgggcgattttaatcctggtctggtgatccgaaaagtgtcaggattcctgaacgcaatgggcttcgagttaaatgaaactaagaccaggattctctaccgaaatggccggcaagctgtgaccggcattgttgttaacgagaagctgcaggtgtcccgggattaccgtagaaaactgcggcaggagatcttctactgtctcaaatatggagtgaagtcacacattgaaaaattggggaatgacgcgcgcatttctgaagaccagtacgtcctgtctctgttaggtaaaattcggtacatcctccttgtgaacccagaagatcactggtttcaggaggccgaagagaaggtcctcgctgtacttggcagaaaggctggttga

SEQ ID NO: 9447 - RNA, 999 nt, unidentified
  source 1..999: mol_type = other RNA; note = synthetic construct
atgtacggtaccgagctatggaagtacagcaccccagaacactgccgcgagatgcttctgagtttcaagctgctaggagaagattggcccgaccagaaagcaatcggttgtctttacgccatttcaaatcataccgagaggcactaccacacggtgctcattcccaagtccgatgggacaaaacgaaagctcttggtccctgatgacttgcttaagatgatccagagaaacattaccaagcacgtcctgagcgagtttgaagtttcctcttgcgctgccgcgtacaggaaagggacatctgtgctcactaatgcctctgtgcatacaggcaaaaagttggtcctgaagctcgatatcgaggatttctttgggtctatcacctttccaatggtgttgaatggcgccttctcaggaaggtacttccctccttccgtgggaacgatgctgacagccctgtgctgttatcgcgattatttaccacaaggcgctcctagcagtcccgctatcagcaacctggtgatgaaaccgtttgatgactatatgaaggtctggtgtgagaagcggaacatcagctatactcggtactgcgacgacatgacattctctggggacttccaacccggcccagtgataaggaaagtctcaggttttctcaacgacatgggattcagcctgaatcagggtaaaactcgtattatttcctggggacggagacagactgtgactggcatcgtggtaaacaggaagccgaaggtttcccccgaataccgtagaaaactgcgccaggaggttttctattgcctgaagtatggcgcaaaaagtcatatcatggtaaccgggagagaagagccagacgaagagcgcgagcggagatatctgcgaagtctgttaggcaagatacagtacctcctttttatcaatcctgatgacatttggtttgccaaggcaaaaggaaaaatacagtcgattctcgaaacctcatacgcttgtctgttatga

SEQ ID NO: 9448 - RNA, 981 nt, unidentified
  source 1..981: mol_type = other RNA; note = synthetic construct
atgtaccagacggaactctggaaatactccactaaaaagcattgtcaggacatgctactgagcttccagcttctcggcgaggactggcctgaccaaaaagtgattgcttgcttatacggcgtgagtaatcatactgagcggcactatcatactgccatgatccccaagagcgatggaacaaaaagacaactgctggtgcctgatgacctgcttaaaatgatacagcggaacatcgccaggaacgtgctgtccggattcgagttgtctagctgcgcaagcgcttactgtaaggggaccagtgttttgaagaatgcctctatacacaccggtaaacgccttgtcctgaagctcgacatcgaggacttctttggaagtatcacatttcccatggtgctgaatggcgcatttagctccaaatatttcccacctaccgttggtacgttactgactgccctttgctgctatcacgactatctacctcagggggcaccatcgtctcccgtaatctccaacctggtcatgaagccgttcgatgattacatgaaagtctggtgtgaggaaaaaaatatctcatatacccggtactgcgatgacatgaccttctcaggggatttccagccaggtcacgtgattaataaggtgagcggatttttagacgccatgggctttgcgctgaaccgcgagaagacaaagatcctctcttctggccgacgtcagacagtgaccggcattgtcgtgaatgagcgcccacatgtttcacccgattatcggagaaggctgcgacaggaagtatactactgtctcaagtacggggtcaagtcccacattacaatgactggcagggaggaacccaaaccggaaatcgagagacactatctcttcagtctcttgggaaagattaactacctgctgtttattaaccctcaggatttgtggtttaagcaagctgaagggaagataaggtcaattctggaccattga

SEQ ID NO: 9449 - RNA, 1011 nt, unidentified
  source 1..1011: mol_type = other RNA; note = synthetic construct
atgcatgaacccgatctgtggaaatattgcactgctgagcactgcagagagatgctgctgtcatttcggctattagaaggtgaggagtggaccgacgacaaagtgataagttgtctatacgccgtcagcaaccacactgagaaacattacaataggcttcggatccccaaaaaaggaggcggtgtccgccaaatccaggccccagatctcctcttaaagaccatccagcggaacatccttcatcacattctggaaggcctggagcttagtccgtgcgcggcagcttatcaccgcggagcaagcattcgagataatgccgctagacacaccgggaaaaatgtggtgctcaagctcgatatcaaagattttttcgggacgatcaccttcagcatggttcagcagagagcctttaacagtagatacttccccgttccagtgggcacactgttgacatcattgtgttgcctcagggatacacttcctcaagggtcgcctgccagcgcagccatatctaatctggtgatgaagccttttgacgaatacatggacggatggtgtcgcgagagggacattgtatactctcgctattgtgacgatatgactttctccggcgattttgccgccgcggaagttataggaaaagtgaagggttttctggacgccatggggttcgagctgaaccggtccaagacgaaggtcttgaccagacacactaggcaaacagtgactggcatcgtcgtcaacgaccgcgtgagcgttccagcggcttaccgacgtgctctgcgacaggacatttattactgcaggaagttcggcgtccgtgagcatattaggtcacggtccgataaaaagtacttggagctcggggaggcaggagaagtgaagtatttaatgtccctgctgggcaagattggattcgtgctctctgtaacccctggcgacgtgtggttcatggaagcagaagaggctgtaaagacactgctgaaggaatatcaggggcaggcatcttga

SEQ ID NO: 9450 - RNA, 1014 nt, unidentified
  source 1..1014: mol_type = other RNA; note = synthetic construct
atgcatgaacctgatctctggaaatactgcactgccgaacactgtcgtgaaatgctgctctctttccacctcttagagggcgaagagtggaccgacgaaaaggtgatttcctgtctttatgccgtgtccaatcacacagagaagcactacagcagactgcggatcccaaaaaaaggcggaggcgttcggcaaattcaggcccccgaccctttgctcaaggccattcagagaaacatcctgcatcacatcctggatggcttggagttatctagttgcgccgctgcttacaggcgtggtgcgagcatatgggagaacgcggcctgccataccggcaagatggttgtgctaaagctagatatcaaggattttttcgggtccatcacctttcccgtagttcaccgatccgctttcaattcaaggtatttccctgcttccgtggggacactgctgacgtctctttgttgtctgaatgattgtctgcctcagggatctccggctagcgcggctattagcaacctggttatgaaaccatttgacgagtatatggatgggtggtgcagggagcgctcaatcacctatagtagatactgcgacgacatgacttttagcggcgactttagcgccgcagaagtgatacgaaaagtcaagggattcctcggtgcaatggggttcgaactgaaccggagtaagactaagatcttaacacggcgcaccagacagttggtgacaggaattgtagtgaatgataaagtgtcagtgcccgcatcgtatagaaaagaggtccggcaagacgtgtactactgcatgaaatttggggtccaggcacatctcgagcgcaggggagaagagaagtatctgaagatggggcccgctggagaggtcaggtacttgactagtcttctgggcaaaataggcttcatcctttctgccgccccaggtgacatttggttcacggaggccaaggaggccgtcaagtcactgctccgcgaagcagcagaaccagtaccggagtga

SEQ ID NO: 9451 - RNA, 1002 nt, unidentified
  source 1..1002: mol_type = other RNA; note = synthetic construct
atgggagaacctggactatggaaatactgcaccgctggccactgtagagagatgatacttagcctgagactcctggaaggcgaggaatggacagagcggagggtcctgtcctgcctctacgccatttcgaaccacacggagaaacactataacaagcagaagctgatcaagaaaggaggcggcgtccggcatattctggcaccagatcccgtgctcaagacaatccagcgaaatatactccatcatgtcttagaagggttggaagtttccccatgcgccatggcctacagaaagggggccagcgtccgtctcaatgccgcttgccacatggataagcaggttgtgcttaaactcgatatcaaagacttctttggctccatcacctatcccatggtgcatcggggagcattcaatagtaggtatttccctgtcccagttggtactctgctgacctcactttgttgttgccaagaccggcttcctcaaggctcacctgcttctgcggccatttctaatctggtgatgaagccctttgacacttacatggagggctggtgtcgcgatcgggggatcgtttacacccgttactgtgacgatatgacattcagtggcgattttcgcgtgtccgctgtgtacgggaaagtgaatgggtttttaggagccatggggttcgagttgaaccaatctaaaaccaaggtgctgactaggcacgtgaggcagacggtcactggaatggtagttaacgacaaggtacaggtacccctgccatacaggcgcgcactgcgacaggaggtgtattattgtctcaaatatggcgtgaaggaacatcttcgccaccgcggtgaaaccgcatatctagccatgggggaagagggcgagctgcgatacttacagagcttgtgcggtagaatcggttttgtcctgagcgcggacccggaggacaagtggttcagagaggctgcagacctggtgaccggaaacattaagacatacttgaaatga

SEQ ID NO: 9452 - RNA, 996 nt, unidentified
  source 1..996: mol_type = other RNA; note = synthetic construct
atgtatgacaccgacctgtggaagcactgtacgccccgccactgcagggaaatgattctctccttttctctgctggaaggggaggagtggactgatgagaggatcataagctgtctctatgccgtgagcaatcatacagaacagcactacacgtgcctcaagattcccaagaagggtggcggagtacgacgggtcatggctcctgacccactgctcaaaacaatccagcgcaacatcctgcatcatattttagaggggtacgaaatcccatgttgcgcaaccgcctaccacaagggtgcaagtatccgcggcaatgccatggtacatctgggccacgaggtagtcctgaaactggatattaaagacttcttcggttcgatcacctttcctatggtgggacaacgagcattcggacgtcagtacttcccggagcctgttggggtgctgctgacatccttgtgctgctataacgatcgcctcccacaaggaagccctgcttcagcggccgtctcaaatttagtgatgaggcccttcgatcggtacatggccgcgtggtgcggccaaagggaagtgatatacagccggtattgtgatgacatgaccttttctggcgatttcgacgtttccgaggtgatgaataaggctaatggattcttgggcgccatgggctttgagttgaaccgttctaagactaaggtgctaactcgacaggaaagacagaccgtcacagggatcgtggttaacgagaaactgcaggtgccatctagttacagaagggaactaaggagagatgttcactattgtttgaagtatggagtccaggagcatctgaaacgccggaacgagcggacctaccttgacatgggcaaggatggggaaactagatatctgatgtccctttcagggaaaattagatttgtgcttagtgtcaacccccaggacaggtggtttagagaggctgacgacagagtgaaacggcttctccgctacatgtga

SEQ ID NO: 9453 - RNA, 1002 nt, unidentified
  source 1..1002: mol_type = other RNA; note = synthetic construct
atggacaaccaacggctgtggcagcatcgcagcaaggaggaggacaaggaagcaatactgtccctgaatttactagagagggccaacgtcccaaaggagaagactctcaagtgcatctatgctgtgagtaaccatattgaagagcactaccgagaggtttttattccgaaaaagaaagggggcagacggaaactgttggtccccgattacctccttcacactatgcagaaaaatatcctgagaatcattctcagcgaagagaaggtatctaaatacgctaaagcttattgcccagggagacggatccgggataacgccttcgctcatgtcggtgccgaaactatcctggagcttgacataaaggacttcttcgagaacataacatacatcatggtataccaatgcgtcttttcaggagaatattatcctcccgccgtgcggacccttttaacacaactgtgctgttaccgcgattacctgcctcaaggcgcgccaacatcacccatgatttccaatctggtgatgttcagctttgatcagtacatgggcaagtggtgcgaagagcgtgagatctgttacacccgctattgcgatgacatgacgttttccgggaagttcgacgtgcgagaagtcaaacagaaagtacgatcttatctgcaggtgctgggtttcgagctcaatctcaagaaaaccaaagtgcttaagcagtacaacaggcagtcggtgacgggtatcgttgttaacgagaaggcacaagtgagtaaaacatataggagggacgtgcgtcaggccgtgtattactgtgggaaatacggcgttcaggaacacttgcagagaaccggagcacagatgtggttgcagaaaggagaagagcgctatctacaacacctcatgggcaaggtgaattatattttacaggtgaatcccgaagattgtacctttcaggaagtcaggaagaatttgctgagaattcagcgccagtgtaagggcggaaagccttga

SEQ ID NO: 9454 - RNA, 960 nt, unidentified
  source 1..960: mol_type = other RNA; note = synthetic construct
atgtggaaatactgtacagacgaggaagctatccgaagctttcacctaaccgatggactgaggtgcaaggagggtaaggagatccagacactgtttgctgtatccaaccacgttgaagagcattatcacatcgcctacatcccaaagaaaaaggggggccggcgcaagttactggtgcctgatgtgattcttgggcgaattcagaaaaacattctccgcaatatcctggccgaaaggaaggtgtcttcttacgccaaagcctatgtcaaaggtgtggggattgtcgagaacgccttgcctcatagtcacgctgagatcatcctgaagcttgacattgaggactttttcgagaatatcacttatctgatggtgtaccagaaagcattccccgagaaatacttcccccccgctattagaacaatgctgactcatttctgttgttacaatgactatctcccacagggagcgagcacctctccgataatctccaatctcgttatgtattccttcgatgaatacatgggcaaatggtgcgaagaacggaagatttcgtacacgaggtatagtgatgatttaactttttccggcaatttcgacgtgaaggaagtaaaacacaaagcacggagcttccttgagaagatgggcttttcactcaatgagaagaagacaagagtcttgaagccttatcaacggcaaaccgtcaccggtatcgtggtgaacgaaaaaccaaacataagcaaaaactacaagcgtcaactgagacaggagatttactattgcgaaaagtacggagttgccgagcatctgagacagaagggcatatgcgacaaggaagagattacctatttgaaagaactgctaggaaaagttaactacgtgctgcagataaactcagataatatggaatttcgcgaggcaagggagaaaatcaataagatgctccttaaggtcaaggggtga

SEQ ID NO: 9455 - RNA, 1017 nt, unidentified
  source 1..1017: mol_type = other RNA; note = synthetic construct
atggctggcaacgatctgtggaaatactgcgaggctaaggaggctgaagacgtcttgaggtccttccatctcttggaagggactggcgtgagcgatgagaaatacctggcttgcttatacgccgtgtcaaatcacacggaggagcactatcacactgccgttattcaaaagaaaaacgggggaatgagaaaactgtccgtccctgatacgttactgaggaccatacaacgcaatattgttaagaacgtactttgcgagcggtccgtaagtcaatatgccaccgcctaccgaaaaaaagcctcggtgatggaaaatgcgcgcccacatgtgggcgcagagatggtgatgaagctggacattaaggatttcttcgactgtatcactttccagatggtctaccagtacgcatttcctgcaatctactaccctcccagtatccggatgctactcacatctctctgttgtaggaacgattgccttccccaaggggctcccagctctccagcaatttcaaatctggccatgagaagctttgacgagtatatgggagcatggtgcggtgaacgccagatgcaatacacccgatattgtgacgacctgaccttcagcggtacatttgaccagaaggaagtgaaacagaaggtgcgtaattttctacacgtgcttggtttcgaattgaaccgaaagaaaaccagggtccaggaccagtcccatcgccagaccgttacagggctggtggtgaacgagaagatgcaggtcagcagagaatatcggaatcagttgcgtgccgaaatctattattgccagaagtatggcgtgacaagtcatctcaacaaaatgggcaacccggcctggatgcgggaggatgagccagatggaaagaggtacctccagtacctgctgggaaaaataaattatgttcttgcggtaaacccccacgacggccacttttgtaagaagcgggaggagctgtctctcatggtcagagaaatctcaacaagatctaatactctgtga

SEQ ID NO: 9456 - RNA, 1020 nt, unidentified
  source 1..1020: mol_type = other RNA; note = synthetic construct
atggccgagagggacatttggcgctattgcacagccgagcaggttgaagaggtcctccgaagctttcgcctgttgcaggggactaaagtcaggggcgacagatacatggcgtgtttgtacgctgtgagcaatcatatcgagaaacactatcatatcgccgtgatacccaaaaagaacggaggtaccagaaaattatccgttcccgacattctgctgcggacaatccagcggaacattgtgaaatacgtcctaccggagcgctttgtatcccagttcgctacagcatacaggttaaacgcctctgtcctgatgaacgcatgtccacacgttggcactgagcaggtgttgaagctggacatccgcgatttcttccactcaataactttccaaatggtgtaccagtcagcttttcccgccgtttattatcccccggcaatccgtatgctcctaacctctctgtgctgttttatggactgtctcccacagggtgcgcctagtagccctgctatttctaatctggttatgaagccctttgatgagtatatgggctcttggtgcgaggaacggcagatccagtatacgcggtattgcgacgatatgaccttcagcggaaatttcgatgtgaagaagctgaagctgaaggtgaagaactacctttacaaaatgggtttcgagcttaacgaacagaagacaaaggtccaacgtcagtaccaacgccagattgtgaccggaatagtggtaaatgaaaagccacaggtctgtcgggagtaccgaagacagttgagggccgagatctattattgcggcaagtacggggtggaaagccatctccaacgaatggggatatccggaggaggcagtgaatcgcctcaggacccagaaagatatgcacaacaccttctgggcaaaattaattacgtgcttagtgtggatcctggggacaaatactttctcgagaagagggatgaaatcctgctcctggtaaaagaattcagaggggattccatcatttcaaaatga

SEQ ID NO: 9457 - RNA, 990 nt, unidentified
  source 1..990: mol_type = other RNA; note = synthetic construct
atgtcatctggccagctgtggaagtactgcacatcagaccaggtgaaagaagtgttgttatccctgcacctgctcgacggggtgcctatcaaagaagaaaaaagacttgcctgcttgtacgcagtcagcaatcacacagaaaagcactatcattctgccgcgatcccgaaaaaaaacggccaagtccggcgtttatttgtgcccgatcctctgttgatgcgaatccaaaagaacattctcagacatgtgctggctgaggaggcagtatccgagtatgccacagcttatagggctggctctgccgtgatagagaacgtcagaccgcatgttggaaagaagaagattctcaaactggatatccagcgcttctttgaccacatcactttccccctagtgtaccagtatgcgttccctgcagtccagttccctccagctatcaggcggctgctgaccgagctctgctgttacaaggactaccttccacaaggggctcccactagccccgccattagcaatctagttatgaagcctttcgatgaatttataggcgcatggtgcgccaagcggaaaattacctacaccagatattgtgatgaccttacgttttcgggggagtttgacgaaaaagaggtcaaatgcaaggtacggagttatttggaggccatgggattcgatctcaatcgcaagaaaactcgacttgcccgccagtgtagtcgccagaccgtgaccggaatagtggttaacgaaaaaccacaagtaaatcgggagtatcgtaggcagctgagggccgaactgtactattgtagaaaatacggcgtcaagtcccacctcgaaaggatttacggtcagaagcgacagatcgaggatgaggactgtaagacatacctccgccagcagttaggtaaggtgaattacgtgctgcaagtgaacccagctgacccctatttctttcaggaagttgcaaggctgaagaaggagctgaaagagtga

SEQ ID NO: 9458 - RNA, 1092 nt, unidentified
  source 1..1092: mol_type = other RNA; note = synthetic construct
atgatcatgggcggaaaggacctctggaagtactgtacagccgaacaagtgagaataacactccggtctttgcacttactcgatggcgtacatatggaagaggaaaagtattttagctgcttatacgccgtgtcaaatcacccagagctgcattatcggcaggcctctgtcccgaaaaagggcggtggcgttcggaatctgctggtcccggaccacctgttgtgcaggatccagaagaacatcctgaggcatgtgctcgcagatttcccaatttccgattatgctatggcgtataagacaggcaccgccatcgtcgaaaacgctaaacctcacgccgggatgaaagaaattctcaagctggatattcggaacttctttgactccatcacttactttcaggtgtaccgtaacgcattccccgccgtgtactatccccctcctatccggaccatgctggcgagcctatgttgctgtagggacagcctgccccaaggagctcctacctctccagccgtttctaatcttgtaatgaagcccttcgacgaatatcttggggcctggtgcgaggagaggggaattagatacacccgttactgtgatgatctgactttttcaggaaaatttgaccggcgcgaggtgcaaaacaaagttaggggctttctggctgcttacgggttcgagcttaatgaaaagaaaacaaggttgcagaaagcccatcagcgccagactgtgaccgggatcgtggtcaatgaaaagcctcaggtgagtcgagaatacagacgcaagttacgagcagaagtgtactattgcagcaagttcggcgtggagtcccacctgcagagatacgggggtgaaggaccccaaaaagaatccgttccacgcgaggcaggtgaggcctgtgtacgttatctccagaagttgcagggcaagattaactatgtcctgcaggttaacccagaggaccccgagttctgcagagcgaaggagctagtcaaggagatgcttgaagctcgagggtgtagtgcagagacggagaaaaaatcaagtgagcgcggagagaatgacgatagaaagtcgaaaaaagtgatatga

SEQ ID NO: 9459 - RNA, 1056 nt, unidentified
  source 1..1056: mol_type = other RNA; note = synthetic construct
atgaagggaaaggatctctggaagtattgtacatcggaacaggtgcacgcggtactgcggtccctgcacctgctggatggtgtccgggtagaagaggaaaagtacttctcttgcttgtacgccgtttcaaatcatccagagagacactatcaccctgccagtgtgccgaaaagggggggaggcacccgcaagcttctggttcctgaccatctgctctgccgaatccagaaaaatatactgcgccatgtcctcgccgacttcccagtgagcgactacgccgccgcctacaaacctggaacggcggtgaccgaaaacgcaaaacctcacgtgggtgctaaagagattctgaagctggacattcgtaacttcttcgattctatcacttatttgcaggtgtacaggaacgcttttcccgctgtctactaccccccccccatacgtaccatgcttgcaaatttatgctgttgcagagatagccttccccaaggtgctccaacatccccagcaatctcaaatctggtgatgaggcccttcgatgaatatatgggagcttggtgtagagaaagaggcattcggtacacacgatattgcgacgacatgacttttagcggcgaatttgatcggcgagaggtcaagaacaaggctcgggggttcctggccgcatatgggtttgagctcaacgagacaaagaccagactccagaaagcccaccagcgtcaaacggtaactgggattgtggtgaacgagaagcctcaggtcagtagggaatatcgcagaaaattgcgggccgaagtgtactactgcgggaaatttggcgttgaaagccatctccagcgctgtaggggcgaggaaggcaccaaagagatctcccgcgagatggagggagcgtgtgtcaggtatcttcgacaactattaggcaagatcaattacgtgttacaggttaatccagaggacgccgagttttgtcgcgctaaggagctagccagagagatgctggcagcaaggtcttgcccggctgacttccctgatgcaaaggagttgcagaagaacaaatga

SEQ ID NO: 9460 - RNA, 1014 nt, unidentified
  source 1..1014: mol_type = other RNA; note = synthetic construct
atgggaggcaaagatctgtggaaatattgcacccaggaacaggtacgggctgccctacgtagcctgagactgttggatggagtacatatccgcgaggaaaactacttctcttgtttgtatgccgtgtcaaatcatccggagcagcactatcacccagcttccgtgcctaagaagggtggcggggtacgcagacttctcgttccagatccgctgttatgcaggatccaaaagaatattttacgccacgtgttggcggagtttccaatttccgaatatgcggccgcttacaaaccaggcacctccatagttgagaacgcagaaccccatgtcggtgctaaggaactcctcaaactggacattcgacactttttcgactcgataactttcttccaggtgtacggccaggcatttccttctacgtgctatccccccgccatcaggacaatgctggcaaatctgtgttgctgtagggatagtcttccccaaggtgctccaactagccccgccgtctcaaatctagttatgaagccctttgacgagtacatgggaaactggtgtcaggagcgaggcatcggctatacaaggtactgcgatgacatgacattcagcggggagttcgaccggagagaagtgcagaataaggtccgaggattcctcgcggcatacgggtttgagctcaatgagcagaagacaagagtgcagaaagcccatcagcggcagactgttaccggcatcgtggtcaacgagaaacctcaagtgagccgcgcctaccgccgtaaattgcgggcagagattcactattgtagtaagtacggagtcgagtctcatctgcaaagaaggcgggaagggcaggcacctgagaaggagaggctgatggaagccgattgtgtccacttcctgcaacagctgctggggaaaatcaactacgtgctccaggtgaaccctgaagacaccgagttttgcagagccaaggagattgtgaaggaaatgcttgccgaacgggcttccctttga

SEQ ID NO: 9461 - RNA, 1023 nt, unidentified
  source 1..1023: mol_type = other RNA; note = synthetic construct
atgactacttacctctcaagatgtgcaagcagagaatatgacctgtggaaatactgcaccaaagagcagattcacgagatgctcttaagcttccggttgttggagggagcccctgtccgggaggagaagaaattagcttgcctctacgccgtaagtaatcatgtgcgccaacattatcacaccgctcagatcgttaagcagagtggaggggtccgtcgactgctgatccccgacgcattgctagggaccatccagcgtaacctactccaccacgtgcttgatgggttttctgtgagcgcctacgccacagcttacaaaaagaaggcgactgtcctggataacgccagagcccacgttggccgggagaggatcatgaagctggatatcgagaactttttttccagcattacctaccccttgatttatcaatccgtgttcccggccatatacttcccccctgccgtccgacgcatgctgacagaattctgctgttatgaggaatatctcccacagggcgcacctacgtctcccgctatctcgaaccttgtaatgaaatccttcgacaattacatgggcgcttggtgtgaagagcgagaaataaactacacgagatactccgacgatatgacattctctggtctgtttgatgagaagaagctgaaacggaaagttcggaattatctgctggcaatgggttttgaactcaatgagaagaaaaccaggttactgggacgtcataccaggcagacagtgactggtatagtggtgaacgagaaacctgatgtcgggcgcgcttatagaaggaaggtgagggcggaagtatactactgtaaaaagtatggagcagtggaacatctccgcaggtgcgagaagaaggagtggatgaatggcggccaaccagacgctgcccgctatctgcagcaccttcttggcaagattcagttcgttctgcaaatctcaccagaagacgcccagtttagagcggcacgggaagacgtgcagtcaatgatgcgcaatatttga

SEQ ID NO: 9462 - RNA, 1014 nt, unidentified
  source 1..1014: mol_type = other RNA; note = synthetic construct
atgactacaaccctctcaaattacgataatgacctctggaaatattgcaccaaagaacagatcaaagacatgttgctctctttccgtctcttacaaggagcccccgtgagggaggaaaaagagctggcatgcctgtacgccgtaagcaatcacatcaaaaagcactatcacaccgcccagatacctaaacgcaacggcagtgttaggaggttacttgtccctgacgctctactgaatacaatccagaagaaccttttacaccatgtgttggatggactgtccgtatccgtgtacgcgactgcatacaaaaagaagactacagtgcttgacaacgcattgagtcatgtaggccaggagcaggtcatgaagctggatatcgagaacttcttcgaaaacattacctttcctctggtgtatcaaagcgcgttcccagccatatattttccccccgccgttaggcggattctcgctgagctgtgttgttacgaagactatctgccgcagggggcaccaacatctccaactgtttcaaatctggttatgaaatcgtttgacaactacatgggggcttggtgtgaagaacggggtatccactataccagatattccgacgatatgacctttagcggtgtctttgatgaggtggaactcaagaataaggtcaagaactacctgttgacaatggggtttgtgctgaatgagaagaagacaaaacttttggggaagcatacccgccagaccgtcacgggcattgtggtcaatgagaaggccgacgttggaagagcttacaagcgcgaggtccgggccgaagtgtactactgcaaaaaatacggcgtgatggagcatctgcgacggtgcaacaaaaaggaatggatgactgagggcgagagcgatacggtgcgctatctaagacacctgctgggaaagatccagttcatacttcagatctctcccgaagacgtgcaattcagagaggctcgagaggatattaggcgtctgctcagagatatttga

SEQ ID NO: 9463 - RNA, 999 nt, unidentified
  source 1..999: mol_type = other RNA; note = synthetic construct
atgaccgaccagaatctgtggaaatattgtaccagagagcagtcaaatgaaatgttactctccctcggattactggagggcacaggcgttaagcccgaggctgcattagcctgcctctacgctgtgtccaaccataccgggagacactaccgaaccgcccagatccagaaacgcggagggggagttaggcggctcctggttccagacgctctgctgaacaagatacagcggaatcttcttcaccacgtgctagatgggttgcccgtgtctacgtatgccactgcgtaccgtaaaaggatgagtgttgtggataacgcagctccacatgtcggccaggccttgatattgaagttggacattaaggagttcttcgagaacatcacattcctaatggtgtaccagtcagcatttcctgctgtctactttccccctgccgtacggaaactcctggctgagctgtgctgttacgaagattatctgccacaaggcgcgccgacatcccctgcagtatctaacttggtgatgaagccatttgacgaatatatgggaagctggtgtggcgagagagggatctgctacactaggtactgtgacgatctaacgttcagcggcagctttgactggcgggaggtgaagcacaaggtggcaggttaccttcgagtcctgggtttcgaacttaacgagaagaagacaaggattctgaagcctcacgtgcgccaaaccgtgactggtatcgtcgtgaatgaccgactgcaaactgccaggtcttacaggcggcaagttagatcggaagtatattattgcaccaaatatggggtggaagcccatctgcgccatctgggcaataaaggtgaaagttatggggattccagagatgtcatgcactacctgcagcatctgcttggaaaagtccactttattctccaggccagccccgaggacgaagagttccgtcgcgccaaggaggagatcgaacgcctcatgaaagaacaggagtga

SEQ ID NO: 9464 - RNA, 1014 nt, unidentified
  source 1..1014: mol_type = other RNA; note = synthetic construct
atgagcggcaatgacttatggaagtattgcactgccgaacaggagaaagagatgctgatctcattccggttactggacgggatccagatgaaagaagagaaataccttgcatgcctgtacgcactgtctaatcacgccgatgaacattatcatgcagccgcggtaaagaagcggggaggcggagtgcgacggttgatggttcctgacgctctattgggcgccgtgcagaggaatatcctgcaccacattctggacggcatcacaccagctaacgcttccaaggcttatcgccgcggcgttacaattgccgataacgcgctgccacatgtgggtgcaaaacagatcgtgaaactcgacatccgggattttttcgaaaacattacgtacctcttagtgtaccaatacgcctttcccgccgtgtatttccctcccgccgtgagaactatgctcaccgctctttgctgttgtcgagaatgtctccctcaaggggctcccacgagcccagctgttagtaatctcgtcatgaagagttttgatcagtacatggagtcatggtgctgtcgcaggggtataagatacacccgttactgcgatgacatgaccttctcgggatccttcgatgcaaaggagcttaagaataaggtcaaaagctacctgcaggtcatgggttttcaactgaatgagaagaagactagagtgttgaaacgccattgtcggcagacagtcactgggatagttgtgaacgaaaagcctcaggtatcccgagattatcgtaggaacctcagatccgagatatactattgcctgcggtatggggccaaagagcacctgagcaggcttggcaactcaaagtggatgaccgaagaggggccggacaccgagaggtacttgcgtcacctgctgggaaagattaatcacgtactccaggtcaaccccgaagacgagtattttctatgggccagagagaaagtgagggaaatctcttctcgcgcaacaaaagacgagattagatga

SEQ ID NO: 9465 - RNA, 1194 nt, unidentified
  source 1..1194: mol_type = other RNA; note = synthetic construct
atggccgggcaggacttctggaagtactgcactactgaagagatcgggcgcacactccgaacctttgacctgcttaagggcatggatgtccccgaagaagcttatctgccttgtctctacacagtgagcaatcagattgagactcattaccacccagtggtgatccccaaaaagagtgggggcagacgaaaactccttgtccccgacgccctactgaggactatccagagaaatctgcttcatcacgtgctagaggagttccagatatctgaattcgcctgcgcatataagaagggaacctcaatagtcgataacgcccgaccgcatgtcggcgcaaaactggtgcttaagctcgacatccaggactttttcgatcaaataacatggattctcgtctaccagaatgccttccctggaacccacttccctcccgctattcgtaagatgctgacagagttctgttgcgtgagggatagattgccacaaggcgcccctacgtcccccactgtgtcgaatctggtgatgaggccatttgatgtccacatgggggaatggtgccgggagagggagatccggtataccagatattgtgacgacttgacattttcaggtgcctttgcccccgaggaggtaatccggaaagtgcgcggttttctgcaggtttatggcttcgaattaaaccggaaaaaaacgagagttttgggccggggaaacgcacaatctgtgacagggattgttgtgaacgaaaaagctcaggtgtctcgcgcataccgaaggaagttacggcaggaggtatatctgttcgaccgttatggtatcaaaactgaggaaggcccaaagaacgatgaaaaggagcgtatgcgcctgctgggtaaaatgaggtacgtcttgagcgttaatccagaggacgtttggttcgggaacatgtacaagaaatggaaggtgggcgctgatagtagaaagaggaccgaggaaatgcagagcatttccgaagagggcggagtcgcaatgaaggccagagtgaacgagggatgtatctcctgcggagcgtgtgtagccacctgtccggaggtgtttcgctttgatgaaaatgatctggcagtagcgtacgccgatgtcaccgacgaaaccgaggctcaagctaaagaggcgcgcgatggatgccctgttgacgtgattgacctcgaagcttga

SEQ ID NO: 9466 - RNA, 1002 nt, unidentified
  source 1..1002: mol_type = other RNA; note = synthetic construct
atgtcagacctgtggaagtattgcacagccgagcaatgcagagagttcctcctctcactggagctcgtcggagattctggatggcccgacgataaaaaactcgcttgtctgtacgcggttagtaaccatgttgaaaaacactatcacacagccgtgataaaaaagcgctcaggcaacgaaagaaggctgctcgtacctgatcctttgctgaaggggattcagcaaaaaatcctgcataatgtgcttgaggactacgctgtcagtcggtacgctactgcctatcacaagggagcaaaactgaaggataatgcggccccacacgtgggaaaggaaaagattttgaagctcgacatcgagaactttttcgaaaatatcctgttcaagcaggtgttacagagctccttcccaaagaagtactttccacccgccgttggaacgatgcttgcatacttgtgttgctattacgactatttacctcagggcgcccccacctcccctgcaataagtaatcttgtgatgaaaccgttcgatgaaagcatgggagcctggtgtgaggagcggggtatttcgtacagccgctactgcgatgacctgacttttagcggcgactttgacgctgagatggtgaagagaaaagctggtgcctttctaggcgagatggggttccagttaaaccgcaaaaaaacacgtgtgatctcccgtggccaacagcagaacgtcaccggggtggtagtcaattgtaagccacaggtgtctaaagagtatcggagaaagctcagacaggagatttatttctgtcgcaagtacgggatccggggccatctggaacgaattggcgataggaaatatctggaccttggcgaagcagggatcgaacgatacaggctgaggctaatcggtaaggttaattacgtcctgcaagtaaaccaggatgacagggattttatagggtgcttgggtgacctgacctccggggtgaagggcttctctaagaaaccctga

SEQ ID NO: 9467 - RNA, 972 nt, unidentified
  source 1..972: mol_type = other RNA; note = synthetic construct
atgtcggatctgtggaaatattgcacagaggagcaatgccgccagtttttactctcattggagttagtgggcaaagatggttggacagacgacaagaaactggcttgcctctacgctgtgtctaaccacgttgaagaacactaccatactgccgtcattaagaagaaaaatggcaaagaacgtctgctgttggttcctgaccccctactgaaaggaattcagcgacagatcctccacaatgtactggaggaacgcccaatatccaagtatgcgatggcgtaccacaagggtgccagcctcaaggataacgctgccccacatgtcggaaaagagaagatactgaagcttgacatggaaaactttttccagaacatcttgttttcacaggtcctgcagtccgcattccctggcaagtacttcccaccttctgtcggcaccctgctgacttatttatgttgttactacgactacctgccgcaaggtgctcctaccagtccagcaatcagtaaccttgtgatgaagcccttcgatgaatctatgggcaaatggtgcgaagagcgcgggattgcatactccaggtattgtgacgatatgacgttcagcggtgacttcgatgcagacatggtgaagaggaaagccggggccttcctgaatcacatggggttttgcctgaatcataagaagaccaggatcatcaccagaaatcgacagcagaacgtgacaggggtggtcgtaaactgtaaaccccaagtgagcaaagagtatcggcggaaactaaaacaggagatttactactgtaagaagtatggcattctcggacatcttgaaagaataggagacaagaagtacttggagcttggggacgccggaatcgagaaatatagactcaggctgatcgggaagatgaattatgtgtttcaagttaatcccgaggataaggagttccggggctatctcaaagattttgtgtga

SEQ ID NO: 9468 - RNA, 987 nt, unidentified
  source 1..987: mol_type = other RNA; note = synthetic construct
atggagaacaccggtctgtggaaatattgtacaccagaacagagccgcgaatttcttctgtctcttcggctgctcggaagaaccgaccgtgaagatggagaacaattagcctgcttatatgccgtgagtaaccatattgagaagcactaccaccccgctgagataaggaaacgggacggctcaattaggagactgctggtccctgatcccctcctgaaaaaaattcagcgcaacatcctgcataacatactcgaccagatgcccgtttctccatatgccactgcctaccacaagggtgcaggcatcaggcttaatgctagacctcactcaggtgcgaagttgctgcttaagcttgatattaaggacttcttcgagaatatcctattctcgcaagtataccagcaggccttcccaaccatatacttcccgccatccgtgggaactatcctaacctacctctgctgttacagagattatttgcctcagggagcccctaccagcgccgctattagcaatctggtaatgaagccctttgacacttatatgggcgcatggtgtggggagaaggggatcaggtactccaggtactgtgacgatatgtccttctctggggaattcgacgcggatacagtcatccgcaaagcaggcgggtttctcaaagctatgggttttgagctgaacacgaagaagacaaaggcagtgtcctgccatcagcgacaggaggtgactgggatagtggttaaccagaaaccccagttgagcaaagagtaccggcgacgtttacggcaagaactgcattactgcggcagatttggcctgcgcagtcatctggaagctatccacgatacacgctttctcccgctcggggaggcaggaattcagcggtataggatgtcactgctgggcaagatcaatcacattttgtatgtcaatcctgaggacgcctggttcttgaatgctagacaaatcgtgcggacgctacgatga

SEQ ID NO: 9469 - RNA, 993 nt, unidentified
  source 1..993: mol_type = other RNA; note = synthetic construct
atgtcccgcctctggagatattgtaccaaggaacaatgcagagacttactgttgtcattccagctctttggagagacaaattggagcttcgaaaaacaaattgcctgcttgtatactgtctccaatcatatcgaggcgcactaccacagtatcatcatacccaaaaaagacggttcaaaaaggcagcttgatattcccgattacatcctcaaaaagatccagaagaacatcttgcatcatataatcgaaaagttctctgtccctgaatgtgccaccgcttaccaaaaaggcaaagggatcctgaataacgttacaccccacattggcaaaaagactgtcctgaagctggacatcaaagactttttccactccattattttcccaatggtgtacgcccgggcttttcccgaggagtattttcctccttctattagaactctactgacgtatctctgctgttaccgagatcgcttaccgcaaggcgcaccaagtagcgcagccataagcaatctagtgcttaagccatttgatacctatatggaactctggtgcaaggaccgcaatatccaatatacacggtattgtgacgatatgacattttctggcaacttccacaaaaaggaggtgatgaagaaagtgcagcacttcctccatctgtctggttttagcttaaactacaagaagaccaaagagctttcgagcaataggcgacagcaggtaaccgggatcgtggttaacagcaagccgcaggtgagtaaagagtaccgtcggagggttagtcaggagatttattattgccagaagttcggagtactctcacacctgaagtacatagacgacaaagagcatctgcctctggggcagattggagtcagaaaatacgtgtcctccctgcagggcaaggtgcagtacattttgtacatcaacccagaagacaagcttttcaggaagctgctggatgaatctattgctaagatctgggattcactgtga

SEQ ID NO: 9470 - RNA, 999 nt, unidentified
  source 1..999: mol_type = other RNA; note = synthetic construct
atgggggaccagaacctctggaaatactgcacaagagaacattgtaggaagctcctgaccgagtttcagcttttcggcgaaatgaattggtcaaaagagcggcagatcgcatgtctctacgccctttccaatcatatcagtgatcactaccatactgcagtcattcccaaacaagatggcacctgtcgtaagctttgtattccggacacactgctaaaactcgtacagcggaacatcctgcatcacatattggatgggttgaccgtgtcgagctacgccacagcctaccgcaagggagttactatcctgaacaacgtgtcctgccacaccggacaggagaaaattttaaagttggacatccacgactttttcggctccattcctttcattctggtgtatcagtctgtttttcacagtgacagattccccccatctgtggggaccttactcactcatctctgttgttataatgggtgcctgcctcaaggtgcacccgcctctgctgcgattagcaatctagtcatgaaaccattcgatgagtacatgggtaattggtgcggagagcgtaaaataacgtatacccggtactgcgacgatatgacattttccggaagctttgaggcctacaaggtgaagaacaaagtaaggagtttcctgaaagtcatcggcttcgagctgaacgaaaagaagacgaagctgctgctcgctggacaacgacaagccgttactggcatagtggtcaacgaaaagcctcaggtgtctaaggaatatagaaagaagttgagacaggaggtttattactgcctgaagttcggtgctgctagccacttagaacacatgaatcacgatgagtcaggctcaaaagaaggggcggagaggtatctgcagcagctgctgggcaagatcaattttgtgttgcaggtgaacccagaggacgaatattttcgcgccgcacgcgaacggcttaggaaaaatcagaacgagcgagtcaaccgctga

SEQ ID NO: 9471 - RNA, 987 nt, unidentified
  source 1..987: mol_type = other RNA; note = synthetic construct
atgggtgatcaccgcctgtggaaatattgcaccgccgaacactgtaggcagctgatcatggagattctgttgtttggggagatcaattggcccgaggagcggcagattgcatgtctctacgcgctctctaaccacattccaagccactacagaacggctaagatcccgaagagggacgggacatgtagaaggttgtgcatcccagacacacttctcaagatggttcaacggaacatattgcaccatatactcgaccctatcccggtgagctcgtgtgctaccgcctatagaaaaggtgtttccttaatctcaaacgtgtcaggccatgtaggccaggagaaaatactgaagctggacatccatgacttcttcggaaacatcccatttattctggtgtatcagcgtgtctttcacagttatcgtttccctcctgccgtcggcacattactgacgcacctatgctgttatgaagggtgtctaccccagggcgcgccaactagtgccgcaattagcaatattgtgatgatgccctttgacgagtatatgggggaatggtgcgcaaaacggggtataacctacactaggtactgcgatgatatgaccttctctggttccttcgaggcttacaaagtgaagaataaggtcagagggttccttcaggtcatcggcctggagctcaacgaaaagaagaccaaacttctgctcgccggacagcgccaggctgttactggcatcgtggtgaattgcaaacctcaagtgtctggagaataccgccgaaagctgcggcaagaaatttattactgctgcaagtttggagccgcatcccatcttcagcatgtccaagatcagaagtacggaaccgatgccacagagaatattcgatacttacagaagctcctgggcaaaatcaactttgtgttgcaggttaatcccgaggataaatacttcaagactgctcgcgaaagcctgaaaaacctggtaacatga

SEQ ID NO: 9472 - RNA, 987 nt, unidentified
  source 1..987: mol_type = other RNA; note = synthetic construct
atgggtaacaccgacatctggaagtactgcaccggcgaacagtgtcgagacatgctcctggaactgaggcttcttggaaatgttgactggagccgggagaaacagttagcttgcctctactcattgtccaaccatgccgaaaaccactaccatctgaaggagattaccggcaagggcggccggcaaagaacactgcaggtaccagatgccttcttgaaaaaggttcagaaaaatctgctaaggaacgtgttggacggcttgcctgttagttcttatgccacggcatatcggaaagggaagagcatcctgtgtaatgccgtgccccacaccggaaagggcaagatattaaagctagacatgagagacttcttcgggaatattacattctttcaggtgagacaaagtgtattcggaggactgctgttccctggcagcgtgggtacactcctgactcatctctgctgttaccgagactatctgccacagggtgcacccaccagtggagctgtctccaatctggtgctgaaatcgtttgatgaatccatgggaaactggtgccggattcgcgagattacatacacgcgttattgcgatgacatgaccttttctgggtcatttgactctagagaggtcaagaataaggtggagtcttatcttcgcatccttgggttcgagttaaaccccaagaagactaaagtcctcgattcaggtactaggcagatggtgacagggatcgtggtcaacgagaaacctcaggccgatcgcgattatcgcaggcggttgcgtcaagagtgtcactactgtcttaaatacggacccgatcctggccgagtgagcagcaataaatccaaagaggcatacctcgctgggctggtcggcaaagtgaattacgttctccagataaacccggaagatatgtattttaaggaaatcaagaggcagctgactcaactgcagagagaagcgggggagtttccaatgcagtga

SEQ ID NO: 9473 - RNA, 1002 nt, unidentified
  source 1..1002: mol_type = other RNA; note = synthetic construct
atgagcggagaagaaatgtggaagtactgcactggggagcaatgtcgggacctcctgaggagcttggacttgctccggggaaccggggtgaagcaggaacaagagattgcatgcttatactccctcgctaatcatgccgaagctcactataggagggccagaatccctaagaaaaacgggggggtcaggaaactccagatccccgatggcatgatgaagaaggtgcagcgaaacctgttacaccacgtcctggacgggctcgaacccagtccctatgcgacagcctaccgaaaaggcgctggcttgaaagagaatgcagccccccataccggtaaaaagcagatcctgaaactggacctggagaatttcttcgagaatattaccttctcacttatcctggagaatgtgtttccgtcgcgcttattcccaccagccgttggcgtgctactcacaaacctctgttgctaccgcgactatttgcctcagggggcaccagtgtcagcagcggtgagcaaccttgtgatgaggccattcgacgattatatgggttcttggtgtggagagcaaggcatagcctatacaaggtattgtgacgatatgacgttttctggcgactttgatgccagaaaggtcaagaataaggcccagaattttctgaaggtaatgggtttctccctgaacgcaggaaagactcgcctatacggtcagggacaccgtcaaagcgttactggagtggtagttaactgccaccctcaggcggctcgtacctaccggaaaaagctgcgccaggatctgtactattgtgagaagtacggggttgcaggtcatcttaaacggcaaggccgggacttgggccaggaagatgcagctggcgcctcctttagataccttcagatgcttgctggcagagctgcctttgtcctgcaggtcaaccctgaggatagttggtgcagagaggccaaaggacgaattgctcgcctgcagtctgaactgtgggtgtga

SEQ ID NO: 9474 - RNA, 987 nt, unidentified
  source 1..987: mol_type = other RNA; note = synthetic construct
atgatttggaggtattgcactgcggagcagtgtcgtgaacttctgtactcctaccgcttattcggtgagcggaaatggtcaatggaagagcaggagagatgtctttacactttgtccaatcatgccgagcagtactatcggaatgtgtggatcccaaagaagaacggaaaaaagcgaaaacttatgataccggatcctatactcgcggaagttcaaaggaacatcctaacacagattctagctgacatgccagtgtccgaatatgctaaggcttaccggaagggactgggactgcgcgaaatggtgcaggagcatcaaggtcagaatacagttatgtgtctcgatatccgcgacttcttcggtaatatcaccttttttatggtctaccagcaggtattcagtagtctcaggttcccccctgccattggcactctcctcaccaacctttgctgttttaaagacacattaccacaaggagcaccaaccagccccgctatctctaatctggtcctcaaacctttcgatgagtacatgggccaatggtgccgtaaaagaggaattgtctatacacgctattgcgatgatatggtgttctcgggggagctggaccccaagacggtgaagaataaagtgcgggggtttctgagagttatcggcttttctctgaacgaggagaaatctagcgtgagacgacagagccagcggcagaccgtaaccgggattgtcgtgaatgaaaagatccaagcagccagagagtatcgaaggagagtccaccaggaagtgtactactgcaggaagtttggggtggacgatcacctggccaagattggcaaagacaagaaagagcccatggacaggcagcgctacttactgtccctgttgggcaagctgaactatatactgcaaatgaaccctcaggatgggcaggccaaaagcgacttggcagccctgaaggaaattatcgtttcattgggcgaaaagaactga

SEQ ID NO: 9475 - RNA, 960 nt, unidentified
  source 1..960: mol_type = other RNA; note = synthetic construct
atggatgctacccgcatcacactcctggcgctggacctgtttggaagtcctggctggtccgctgataaggagatccaacgactctacgctctaagcaaccacgccgggcggcattatcggcggattatcctgtcaaaacggcacgggggccagagactcgttttggcccctgactatcttcttaagaccgtgcagcgaaatatactcaagaacgtgttatctcagttccccttatccccgtttgccaccgcctacaggccagggtgccccattgtgtccaatgcccagccccactgccagcagcctcaaattctaaagcttgacattgagaacttctttgattctatcagctggttgcaggtatggagagttttccgccaagtacaactgcccaggaacgtggtgactatgctgacttggatctgctgttacaatgacgctctcccacagggtgccccaacaagtccggcaatcagcaacctggtcatgcgttgtttcgatgaacgcataggcgagtggtgtcaggcaagaggcatcacatacacacgctattgtgatgatatgactttttcaggacatttcaacgcaaggcaggttaagaataaagtctgcggtttgctcgcggagctgggcctgagtctgtatcagcggaagagctgcctgattgccgcttgcaaacgacaacaggtgaccggtatagttgtcaatcacaaaccccagctcgctagggaagcacgtcgcgcactgaggcaggaagtgcatttatgtcagaaatacggcgtgatttcgcatctgtcccacagaggggagcttgacccatcaggggacctgcacgcacaggccacggcttatctgtacgccttgcagggaagaatcaattggttgcttcaaattaaccctgaagacgaggcctttcagcaagccagggaatctgtgaagagaatgctagtcgcgggatga

SEQ ID NO: 9476 - RNA, 960 nt, unidentified
  source 1..960: mol_type = other RNA; note = synthetic construct
atggatgccacccgtgtctgtctcctggcactagacttgttcagcagccccgggtggtctgctaatgaagagattaggcgcctctacgcattatccaactcaacatcaaagcactaccgtaccatcgtgctgagcaagagagacggaggggagaggcagatcctcgcacccgattatttactcaaaactgtccaacgcaatatcctcagaaatgtgctttcgcattttcccgttagcccattcgcgactgcttaccgacctggctctactgtggtgcataacgctaggccgcacctttcccagcctcaaatactgaaactggacattgaaggtttcttcgaaaatatttctggcctgctggtctggcgggtgtttcggcaaacaaccctgcctaacgccgtcgtgacaatgcttacgcacctgtgctgttaccgtgacgctttgccacagggtgccgcgaccagtccagccatcagtaatctggtgatgcggcgatttgatgagcgaatggggcgctggtgccaggaaagacacattgtctatacgagatactgcgatgatatgacatttagcggcgagttctccgccaggcaagtgagaaataaggcagctgcactcctcgccgagctaggactgcggctgaacaaacgaaagaccgccctcattccagcttacaaacagcagactgttacagggatcgtggttaacgaaaagctgcatatatccagggagcagcggcggcttttacgccaggaggtacactattgtctgaagttcggcgtagccgcccatctgagtcactctggaaagtccactgagtcagctctgtgctatttgcagcgcctacagggtaaaatcgcatggttgcttcaagtgaaccccgacgaccgcgcgtttagaagggccttgagagatgttcagcagatgatccggcagatagccctgcctggcaccaggtga

SEQ ID NO: 9477 - RNA, 1071 nt, unidentified
  source 1..1071: mol_type = other RNA; note = synthetic construct
atgcggcgagctaatgcactcagcaccttcagcagattgagagatcgcttgtatagaatagtggccgccgatgccttctttaagcaccagtgggacaaagagcccacgctggatgcaacccgtgcctgcctgctagccctggaattaattggccgctcagactggtcagctgaccgagaaattcgctgcctttacgccctgtcaaatcggagcgaacgccactatcgcaaaatcgtgctgactaaaagagatggcggcagtcgagtcctacatgcacctgggttcctcttaaaaaccgtccagaggaatgtggtgaagaacgtgctgagccattttccagtatccccatttgctacagcttatcgacctggttcctctactctctgtaacgccagtccacatgttgggaggaagcagatcctgaagctcgacattgagaagttctttgacaacattcgcttcacccaggtatacagactgttcaacaaaaccgaacttcccgctggagcggtcaccctccttacacacctgtgctgctacagagatgcactgcctcaaggggctccaacaagccccgcgttaagtaatctcatcatggcacggtttgatgatctcctgggaatatggtgtaaggagagagacattgcctacacacggtattgtgatgacatgacattcagtggcgatttcgacgctcaccaggtcactaataaggttcgtggactgctgaacgacatgggtttcaccctaaactctaggaagtcacggcggatcgctaggggttctcaacaaacagtgacgggcatagtggtgaaccatagaccgcagttgccctcggaatttaggagggcacttcgccaggaggtttacttttgtcagaagttcgggatcgcttcccaccttgagaggatcggaagctctgagactcctctgaggtaccttcaatccctgttggggaaaatcgcctacctcctgcagattaatccggatgacgcggagtttcagcgtgccaaggcagccatcggccagctgctcaaagccgagacttctttgtcctatcgggccgactga

SEQ ID NO: 9478 - RNA, 972 nt, unidentified
  source 1..972: mol_type = other RNA; note = synthetic construct
atggacgccgcacgagcttgtctcatcgctctggaactcacgggcaaaactgcctgcccagccgataaggagatccagtgcctttatgccctatctaatcgatctgatcgccattaccgcaagatagtcctgaccaagcggtccggtgggttgcgcaccctgtatgcacccgacatcctgctcaagtccgtgcaacgcaacatcctgcgtaacgtcctgtcactgtttccattgagtccatttgccacagcttacagggagaagtgcagcaccctggataatgcgagcccacatgttgcccaaagtaacgtgttgaagctggacattgaaaacttcttcgacagtatcacattcttccacgtccatagattatttaagaaaaccgagttacctgctgccgtggtaaccctactgacacacctttgttgtcaccgcgatgtgttacctcagggcgcccccacaagcccgactatttccaatctggtgatgaaacgtttcgacgacgtgatcggcctgtggtgtcaggagagagatattgtgtacaccaggtattgcgacgacatgacgttcagcggggacttcgatgctaggcaggtaaaaaataaagtgcggggcttgctgtacgatatgggatttacactaaatgccagaaaatctagactcatcactgcaaatcagcggcagaccgtgactgggatagtcgtcaaccagaagccccagctgacacgggacattcggcggaagctgagacaggaagtttatttttgccagcgttttggagttgcgagccacctcgttcaaactggtgattttaacccccaggagtcccctagggagcagagacttaggtacctccagtcactccaaggaaaaattgcctacctcttgcaaataaatcctgatgacgcagaattccagaacgctcgatctgctgtgaggcagcttcttaaggaagagtcagcgtcggcatga

SEQ ID NO: 9479 - RNA, 945 nt, unidentified
  source 1..945: mol_type = other RNA; note = synthetic construct
atgaatgccgcccagctatcactcgtaagcctggaacttacggggcacccgtactggtccccccataagcagctccggtgtctgtatgcgttaagtaatcattcagaacggcactataggactctctcccttccaaaacgtagcggcgggatgcggaacatccaggttccagatcccctcctgcgccaagtgcaaaggcacatacttcgccacgtgctgagtctgctcccgctgagccccttcgctacagcctggaggcccgagtactctctgcgacataacgtcctgcctcaccttggaaaaaaacaggtgctaaaattggacatcgagaactttttccctgggattatattccctcaagtgcagcagctcgcatttgctaagacctgcctgccatatgcagccaccaccctgctgtcacacctgtgttgctatcgcgacagattacctcagggcgcgcccacatctcccatgttaaccaacttggtcatgaggccctttgatgattacattggagattggtgccagcagcaggaaattgcttacacacgatacggggacgacatgacattttccggcgattttgatgcacggagagttcagaataaggtcgccggcttcctaggcgagatgggtatggttctgaatgagggtaagacccgcgtgatgaggaggggtcagcagcagatagtgacgggaatcattgtgaacgaatctactcctagagctccacgggaaatgcgtagagcattgcgccaagccctgtactattatggcaagtacggggcctcggctgtaccagagggattcgacgagcagcagtggctccagagcctgcatggaaaaattactttcatcttgcagatccaccctgaggacgccgccttgcaacatgcacgaggcatcctccaaagacagcttaaggctatcagatcccaaccatga

SEQ ID NO: 9480 - RNA, 936 nt, unidentified
  source 1..936: mol_type = other RNA; note = synthetic construct
atgaacgctgctcagctgtcactaatcagcctggagctcactggccatcctcactggagcccagctaagcagctccgatgtctatatgccctcagcaatcattccgatcgtcattaccgggagttgcagctgcccaaaaggtctgggggcattcgcacaatccatgtgcccgcaccactcctgaagtcggtacaacgtaacatcttgagacacgtgctttccctcctgcccttgagtgactacgcgactgcttggcgcccagggtataccttacttaataatgttttgcctcacgttcgccagaagcaggtgctcaaaatggatatcgacaacttctttcagcggattatttttcctcaggtgtggcagcaagccttcgccaagactagattgcctcaggctacaattacgctgctgtcccacctgtgctgctatagggaccggctaccacaaggagccccgacatctcccacgatcgccaaccttgtcttaagggattttgacaactatataggacgatggtgtgcagagcaggaaatagcctacaccagatacggcgatgatatgacctttagtggtgacttcgatgccaggcgagtccgcaataaggtgaaaggctttctggcagagcttgggtttgaactcaaccacgacaagaccagactgatgtcccaagggcagagacaaatcgtaaccggaatagttgtgaatggtccatacccgcaggcacctgccacacttaggcgtgagctgcgccaaaccttatactattacgaaaaattcggctggtcacccgcgcacagcgaaatgactgagcggcactggctgcagacaatgcagggaaagattgagttcatcctgcagattaggcccaacgactctgaattcctgcatgcaagacacaatgtccggcgctggctgaaacggtgcgcttga

SEQ ID NO: 9481 - RNA, 1038 nt, unidentified
  source 1..1038: mol_type = other RNA; note = synthetic construct
atgtctcgcgacatctggaagtacatcacggtggaacagtgtaatgaatttctactcagctttcagctgttgggcgagactactctgagtaacaaggagcagattacctgtctatatagccttagtaacacactggaaaagcactacgaacaatatactctggtcaagagcaatggcgggacgagaaaaatcaccaaacctgacgagagactcaaacttgttcagaagaatatccttgccaatattctgagtcagcggagcgtatccatttatgccaccgcttatcagaagggggttggcctcataatgaacgcccagccgcacacggaaaaacagcagattctgaagcttgacatagaggatttcttcgactccatttctttttcccaggtgtacgcttacggtttccctcgttcatatttcccaaaggctacagcaggcttattgaccaatctctgttgctataaccactgtctgccacagggtgccccaacttcccccatgatctccaatctggtgctgagatccttcgacgatagtatcggacaatggtgcgtagagaaggggatctcttacaccaggttttgcgatgatatgaccttctcaggaacctttgacgccaccacagtgaaaaataaagtgcaagcattcctggtcgagctgggattctcgttgaacaaaaaaaagacacgggtgatatctaagcacgagcaacagacagtgactgggatcgtcgttaacgaaaagagccaggcccccaggacttaccggaagcagctaaggcaggagatttactattgcatgaagtttggcgttagctcacatattgcgcgaaaaaccgcggtcgctccccatctgatagagcagcgcacaatcgagaactaccttttatctttgctcagcaaaaccaatttcattttgcaaatcaaccctctcgatgaagaatttctgcaagcaaggacccagctgaaggtgttactcactgagcccgtgtcatatacacatctggatgtgtacaaacgccaggtctaccgatga

SEQ ID NO: 9482 - RNA, 1002 nt, unidentified
  source 1..1002: mol_type = other RNA; note = synthetic construct
atgtctcaccgcgatttgtggaagtattgcacccccgctaaaaacagagaatttttgctgtcactacagttactgggccagaccgagctgagcgatgcccagcaaatcagctgcctttattctttgtccaaccacctggaagcccactatagaacctacttcctcataaaaaggaatggctccaagcgcaaaatttcagcccccgacttattgctgaagaaggttcagaaaaacattctcaccgtctgcctgaccaataggacctgctcaccctacgccactgcctacaggaaaggggtacagctgcttgagaacgctactccacacttaggacaaaagcagcttctcaaactggatattgaggacttcttcggctcaatcactgttcccatgattgctagaagcgcctttcctcgcacatacttcccatcttcggtcgcagggcttctgactcagctttgcgcatacgatgattgtctgcctcaaggagcgccgacgtcccctctgatctccaacctcgtgatgaaaccattcgacgacagtatcggtcaatggtgtgcccagcgacagataacatacacacgattttgtgatgaccttacatttagtggtgacttcgcccccaaggaggtgaagaaaaaggtgcagaattttctcttcgagctcgggtttactctaaacaagataaagacgaaacagttgagcgcaagccagcgtcagagtgtgactggaatcgtcgtgaataccaaggcgcaggttcctcggtcctatcggaagaaactgagacaggagatctattactgtctcaagttcggcgtgaggagtcatctaattcatcaacatacgaccagccagccagtactggaacaagaggaagaccagcggtacttgcaacaactgatcggcaagacaaatttcattctccaggtgaatccgtctgaccaggaatttctgcaggctaaaaaagcactgaaggagctcctgcaggctaactatacatga

SEQ ID NO: 9483 - RNA, 1011 nt, unidentified
  source 1..1011: mol_type = other RNA; note = synthetic construct
atgccgtactttttaggagggattcgccccatgaacaaaagtatttggaagtatatcaccaccgaccaatgtaacgactttctcctcagttttaatctgcttgcacctacgaacctttcacccgaaaagcagctggcatgcttgtacgcagtcagcaacagcatcgagtctcactacaccacaacatatctgaagaaaaagaccgggggacaccgggtgattcacgagcccagtccactgttgaagaaaatccagaagaacatcctggtgcatgtactggaaccgcaggcctgcagcgtgtatgccactgcgtaccagaaggaaaagagcctcctggataatgctgctccacatattggaaagaaacaggtgtacaaactggacatcgacgattttttcgactctatctctttcactatggtgttccagagggcctttccccgtgagtattttccacctcaggcagccgggattctgacacagttgtgttgcttcaacgattgtttaccccaaggcgccccaaccagccctatgatatccaatctggtgctgaagccattcgatgattacataggtcagtggtgcagggaacggaatatcgcttacactagatattgcgatgacatgaccttttcaggggagttcaatgttaagaagcttcaccacaaagttagggcctttcttgaggctctcgacttctcccttaatcagaagaagactaaattactggccacgggtaagcaacagattgtcacaggaatcaccgtcaatgagaaaatgcaagtgcccaaaaaatacagacgagaggttcgccagtcagcttactactgtctcaactatggcacagcgtcccatctaaaaagaatgaacgaaggcaatggcgaactggatcctgagacttatctcaactccttgctgggcaagatcaatttcattttgtcagtaaaccctagcgacaaagagttcagtctactgaaggaagagatatccaaactactctcgcattcttga

SEQ ID NO: 9484 - RNA, 984 nt, unidentified
  source 1..984: mol_type = other RNA; note = synthetic construct
atgcaaaaccaggatgtttttggttacgctaccaatgctcaaatcaacgacttcttgtattcccttcagctcttcggcgcaagcgattggtctaaggagaagcagatcggggctctgtatgcaatttccaatcacattgaggatcattgcacacttttccaggtacccaaacgaaatggatcagagcggaccatttgcgccccgtcacctctgctcaaaacagtgcaaaagcgtatcctgtttgctgtcctgagtgagcgccccgtgagcgaatttgccacagcttacaaaacgggggtgtccatactcgacaacgccgccgggcatgttggccagaaatatgttctgaagctggacatcgagaactttttcgggtcgatcttatttcaggacgtgatgaattttgcattccctcgcgccctgtttccaaagagagtgagtgccctattcgcgtcactctgttgttatcacgattgccttccccaaggagcccccactagtgcctgtatcagcaatattgtgctgaagcctttcgacgattacattggtagagtcgcaaaggaaatgggagccgtgtacaccaggtactccgatgatatgacctttagcggcgacttcgacacaaagaaaatgtactacaaggccaagctgttcttggaggctatgaattttaccgtgaatgaagcgaaaactcagatacttaccaaaaaatctcagcaaaaggtcactggcctggtagtcaacgagaaggtgcaggttccaaagaactacaggaaaactgtcagacaggaagcgtattttgccactaaatatggattaacgtctcacttggcctataggcagaacgtgcaggcagcagaagtaacacagaacgcagctttccggtacaagctcagcctgctgggcaaaatcaactacattttgctcgctaacccagaagaccaggagttcaagaagtggcagaatgagataaaatctctatga

SEQ ID NO: 9485 - RNA, 984 nt, unidentified
  source 1..984: mol_type = other RNA; note = synthetic construct
atgaatcatcaggaagtttttggatacgcaactgacgcacagctgtccgaattcctgtattcactcagactactgggcccttctgcttggcccaaagagaaacaactcgcaactctttacgctatatccaatcatctggagaaccactataaaaccttcaccgtccagaaaaggaacggacagatgcggaatatttatgctccgtcgccactactgaagggggtgcagcgaagaatactcgtaagtctccttaacgaaaggcaagtcagccccttcgcaactgcctacaagaatgagggtagcatcttttttaacgccgctaagcatgccagacagaagtacattctcaagttggacattgaagacttttttggaagtattctgttccctgatgtcatgaattatgcctttcctaaagcgatcttccccaaacgcatctctgggctgttgacaagtttatgctgctatcacgatgcattgcctcagggggcgccaacatctgcggccatctccaacattgtgatgaaacccttcgatgattatatgggcaagttggcctccgaaatgggcattaattactcaagatactccgacgatatgaccttttcaggtgacttcgacacggcttacatgtacaggaaggcaaagatgtttctgaacgacatgaacttctctgtgaaccacgccaagacaaaggttcttacacgcaagatgcagcaaaaagtcaccgggctgattgtaaacgagaaggtccaggtgagcaaagcctataggaagaaggttcgccaggaggcttactatgtgagccgattcggactccggaaccacctggcctttatccaacagctgaatgaggtggagatcagcaaagaagctgtgaagcggtaccagctggtgctcttaggcaagatcaatcacatcctttgtgccaacccaaatgataaagagttcctgaattggcgtgagaagataaaaggcttatga

SEQ ID NO: 9486 - RNA, 1002 nt, unidentified
  source 1..1002: mol_type = other RNA; note = synthetic construct
atgaactcccacttctggaaaaactgctccgcccaggaggagagggctttcctgttagacttgaaccttctacggcagtacggagacgcctggagtgataaggagaaaatcgcattattgtacactgtaagtcggactatcaatcagcattatttgaccgtgaaaattcctaagcgaaccggaggccttcggacactgcatgccccagatccgttattgaagatgatccagaagaatatccttagcctgctagagacacgtaccctctctgctttcgccaccgcctataggaagggggggtcaatattagcgaatgccacccctcacgttggtaagaaacaactgcttcagctggacctgctggatttttttgactctctgagcttcccgatggttatggccgcagcatttccaaagacggtcttccccgataacacacgcatgctgctaactaatctctgctgcctgaacgacgcactcccccaaggtgctccaacgtccgcactcatttcaaatctgatcatgaggcctttcgatgattatattggcgagtggtgtaaagaaagacagatagcttattcgcgctattctgacgacctcacctttagcacaaatgaaggcgacctgaccttggttaaaaggaaggtggagcatttcctcgaagccatgcagctcaacctgcaccccgctaagacaaaatacactgatcaaagtatgagacagtgtgtgactggcgtcgtggtgaaccaacaccctcaggtcccccgcagatacagatccatgctccgacaggagatttactatcttgagaaatttggactgacagggcacttggcttgtctgaaggaaaaaggagaagtagccgccgaccttagcgaaaagcagtacctgcgtaaactgatcggcaaggtgcagtttgtgtgtgcgatttgcccagagtcagcggggttccaagatgcttactggcggctccagaagctggcaatctcttttgaggaatga

SEQ ID NO: 9487 - RNA, 1002 nt, unidentified
  source 1..1002: mol_type = other RNA; note = synthetic construct
atgaggtacactaacctgtggaagtactgcgatatccaacaatgtcaggattttcttctgtctttggaactttttgacgaaagcagactcacacgccaggagcggcttaaatgcctgtacgcagtcagcagacacgcagaaaagcactacagaaagacattccgcaaaaaggccgatggcagtctacggccactgcttgagccggactatctcctgaaacagatacagaggaacttactctgtaacgtgttggaacgagttcccgtctcagagtacgccaccgcttatcgaaagggtgtgagcgtccgtgataacgcagctgcgcatgtagcaagccctcagatcttgaaactggatattgagaacttcttcggctccatcacggactccatggtgttcacaaaggcttttcctcgggaatattttccctatccagcagcctctctgctaaccgccatttgctgctacgaaggctacttaccccaaggcgctcccaccagtgccgccatatccaatctgattatgaaagacttcgacagatacatcggaaattggtgccgtgagaagggagttaattatacccgctattgtgatgacctgaccttctcaggcgattttgactgggtggaggtgaaaaacaaggtgagggcctttctcaatgccatggggttcgagatgaataaaaagaaaacgaagttgctcactgccggtcagcggcagatcgtaacaggggtcgtggtgaacgaaaagctgcagactccacgcgcttacagaagggagctgcggcaaatttacttctatatgaagaagtacgggatgcgctcgcaccttcacaataaactcggaagggaggcagctaacgaggaaatggcttcttatttagaacatgttctgggacgagtgaatttcgtcctccagatcaaacctgaggacgggtgttttaaagaaatgaaagcctggattctggagaagaagaaggaggaagcgcatgagtgtctgtga

SEQ ID NO: 9488 - RNA, 975 nt, unidentified
  source 1..975: mol_type = other RNA; note = synthetic construct
atggacttatggcggtattgcaccgccgagaaatggcaggagttccttgtctcactcgacctgctcggttcggctccggctgacagggaagcctatttcagatgcctgtatgcactgtcaaaccatcccgaggcgcactatcgcacgctgtctgttccaaagcggggcggaggccgaagaacccttcgtgagccggatgccttgctgaagaaggtgcagaagaacattctgcgccatatcctggcgggggctccagtcagtgaatacgcctgtgcctataggaagggaatgggcgtgaggcagaatgcagccattcacctaggacaacccatgatccttaaactggacatccacgactttttcggcagcataacattcccaatggttatgtggagcgccttccctggcacattgttcccacctgccgctgctaccatgctgactagtctctgctgctttagagatgtcctaccccagggggctcctacatctgcagcgatttccaatctggtcatggagccttttgatagacacatgggtgcttggtgtgcagccagggggatacggtacagtcggtactgtgatgatatgactttttccggtgttttcgacgctggggaagtggaagccaaagtgcgcgcctttttggaagtgatgggcttctccttgaacaagaagaagaccaaactgatgactgctggtcggagacaaacggtaaccggactggtggtaaacgagaaattacaagtgccccgggaataccagcgagcactccgccaggagctctatttttgtgagacatacggggtgcgaagccatttagaaaggaaaaatggaagagccccctctgaggaggaggccgcacgttacctggaaagccttgcaggcaaagccgcttacgtcgcgtcagtggcacctgaatccgagaatgccaggcgcatgcaggagaagatcaagaaactcatcaaaaagtga

SEQ ID NO: 9489 - RNA, 999 nt, unidentified
  source 1..999: mol_type = other RNA; note = synthetic construct
atgcccgacaccgatgtgtggaaatattgcactacagcccagattaaacaatttctcgtgagcctgcgcctacttgggaatactgattggtcagacgagaagtatatcgcatctctctacgcggtgtctcgaaacattaacaatcattaccagcagactacactcctgaagagagacggaacacagagacaccttttggtgccagacaaactcctgaagaagattcagaaaaacattctgcggaaccttctgcaggacgttcccctcagtgcccatgcaaccgcatataggcaggggacggacatagtggccaatgcccaagctcacctgggccagagacagatcctaaaactggatatcgtggactttttcgggtctatcacattcatgatggtctgccggtcagtctttccaagtctgtacttccccccctccgtgggcaccctgctaacaaatctttgttgttacaatgacgcactgcctcaaggcgctcctactagcccagccatctcgaacattgttatgaccccgttcgacaactacataggcaaatggtgtcaggaaagaaagattgtttacacgcggtattgtgatgatatgaccttcagcggtgattttgaggctaagcaactcaagaataaggtgagggccttcctgcaggaaatggggttctccttaaaccaacataagaccaagttattcacttgccacaccaggcagctggtcactggaatagtcgtgaacgagaaactgcaggtgtccagggaatatcgaaagcagttacgtcaagaactctatttttgccagaaatttggagtactgtcacacctcacacagatcaataacggtctgatcgcgaaacaagaggatgtcgagtcctacctgcaaagtttgttgggcaaggctaattttattgtacaggttaaccctcaggatgcctacttccttcaggcccagagcttgatcaagcagttgatccgcacccaccgcgctgagtga

SEQ ID NO: 9490 - RNA, 999 nt, unidentified
  source 1..999: mol_type = other RNA; note = synthetic construct
atgcccgatatgcctctgtggaaatactgtactacagcccactatctggagtttttgattagcctgcagttgtttggggatacagactggtgtgccgaaaagcagatatcctgcttgtatacgatatccaatgatgtaaacgcccactaccagaggacaaccatccttaaaagagacggcacacctcgccacttgctggcgccagatcccctgctgaagaagatccagaagaatatccttagaaacattctggcacctgtccccgtttcaccatacgcgactgcttaccataaaggcgcagacgtggtggccaatgcggcagctcatctgggtcaaaaactgcttctcaagctggacatcgaggactttttcggtagcataatcttcccaatggttcggaggagtgccttccctgatatctatttcccccccgccgtgtctacccttctcacacatctgtgctgttacaacgacgctcttccgcaaggagcaccaacctcaccgactatctccaatttagtcatgaaaccattcgacagccacattggtgaatggtgcagtgctcggggcattatctacacgcgatattgtgacgatatgaccttttcaggcgattttgacgccaaagcagtgaagaacaaggtgggccacttcttacaagccctaggattcagcctcaataaggagaagaccaagctgctaacccgccacactcgacagtctgtgactgggattgtcgttaaccagaaactccagctcagtagggattatcgtagacaactccggcaggagatttatttttgccagaagttcggggtagtgtcgcatctgaaacggatgaactaccctctggagtctggagatgtggaacgctacctccaggccttacaaggcaaagtcaatttcctgttgcaggtgaatcccggggacgacgtctttagacaggctatgtccggaattaagcagatgatcaaggctaacaggaactctcagtattga

SEQ ID NO: 9491 - RNA, 1005 nt, unidentified
  source 1..1005: mol_type = other RNA; note = synthetic construct
atgcccgacaacgatctgtggaagtactgcactgccgagcactgtaaagaactgcttctcagcttccggctgtttggaaacactgcttggacaggtgagaagcaaatcgcgtgtctctatgccttgagcaggcacatcgggaaacactacgcccgagccgtaattcctaaaagggatggctccgcccgccatctattagtgccagacccccttctgaaacaagtacagaagaatatactccatcacgtcttggctgagatgcctgtctcgccgcatgctacggcctaccaccccaaggcaaatgtattcgccaacgccaccccacatctgcgtcagccacaggtgctgcggctggacatcgaagatttcttcggtaccattacattcccaatggtgtacagtcaggcatttccctatgtctactttccccctagcgtgcgcacattattgacacacctgtgctgctaccgggactatctgcctcagggcgctccaacttccgccgatatctctaacctcgtgttaaagcctttcgatgaccatatggggcggtggtgttctgaaaggggcatcacatacacccgatattgtgacgacatggtcttttctggggatcttgacgcaagagcggttaaaaacaaggtccagaattttctgcaggctatgggattcagccttaacctcaaaaaaacgcgcctctccaccagacatcagcaacaggtcgttaccgggctagttgtgaatgagaaggtgcaggcccctgtgcaatatagaaaggctctcagaaaggagatttacttctgccagaagtatggagtgcagtcacacctgactcagactgcagaccagacctacctgccccatggccacaacggcgttatgaggtatctggcatcactgttgggaaaagtgaattttgtgcttcaggccaatccgcaggatgcttactttcaacaggcaaagagtgcgatacaacacatgcgtgcacagctgaaattggcttga

SEQ ID NO: 9492 - RNA, 966 nt, unidentified
  source 1..966: mol_type = other RNA; note = synthetic construct
atggatttctctcagtcacaaatcgaggaggtgcttgctctacctctgctgaccgacaagactcccgaaaagaggcttaagaccctctatgccctgtccaatcatgccgaggaacactaccatcccgttaccgccgcaaagcgcaatggcggtaggcgcaaaatccttgtcccggacgctttactgaagcaagtgcaaaggcagattctccacaatattctggagaaacaaccaatcagccgatatgccaaggcttaccatccaggggccgcaattcgggaaaacgcggccgtacaccttcaccaacccggcatactgaagctcgacatagaaaacttctttccgagcatcctgtttccagatgtcctgtccagttgtttctcctcgcagcggttttctgtccccatgggcaccttactgacgaatttatgttgctatcaggggtatctacctcagggggccccaactagtcctgcaatttccaatttggttctctaccacttcgacgtgtggatcgggcagtggtgcggtcagcagcatatccggtacactagatactgcgacgacttgacattttcaggagattttgatgcagccttggtgcagggtagagtcgagggatacctgcagacgatgggcttcatgttgaaccagaaaaaaaccagatggatgacagcgcaccagcagcagatggtgacaggcgtggtagtgaacgaaaaaatgcaggtgtctcgcgcgtatcgaaggaatctccggcaggagatttactactgtagaaaatatggagttcagagccaagcagcctatgctgctggcaaagacgccgctgagataggccccggagatgggaagcgttacctgcaaagcctcctgggaaagattaacttcgtcctgcagatcaaccctgatgacgcagaatttcagcgtgctgaggaagaggtgaaatcatggctcacagccaagtga

SEQ ID NO: 9493 - RNA, 1032 nt, unidentified
  source 1..1032: mol_type = other RNA; note = synthetic construct
atgtatatagatcataacgaggtcatcttccagccttttgatgtggaatacgtggttgaacggggtctggagcgggccatggaagaggcatttgccttccaccagaattgtcgcctcccgttcctgatggacgtcagccaactggcaggttttttgtctttaaccaaaaaggagacgtttcggttcgtgttcgcctgtgattcaatgtaccgtaccttttccttgccaaaaagaaccggaggtacacgccagattgatgctcccatgcccgagctatcttgggctcagtatcggatcacccgggagatcctaaataagctgcctattagtcagtacgcgactgcttatcataaaggagcgagactgactcagaacgcctcaccgcacacgggcagacgctatcttctcaagattgacctttccgactttttccacaatatccgcatgactgacgtgcattcgcgagttttcaccccctactatcctaaacaaattgggtacttcctgtctctcatctgctgcaaggatgggactctcgctcaaggggcccctagctctccagccatcagcaatatcgttatgagatgctttgacgagcccttcggccagtggtgtaaaaaacgaggcctgagctacacaaggtactgcgacgatattaccataagtggcgatgtgcccctctatagggcctatgaaaaagcatcactgtggttgaacaacatgggctttacagtgaatgaaaagaagacaaggtttataaccgacgccagcaggcagacagtgacagggttgactgtcaacgaaaaggtgagtgtgccatccgactacaaaagaaagcttcgccaggagctgtactatgtagagaagttcggaattagatcagctgcggatcacatgcgtctgcctgacgccctgaagtactgtcagtccctgatgggccgaatcaattacgtacttagtgtcgagccagccaacgaatccttcctcagggcaaaggacgctttaagcggacaatttgcattctgcgtctga

SEQ ID NO: 9494 - RNA, 1032 nt, unidentified
  source 1..1032: mol_type = other RNA; note = synthetic construct
atgtacattgagaataatgaggtcatctttcggagctttgacgtgaactatgtggcaaaacatggcctggaacaggccatggatgaggcgttcgccttccacgaaaagtgccgcctcccgtttctgatggatattgcccagctcgctgggttcctgagcctgactcaaagagaaacctataggttcgtttcaaagtgttcccgcatgtatcggtctttcgatctgcctaagagaactggtggcactagaaggatcgacgctcccctacccgagctgagttgggcccagtacagaattgacaggacaatcctgcgcaagatccctattagccgatacgctaccgcctaccacaagggtgccagattaacacgaaatgctctcccccataccggaaaaaaatacctactgaagattgacctgtcagatttcttccacagcatccgaatctccgacgtccatggtcgggtcttcgccccatactacccgaagcaaatcggctattttcttagtcttatttgctgcaaggatgggtctttggcccagggagcgccaacctctccagcaatatcgaacatcgtgatgcggtgtttcgacgaacctttcggccactggtgtgagaaaagaggcctctcatacacacgctattgcgatgatatcgcaataagtggcgacgtacccctttacagggcctacgagaaagcaagtttatggctcaacaacatgggatttaccgtcaacgaaaaaaagacgcgttttataaccaacgcttccaggcgtacagtgacggggttaactgtgaatgaaaaggtcagcgttccctcagactataaacgcaagttgaggcaggaactctattatgtaaacaagttcgggattttgagcgcagccgcctaccttaaactgccagacgctctgaagtactgtcagtccctgatgggacgggttaattatgtgctgtctgtggagcctgagaatgagtcctttataaaagcaaaagaggcgttgtctgggcagtttgctttttgcgtgtga

SEQ ID NO: 9495 - RNA, 1038 nt, unidentified
  source 1..1038: mol_type = other RNA; note = synthetic construct
atgtatatagacaaagacgaagtcatcttcgagttcttcgacgtggagtatgttacgaaacatggcctggaacaggctatggatgcagcagtagcctttcaccagaagtgtagattgccctttctaatggacatttcacaactggcagcgtttctcagcctggacagacgcgaactgtttgggctggtcaaaaggtgcgatacgatgtacagaagcttcctgctgcctaagaggaccggtggttaccgacagattgacgctcccgcctacgagctgacagcgtaccagtaccgtattttgcaccggatccttggacgcatcccaatttccagatatgccactgcatatcacagaggagccgcactcaccaagaacgccagcccccataccgggaaacgctacctcctgaagatcgacattaaggacttctttcactctgttaggttatctgatgtacacgccagagtgttcgccccttattatccgaagcagattggctacctgctgtccctcctttgctgcaaagacggccggcttgctcaaggtgcgccaacatctccagctatctccaatatcgtgatgcggtgttttgatgagcctttcggcgaatggtgtgagaagcgagggttgtcgtatacccgatattgcgacgatatcactatctcaggcgatgtgcccctctaccgggcacttgagaaggctagtctatggctgaataacatggggtttaccgtgaacgagaaaaagacacgctttataaccaatgccagtaggcagacagtgactggattgactgtgaatgaaaaggtgaacgtcccaagcgactacaaacgccgtttacggcaggagctctactacgccgccaagttcggggtcagttcagccgctgattataaaggcctgacagatgctgaacaatactatcagtctttgatgggatggctgaatcatgttctcagcgtcgagcctgagaacgaatccttccttaaggcgaaacaggccttacgggaaaggtacgctgcagataggcgtatatga

SEQ ID NO: 9496 - RNA, 1050 nt, unidentified
  source 1..1050: mol_type = other RNA; note = synthetic construct
atgatcgtgaagaacgactccgttacatttgaaccatgtgacatgccatttacccggaaattcggatgtgatgaggccgccaaaatggtgctggactttaaggcctttcatcctaaactgcctttcctgtacgacactcaccagctcgctgactttctgaagactggccgcaaaaccctcttcgacttaacgaatcatcctgaggcctgctattctacagtgagtgtgccaaagaaatccggcgggacaaggacgcttaatgttcctaacgatagacttaaagctattcagcggaagattttgtatgagattctcgcgtacctgcccgtgagcaaacacgccgccgcatatcacaagggagcaaggcttactgacaacgctgccgctcatatacaccatcgttacctcctgaaactagacctctctgatttctttggctccattaggttcgactctgttttttgctcagcattcaatgctcactattttccccgacaaatcggagtcatgctgactagcctttgctgtttcgacgatgtgctaccacaaggcgcgccgacatcacccgccttatctaacttggtgatgaagcggttcgataattccttcggagcgtggtgcagtgcccgcggttttagttacactagatactgcgatgacatcgctgtctcggggaactgtcctgtttaccccgcttacaagaaggcccgcctgcttctggagaacagcggcttcgaaatcaatgatgccaagaccagatttgtcaccgacgccggacgccaaaccgtaaccggtctgacagtcaatgagaaactgagcgtccccagcgattataagaggaaactgcgtcaggagttgtactatgcaaaaaagttcgggctggaaaacgtgatccagaagcagaatctgacagattacatctccggtggcaaggctgatgctgccagatatgcaatgcacctgttagggaagttgcattttgtgttgtcagtagaaccggataatgcatacttccggaacgcacgacagttcctcataacccagctctga

SEQ ID NO: 9497 - RNA, 1035 nt, unidentified
  source 1..1035: mol_type = other RNA; note = synthetic construct
atgttggtgagtgacaacgaggtcatgttctttgagtctgatatgaggtttgtgaagagattcggcctggaggcggccactgacatggtgcttgactattctgcgataaataagacaccgttcatttacgacttcttccagctgagctcgttcctcaggatcctcccatccgatttgaggaaactgctggatgatatccctgggagctaccgctcactgcaaattcctaaaaaatcaggaggatatcgcgagctgaaccaaccactcgggagactcccggacatacaggagcgaatctacaccggtatcctgaaacgacttaagtccagcccttacgccaccgcctaccatcaaggagcccacctgtcagataatgctgcaccacacattggcaagcggtttctcttaaagttggacatcaccgatttttttggtagcatacgcttcgacatggtactaagttcagttttcaataccagcctgtacccccggcacataggagcaatgttgacgtctttatgctgcctcgaagacgtactgcctcagggcacatgtaccagtccaactctgtctaatctggtgatgaagaggttcgacgacatctttggggcttggtgtaaacgtcatggctttgattatacacggtattccgacgacattactgtctccggtaacacatctctttatcccgcctattgcgcagccaaaagcatgctgcacaagatggggtttgaactcaacgaacgtaagactcatttcattacggatagctttcgccagaccgtgacaggactaaccgtgaacgaaaaagttaatgtcacagccgcttacaagagaaaactgaggcaggagctttactacaccgatagattcggcatcgagagtgccgcacagtacctgcatcagcccgatgctaagaagtattatcagcaactaatgggcagattgaactttgttttatccatcgagcccgatcacacttacttcattaaggcaaaggaaaaactttccgagcagcgggctgaaatcatttga

SEQ ID NO: 9498 - RNA, 996 nt, unidentified
  source 1..996: mol_type = other RNA; note = synthetic construct
atgcgcatcactgaaggcaccgtccggttcgacggatgtgaccgccattttgcagagaagtttggtgcacaccaggccgccgaaatggtgctggattttgccagtactaatacacatcccttcctttacgatacctaccagcttgcggcacacctcgggttacgcagaaaggccctgttcgaactcgtgaggcgaccaggacgccattatagaacactgcggatccccaagaggtcaggcggaagccgtaccctaagcgtgcctgacgaccggttgaaaaccgtgcagcggacggtactgcacacgattttgtgccactttccggcatccgcttatgctacagcttaccagcctggcgccacactcaggcagaatgcagcccctcattgtgggaagaagtacctactgaagctggacctggaggacttttttgggtctatcaggttcgatcaggtgtatggcgccgtgtttcacaccagaagattcccaaaacagattggcgcaatgctgactgctctgtgttgtaaagatgatgctctcccccagggagctccgacatctccacagttaagtaacctggtcctgaaatggttcgacgatactatgggggcctggtgccaacgcagaggtatcgcctacacgcgttattgcgacgacataacattctcagccgatagacctttgtacgacgcctatagaaaagctgttggcttactcgagcatcaagggttctccattaacgaagaaaagactcggttcgttactgcggcgggccgccaaaccgttaccggattgaccgtcaacgagaaggtgggggtgcccgctgattttaagagggcactgaggcagcaggtatactacgccctgaagtttggcgccgagccccctgagtatcggcgacttctcggtaaagtccaattcgtccttcagacagctccagagcacccatggttctgcgatgcgcgagaagagctcataaggcgtctgaaaggatga

SEQ ID NO: 9499 - RNA, 1065 nt, unidentified
  source 1..1065: mol_type = other RNA; note = synthetic construct
atgcacttcgagggggaaaaaatcgttttctccgccgcagacatcgagcgggctaagcgtaccggcattgaaaatatgctcctcagggctgaccaatactgctccgccttctctatcccatatatctgtgatttgtttgagctgtctacggaactcgggcttcccgctgaggatctggcccgaattggttcaagagcttctatgaagtaccgctgttattacattaagaccggctcaggcaagttcaggaagatcgaggagccggacttcgagctgagaatagtgcagaatcggattctgaaccatattctccgatactatcggatctcggagcacgcggcagcgtatcacaaaggcgccagcgtcaagaacaatgccatgccacatgtcggtaaaaggtacttgctgaaaatggacctctcagacttttttggtcatatcacagattcaatgctgatggataccgtgtttagcgaacagcacttcccctaccctgtggggcgcaccttaactgatatctgcacccgtaacggatctgtgcctcaaggggcctgcacttcccctgcaatatctaacattgtcatgaaaggctttgacgatcgaatgggccgttggtgcagttatcggggaattagttacacacgatatagtgacgaccttacttttagttccgatgaacctttataccccgcctacagaaaggctcgccgcatgctggaagaaatgggattcgggattaacgacgacaagacacactttataacaagcgccggaaggcagcaggtaacgggactggtggtgaatgacaagctgggaatcccagcggattacagacggcggctcaggcaggagatctattacgtattgaaattcggggctagggatgcatttagcagaagcgatgattgtcgcaatgagcccggcatgaccctacggagatatctgcttaggctgatcggcaaaactgaatatgttcttcagatccgcaacgacgacaggttcttcagagaggccaagataaaattggccgaagagattgctaagctaagctccgcagaggaatga

SEQ ID NO: 9500 - RNA, 1059 nt, unidentified
  source 1..1059: mol_type = other RNA; note = synthetic construct
atgtatacccagaacgggcgcatcacatttgagaagagcgatctgaagttcctacagaaacatggactgtccaaggcagtggtaatttatgaggaacactgtgcccactctaacctccccttcgttactgatcatcatcaattggcaggattgctagggtgctacactaacgtactgttccagacccttagaacagtggatgagttgtattacgacgcagccatcccaaaagctaccggcggctacaggaccttacaggtccctactcaccctcttaggtacatgcagacagttatcctccacagcattctggacaaactgccagtgtcaccttatgccacggcataccacaagggagccagaatcactgataatgctaagccccatcagcacaagaaatacctgctgaaaatggacctccaggacttcttcagcagcataacatttgaacaggtcctctccggcgtttttcacaagggacggtttcctacccatgtcggcgtatccttgacggcactctgctgtaaaaacggcgtgttaccgcagggtgcccctacatcaccagccctttcaaacctggtcatgagtcatttcgatggtgttatgggggaatggtgctgtagacaagggttttcgtatacacgttattgcgacgacatcaccgtgagtggcaatcgacccctgtatgctgcctaccaaaaggccaaaggacttttggaaaatatggggttcgaactgaatgagaaaaagaccagattcgtgactgcagctcaccggcagacggtcaccggactgactgtgaatcaggggattggcgtgacagctgattataagcgcaacctgcggcaagctgtgtattacaccgtgaaatttggcgccgcggatcacataaggcagcgcaacctcactcggtttatggttaatggcgtgccacagaccgagcgatacctcgcccatttagagggtcaaattcgttacgtcctgtccgtggagcccgacaatagggctatggtcaagctgcttgcggacctgtctgcgtctccgccctacatgggttga

SEQ ID NO: 9501 - RNA, 1014 nt, unidentified
  source 1..1014: mol_type = other RNA; note = synthetic construct
atgattattaacaagaagtacgagtctatcgtctttgatgaaagtgacatgaatttcgtgtctaagttcggcattcaggaagccactgatatggtgttcgactacctgtcgactaacaaaacaccgtttatatacgacgtttttcagttagcagactatctgcaaatcaaactacccaagctgttcaggttggtcaataaggccgatgaactttattccaacgtcgtgatcaagaaacggaataagagcgatagaattctgtcagtacccgactattatctcggtagcgttcagaagaggatcaaccgcaaaattctcagtaaaatcgacataagcaagtatgcgaccgcttattataagggctctaatctgctgaaaaatgtggagaatcattgtgggaagaagaacatcctgaagatggacattacagactttttctctagcataacctttggcatggtgctgtcaagttgttttaacacctctagatttcctcggaatatcggttacatgttaactaccctttgttgtaaagacgactgcctgcctcaaggaacgtccacgagcccagcaatttcaaacatcgtcatgaagaatttcgatgacattctgggcaattggtgcgagaagcgcggaatctcctacacaaggtattgcgatgatctcaccttctcctccgatgaggatttgtaccctgtgtacgtcaaggccaagtccatgctgaacgatatggggtttcaggtgaacgagaaaaagacacacttcatcaaaaactccaaccgacaagaagttactggaattgttgtgaatgaccatccacagctctctaaagactatagacggaaattgcgtcaggagctttacttcgtattcaagtacgggataaaagatgcccttgagcacatcaacaagaaagaagtgtcgaacaaagagatttacagctacgcttgccagctatcaagtaaaatcagctacgtactctttatcaatcccaatgataaggaattcgtgtga

SEQ ID NO: 9502 - RNA, 1062 nt, unidentified
  source 1..1062: mol_type = other RNA; note = synthetic construct
atgaaggtggtgaacgagacagtggagttctttgaatgcgacatgaacatggtgagtaaaattggattgatggaggcagttgagatggttctcgacttttcctcaaccaataccgtgcctttcatttatgatacgtaccagctgtctgatatgtttgctattgggcggaaaaatctgttctccctgatccgaaattgcgaccagaactacaagcagattaacatcaagaagtccaatggtgatattagggttctatattctcccaggactcgactgaaagcaatccagaacatcatcctgaaggagatcctgtacaaaataccagtctcaaaatacgcgacggcctatcataagggtgcgaagcttatcgataacgccaagcctcactgtgggaaaaaatacctccttaagatggatctgaggcattttttcgactctattactttcacccaagtgtatagctccgtgtttaacacatgtaggtaccccaaacagattggcacaatccttactaccctctgctgtcaccaggatgtcttgccacagggagcccctacctcacccgcactgtctaacatagtcatgaagagctttgacgactacttcggcaaatggtgcgaaaagagaaactttagctacactcgctattgtgatgatatcactgtaagcggagattccagtgtgtacccggcctatctcaaggctgaggccctgctggaaaatatggggttcgagatcaatcagaacaagacccacttcataacaaatacaaacagacaggaagtaaccggacttgtcgtgaatgaacgcgctcgggttagtagcgactatagacggaaattacgccaagagatacactatgtcacaaagtatggcatcctggacgctttaaaacatctcaaagactctggctatgagagcgtatactcatactatagttcgctaatgggccgtattaactacgtgctgcaaattgaaccagaaaatcagcaaatgttgaatctcaaggccgacctggaaaagtccttggagaagtacgagtggcagaccatgttacagtga

SEQ ID NO: 9503 - RNA, 1062 nt, unidentified
  source 1..1062: mol_type = other RNA; note = synthetic construct
atgcttataaaaggacagtctgtgacctttcacgccgatgatatgcattttgtgaagaagttcggtatcatggaagcaactaacatggtcctcgattttgcttcgacttcaaacttgccatttgtatatgacacttaccaactggcatctctgctccagttgcgtagatcctccatgtttaaaattgtgcgaaagtgtaactcctattatagggacgtggagcttaagaaaaataatggcaaagtccggtacatctcagcccctcttgacattctaaagtggacacagaagtgcatactgacaaacattcttgagaagtaccccgtcagcaagtttgccacagcataccggaagggactgaaactcgttgacaacgctaaggtgcacacttctaagaaatatatcctgaagatggacctgaaggacttcttcccaagcatcggcttcgaacaagtatattcctgtgtgttcaataccaggcacttcccgaaacagattggagttatactcacgagcttttgctgcagaaatggggttttgccacaaggcgcgcctaccagtcccgctattagtaacattgtgatgcggaatttcgatgatattttcggagcatggtgtgagaagcagggttttagttacactcgatattgtgacgacatcaccgtgtcaggtaacaaaagcctatatgtggcctttgtgaaggccaaggcaatgttggagaagatgggctacgaaatcaataccaaaaaaacgcacttcctgacaaatgcctcctgccagacagtcaccgggctgaccgtgaacgagagagctaggatccctagcgattaccgcagaaatctgcgtcaggaaatctattatgcccagaaattcggggttaaagatgcggtcatgcgggccaatcgcgaagagtacatagtagatggcaaggtggacgaacataggtacatctctcatctcgaagggaaagtccaatacattctgcagatcgagcccgagaacgagtacttcaaaaaggctttaaaaacagttcagaacctgcgccccttaggcaacttttga

SEQ ID NO: 9504 - RNA, 1101 nt, unidentified
  source 1..1101: mol_type = other RNA; note = synthetic construct
atgatcattagaaatggcacaatcgagtttgggcacggggatatgcattttgtggagaaagtgggcctttctgaggcggtggagatggtcctcgatttcaaaagtcagaataagataccctttgtatacgacacctatcagctagcggacctgctgatgatcagaagaaaggacttgttcagcctgagcaagaatgccgacagtttttacacctatgccactattaagaaacgtgatggatcgaagaggatcttatgtgtacctgacgcatatttgaaatctgtgcagcggacgattctttccacaattctctccaaacttccggtttccgagtacgctacggcttataggaagggctgcaagctgcagtctaatgcccagccccattgtggtaaaaagtacctgctgaagatggacatctgcaacttcttcgacaatatcacctttatgaaggtctactctagtgtcttcaacactcgccattttccaaagcaagtgggagtgatgctgactcaactctgctgtcggaatgatgtcctaccccagggtgctcctacaagcccagccatttccaaccttgttatgaaaagtttcgacgacacttttggagcatggtgtcttcgacacaacctgagctatacccggtattgcgatgatatcaccgttagcggcgatatacctctgcacaatgtttatctgaaggcctctgaaatgttgcacaagatggggtttgaaatcaacaagcgaaaaactcacttcgtaaagtacacagaccggcagtcagtcacagggttaaccgtgaatgaatgcattagggtcgactcaaaatataagaagcaactcaggcaggatatctactacactctcaaattcgatgtggtgtccgcaatgaaacgctcactgtccttcgaatttgacgaaaacgaggacattgatagcgctgtgataaaatacttaaacagcctgatcggcaagacagcctatgtgctgcagatagaaccagacaacgagtacttcaaaaagctgctgaagaaattgaccgacctcctcgatgagacgaagttggatattagacgctcaaaatactttaccttctactga

SEQ ID NO: 9505 - RNA, 1098 nt, unidentified
  source 1..1098: mol_type = other RNA; note = synthetic construct
atgtatattgaagataacatcgtcaagttcgagtattgcgatatgtcttttctgaagaaattcggagtggatgtcgctgcggatatgtaccttgacttcaagagtgttaacaagatccccttcatttacgatacttatcagctggccgacttctttggcattagacggacaaacctctttaaagtgacgaagaatatcgacaaattctactacacaactaccattaagaagcgcagcggcggggtgcgcaagttgaatgtgcccgacgacacgctgaagtttatgcagaggtgtatactcaaaagaatcctgagtgagtttaaggtgtctaaatacgctacagcgtataagaagggggccacactcaaagataacgctagagtgcactcagcaaagaaatacatcctgaagttggacctgaaggatttcttcgacagtatcaccttcatgcaagtctatgacgccgcattttcgacccggtactttccaaagcaaataggggtcatgttgactaccctatgcacaaggcaggacgtcctaccccagggaacacctacatctccagttctgagcaaccttgtaatgaaaaatttcgacgattctttcggcgcctggtgcgaagagcggggtttctcctatactcgttactgtgatgatataactgtctccagcgataatgagctgaaaggagtgtactcaaaatgtaagttcatgctgaccaaaatgggctttgagattaacgagaaaaagactcggtttttaaccaatggctcaagacagaccgtgaccgggttaacggttaatagcagcgtaaaagtaccgtccccttataaaaaagagctgaggcaggctgtgtattacaccctcaagtttactgctgccgatgccctcaaacgagacaagaactttgaacgtaaaaccgaccttcctattgacgaagaagcattgcgataccttaactgcttaatcggtaaggttgcatatgttctccagattgaagaggacaacgtgtattttaagtccgccctgatcaaactggtgaatcgcaaggacgagctggagttcaatatcaagagggaaaacaattacaacttctga

SEQ ID NO: 9506 - RNA, 981 nt, unidentified
  source 1..981: mol_type = other RNA; note = synthetic construct
atgattgaagacttttatagcgtgaattccaacaaactcccctttctaacggatcagcgccaactggctagtatgttaggcatcgagttgcggactctctacagtatccttaagtctatcaacgcaaattacacgacacataagtttgtgcaaaaaaatgggaaagtccggaccattaatgagccatccaccaagctgaagtcaatacagcgcttaatttacttccggatcctccagcatctgccagtttccaaatatgccaaggcttatcgtcccaggatcacgattaaacagaatgctctgccccacataggaaaaaagtatctcctgaagatggacatcaaagacttcttcccttctattactttcacacgagtctatggcgctgcctttaacaccaagttctttcccaagtatatcggcactctgctcacaacactgtgctgtaaggacgactgtctaccgcagggggcccctacctcacctgcacttagcaacctggttatgaaaaacttcgatgagtacctgggtaagtggtgcgaggaaaagggtattgcctacactaggtactgcgacgatctgaccttcagtagcgatatgccactctacggtgtgtaccttaaagcgaaatatatgctggaaaatatgggattcgacgtaaacgagaagaagaccaagttcatatcttccaaaaacaggcaaaccgtgacagggttaaccgtaaacaagaagctgaacatctcttcggtgtacaagcgagaacttagacaggaggtgtactatgtcttgaaatttggcgcaaagacagccattctcagagggggacacgaagattatataattggcggagaaactttgaaagtggactacctttaccacttgctgggcaaagtcaattatgttctgagcatcgagagagataataagtggtttcaggagagcaaagggtatttgactgatatgatcatcaagtactcatga

SEQ ID NO: 9507 - RNA, 1083 nt, unidentified
  source 1..1083: mol_type = other RNA; note = synthetic construct
atgttgaataagaaggagatgcagaagatgaagataaccaaagggcacattagcttcgagcaatccgacatgcacttcgtagagaagtttggcatcagcgaggccttccggatggttggtgactatgtgagcgagagaaagactcctttcgtgtacgatacgtaccagctggcctatctgctaggcattggcagaaaagatctcttttccctggtcaaaacagttgataaccattaccgcccggtcaacatcctgaaaaagaacggtaacattaggacactgattatcccctccagtaaactgaagaggattcaaagtgttattgcagggcgcatcctgagctgttactccgtgtcagaatatgcttacgcttaccttaagagaaagacaatctacgacaatgcctccgtgcattgcggaaaaaagtacctcctgaagatggatatcacagattttttctcctcgatatgtttcgataggatctattctgcggtcttcaacaccaaatatttcccacggcaaattggggtcatgctcaccgctctcgtctgcaatgatgacgtgttaccccagggcgccccaactagcccagcaatctctaatatcgtgatggcatccttcgaccggcttatcggaacatggtgcaaagagcgtggggtgtcttataccagatattgtgacgacctaaccttttcaggaaacgtacctttatacggagtctttaagaagagcaagagtttgttggaagaaatgggctttgaagtaaacgaaaagaaaacccgcttcattacttcttcagacaggcagacggttactggtctgaccgtgaatgaaaaggtgtctgtcccttcagactacaaacggaaactccgacaggaggtgtattatgtgctgaaacacggcatagttaacactgtgctttttacagagaataaggagttcatctctgatgggcaggtagacgaggaaaaatactacctttcgatactgggacgagtgagttacgtgttgcagatcgagcccgacaataggttttttagcgaggcccgtaagcgcattatggaagatagatataaaacctga

SEQ ID NO: 9508 - RNA, 1050 nt, unidentified
  source 1..1050: mol_type = other RNA; note = synthetic construct
atgcagatttttatcgacgacgtcacattcgatgcctgggacctgcactttgtggaggaatttggggtgttccgcgccacagagatggtgctggacttcttcgaacacaataggcaccctttcctgtatgatacctaccagctggctcacttcttacaagtggagcagaaacagctcttgacaatccttggacgatgtgatacgctgtatagaaaggtgaagctgcccaagaagaatggaggcgtcagaattatcagtgctccgctcagagatttgaagcagatgcaaaagatcatcctggaacacttcttgaagaaactccctgtgtccgagcacgccaccgcatataaggaaggtggaactataaggaaaaacgcgagcgtccattgcggcaaaaaatatcttctcaagctcgatattgaggatttttttgactgcatctcagccgaacgcgtatataaaagtgcctttcatacccagtactttccccagaagattggaaaaatcctgacacggctttgtaccaaaaacggctacttgccccaaggggcgcctacatctccaatgctgtccaacctggtgatgcggccctttgacatggtcatgggtaactggtgcaaaaaacacaacataggctacacccgctattgtgacgacataacgttctctgccgacgtgccattgtacgtggcttacgtaaaggccaagagcttactggaaaaaatggatttctgtctaaacgaggagaagactaagtttatcagatcaagcaataggcaggtagtgaccgggttaacagttaatgagtgcattcatgtgactgcagactataagcggaaactgcgtcaggaaattcattttgttctcaagttcggcctgaaagatgcacttctccataccactccaaatccattcgttactgaacaagctgtccataccgagcggtacttccagtccctaatggggcgaattcacttcgttctgcagatagagcctgagaacaggtactttcttgaagcagagcagaagctgaagggtatcaatcactga

SEQ ID NO: 9509 - RNA, 1245 nt, unidentified
  source 1..1245: mol_type = other RNA; note = synthetic construct
atgccaaagtcagatactctcaggcggatagccaatcatttcatgatcctggattcccctcccctcaatcaaacaatcctgtactgcaaagggctcatttttggtcgcaccttacacatgaaaatagagggcagctgtgtcacattcgagccctgcgacgccgcttttgtgaaaaaattcggtcctctagaggctgccaacatggtgttggactaccacagcgtccatccaaatatgccgttcctgtacgatgccgaacagctggctggcttcttcgacatcagttgcggggagctgaatcacatcgtaaaccatattcagaaggaatacaagaaggcatttcttccaaaaaaagatgggacctatcgcagcctttatattccctctatcagactgcagttttgtctgggacctatcaaagacaagatcctctctcagctgcccgtgtcaaagttcgctactgcgtaccagaagggatcctctacgagaaaaaatgcagaacctcacatcggcaagaagaacctgttgaaactcgatatcaccgactttttcgggagtatctccttcgagcaggtgttatgcgctgcatttaatactcggtatgttagtaagcaggtgggctttctccttacctcattatgttgcaagaacgatgccctcccacaaggtagccctacatctcccgcacttagtaatattgttatgaggcgatttgacgatcaaattggacggtggtgcaaccaaaggcagattacctacacacggtactgtgatgacatgaccttttcgtctgaccgcccattgtatggcgtgtatcagaaggttaaaaaaatccttttcgagatgggcttcgagctgaacgaggcaaagacacactttatcagcaacgccgacagacaaacagtcactggcctggtggtgaacgaaaagctttcaattcccagctcctacaagcggaatctccgacaggaaatatattatactctgaagttcgggattgaggactccatcgtccatggaaaccgtctcaacttcctggaggatggccagcctattcgctgtccaacgtacatgacccacctaattggatccgtacagtacgtcctacagatagagccggaaaataggtggtttctgaacgccaaacagaagctgctggattatgcgcgtgcctattttagagctgaagggttgggagaagaatactacttgcatagaagccgactgagggagaaagacgagtga

SEQ ID NO: 9510 - RNA, 1002 nt, unidentified
  source 1..1002: mol_type = other RNA; note = synthetic construct
atgccttgccggcgttacatcagggggaaggctccgccagacaacactcctaccaataagagaattacccctctgtttagcgttcgactgagattttatagggtgatcctctattgcaaaggactgtactccttccgcttgaagtattattctgcagctgtgattttcatgaacatcatagacagcaacgttgtgttcggcagcggagacgcggaatttgtgaagaagtttggtctatttgaggccgcccaaatggtgctcgattataaaagccgaaacaacctgccattcatatacgatacctatcagctggcagactttctgggcataaagcgcaaggagctcttctttatttcgaagaacaccgacaaatactacaacgcattcgagataaaaaagaaaaacgggaagccaaggcggctgtacgctcctgctagtaagctgaaggcctgccaagcagccattaaccgcctgattcttaaaaatctcccagtgtcagagtatgccgcggcctaccagaaaggctctcagatttcaaaaaatgccgcgccccacatcggcaagcgttaccttctgaaacttgatatcacggatttcttcgggtctatcagatttgaacaggtctacagtgccgcattcaatactcggtatttccccaaacagaccggtgtcatcttaacagagctgtgttgtttaaatgacgcattggtacagggtgctcccacaagtcccgccctctcaaacattgtaatgtacaatttcgacaactccatcggactatggtgcaaaaaaagaggaattgcctatactcgctactgtgatgatatgacgtttagctccgatcggccgttgtatggcgtctaccaaaaggtcaagaagatgttgtttgaaatgggctttgaactgaatgaggctaaaacacatttcatctcaaatgctgacaggcagactgtgacagggcttgttgtgaatgaaaagctctctatcccctcctcctactga

SEQ ID NO: 9511 - RNA, 1080 nt, unidentified
  source 1..1080: mol_type = other RNA; note = synthetic construct
atgctcatcaaaaagaatcgcatcattttcgaacagtctgacatggcctttgtcgagaaatttggagtgctagatgcagccgaaatggtgatgaattataaaactgtctgcaccttgcccttcgtatatgacgcagaccagttagccgaattcctgaaaataggtcgcaaagacttttttgatctaatcaagaactgcgatacttgttaccggccaattagcctgaaaaagaagtcaggcacatacagacagatttacgctccaaacgatattctcaagagaatccagaaaaccattctcgacaagatactgagtaagctgcctatctcgcagtacgcgaaggcatacagaatgggcgggactcttatagacaatgccgcagcccacattggaaagcgatacgtgcttaagctggacatcaccgatttcttcggtagcatttcctttgaacaagtgtattctgctgcttttcatacgaagtatttccctaaacagattggggtactgcttacaatgctctgttgccgcaaagaagttttgccccaaggcgctcccacatcccctgctctgagcaatattgtcatgtgtcacttcgataactatatcgggtcatggtgcgaggcaagagccatagcctatacacgttattgtgacgatatgacctttagctctgaccggcccctgtttggagtgtaccagaaagtcaagaccatcctgggcgaaatggggttcgagttgaacgagaaaaaaacccattttatcctcaacaccagtaggcagtcagtgacgggaatcactgtgaacgagaagctgtccgtgccaatccattacaagaggaagctgcggcaagagatatattacacactcaagttcggactcgtggaacaaatcgttcgattaggtaaaactgagttcttcatggatgcgaggccgaacgttcagaaatactacaatcacctgttggggcagattggctttgtcctgcaaatcgagcctgaaaataactggtttcagaatgccatgatcaagcttaagagttcctctttcttacagggcgagatggagctgtggaggcggtga

SEQ ID NO: 9512 - RNA, 1065 nt, unidentified
  source 1..1065: mol_type = other RNA; note = synthetic construct
atgaaaattgagaaagacaccgtgacatttgaagcgccagatgccgactttgtcaccaagtttgggattcaggcagccgccgacatggtgttggacttccactgctttcatccacaattacccttcctctacgatgctcggcagcttgctgcgtttctctctacatccaggcagaagcttctttattatgttcgccatactgcagctgcctatcaccccgtcacaatccccaaacgcaatggggacgtaaggatactctctgttccggacgacactttgcgacggtggcagcggaagatttgtagagagctgttggcgtatttgcctgtggcccctcaggctacagcctaccgtaagggcggggctattagtggcaatgcagccccacatgtgggcaagcgctacctgttaaaacttgacataagcgacttcttcgggagcatctgtttcgaacaagtccattcggccgcattccacacccgctacttttccagacaggtgggcttcctgttgacatccctgtgttgcaaagatggcgccctaccccaaggagcccctacatcacctgcacttagcaacttagtaatgaggaactttgatacctccatggcccggtggtgccagaggagaggtatcgtgtacactagatattgtgatgacctcaccttttcagctgatcgaccactgttcgctgtttattcaaaggcaaaaaacatgctggcagaaatgggattcgatctaaacgaggcaaaaactcactttatcacgaatgctggtcgtcagagcgtgaccgggctgactgtgaacgagaaggtcagtgtgcccgcgggttacaagcgctctctacgccaggaagtttactataccctgcggttcggcctcgccgatagcattctccggggaggacacgctaccctcctgacagacgatctgccggatacggagagataccgtcagcagctgctgggaaggatccaatacgtgctgcagatcgagccagaaaatcgatggttcagggaggccaagcaaaagctgctgagttgcgatgacagacctaaagtctga

SEQ ID NO: 9513 - RNA, 1068 nt, unidentified
  source 1..1068: mol_type = other RNA; note = synthetic construct
atgatagtcaaggaaaacaccgttattttcgaggcctgcgatatggcattcgtgaaaaaatttggaatcgctcaggcaaccgaaatggtgctcgattataaatccgtgaatccactgccttttttgtacgacacataccaggcagctaaattcctaggcgtcggccgattaacactgtttcagtacgcaaaaaatccggaacaggggtacaagcttataacgcttaaaaagcggagtggcgacaaacggcgaatatacgctcctgacatcgtacttaagcacctgcaaaccggtattctgaggaagatcctcatttatttcccggtgagtccctacgcgactgcctactctaagaattgcactctgcgcaataatgcggccccccatgtaggaaagaagtacctgctgaagctggacatcaccgatttctttgggtccattagattcgaccaagtgtattctgctgcctttaacactcggtattttccaaagcagatcggggtgattcttacctcactgtgttgccgcgaagaagctctccctcagggggcaccaacctcacccgctctgtccaacctcgtcatgcgaaatttcgataactcactcggcaggtggtgtcagaagcgcgggatcgcctatactagatattgtgatgacatgacgtttagctcggataaaccactgtaccccgtctacgagaaggttaaaagtatgctgtatgatatgggcttcacattgaacgagaagaaaaccaggttcgtgacaagcgccggcaggcagtctgtcacaggactaaccgttaacgagaaagtggccgttagcagcgactataagagaaaactgcggcaggaaatttattacgctctgaaattcggtttggaggattccattcggtttgccaagagaacagagtttatgcgcgacggtgtgttagacgccgagagatacgcgcaacacctcatcggaaaggcaaattatgtgttgcaaatcgagcctgagaaccgttggttcagggaagccttagagcgtctccagtggactcttaagtgcttggaaatgcagggatga

SEQ ID NO: 9514 - RNA, 1029 nt, unidentified
  source 1..1029: mol_type = other RNA; note = synthetic construct
atgcatatacagaacggtgccgtgacctttgagccacacgacatgtggttcgttaaacgggtaggttttgaggccgcatgcgagatggtgcttgactatgcaagtcagaacaagctgccattcctgtatgacacccaccaactcgctcactttctgcatattcccaggcggtacttgttcaggtggttccgagatatgagcagctgctacacccccatcgccttaactaagagatcaggaggcgttcggcacctgcatgtgccagtggaccccttaatgtgcgctcagcggaggattctgcaggatatagtgtctaggcttcccgtgtccccttatgcaaccgcatacgtcaagggaaagcgcttgactgataatgcggccccgcactgtgggcatagatatctgctgaaactcgatatcacagacttcttctccagcatccgttttgatcaggtgtactcggctgctttcaataccactcgcttccccaagctgattggggttatgctcacagctctttgttgttatgaagatgtgttaccgcaaggcgcacctacctcacctgccttgtctaatgtggtcatgagacggtttgacgatcgaatcggcgaatggtgcaagaaaagaggtatcgcttacactcgttactgtgacgacatgacattctcctcagataaacctctctttgccgtctaccaaaaagtgcgggggatgttggctgaaatgggactcagcctgaatgaaaagaagacacgatttgtgactcacgcctcccgccagagtgtcaccgggttgacggtaaacgagcgcgtggccgtcagttctgactacaaacgcgacctccgccagcaggtccattacgcccttaaatttggctatgcggatgccctggcgaagagaggcgacacgacatttgagaacggcgaccactacgcccaccatctaattggacgtgttagatatgtactgcagatcgagccacacaacacatggttcagggatgcactgcctaggctactgtggaagtga

SEQ ID NO: 9515 - RNA, 1185 nt, unidentified
  source 1..1185: mol_type = other RNA; note = synthetic construct
atgattctgagatttgcttctgcgtgtattagagctatctgcactgccactgttcgtaggtttctggtgttcgagaaaggaggagtgtgtgttcggaagatcggagataccctgatcttcacatctagcgatatgccattcgtgaagcgcttcgggatcgaggaggccactaaaatggtgggggatttctacgccgaacatgacctgcccttcttatttgacacataccagctgtcctcggagcttggcctaaggaggaagactttattttcactaacgcgaaacccagaaaaactgtactaccccgtgaccctcagcaaaaagaacggggggactcggaaattgcatgtgcctttcaccgtcttgagaggtatccagcgccatattctgaacgccattctgaacaaactgcctgtgtccagttatgccaccgcatatcggcgcaagcaccagccattgcataacgccgctccccactgcggtaagcgatatctgctcaagatggacatccgtgacttttttggatcaatacgctttgatcaggtgtacagagcggccttccatacaagacactttcctgtgcagatcggcgcaatgcttaccagtctctgctgttatcaggagaggctgccccaaggtgcacctacatcccccgcactttccaatttagttatgaagcactttgatgagcagatgggagaatggtgtcagaaacagggaatcgcatatacaaggtatagcgacgacctgacattctcagccgacgtcccgctctatcacgtctacaaaaaggctaaggccttcttggagcacatgggcttcgagctgaacgacaagaagacccacttcataactaatgcttctcaacagagtgtaaccggcttggtagttaatggggatacaccaacggtgagccgtaaaacccggagagcactgcgccaggaactatactacgtgcaaaaatacggcctcggggacgcgataatgcgaggtaatcgaacggcctttattaaggatggccggccgctcgtctaccgctatctgaaccacctcgagggaagggtcggctacatgcttcatgtaatgggcgaagatgacgaactcaagaatgctctgcagatgctccacagacggaggcaaaatctgcttattgacgctggcgtcgtgttgtgcgatgatgactga

SEQ ID NO: 9516 - RNA, 1053 nt, unidentified
  source 1..1053: mol_type = other RNA; note = synthetic construct
atgtacatccgcgagaatggcacaatttatttccacgaatgggatcggccctttgtggccaaattcggcgagcatacagctactcagatggtgctggcatttcaggcggagcaccgcgggcttccatttctgtacgatacccatcagcttgctgccttcttacagatgaaccggaagcggttgttcgacctcgttaagcaagtggacgagcactatgaccaggtgaaaatcgttcagaaaaatggcaagatgcgggtgttgcacgtgccagatggagcactgaaagcagtgcagagacagatacaacgtaacatcttgatgcattttctgccgtccccacacgccaccgcgtatattcgaagaagaaccttagtggacaacgcagcacctcacgtcgggaagaagtatctcctgaagcttgacatcacagactttttcgggtccattcagttcgcccaggtttaccggagtgccttctgcagcccttattttcccaagcaagtcggcgtgctactaacccggctctgctgttggcagggtgccttacctcaaggtgccccaaccagccccgctctgtcgaatctcgtcatgaagtcattcgatgtatacctgggagactggtgtcagaaacatgctatagcctatacgcgatactgcgatgacatgacgttttcagctgatcgcccgctgtacatggtgtaccagaaagtccagatcatgctcgaacacatgggcttcagcctgcatgaggataagacttgttttgtgactagggccagtcgtcaatgcgtaaccggccttactgtcaatgagacagtgtccgtctctagggtttacaagagacgcctccgacaagaattgtactacgctcagaaatttggactggccgactctctcaggcacactcagcgcggggggttcttcaccggtgatacacctgacgttgaaagatataggaaccatctgctgggacaggtaggatttgtgctgcaagtcgagcccgaaaacagatggttccagcacgcaaggaatgctctgaaaacaatgaggtga

SEQ ID NO: 9517 - RNA, 1086 nt, unidentified
  source 1..1086: mol_type = other RNA; note = synthetic construct
atgattgtgaaaaatggtgctgtcgaattctccgatgtggatatgcggtttgtggaaaaattcggcatctttaaagccactgagatggttctggactttcataatctgaacaagacccccttcatctacgacacacatcagctcgcctccttcctgggatacggcagaagactgatgttcctggtaaccaaagatccggaatcacactatttccccactgaaatcccaaagcgcgacggaacagcccgcaagttgcttattccagacaccctcataatgtctatgcagcggcacatcctggacggaatcctaaaacatctcaaacccagcagatatgccactgcatacgcgcctaagaccaacattaagcagaatgcccagcctcacatcggtaagaaatatatccttaagaccgatatctccgatttcttcggcagtatccgatttgaacaagtttatagcgctgcatttaacacgcgtctgtttccaaagcagattggggtcatgctgaccgaattatgctgctataacgggtatctccctcagggagctcccacatcacccgcactctcaaacttagtcatgaagaacttcgacaacaatataggctactggtgtgagaaacacggcatttcctacacaaggtactgtgatgacatgactttcagcagcgataaaccactgtacaatgtgctgcagaagctgacgaaaatgttagatgaaatgggcttcgagcttaatgcgaaaaagaccaaatttgttacctcgagctctaggcaaagtgtgactggattgactgtgaatgagaggctctctgtcagccgcgactataagcggaacttgcgacaagagctgtactacgggtttaggtttgggttcgagggtgccgtgagtcgtacaaagcacccggagtttttcgatgacaataaccactttatgcatgagtcctattataactcactgctagggagagtacgctacattctttctatagaacccaacaatacagagtttagtgaggctctcgaccggctgaagcagtacgacatgtatcagtacagaaagttgcctaggattgtgtactga

SEQ ID NO: 9518 - RNA, 1068 nt, unidentified
  source 1..1068: mol_type = other RNA; note = synthetic construct
atgaaaatcgtcaaaaaccacatcatgttcggagcagaggacacgaacttcattaaaaagtttggccttagtgaagccctggaaatggtggaaaattttcgcacattgaacaatttaccctttatctatgactccctgcaacttgctggctttctggacattcctctgggagtcatgttcagaatggtgaggaaggggtgcgattcgttgtaccacagccatacaatcaaaaagaaaaatggtggggaacgacagctatattcaccttactgcgtactgaaacgctgccagagtataatccttcggaatatcttgatgaagctgcccgtcagcaagtatgctactgcttacaaacccaaagtgagcatagtggacaatgccaatccccacattggcaagaagtatctcttaaagatggacatcaccgacttctttgattctatcagctttgaacaagtatacagtgcagcctttaataccagatacttcccaaaacacattggtgtgatcctgacaaatctgtgttgtaggtccgactctctgccacagggagccccaacttccccggcaatatccaacatagtcatgaagaacttcgacaacaacattggcaattggtgtgaggaacgtggaataagttataccaggtactgcgatgatttgacattctcatctgataaacctctctatcatctctacgtgaaagtcaagaagatgctttacaacatgaatttcgaagtgaacgagaacaaaacgaggttcgtgacctcagcctctcgacagtccgttaccgggattaccgtaaatcagaagctcactgtgtctcgggagtacaaaagagagctacggcagaagatctattacgttctgaagtttggcgtgaagtcaagcctcgtctacgagacaaatgggtttctcggggatgacgttaatgcaattgctactcatatgctgaacgtgctgatcggaaagattaactatctgctcagcgttgagaaaggcgagggtaacaactatttcaagaaggcgaagggcattttgatcttaatgcgcgatgagctggagtga

SEQ ID NO: 9519 - RNA, 1050 nt, unidentified
  source 1..1050: mol_type = other RNA; note = synthetic construct
atgaaaataaaaggcaacaccgtttttttcgactcttccgacaagagcttcattaagaagtttggcttctctgccgccgcagacatggttatggattttagatcgcagaataagctgccattcatttatgatctccttcagttatcaggctttttgtctgtcgacttcaaggatacagtcaggttcttgaagaagggctgtgacaatgattatcgtacgcttactatcaagaagaggaatggaaacgatcggatcctaaacgtacctagccccaccctgaaacgctgccagaggattatctacaatgagatcctgaaaaaccttcctgtgtctaagtatgcgaaagcttataagaaaggagtccatctccaggataatgcaagcccccacgtcgggaaaaagtacatcctgaagatcgacataaccgacttctttggcagtatcacttttagggaggtgtacagcgctgcatttaatacaagatactttcctcgacacgtggggtacgtactgaccgtgctgtgttgcaaagatgaagctcttccgcagggagccccaacatcccctgccttatccaacctggttatgaaaggtttcgacgagaacataggcaaatggtgcgaggcccggggaatcagttataccagatattgcgacgatatgactttttcctctgacgagccactgtaccacgtctataaaaaggtgacctccttgctcgaagaggctgattttagcgtgaatcaaagcaaaaccaagttcattactaacgcaagtcggcagtcagtaaccgggctgactgtgaatcagaaggtgagtgttaaccgcgaatataagcggacactgcgtcaagaactgcattacctgtttctctacggtgcggagaattgtctcattaaaacggataacaagcaatacttcacaaatggtaaacccgacaagaaccgatacttgtcatcactggaggggcgcattgtgttcgtgctatccgtggaaaaagacaacccctacttcaagacagccctcgaaaagttaagagccctctattga

SEQ ID NO: 9520 - RNA, 1065 nt, unidentified
  source 1..1065: mol_type = other RNA; note = synthetic construct
atgtttatcaacgggcagagtattaagtttcagaactctgacatggccttcgttaaaaagtttggcctgattgccgccacggaaatgatcctggactacaagaaaaagaactcagtcccctttatatacgatacctttcagctgagccagttcctggacatctcaaataaacaagtgtatagggccgtaaggaattgcgacaaaacatactcctacgtgaccattaagaagaagaatgggaatgatcggatgctgctggttccagggaaacagctcaaacgaatccagaggataattctccggagaattcttaacaagattccggtcagcgagtatgctactgcctacaagaagggggccaccttatactccaacgcatccccccacaccaataagaagtacctgctgaagttggatatcacggatttcttcaattcaatagacttcctgacagtgtaccggtttgtgttcatcaagtattaccctaagcagatttcgtatatgctaaccaagctatgctgtaagaatggattccttccacaaggtgctcctacaagtcctgcgctcagcaatctggtgttgaaatcttttgacgactatatcggtgaatggtgtaaaaaacgcggagtaacatacaccaggtattgcgatgatatgactttttctggagacagaccccttctcgatgtgtataagaaagtcaagaatgtcctggacaagaacggctttgacctgaacgagaataagacagttttcgtgtcaagtggtaaccgacaatccgtgactggattaaccgtcaacgaaaaagtgaacgtaagcaaagactataagcgcaaactcagacaggaaatctattatgcgttgaaattcggcttcgaggatgccatcatcaagagcgacaataaaaacttcattactgtggagaacggcgtcgagatagctgattccatgaagtaccaagactctcttatcggccgcgtgaattacgtgctccagattgaaccagataacgcttggtttcgtactaaagcaaaagagttggcagagaaagcagttttcgattga

SEQ ID NO: 9521 - RNA, 1062 nt, unidentified
  source 1..1062: mol_type = other RNA; note = synthetic construct
atgtatattaaggatggtaccgtcaggtttgatgcatgtgacaaaaacttcgtgaagaagtttggtctaatcgaagcagctaatatggtactggacttttccagtacgcacaacatcccatttgtttatgatgtgtggcagctgtccgtgtacctcggtgaaaatcctaaatgcctctggccaatcgtcaagcatgtggatgatatgtataaggtctgctttgtgcccaaaaggaatggggggacaagacaactgtgttcccctaatagcagattgaaggccatacagcataacgtcctgaagaagttcctgaacaatatgcctgtcagcaaatacgccactgcttacatcaaggggaagactctctctgacaatgccaagctgcacacaaacaaaaagtatgttctgaagatggacatcagtgacttctttggctccattcacttcgataagatctacaattcagctttcaacaccacccttttccccaagcagatcggctacatgttaacttcactgtgttgccggaaggatgtgttaccgcaaggcgcaccaacctcgccagccttgagcaacattgtaatgaaaaggttcgacgactacataggcgattggtgtaaggggagaggcatctcatatacccggtattgcgacgatatgaccttcagctccaataaacctctgtataatatgtacgtgaaggtgaaaaaggtgcttgaggacatggggttcgagctgaacgataagaaaacacatttcatcactagcaactctcgacagagcgttacaggcctaactgtgaatcgcaaagtttctgtatctaaagattacaagcgagcactgcgtcaggaggtttattttgccctcaaattcggactcgctgaaagtattatgcacggagacaaaacggactttgtgaaaaataatgctcccgacaccgccgcgtactatcacaaccttcttggacgggtgtcatacgtcctccagattgagcccaacaacaactacttttgcgaggcgattcgcgaattgcgcacaggaaaaattttggcccagatatga

SEQ ID NO: 9522 - RNA, 1074 nt, unidentified
  source 1..1074: mol_type = other RNA; note = synthetic construct
atgaaggaaaactcattcaccatatccttcgaacaacatgatatgccgttcctcaagaaatacgggctgttcaaggctatgaggaaggtccgaaaccacaataaaaagtacaaggtgcccttcatcgatgatacctatcagttggcccacgcactttctatcacccgtaagcagctctttgacctaagccgtaatgctaataagcattacaagcagatcctccttaagaagagaaaaggcggggttcgggtaattaacgctcctgatcccgagctgaaagacattcagagaagaatactacgccgaatcttatacaagagtgagatcagcaaatatgccactgcttacgcacctgataggaaattgaaggacaacgcgacgccacatgtgaatcacaaatacctgctgaaaatggatattaccgatttttttggcagcattacgtttctggaggtgataagctctgcattcaacagtaaaatctacccaactcagatcggtgctatgctgacagccttatgctgcaaagacgaggtactgcctcagggagcccccacatccccaatgctttccaacattgtcatgaaaaactttgacaatgccatcggcggctggtgtgagaagagagacattacctatacacgctattgtgacgacctcacattttctgcggacatacctctgtacaacgtgtatcagaaggttgaagatatgttgattcagcgcggattcgaagtgaatgagagtaaaaccaagttcatcactaattccgggcggcagacagtgaccggactcactgttaacgaaaaagtctcaattccaagagactataagaggcagttgcggcaggagatctattatgccctgaagtttggtctttctgagtcaattgtctacgggaacaaaactgaattcatggactcgaggggccccaattgctggcggtattaccaacacctgaagggaaagctcaaccacgtctttcaagtggaacccaataacatgtggttccgcgatgccgatgagaaactgtgggtggcatacatccaaccgaatatgaggtacccttattga

SEQ ID NO: 9523 - RNA, 1059 nt, unidentified
  source 1..1059: mol_type = other RNA; note = synthetic construct
atgaaactcaacaaaatctccgtgtctttcgaacaccaggatttacacttcctgaagaaatatggcttttttaaggccgcctctatggctaaaaagcattacaagaaatacgacgtcccctttataacggacatataccaactgagtcacttgttccatgactttaacaaaaacgtgtttaagctgtccaagaatgcaaacaagcactacaagaaaaagattctgcggaagtcaaatggcggaatacgaatcttgcatgcaccagatgaaactcttaaattttatcagaggaggatcttagagaagatactgtacaagatccctatctcgaagtatgccacagcctatgtgccggggaaaaaactgcaggacaatgcctccccccacattaaacacaagtatctcctgaagatggacatcacggattttttcggttcaatcacttatatgcaggtgatttccactgcattcaattctaacatgtacccagtccagattggcgcgattcttaccagcctctgttgtaaagatgacgtgcttcctcaaggcgctcctaccagccccatgcttagtaacatcgtgatgaaaaatttcgatgacatcctcgggcattggtgcgaaaagcgtaatattacctatactcgctattgcgatgacctgaccttttcagcgaacatcccactataccacgtatacaacaaagtttctgaaatgctagagaagagagggtttgaggtaaatgaggctaaaacaaaattcatcagcaacactagttgtcagaaggtcacaggactgacagtcaacgagaaggtggctattcccaaggaatacaagcgccaattacggcaggaagtttactacgcactgaaattcggcctcaaggatagcattattaaagggaagaaaaaggagtacatcgagttcggagttcctgacattcatagatattacgatcatctgaatggtaagctcacctatgtgttgcagatcgaaccacagaatgagtggttcgagaacgcccacaagaagttgaaaaatctgtataccctgtgcacatga

SEQ ID NO: 9524 - RNA, 1077 nt, unidentified
  source 1..1077: mol_type = other RNA; note = synthetic construct
atgaagctcaataaattcactgtatccttcgaacaacaggatatgcattttctgaaaaaacacggctttttcaaggcctccagtatggtgaaaaaacattataagcagcacaataccccgtttatatatgatacataccagctggcaaacgagcttcgcatttttcacaaggatgtttttgaactctctaagaatatccgaaagcactataagttgattatgctgcgcaaaaagaacgggggcctgagatacatttatagtcccgacgctaatctcaagcatgcacaactgcagatactgaagaacatcctcaacaacataaagatctctccttatgccacggcctacgtgaaaggcaaaaaccttaaggacaatgctaaaccacatactaaccacaaatacctactcaaaatggacattacggatttttttggtagcatcacctatttgcaggttctgtcgaccgccttcaataggaaaaggtttcctacccaaattggagcaatgttgtcatccctgtgttgcctgaatgacgtgcttccacagggagcgcccacatctcctgcgcttagtaacatcgtgatgaagaatttcgatgacattataggagcctggtgtaagaagcgtaatattacatacaccagatactgcgatgacttaactttcagcgccaacagcccactgtacaacgcttacatcaaagtcaagaacatgctggaggaacgggggttcgagttgaatgaagagaaaacaaagttcatcactaacagttctagccagagagtgaccgggttaactgtcaacgagaaagtctcaatccctaaggaatacaagaggcagctccggcaagaagtgtactatgcaatcaagtacggcctggctgacagcattgtaaaggggaataagagcgagtacatcaattatggtaagcccaacattcattcctacttttcccacctggagggcaagatcttctatgttctacagatcgaacccgacaatacctggttcgtgaaagccgctgagaaattaaacgatcggttctgctatgagataaaatcaacacagtgtacatga

SEQ ID NO: 9525 - RNA, 1059 nt, unidentified
  source 1..1059: mol_type = other RNA; note = synthetic construct
atgagatttcacaatggtattctgtctttcgatgcttccgaccgatactttctggaaaaacacggattgcacaacacaataaaggccgctggaaagcattatgattcttacgagacaccctttatccgcgatacctaccagctagcgcaccaagccggcaccttccggaagactctgttcgagctctgcaagaataccagcaaacactataagaccatcaccctgaaaaaaaagtcagggggagtgcgatacatccacgcaccagatggcacactgaagtgcgcacagcagtacattctgcggaatattgtgaacaagatcgccgttagtccttacgcaacggcatatgtcaaggggaaaaggctgcatgacaacgccgctcctcatacaaaccacaggttcctgctgaagatggacatcacggatttttttggcagcattacttttctcgaagtgatttcaagcgcgttccctgccaagatgtatccagtacagataggggcaatgttgacaagtctttgttgccttaatgacgtgctgccacagggcgctccgacttctccgatgctctccaatattgtcatgaggtcgtttgatgacttcatcggctcttggtgccaaaaacgtggcgttacatatactcgctactgtgatgacctgacattctcaagcgacgcccccttatacggggtctatctcaaagttaaagaaacgttggagaaccgcggattcaccgtaaacgagcataagactaagttcatcaccaacgcttcctcacagagagtgactggtctaaccgtgaacgaaaaggtgtccatcccaaaggagtataaacagcagctgagacaggaagtgtactatgccgtcaagtttgggttagctaatagtatcctgttcggcaataaaaccgatttcgtgaagaacggtgtccccgaccctgtttcctattacgagcacttgttaggaaaacttcagtatgtgcttcaaatagagccccataatcaatggtttggtaaggccattaaagacctctgtgaccggtactacctcagcaaatga

SEQ ID NO: 9526 - RNA, 1053 nt, unidentified
  source 1..1053: mol_type = other RNA; note = synthetic construct
atgaagaaagcttcaaacatcattcgcaacatacaagttttcgtcaagaaactcattggcatcttcgctaatagtcactcctccaaaaagcagaaatcaaacaaggggatttccaaggagctgcagtctctggccgatactctggggactacaaccggtgaactgttcgccctgtctaaaaaggcggattcatgttacaaggagatccggatcccaaagcggagtaatgggtttagaattatccatagtccaaatggaaagctcaagaaagtgcagaaaaaaatcttgcagagcataatcagcaaggccgagacatcgccatatgccatggcgtacaaaaaaggcaagaacctgaaggacaatgccgaccctcacatcaaccacctgtatttactcaaaatggacatcagcgatttcttcagctctatcaccttccatcaagtccttagttctgcctttcccagcacactcttccctacacaatgcggcgttattttaaccagcctatgtaccaaagatggcgtgcttcctcagggagctccgacgagtcctgctctttccaatctcgtgatgaaatcctttgacgagcatattggcttctggtgcaatgaacgcggtattgtgtacaccaggtattgtgacgatctgacattttctgcagattaccccttggtggtcctgtcttataagattgaggatatgctaaaccgatggggttttcaggtcaacaagaagaagaccaagtacatcttcttttcgtcccgtcagactgttactgggttgtgcgtgaataaaaaagtaagcattccaagcgactataaaaagactctgaggcaggacgtatactacgccctgaaattcggactcgaggattcaatgatacacggaaaaaagaacgacttctttgagaacggcaagtgggacacggcaagatataagtgccacttaatcggaaaggtgaattacatactgcagatagaaccggaaaataagtggtttcaagcagcaaaggaaaacctttccaaatcatttgacccccccttgaactcctga

SEQ ID NO: 9527 - RNA, 1068 nt, unidentified
  source 1..1068: mol_type = other RNA; note = synthetic construct
atgatggtgaaacggttcatcacacgcttcgaaaaacaggacatgcatttcgtcgccaagcacggatttttcagggctgctcggatggtgcgcgctcacaagaaaaagcataatgccccattcatcgccgatacctatcaactcgcgcacgaattgggcgtaagacggagggaattgtttggccttacaaggcaccctgagtaccattatcggatactgactcttcgtaaacgcaatggtgggttaagggtcctgcacgctcctctctatcagatgaagcaggtacagcaacatatcctgaagcgcattctgccgcacctgcccgtcagtccctacgctactgcctacgtgcaggggaaggccctagccgataatgcagctccacacgtgggccacaagtacctgcttaaaatggacataacagactttttcggttccattacctatctccaggtgctgtctactgctttcccatccacattctaccccccccagattggagcgatgctgacggatctctgttgctacaaggaagccctcccacaaggggcccctacctcaccaacgttgtctaatatcgttatgtgtcgattcgacaacgcaattggaggttggtgcaaaaaacgcgggattgcctataccagatattgcgatgatcttaccttcagcgccgatacacctctgtaccatgtctatgagaaggtgaaagacaaactggagggcatggggtttgctgtcaacgagcggaaaacccattttgtgactgcagcctcgagacaaaccgtgactggcttaacagtaaatgaaaaggtggcaatcccggcagactataagcgtcagctaaggcaggaggtttactacgcgatccggtttggcctcgcagacagcatcaatcagggaggaaagccctttagaaccattggcaataaccctgatgttaggagatattacaaccacctgaacggtaagctgaactacgttttgcaggtggagccccataaccgatggtttgcctgtgcaaaggaggacttaagacgacagtttgaagacgagatatgccgttggtga

SEQ ID NO: 9528 - RNA, 1086 nt, unidentified
  source 1..1086: mol_type = other RNA; note = synthetic construct
atgatcataaacgattggtccgtaaggttcgaaaatgcggatgcacacttcgtggaaaagtatggcttcttccatgcttgtcataaagtgcggcaacatgtggagaaatatgatacaccatttgtgcaggacactcaccagctcgccgcaacattggcccttcgtcataggcaatttttcagattacttagagaagcagacgctcaatacgaacgggttgaaattcccaagaaaaacggcggggttagagtgctgtatgcccccaatccactgcttaagagggtccagtttttgattttgaggctgtttctggatggaatgcccatctccaggttcgcaacagcctactgcaagggtaaatcgctgagggataacgcatctccacatactggccacacatatctgctgaagatggacattactgacttctttgatagtataaccttccctcagatcgtaggcactgccttcccgaaggacatgtatccctctcacatccgagcgatgctgactgccctgtgttgcagaaacgagcagcttcctcaaggggctcccaccagtccggctatctcaaatctggtgatgcgccgctttgacgacgttcttggagagtggtgcgagaagcacgatatagcttacacccggtactgtgatgatttaaccttttccgctaataaaccactctttgccgtgcaccagaaagctaccgctatgctcgagggaatgggtttcaccgtgaacgaggccaagacgcgattcgtcaagaataccagccgtcaggccgtcaccggcttaactgtcaacgagaaagtgtcaatctctgcagagtacaaacgagccctgcggcaggagctccactatgccatcaaatttgggattcgcgacagcctggtaaaggggctcaagacagcgtttctaacaaatggacagcctgacaccgaacggtactaccgccacctgagaggcaagattaactatgtcctcagcgtggaacctcagaatacgtggttcgccgacgcattgaaacgcctagaagttgtctatcattgggaggtgtacgagtacgtgagatacggtaagcggtga

SEQ ID NO: 9529 - RNA, 1044 nt, unidentified
  source 1..1044: mol_type = other RNA; note = synthetic construct
atgatcgttaggaaagatggggttgtcttaaaaaaggaggacgacaattatatcaagaagttcgggttgatgaaagctgccgaaattgcaattgaatacaaacagacccacaaaacccctttcattcacgacctgtttcaactggccgcttttataggccccggcaagagatcattctttaagctgctgaaaaatgtgaacaacgagtactcttttttcgagatcaaaaagaagaacggtgggtttcgaaaaatatacgctccttcccctgagctatgcagggctcaacgtgttatactgaggggcatcctgagctgctatgacgtgtccccctacgcaagcgcatatattgagggcaaagggttgatcagcaatgcccagccgcacacaaacaagaaatacatccttaagatggacattactgatttcttcggttctatttcattcgagcaggtgatttctacggtattcaacaagaactactttccctccgcggtgggctatgccctcactaccctctgctgttataaaggctatctggttcaaggagcccctacctcccccatgatcagcaatctggtgctgaaacatttcgacgatgtgatgggagtgtggtgtgagaagcgcggaatctcttatagtcggtactgtgatgacataactttttccgcaaatgaaccattgttttgcgcctacagcaaagccaaggccttccttagtgagatgggattcgaaattaacaagaagaagacccgatttgtatcacatacatctcagcagaatgtgacagggcttgtcgtcaatgaaaaggtgtcagtgccaaaagagtataagagagatctccggcagaagatctactactttctaaagttcgataagaaggacacagctttcaaacagagcggtcgggaatattacagttacatcaactatcttctcggacgcgcgaactacgtcttatcgattgagccaaacgataaatttctgaaggagtccatcctggtcctcagagaaaaaagtgacgtagaatattggaatgagtga

SEQ ID NO: 9530 - RNA, 987 nt, unidentified
  source 1..987: mol_type = other RNA; note = synthetic construct
atgttctaccgaaaataccactcttgtatatttaagggctacattatgaacgacttttcactgaccgaaattttcaatatgcgcgaaaaagagatctactacgtctcaaatcacatcagcaagcactacaagagggtggagatacctaaaaagacaaaaggggtacggatcctgtacattcccagcaaaaagttgatctacatgcagagaattatcctgaatgctttcctttctgagtacaagatttccgagtgtgcaaccgcctaccacaagggatcgactttagtcagtaatgccctgccacatcgcaacaaaaaatacgtgctgaagctggacatcgaggacttctttggatcaatcacttatgggcgagtgtacaagatgttcttcaaacattttccagtcaagtacgccaaactttttaccgaactctgttgctataacgataaattggttcagggtgctcccacatccccggccatcagtaacatcattatgctagatttcgataacagagtggaaagctactgcaaggaaaataacatttcctacacaaggtattgcgacgacattacgctctctgcggatttttcccttgataggacttatcatcgtattaaaaaggagctgcaaaaggctggcttcgaattaaacaaacgcaagacccattttgtgaaaaacacccaccagcaaaaaatcactggtgttgtagtgaatgaaaagatccaggtgcccatcgagtacagaaagaagctgcggcaggaactatattatctctataagttcggagccaataacgttatcctcaagaacaactatacagactatataagcaacgggaacaccctcgacgtgaagtatatcaatagtctgctgggccggatcaattatgtcttgcaaattgatcctgacaataatgagtttgcaaaggagaaagagaaactgtgctcttatgtccagcagataaagattcagaaaatattctga

SEQ ID NO: 9531 - RNA, 915 nt, unidentified
  source 1..915: mol_type = other RNA; note = synthetic construct
atgctggaatctacttttaatatgagcaaacgcgaactgtactacgtcagcaataacataggcaagcactacaagaagatcatcatcaagaaaaagtccggagagaacagaacgttgtatgccccggacaaaaagttgaagtacattcaccggataattctcaaagaattcctgtccgattataaaatctctgcctgcgccaccgcttatcataaaggcgcacaacttgttgataacgcactcccccacatcaataagaagtacctcttgaaacttgacattaaggatttcttcccctcgataatgtttggtcgggtctacaagctcttttattccaaatttccagaagagtatgcaaaactgttcgccgaactttgctgttacgatgactgcttagttcaaggggcgcctacctcaccagccgtaagtaatatcgtcatgttaaacttcgacaatgaactcgaggcttggtgtaagagcaatttcatcagttatacaaggtactgtgacgatattactttgagctcagatgagcccctggtgtccgcttatcattatgtgaagaaactgctgaacaagaatggattcgaggtgaataagaagaaaacaaggttcatcaaacacactcatgggcagtatgtgaccgggattgtggtgaacgaacacctgcaggtaacacgagagtaccggagaaagctgcgtcaggacctatactacctttacaaatttggtgccagagacgtgatcctgaaaaataagctggatgactacatcttaggcaagaccacactgaacgctaagtatatgcagtctctcatgggaaggattaactttgtgctgcaggttgaccctgataacaaggagtttaaagaggagaaaaccaagctaatcaactatatgaacatccgcatttga

SEQ ID NO: 9532 - RNA, 969 nt, unidentified
  source 1..969: mol_type = other RNA; note = synthetic construct
atgtggaagtacatgaaccaggagatgtgcaatcagtttctgctctcattacatctcattgatggcgatttgtcagatcaggagaaaatcaagctgctttacaccatttccaacacaattgagaaccaatacgagatcatcaagatcaagaagaactcagggaaactgcgtactatttactgcccccaccccctgcttaagtctatacagaggaaaattctccaccagattctgaatcacaaatctatatccagttacgccaaagcatatcatccgcatattggcctaaaagaaaatgcactcccccacgttcaccagaaaagaatcttaaagctggacatccaggatttcttcaatcacatccagttcataaacgtgtacgaaagttgttttagcctggcgtattttcctaagccaattggaatgctgctgacccaattgtgcacatatcacgatgacctgcctcaaggtgctcctacctccgcttatataagtaatctcgtgatgaaggacttcgacgaggagatcggggactggtgtagccagcgcaatatatcctatacacggtattctgacgatatgacgttttccggagatttgatcccagccgacgtgatcagaaaggtgaaacagtacctcaaccccctcggattaaagcttaattaccagaagatccacgtcattaaccattctcagcaacagaacgtcactggtatcgtggtaaatgagaagatccaagtcccacgactatataggaggaaaatccggcagaccatgcattatatcgaagcctacgggttgcaaagccatctggagaaaattggctatcaaaagagccctgaacgctacctgaaccacatatacggccaggtgctgtatattctgcagattaacgcccaggacaaagaatttcagatctacaaggacaaacttaaggaatacgagaattcgtatactttcagcgtttga

SEQ ID NO: 9533 - RNA, 948 nt, unidentified
  source 1..948: mol_type = other RNA; note = synthetic construct
atgtggaaatacatggatcagaaccagagccaagaatttctactctcactccacttgctccacaaccagctgagcgataaggagaaagtgaagatgctgtattccatttctaacagtatcgaagagaattacaacatcatcaagatcaagaagaggaatggcagccttcgcacgatttaccagccccatactaatctgaagttaatccagcgacagattctgaaaactatcctgaataaccgcagtgtgtctacatacgccaaagcttaccacaagaatattggcctgaaagacaacgcttatccccatgtacaccagaaaagaatcttgaaactggacattaaagacttctttgagcatatccagtttatcgatgtttacaacgcctgtttctcgctagcctattttccgcagtccattggtcaccttttaacccagctgtgcacctatcatggctaccttcctcagggggcaccaacatctgcctatatcagtaacctggttatgaaggaatttgacgagcagattggcgaatggtgtgagaataagcacatctgctacaccagatactccgacgacatgacattctccggagatttcaatcccagagaggtgatacagcgggtcaggaaggctctgtatcctttggggttagagattaataaccagaaaattcacgtgatcggcaatggacagcaacaaaacgtaaccgggctggttgtgaatcaaaaagtccagacttcaagccggtatcgtaaaaaggtgaggcaagcgatatactacatgaagaagtatggattggaatcccatctttctgcaatacaatatcagcagagcccacaaaactatctgcaccatctctacggtcaggtccagtacatactgcagattaaccctctcgatcaagaattccagtcatatcaggagtacctcaaaaagatcaagtga

SEQ ID NO: 9534 - RNA, 954 nt, unidentified
  source 1..954: mol_type = other RNA; note = synthetic construct
atgattatacacactaaagaggattgcaacaatttcctgctttccctgaatctgatcaataagaacatatccgatagcgagaaactacggctcctgtataccttgactaatcctatcgaaaagaactacaagatctacaagattaggaagaagaatggtcagttccggcagatttacattcctaacaacctcttgaaaagtatccaacgcaaaatcttgaagaatatcctcaacaacaagaagatttccatatacgccaaagcctacaaaaaaggcgtgtgcttaaaagataacgcgtacccacacctgaataagaagattatactgaagctggatatcatcaacttctttgacaacattgagtactatgacatttacagaacctgcttttcaaaagaatactttcctccatctgttggtcatctgctgactaatctctgtacatatgagtcgagacttccacagggggcacccacaagcgcttacataagtaatctggtgcttaaggagtttgatgaggaaatcggacattggtgtgacgaacacaatatatcatacacccgctattccgacgacatgaccttttctggcgatttcaatccccaagagatcattaaaaaagtgcgacactacttgaactacctgaacctaaagctgaataacaagaaaatcaaggtgatcagtaactctaaacagcagcgtgtaacaggcctcgttgtcaataaaaaaatccaagtccccaagaagtatcggtataaaatcaggcaggaggtgtactatattaagaagtacggactcctctcacacctccagaaaatcaactatgaagacaaaccgctgcattatttaaatagcttacttgggaggcttaattatctgctgtctattaacagcaacatcgagttcattaagtataaggaatacctaacgaagctgagaaagacatatttgtga

SEQ ID NO: 9535 - RNA, 942 nt, unidentified
  source 1..942: mol_type = other RNA; note = synthetic construct
atgataaaccacaccaaagaacagtccaaagagtttttgctgagcctcaatctcatcaactcaaaagatgtgctgaaaaagctttactccataagcaataggattgagtccaattacaaggtttacaagattcgtaagcataatggtaagtaccgcacaatctattctcccaacacactgctgaaaagcattcaaagaaatatcctgaagaacatactgaacaacaagaaaatcagtaagtacgctaaagcctatcacaagaatatcagtctgaaagacaatgcaatgcctcatttgaacaaaaaaatcgtgctgaagctagacatcatcgatttctttgagaatatcgaatacccaactatttaccggtattgtttcaatgagatctatttcccaaagtcagtgggccaccttttaactaccctttgcacttatgagtccagactcccccagggagccccgacatcatcgtatattagtaacctggttatgaacgatttcgacaatacgataggcgaatattgcgaacagaataacatcagttacacacgatattctgacgatatgaccttctctggggactttaatccctctaagttaatcactattgtgaggagagagttgtacaagctcggattgaagattaacaacaagaagatccacgtcataaataactcccagcagcaaaatgtaaccggcatcatcgtcaacaaaaaaatacaggtcagctccagctatcggaacaaaatccgccagatcatttactacattaagaagtatgggcttaaggatcatctaaacaggattaactaccaagaaagcccttcaacctatattaatagcctctacggtaaaaccctgtatgtgctctctattgacaaaacgaacaaggagtttatcaattacaaggagtacctgaaagaactgaaaaaggcgatttga

SEQ ID NO: 9536 - RNA, 957 nt, unidentified
  source 1..957: mol_type = other RNA; note = synthetic construct
atgtggaaatatatcggcactaaagagtgtaatgattttctcctgagtttgcacttgattgactgtctagaccagagaaagtacatcaaaacgatttacagcatttccaacaatatcgaaaagaactacaagatctacaagatcaagaagtcaaatgggggatacaggactatctatgaaccaaatcccctcctgaagcagatccagaagcggatcctgacctcgattctgaatcataaagctatctctcgatatgccaaagcctaccacaaaggcacccaattaaaggacaatgcatttcctcatgtaaacaagaacatgatgcttaaactggatatcaagaacttctttgagacgatcacttttctggacatttataactcttgcttctcaatcgaatactttccaaaaagtgtgggcatgattttaacatacttgtgcacctatgacaatcacttgacacagggcagtcctacttccccctatataagcaacctcgttatgcaggagttcgacgaggaacttggttcttggtgtgatctgatgggcatatcatatacccgctactcagatgatatgacctttagcggacagttcaacccgcgtaagattatatccaaggttaggaaaatgctgtatagactagggatggagctgaatgactccaaaacacatgtggtctataagagctctagccaaaaagtgacaggtgtagtcgtgaacgaaaagatgcaggtgagcaaacggtatcgcaacaaaatcaggcaggagatttactacattaaaaagttcgggctgaatagtcacctcaagaaatgcaacatagacattaactccataacctacgtcaatattctgtacggaaagattctctacgtgcttcaaatcaacgagacagataaggagttcataaagtataagcagttcatcaaggatcttaaaggaaatatcgggtga

SEQ ID NO: 9537 - RNA, 954 nt, unidentified
  source 1..954: mol_type = other RNA; note = synthetic construct
atgtggaaatacattggcacaaaagagtgtaatgattttctgttgagcctgaacctgttcaattgcaaagacgagaatcactacataaaaaccctctattccatcagtaataacattgagaacaactaccgcatatacaagattaaaaagcggaacgggaaatatagaaccatctatgaacccaaccctttgctgaagcatatacagaaacagatcctcataaacatcctcaacaataaaacgatctccgaatatgctaaagcgtatcataagggaatttcactgaaggataacgcgaatcctcatattaacaaggacataattctgaagcttgacatcaaagatttcttcgagaacattagcttcctcaacatttacaatagctgcttccagattgaatattttccaaagtctgttggcatgctgctaacgacactgtgtacttacgatgatcacctcacacagggatctccaacttctgcctacatttccaatttggtaatgaaggactttgacgaggaacttggtagttggtgcaaagagaattccatctcatacacccgatattcggacgacatgacatttagcggctcatttaatcccagtgatatcataaagaaggtgcggaaaatgttatactccctgggactgcagttaaattctgacaagatccacgtggtcaccaaaaatgcctgtcagaccgtgactggtctggtggttaataacaaagtgcaagtcgggattaagtataggaaagagatccgtaaagaggtgtactatattaataagtacggcttgcaaagccacctgaagaagatcaacattaaggacaagaacaaatacctcaattctctttatgggaggatcctgtatgtccttcagatcaacaagaatgataaggaattcatcagttacaagaagatcatcaacaaaatcaagagcgatctatcctga

SEQ ID NO: 9538 - RNA, 954 nt, unidentified
  source 1..954: mol_type = other RNA; note = synthetic construct
atgtggaaatacattggaaaagaagagtgtaatgagtttctcctgagcctgaaacttttcaattgcaaggacaagaagaaatatctcaacacgatatactccatttcaaacaacatcgagaacaactacaagatttacaagatcaagaagaagaacggcaagtataggacaatatatgagccaaattcccttctgaaacatattcaacgtcagatactggtgaaaatcctagataataaggccatttctaagtacgcgaaagcttaccacaaaggtattaatctgaaagacaacgcaattcctcatctaaacaaagagctgattctgaaattggatatcaaagacttcttcgaaaacatctctttcatcgatgtgtacaattcctgctttagtatcgaatacttcccgaaaagcgtcggtatgattcttacatatctgtgtacctatgatgattatctcatgcaaggcgctcccaccagcgcctatatcagtaatctcgtaatgaaggagtttgacgaggttctcggactgtggtgcgaggaaaataatatctcctacacccggtattcagacgatatgacttttagcggggaattcaatccccgcgaggtgatcgtcaaagttcgaaagatgttgtataagttagggttagaactgaacaacaagaagatccatatcattcacaaaagttcgaatcagaatgtcactgggatcgtggtgaatgaaaaagtacaggtgtcagccaaatatagaaaggagatcaggcaggaaatatactatatacggaaatttggcctggaatctcacttgaaaaagagaaacattgacatagagaaggagaagtacatcaacattttgtacggaaagattctctacgttcttcagatcaataataaggacaacgagtttaacaagtacaaaaagttcatgaacgacttcaagaacaagttttga

SEQ ID NO: 9539 - RNA, 957 nt, unidentified
  source 1..957: mol_type = other RNA; note = synthetic construct
atgtggaagtatattggcctcaaggagtgcaacgaatttttactgagcctgaacctgtttgactgcaaagatgaaaagaagtacatcagaactctctatagtatttccaacaacgtcgagaacaactacaagaagtacaagattaagaagtcaaacggaaaataccggacaatttacgagccatctcttttattaaagcacatccagcgtcagatattgaataatatcctgaacgataggatgattagctcctacgccaaggcgtatagaagaggaagctcgcttaaggataatgccattgtgcaccagaacaaaaagatagtcctcaaacttgacatttcaagcttcttcgacaatattagcttcatcgatgtgtacaacagctgtttctccattgaattttttcccaaaagtgtcggaatgttgctgacatctctttgcatctacaatgattacctgccgcaaggcgctcctacctctgcattcattagtaatttggtgatgcgaagctttgacgaagagataggttcatggtgttccctgaaaaatatctcatacacccgctattcagacgatatgacgtttagtggtgatttcgattgtaaggaggtgatcaataaggtgaggaaaatgctgtctatcaaagggctggagctcaacaaggacaaaatccatgtaatcaagaacagttcctgtcaaaaagttactgggatcgtggttaataataaggtccaggtatgcagcaactataggaaatctatccggcaggagatctactatataaagaaatatggcctagagtcccataagaagtatcgaaacatactgtcctccaatcggaaatacctgaattctttgtatgggaaagtttcgtatgtgctccagattaatcgcgacgacaaagaattcatcgactacaagaactatctgctcaaactcctaaaagacaatctgtga

SEQ ID NO: 9540 - RNA, 951 nt, unidentified
  source 1..951: mol_type = other RNA; note = synthetic construct
atgtgggattatatcggggtgaaggaatgcaacgattacctcctctcgctgcacttgtttgactgtgaggacgaacgcaaatacatacggactctgtacgccatcgccaacaatattaggaatcactaccgcaaatttcagatccgaaaacataacggcaagatgagaacaatctacgaaccttccgggattctgaagcacattcagaagagaatactgggggaggtgctggaggacctgaaggtatctccctacgcaaccgcttatacacgtggcaaatctctgttagataatgcctgccctcatgtaggttgcaagatgattctcaagcttgacatcaagaacttcttcgaaaacatttggttccttgacatctataacagttgtttccccatcgagttgtttccgaaatccataggaatgttgtttacctatctttgcacttacgacgatcatctggtgcaaggcgcacctacaagcgcctacattagcaatttagttatgagggactttgattacgctgtgggtaactggtgtcgtcagcaaggaattgaatatacccgctactcagatgatatgaccttctcaggcgatttcgatcccgcagctgtgatccgaaaggtccggagggagctgtatcgcctagatatggaactgaacgacagtaagacgagagtgatatataggagccacagacaatgcgtcactggcgttgtcgtgaatgaaaagccacaggttagcaaaaaatatcggaaagagatccggaaacagatgtactatatcgagaaatacggtctatccgagcaccttaaaaggacaggaaaggccgagaaggggtatctggaaaccttgaaaggatgtatctgttatgtcctccagattaatccagacgacgctgagtttagacagtacctcaagaaggccaatgagctcctgtacgcggacaagtga

SEQ ID NO: 9541 - RNA, 951 nt, unidentified
  source 1..951: mol_type = other RNA; note = synthetic construct
atgtgggactatatcggtgtgaaagagtgcaatgattacctgctttctcttaatctcttcgactgtgatgatagacagaaatacattcgcactttatatgccatagcaaacgatgtccgcaaacattacaccaaataccagataagaaagcacgacggaaaaatgcgcactatttacgaaccctcggggatcctcaagcacatccagaagagaattttgaccgaagtgctggaggacatgcgcgtatctccgtacgccacagcttataccaaaggaaaaagcctgctggataatgctcaaccacatgttggccagaagatgatcctgaagttggacattagacactttttcgagaatatctggtttcttgacatttacaacagctgcttcccaatagagctcttccctaaatccgtgggaatgctgtttacatacctttgcacgtatgatgatcacttggtccagggcgcacccacaagtgcgtttatcagtaatctcgttatgagggagtttgactatgaggttgggaactggtgtaaccagaagaatatttcctacacacgatattcagatgatatgaccttctctggcgactttgatcctagcggggtgatccggaaggtcaggcgcgaactctataagctggacatggagctcaacgattcaaaaactagggtcattcggaggagccatcgtcaatgcgtgaccggtctagtggtgaatgaaaagaggcaggtatcccgggaataccggaaggagatacggaaacagatctatttcatccagagacatggactgtccgaacacctagcccgaattggccgagacgagaaggggtacttagagaggctgaagggctcaatctgttatgtgctgcaaatcaaccccgatgacgctgaattccgtaagtacctggaggacattgacgaattgagttatgccaacaagtga

SEQ ID NO: 9542 - RNA, 969 nt, unidentified
  source 1..969: mol_type = other RNA; note = synthetic construct
atgtggaaatatattacgaaagagcaggtgcaggaatttctgctgtccctcaacctgttagacaacaaattgaacgacaaagacaacatcaataagctctatagcatcagtaataacatcgagaacaactacaagatcttcaagatcaagaaaagaaacggcaaattccgaactatatatgaacccaattacacactgaagaatattcagcgcaagattcttaacaacatcctcaacaataagtcaatcagtaaatacgctaaggcatataagaaaggcactagccttaaagataatgccaaagagcacctaaataagaacatcatcctgaaattggacatcaagaattttttcgagtcaatccagttcattgacatttacaactcctgttttccgatcgaatactttcctaaagaaattggcatgctgctcacctttctctgcacatacaataattatctaccacagggggccccaagttcctcttacattagtaacttggtgatgaaagagtttgatgaatacattggtgactattgcgataaaaacaacatcagctataccaggtattctgatgacttaaccttcagcggcaatttcaatcccagcatcatcattaaaaaggtcagaaaggatctgctgaagatgggacttgaaattaatgactccaaaacgcacatcataaaaaaaggtaacaggcagtctgttacagggatagtcgtgaatgagaagcttcagatatcctctgactatcgcaaagaaattcggaagcaaatatactacatcaagaagtacggaatagaaagccatttggagttcaccaataataatatttcggagatcaagtacctgaattcactgtatgggaagataaactacgtactgcaaattaacaaggatgataacgagttcatcgagtataagaagtacattaacaagctgctcaaggagaaacggcctaagaattga

SEQ ID NO: 9543 - RNA, 966 nt, unidentified
  source 1..966: mol_type = other RNA; note = synthetic construct
atgtggaagtatattacaaaggagcagaccaaagattttttgttatctctgaacctcatcgatgataaactcagcgataaagaaaagatcaacatcctatactccataagcaacaacattgaaaacaactacaggatcttcaagattaagaaacggaatggtaagttgcggaccatttatgaaccaaatcccacgttaaaaaacatccaaagaagaatcctcaacaatatactcaacaacaagtcgattagcaaatacgctaaagcatacaaaaagggaatttgcctgaaggataatgcggtcgagcatctgaataaggaaactattctgaagctggatatcaaggacttctttgagaacatcaaattctccgacatttatgactcttgttttagtatcgagtactttcccaaagagattggtatgttgcttacccatctgtgtacctacaataatcacctgacccagggatcacctacaagtgcttatatctcaaatcttgtcatgaaggagtttgacgagtatattggcgactattgcgaagataataacatcagctacaccagatattccgatgacctgacattctcaggcaacttcaacccaagtaatgtgattaaaatcgtaaggaaggccctcctgaaactgaatttagagattaacgacgataagacttgcatcataaataaaggcaatcgccaaactgtgactggcataacggttaatgaaaaggcccagatatgtagcacatatcgtaagaacattcgaaaggagatctactacattaaaaagtttgggatagactctcacttgaaattcaccaacaataatatcacacctctgaagtatcttaggtacctatccgggaagatcaactacgtgatacagatcaacaataacgacaaggaattcctgaaatataagatctacatcaacgagcttctccgggaaaaacgcgtggactga

SEQ ID NO: 9544 - RNA, 954 nt, unidentified
  source 1..954: mol_type = other RNA; note = synthetic construct
atgtggaaatatttgtctaaggacaaagagaaggaatttctgcttagcctgcatctcataaatggagtgaacgatgaggacattctcaataaaatttacaccatctccaacaacatcgagaagaactacaagatcttcaagataaagaagcggaatgggaaaacaagaactatctatgagcccaaccccaacctgaaaataatccagaaaaacatcctccacaatattctggaagatcgctatattagttactcagccaaggcttacaaaaagggcataagcattaaagacaatgcaaatgagcacgtagataaggacatgatactgaagctggacatcaagaacttcttcaacaatatcacctacattcaggtgtactgtagctgctttaaagaaatctatttccctaagtccatcggcaccctgttgacaaatctttgcacgtataatgattctctgcctcaaggggctccaacctccagctacatctcaaacattataatgctagacttcgacatcaagattggcgaatactgcaaagaaaataacgtcagctatactcggtattgtgatgatatgaccttttctggtaacttctccaaaatggagataattaaccttgtcaagtcagaactgaaaaaactgggattaacgctcaatcatgacaagacaaagttgatcactaagaagaatagacagtatgtgacagggatcgtggttaataaaaaagcgcaagtgtcgattgattataggaaagaaatccgcaagaacatttactacatcaagaaatacggactcaactcccacatgaattatcagaaaatgagtctcccaaaagagaagtatctgaacattctgcttggtaggattaattttgttttggaggtcgacaaagccaacaaggagtttattgagtacaagaagtacatcctaaagttaatcaaggatcgatga

SEQ ID NO: 9545 - RNA, 954 nt, unidentified
  source 1..954: mol_type = other RNA; note = synthetic construct
atgtggaagtatactaccaaggaagtgtgcaacgattacttgttaagccttttttcgttcgatctgatctcatccaaccaggagacactcaaactcctttacaagatctccaacaacaaagaaaagtactaccatgtcatcaagatcaagaaaaagtcaggaggttaccgtaccatttatcagccgtcccccacactgaagtatatccagaagactatattggacaaagtgctgaaagagaaaggcatctctaaatatgccaaagcgtactacaacggcgcctctctaaccacaaatgccaagccacatttaaatcagaagatcatcctcaagctagatattaagaacttctttcctagcactaactatctcaccatctacaaggcttgcttcagcaaagagctgtaccctaagagtatcggaactctttttacgtcactctgtacttaccaggattttttgccacaggggtctattacagcaccctatatttccaacttggtgctgaaagacttcgataacgggattggcacgttttgtcaaaagcgcaatataaactatacccgatattgcgacgatatgaccttctctggtaattttgaccctcatcacattattaagtgtgtcgctaataaactgcacaaaatcggctacgaactgaacaagaagaagatccacattataaccaacaataagaggcaagaggtgaccggaattgtagtgaataaaaaactccaggtcccaaaagactatagacacaaaatcaggcaggaactgtattacgttacaaaatactcactgtccagccaccttgagcggaataatattaaggacaaagagacatacctccaaagtctgtatgggaagattctgtatgttctgcagatagaccccagtaataaagagttcataaagtacaaggagctgatcagcttagaactgaataagatgtga

SEQ ID NO: 9546 - RNA, 954 nt, unidentified
  source 1..954: mol_type = other RNA; note = synthetic construct
atgtggcagcacctgacgaaaaagcagataaacaacttcatcttaagcctgaatcttattagctttaacaacctgtctaacaaggagaagctcaagttactgtataccatctccaatcatggtgaaaaacactacaaagtcttcaaaatcccgaaaaaaaacggcgggtatcggacaatatacgagccagattacacactaaaaatgatccaggagaatattttgacgaatgtcctcaacgaacgaatcattagttcatatgccaaagcttacaagaagggtctgagtctgctggataatgcactgccccatctaagacaaaaaatcgtgctgaaactggacataaaagattttttcccctcgattgacttccttaaggtgtacaagaaagctttccctagacatatttatcccgaggcagtggcgtcactgcttaccaacctcgtcacctataataataccttgcctcagggagcccctaccagttcatacatttctaatttggttctgaggtccttcgacattaaaataggatccttttgccaatctaagaatattgcctatacacggtactgtgatgacatgacttttagcggagagtttaatccacaggaaatcatcaacctcgtaaaaacagagctgttcaaggagaacttcatactcaacaagaagaagatcaagatcataaagtccaataaggcccagattgttactggcatcgtgtgcaatgaaaagttaagcattccaaggacttataagaagtttattcgccagaacatgtactacatcaataaatacggcctaaataaccacctcaaatacatcaactatctggatagcaaagactatctcaataagctgtatgggcagatcctctttgtgttgcaaattgagaagaacaataaggagttcttgaactacaagaacgaacttatcaaacttaaggaaaactga

SEQ ID NO: 9547 - RNA, 960 nt, unidentified
  source 1..960: mol_type = other RNA; note = synthetic construct
atgttcagatatctgtcccttgataagtataacgacctgctgtcttcattcaatctggtgaatactaccgacatcaagaagataaataagatgctctacaacatctcaaacaatatcgacgccaattacgaggagatcattatccacaaaaaaacaggaggcctgagatttctctatgcgccttctaaagaattgaaaagcatccagaaaaggatcctaaaaaatgtgctcgaggagaagaagttaagccgctacagttacgcttatcgaaaaaaagtttcggtccttgataatgctaaaccccacgtaaaaaaggacgttatagtcaagctggatattaaggacttcttcgacaatattaccttttccatggtgtacgactcttgttttaatgaaaccctttacccgaagaagatgggaatgctctttactaatctgtgcgtgtacaataaccgtttaccccaaggggccccaacttctggcttcatatcaaatatcgtactacgcaactttgacgagaaggtgggtagttattgtgagaagcggaaaattagctatactagatattccgacgatctcacgttttccggtaacttcaacgtcaaggatctgataaagtacgtgaacaagctcttgtatgagtacaacttccgattgaacaagaagaaaattaaggtcgtaagcaagaaaacacggcagcaggtgacagggattgttgtgaacgaaaaagtcaatatccgccggaattacaagaggaaaattaggcaggaaatgtactacatcaagaaatacagtctgaaaagccatctgaagaacattgcatacaaatgcgatgaaaaaacctatctgttgaaccttttaggcaggattaactatgtgtacaacatcacaaaggacaccgagttctataactataaaaaggatgtgacgaagctcgttaagaaactggatctgaagtga

SEQ ID NO: 9548 - RNA, 954 nt, unidentified
  source 1..954: mol_type = other RNA; note = synthetic construct
atgctcgacaatgtcacaaaggacatggctaacgaattcctactgtcgctgaatcttattgatgagaagttaagcgataaggagaagatcagaaagctgtacacattgagcaacaacattgagaagaactataagaaaacggtgatcctgaagaaggatggaaacaagcgtattatatacgagccaaattataccctgaaaaaagtgcagcgcaatattctcgataacgttttatcagggttcaaagtgtccaaatacgctatggcctacgttaaaggcaaatccgtgaaggataacgccaatatgcatgtcaataagaaactgattctgaaactcgacatcaaggattttttcaacaacatttccttcatggacgtttacaacaaggtatttttagaggagtactttcctaaacaggcgcggactgtgcttacctatctttgcacatataacgaatttctgccccaaggtgcaccgaccagcagctacatcagtaatctgattatgcaggatttcgacgaaaaaattggactgttttgcgaaaagaacaacatcagttatactcggtattctgatgatatgacttttagtggtgacttcaatgtcaagatggtcatctttaaggtgaaagacgagctgaagaagatggggatgcagctcaattatgacaagatacacgtgatctactcaaatatgtcccagcaagtgaccgggattaccgtaaatgaaaaaccccaggtcctcaaagttaaacgaagaaagataaggcaggaagtatactatatcaagaagtatggcctctactctcacttgaaaaggatcaatgtgaaagacgagttcagctacctgaggtctttgctcggcaaaatcaatttcgtgctaatggtgaattcagaagacctggagttttttaagtaccgcgagttcatccttaagatattcaacaacttgtga

SEQ ID NO: 9549 - RNA, 942 nt, unidentified
  source 1..942: mol_type = other RNA; note = synthetic construct
atgtggaaatatcttaccaaggagcacaaaaaggaattcatattgagcctgaatttgatcggcggtaagtttagcgatacagagaaactgaacattctctacgctattagcaacaatagcgagaagtattacacgacgaagtatatcaacaagaaagacgggacaaaacgtgagctgttggtaccaaataagactctcaagaacattcagaagaacatcctgaataatgccctgaacgatctagaagtctcgaagtatgcatgtgcctacataaagaacaagtcacttaaggacaatgcttctcctcacatcaatcagaaagttgtgctgaaactggatataaaagacttcttcacctccattacgttcgaggaaatatacaaagtgatacccaacgaattgtttcccacctctatcaaggtgttaatgcttaagttatgtacttactacgactatctacctcagggagcccctacctctccatacctctccaatctcgtgctgaagaacttcgacaattatattggcacttattgcaaagagaggaatattaactacacccggtactgcgacgatctgacttttagtggcgatttcgatgtgaaaaagctcaaaaacaaagtccaggcgtttcttgaggagatcggatataacctgaatgacaaaaagacgaaggtgattaaaaacaacaagcgacaaatcgttacaggcctggtagttaatgaaaaagtcaatatccccatctcctacagaaaaaagattcgccaggaaatgtattacatcaacaaatacgggatcgactcacatctgaaatatatcaacaacaccaacaaggaaaagtacattaacagtctcaagggtaaaatcaactattgcctgaacattaatccgaataataccgagtttcaatcctacctgaagaagctcaataatttattgtga

SEQ ID NO: 9550 - RNA, 948 nt, unidentified
  source 1..948: mol_type = other RNA; note = synthetic construct
atgattgataccgacgtgctgattatcagcgaaaccttggacgtccccgtgaacaagctctacatgctctctaacaactacacttcccggaaaaagcacaggagaagcaaatatgagaactaccatatggttgtgatccatcatggaatcgtacacaagaaacgtatgctctcagtgcctaatgccttcttaaagaccgtccagaggagaatacttgaccagtatctctaccagttagaagagagcgaatatagtacggcatactgtaaaggtaagtctctcctggataatgctagccctcacgttggtaaggagtgcgtgctaaaacttgacatttcccattttttcgacagtatagacgatgacatggtttatctcgtgatgaaacggcttggactgtccgtgccggcaaccgctcttctgactcacttgtgcacataccgggccaaactaccacagggcgcaccaacaagtccttatatcgctaatttggccatgaagcagttcgacgagaagctggggagatggtgctcggagaggaatatcgcgtacactcggtattgtgatgatatgactttttccggcagcaaagccgcgattagggagagccggattatttctaaagtgcgctcaatgatgtatcgcatgggctttatgctgaacgacaagaagacagtctttatctcctcatctcagcaacagcgcgtgacaggaatagttgtcaatgaaaaacccgtcctgtctaggacccaaagaagagctatacgacaggaggtgtactactgtcagaagtatggggccgccaagagcatcaagcgtcgcaagctgaatatttccccagataaatacctgcacagtctgttggggcgaatcgccttcgcactgcaaatcgagcccgataactcagaaatgaaaggctacttcgaaacggtaaagaacatgatctga

SEQ ID NO: 9551 - RNA, 948 nt, unidentified
  source 1..948: mol_type = other RNA; note = synthetic construct
atgctggacgcagatataattaaaatcagcgaggctttggacgtgcccgtaaacaagctctatatgctctccaataactataaaccacgaaagaaaagaagggggtccacctacgaaaactaccacacagttgtcattcaccacggacggggccataaaaatcgacggctaagcgtgccaaatgcctttctgaaaatggttcagcgtaggattcttgaatgctacctttaccaactggaggtaagcgatcattcgactgcctactgcaagggaaagtctttacttgacaacgcatcaccgcacgtgggaaaggagtgtgtgctcaaactggacatttcacacttctttgactccatagatgacgatatggtctatttagtgatgaagcatctggggctttctgtgcctgccaccgccctcctgacccatctctgtacctataaaacgcgcctaccccagggtgctcctacttctccctacatcgctaatctggtcatgaaacagttcgacgaaaagttgggctgctggtgcaggcggaacaatattacgtacacacggtattgtgatgacatgacattcagcggtaccaagagtgccataagagaatcccgcattatcagcaaggttaggtctaagttgtaccacatgggcttcacattgaacgataaaaagaccgtctttatcagttcatcccagcagcagcgcgtgactgggatcgtggttaacgagaagcctgtcctgtctaggtcacagcgccgagctatcagacaagaggtgtactattgtcagaaatatggagccgtggaaagcatcaatcggaaaggcctggacatccccagtgataagtatctgagaagtctcctgggccagatcgcatttgcgatgcaaattgggccagataatgcggagatgagacgttacttcgacactataaagaacctgatctga

SEQ ID NO: 9552 - RNA, 954 nt, unidentified
  source 1..954: mol_type = other RNA; note = synthetic construct
atgatagacgcagatgtgatgaagataagtgagactcttgatgtgccagcaaacaaactctatatgcttagcaacaactacacagctagaaaaaagaggagaggttccaaatatgaaaactaccacaccgtcatcattcaccacgggagggggcataagaatcggaagctgtccgtgcctaacgcctttctgaaaatggttcaacgaggaatcctggaacagtacctgtatcagttggagatctctgagtactcaacggcttattgtaaaggcaaatctcttctggacaatgccagccctcatgttggcaaagaatgtgttctcaaactggacatatcacattttttcgactcaatcgacgatgatgccgtctaccttgtgatgaagcgtctgggcctgtctataccagccacaacactcctgacccacttatgcatctacaaagcacgcctaccccagggagcgccgacaagttcctatattgccaatctggtgatgatgcagttcgatgagaggctcggcagctggtgctccgaaaggaacattacatatactcgctattgcgacgacatgaccttttccgggaataaagctgacatccgaagcgcgaacgtagtcggaaaggtgcgtcgcatgttatacagaatgggcctcactctgaatgataagaagaccgtattcatttcaagttcccagcaacagagggtgaccggagtggtcgttaacgagaaacctaccctcagccggagtcaaaagagatctctgcggcaggaagtgtactactgtcagaagtatggggctgctaagtcgatcaacagacggggtttagacattagccccgataagtacttgcactctctattgggtcgcattgcattcgccctgcagattgagcccgagaatgccgagatcaaggaatactttgagactgtcaagaatttgatcaatacctga

SEQ ID NO: 9553 - RNA, 945 nt, unidentified
  source 1..945: mol_type = other RNA; note = synthetic construct
atgtacaacgacattccatatatcgccgagacattacgtgtccctgttggcaaactctacatgctgtccaacaattacaagccaaggaagaagagaaagggcagcatctacgaaaattaccatacagtcgtgattcaccacggaagaggccacaagaaccgcacactgaacgtgcccaacgccttcctcaagctagttcagcgacgactcctggacaactttctatatcagctcaaagtgtccgagtatagtactgcttattgtaaaggcaattcacttcttgacaacgccgcaccccatgtgggaaaggagtgcgtactgaagttagacatcagccacttttttgattctatcgacgacgataaagtgctgtttgtgatgaaaagattgggagtgagcataactgctactgtcttgttcacccacctttgcacgtacaagggtaagttgccgcaaggggcgcccacttcgccctacatagccaatctggtcatgaaacagtttgatgaaaaacttgggcattggtgctctgaatacaatattacatacacacggtactgtgacgatatgaccttctctggatataaggcagatattcacagtgcaaaagtagttggtaaggtcaagaggatgctgtatcatatgggcttcaccttgaacgacaagaagaccgtgttcatcaatagctcccagcagcagcgggtgaccgggatagtggttaacgaaaaacctaccctgagtcgctcccaaaaaaggacgctgcggcaggaggtatattattgtcagaaatacggcgccgctgagtcaatcaatagaaaaggtctggatatctcacctgataagtatctccatagcctcttagggaggatcgcctttgctctgcaaattgagccagacaattctgagatgcgcgaatacttcgagactgtgaagaacctgatttga

SEQ ID NO: 9554 - RNA, 957 nt, unidentified
  source 1..957: mol_type = other RNA; note = synthetic construct
atggacagcgacgtcatctctattgctgagaaccttggtactacagccgcaaaactatacatgcttagcaataactactcccctaagaataaacgacacggttcacggtatgctaactatcataaggttacgatccagaagcctggcagccataagagtcgcactctgcatgtcccgaacggattcctgaagatgatccaacggaggattctggacaaatacctgtacacccttgaggtgtcagaattttcgaccgcttacagaaagggtacaaatttactggataacgcactccctcacgtggggaaggagtgcgtgctcaaactggatattagcgacttttttggctccatcgatgacgacgccgtatacatggccatgaaaggcttgggattgtctgtccctgccactgcactgctgacccatctgtgtacatatcacggaatactgccacaaggggctccaactagtccctatattgcgaacttagtgatgagacactttgacggaaagttgggcaagttctgcatctccaggaatattgcgtatacccgctattgcgatgatatgacattctctgggtccagggaggatatactacgtgccaagctgccaggcaaagtgaaggcaatgctcgctgcccggaatttcatcttgaatgactcaaaaaccgtccttgtgtacgcctccaggcagcagcgcgttaccggaatcgtagtcaatgaaaagaccacagtgcccaggagctctcgacgtgaaataagacagcaggtgtattactgtagaaaatttggggcccaggattgtattcgccggaaggggctcgatattacacccgaaaagtacttaagtggtctgctgggccggatcactttcgcactccaaaccgaccccgagaacaaacagatgcaggaacacttcagaactgttcgagagatgatcggcaaactcacgtga

SEQ ID NO: 9555 - RNA, 954 nt, unidentified
  source 1..954: mol_type = other RNA; note = synthetic construct
atgacagactctgacgtactgaaaattgccagcgagatagagatcagtgtcaacaagctgtatatgttgtccaacaacaattcacctagacacaagtcgcggaagaagaaacaccggaattatcatactgtcatcatccatcgcggccgggggcacagaaatcgtattctgtccgtcccaaatactctcctgaaactcgtgcagcgcaagatcctagactgtttcctgtatcagctggaaaccagtgagtactcgactgcctattgcaaaggtaaatctctgttggacaacgcctcaccgcacattagaaaggaatgcgttctgaaacttgacattagtcacttttttgactccattacagatgatagcgtctatctggttttcaaacagttcggcttatccgtgcctgctacctccctcttgacacatttgtgtacatacaagggtaagttaccacagggagcgcccacttccccttatatagcaaatctggtcatgaagaacttcgataaaaaacttgggaagtggtgcaaggagagaaatatcacctacactcggtattgcgatgatatgacgttttcaggagataagacctcagtgcgaaaaaacaagataatcgtgaaagtgaaggcaatgctcggcagtatggacatgaagttaaacgacaagaagaccatctttatatccagcagccaacagcaaagggtgacgggaattgtggtgaatgaaaaagctgccatcccacgtgagatgaggaggtctattaggcaggaagtatactactgtaccaaattcgggatctctgatagcctgcagcagcaacgcctcgacatttctcccgataaatacctacatagcctgcttggccgaatcagcttcgcactccagatcgatccctacaattctgagattcaaaagtactttgacacagttaagcagcttatgaacgcttga

SEQ ID NO: 9556 - RNA, 954 nt, unidentified
  source 1..954: mol_type = other RNA; note = synthetic construct
atgatcgataaagacgtgctccaaataagcgagacgctgggcgttcccgtcgggaaactgtacatgttaagcaacgactacatcccccgaaaaaagtcccgcaagtccaaatacaacaactatcataccgttgtgattcacagggggagaggacacaagaacagagtcctatcagtcccaaataatttcctgaaaatggtgcagaggcgcttactggagagatacctgtatcgcttagatgtgtctgaatgctccacagcctacagtaagggcaaaagcctcctggacaacgcctctccgcacgtgggcaaagagtgcgttttgaaactcgacatctctcattttttcgattcgatcgatgacgacatggtatacatgattatgaagcagttcggccttagtgatcccgccaccgcactacttacaaatctctgtgttcacaattgtaagctgcctcagggtgctccaacgtcaccttatatagcgaacctggtgatgactcattttgatgaaaagctgggtgcatggtgctccgagcggtctatcgcctacacacgttattgcgatgacatgaccttctccgggacaaaggaggctgtgaaaagcagtcacatcatccgcaaggtaaagcggatgttgtacaggatgggatttgaacttaacgagaagaagaccgtgttcatttcaagttctcagcagcaacgggtgactggcatcgtggtaaatgagcgtccacagttgactagggagatgagaaggtcaattcgacaggaagtctactattgtaccaaatatggagtgaaggaaagcttgcagcaccggggactcgatataagcgaacaaaagtatcttcatagcctgctcgggcagatttcctttgctctgcaaattgaccctcagaatgaggacatgagacggtactttgacaccgtcaaaaacctgatgaatacttga

SEQ ID NO: 9557 - RNA, 954 nt, unidentified
  source 1..954: mol_type = other RNA; note = synthetic construct
atgatcgacgcagacgtaatcaaaatttccgagacactcgatgtcccagttgggaagctgtacatgctcagcaatgaccgctttccgagaaagcgtcgacggaaatcaaaatacaccaactaccacaccgttatcatccataggggacggggacacagaaatcgtaaactcagcgtgccaaacagctttctgaagatggtgcagaggcgaatcttagagcactatctctataacctggacgtgtccgcatttagcacagcatattgcagggggaaatccctactcgataatgcttctcctcatatcggtaaggaatacattgtgaaactagacatttcccactttttcgacaacatagatgacgatatggtattcatgataatgcggcaactggggctgaccatgcccgctacgagcatgctgaccaatctgtgtgttcacaatggtcgccttccccagggtgcgcccacttcaccttacattgctaacctggttatgaagcatttcgacgaaaaattgggggtctggggcgccgaaaataacattacatacacgaggtattgcgacgatatcactctttctggcactaaaaaagccatcgagagtagtcaccctgtgggaaaaatcaggcgaatgctttaccgcattgaattcaaccttaatgagaagaagaccgtgttcgcctcatcttcacagcaacaaaaggtgacaggaatcgtggtcaacgagaagccccagatttctagagagatgcgcagagccatcagacaggaagtgtattattgtgctaagttcggcgtgactgagagtctgaagcggaacggcttgaatataagtgcgaaggagtaccatcattctttactgggccggatttcgtttgccctgcaggtcgatccagccaacgatgaaatgcagagctattttaataccgtcaagaacttgatatccaagtga

SEQ ID NO: 9558 - RNA, 963 nt, unidentified
  source 1..963: mol_type = other RNA; note = synthetic construct
atgacagatgtggatgtgatgctgataagcgaggtgttgggcgtgcccgtcagaaagctgtacatgctgagctctgaccgtgtgccaaggcagaagagaggcggtagctattccaattaccatcagagtgtaatctacaccggccggactaaaaaaaaacgtgtcctcaccgtacctaacggattcctcaagcttgtgcagcgcagaatcctcgaccgctgtctgtctaagttaccagttagcgaatacgctacggcttaccgcaaaggtacatccgtgcgagacaacgccctgcttcacaccgggaaggaattcatcataaagctcgacatttcgggctttttcgatagtattaacgatgatgctgtgtacatggtgatgaaacagtttagactgtctcccagagcaacatctctcttgacccacctttgcgttcaccgcggagtcttgccccaaggagcccctacatcaccgtacatcgcaaatctggtcatgaagcattttgacgaacatatcggcgcctggtgtgccgaacggaacattacctattcaaggtattgcgacgacatgactttttccgggagtcgggatgaccttctcgggagccgccttgtgggtaaggtgggacggacgctgtatgcaatgggctttactttaaacagggaaaaaaccgtgttcgccggaagctcccaacggcagactgtaacagggctggttgttaatgagaaagctgatttgcctcgagaaaagcgaagggagctgaggcaggaggtctattattgcctgaagtacggcgtcagagagcacctatcacagagagggtcctcagatgccccactgcggtatattaatggactaatggggcgcctcgcgtaccagttacaacagaggcccgaggacgagaaactgcgtgagtggttcgttcaaatcaaaaagctgagggaaagtgagggcgacaagtga

SEQ ID NO: 9559 - RNA, 954 nt, unidentified
  source 1..954: mol_type = other RNA; note = synthetic construct
atgacagatgtagatgtaatgcttgtggccgaagtgctgggggtcccagtgcataggttatatatgctcagtagcgaccgaatgccaagaaacaaacgcggagggagctactccaattatcacaagagtgttatctactcagggagatccaagaagaaacgagtcctgacagtgccgaatggatttctgaagaccgttcagagaagaatcctccaccggtgtctctacaaactgcccgtgagcgagtacgccaccgcatactgtaagggcaggggccccgctgataatgctagtcctcacactggcaaggactacattataaagctggacattagcgatttcttcggcagcattaatgacgatgcagtttacatggtgatgaaacaactgaaactcactccccgcgctacgtcactgctgacccatctgtgcgttcacaacggagtgctgcctcagggcgcgcctacaagtccatacctagctaatttagtgatgaagcactttgatggtcgtatcggatcctggtgcgccgaacgcaatatatcgtatacccgatattccgatgacatgactttctctggtcgccggggagacttgctagcttcaggcctcaccgggagagtcaggaacatgctttattctatgggcttcgagttaaacagcaaaaaaaccgtcttcgcggtctgctctcagcggcaaactgtaacaggcgcagttgtcaacgagaaggtgaacgtgcctagcgaattgaggagaaaattgaggcaggaagtgtactattgtacgcggtttggggtggaggatcatttggcacggtgcggatctggtgaggccccaaaggcctatatctccgggctcctgggtcgcctttcatacgccctgcagcttcgtcccgacgacgaatggctgaggtccggctttgagaaaattaaggccatgtctaacgacatctga

SEQ ID NO: 9560 - RNA, 960 nt, unidentified
  source 1..960: mol_type = other RNA; note = synthetic construct
atgacagattctgacgtgctggcggtcagtcatgcccttgatgtgcccgtgggaaagttgtacatgttatcaaacgagaggattccacggcaggccaaatctagtagctccaagtataagaactatcacaccgtggtgatcaaaaaagggttgttccgcaagagccgcaagctgagtgtgcccaatgctctgctcaaaatgacacagcggaggattctgcaccagtatctgtatcgtctggaacttagctcgttctcaactgcctaccagccggggcggagcctaaaagacaatgcatctcctcacctgcatcaggaatacttgataaagctcgatattagcaagtttttcgataacatcgatgcagacatggtgtacagcgtcatgcgccagctcggacttagccaagccgcgaccgtcctgctgatgaggctgtgcgttcataattccgttcttccccagggcgcaccaacctccccatacatcgctaacctagtaatgaaaaggtttgatgagcatttgggcgagtggtgtggtcgccggggcattaactatacccgatattgcgacgacatgaccttctcagggcggaaaacggacctactcacatgtgacctggtccgtaaagtaagacgcatgttacacggtatgggattcgagcttaatgaaaggaagtcactgtttttatcctgtgccaaccaacagaaggtgacaggcatcgtggttaatgagaagttgcaagtccccagggaactgcgaagacaactgcgacaggaggtttacttctgcctcaagtttggacctaaggaatctatgaagagaagaggcctcaaaactagtcctgagcaatacctgcactccctgctggggagaatcgcttttgccctccagatagaccctgataatttggagatgcagggttaccactctcagatcaaagaactcactgctcagctctga

SEQ ID NO: 9561 - RNA, 960 nt, unidentified
  source 1..960: mol_type = other RNA; note = synthetic construct
atgactgaccgggacgtcacagagctaagcagagccctgggtgtacctgtgggaaagctgtacatgctgtccaacgaacgaatcccgaggaaaccaaaaaggggatccagcaagtataagaactatcataccgttgtgataaagaaggggctcttcagaaagtcccgcaagttaagcgtgcctaacggccttctcaagatgacccaaagacggatcctgcaccagtacttatatcgattggaggcttctcgatactctacggcttatcagcctggcagatctctccgcgacaacgctagtccccacctcggccaggaataccttatcaaactggacatctcaaagttctttgataacattgacgccgacatggtctataatgtgatgcgtcaactgggactctcacgggcagccgccgttctgctaatgcgtctatgtgtccacaatagtgtcctgccacagggggctccaacttctccttacatagcaaatcttgttatgaaaccctttgacgaacacttaggcgattggtgccgcgcccggggaatcaattatacacgctactgcgatgatatgaccttctcaggtaggaaggcagacttgctgacatgccatttggtgggaaaggtgcggaaaatgctgaggcgcatggggttcgagcttaacgacaaaaagaccctgtttctgtcccgaggcagccagcagaaggtgaccggcattgtagtgaatcagaaactcaaagtcccaagagagctcaggagaactctgaggcaggaggtgtactactgtacaaaattcggggccgaagagagcctcaaacgcaggagacttgatatggcccccgaggaatatctgcggagtttgctggggcgtattgcctttgcgttgcagattgatcccgaagattcggagatgcaaggttaccattcccagatcaaagctctggcagcgcaaaagtga

SEQ ID NO: 9562 - RNA, 963 nt, unidentified
  source 1..963: mol_type = other RNA; note = synthetic construct
atggccgacgctgacgttataaagatcgctcagagcttgggggtgagcgtgaagtcgctgtatatgttgagcaataacccgatgcgcctcagggagaaacggagaaaacccaggtacgagaattatcgccgagtagtcattcatcggggtagggggcgcaagaatagagtcctctctgtgccaaacgagtttctcagacgggtgcagcgaggtatcctgaagaaatatctgtacaatctcgaaccgtcagagtacgcgacagcttatcttcctggattcagcgtcagagccaacgctctaccacacactgggaaggaattcatcgttaaaaccgacatactgcacttcttcgattcaatcgatgaggaactggtctggcgtacagtgagagagttggggttttctatccccgccaccacgcttctgactgacctctgcgtatacagggatcggttgcctcaaggcgcccccactagtcctcacctggccaatctcgtgatgcggcgcttcgatgaaaagatcggcgcatggtgcaaggaaaggggaattacctacactcgctactgtgacgatatgacgttttccggacagaaggacgctctctgcggcgttggtctgataggcgaggtccgaaaagaattacaccgcattgggttacagcttaacgatgagaaaacagcctttatcccagcatcccagcaacaaagggtgaccggagcagtggtgaacaaaaagacacgtttatctcgggacgcaaggcgagaactgagacaggccgtgtactattgtgagaaatttggcgttaaggaacatctggcacatcgtaacgatccatccgcccccgaggaatatctgcggtccctgctaggcaaaattagcttcgcgcttcagctggatcctaccgacggcgagatgagagagatgtttaggaagattaagaagctgaccgacggaagtaaatga

SEQ ID NO: 9563 - RNA, 978 nt, unidentified
  source 1..978: mol_type = other RNA; note = synthetic construct
atgaatgacatcgacaacgatatcataaggatatccgaggagctcgatgtgccactgaagaagctgtatatgctgagcaataacagaattcggtaccacaaacggaaccagaagaaatgctattccaactatcgcaaagtcatcattcacagaggacgaggtcacaaaaatcgggtacttaaagtgcccaatgagtacctgaaactggtgcagaggcgtatcttggaaagatatctttataccctgtctgtgagtgaatacgccaccgcctactgtaagaacagttccctcttgaagaacgccgagcctcatattgggcagcaaagggtactaaaactcgacgtgtctggctttttcgacagcatcgactttgggaaagtgtacggcgtcatgtgtgagctcgggttttcaaagcccgctaccactctcctaactaacatttgtacctacaattccatcttgccccaaggggcaccgacatcacctcagatctcgaacttaatgatgaaacgtttcgacgaacggatcggaaagtggtgcggtgagcgcggaattaactacaccaggtactgcgatgatatgacattctcaggaggcaaagcggtgctgaatgcaaaggaaataacgcagttggtgtctagggcactgtggaaaatgggcttcaagctgaatatgaaaaagacaactctgattggttcaagccagcgccagcaagttacgggaatcgttgttaatgagaaggctcaaatcagcagcaagcagagacgagagatcagacaggaaatctattattgcgaaaagtatggcgtgtctcagtccctctttttcaagggcgctgacataacaccagaaaagtacattaacagtcttttagggcgcattagcttcgccctgcagattgatcctgccgatgtcaagatgcatgagtactttaaggtggttaagaagcttaaaagtgaggtctgtgtcgaaaaatga

SEQ ID NO: 9564 - RNA, 960 nt, unidentified
  source 1..960: mol_type = other RNA; note = synthetic construct
atgaatgaacaggaggtgaattacatgtcctcactttttctgggagcatcaacgttggaaaaacgcgacttgattaacctaatgcccaataaaatcgtacggaaatattatatccggcacgatattccaaaacggacaggcggcattagggtcatatacgagccctcccagaccctgaagactgttcagcgacggatcaaccgctggttcctcaaggacgcccccgtgtccgatttcgcctttgcttatgtgaaaggtagatgcattctggacaacgccaagccacatgtgggcaagccaatactcttaaaactggacatacatcacttcttcgataatatccactttgagagtgtctttgacattttcaagtctctcggattttcggaaaactttgcgaggctcgtggccggactcactacggtggacgactatctccctcagggtgctccaacatcccctgcactgtcaaacctttttctgaaagaattcgatgaggagatcggcgaatactgtagcaagaacgacatcgtctacacccgctacagcgacgatctgactttttctatgtacaggttcaatcccgacttagttaagttcgttagagagaaattaggagcactggggttggagctgaaccgaaagaagtctaaaattatttgcgggccgttgcagaagagagtgaccggcgtggtcgtcaataataagccccaagtacctcgcagctacagacacaagattcgtcaagaaatgtattacatcagcaaatatgggcttgatgctagtctgaataccaggaacataaccgacaaagagaagtatgtttcttgtcttctggggcagatcaacttcgtgctgcagatcaataaaaacgatgatgagttcaagaagtacagggaaatcctgatgacacctagtctagataacctccgtagccaacttacaaatctgttgaactga

SEQ ID NO: 9565 - RNA, 933 nt, unidentified
  source 1..933: mol_type = other RNA; note = synthetic construct
atgaatagcaacgagaagaaatttttactgagtctcttttccttcgacaagaacctgagcgacaacgagaagatcaaaaagatgtacataatgtcgaacaggatcgaaaagtactaccatcatttcaccataaagaaaagaaacggtaccgagaggaacatcctgtgtccatatactcaactgaaaaaaatccagctgaacatcttgaatgggttgctttatgataagtctgtctctgtgtttgctaaggcatacattaaaaatagctacttggtggacaatactattatacacagggggcacaaatatatcctcaaactggacatacacaacttcttcgagaatattagctatgtggacatctttaacatctataaggaatacggattctccaatgccctatgtagtctgttagcccatttaactacatataatgactacctgccccagggggctcctacctcaccttatcttagcaacctggtactcagaaactttgactataaagtgggcaagtggtgcgagaaacaaaacattaattatacgcgctactctgatgatatgaccttttcgatgaatgagtacaataaagacttgatccgattcattcggattaatctgttcaagcagggccttgagcttaacaacgagaagatttgcctgatccatcactcccaacagcagaaaatcacaggtattgtggttaatgataagatccaggtcgattccaaatatcggaaaaaaatcagacaggaactctattacatcaataaatacggactggatgaacacctggaacgtaataagacaaaggacaagaagaaatacctcaaaattctctacggaaagatactctttgtcctatcagtggataagaacaacaaggaattcatcaagtacaagatgattgttcgcaagattctgaatggctga

SEQ ID NO: 9566 - RNA, 1053 nt, unidentified
  source 1..1053: mol_type = other RNA; note = synthetic construct
atgttgtatctcaacagccaaaaggcactgattgaccttctctatgaggactggtgtgaagatatctccaaggaagtgtttacagccttcatttatcgtatcagtaacaacccccagaacttttatcgacgaaatcagatttaccagaagaatgggaaagttcggaatgtggatgtcccatcccagggcttaaaaataatccagaggatcatactgaagcggatcctggagaacatcccagtccataattcagcaagggcctacattaaaggcagctcactcagagacaatgccggcgcccactgtggtcgcaaatgcgtggtcaaactagacatcaaaaggtttttcgaacacatagacgagaagtccgtttacctcatattccggcgccttagttaccctccggatgtttgcagaatgctgactaaactgtgctgtctcaaaggtcgtctgcccacaggcgctcctacctctccctacttaagcaacctgttcatgaaaaagttcgatcgcgagatgagcttgttttgcgagaataaaaacatctcctacacaaggtacagtgacgacattaccttttcatttgattctttcgacaagaccagactaattcgggtgaccagaaacttcttgggactctatgcaaatggactgcctcttaaccagaagaagatcttcgttgtgacgtctaacaaaaaacagaaagtcaccgggcttgtggtgaatgaaaagacttctgtcgacaaggaattacgcaggaacattaggcaggctgtgtattatatcggaaagtttggagtgtccgatcacatcagacatctgcaaagctcagagtacgggggctgggtaatgttcattgcggatgactggcatttccgcatggtaaagttgcgatacctgagaacactgcaagggcggattagcttctgtctgtgtgccgatccagataatactgagatgaagcagtacgctgaatttatcaaggagatcatcaaaaaggagaaggaagagatttgcatactgaagatgtcgtttcaaaatgctaagaaatga

SEQ ID NO: 9567 - RNA, 921 nt, unidentified
  source 1..921: mol_type = other RNA; note = synthetic construct
atgatagtttatcaagaacttgcgagtatcgagagggatctagggttttccgccaagaccctgtacgggctgtcaaatcatctggaaaagcactatcataacgtcttgattcccaagagcgatggatctaaacgtaaactcagcgtgcccgaacttattttgaagcgagtgcagcggagtattgctgaccatattctcgtgcagtttccagtgagcaactacgctaaggcctacaaaatcggcggttctgttcaacacaatgcccagccacacgtgggcaaaaagaaaatcctcaaacttgacattgagggcttctttgatcacatcctctactctcaggtcaaagagaaggttttctgcaaggagaaatttgcagaacccatacgcatcctcttgacaatgctatgctattacaaggagtcattgcctcaaggcgccccgacttcgcctgctattacgaacattattatgtacgacttcgaccagactgtcggtgcattctgtaatgagagagggatcagctatactagatactgcgacgatatgacattctccggagatttcgacgaaggcgaagtgatagccttcgtaaagggggagctgtatcgactggggcttttcctgaagaataggaaaacggtggtcgtccctgcatcaaaacgccagaccgtgacaggcatagtagtgaacgagaaaatcaacctgaccaaggagtataagaaaaagatccgccaggaaatgtactacatccagaaatttggcatcgatgagcacttaacccggctgggagttagtgacaagagaggttacctcctgtccctgatgggaaggatctcttttgtgttacagaccgtaccaaacgactgtgaatttgctaagtatcggaagatgctgacacagggatccttccaaaatgcctga

SEQ ID NO: 9568 - RNA, 912 nt, unidentified
  source 1..912: mol_type = other RNA; note = synthetic construct
atgatcgtctacaaagagttggctagtattgaacaggatttagggttcagcgcacgaaccctgtacggcctctccaaccatctagaaaagcactatcacaatgtcttcattccaaagagcgacgggtctaaaaggaagttgtcagttcctgacctaattctgaagcgggttcagaagtctatagccgataatatcctggtgcagtttcccgtgtccaggtacgcgaaagcttataaagttgggagcagcgtgcagagaaatgctcaacctcatattggaaaaaagaaactcctgaagctcgacatcgagggattttttgatcacattctgtatagtcaggtgaaagacattgtgttctgtgaagagaagttcgccgagccgattaggatactgctcactatgttatgctattacaaggaatcccttccccaaggggcacctacctccccagccatcacaaatattatcatgttcgacttcgatgaaactgtaggcgctttttgtaacaagaagaacatcgcatatacccgttactgcgatgatatgacgttctcgggagattttgacgaaggtgaggtcattacattcgtgaagaaggagcttttcaaactcggcctgtttctgaagaatagaaagacagtggtactgcccgcctcaaaacggcagactgtcaccggaatcgtggtgaatgagaaactgaacatcaccaaggagtataaacgcaacatccgccaggagatgtactacatacagaaatttggcatggacgaacatcttaataaattaggcatctcagacaagcgaggttacttgctcagtctgaagggtcgcatctctttcgtccttcaaacaataccaaacaatcgggagtttgttgaatatagaaaagtgttgaacgccaacctgctgtga

SEQ ID NO: 9569 - RNA, 1134 nt, unidentified
  source 1..1134: mol_type = other RNA; note = synthetic construct
atggctagccgccacctctttacacatgcacagctgatccggtgtacttctcccacaaaggattttctacgcaaacttctgctgaatggcctagtgcccctgagtcggaatgcccaccgatccgccgctaggctcagaaagctgcaccttgccgacttgagactgcgcgtgtctccatgcaagttagtgttgttctacgacccttcgggcaaggaatccgatatgatcgtctataaggagttggccagcatagagcaggacctaggttttcctgcccggacgctgtatggtctgtccaaccatttagagaaacattaccataacgtgttcatccctaagtctgatgggagcaaaaggaagctttcagtacccgacttgattctgaagagggtgcagaaatccatagcagatcacattctttcacaataccccataagcagatacgcaaaggcttataaggtgggaagcaacgtccagagaaatgcgcagccacacgtgggcaaaaagaaaatgctgaagttagacatcgagggctttttcgaccacattctctactctcaagtaaaaaacatcgtcttctacaaggagaaattctcggaacccataagagttctgctgaccatgctgtgctattatcaggaggctctgccacaaggggctccaagtagtccggccattacgaacattatcatgtacgacttcgacgaacggatcggggctttctgcaatgaaaaacacattgcctacacacgctattgtgacgatatgaccttttcaggagagtttgatgagagggaagtgatttcttttgttaaggaagagctctccaagctcggtctgttcctcaaaaatcgtaaaactgcagtgatccctgcctccaagcgtcagaccgttaccggaatcgtcgtcaacgagaaactgaatgtgaccaaggagtacaagaaagcaattcggcaagaaatgtactacatcaagaaatttggggttgatgatcatctcgcccgactcgggattagcgataagcagcactatatccgaagtcttgcgggcaggatcgcctttgtactgcagacaactccgtcagacggcgagttcgcaggatataagaaattccttgctgaatgtagcttgtga

SEQ ID NO: 9570 - RNA, 912 nt, unidentified
  source 1..912: mol_type = other RNA; note = synthetic construct
atgatcgtttataaagagctcgctagtatagaacaggacttgggttttagcgctaagactctctatggcctgagcaaccgtttagaaaagcactatcacaccgtctacgtccccaaatcggatggtacaaaacggaaactgtcagtgcctgatctcatcctgaagttggtgcaaaagagtattgcagacaatatactggttcagtatcctatctctagatacgccaaagcctataaggtggggtccaacgttcagaagaacgctcatccccatgtaggcaaaaaaaaactactgaagctggatatcgagggcttttttgaccatattctttactcccaagtcaaggatatcgttttctaccaggagaagtacgcggaaccgattaggattctgctgaccatgctgtgctattatcatgactccttgccccaaggagccccaacatcaccagcaatcacgaatattataatgtacgacttcgacgaaactgtcggagccttttgtgatagcaaaaatattgcttacacgcgctactgcgacgacatgaccttttcaggcgacttttctgagaaggaaatgattggcttcgtaaaaaacgagttgtctaaactggggcttcaccttaaaaagagaaaaacagccgtgataccagcaaccaagtgtcagtgcgtgactgggattgtcgtgaatgagaagatgaatctcacaaaggattacaagaagaaaatccgacaggaaatgtatttcatcaagaagttcggactagatggtcacctcaagaaaatgggagtgagtgacaaagagcagtaccttctgtccttaaaggggcggatcgcctacgtgctgcagaccattcctaacaacgatgagttcactgagtataagaagatcctccacagcatcagggtgtga

SEQ ID NO: 9571 - RNA, 909 nt, unidentified
  source 1..909: mol_type = other RNA; note = synthetic construct
atgattatctataaggaactgagtagcatagagaaggtgcttgcctatccagccaaaaccttatatgggttgtctaacaatctcgagaagcattatcacacagtgtttgttcctaagagcgacgggtcgaaacgtaaattatccgtgcctgatctgattctgaaaaacgtgcagcgcagtattgctgatcacattctggcctactaccccattagccggtacgcaaccgcttacaaggtaggcagttctatccagaagaatgcccggccccatgtgaacaagaagaagattctaaaactggatatcgagggctttttcgacaatatactgtattcacgcgttaaggacgtggtcttctacgaagagaaatattcagaaccgataagaatcctcttgactatgctgtgttactaccaagaaagcttgccacagggagctcccacttcccctgccataaccaacatcatcatgtacgactttgatgaaaagatcggggcttactgcacagagaagggtgtttcatatacaaggtattgcgatgatatgactttttccggcgactttgacgaaaaggaggtaatcgccctcgtgacgtctgagcttcagaagctcggtctgttccttaaaaacagaaaaaccgtggtcatcaaaaatacaaaacgacagaccgtgaccggaatcgttgtcaatgagaaaatcaatctggtgaaggagtataagaaaaagattaggcaacagatgtactacattaagaagttcggcattgaatcccacgcggaacatctaggaatcaccgacgtattcggatatttgtctagcctcaaagggcaggtcgcatttgtccttcaaacttgtacgcagaacgcagagttcaaaggctaccaagagttcctgcagaacctgaaatga

SEQ ID NO: 9572 - RNA, 909 nt, unidentified
  source 1..909: mol_type = other RNA; note = synthetic construct
atgatagtctataaggagctttgctccattgagaaggacctaggatatcccgcgaaaactctttatgggttatcaaacaggatcgagaagcactaccacactgtatttattccaaagagtgatgggacaaagcggagactatctgtgcccgatctgatcctgaagagcgttcagaggagcatagccgataatatcctggcttactacccgatctcagagtatgccaccgcctataaagtgggctcttctgtgcagcggaatgcaaggccacacgtgaataaaaagaagatactcaagctggacattgagggcttcttcgataacattacttatagtagagtcaaggacatcgtattctacgaggataaattcagcgaacccttgagggtgttacttaccatgttgtgctattatcgagattccctcccacagggagcacctacatcccctgccatcaccaacattatcatgtacgatttcgacgagaagattggcgcctactgctccaaaaacggggtcagttacacacgttactgtgacgacatgacattttctggcgactttaacgagcaggaggttatctcgttggtgaaggaggaactgcgcaagctcggtctgtttctcaaaaatcggaaaaccgctgtgatcgaaagaacgaagcgccagacggtcactggtatagtggtgaacgagaagattaatctcaccaaggaatataaacgaaagattcgccaagaaatccactacatcgaaaaattcggaattgaagggcatgcaaagaaacaggctattaccgatgttgccgaatacctgacaagcctgaaaggcagaatcgcttttgtcctgcaaacttgtcctgacgactcagagtttctgaaatacaaagcgatcgttcatcccctgcattga

SEQ ID NO: 9573 - RNA, 909 nt, unidentified
  source 1..909: mol_type = other RNA; note = synthetic construct
atgattgtatatagagagcttaatactctggccacagatctggggtttccactcaaaaccctgtttgcgctgtccaataacatagacaaacactaccataacgctttcattcccaaatcagacggcactaaacggaaactaagtgtgcccgataaaatcctaaaactcgtccagaaaagcatcgccgataacatcctggcttattatcctgtatccaaatatgcatgcgcatatacttacggatcgaatgtgcaaaagaatgcggcaccccatattggcaagaagaagatattaaagctggatattgagggattcttcgacaatatcatatactctcgggtgaaggacattgttttttacaaagagaagttctctgagccagtcagggtcctgctgagcatgctttgttaccaccgagacgccctccctcaaggtgctccaacatctcccgccattaccaatattatcatgtacgacttcgatgagatcatcggctgttattgcaacgaaaagggcatcagttatacccgttattgcgatgatatgaccttcagcggggactttgacgaaaaagaggtgatagtgttggtgaaacaggagctgaagaagctcggtctgtttctgaagaacagaaagacggccgtgatcccgaataccaaaaggcagaccgttactggcattgtcgtgaacgaaaagatcaacttggctaaagaatacaagaagaaaatccgccaggaaatgcattacattacgaagttcggattagatgagcacttgaagaggacaggggagacagacaagaagaaatacctcttgtccataaaggggcgcatcgccttcgttcttcagactacccctaacgacaaagaatttctcgagtacaagtcactgcttacaaaggaaaagtga

SEQ ID NO: 9574 - RNA, 909 nt, unidentified
  source 1..909: mol_type = other RNA; note = synthetic construct
atgatagtgtatagggagctcaaatcaattgagcatgatctgggattcagcgctaagacactctatgggcttagcaataatctggacaagcactatcacaacgcctttatacccaagtccgatggtacaaaaagaaaactttcggtcccggatctcatcttaaaaaaggtgcagagaagcattgcagacaacattctagcctactatcccactagtaaatatgcgtgtgcttacgcctacggagccagtgtgcaaaaaaatgccatgcctcacgtgggaaagaagaagatcttaaaactcgacattgaggggttcttcgacaacattatttactctagagttaaggagactgtgtttttcaaagaaaagtttagcgagcctattaggatactgctgtctatgttgtgctactatctggattccttaccacagggtgctcctacaagtccagcgataaccaacatcatcatgtatgacttcgacgaaaagattgggtcttattgcgcagagaaaggcatcgctttcacccgctactgtgatgacatgaccttctcaggggactttaatgaaaaggaaatcatcgagttggtcaagtccgaactgaaaaaattgggcctgtttctcaagaaccgcaagacggccgtggttcccaacaaaaaacgtcagattgttacaggcatcgtagtcaatgagaagatcaacctgaccaaggaatacaaaaagaaaatccggcaggaaatgtactacatcaagaaatttggcctggaggatcatctgcgaaagatcggccaatctgacaagcagcggtatttgctctcacttaagggaaagatcgcatttgtactgcagactattccagataagaatgaattcctggagtacaaagagctactttccaggaaatactga

SEQ ID NO: 9575 - RNA, 906 nt, unidentified
  source 1..906: mol_type = other RNA; note = synthetic construct
atgatcgtctacaaagagctgaagacaattgaacatgaactgggcttccctgccaaaacactctacggcctgtccaacaacttggaatcccactatagaaccgtgttcattccaaaacgggacggaaataagcggaagctttctgttccagactctatactgaagatggtgcaaagagccattgcggacaatattttgtcgtattatcctgtatccagctacgctatggcctacagtcccgggtgttccgttcagcgtaatgcatctcatcacatcggcaagaaaaaaatcctgaaactggatatcgagggcttctttgataatattacctacagcagggtcaaagacatcgtctttttcaaggagaagtttagcgagcccattcgcatccttctcaccatgttgtgttattacaaggaaagtctacctcagggggctcccaccagtccagtgatcactaacatcctcatgtatgactttgacgagagggtgggagagtactgcagggagaaacagatttcatacactcgctattgcgatgacatgaccttctcaggcgatttcgacgagaagaaaataatcgcttttgtgaagaacgaacttaaaaagctgggtttatttctgaagaatcgcaagacggcagtggtccccgtgaccaaacgacagacggtgacaggtattgtagtcaatgaaagaatcaacctgactaaggactacaagaaaaaaattcggcaggaaatgtattacatccgaaaattcgggatagatggacaccttaaaaagctagagattacagataagaaggcctatttaaacagcctgaaggggcggatatcattcgttctccaaactatcccgaacgataaggaatttctggagtacaaaaatatcctcaagtgccagtga

SEQ ID NO: 9576 - RNA, 909 nt, unidentified
  source 1..909: mol_type = other RNA; note = synthetic construct
atgatcgtttaccatgagttagcatccttacaaaaggatcttggattctcagcaaagaccttgtatgggatttcgaacaatattgctaaacactatcacacagtgctggtcccaaagaaggatggtacgaaacgcaaactctcagtgccagatgtaatgctgaaaagggttcagcgggctatcgccgacaatatcctttctcaatatcctgttagcagatacgccaccgcttacaagccaggagcaagtgtccagaaaaacgctggtaaacacgttgggaagcagaagatcctgaaactggacgtgaaaggcttctttgacaacatattgtactctcaagtgaaggacatcgtcttttacgagaaaaagttttctgagcccattcggatcctgctcagtatgctgtgttactttaatgacagcctcccgcagggagcacccactagtcctgccattgcgaacataattatgtaccagtttgaccagaatgtcggctccttctgcaagcagaacaatgtcacttacaccaggtattgcgatgacatgatcttctccggggactttgatgagagacaaatcgtatccttcgtgacttcagaactgaaaaagctcggcctgtttctaaaagacaagaagacagccgtgattcccaattctaagcgacagatagtgacaggaatcgtggtgaaccaaaaagcgaatgtggccaggcagtataagagcaaaatccgccaggaaatgttcttcataaagaaattcgggatcgatggccatctacagaagacaggcattaacaaccgtcagaaatatcttaacagcctcaagggcagaattgcctttgtactgcagaccttgcctggtgataaggaattcctgaagtacaagaactatctggccaatttgaaatga

SEQ ID NO: 9577 - RNA, 948 nt, unidentified
  source 1..948: mol_type = other RNA; note = synthetic construct
atgatcgtttatcatgaggtagcgacagtggctcgcgagttggggattccactcaaaaccctttacggcgtatccaacaatattagcgcacattatcacaaggtcgccctgcccaaaaagaatggcggtacacgtatcctttctgttcccgatcccgtgctgaagaccattcagtgcgccatagcggataccctgcttccactgagtccagtgagccgatacgcgaaagcatataaaccggctgcaagcgtgaaagccaacgcactaccacacgttggcaaaaagaagctcttaaagcttgatatcctccatttctttgattccatcctctactctactgtgaaggagaaggtcttcccagcctcacggtacgccgagcctattcgcatcctgttgaccatgctgtgttatgaacgtgacgccctcccccaaggagccccttcaagtcctgcaataaccaacatcattctcttcgacttcgacgaaaccgtgggagctttctgccacgagaggggcatcgcgtatacgcgctactgtgatgatatgacatttagcggagactttgacgagaaagaggttaccgcatttatagaggctgaactaagaatccgagggttctttttgaaccggtccaaaactgccgtgatcaggcacactagaagacagacagtcacgggaattgtggtcaatgaagctcctgctttaccaagggccaccagacgcgaattaaggcaggctgtgtactactgcaagacttatggggtggccaatcatctggcccggatacagtcatctactagtcccgggaagtatctggagaagttgctgggcaaaatttcgtacgctctgtccgtagacccggatgacgccgacctgcagaaggcacggaagacagtcctcctgctgattggtctggaaaaacacatccccgaccctacacaaccttga

SEQ ID NO: 9578 - RNA, 918 nt, unidentified
  source 1..918: mol_type = other RNA; note = synthetic construct
atgatagtctatcgggagctgtcgacactggaaagagatttgggcttctccgcgaaaaccctgtacgctgtttctaactccattgataggcattaccataaggtgactcttcctaagaaaagtggaggcactaggaccctcagtgtgcccgatgagatcctgaagaagatccagagggccatcgccgaaaagctgctcgcttatcacccagtttcacagtatgcgaaagcttacaaacccgccgcaagcgtcaagcgcaacgccatgccacatgtggggaagaagaaactgctcaagctgtacattttgcacttctttgactcagttctctacaacactgtgaaagaccgtgtcttccccgaaacagtcttcagtgagaagctacgcattcttctgagcatgctgtgctactatcgggacgtgttaccacagggtgctcctacgagccccgtgatcaccaatattattctctacgatttcgatgagacaatcggcgacttttgtttgtcacggggcattgcctataccagatattgtgatgacatgactttttccggggactttgacgaaaaagagatcattaaaactgtgcagcaggagctgaatgctcgagggtttcttctgaataggaaaaagaccgcagtggtaccttctagcaagcgtcaagtggtaaccggaatagttgtcaatgagaagcttagcctgagtagatccgcccggcgctcattgagacaagcattgtattattgcaagacatacggtgtaagcgagcacctcgcacactgtggcatccatgatacccctaaacactacctagaatctctgttaggaaaaatagcctacgccctgtctatcgacccggatgactccgaattactgaactgcaaggagacagtgacgcgactccttcaggaatga

SEQ ID NO: 9579 - RNA, 924 nt, unidentified
  source 1..924: mol_type = other RNA; note = synthetic construct
atgatcgtgtacactgagctgagatctttggagattgatctcgggattcctatcaaaaccctgtatgccgttagcaacaacattaacgctcactattactctaagagcatccccaagagtgatggtagtcaacgggtgctttctatccctgatgaaccactgaagaagattcagagggcaatctcagagaagctgctagtctacgagccagtgtccatctatgcaaaggcgtacaagcctacatcatccgtgcggaagaacgccgtgtgtcacgtgggcaaagaaaagctcctgaaactcgacatctacaagttctttgacagcattaattacagcctcgttaaggaaaaagtgtttcccagcaataagtactccgaacaaattcggatacttcttagcttactgtgctataaaggagaaccactgcctcagggcgctcccacttcaccagtcatttctaatatcataatgcgtgacttcgatcagactgtaggggagtggtgcaaagagcgcaaaatatcatactctcgatattgtgatgacctgtccttctccggaagttttgatgagacggacgttatcgaattcgtaaccgttaatctgaaatctctaggttgcatcctgaacaagaagaaaacacactgctttaaaggcaaggaaaaaaagaccgtaacaggagtggtcgtgaacgagaaaataaacacacagaagagctatagaaggcagatacgccaggagtttttctactgtcagaagttcggcgtgcaagaacatttgtcaaggattggctcgagtgagaaaccctataattacttgagtagatccttggggcagatcaattacgtcctccagatcaccccggacaataaagagtttctgtcctataaggtccaaattcttgccttactcaaagagcataagtga

SEQ ID NO: 9580 - RNA, 924 nt, unidentified
  source 1..924: mol_type = other RNA; note = synthetic construct
atgatcgtgtacaaagagcttcagagcttagagacagatctgggggttactgccaaaaccctgtacgcaacatcgaataatataaatgcccattaccacaacaagtctattcctaaatctgacggatccattcgggtcctgagcattcctgacgaacctctcaagaaaatccagcgagctatttcagaaaaactactagcgtacgaacctgttagtatctatgcaaaagcttacaaaccagctagttcaatcaggaaaaacgccatctgccacgtgggcaaggagaagttgctgaagctggacatctacaacttcttcgattccatcaagtatagcctggtaaaggagaaagtgtttccagcaaagaaatatagtgaacagattagagtcctgctgtctcttttgtgctataagggagaaagcctgccccaaggagcccccacttcaccagtcatctctaacataataatgcgtgactttgatcagacagttggcgagtggtgtgaggaaaggaaaatacggtacactagatactgcgatgacatgagcttctccggtagttttgatgagtctaatgtgatcaagttcgtggaaggggagcttaaatccttaggctttatcctcaatcgacgcaaaacccggtgttttactggggggaacaagaagaccgtgacaggcatcgtggtgaatgagaagattaacaccgagaagagctataggagacaaattcgccaggaggtgttttattgtaagaagttcggtgtccaggagcacttgacccatatgggatcacccgaaaacccgtataattatctgtcccgccttctcggccagattaactacgtactccagataacgcccgataataaagaattcttgaactacaaggtccagattctgaacatcctcaaggacaatcaatga

SEQ ID NO: 9581 - RNA, 936 nt, unidentified
  source 1..936: mol_type = other RNA; note = synthetic construct
atggtcgtgtatcgagaactgagcagcatagaagcagatctaggaattccagcaagaaccctgtatcgcttatccaacaatattggcaaacattatagggagaagaaaatacccaagtccgatggaaccgtgcgcctgctttccgtgcccgacgagattctgaaaaaagtgcagaggtcaatcgctgagaagttgttggcgtatgagcctgtttcgctctacgcaaaagcctaccggatcgggggaagtgtaatttcaaatgctgcgcctcacgttggcaaggaaaagattttgaagctggacatctaccacttttttgacagcatcagttattcttccgtgaaggagaaatgctttccggccgaaaaatacgccgagaaaataagaatcctgctggcaatgctttgttatcacggcgagtctctgccacagggtgcccctacgagtccaatcattagcaacattatcctcagggactttgatatcgaagttgggagatggtgcagcgaacggaaaattttttattcacgatactgtgacgacatgactttcagttgtgacggggactttgatggggccgaggtgacagctttcgtcaaacagaagctaggcgtcctcggattcatcctgaatgatcggaagacccggctccttaagaagggtgataagaagaccgtgacagggatcgtcgtgtccgagaagctgaacgcttcaaaggagtaccgcagaactgttagggcagaaatacattactgccagaagttcggcgtggaaggccatttgtctcgtacagccaacgccctggccgaaaatccaagcaaataccttgcttctttaatgggtaaagtaaactacgtcctccaaattactcccgaaaataaagagttcctcgagtataaggagtacctgtctgatatcatcaaggagttcaaatga

SEQ ID NO: 9582 - RNA, 921 nt, unidentified
  source 1..921: mol_type = other RNA; note = synthetic construct
atgattgtttacaaagagcttaagagcattgagaaagaacttggcttctcatccaaggcactgtacggactctctaacaatctgggtaagcattatcataaggtcgaggtccccaaaaaatcagggggaactagaaccctctccattcctgatgaagccctcaagaaggtgcagcgcgccatcgtacagtccttgttagaatttgaaaacgtgagtttccacgccaaggcttacaaatataactctagcatcacgaagaatgcatctcctcacgtggggaaagagaagatactcaaactggacatttaccggtttttcgataacatctcatatagtgcagtgaaggagaaagttttcccagcggaaaaatacagtgagcagattcgcatcctgctctcgatgttgtgctattataacgaagctttaccccaaggcgccccaacaagcccgataatcaccaatatactaatgcgggaattcgacaatgtgctgggagaatggtgcaaaaagaggaatgtggactacacacggtattgtgatgatatgacttttagcggcagctttgacgaaaaagagattattgactacgtcatccatctgctatgcggctttggtctgaggttgaatgacaaaaaaaccaaggtgttcaccagcagtcagaaacagatcgttacaggcatcgtggtgaacaagaaaatgaatgtctcaaaggcttacaagcgtgaaattaggaaggaagtgtacttttgtaagaaatttggggtcgagaaccacatagagcacgaggagatacaactgtcccccgagagatatctgaattctctgcttgggcgaattaacttcgttctgcaggtatgtaagaacgataaagagttcaaggagtacaagaagatcatctccaagatcatcaagaacaaatga

SEQ ID NO: 9583 - RNA, 924 nt, unidentified
  source 1..924: mol_type = other RNA; note = synthetic construct
atgattgtgtacagagaactaagcaccctcagcagggatctcggaatacctgccaaaaccctgtatgctgtgtctaatgcccaagataaacactaccggcttatcaaaattcccaagaaggacgggactgacagaacgcttagtatacccgatgagattcttaagaaaatccaacgtgctattagcgaacagctgctgtctagagaacccatctctaggtacgctactgcatatcggcccgccagcggtatcttaaagaatgcactgcctcatgtgggcaaagcgaaattgttaaaacttgacatcttgcacttcttcgattcaatcttgtacagtgccgtgaaggagcgcgcatttccagccgacaggtactcagagtcgaacagaattctgctctccatgctgtgttactaccgggacacactaccacaaggggctcctagttcacctgccattacaaacataatcatgagagactttgacgaagctgttggcgcatggtgcgcggagcgaaagatcgcctataccaggtattgtgacgatatgagcttctccggcgatttcgacgaggaggaggtaatcgaatacatagccgcacgcctgaaggaactgggtttcaccctcaaccgtcgaaagactgtagtgaagaccaactcccagcagcagacagtcactggaatcgtcgtgaatcaaaaaccgaacattagcgccaagtacaaacgcgagattcggcaggccgtcttttattgcacgaaatttggggttacagaacatcagaagcagatcggctctagtcagtccccagtcgcttatctccaggctctgttgggaaagattaactatgttctgcaggtgtgcccaaatgatacctcatttgccgcatacaggaagtccgtgctcgcgctgctggagaagaatcgctga

SEQ ID NO: 9584 - RNA, 924 nt, unidentified
  source 1..924: mol_type = other RNA; note = synthetic construct
atgataacgtacaaagaacttgctaccgtggagggggaactgggcatacctctgaagacactatacagtgtgtcaaacaatgtaaatgcgcactaccgcagggtgctgatccccaagaaggatggaacctaccgcaatctctctgtgccagacgctcctctgaagcggattcagagagcgattaacgagaagctgctagtctatgagccgatcagccgttacgcaacagcatataggattgcatccgggatccggaataacgcccttccccacattggtatgcctaaggtgctcaaactggatatcaagggatttttcgattccgtaacctatagtctcgtcaaggaacgcgtctttagaaaagagaagtatagcgaacctgtgagagtcctgttgacaattttgtgctactataaagacgtgcttccccagggagccccaacttcccccgttatcactaacatcgtaatgcgagagttcgacgaggtaatcggcgaatggtgtggtaagaaaggaatagcttatacccgttactgcgacgacatgacattctcaggggactttgacgagaaagaagtcaaggctttcgtcgccggggagcttaagaaacaaggcttttttctgaacgcccagaagaccgttgttgcaactgctgccaaacggcagacagttacgggcgttgtggtgaacaaaaaagccaacgtgagctctgaataccgacgcgagatcaggaaagaggtgtttttctgtcaaaaatatggagtggcagagcatattgaaaggctcggcttagatgttgataccaagaactatctccggaagctgttaggcagaatcaattacgtgttgcagatttcgccagatgacggtgtcttccaggggtacaagaatgccgtgactgaaatgctggccaatgagaggtga

SEQ ID NO: 9585 - RNA, 924 nt, unidentified
  source 1..924: mol_type = other RNA; note = synthetic construct
atgattgtgtataaagaactgtccagtgtggaagcggacttaggatttcccgccaaaaccctttacggtctaagcaataatctcagtgcacactaccgggaggtgaaacttcctaagagggacggcagctttcgaaccttaaatgtgccggatgagatcttgagccgtgtgcagagagccatagctgacaaactgctctcctacgagccaatttcgacttatgccacagcctatcgaatcgcggggtctgtatgcaaaaacgccgttccacacgtgggcaaggcaaagctcttgaagctggacatcgcacatttcttcgattcagttttgtattcaaccgtgaaggagaacgcattccctaaggagaaatatgctgagaagatcagggtgctgctcgctatgttgtgctattgcggagaggtactgccccaaggcgctccctcctctcctatgatcacaaacattattatgcgagacttcgacgaagccgttggtaagcggtgtcgggccctgggagtctcctatacaagatactgtgatgacatgactttttcaggggatttcgatgaaggagagatcgtgcctttcatcagagacgagcttcgcaagcgggggttctttctaaatgaaaagaagaccgcagtggtccccttttgtcgtcggcaaattgtcacgggcgtagtggtgaacgaaaaactgaacattagtgcggattacaagagaaaaattaggcaggaagtcttctttctccgcaaatttggcgttgctgatcatctgaggcgcactgcctctccattttctgaaaagcagtacctgatgagactgctggggcgcatcaattacgtcctccagataagcccagacgacgccaaattccttgattacaaagaggctgtcatcaggatactgaaggaggccaagtga

SEQ ID NO: 9586 - RNA, 987 nt, unidentified
  source 1..987: mol_type = other RNA; note = synthetic construct
atgtgtgggaccacgttccgcccaatagccatacaaatgtactgcctcgcagtcgtttacgtttcgatgattgtgtacactgagctaaagtcagtggagcaggaccttggaatcagtgccaaaacccttttctccgtgagcaactccctgagctctcattataagagggtcaagatccctaagaagaacggctcctttcgcgaattatctgtgccggatgaagttctcaaaaaaatccagagggccatcgtccagaaaattctcgtgtacgaaccaatttcaaagtacgcccaagcttacaagacaggagctagcgtgcagagaaatgcatcgcaccacgtgggcaaaaagaaaatattgaagctggacatcaagcacttctttgactccattctgtactctactgtcaaagacaaatgctttcccgccgagcggttcagtgaacctattagaatcctgctctccatgctgtgctataatcgcgaggctttaccccagggcgcacccagttcacctatcataactaacatcattatgcgtgacttcgatgaaaaagtcggtgatttctgtcgagagcggaatatcatttatacgagatactgtgacgacatgaccttttcaggggactttgatgaaaagccgattattgagtttgtcaaggcggctctcttcgagtacgggtatctgttgaattctaagaaaacaaccgtggttagcagctctgggaggcaaatcgtgacaggagtagtcgttaacgaaaaaatgacagtgcccgccgagtataaggcgaaaattcggcaggaggtgtatttctgcaaaaagttcggcgtagagaaccatctagagcacatccattatagtaaggataccaaggcatacctgcagagcctgttgggtcgagtgagctttgtactgcagactgaaccaggcgatcaagagtttctggaatacaagacctatcttaccgagatcctgtcccagatctga

SEQ ID NO: 9587 - RNA, 921 nt, unidentified
  source 1..921: mol_type = other RNA; note = synthetic construct
atgattgtgtacactgagctcaaatcagttgaacgcgacctggggattccattaaagaccctgttctccgtgagcaacaacttgagcgcccattacaggacagttaaaattcccaagaaaaatggctctttcagggagctccacgtcccagatgaggtgctgaagaagatccagagagcaatcgctaagcggattctggcttacgaagcaatcagcacatatgcacaggcgtatcgcttcggagccagcgtccaaaggaacgcatcccatcacgtaggaaaaaagaaaatcctgaagcttgacatcaagcacttctttgactctattatctacagtaccgtgaaggagaagtgttttccctctgaacggttctccgaacgcgtccgggtgttactctcgatgttgtgctattatagagatgctttgccgcaaggagccccttcaagccccgtgattaccaacataataatgcgagactttgatgagagagtgggtgccttctgtaaagagcggaacatatcatattccagatattgcgatgacctgacgttctccggggatttcgatgagaaacctgtcgtggaatttgtaaagacagagctgtttcagcgtgggtacctgctcaaccatcagaaaacgactgttgccagcagttctcagcgccagcttgtgaccggcgtcgtggtcaatgaaaatatgactgtaccctgtgagtacaaggccaaaatcagacaagagatgtacttttgccagaaacatggtattgaagaccacctgcaccacatccagtatacaggcgaggttcgtgcttacgtgagttcacttctaggcagggtgagtttcgttctccagactgaacctgagaataagaccttcatggaatacaaggcgtttctaatcaatgccctgcgaaggttttga

SEQ ID NO: 9588 - RNA, 924 nt, unidentified
  source 1..924: mol_type = other RNA; note = synthetic construct
atgattgtctacacagagttgaagtcgatagagaaagatcttggcatacccctgaagacactcttctccgtgtcaaataacctatctagccactacaagaaagtcaaaatcgccaaaaagaatgggggtactagagagctgagagtcccagattacatcctcaaaaaaattcagcgcgcgatatgcgacacctttctggtgtatgaacccatcagtaagtatgctcaggcatacaggttcggcagtagcgttcagaaaaacgccagctaccacattaacatgaaaaagatcctaaagctggacataaagcatttctttgactccatcctttacaccacagtgaaagataagtgctttcctagtgatcggttctccgaacccattaggattctcctttccgtgttatgctactatggcgatgctctgccacaaggtgccccaagctcaccggtaatcaccaacattataatgaaggacttcgacattgaagtggggagtttctgtgagaagcggaacatctcatatactcgatactgcgatgacatgaccttttctggcgattttgacgaaaaggagatcatctcctttgttaaagagaaactgttcagctgtgggtatctcatcaacaacaagaaaaccacagtcgttaaggagggcaaatgtcaactggtgacaggaattgtagtgaataagaggctctcaaccccttctgaatacaaagctaagattcgccaggaaatctatttcggaacgaagtacggatttgagaaccacttgaatcatactggaaatcagacggagctgaagtcctatatcgaatctttgttagggcgtgtgtctttcgccctgcagactgagcctgacaataatgaatttaagaagtacaaggcacagctgatcaaatataagaaaagcattagctga

SEQ ID NO: 9589 - RNA, 924 nt, unidentified
  source 1..924: mol_type = other RNA; note = synthetic construct
atgatcgtataccgcgaattgtccagcgttgaatccgatctggggttctcttccagggagctctatgcactatctaattcaatagaccgacagtatcgcgccgtgaaacttccaaagagtgacggcacataccggaccctgtctgtgccctcacagaagctgaaagcggtccaaagggccattacagaaaagatcctggtccatatgcccgtgtcccgatacgcaaccgcctatcgctacggggcttccgttcagagaaacgcaagggtgcacatcggcaaagagaaggtgttaaagctggacatttaccacttttttgacagcatacggtaccaacaacttaaagataaggtctttacggccgacagattctcagagtcaatccgtattctgttgtcgatgctgtgttattacagagatgtactcccgcagggggctcctactagcccagctgttagtaacattatcatgcgtgattttgacgataccgttggagctttctgcgcggagcggggtctagcttatacaagatactgcgatgacatgactttttctggatcgttcgactatgccgagattatcaagttcataaagaacgagcttcacaagaatggcttcatcctcaacggtaaaaaaactaagctggtgagctctgccaatagacagacagtcaccggaatggtggtgaataagaaactcagtacccctagtgattacaggcggggcattcgcagggaggtctatttcattaagaaatatggcgctgccgaacatctgaaacatatcgagagcaatctgagccccaaacagtacctgcagtccttgcttgggaaaattgcgtttgcactcgaagccgcacctttcgacaagcacttagtggaagccaaaaacgccataatcagcgagatcaagaaggaaccatga

SEQ ID NO: 9590 - RNA, 945 nt, unidentified
  source 1..945: mol_type = other RNA; note = synthetic construct
atgtactgttcgggagaaaaaatgatcgtgtatagagagctttcctctgtggaggccgatctcgacttctcagcaaaaactctgtactccttaactaacgatattgagaagcattacagacgagtggagattcccaagcatgacggtactttcagggtcctgtacgtgcctgacacgctgctgaagacagtgcagagacggatcgcgaatcgcattctgcttctggaaccaatcagcaggtacgctaccgcttataagcgagggtcttttataaggaaaaatgcttcctgccatgtgggaaaggaaacagtattgaagctcgacataaaacacttcttcgacagtatcctatactcacacgttaaagacaaagtctttaccgagaagcggttcagtgagcccattagggtcctgctgacaatgctgtgttactacaaggatcggttaccgcaaggcgccccaacttctcctgtgatcaccaacatcgttatgcgcgactttgacgagacagtagggaattggtgtaaccaacgcggtatcacgtatacaagatactgcgatgacatgactttctctggctcctttgatgtcaacgaggtcaaaatctttgttaagtccgaattgcggaaaattgggttctttctgaatgagaagaagaccgtcagcgccaagggaacccagcggcagatcgttaccggcattgtcgttaacgagaaacttaacgtgagcagcgaatatcgtaagaaactcagacaggaagtgtactattgccgcaagtacggcgtggaagaacacctaaagaggataggcaatagcgtggatgccaaaaaatatctgcagggactcttggggcgtataagttatgtacttgaagtgcgatgcgatgataagtcattcctcgcagacaaagagtttattgcaggtttgatcaagcagtatgagtga

SEQ ID NO: 9591 - RNA, 930 nt, unidentified
  source 1..930: mol_type = other RNA; note = synthetic construct
atgaagatagtttacaaagagctgtcctctatcgaggctgatcttgggtattctgcccatatgttatacgctctctcaaatagtatagccaaacactaccgcagtgtaagtattccgaagcacgacggaactagcagaaccctatccattcctgatgcccccctgaaggcagtgcagcgaagaatagccagcgtcatccttccattgctcccaattagccagtatgcaaccgcctatagatgtcgagggggcattgtcgcaaacgcgagtccccacagagggaaagataagatactcaagctggacatctaccgattcttcgactccatcatgtattccgctgtcaaagaccgcgtgtttacacgggaccggttttccgagccaatccgcgtattgctgagcatcctgtgttactacgacgacagactgccccagggagcacctacatcacctgccatctcaaatattatcatgagggaattcgacgacgccgtgggaaagtggtgctctagacggggtattacctacacgcggtattgcgatgatatgactttctctggcgattttaacgcggctagggtggttgcattcgtgaggcgccgactgaagaagtacggcttcctcctgaatgacaagaaaacccatgttgctagatattttaacaagcaggtcgtgactggtatcgtcgtgaaccgtaagctgaatgtgccttcaagctaccgtaggaaaattaggcaagagatgtacttttgccgcaaacacggcattgaggaacacctaaaattcatccatgaccccacaccgccccaagagtacatcaggcggcttctcgggcgcgtgggctatgttttgagcgtgtcgccagatgatggagaattccgtaaatatcgggattttttacggagggccctggctcaggaatctgaatga

SEQ ID NO: 9592 - RNA, 921 nt, unidentified
  source 1..921: mol_type = other RNA; note = synthetic construct
atgatcgtataccgggaactcggctctttggagagcgacctgggcttctcactaaaaactctgtatgcactgtccaataacatcaagaagcactacgtgtcggttgagatacccaagagaaatgggggggtcaggtgcttaagcgtcccggacgagatcctcaagcgcgtgcaacgccgaatcacagaggtgattctaagtggacagagggtttcaaaatacgcaaccgcatatagatacggcgccggtatcctgaaaaacgcctccgagcacgtggggaagccaaaagtgcttaaactggatatcctccatttcttcgacagcatatcctacagtgaagtcaaagagaatgtatttgtgaaggagcgttttagcgaatctgttcgcatccttcttaccatgttgtgctattgcggcgacagattgccacagggagctccttcctcacctgccatcacaaacattgtgatgagggatttcgacgaaaaggtcggagcctggtgtaaagagcaaggaattgcctatactcgctattgtgacgatatgacgttcagtggcgattttgatgaacggtccatcattgcttttgtgaaacaggagctcctgaaaaagcacctggtactgaactacggtaagacgtctgtgacaacccccggcaaaaggcagattgtgaccgggatagttgtcaatcagaagcctaacataagcgccgactatcggagaaagctgaggcaggagatttattactgtaagaagtacggtctggaggagcatgcgaatcgtattggagaagacgatacccaaaaatacctgctgggtttgcttgggagagtctcttacgctctccaggtgcggcccgatgacgttgctctcaaggaagtgaagcggtggttaacacagactatcaacgaacgaggctga

SEQ ID NO: 9593 - RNA, 921 nt, unidentified
  source 1..921: mol_type = other RNA; note = synthetic construct
atgattgtgtacaaagagctgaaatctcttgagtccgatttaggattttctctcaagctgctatacgccctgagcaacaacattaagaagcattactcaaccgtcgaaataccaaagcggagtgggggagtcaggaggctgtccgtccctgacgaaattctgaaaggcgtgcaaagaaggatcgccgttgttatcctgtcaggacagagcgtctctaggtatgcctccgcctatcgttacggtgcatcggtggttaagaatgcggcagagcacgtaggccgaaagaaggtgcttaaattggatattctgcacttcttcgattctatctcttatagcgctgtcaaggagaatgcattccctagcgaacgattctcagaaccggttaggatcttgcttaccctgctgtgctattacggagatgtccttccccagggcgcgccaagttcccctgtaatcacaaacattgtgatgcgcgatttcgacgaaacggtaggcgcctggtgcgaagagaaaggcatatcctatacacgctattgcgacgacatgacatttagtggggactttgatgaaaaggctgtgatcgactttgtcaaagaagagttgcgcaaaaaacggctcctgctcaactacaagaagacctcactaactaatagaggggggagacaaactgtgaccggtatcgtggtgaacgagaagcccaatatcactagtgagtaccggcgaaaactgcgccaggaagtgtactattgtcagaaatacggcgtgagcgagcatacaaaacggattggtgaggcagatgctaagaaatacttgagagggctcctgggacgggtgagctatgcccttcagataagacccgacgacgcctggttagttaaggctaagtgtgagctgctcaagctcattaaggagcgtcactga

SEQ ID NO: 9594 - RNA, 921 nt, unidentified
  source 1..921: mol_type = other RNA; note = synthetic construct
atgattgtgtatagagagctgtcaagcctttcaaaggacttgggagtgagcaagagcagcctgtacaaactgtcaaattctatcaacaagaactaccacaaggtcgaaatcccaaagaagaacgggggcaccagagtgttgtctgttccctccgagaacctgaaggaagtacagaggaagattacaaaagtgatcctatcgaaggagacagtgagtattcacaccactgcctatcgctatggtgcatccaccgcatataatgctagccaccacgtcaataaggacgttgtactcaaattggacatccttcacttctttgattccatcctatacagcgacgttaaagacaaggtcttccccgctgaaaagtacagtgagcaaattcgtactctgcttgcgatactgtgttaccataaagattctttaccccagggagcaccttcatccccggccataacgaatatcatcatgcgggattttgataatacagtgggcgaatggtgcaggaagaaaaacattgcctacactagatattgcgatgacatgaccttcagtggaaattttgacgccaaagaggtcatcgggtttataaagatccagctgagggagaacggcttcctcctcaacaccgccaaaacacgagtaattcggcgcaacaggagtcaaaccgtcacgggcatcgtggtgaacgagaaaataaatattcctgctgactacaaacggaaacttagacaggagttatactattgtaagaagttcggggtgaattctcatatggctcgcatggatttcgacggaaacgaaatgtcttatattaaccgactgctgggtaagattaattacgttctgtccgtgactccacatgataaacagatgctggattacaaaaagtggctcatcaatgagctcgaatatttttga

SEQ ID NO: 9595 - RNA, 909 nt, unidentified
  source 1..909: mol_type = other RNA; note = synthetic construct
atgatcgtgtatagagaactcagctccctggagcaagacttaggtattaacgctaagatattgtacgccgttagcaactctatcaataagcactatagggaaacgtcactgcctaagaagagtggcggattcagataccttagcgtacctgacaaaatcctaaaatctatccagagacagattgctgaagtgctgctgatacacatgccaatttcgaaatacgctaaagcctaccgttttggtagtagcacactccgtaacgccaaacatcatgttggaaaacaggtagtgctgaaacttgatatcctcaggtttttcgattcaattcggtactccacagtgaaggacaaggtcttccccaaggaaatttacgccgagccactcaggattctgctgaccatgttatgttattataaggaaggactccctcagggcgcaccctcttcacctccgatcactaatatcatattgtacgagtttgacgagcagatagggcagtggtgccgcgagagagagatcagttatacacggtattgtgatgacatggcgttttccggcgatttcgaccccgctgaagtgatcaggtttgtgcgggtccaacttaagaagatgggctttttactgaatgaacagaagaccagaattcagcgcctgggacagcaacaaactgtgaccgggatcgtcgttaacaaaaagctctccgcgcccgccgattatcgcaggaagttgcgacaggagctgtactactgccggaagttcgggatccgcgagcatttgcagaagctagggctggagattaacgaacacacctatcgaatgcaactgctgggcaaagtgaattacgtcctccagttctgcccagatgaccaggagcttaaagccgcaaaaaagtggctgcaggcaaaatga

SEQ ID NO: 9596 - RNA, 915 nt, unidentified
  source 1..915: mol_type = other RNA; note = synthetic construct
atgatcgtttatcgcgagctgtctagccttgagcaggatcttggtatcagctcaaagactttgtacgccgtttccaataacatatctaagcattaccaccgggccaaactccccaagaagtctgggggttaccgcaatctgtccgtgcctgacgagatcctgaaggccattcaacggcagattagcgaggtgttgctgattcacatgccagtgtcaaggtacgctaaagcctatagatttgggtcctcgacactaaggaacgcaaagcatcacgtgggaaagcaggtggtcttaaagctcgacattctgcactttttcgacagcatacgttacagtaccgtaaaagacatggtgtttcccgaagaaatttacgccgagccactgcgtatcctgctgacgatgctgtgttaccataaggatgaccttcctcagggagcacctagtagccctgctatcacaaacatcatactctacgagtttgacgaggtgattggacagtggtgtagagaaagaggcatcgcgtataccagatactgcgacgatatcaccttcagtggggacttcgatccggctgaggtcataaggttcgttcgcctggaattgaaagaactgggcttcctgctgaacgaacagaaaactcgcattcaaagaccaggacaacagcagtcagttacaggcatcgtcgtaaatgagaaactctctatccccgcagtgtatcgacggaaactcaggcaggaattatattactgcaggaagtttggcatccaggagcatctccaaaaaattggcctagaaactccagaggatacatatcggatgcagctgctcgggaaggtgaattatgtccttcaggtccaccccgatgataaggaaatgttggaggctcgaaagtggttacaacagtccaccaaatga

SEQ ID NO: 9597 - RNA, 915 nt, unidentified
  source 1..915: mol_type = other RNA; note = synthetic construct
atgattgtctacagggaactttcgagcttggagcaggatctgggaatcagcgctaagactttatatgcggtcagcaataatctgaacaagcactaccgaaaggcaaagctccctaagaaaaatggggggttccgcaatttatcagtgcctgacgaagctctgaaaactattcagaagaggatagccgaggtgctgctgatccacatgcccattagtaaatatgccaaagcatacaggttcgggggatccacactccggaacgctaagcaccatgtgggtaagcaaatcgtgctcaagctggatatcttgcactttttcgactccatcagatactccacggtaaaggacgtggtttttccggagaaaatttatgctgagcctcttaggatcctgttgaccatgctatgttaccataaagacgcgcttccccaaggcgccccaagttctcctgccattaccaacatcatcctctacgagttcgacgagcagataggcggctggtgtcgaaaccagggtatcgcatatacccgttattgcgatgatatgacttttagcggcgattttgatccctcagctcttatacagtttgttcgcctcgagctaaagaagatgggcttcctgctgaatgaacaaaaaacaagaatccagcggtctgggcaacagcagaccgttacaggcatcgtggtaaacgaaaaactctctattcccgccgactaccgcaggaaactgcggcaagaactctactattgcagaaaattcggaattagagaacatctgcagaagataggtctggacatcccagaggatgcctaccggatgcagctgttaggaaagattaattacgtcttgcagctgtatccagatgaccgtgacatgattgccgcaaagaaccagattatcgccaaatcccgctga

SEQ ID NO: 9598 - RNA, 915 nt, unidentified
  source 1..915: mol_type = other RNA; note = synthetic construct
atgatcgtctatcgggaactcagttcactcgaacaggatctgggcatttcatctaagaccctttacgctgtgagcaaccacattaacaagcactaccacaaggcaacactgccgaaaaaatccggcggatttcgaactctgagcgtgcctgacgaagcgctgaaatcgatccagagaagaattgtcgaggtactgttaatctccatgcccgtcagcaggtatgcaatggcatacaggtacggctcatcaaccctgcagaatgctaagcatcatgtggggaagcagctggtgttgaagctggacatctttaggtttttcgacagcattcggtatagtacggtgaaggacaaggtgttcccagaagagatttacgccgaatctttgcgtattcttctcacaatgctttgctatcacaaagacgcactgccacaaggagcgcccagctctccagctataaccaacatcattttgtacgagttcgatgagagagttggccagtggtgccgagatcagggtatcgcctacaccagatacagtgatgacatgacactatccgggtcctttgaccccgctgaagttatccggttcgtacgtctcgagcttaagaaaatggggttcctgctgaatgaacagaagactcgcatccaacggcccgggcagcaacagtccgtcactggaatcgtggtgaatgagaggttatctatccctgccgattatcgcaggaaattacagcagcagctctactattgtaaaaagtttggcgttcagtctcatctaacaaaaataggtctggaggtcagcgaggccacctatcgcatgcagctcttgggaaaaataaattacgtgctgcagctctcccctaacgatcgcgacatgctggaggccagacggtggcttcaacaaagtgccgagtga

SEQ ID NO: 9599 - RNA, 912 nt, unidentified
  source 1..912: mol_type = other RNA; note = synthetic construct
atgatcgtgtacagggagttgtcgagcctggaacaggatctcggcttttcagcccgcactctgtatgcagtatcaaacaacttgacaaagcactaccacgagacaaaactccctaagaagtccggcggattcagaaagctcagcgtccccgatcaagttctgaaagcaatgcagaaacgaattacggaagtgctgctcatatacatgccggtaagtaggtacgctatggcctaccggttcggcagttccacgatccagaacgcccggtatcatgtgggaaaacagattgtgcttaaactcgacattctgcacttcttcgattcaatacgctacagcgacgtgaaagacaaagcttttcccacagccatctatgaagaaccacttcggatcctgctgaccatgctatgctaccataaagacgctctgccacagggagccccttcctctcctgccattaccaatataatcctgtacgaattcgacgagcagattgggcaatggtgtagggagcggaatatcacatataccagatactgcgatgatatgacctttagtggggattttgaccctgcggaagttatatgcttggtccgccaagaattaaagaagctcggttttcttcttaacgaacagaagactaggatccagcgtcccggtcagcagcagactgtcaccgggatcgttgtgaatgagaaactgtctattccctctgactatcgtcgcaagctgaggcaagagttatattactgtcgaaagttcggcatgcaggagcatttacagagaacaggatctgagattagcgctgatacttatagaagacaactgatggggaagatcaactatgtgctacagctcaccccagacgatcgggacctgttgcaggcaaaggagtggctgtccaatgagggctga

SEQ ID NO: 9600 - RNA, 921 nt, unidentified
  source 1..921: mol_type = other RNA; note = synthetic construct
atgatagtctacagagagctgtcctccttagaacaggatctggggattcgagctcagaccctgtacgccgtgtcaaacaatctggggaaacattataggaacgcaaaactgccaaaaaagagcggaggataccggactctgtctattcctgacgccgtactaaagtctatccagaaacagatcgccgaagttctgctgatacatatgccggttagccgccacgctaaagcttaccgatttggtagctccacagtccggaatgcaaaacctcacgtcggaaagccaatcgtcctcaaacttgacatcctgcactttttcgattcgattcggtatagtaccgtgaaggacaaggtgtttccagccgagatctacgccgagcccctcaggatacttctcactatgctatgttatcatcgcgatgcgctcccccaaggagcccctagtagtcctgcgatcactaacattatcatgtacgaattcgatgagctggtaggccagtggtgccgagagcgcaatatcgcttacacaaggtactgcgacgacctgacattcagcggggatttcgatccctatgaggttattcgctttgttcgtcaggagttaaggaatatggggttcttgttgaacgaacagaagaccagaatccagagatctggccagcagcagtcagtgaccggcatagtcgtgaacgaaaagctctccattcccgcaagctatcggagaagactgcgtcaggaactttattactgccgcaagtttggcgtgtcagaacacctgcggaaaagcggcctggagattctcgagtcaacatataggatgcaattattgggtaaggtgaattacgtgcttcaagtgagtccagacgaccaggacatgttggatgcaaggagatggctccaacaaacgtccaagtcttgttga

SEQ ID NO: 9601 - RNA, 933 nt, unidentified
  source 1..933: mol_type = other RNA; note = synthetic construct
atgattgtctatcgtgagctcagctctttagagcgggacttagggatcccagccaaaacactgtacgccgtatccaatagtctttcccggcattaccgcatggtgagtatccctaagaagaccggcggggtacgaaatcttatggtgccagacactgctctcaaaaccatacaacgcagaatcagcgatgtccttttggcgcacatgcccgtttctagctacgccacagcatacagatttggaacatgcacgctccgaaacgctgctgtgcacgtggggaagcccgtggttctcaagctggatatctaccacttctttgactctatcccatactcgctagtgaaagagaaggcattccctgcccatatctatgcagagcagattcggacgcttctgactatgttgtgttatcacaaggatgtcctgcctcaaggagccccgtcaagccctgctattgtcaatataattctcgcgaactttgacgaaaggattggcagatggtgtacccagcggggtattgcatacactaggtattgtgacgatcttaccttctcaggcgacttcgatcccaaagacgttatcgcctttgtggagggccagctgaagtccctcggcctgctgctgaataccaacaaaaccagggttcagaggcagggtcagcaacagctcgttactggggtgatagtcaacgagaaacccggagtgccagccgtataccgcagacagctgcgtcaggagatgcactattgccagaaattcggagtgggggaacatctgaagtttctgggacaaggcatctcagaagaagcttatctaaggcagctgctgggtaaggtgaactacgtcctgcatattgtcccggattgcgaggaattccaacagtatcgcacatgggtgttacagaaattgcagaatatctccttggccaagtga

SEQ ID NO: 9602 - RNA, 930 nt, unidentified
  source 1..930: mol_type = other RNA; note = synthetic construct
atgattgtttaccgtgaggcccctaccctagcgcgggatttaggagtaggactccacacactctacgctttaagcaatcgcctgagcgcacattaccatacggtggaactgactaagcctaacggcggcgtgagacggttgaccgttcccgatgaggccctgaaaggcgtccagaggtcaatagcccgcaatctgctggcttgcagggaactctccccctatgcgaccgcctaccgttacggggcaggaaccgttcggaatgctagtgcacatgtggggaaggcacgtctgctgaagatggacatctaccacttctttgactccgtgaactactctgctgtgaaggatgccgtatttccagccgaagtgttctccgagcctctaagaattctattgacgatgctgtgttattaccaggatgccttgccacaaggggcccccacaagtcctgcagtcgcaaacattctcatgagggactttgatgaagacgtgggtggttggtgcgcccggagaggtatcgcttacacacggtattgtgatgacttaacttttagcggagacgcaggtctggctggcgcgtatcggtacgccgaagctcgcctcagggagaaggggttcctggtgaaccgccgaaaaacactctacctcgacgctggcagacgacaatgtgtcactggcctggttgtcaacgagaaagtggacgtgcccgccgagtatcgacgcgctcttcggcaggagttgtattattgcaagaaattcggacttgaagagcaccttagatcagtagggtgggagggggacccaaccgcttatgcgaggaggttgctgggaagattctcttatgcccttcagatcaggccggaagatcgagcactgcttgagggcaaagcctggctggtcgaagagctgaatcgcagagccggcaagtga

SEQ ID NO: 9603 - RNA, 921 nt, unidentified
  source 1..921: mol_type = other RNA; note = synthetic construct
atgattgtttaccgcgaggcggcctcacttgcacgcgacttgggggtggagttaaagacactgtatgcgctgtctaacagtctgccagcccactaccgtacagtggagatacccaaggccgacggaggtgtcagacgactgactgtccctgatgaagccttgaaaagggtgcagagggctatcctgaataacctcctggtgcatatgccagtatccccgtacgctaccgcttatcggtatggaggcggcgctgtctgtaatgcagccaggcatgtgggcagaccccaggttttacggctcgacatcaggcacttcttcgatagtgtcaggtattccgcggttaaagacgcagtgttcccgccagaaatattcagcgagccactcagagttttactgaccatgctatgctattacagagatgcattgccccagggtgctcccacgtctcctgccatcgtgaatatcctgctcagagattttgaccggagagtcggtggctggtgcagagagcggggcattgtgtacacccggtattgtgacgacctcacctttagcggcgaggatttgtcaggggtgcgagccgtaacggaagccgaactgcgggatctggggtttttcctcaatgagaggaaaacccggcttcgtagcgcagggcagcgacaaacagtgactggacttgtcgtgaacgaaaaggtcagggtaccccgggaagagcgcagagcaattcgccaagctgtttactgttgccgccgctttggtctagaggaccacctggctcgcacaggggtgggacttactcctgaagcctgcctgaaccgattgctgggccgggtgggatacgtacttcaggcagaccctgattgtgcctgggccctagaggctagacgttggctcctggaggaaaggcgccgaaggatctga

SEQ ID NO: 9604 - RNA, 942 nt, unidentified
  source 1..942: mol_type = other RNA; note = synthetic construct
atgatcgtgtacactcacaccgaaactctcgcccaagacttgggcattcccgctgcgaccttattcggtgtatccttccatctggaccgccactacagacgagtgacactcccaaagcgcgatggtggggtccgcacgttatgtgttccagacccgatcctcaagaaaattcagaggaggatcctgcgggtgctgctcttccacagacccgtgagcccttacgccaccgcctacagaccaggggtaggattacgtgccaatgcactgccgcattgcgggcggcagtgtgtccttcagctggacatcagacagtttttcgactccgtccggtatctccaggttaaggaaattgtgttcccaaaagaaatcttctctgagaagctacgggtattgctgagctgcctgtgctatggcagagacggactgcctcaaggcgctcccacgagtcctgccatttcaaacctgctgttgagggactttgatttgcgcgtcggagattggtgtgctgcaaggggcataagatatacacggtactgcgacgaccttactttctcaggcgcttttgatcccaaaccagtcatccgaatggtgagcgatgcactatggcgggagggctttgtgctgaatcctcggaagacccgcttttcccggtctggacaacgccagacagtgaccggtgtggttgtgaacgatcgacctcgactcgatgcggccaggaggcgagcacttagggctgagctgtattactgtagacgctttggggtggccgaccacctgagtcatataggggatcccaggacacctagagcctatttgctctcgctgcttggacgtctggatttcgccctgtctctgggcgctgagccacagctagcagaggggaggcgttgggttctcgaacagcttaaacccagcaaacagaaggaagagattgacggttga

SEQ ID NO: 9605 - RNA, 933 nt, unidentified
  source 1..933: mol_type = other RNA; note = synthetic construct
atgattgtgtatactgagacagccaccctcgagagggatctgggcatcccagcaaagaccctgttcgctgtctcgcatgaccttaagcggcactaccggcgggttgagctgtccaaagcagacggaacagtgcgtgtgctcagcgtacctgatgcagtgctgaagaaaatccagaggagtatcaacgcgaacctcctcgcatatatgccaataagtccctacgctacagcctacagaccaggcggaggcgtgagacgcaacgccttaccccactgcggccaggaacagctgttgaaactcgacatccggagatttttcgatagcgtgcgctatacacagcttaaagaaaccgtctttccggccgccgtctacgctgagaagctacgggtgttactctctattttgtgctactcaaaggaggggcttcctcagggtgctcccacctctcctgccattgctaatatactgctgcggcagttcgacgagactgttggtggatggtgcggggccaggggcattgcttacacccgatattgtgacgatcttgccttctcagggaggtttgaccccgctgcagtcatctgtactgtgcaggaggccctgaggagagaggggtttagcctcaatgcacaaaaaaccaggctagcgggacctgggggtcgtcatctggtgactggggccgttgttaatcttcgacctcgagccccagccgaagagagaagagccctgagacaggaactgtactattgtgaaaagttcggcgtacgaggccacctcgtccaaacgggagatccacgtacggctcaggcatatctggcggcgctgctaggcaggttggactacgctctgtccctgtcccctgaaccgcgcttggcccaaggacgcagatgggtgttggatcgcttaagggaggaacgcaccgcacggccctga

SEQ ID NO: 9606 - RNA, 924 nt, unidentified
  source 1..924: mol_type = other RNA; note = synthetic construct
atgggcattgtctaccaggaaggaccaagtctggcccgcgatcttgggttgccgttgcgcaccctctacgctgtgtcaaatcgtattcccgctcactaccaccgcgcggaagttcccaagagagacggcggggtgagagtccttcgtgtcccagacccagtgctgaaagacatacagaggcgtatcgcccgtgttctattatcgggaatgcctgtgtccccccatgccacagcatacagatacggagcaggcgtagttgagaacgcccgccgccatgtgggaaggcctgaactgctgaagctcgacatactccacttttttgactctatcaggtacattcaggtgaaggaagccgcctttcctgctgagatctatgcggagcctctcaggacgctgctttccatgctatgttatgaccgcgatgtccttccgcagggagctccaaccagcccctggatcgcgaacctggtactgcggccttttgatgaaaaattaggtgcatggtgtcgggcccggggagtggtttatacacggtactgcgatgacttggccttcagcggcactgcactggatggggtggaggagagggctgaggaaggccttagggcactcgggttccggctaaatagagccaagagggccctgtgccgagatggtcagcaaaaacgggttactggcctcgtcgtgaacgagcgagtggctgtgccagcatgttgcagacgacggctgcggcaggagctgtatttctgcagacgcagaggcgtcgaggaacatctgagggcagtgggcttggctgaggggcgagaacaatgtctcagacgattactggggcaggtagacttctggctgcaagctcagcccgattctcaggaagccgccgagtataggagatggctgttggacgagatgcgcgatggtcggtga

SEQ ID NO: 9607 - RNA, 930 nt, unidentified
  source 1..930: mol_type = other RNA; note = synthetic construct
atgaaaatcgtgtacagagaggccagtaccctggcccgagacttgggcattccgctggacatcctttatgctgtcagcaatcgtctggatgctcactaccacaccgcagtacttcctaaacgcgacggtggaacaagaaccctgactgttccagacgggctgctaaagcggattcaaagggctatcctggagacattgcttgtgcacatgcccgttagccgcaacgcaactgcgtaccactacggggcccgggtgacaaagaacgcagcacctcatgctgggaagaggtttctgctgaagctcgatatcgcccgtttcttcgactccataagatatacgtctgtcaaggaagctgccttcccaccagagatttatgcagaacccttgcggattctcctagcgatgctctgttatcatcgggatgctcttccgcaaggagccccaaccagtcctgccatctcaaaccttgtgatgcgccccttcgatgaacaggtggacggttggtgtagggctcgcggcatcgtctacacaagatattgcgatgatatgacctttagcgcgggcaggcctctaggaggtgtgcatggattcgtgcaggacgctctggggggcatgggtctgctgttaaacgagcgaaaaacagcaaggttccacgcaggccagcgacagactgtcactggcttgaccgtaaatgatcgccctaatgttccccccgcttacagaagggccttacgccaggagctgtacttttgccggaaatttggagcggcctcccatctcgctcacatagggctcgacatggatgtccctacgtacttacatcggctgctgggaagagtgtctttttggttgcaggccgaccccggcaatcaagaagccgcagcctataggagatggactctcgcccagctggactcagccctcccatga

SEQ ID NO: 9608 - RNA, 942 nt, unidentified
  source 1..942: mol_type = other RNA; note = synthetic construct
atgattgtctatcgagagctgtccaccctggccggcgatttaggcgtgtcgggacggactctgtacgctgtgtcaaacagcctccctaagcactaccgcacagtagagctcccgaaaggggacggggccgtaagaaggctttcaattcccgacagggaattgatggagattcagagacgtatacttaatcgcctgctcgtgtacatgcccgttagtccatacgcagcggcatacagacgcggcgttgatcatgcggctggtgcgcgtcctcacatcggaaggccagtgctccttagacttgacatccgacacttctttgactccatcttgtatagcgatgttaaggagtatgcctttcctgctcatatatacgccgaacccctccgagtgttactgtccatcctctgctactgtggtgatgctctgccgcaaggggccccaacatccccagtggttagtaatcttgtgttaagggatttcgatttggaaacaggcgcttggtgtagcgctcgggggatttcttatactaggtactgcgacgacatggccttctctggcgcctttgaccctgtcgaagtgtctcggcttatcgccggaaaactgcgcgaaaggggcttcttcctaaacgaggagaagacccgcgccatgttcgctggccagagacagaccgtcacggggctggtcgtcaacgaaaggctgaatctgccacgggagtatcggcgagcattgcggcaagaactgtatttttgcaggagatttggagtgagcgcacatctggccagaaccggagcagctcctgaacccgaggcatgtctgcggtcactactcggtagagtaagttacgtgctgcagatctctcccgaaaaccgcgagatgctcggatatcgcgagtggctgctgcaggagctagccttgctgcactccggtgagcgtgacagctga

SEQ ID NO: 9609 - RNA, 930 nt, unidentified
  source 1..930: mol_type = other RNA; note = synthetic construct
atgatcgtgtatcgtgagctggagactctgaccagagacttagggattggagcgggcgtcttgtacgccgctggcaaccgaccagaggcacactatcgaaccgtgtcaataaccggtggcaacggcactgtgagaacactttctgtccccgaccctatgctcatggctatacagcggcgcattttattccgcctgttggtacatatgcccgtgtctccgcaggcagctgcttaccgctgtggtgttagcaccttgagcgctgcacggtttcacatcggcaagcccgttctcctgtgcctcgatattaggcactttttcgacaatatccggtacgcagatgtcaaaagatatgctttcccccctgacatctacgcggaaccacttcgcgtgctccttacaaggctgtgttatctgagagacgcactccctcaaggagctcctacatcccccgcgatctctaatctagtcctggccgactttgatcgggctctcactagctggtgtgcccccagggggatcgcctacaccaggtattgtgacgatctggccctgtccggggatttcgatcctgatcaggcctgcgaaatcgctgccgccttgttacgacagcatggctttcttctaaacccagccaagaccaggataaggcgagccggtactaggcagcaggttacaggactgattgtgaacgaacggccaagtgtgccacgtgaatatcggcgggcactgagacaggagctttactactgcagacgtttcggggtagccagtcagatgcagagacgcgggttttgcggaaaagagacgtcctatctgcaatcactcctgggaagagtcaattacctgctacaaattaggccggacgacgtggcagccaagcaggatcgcgactggctcctggccttgctgcatacacaacagacgccttga

SEQ ID NO: 9610 - RNA, 936 nt, unidentified
  source 1..936: mol_type = other RNA; note = synthetic construct
atgcccgataggattgtctacaacgagctgagctctatagagctcgatctagggtttaccgcacagcagctctatgctgtatccaatagcttgcatagacaatacaggcaagtaaagcttcctaaggctaacggaggatatcggacactttctatcccttcacctttactcaaggccatccagcgacgcattactacagttctgttggcccaggagccagtcagtccttacgccacagcctatagatatggcgggggtcccttacggaacgccagacagcacgtgggtcggcagatggtagtgaaactggatatacggggatttttcgaccacatcctctattccgacgttaaggacgcggcatttccagcagatcggtatgccgaacctcttagggtgctgctggcaatgctgtgttactacggcgattccttacctcagggtgcccccacatcgccggccatttcaaatatcgtcctgaggagctttgacgatgctgtgggagcttggtgtcgagcccacgggatcgtgtacaccagatattgcgacgacatgaccttctctggcccaccagaggtcaccgaggtgattccgttcgtgcaggcccagttggagcagcgcggcttctacctaaaccgccgaaaaatggtggttgcgcaccgtgggtgcaagcaaacggtcactggcctggtggtgaataggcgcctcaacgttccagctggctacagaaagaaacttaggcaggagctgtattactgccgtaaattcggactggttcaacacctggcgcatattggggacactacaccccccatgacttatgcaagacgcttgctgggcagggtcaattatgtgctggctgtgagtcccgaccgggaagagtttagagaataccgccattacctcacggaatggtgtcagacctacaccgaatga

SEQ ID NO: 9611 - RNA, 939 nt, unidentified
  source 1..939: mol_type = other RNA; note = synthetic construct
atgattgtgtaccgcgagctctcgtctctagtaagggacctgggcgtggaagccaagacattgtatgcgctgtccaactcactcgaaaagcactaccatcaagtgaagatccccaaaagggacgggggctatcggcagctcagcgtacctgatgagcaacttaagcgggtccaacgccagatcgacagagtgttgctggctaggatgcccgtctctccatacgcaacagcctatagatgtgggtgcggaattggcaggaatgctctgccgcacttaggacagcccggggtgttaaagcttgatattcgccacttctttgatagtatcccttacacggccgtgaaggagcgcgcttttcctggtactatctacggggagcctctgagagttctcttgaccatgctgtgttattacagggactccctgccccagggtgctccaagtagccctgcgatcaccaacataatcatggccaaattcgacgccagagtgggccagtggtgcgcacagagagagattcggtatacacgctactgcgacgatatgaccttttcaggctcctttgatccccaagaggtggtcgctttcgtgaggcctctgctccgagagatggggtttttcctcaacgagaagaaaactcgattcttaccagccggacgacggcaggtagtcactgggatagttgttaatgaaaaaccaggccttccagccgagtacctgcgacgtttgcgtcaggaagtctatttctgccagaaatacggaaccgcagatcatatggcacgctgtggcattcagggtcccgctagcggctatctgaggagactgcttggccgggttaattacggtcttcagatcctaccaggaaaaaaggaactgctcgaagcccgggcatggctgatgaaggagatggcccgtgaacaggaaggagacagaccgtga

SEQ ID NO: 9612 - RNA, 945 nt, unidentified
  source 1..945: mol_type = other RNA; note = synthetic construct
atgatcgtctaccgtgagctttccagcctggttcgcgacttaggtatccccgctaaaaccctgtatggggtatcaaatactgttgagactcactaccacaaggtgcagctgcctaagagggatggcggcgtgcgagagttgagcgtccctgaccccatcttgaaacatattcagagacgaattacacaggtactgttgctgccaatgcccatttcccggtacgcatctgcttatcggtatggggccagtaccttacgcaatgccgctccacacgcaggccaacccggaatcctgaaactagatataaggcatttctttgactcaatcctctatagcacagtgaaggagaaagcctttccaccagaaatctacgcggaacccttgcggatcctgctggcaatgctttgctattaccgcgacacccttcctcaaggtgccccatccagtccagccattacgaacataattatggcccagttcgacgaagatgtgggcgcctggtgtagatctagaagtatacggtataccaggtattgtgatgacatgacattctctggagcttttgatcctcgggaggttaaagccttcgtctcccagaaactcagagaaatggggtttttccttaacgagtccaagtctaagtacctccctgcaggccaaaggcagactgtgacaggcctggtggtgaacgaaaagcccgctgtgccttcagactacctgcgatccctcagacaggagctctacttttgccaaaagttcggagtgagtgatcatatggcccacctgggtattaaggagtcggaggcgcactacttagcacgcctgctcgggagggtcaactacgtgctgcagatcaccccgggaaagaaagaatgggcgcaggcccgtgcttggctccttgttcagctaagcagcctgaatgactctagcccggtcatttcatga

SEQ ID NO: 9613 - RNA, 927 nt, unidentified
  source 1..927: mol_type = other RNA; note = synthetic construct
atgatcgtctatcgcgaactaagcagcctcgctagagacttaggcgtggatgcaagactgctctatgctgtgtccaactcccttgataggcattacaggcaagtctgtttgccgaaaaaggacgggggggtgaggaccctctctattcccgatcagctcctgaaaacaattcagcgacgcattacgcaggtgctgctagtgcatatgcctgtctctccttatgcaacagcctaccggtacgggggatcagcttggcggaatgccgcacctcacgtcggacagcccgctttgcttaagctggacatccgccacttcttcgacagcatattgtacgcgactgtcaaggagagagccttccccccagagatctacgctgagcctctgcgtatacttctgacaatgctgtgctattaccggcaaagcttaccccaaggcgccccatcctcaccggcgattaccaatattatcctgtcgggtttcgatcaggaagtgggagcatggtgtgcaggaaaaggcatccgttacaccaggtattgtgacgatatgaccttttcaggactgttttctcccgaggaagtgacaagttttaccgaagccaggctgcagccatttggcctgttccttaacggaagaaagactcgatttatcccagctggccggcgccaggttgttactggcttggtggtaaacgaaaccgtgggcgtacctgcccattacctcagaactctgagacaagagttgtactattgccggaagttcggtgtgagtgggcacatggcccgactaggcgttcccgaacctgaggcccggtacttagctcgcctgctcgggaaagtgaattatgttctgcaggtaacgccaggtaagagggagtttcagcaggctcgtgcctggctgctccaggcacttgcccactgcgaggggtga

SEQ ID NO: 9614 - RNA, 963 nt, unidentified
  source 1..963: mol_type = other RNA; note = synthetic construct
atgatcgtgtaccgcgagctgagttctttggttcgcgatctggggatccctgctggcaccctctacgcggtttccaacacattagatcgacattatatccggcgtcagttacctaagtcatcaggaggcgtcagagaactgagcgttccagacccgctgctgaaacatattcagagacagatcctccgcgtacttctggtgcacatgcccgtgtcgccttatgccaccgcgtatagatacgggggatctaccctctgcaacgccgcaccacacgtgggcaagccctgtgtgctgaaactcgacatatgccatttcttcgatagtatactttacagcgcagtcaaagagacagcctttccggccgaagtgtatgccgagaacttgcggattctgttggccatgctgtgctatggatgggacaggctaccacagggtgcccccacctctccttgcattactaatatcctgatgagagacttcgacaatgaagtcggggcctggtgtcgggagcgacaaattgcttacacaagatattgtgatgacatgactttttccggcgatttcgcccgcgatgaagtacttcgctgtgtcgagccaaggctgagggccttgggcttttacttgaacccaggcaagacgaagtggctccccgcagacaggaggcagcttgtgaccggcatcgtggtgaataagaaatgcaacgttcccagcgaggagcgtcgggctcttagacaggagctgcacttctgtcaaaagtttggaatctccgggcacatggcacgggcgggaattgacggtcccgaggaccgatacctcgctcagctgctagggagggtcaattatcagctgcagatcactcctgggcgcagggaactccaggaagcaagagattggctgataaaggctcagcctcaatacggcggaggtcgggagacaagcccagctgaaaaacaaattttatga

SEQ ID NO: 9615 - RNA, 933 nt, unidentified
  source 1..933: mol_type = other RNA; note = synthetic construct
atgatcgtttacagagagctcagttccttggtccacgatctggggatttccgcccgcaccctctatgcggtgagcaacggcctggatcagcattatagaagggccgagttacctaaggcagatggcggcgtacgggctctttccgtgcctgaccctttactgaaacacatacagcgcagaattacccaggtcctgcttgtacatatgccaatctcgccctgcgctacagcgtaccgttacgggggttctgttttggtgaatgcagctccacatgttgggcagtcagccgtcctgcgcctggatatacaacgcttcttcgacagtatcagatacacaagcgtgaaggaagcagcctttccagccgatatttacgctgagcccctccgaatcctgctgggcatgctctgttatcatcgggagggattgccccaaggagccccctcatcccctgccatttcaaacattgtgatggccgacttcgacgcccaagtgagcgcctggtgcagggaacggggtttgacatacactcgatactgtgacgacatgacttttagcggagcgcctgtgccatccgaggtcgtgtcttttgttagcgatcggcttaggccactgggcctgttcctcaatagaaggaagacgcgctatctgcccagtgatcgtaggcagctggtcaccggcatcgtggtaaaccaggccctcaacaccccggccgaataccgacggaaattacggcaggagctgcacttttgccaaagatatggggtggctgctcacatggcatggcagggattgacttgttctgaagacgcttatcttgcaagactgctcgggcaggtgaattatgcactacagatctctcccggccgctcagacctagagcaggctcgtgcatggcttagggcgggaggtggtaggacagaaccgcacacctga

SEQ ID NO: 9616 - RNA, 963 nt, unidentified
  source 1..963: mol_type = other RNA; note = synthetic construct
atgcacatcttgtatggattcagtagacggaagggcccaaaccacatgattatttaccggagtatcgacacccttgccaaagacctgggtttcagtccgaaaaccctatatgctgtctcataccagactgatcgccattatgaacaggtcagtttcgcctgcggagggaagaccaggctgctgagcgtgcccgacccattgttaaagtccattcagcgtagcatctatcgcaatctgttatgtcatatgcccgtcagcccttgcgcagctgcatacagatttggcacatcgatagctcagcatgcgagacttcatgccggacagaaactcgtatatcaaatggacatacaaaacttcttcgatcacatcttgtatagcacggttaaggacaaagccttcccggaaattatttactccccttctctgaggatcctcctcacgatgctctgttactatcgggatcggcttcctcagggggcaccaacatcacccgttatcgcaaacctggtactgaaagatttcgacgagaaagtgtgcgcctggtgtaggcagcgccacattcgctattcaagatactgtgatgacctgaccttttctgggtcttttgatcccgtgtccttatatgaatttgtgaagggtgctctgtatcaggaggggttctatttgaatcccaaaaagactaggctcctcagccagtcccgaaggcagacagtcacaggcctcgtggtgaatcagcaggtgtccgtcccttcagcctaccgtcggcaagttaagcaagagatctactactgccagaagtacggcataactgcgcacatgtctcgccagaatatcgctgacaccccagagcactacctacgaagcctgcttggaagagtggactttatcctgtactaccatcaggatgcctcttgggccatggatggccgacaatggctgattactcaactgaagaacttttga

SEQ ID NO: 9617 - RNA, 912 nt, unidentified
  source 1..912: mol_type = other RNA; note = synthetic construct
atgattatctacaaagaaatcagcagtatcgagcaggaccttgggtacgacatcaagacactctacagcatctcatacagcctccatcggcactacattagtataaagatgcccaaaaaacagggtggatataggattctgtcgatccccgatgctcctctgaagtgtatacagaagcgcatcgccgaggtcctgctgtctcaaataaatatttcaccttacgcaatcgcctataggtacggcggatccacgttaagaaatgctgccccacatataaataaggatatcgtccttaagctcgacatccacgatttctttaataacatcctgtattccactgtgaaagagaaagcgtttccgaaagaaaagtactctgagaacattcgtattctcctgagtgttctttgctattataacgacaccctgcctcagggggcaccaacttcacctgctatctccaacatcattatgtgcgatttcgacaataccatagggtcttggtgtaaaaagcacagcatagcctatactcgatactgcgacgacatgaccttttccggaagcttcgaccccaaggaggtaatcaaatgtgtggaatctgagctgaagaaaatgcggctgttcttgaacaagaaaaagacaattgtggccagaaaatccaataagcagattgtgaccggcatcgtggtgaacgaaaagctaaatattccacggcagtacaaaaaggacattaggcaagctctgtattattgcagaaagtttggcgtcgaaaatcatatggccgatgcaaatatcaacgatacaaacgagcactacattctaaagttattgggtaaggtgaactacgttctgtcagtatgtcccaacgataaagagttcatcaactatcgcgattttttgaaaggcctcatttga

SEQ ID NO: 9618 - RNA, 912 nt, unidentified
  source 1..912: mol_type = other RNA; note = synthetic construct
atgatcgtttataaggagatatcctctatcgaacaggatctcgaatacgacatcagaacattgtactccatctcttatagtctccatcgacactaccacagcattaaaatatcaaagcggcagggaggctatagggtcttatccattccggacatgcccctgaagtgtatccaaaaacggatcgccgatgtgttgttgagccagataactatttccccctatgccaaagcttacagatatggagggtctaacattaagaatgcaaccccacatatcaacaaggacattgtgcttaaacttgacataagggacttcttcaacaatattctgtatagcacggttaaagagaaggcctttcctaaagagaagtacagcgagaatattcggatcctgctgtctatgctgtgctattacaacgatgctctgccccaaggcgctcctacctccccatttattagcaacatcatcatgtgcgagtttgacaatgccgtcggaagttggtgcggcaaacatggcgtcgcatatacacgatactgtgatgacatgacctttagcgggaatttcaaccctaatgaggttataaagtacgtgagattcgaactgcgcaagatggggttcttcctgaacaataaaaagacaattgtggcgcacaaatcgaataaacagatcgtcactggtatcatcgtgaataagaagcttaacatcccccgcaaatacaaaaaggacatcaggcaggcaatatactactgtaagaagtttggcgtgtataaccacatggaatccaccaatattaatgatacggtggagagttacattctcaagttaatggggaaggtaaactatgtactctcagtgtgcccaaacgataaggaatttatgggttatcgtaactacctgaaatcactaatttga

SEQ ID NO: 9619 - RNA, 927 nt, unidentified
  source 1..927: mol_type = other RNA; note = synthetic construct
atgatcgtttaccgcgagctgtcttcacttgaacgcgacctgggatttcctgctagcacgttatacgctgtctccaacaggctgaaccgacactaccgtaaagtggaactcccaaagggcgatggacctctgcgcaccctgtctgtccccgacaatctcttgaaaacaattcaaagaaggatcgcccaagtcctgctgagcactctgcctgtgagtccgtatgctacagcctatcggcctggtggctcagtggtcaaaaatgctcgaccacacgtagggaaacccgtagttcttaagttggacatctaccatttcttcgacgccgtgtgctatagccgcgtaaagaaagagatctttcctcccgagatttattccgaacagaacaggattttgcttagcatgctgtgctgttaccaggacaagttaccccagggagcccccacctctccagcgatatctaatcggatattgctggagtttgatcaggagatcggctcctggtgtgcaagacaggggatttcgtacacccgatattgtgatgacctcacattcagtggtgattttgctccaggcgacgtgattcgtcttgttagagaaaggctcaaggtgagggggttcctgttgaataaccgtaagatacaggtgctcaggcaggggcagcggcaaagcgtgactggagttgtcgtgaaccaatccctgcaggccccagtttcacttcggcgagagctaagacaacaggtgtattactgccggaaatttggtgtgagtgatcatctggcgcgcacaaagcagaccgtctccgaagaagactacctccggagactgctaggccaggtgaacttcgcactccagatcaatccggcagatcaggagttagccgatgccaggcagtggctactggcagagatccgcagaaagagaacttga

SEQ ID NO: 9620 - RNA, 933 nt, unidentified
  source 1..933: mol_type = other RNA; note = synthetic construct
atgaggtcctattctattgtatacaaagacatctacgccctcagtggggatctgggagtgagccccagaattctttactccctgtcaaatcgcatcagcggccactatcataccgtcgcgatccccaagaaaaacggaacctaccggaaactgagcgtgccagatgacatactgaagtatgtacagaggcggattaataaggtgctattgtgctatatgccgtcgtcaggctatgccatggcctacgagtatggaaaatccatcctaaaaaacgctaatccccactccaacaagaaatgcattcttaaactcgacatcgacgattttttcgatacggttaagtacagtcaggtcaaagagaaagccttcccagcagctcactttgctgaaaacctcagagtgcttctgtctcagctctgctataacggcgaagggctgccacaaggtgcagcaacctcacctaaaatagccaatttaatactgcgcgacttcgatgagaggatcggatcttggtgtgcccagagggacattacttacacacggtattgtgacgacatgacgttttccagtgacaaggggttggatggcgtgtacaaatacgtgcgcgatgaattattcaaggagggttttctgctgaacaaagacaagacaaagttcattgatagtcatcaccgacagaaggtcactgggatcatcgtgaataatagccctaaggttcccacagaatataccaagaagatcagacaagagatttactactgccgtaagtttggtatctcagagcacttgagccatactgattccgataagtctctctgtgaatacttggcttctctcctgggccgaattaactatgtccttagcgtgacacctaagaatgaggagatgaaggactacaaggaccaggttaccatatggcagaaaagcctgtga

SEQ ID NO: 9621 - RNA, 918 nt, unidentified
  source 1..918: mol_type = other RNA; note = synthetic construct
atgatcgtgtataaatcgctggaatctgtagaggctgacttgggtgtaagcctgaaaactctctatgcagtctccaacaatctgcagagtcattacagaaatgtcgagctgcccaagaaaaacggcgggattagacacctatgcgttcccgatgacgtgctgaagcacattcaaaggaggatcactgaagtgatgctcgtccacatgccgattagcaagtacgctggagcttatcgctacggcgcatctgtcatacataacgcctccgcccatctcgggaagaaaaggatccttaagctggacattagtaagttcttcgacagcgtgctgtattctcaggtgaaagaatatgcctttcccgaaatcattttctcagagaaagtccgcgttctgctttccatcctctgctattacaaagaatcgttaccacagggcgcaccaagcagccctgccatttccaatatcatcatgcgccaatttgacgaaaaggtcggcgcctggtgtgaggagcgtagcatatcctacaccagatattgcgatgatatgaccttctccggagactttgatgcgaatgatgttaagaagcttgtggagcgcgaattgggtaagtatggattttacttgaaccctgtaaaaacgaaaacagtgaccagtgaccaccggcagtcagtgacaggcattatagtgaatgagaagttgtctctgccttcagagtaccggaggaagctgcggcaggagctgtactactgtagacgatatggcgttgatgctcacatggaacgtatcggggtgagtggttctgcaggaagctacctatcacgactcctggggaaagtcaactacgtgctttctgttcggaaggacgatgccgagatgaaagagtacaaagcgtggctcgtggccgagttaaagaagtga

SEQ ID NO: 9622 - RNA, 933 nt, unidentified
  source 1..933: mol_type = other RNA; note = synthetic construct
atgatcgtgtaccatgaattgagctcattatgcgcagacctgcggttatctcctaggaccctatacgccgtgagtaatgccatggaaaagcactatcatactgtgcggatcccaaaaaaaagcgggggatttaggaaacttaccgtcccggacgacctgctgaagatgattcaacggcgcattacagaggccctccttctgccactccccgtatctgccgccgcttctgcttactatccaggtcgcggcataaaacgtaacgctctgccccatgtgggcaaacctgtactgctgaagatggatatttatcacttcttcgacagtgttctctacagggatgttcgggattgcgcatttcctgccgagatttattccgagcccctccgggtcctgctaacaacattgtgttatggaatgaatgagttacctcagggcgcaccctcatcgccagcgatctccaaccgcattctatacaggttcgatgaaaaagtcttgaagctctgccgaaagcaggggattcactatactcgatattgtgatgacctttgttttagcggggactttgacgccgaagcgttgaggaaggaggtcaccaagctgctgatagaagagggcttcttcccgaatcgaaagaagactaaagtgcagaaaggagggacaaggcaatgtgtgacgggactggttgtgaatgaaagagcaaacgtgcctgctgagtacagaagaaagatcagacaggaactgtactacataggaagatttggtcttcgctcacacatggagcgcaccaaggctgaaggttccgaattgagctacctgaggaagctgctgggcagaatctcctactgccttgagatcgaccccgagaacgatgagatgaaacgtgatcgcgaaatggttctcgagctcatcggggagcggaccggcagacagtga

SEQ ID NO: 9623 - RNA, 927 nt, unidentified
  source 1..927: mol_type = other RNA; note = synthetic construct
atgatcgtctaccgcgagttgtcaagtctttccacggatttagggttctccgccaaggccctctatagtgtctcgaatagcataaccaagcactatcaccctgtgaagatacccaagggcaatggcgaatacaggcagctaacagttcccgacgagtttctcaaagccatccagagacggatcaatgataagctcctatgtttcgagccaattagcccatatgctacagcgtaccgtgtgggagggtctacaaaagctaatgcctgtccacacgtaggacaaaaagttctgctgaaactggacatcagacactttttcgacaatctcatctaccctgtcatcaaggaggctgctttcccaaaggaacgctacagcgaggcgaaccggatattgctgacaattttgtgcacctaccagggctacttgccccagggtgcacccacttcccctaccattagcaacattgtgatgaggcaatttgatgatactgtcgggacatggtgcgaaaaacgaggaattcattactctcgctactgcgacgatatgactttttcaggtgacttcgacccgaagcctgtgaaaagcatggttgcaggcgaactgcgaaagctgggcctttttctcaatactaagaagatggtggtagccggcaaagggcaaaagcagaccgtgaccggtattgtcgtgaacgagaaagcatcagtgccgactggatataagagaaaactgaggcaggagctttacttctgcatgaagtatggcaccgactctcatatgaaccataatgaaatcaacatggagaaagggaactatattttatctctgcttggaagggtgaactatgcctgtagtatcgaaacggacaacgaggaactcaagtcctatcgggattggctgctgctggagtcccaggaaaccaaaagatga

SEQ ID NO: 9624 - RNA, 1005 nt, unidentified
  source 1..1005: mol_type = other RNA; note = synthetic construct
atgggcctgcgtattcagagggactcgtgccacattttaacggtgttgctgcatggaaacaggggccgaagagcatgttgcatgatcgtgtattgggagctctcatcattatccaccgacttaggattttcccctaaggcattgtattccgtcagcaacagcatcggccggcattatcggctggtacagatacccaaaggcaatggtgaactgcgccgcctgacagtgccagatagattcctgaaagctatacaggtgcagatttacgagaaattgctgcgcctggaacctgtgagcccccatgctgccgcctatagaccgggaggatctacgcttgtcaatgctaggccccatgtagggcaagccgtgcttctgaaactagacatccggcactttttcgatagcctcatctatccacaggtgaaggacgcagccttccctgtcgagaggtactctgaagcaaatcgtatactcctggcaattctctgcacatataggggaatcctaccccagggggcccctactagtccagctattagtaatatcattctccgaaacttcgatgataccatgggcgaatggtgtggcagacagggggtccgatacacccggtactgcgacgatatgacctttagcggtgactttgacccagctgcggttatcgaaaaaacagccgctgagctgaagaacatggggttgtaccttaatgccggcaagactgttgtggcgagaaaggggcaaaagatgattgtgaccggcatcgtggttaacgaaaaaacctctatcccgcgggactacaagaggaagcttagacaggagctccactactgtactgagtacggtcttgccagtcacctggcgcacactcactcccaaatggaacaacgggattacgtcctgtctttgctggggcgcgtgaattacgccctgtccgtagagcccgctaacgcagagctaggacagtatcgcgtttggctcacagaggccatgaagcagatctcatga

SEQ ID NO: 9625 - RNA, 915 nt, unidentified
  source 1..915: mol_type = other RNA; note = synthetic construct
atgattatctataaggagttttcctcactgcttagcgacctgggcttttctggtaagaccctctatagtgtgtcaaaccatattaaccgtcattatcacccagtcaaaattcctaaagccaacggggagttccgagagttgaacgtccctgacaaactactcatgaccatccaacgcgctataaataacaagctcttatgcctggagaatgtttccaggttcgcaatggcttacaaacctggctctagtaccaagatgaatgccgtggcacacgtggctcagccagtggttttaaagctggacattagacacttttttgatcacttgatcttcccgcttatcaaagagaaagcctttccggcagcgaggtactctgaacagaactcgatcctgctcacattcctctgcacatacaaggatgccttgccccagggtgcaccaacatctcccactatcagcaatataatcatgaaggacttcgacaactttgtgggggggtggtgtaacgaaagggggattgcgtacaccaggtactgcgatgacatgaccttcagcggagacttcgatccaaaagctgtgattatcctggtcaaaaaggaactgaaaaaacttggactttacctgaatgataagaaaacagtggtcgtgagaaagggacaacgccagtccgtaactggcatcgtggtaaacgagaagcggtccatacccatcgaatataaaaagagaattcggcaggaaatgcactattgtatgaagtacggagttgccagccatctcgagcgaatcggcatagatgaagcccccaagacgtatactctgaagctgctaggcaagattaattacgtcctgagtgttgagcctaataatagcaacatgcgccagtatcggtcatggttgatggagcagaagttctga

SEQ ID NO: 9626 - RNA, 921 nt, unidentified
  source 1..921: mol_type = other RNA; note = synthetic construct
atgatcgtttataaagagctgagctccctaacctccgatctcgggttctcatctaaggctctgtattccgtgtctaatcatataggtcgccactacagagctgtgagcgtacccaagggaaacggcgagtctaggcggttgcatgtgcctgacgccctcctgaaggccattcagcggcggatcaacgaccgcctgttgtcattggaggcagtgtctgcctatgcgacagcttatcgcgccggagggtctaccaaacgtaacgccgcacctcatgttggtaagcccgtgttactgaaaatggatatacgtcacttttacgatagcctgatctacccccttgttaaggaaaaggcttttccgaaagaaaggtatagcgagcagaaccgcgtgttactgagcctgctgtgcatttacaatgacacgttgccacaaggagccccgtcctcgcccaccataagtaacatcattatgagagatttcgacgagagggtggggcaatggtgcgcgcagcaggacatcacatacactcggtactgcgacgatatgactttcagtggcgactttgatcctcacccagtcattcgatttgtcaggaaagagctgcagtcccttggccttttcctgaataatagaaaaaccgtcgtagctcgaaccggccagaaacaggcagtgactggtatcgtggtcaacgaaacaacacatattccatcaggctataaggcagcactgaggcaagagctctactattgtcgcaagttcgggattgccagtcacctcttacactgtggcatcgacgaaagccctgaaagatacgctcagaagctgctaggaagagtctcatacgtgctctccgttgagccacagaatcgacagatgcaagattaccgggcctttctccagagttgtcttcagagcaggtga

SEQ ID NO: 9627 - RNA, 927 nt, unidentified
  source 1..927: mol_type = other RNA; note = synthetic construct
atggtctgtaagtcctactctgacttggaacgcctgctgggcattagcgtgaaggcactctattcggtcagtaacgcctcctggaagcactacagaagtgttaaaatcccaaagaatgatcgaggggagttccgcgagcttcacgttcccgatgaattcctcaaaaccgtccagagacggatcgctgaccgcctcctgtcagcctatccagtgtctccttacgccacagcttatcgtcctggcgggagcaccattgtaaatgctcggccccatgtcgggaaaaacgtgctgctgaaactggacatccaccatttctttgacaacatcctctacgcaacggtgaaagagaaggcttttcccgctgaggactattcagagagtattcgcatactcctgacaatcttatgcgtgcataaggacgccttgcctcaaggggccccgacttcacctgttatcagcaacattatcatgagagatttcgattgtaccgtaggaggatggtgcgatgctaggggtatagcgtatacaaggtattgcgatgatatgacttttagcggtgactttgattctcgtgaggtggtttccctggtgagaaccgaactcagaaagatgggacttttcttgaacgagaaaaagacagtccgggcggtgcgaggccagagacaatccgtcactggcttggttgtgaatgagggcctgcgtatacccgcagcataccgcaaaaagcttcgacaggaagtgtactactgtaggaagtttggcgtagccgcacaccttcagaggatgggatctggggaaagggccgaagagtacctaccaaaattactaggtcggattaattatgcctgcagcgtgatgccagacgaccaggaactgcgccaggagcggaggtgggtgatgcaacagctgcacaccctggaacggtga

SEQ ID NO: 9628 - RNA, 933 nt, unidentified
  source 1..933: mol_type = other RNA; note = synthetic construct
atgatagtgtataaggagctctcttccttgactaatgatctcggtttctcagtcaaagctctgtattccgctagcaatcatatctcatcgcactatcataaggcaaagatcctaaagaaaacaggcgaatatcgcgagctctctgtcccagacgacttcctgaagagcattcagaagagaatagtggagaagttgctcgtgtatgaagaggtgagtccgtatgctacagcctaccgttattccacatccataatcaagaatgcgagggtgcatctgcacaataacacgatccttaagctggacatacgccacttttttgaccacatcatttacccagtcgtgaaggaaaaagcctttcccaaggaaaaatactcagaggagaataggattttacttagcctgctgtgcctgtaccacgatgcacttcctcagggggcccccactagtcctatcattagcaacatcatcatgaaagacttcgacaataccgtgggagcatggtgcaagtctaaaaaaattcgctacacccgatactgtgatgacatgactttcagtggtgactttaacattagggaagtcatctcctttatcaaacgggagctgggaaaaatgggcttctacttgaacgatgccaagaccgttgttgctaggtctgggcagaaacagatcgtcaccggcattgtggtaaacgataaacttaatacccccttactctaccggaagaagctgcgacaagaactgtattactgtaagaagtttgggattgccagccatctaagacagaagtctatagatatgagcgagagagagtacatcctgaaactgttaggacgggttaatttcgtgctttcagtaggccagacgaacaaagaaatgcaagaatacaagagttggttgctggatcagaacaacctcttcattacagagaaatga

SEQ ID NO: 9629 - RNA, 921 nt, unidentified
  source 1..921: mol_type = other RNA; note = synthetic construct
atgatcatatacatggagctctcctcaattattcacgatctgggcgtgtctgcaaaagccctttatgctttgtctaatcacacagaaaagcattaccacagagcaaaaattctgaagggcaatggtgagtatagggagcttgcggttcccgacaattttctgaaatcggtgcagcgaaaaatcgctgataccctactggttcacgaggagatatcaccctacgccactgcctatcggtatgggggatccgtcattgccaatgctgaacctcacctgggcaacagctccattttaaagttggacattcgcaaattcttcgacaccataacttaccccttgatcaaagacaatgcatttccaaagaacagatatagcgaaaagattcgcattttgctgactttcttatgtgtctacaacgatgtgcttccacaaggggccccgacatcacctgtgattagtaacatcatcatgcgggagtttgataatacagtaggcgcttggtgtcgacagaggaatatctgctacacaagatactgtgacgatatgacctttagcggagagctaaatagggaagagataattgactttgtcaagaaggagctgaaaaagatgggcttcttcctcaacgacaaaaagacggccttcatacatgacggacaaaagaaaatcgtgaccggtatcgtgatcaacaagaagctcaacaccagcaaaaagtaccggaaacaggtacgtcaggagatcttttattgcaaaaagttcggggtggcctctcatatgaagcatatcaactccgataagagtaaaaacgattatctgctgagtctcctcggaaaagtcaatttcatcctgagcgttgacaaatgcaacgcagaagcgctggggtacaagaagtggctttctgaagaaatcaagaacaattga

SEQ ID NO: 9630 - RNA, 927 nt, unidentified
  source 1..927: mol_type = other RNA; note = synthetic construct
atgatcgtttaccgcgaattgtcaagcctgtctgaggatctcggggtgtccaagaaggcgctatatacagcttccaatcacgccagttcccattacaggaggatcaagatccctaagggaaacggagaatttagagagcttgcagtccccgataattttctgaagagtatacaaaagcgcattgctgacaaactcctgatctatgaagagatctctaagtatgccactgcctacagatacggaggttctgtcgtcgcgaacgcaaagccccatataaagaacgggacggtgcttaaagtggacatccggcacttttttgaccacattatctatccaatcgtgaaagacaaagcttttcccgcttacaggtactcagaacctaatagaatcatgctgagcctgatttgcttgtacaaggacactctcccacagggagcaccaaccagcccggtcattagcaacattattatgaagaacttcgacgattgcattggccagtggtgcgataagaaaggtatagtctatacacgctactgtgatgatttaaccttctccggcaacattatacccggcgagattatatgtttcgtgaaacaggagttggcaaaaatgggcttctacctgaacaacaaaaagaccgtaatcgcccggaatggacagcgtcagctaatcacaggcgtagtggttaacgacaaactgaatattcctctcgattataggaagaagctgcggcaagagctttattactgtaaaaaattcggtgtgagcagtcatctgtcaaagatcaattctgaacagaatgaagagaaatacctccaaaaactgttagggcgagttaattatgcccttatgatcgacaagtcgaatgcccagatgaatgggtaccgacagtggttggtgaacgagctgaaaaagtataacggctga

SEQ ID NO: 9631 - RNA, 927 nt, unidentified
  source 1..927: mol_type = other RNA; note = synthetic construct
atgatcacttacaaagaactctcctctctgaccaatgaccttggattctctgctagggctttgtacagcatcacacataacattcacaaacactataagccggtgtcgatacccaaaggcaacggcgagatgagaaagctatgtgttccagataaattcctgaaagccgtacagagaagtattgcccgcaacctgctctcctacgaagagattagcccatatgcgactgcctaccggttgtgcggttcaaccgtggtaaatgctcggccacatcttggagcggaggtcattctgaaactcgacatttgtcacttcttcgatcacataatctatccagtcgtgaaagataaggtgttccccggtgagaagtattctgaagccaatcgtgtccttctcacattgctgtgtacctaccgcgagagtattcctcaaggcgcacccacatctcctgcaatctccaacattgtgatgagagactttgatgacacggtcggggtttggtgcgaggaccgagggatatgctatacccggtactgcgatgacatgaccttttcaggtgacttcagccctaaggaggtgataagctttgtgcgaactgaactgggcaaaaagggctattttctgaataacaggaagaaggtgatcgcaaagaggggacagaagatgcaggttacaggaatcatggttaacgagaagttaaacgtacctaatacctataggcgcaagctaagacaggagttgtactactgtcggaaatttgggatcaagagtcatatggagaaaatcggggtggagatcacggaacaagaatacatcatgaaactgctcggccgtgtcaattaccttttacaggtgactcccgatgacaagtccgccaaagaagctaaactgtggctgattaaggaactgaagaaggcctcactctga

SEQ ID NO: 9632 - RNA, 939 nt, unidentified
  source 1..939: mol_type = other RNA; note = synthetic construct
atgtttcgcaaaagagagggggggtttgccgtcattgtttattccgagttatcatccttgtgtcgggatctgggcttcactgcccgcgagctgtatgcagctagccggaacaccgacagactctacagaaaagccgtgctgccaaaagcgggtggaggagtacgggaactgagcgtgccatctcctcttctgaaagccattcagacagcggtctatgagaaactcctgtcgcaggaaccggtgtctcggtatgcctgcgcatataggcccggtggcgggatcaagagatgtgccgcaccgcatgtgggcagaggccaagttcttaccctggatattcgacgatttttcgactccgctatctaccccctgataaaggagaaggtgttcgctcccgagcgttacagcgctcctaacagggtcttgctgtcaatgctgtgtacatacagagatgctcttcctcagggcgctccaagtagcccagccatctcaaatatattactgtacgggttcgacgaggcggttggggaatactgcagggagcgtggcattaggtacacgcgatattgcgatgacatggcatttagtggtttgtttgacgcacgcgaactgactgccttcgtggagtccgagcttcgcaaactcggattctacctcaatcgaaagaaaacaaggctggtgcggcctggacaacgtcaggcagtcaccggagttatcgtgaatgaaaagcttgctgtgccccgggagtacaagaggagactacgccaggagctctattacatcgaaaagtacggcatggaagaacacctgtctcgcctcgggggcgaagcccaaaacgtcgattatgccgcacggttgctcggaaaggtaaactatgtgttaagtatcgaacccggtaatattgaggccgcccactgggctaggttgctaaaggacaagtga

SEQ ID NO: 9633 - RNA, 930 nt, unidentified
  source 1..930: mol_type = other RNA; note = synthetic construct
atgatcatctacaatgaactggcgagcctggaagccgacctgggttatagtgcaaagcaattatacagcctgtcaaatggaattaaccggcactatcatcctgccgagatccctaaaagcgacggcggctctcgttcactatcggttcccgatgctcagctcaaggcagtccagagtaaaattgctgataggctgctttctctcgaagatatttccgtatatgctaccgcataccggccagggggctccatagtgagaaacgccctgccacatattgggcattcagatgtgttaaagttggacatacgcaggttttttgattcgatcacgtacccactcatcaaggagaaggccttccctgcaaagcggtacagcgaaaaaaatcgcatcctgctagcaatcctctgcacctacaaagaggctttgccgcaaggtgctccctcatctcccgccatctccaacatcatccttcgaaatctggacgacgccgtcggctcctggtgtagatccagatacattacctataccaggtattgtgacgacatgacatttagcgggcgtattagtacagccctgaaaaaggagatcattaacacagtagagcagcagctccggaaagcgggcctgtatttgaacgccgataagacagtcttcgtgcacgacggacagagaaaatgcgtgactggcatcattgtgaatgaaaaggtgtccattcctgctggttatcggagggatataagacagaagatgcactacatatgctcctacgggatcaagtctcacattcagcatactggaagtaaattgtctgaggaagaatacctgcgaaagcttctgggacgcattagcttcgttttatctatcgacccccacaacgaggagatgcttggatatcgaagcaaactcatagagatccgcaggactctgtga

SEQ ID NO: 9634 - RNA, 918 nt, unidentified
  source 1..918: mol_type = other RNA; note = synthetic construct
atgatcgtctatcgtgaatttagtagcctgactgaggatctggggttttcaggcaaggccttatattcgctgtcaaacaagatccaccgccattataagaaggtggaaattccaaaggccgatggatccgtgagatccctatcagtgccagacgacttcctcaaggccgtgcagcgcagaatcgcagatcggctcctgtctatggaagagatctccccctacgccatagcataccgccccggtggatctccactgaagaacgcaagacctcatatcgctaaaaacaccgtcctgaagctcgatattacctgtttctttgaccacattacttacttcttagtgaaagaaaaggccttccccaaagaaaggtacagcgagaggaatcgaatccttttgacgatgctgtgtatttacaatgatgccttgcctcagggtgcacctacatctccggttatcagcaacataatcatgaaggacttcgataatgcggtaggaaggtggtgcagagagcggcggattgtttatacaagatattgcgacgacatgaccttcagcggggactttgacgtctgcgaggtcaaaaattttgtgtctggcgagctaaggcgtatgggcttctttcttaactccaaaaagacaacagctgttcgacgcggacaacggcacactgtgaccggcattgtagtcaatgagaagcctagtattagcgctaattacaaagccaaattgcggcaagaactgtattacatcatgaagttcgggatcaattcccatttggagaaatgtgggatagacatacccgctgagaaatacctgcagaagctcctcggtagggcgaactatattcttagtgtggagccagataacaaaaaggtgaaagaatacaagggctggctgaccgcccagctgaagaaatga

SEQ ID NO: 9635 - RNA, 921 nt, unidentified
  source 1..921: mol_type = other RNA; note = synthetic construct
atgatcgtctacagagagttatcttctctcgaaacggacctgggggttagcgccaaagtgctctacaccctaagcaacagtcgttcgtcacattatcacactgttatgctgccgaaggagaatggagagttgagacaactgagcgttcctgacgggttgttgaaaagtgtacagcgaaaaattgcgaggcagctgctcgtctacgaggaggtatccccatatgcaatggcttatcggctcggaggatcaactctccacaatgcagtgccccatgtggggcagcccatggtgatgaagctagatatcaggaagttctttgaccactgtttttacccgctggtcaaggagaaagccttccccgctgctaggtattctgaaccaaaccgggtgcttctgtctcttctgtgcgtctaccacgacgccttacctcagggagcccctacctcacccgcgatctccaatataattctgcgggatttcgataacgccgtgggctcctggtgtgctaagcgccatatcgtctacacacgctattgtgatgacatgaccttcagcggttcctttgacccagccgaggtgaagacgaaagtacggacagaactgagaaaggtgggcctgtttctgaacgataacaagactgtcgtgcttaatggcggccaacggcagacagtcaccggcatcgtggtgaacgaaagggtttcagtgcctagtgactataggcgaaaactccgtcaggaactgtactactgcagaaagtacggtatagcagcacatttggaacacattggcagcgaggctgacgtacgctcctacgagagacagctcttagggagggtgaattacgttctgtatgccgatccatgcaaccaagagatgcaggaatatcgacgctggctgcagaatacacttaccggtaaatga

SEQ ID NO: 9636 - RNA, 912 nt, unidentified
  source 1..912: mol_type = other RNA; note = synthetic construct
atgattacatataaggagatctcctctttggagaacgatcttggtgtcagcgctaaagcgctctatacccttaccaatgagatccatcgccactacaggactgtaatgataccaaaggacaacggcgagctgcgtaagttgtcggtgccagacccctttctcaaaagcgtgcaacggaagattgcccacaatatcttgtttttcgaggaaatcagcccgtatgcaactgcttatagacctggaggaagtaccctcattaacgcactgccacacgtgtccaagaacactgtcatgaaactcgacataaacaagttcttcgaccacattatttaccccattgtgaaggagaaagtcttccctgcccacaaatacagcgaagccaacaggattctgcttaccctgatctgtatttacaaggattcactcccccagggagcaccaacaagtcctgtcatctccaacatcgtgctgaaagacttcgataacaaagtaggtgagttttgctttaagaggaatgttacgtatacacgatactgcgatgacatgaccttttctggagaattcgacccccagcaaataaagagattcctgcagaacgagctaaaaaagttagggctataccttaattccaaaaagacagtgatcctgaagaacggccagcagaaaaaagtcacgggcatcgtggttaatgaaaagcctaacgtgtgtgccaagtacaaacgcaagctgagacaggaaatctatttctgccagaaatacgggattaagaatcatttggataagaccggctcatgtctgactgaagcccaatataaggctcagctcttagggcggataaattactgcctgtctgttagtcataaagataagaatatgcagggctttaaggagtggctgatcaataataaatga

SEQ ID NO: 9637 - RNA, 1119 nt, unidentified
  source 1..1119: mol_type = other RNA; note = synthetic construct
atgaacgttaattttctgacagccgcagcctcacgttgcgggcagacctacacattcgattcacggttcgcccctgaaaagctgactgctcagtatacaggcccctgctctatggggtggcgcattctactgcgcatttttagtatgaggatctctattgcatcccatgctttccgggaaggcagtagcgtggtcattgtctaccgggagctttcctccttggtcagtgctttagggttttccgccaaaacgctctacggtgtgagcaatcgtgtgaccacacattacagacagctgaagataccgaagtcaaacggaggtttccgaacccttcacatccccgatcagctgctgaaaagcattcagcgacaaataaatatgcagctgctgctccctgagcctgtgagcccgtttgcaaccgcctatagaccaggaggcagcactcggataaacgctcttccacatgtcggcaaacctatagtcctcaagcttgatatcgatcatttctttgaccacgctttctatccattggttaaagagaaggcgttccccgcaatgaggtattccgaaaagaatcggattttgctgagcctattgtgcacatataaggatacccttcctcagggtgctcccacgagtcccgcgatctctaacatgatcatgtacgacttcgacatggccgtgggcaaatggtgtgtgatgcataatgtgagctacactaggtactgtgacgatatgaccttttccggaatgttcgacattgcagaggttatcgcggtggtgaaggacgccctgaaagactgggggttttttttaaacgccaggaaaaccactgtgattagatcgtcacagcgccagactgtaacaggactggtagtaaatgagcaagttcacattccatcttcttacagaaacgccctccgccaggagctgtattactgtagaaagtttggaatccagtcacacctggagcacaggcacatcaaaatggaacccgaagcctacgcattatctttgctcggcaagatcaactattgtctctccatccacgctgccgacccaatgatgctggagatgaagcagtggctcatgcaacaaatccgaaacaattgcttctga

SEQ ID NO: 9638 - RNA, 954 nt, unidentified
  source 1..954: mol_type = other RNA; note = synthetic construct
atgatcatttatcgggaattttctagcctgtctcgcgatcttgggtttagcggccgaaccctgtacggggtcagtcacgccgtgaccaaacattacagaccagtccgaatccccaaacgcggtggtggaactagggagctgcatatccccgatcccctactgaaagcaatacaaacgcggattgccgaaacactcttgcctctggaggaaatttctccatgtgcttcagcctaccggcccggaggcagtaccaaaaggaatgcgttgccgcacgtgggccggcagacagttctgaaattggacatctccgggttcttcgatcatattacctacccacttgtaaaaaagaaggctttcccagcctccaggtatagtgaatcaaacagagtgttactcgcaatgctgtgcgtgtataaggattccctgccacagggcgcacctacttcacctgctatatccaatatcgtgatgaaggacttcgacgatgccgtttggaggtactgtgccgcgcgcgagatcgcttacactagatactgcgacgacatgacgtttagcggcgacttcgaccctgcccccttgattgcatttgtaaaagcccgtcttaagaagatgggtctatttctcaacgagaagaaaaccgctgttttaagacagggacgcaggcagcaggtgacaggggtcatagtcaacgagaggccaggagtgcctgccgagtataagcgggcaattcgccaagaggttcactattgcgaaaagtatggcgcggctgatcacctctcgttcagaggagatccaactccgcctgccgactatctgatgtctctgatgggccgagtgaactacgtgctcagcatcgaacctcaaaatgaagagatgcgtgggtacaagacactggtcgctgcctggcttaaggaggctgcacagcccaaaaagacccccgaggaacagccctga

SEQ ID NO: 9639 - RNA, 924 nt, unidentified
  source 1..924: mol_type = other RNA; note = synthetic construct
atgatcgtctatcgggagctctcttctctggctcgggaccttggggtgagcgggagaactctttacgccttgagcaaccatgtcgtgaagcactaccgtcgagtgctcctcccaaagggctcaggcgagtaccgtgagctgcacgtccccgacgatctcctgaaaatggttcagaagcgcatagcagaaaggctgctggcgatggagccagtctcaccttatgcgactgcatatagagtggggggaagccctatgttgaatgccaaacctcacgtgggcgctcctgtgctcctcaagatggatattaggcatttcttcgatcacgtgatttaccccgtggtcaaggaaaaagtcttctccgcagagagatatagcgaaaagaaccgggttctgttgactcttctttgcatgtacaaagatagtttaccccaaggggcaccaacaagcccggttatttctaatatcatcatgagggacttcgacgacaggatcggatcatattgtcgcgagaggggcattcggtacacaaggtattgtgacgacttaacattctccggtgactttgatcccgccccaatcaaagcctttgtacgcgaagaactgattaagatgggattttacctgaacgataaaaaaaccgttgtgctgcgagaaggtcagaagaagacggttaccggcatagtggtgaatgagcgattaaacaccagttcggcctacagaagaagtctgcgccaagacgtaagattttgcaagaagtacggtgtcgctgatcatctgaaacacattggaaaagtgggagtatctgaatactcctatctatcccagctattgggccgcgccaattacatcctgcaggtagacaaggataacgctgaggtgaaggggtataaacggtggataatcgagcagatgaccaagcattga

SEQ ID NO: 9640 - RNA, 912 nt, unidentified
  source 1..912: mol_type = other RNA; note = synthetic construct
atgataatataccgggaactgtcctccctgtctgatgacctgggcttcagcgctaagaccttatactcagtaagcaattctatttcttcccactaccgctgtgtctcaatcgccaaaccaggaggcggctatagagaactctctgtgccggattgtctactgaaaagcattcagaggagaattaacgagaagcttttgtggatggaggagatttctccctacgccacagcctaccgagtgcttgggagcaccaagaaaaatgcattccctcataagggtaaccctatcgtcctgaagttggacatacgccactttttcgactcaattatttatcccgtcgtgaaagagaaggtattccccaattatcgatactcagagcagaacagagttcttctgagcttgctgtgcgtgtataaagatgctttaccccaaggcgcaccaacgtctccagccatctcgaacatcatcatgcgggactttgacaacaagataggatcgtggtgcagcgaaaggggggtggtgtacactcgttattgcgacgatatgacattttccgggaatttcgatcctaaaccgctgcgcgcacatgttaaatccgaactcagaagtatgggcttctttctgaatgaccggaagagtgtgatcctcaaccggggtcagtgtcacatcatcactggagttcttgctaatgagcgactccgggccccaagtgactacaggcgcaggatcagacaggagatgtatttttgtcgtaaatatggaatcgggtcccacctgcgcaggatcggtattgaagacgacgtcgcccattataggttagtgctgctcggcagaattaactacgctctatccctggatcctgcggatagcgagctcgtcagttacaagaagtggttgtgcgaaaatgattga

SEQ ID NO: 9641 - RNA, 924 nt, unidentified
  source 1..924: mol_type = other RNA; note = synthetic construct
atgatcgtctaccgcgagttttctagtctcgcaggcgatcttggcttcagtgcgcgtaccctctatggggtgagctatcatagagctagccactaccaaaccgtcagaattcccaaggccaatggcgaatatagagagctgcacgtgcctgacgccctattaaagtcgatccaacggcggatcctgagcgtgatactggaccgggaggaaatctccccatatgctaccgcctacaggtacggaggtggtattgcaaagaacgcagctccacatgtaggcaagccagtggtgctgaaactggatattaggcactttttcgaccgagtcatatacccccttgtaaaagatcgggccttccccgcagaccggttttcagagagcaacagggtgcttttgaccatgctctgcatgtatagagatgctttaccgcagggggctccaacatcccctgcggtttcaaatatcatcatgagggagttcgatgacactgtgggggcgtggtgtgcaagacagcagattgcttacacacgatattgtgacgatatgacattctctggcgactttgaccctaaacccgttattcagaaggtgcgccaggaactgcagaagatgggttttttcctgaacgacaagaaaactgtggtggtccgcgatggacaaaaaaaactcgttacaggggttgtagtcaataggagactgagggcccctgccgaataccgtcgtaacctccgacaggagctgtactattgcaggcgcttcggagtgtccagacatctggagcacagggcccttcagcaaactgagggccagtacctacgaggactgttggggagagtccagtttgccctgcagctcgatccggatgaccgggaacttcgcgacgatcgcgcctggttgttgtcccggatctctgactgcacgtga

SEQ ID NO: 9642 - RNA, 924 nt, unidentified
  source 1..924: mol_type = other RNA; note = synthetic construct
atggtcgtgcatagagagctgagttctttgtgccaggacctgggttacagtgctcgcgcactttattctctgagcaattcagtcagcgagcactatcacgatgcgatgatccccaaggccaatggcgagtaccgactcctgcacattcctgataaattcatgaaggctgttcagaaatctatcgctcagaacatcctgagctatgaggatattagcccttacgccatggcctatcggccagggggctctaccaaggccaatgcgttcccccatgtaggggcatcgatggtgatgaaactagacgtgcgcaagttttttgaccacattacctaccctatggttaaggaaaaggtgtttccgagcgagaaatacagcgagtccaatcgtatcctgctctcagtgctttgcgtatataatcatgccatcccacaaggggccccaacttctcctgccatctcaaacattatactgagagatttcgacaaccgtgttggtgactggtgcggtaagagtggaataacctacacacggtattgtgatgacctgaccttttcaggggaattcgaaccaaaagaggtgaaggcttttgttaagaaggaattattcaaggaaggcttcttccttaactccaaaaaaacaatcgtgttgaggaacggccaacgcaaggaaattactggaatcgtcgtgaacgagaaggccgcagtccccgcaagatacaaaaaaaggatacgacaggagttgtactactgtcggaagtttggcattgacgaacacgtgaagcggctcggactacccgaatccacggaagcttacgcaaggaaactgctcggaagaattaactatgtgctctccgtcgagccggataatgacgagatgaaaaggggccgcgctgagttactgagttggttccagtccacatcctga

SEQ ID NO: 9643 - RNA, 912 nt, unidentified
  source 1..912: mol_type = other RNA; note = synthetic construct
atggtggtctaccgggaactgtcttccctgtgtcacgatctcggctattcagctcgcgccctctataccctgtcaaacagcgtggcagagcactaccacgatgtgatgattccaaaggctaatggggagcagagacttttgcacgtgccggacaaattcatgaagtccgtccaaaaaagcattgcgcgtaatctccttgcatacgaggaaatcagcccttacgctatggcctaccggcctggaggttcgacgagagccaacgcaaggcctcatgtaggggcgccaatggtgatgaagcttgatgttcgcaagttttttgaccatatcacttatcccacagtcaaggagaaggtgttcagcagcgaaaagtattccgaaagtaaccgagttctgctgtccgtcttgtgcgtgtattcacacacaaccccccaaggagctcctacatccccagccatcagcaatatcataatgcgagatttcgataacagagtgggcgattggtgcgacaaaaggaacataagttacactaggtattgtgacgacttaactttcagtggagagttcaacccatctgaagtcaagacattcgtgaaagaggagctgtttaaggaaggtttttttctgaacagtcggaaaaccgtggtgctgcgtaatgggcagcgcaaggagattaccggcatcgtagtcaatgagaaagcctcagtgcccgccgagtacaagaagcgcattagacaggagctcttttactgtcagaaatacggcatcgacgagcatgttaaaaggttgggtctatgcgaatctggggaatcttatgcacgaaaactactgggccggattaattacgttctctctgtagaacccgaaaatgaggagatgaagagaggacggaccaacctgcttctgaggttatga

SEQ ID NO: 9644 - RNA, 930 nt, unidentified
  source 1..930: mol_type = other RNA; note = synthetic construct
atgatcgtgtaccgcgaactgtcttccctgtgtcaggatttagggtattccgcccgggcgctctacaccttgtccaacacagttacggagcactaccacgacgtgtcaatcccaaaagccaacggagagtataggctgctccatgtgccggatacattcatgaagagcgtccaaaaatctatagcccggaacatcctcgagtatgaagagatctctccttacgctaaagcatataaacccggaggtagcaccattagcaatgcagagccacacgtgggggcccagatgataatgaaactggatatacggaagttcttcgatcacattacttatccaatggttaaggaaaaagtgtttctggctgaaaagtactccgaggcgaatagaattctgctgagcgtgctttgcgtatatagtcatactgtccctcagggagctcccaccagtccagtgatctccaatatcatcatgaaagactttgacaaccgcgttggcaagtggtgtagcgagaagtcaattacctacactcgttactgcgacgatatgaccttctcgggtgtgtttaaacccgccgaggtgcggaaatacgtcggcgaggagttgttcaaagaagggttctttctcaatgggcaaaagacagttgtcttacgcgagggacagcgaaaggaaatcacaggcattgtgataaacaacaagctgagtatccctaaggcctacaagaataagattaggcaggagctatactattgcaggaaatatggcatcgaagaacatatcaggagattggagattaaggaacgtcctgaacgataccttagaaagctgattggtagaattaactatgtcctctgtgtagagcccgagaatgaagaatttaaggctggcaaggagtgggcatcagaagagatcaaaaagctttctgacctgtga

SEQ ID NO: 9645 - RNA, 930 nt, unidentified
  source 1..930: mol_type = other RNA; note = synthetic construct
atgatcgtttataaagagctcagctcactctgtcatgatctgggctttagtgcaagagccctgtacactgcatccaactcagtggaccagcattatcacaccgtcgaaatacccaagggcaacggagagactaggacattgcacgtcccagacccatacatgaagaccatccaaaaatccattgcaaagaacctgctggcctacgaagaagtcagcccatacgctattgcatatcgattcggcggcagcacaaaagctaatgcggctccgcatgtgggccaccctgttattttgaaaatggatatccgcaagttcttcgaccatatcacataccccatggtgaaagaaaaagttttccccgagaaaaagtatgcggaatccaatcgcattttactatctattctctgcgtatacgatcacacgattccccaaggggctccgacgtctccagccatatctaatattatccttcgggagtatgacgacattgtcgggaagtggtgcgaaaatcaggccataacatataccagatattgtgatgacatgaccttcagcggtgattttgagcctgcccccgtaatcgcctttgtgaagaaggccctgtttgagcagggattttttgtgaacaacaagaagaccgtggtgttgagaaacggacagaggaaagaggttactcggattatagtgaatcaaaagatctccgtgcctgcttcgtataagaaaagtttacgtcaggaactgtactactgcgagaagttcgggatcgagagtcatcttaagcacatcaaagccaatgaaaatgaggagcactacatcgaacggctgctgggtagggtcaactacatcctgtcagtggagcccgataatcaggagatgaaaaaatatcgacagtggcttctcaaccagaagccttacatgactaaggcatga

SEQ ID NO: 9646 - RNA, 918 nt, unidentified
  source 1..918: mol_type = other RNA; note = synthetic construct
atgatcgtgtacagagaactgccctcattgtgcaaagatctgggcttttccgcccgggctttatatgcggcctcaaataccattaataagcggtatcataaggttaggatccccaaggctgacggagactaccgcgaactttacgtgccagatgactttttaaaatcaatccagcgcagcatagccaagaacatactggcctatgagccaattagtccctacgcctgcgcatatcgaattaacggatccacagctctgaacgcctgtacccatgtcggagagccaacgatcctgaagctagacatcaggaagttcttcgatcacattacttaccctatggtcaaagagaaggtgttccccgcagaaaaatacagcgaacagaacagaatattgctctcgatcctttgcgtctacctgcagacagtacctcagggcgcaccgacatctcctgccatttccaatattattctgcgagagtttgatgaccgtgtaggcgaatggtgtaaggcgaggaacatcaattataccagatactgcgatgacatgactttcagtggttcttttgacgcaaaggaactcaaacagttcgttgagaatgaaattcaaaaggagggttttttcatcaacgctaagaaaaccgtggttctgcacgatgggcaacggaaagctgtgactgggattgtggtgaatgagaagctgagcgtccctgccgaatataaaaaggacatcaggcagatcatgtattattgtaacaagtacggcgtgatcgatcacatgatggcaaataagatcatcgggtataaaagtgactacctcaacgttctcctaggcaaaattaattacgtgcttagcgtggagaaatctaacaagcaatttatagagtaccgctcccaggtcaagaaatggttggccgagtga

SEQ ID NO: 9647 - RNA, 939 nt, unidentified
  source 1..939: mol_type = other RNA; note = synthetic construct
atgattaccataacctacaaagagctgagttctctaacaaatgatctcgggttctctgcaagggccctctatgccctgtccaaccactccacaaagcactaccataagacagtgatccccaaacatagcggaggggagagggtgctccatgtccctgatgagtttctcaaagcagtgcagcgctcgattgtgaggaacttactggcctacgaggctgttagcccccatgcccgcgcctactgttatggcgcgagcaccgtgaagaatgcgctgccgcacaaggggcaccgagttcttctcaagcttgacattcagaatttcttcgacagcatcaattatcctctggtgaagaacaaagtcttcacaaaggaaagattctctgagtcaaaccgggtgcttctttccctgttgtgcacgtataaagacactctgcctcaaggagctcccacctctccattcgtctccaatatcataatgaaggactttgacaacactgtaggtacctggtgtaacgaaaggaacattacttatactcgttactgcgacgacctgacgtttagtggagacttcaatcaggatgaggtcaaaacatttgtaagtcaggaactgcgaaaaatggggttctttttaaacgctaagaaaaccaccctgctgcacgatggccagcaaaagtgtgttactggaattgtggtcaacgataagttgaatgccccactgagatatcgcaaaggcatccggcaagaggtttattactgcaagaagtttggtattgaagagcacatcaaaaaacagggtatagaaaagacccgggaaggctacctaaagtcactcttgggcagaatcaactacgtgctgtcaatcgatgatactaatgaagagatgaaaagctacaaggcatgggcattgaaggagtgcaaaacagctcagttaaaaaagtga

SEQ ID NO: 9648 - RNA, 930 nt, unidentified
  source 1..930: mol_type = other RNA; note = synthetic construct
atgatcaccattacatataaggaactctccagtctaacctgtgacctgggattttcagccagagctctgtactccttgagtaaccacgcctccaaacactaccacaaaactgtgattcccaaagggagtgggggcgaaagggtgttgcatgttcccgacaatttccttaaggcggtgcaaagaagcatagtccgcaatatactctcccacgaagaggtttcaccttacgcccgagcatatagatatggcgcaagcactttgaagaatgcgatgccccacaagggtcataaagtcatcctgaagctggacatcaaaaattttttcgacagcatcatctacccactcgtcaagaaaaaggtgtttccttctgagcggttttcagagtccaatcgggttctcctgacacttctttgcatgtacaaagatgccttacctcagggggccccaacatcgccctgcattagcaatattatcatgaaggacttcgataacaccgtaggcacctggtgtaaggaaaggaacatcacctatacgcgctattgcgacgacctgacattctctggagatttcaatgtagatgaggccaaggcctttgtggaggctgagctgaagaaaatggggttctttctgaatgcaaagaagactactgtcttgcgagacggtcagaagaaatgcgtgacgggcatccttgtgaacgataaaattaacgcaccgttagaatatcgtaagagcataaggcaggcagtgtactactgtaagaagttcggcattgatgaacatctgaaacgcaacggaatcgagaaagctgctgagggatacctcaaatctctgctgggtcggattaactacgtcctctctatagataacaccaacgaagagatgaagggctataaagcttgggccgtgaagcagctaaagaagctgaaatga

SEQ ID NO: 9649 - RNA, 924 nt, unidentified
  source 1..924: mol_type = other RNA; note = synthetic construct
atgatcgtctataaggaactcagcagcctaaccaccgatttaggctttagcgctcgaactctatactcggtggccaggatggttagaaagcattaccacgaagtcagtattccaaagaaggatggaacagagcggaagttgagcgtaccagacgaactcctcaagaggattcagagacgcattgccgagaaaatactgatgtatgaagacattagcccctatgcgacagcatatagggtatgcgcctccacacttatcaacgctaaagcccacctggacaagaaatgcatattgaagttagacatcaaccatttcttcgattccattatctttcctgtggtgaaaaacaaggtttttaccgaagagaaatactcatacgcaaatcgcatcttgctcactgcgctgtgtatctatgaggattccgtgccccaaggggcacctacttcaccggtgatctccaatataatcctgcgagaatttgattttcacatcggctcttggtgcagtgagcgggggattacctatacaagatattgtgacgatatgacctttagtggcgagttcgaggctaaggaggtgataaaagaggtcgaggatgcactcgctaaggaaggattctaccttaatcggaagaaaacggccttcctgaaagacggccagcgtaaagaggtcaccggcatcgtggtgaacgataaggttagcgtgcccaaagagtacagacgcaagataaggagtgaagtccactacattaagaaattcggaattgactcacatctgtctcacattggttgtaacatggacaaggtgaaatacctgatgtccctgttcggtaagatcaactacgccctttctgtttctcctgacaatgccgaaatgaaaaattgcaagaagatcattgggaaaatcctgtacaagctgaaatga

SEQ ID NO: 9650 - RNA, 939 nt, unidentified
  source 1..939: mol_type = other RNA; note = synthetic construct
atgaagaacacgtactttgagctgaaaacactggaaaatgatcttggagtgaaggcagggaccctatataggctgtcaaacaacattaactcccattatcggtctgtaagtataccaaaacctgacggcagcaaacggactttaagtatcccggaccccgtgctgaaacacgtacaaaaacgaatcaacgacgtcattctatctacaatgaatgtttccgtgtattcgaaggcatattcatttggcgattcacctctgaggaatgctatcccccatctgaagcagaagttaatcctgaagttggacatcagaaagtactttgatcacgtcacatatccccttattaaagagaaggtgttcaaagatgatcagttctctgagagcaacaggatcttgttgagcctgctctgcatttataatgaaagcttgcctcaaggagccccaacttcccccgccatatctaatatccttttatacgacttcgacaatgtgatcggcgaatggtgtcgccagcgcaactttgtttatacgcgatactgcgacgatatgacattttccggtaatttcgacggacttcaccccatcgacataattagaaaagtcgagctcgagctgaagaagtacggcctgttcattaaccggaagaaaattcagagtctccatgatggccaaagaaagaaaattaccggtatcgtggtgaacgacaaaccaaatgtgcctgcgaattacagacgcaagatcaggcaggaaatgtactacatcaacaagtacgggctgcaggatcacctcaagaaaaccgggtcaaagcagaccgaggccgaatatctccgttctctcctggggcggataaactacgtcttgagtattaattgttccagcgagttcgaggtttaccgtaccaagactgtgagcctgctggatgctctcctttccgtctga

SEQ ID NO: 9651 - RNA, 930 nt, unidentified
  source 1..930: mol_type = other RNA; note = synthetic construct
atgatgaacacttactttgagttgaatacccttgaaaaggatctcggaatttctgcgaggaccctgtattcgctgagtaacaacatcaactcccactaccatagcgtggtgatacccaaatctgacggcggctccagaaaactatcgatacccgattacagcctcaagaatgtccagaagaggatcaacaatgttatactgagctgtatgaatgtgagtatttatgctaaggcctatacgaatggtgacagtccgctgagaaatgccttgcctcatctcgacaaaaagaccattctgaagctggacataaggaaatacttcgaccatattacttaccctctgatcaaggagtcagtcttcaaaaaggaaaattttagcgagagcaatcggatcctcctttccttactatgcatgtttaatgagagcctccctcaaggtgcaccaacaagccccgccatttccaacattcttctgtatgatttcgataattggatcggggagtggtgccgacgccaggacatcacttacacacggtactgtgacgacatggcattttctgctgaagaactgaatagtgatataatcatcgagcgagtacgcctcggactgaaaaaatatggcttgtacatcaacaacaagaagactcagattatccacgatggacagagaaagaaaataacggggatcattgtgaacgacaagccaaacgtgtccatcgattattgcaagaaaattcggcaagaaatgtactatatccgtaagttcggcattgattctcacttaaaagctatcgggtacgagaagaccgttgacgactatctgaggtcattgctgggcagaatcaacttcgtcctttctatctcattttccaaagagttcgatgattaccgcacaacaattgcctatattcggaacaccattttttcatga

SEQ ID NO: 9652 - RNA, 948 nt, unidentified
  source 1..948: mol_type = other RNA; note = synthetic construct
atgaagcacacgtactttgaactggagacattagaaaaggatcttaacgtgcacgccaagactctttacgggctcagcaataacataaatgcccactaccactctaggataattaagaagtctaacggcggtgaccgcgtgctcagcgttcctgacttcattttggtcaaggtgcagaaccagattaatgacgttatcctgagtcgcatgcccgtgtctgtgtacagcaaggcctacagcgcaggagattccccattaggtaacgcggcacctcatctgcgtaatgataccgttattaagctcgacattaggcagttttttgaccatgtcacatatccactcgtaaaagagaaagtgtttagaaaggaactgttctccgagtccaatcgcatcctgctatcattactgtgcatgtataatgaatcacttccacagggcgctcctacttctcccgctatctccaatatcctgctgtacgacttcgataaccgcatcggtgaatggtgtcgacagcggaatattatctacacaagatattgtgacgacatgactttctcaggagattttgagaactgggatccgatagacattatcagaaaagtcaaactggagctcaagcaatacggcctcttcatcaacggccggaaaaccaagatcctacataacgggcagcgcaaaaaaattaccggaatcgtagttaacgataaacccaatgtctccatcgactacagaaaaaaaatcaggcaagagatgcactatattcggaaatacggattgaagaaccacattcgtaagaccgggtgcgataagtcggagatggaatatctgcggagtttgcttggcaggataaactatgtgttgagcgtgaatagaatcgaggagtacgaacggtatcgagacgatgtggtcagttatctgaggcatatggggctgcgacaggatctgtga

SEQ ID NO: 9653 - RNA, 972 nt, unidentified
  source 1..972: mol_type = other RNA; note = synthetic construct
atgaaacacacttatttcgaactgaaaaccctggagaaggatttgggagtctccgccaaagtgctttatacactatccaatcagatcaatcggcattaccgctctgtggagatcccaaagtccgatggtggcacccggaaacttagcgtccctgaccccttactgaagtctgtgcaacgaaagattaacgaggttatcttgtcacggatggatgtcagttcttacgctagagcatatagttacggggactctccgctcaagaatgcctcttcccacgtgaacaaaaaggagatttttaagctggacattcgcaaattctttgaccacgtcacatacccactgattaaagagcgcgtgttcacagcggaccgattcagcgagagcaaccggattctactgtccttgctgtgcatgtatgacgaaagcctccctcagggagctccaaccagtccttcgatatcaaacatacttctctacgagtttgacgaagaactgggcatctggtgtaaagagcgggatgtgtcctacactcgttactgtgatgatatgacctttagcgccaatagcctcactcccgaggaaatcgaacataaggtatcatctatgcttaagcagtacggcctgttcatcaaccaaaagaagaagcagtatattagggggagtagaagaaaaaaagtgactggcatcgtggttaatgaaaagcccaacacgcccgttgagtatagaaagaagatcaggcaagagatatttttcatcaacaagtacggtctgaaagatcatatggaaaggattaaatgcacagatagccaggggagttatctgtcctcactgttaggaagaatttcgtatgtactctccatcaatcagagcgaggagtttgaaaagtaccgtgagcagatatcaaccttactcaaggagcaggacgacatgcgcatcattcagaaatctgaagaaacgaggaggttgctgtga

SEQ ID NO: 9654 - RNA, 927 nt, unidentified
  source 1..927: mol_type = other RNA; note = synthetic construct
atgatagtgtacaggaccatgcaggctttggagacagacctcggcttttccgcccgcacactctattccgccgctaataccattgacagacactaccatgaagtccggatccccaagcgtgatggcacagagcgtattctgcatgtgccagacgagttcctaaagcgaatccagagaagaataaacgatgttctcttggcgggaatgccagtgtccaggtatgcaaccgcttacaatcctggtaattcgatcatgcagaacgcacagccccacgccggcaagcacttcctgttgaaacttgacatccgagacttcttcgatcatattacttacccactcgtaaaggagaaggtttttccggaacacatctactctgagcagaaccggatactgctaagcgttctttgcgtgtaccatgactcaatcccccagggagcccccacttctgatttaatcagcaatatcgtgctctacgatttcgacagaaccgtggggcgatattgtagagaacggaacatagccttcacaaggtattgcgatgacatgagcttttccggcgattttgatccacaagaactgaccgcatttgtctcagaggagctgcgcaaagacgggttctttctgaatcgcaaaaagactgtcacggctaggcctgggcaggccatgagggtgactggtctgtctgtgaacgaaacggtcaacgtccctagtgagtatcgccggaagattagacaggaaatgcactttattcagaagtacgggaccgcacaacacattaaacgcctgggcatcggaatggaggagcaagcgtatctgaatagcttgaaaggacggatcgcctatgtattatcagtgcgtgaaatccctgagttcagggaatacctgaaacaaattagtcttctggagaagcggcagatgattcagtga

SEQ ID NO: 9655 - RNA, 987 nt, unidentified
  source 1..987: mol_type = other RNA; note = synthetic construct
atggtctactataaggatctgagcactcttgagaaggacataaggatcccaaggaaagtgctgtacaagtttagccggaatattttctcaaactacaagaccgtcgaaatcatgaaaaacaacggagagatccggacccttcacgtcccaaaggacaatttaaagagcatccagaggaaaatacgcttttatatattgcggaagatgccgacaagtatctacgctaccgcatacatccgtggggagggcatagttaataatgctaaggttcacgtgggggcggaaaatattctgaaactggatatccgacacttctttgataacatcacctatcctatggtaaaggagaaggttttcaaacccgacattttttcagaaccaattaggatcctcctatcaatcctgtgtgtgtacgagcactctattccccagggagcccccacttcgcctgacatttccaatatcattatgcgcgatttcgacaaagaaattggtgactggtgcaaagaacggaacataaactataccagatattgtgacgacatgacctttagtgggaaattcgataaagagcctgtgatcgagaaggtggaatccgaactccgaaagatgggattctacatcaacaataggaagacaacgtacctccattccgggcaatccaagaacgtgactggaataatcgtcaatgagaaattgtctgccccccgtaaatacaaaaaggaaatcagacaggagatctattactgcaagaagtatggcatcgaaaaccatatgaagcattctgtgctgaaaaagaaatccagacagcttagtgatgccctgaagggccaaatcgacattgacattgatgtggagattagcacagagcagtatattaattctttgatgggccgcattaactacgtcctgagcgtagaggataacgaggaaatgagagagtacaaggaatggctctatggctgcggtaatacacagaaattttga

SEQ ID NO: 9656 - RNA, 975 nt, unidentified
  source 1..975: mol_type = other RNA; note = synthetic construct
atgactaacgcgaaaaaaaagtattccgatctgtcctccttagccctggatctcggcttcactggaaaagaactgtacaccgtgagtaacgcgataacccgatattacttagaggtggcaattccaaaaagcaatggcgagacgagaaccctccatgtgccctctgggatgctgaaaatgatccaaacctctattgccagggtcctgctgccaaaagtgcctgtttcgcgttacgcctgtgcgtataagcctggggccagcgccgttaaaaacgctatgccgcacgtgggggctcctatagtactgaagttggacattcggaaattctttgaccatatcatctttcctatcgtgaaggagaaggcctttcccgaaaaaatgttcgctgagaagcttaggattctcctaactattctctgcatctataaggaggcactgccccagggctcaccagcttcacctggtataagcaacatcataatgagggacttcgatgataaagtcggcggctggtgtgcagaaaggggtatagcctacacacgctactgtgacgatatgaccttttccggcgattttgatccaaagcccgtgaaggacttggttcgcaacgaacttagaaagatggggttcttcctgaatgacgcaaagacagtggtcgctcacgatggaatgagaaaacaggtatgcggcattgtcgtgaatgagcggcccagcgtgcccaaagattacatcaagaagatccgccaggagatttactacattcgtcgctatggactggcctcacacctaaagagaacaaatccaggagtggaccctgtcaattacatcaactctctctctggacgaatccggtattccatctatgttagcaaggctagtgacaggtgcgccgacccggagttgagtgggtacctggatgtaattaagaaggaaatggacatccttgcaggtcgggactatcgggacagaacatga

SEQ ID NO: 9657 - RNA, 1026 nt, unidentified
  source 1..1026: mol_type = other RNA; note = synthetic construct
atgctggccgcagagcagcataccagtagagtgcacgctctgactggatgtcctgcagccgctctgcagaatattttgaaatggtgtcagaaaggggggagaatgattgtatatagggaattatcttccctttgcagtgacctagatgtatccgcaaagaccctttacactctctccaatagtatcacttcccgttataggacagcccagttactcaagaaagacggaggctacagaacccttcggatccccgatccactgctgaaggaggtccaaagaaaaattgtccaggtgcttttgagcagaatggaaataagcccctacgctaccgcttatcggtacggcgcgtctatcaagaagaacgcaagcgtccacgtgggccagaaaacagttctccacctggatatccggcgcttcttcgataggatattgtttccccaagtgaaagagaaggtctttccaaaggagcgctatagcgagccaatccggatattgctgaccattctctgtttcgacggggagaacctaccgcaaggtgcccctacgtcaccctggatcagcaacatcatcttatgtgactttgataacacagttgccgcttggtgccgcaagcgtggcatccattactccagatactgcgatgacatgacgttctcaggtgaatttgaccctgcggccgtggaggacttcgtggaacgccagctgaaaaaggagggcttcttcctgaataggaagaagacacgacgaatggataggtcacgtcggcagtatacttgcggactcgttgttaacgatcaggtgtctgtgcctagcagtgtgagaaggaagattcgccaggaaatgtacatgatccagaaatacgggctggactcccatctccggaagatacaatatgaaggttctgaggaagaatacttgaattcacttctgggaagggtcggctttgtgctgtcgattcaggcctctgacgagtttctgcgatataaacaaaccctgctccgcatgatgaagaaacgaaatatttga

SEQ ID NO: 9658 - RNA, 933 nt, unidentified
  source 1..933: mol_type = other RNA; note = synthetic construct
atgatagtgtaccgtgagctctcctcgctgtcccgtgaccttgaggttagcgttaagactttgtattcactttcaaacagcatctccagacactatcatactgtccagcttcctaagaaagatggaggagtcaggactctgagggtgcccgacccccttctcaagcatgtgcagaggcgcattgctgaggtactgctggctcagacagaaatctctccgtatgccaccgcctaccattacggggccagtatcaagaaaaatgctgcggtgcacaccggtaatgagaaggtgttaaggctcgacattcgacaattttttgatcacatcctcttcagtcaggtgaaacagaaggtgttcccagcggaaaggtatagcgaacctattagagtcctgctaacaatcctgtgtttcgatgaggagactctaccacaaggcgcccctacaagcccctggatatccaacattatccttaaggattttgacgacgctgtatctgcctactgcagatcgaaaggcattcactactccagatactgcgacgatatgaccttttccggagaactggacgagaaagaactcacggaattcgtttctgaacagttaaaaaaggaaggctttttcttgaatcgcaaaaagaatcggctgatgaaggcaagccagagacaatatacctgtggtctgattgtgaacgaaaaagtgtcagtcccatctgatacgcggcggaagattcgccaggaaatgtacatgatacagaaatacgggctcagttctcacctggaggccgtgcatttcgagggcagcctggaggaatatctctacagtttgctgggccgggtcaactttgttttatcaatcgagaaacgcgaggagttcttgaagtatcgaaaggcactgctggagatgatcagcgggaacacagacacccacgcatga

SEQ ID NO: 9659 - RNA, 1035 nt, unidentified
  source 1..1035: mol_type = other RNA; note = synthetic construct
atggggcctggtacagccgctgcacgcaggaacatcagaaagtggtgctttggccgcgaagaacggcgtatgatcgtttaccatgagcttagtagcctttgcttggacctaggaatcgaagcaaagaccttgtacgctttatccaacaatgtctccagtcattaccatgaagtgaaaattcctaagaagggcgggggaatgaggaccctgcatgtgccggacgatgtgctcaagcacgttcagaagagaattgctgaccagctgctcgcgtgtgaggagatttcagcatacgcttatgcctacagatatggctgctcggccaaaatgaatgcaaagagacacgtgaatcaggaaattgtgatgcggttggatattagggactttttcgaccacataacattcgctcaggtgcgcgagcacgcttttccaaagtggaagtactcagaacccctgcggacgctgctcagtgtactgtgtatcgacgaagatagccttccacaaggttcccccgcgtcacccgccatatccaacattattatgcgcccctttgacgatgtcatgggagagtggtgccggcggaagaaaatcacctatactaggtattgtgatgacctgacctttagtgggtctttcgagcctaatgaggtcatcgcacaagccgccctattcctgagccacctcggctttttccttaatgagaagaaaactgtgatcagacggaaagagcagcgccagttcacgactggactgatagtcaacgagagcgtcagcgttcctccagaatatcgtcgcaaaatccgtcaggaaatgtactacctccagaagtacgggttatcttcccatctggagcagattaacgagacagatgagaaaacctatctgcgatctctcctgggtcgaatccgatatgtattatacatccactcttcagaagagttcaggaactatgaagccatagtgctgaaattgactgaggagacaagccacggcagagacaatcaaaaaaccgattgtgatgccggcagggccgaatga

SEQ ID NO: 9660 - RNA, 948 nt, unidentified
  source 1..948: mol_type = other RNA; note = synthetic construct
atgatcttttatggtctagcgaaactggagaaggccctgggctacgaggcaaaaactctgtacgcgctgtcgaacaatgttaagaaacactatcatcccgcacagatccccaagaaaaacggggaaatgcggaatttgctggtgcccgatatggccctgaaaagcgtccaaaaagctatagccgaaaagatcctccagaatttcccagtatccccgtatgcctatgcctaccgcaaagggttcggaattaaaaagaatgctaggcagcacaccggcaaagaaaaggtgttgaacctggacattgaaaagttcttcgaccacattctttacacacaggtcaaggattacgcatttcctaaggccttttttgccgaagacgtgcgcatcttactcagtatcctctgctatggagagaaagggcttcctcagggcgctccaagctctccagctataacgaacctcgtgatgcacgactttgatatgaaaattggtaagtggtgcgaaaagcagggcattgattactccagatattgtgatgatatgtctttctcaggcgacttcgacgagaaagccgtaatctcattcgtgaaaaaagagctccggcgtctgaacatgtccttaaagcgtgagaagacccgggtggcaaagaaggggagtaggcaaacagtgactggtatcgttgttaatgagatccctagcgtccctagtgagtaccgcagaaagcttcggcaagagatttactaccttaagaagttcggcgctggacatcagctgcgacattacggactgaagatgaccgcaaaagactattttttatctctgttggggagggtcaattatgtcctgcacataagccccgacaactatgaaatgtggcaatacaggagataccttaagaacatgctgagacagtcacgcttgcagccacgaaggtccgtgctactctga

SEQ ID NO: 9661 - RNA, 972 nt, unidentified
  source 1..972: mol_type = other RNA; note = synthetic construct
atggcttatctcgaccccgatgtcattgctgtgttactgcacgtaccggtccacatcctgtacgcgttttctaacagtagctataagcactataggctgatctcgatcccaaagaagaatggcaagacacggcagttgaccgtgcccgacaatgacctgaagatcatccaacggtcaatttactttcgcttcctcaggggtagagaggttagcccagctgccaaagcctatttgaaaaaaggaacaaccacggaaaacgcaaaaccccacgtgggtaagccaatgatactgaagctggatatacgccattttttcgacaacgtgctgttttggcatgtgaaggagaaagtattcactagtgacatttactccgagaacgcccgggtcctcatgacctacttatgtacctacgatggccacttggcacagggcgcaccttcatcccctgctattactaacatcctcatgaaggatttcgatgatgagattctacggttttgcggaaaggatggggtttgctacactcgatattgcgacgatatgacattctcaggagtatttgaaccagatcaagtgatcagcaaagtggcctgggagctgaaaaaaatggggctccacttgaatcctgccaagaccagagtgatttggcagggccagcagatgaatgtgacagggcttgtcgttaatgataaggtgagcgttcccgcctcttatcgacgtaagatccgccaagagattcattatatctggaaatattccgtggaagaccatctcaagcacatgggaagagaagaggacgaacagtacagttacctgtctaatcttctgggcaggataaactacgtcctttccatccataaagacgacttcgaattccaggagtacaaagactacgtcgttatgggctgtgatggtaggcttcgttacaaggaaagaccttatcagatagggattgacgagctgctaggatga

SEQ ID NO: 9662 - RNA, 1008 nt, unidentified
  source 1..1008: mol_type = other RNA; note = synthetic construct
atgaaacgttccattaaaaaactgattaggcccaaggacgctgccatgtggttatataaggcccagagcggtaaggaggtaactgaagctcttatgctactttacgacatgagtaacaatgcacctaaatattaccagaagaaggagatcccgaaaaaacaaggaggcaaaagagtgctctcggtccctgtcaccgaactgaagcgggttctgtgctgtatcaaggcagagatattggattacatacctgtgtcagactacgcccgagcgtacaagaaaggcggcggtatcgcgcatgccgccaaggaacacgtggggcacgagacgctcctgcgtctggacatcgaaggtttctttgatcacattacatacaaggaggtgtataagcacgtgttcggacggtattacccacgcaaagtcgccggcttgctgacagctctgtgttgttatgaaaagcatctcccccaaggagcccccacttctccagccatttctaatattgtgatgaaaggattcgacgacgaagtagctgttttttgcaagatgaacaacatccattacaccaggtactgcgacgattgtatcttttctggtaagtttgacgtgggcgccgttattaaaaaagtgaagtcagagttgctgaagatgggcctaagactgaacgatgaaaagacaaaggtgataagccagggacagaggcaaatcgttttaggggtttgcgtcaatgagaaaatgcaggctcccgctgcatatcgcaataggatcagacaggagatttattactgcaaaaaatacggggtcaaaaatcacctgttgcgactcaatgatgaacgcttcgtgaagaagacccctgggggggtatttgtggatgcagtgggctatctcatgcagcttaaggggaagataagtttcgtcctcagcatcaacccagatgacaaggagatgcgggagtatttcaacctgctttccgtctccaagaagagcacgagagcaaaaaaatcctgttga

SEQ ID NO: 9663 - RNA, 1224 nt, unidentified
  source 1..1224: mol_type = other RNA; note = synthetic construct
atgaacagaagcctgtacctgccccaaatggactccctgtacgcatttgcctaccagtatctgcgcgtcaacggacggtcttgcaggtcagacgacatctactcctgtggcggagagatcaaagcgattcttgatgatacaaggcctcattatcgcaaaattctcatacccaagcctaataagaaagaaatgcggactgtcttcgaggtgacccaggacctacgatcacttcaacatttcatcaagcggtatatcctggatagactcgacgcaatgtatacttcgccttacgctttcgcctatcgcctcggcctgtcagctcgtgataacgcttctgcccacgccggacacagatacatgcttaaactcgacatacgccatttctttgagagcacacgcgcagggcaagtctactctatgtttagaaagtacaccccatataacagacagatattgggcacactgacccgtctggtgtgctataagggcgccttgtgccagggcgcttgcacttcccctcaaattgccaatctgattctctccgattttgacatggccatcggaacctgctgccgcgatatgtgtattacctacacgcggtactgtgacgatatgacattctctagcgttcttcccttcgacaagagcgctctggaacgaacggtggccctaatgttacagccatatcactacaaactgaatacacgaaagactcgatttctagggcccgggcacagactcgaggtaactggcgcggtcgtgaacgagagggtgcatgcaaagcgtgaatataggcagaaaatcaggcaagaactgtactacaccaatcgctacggggtagcagatcacctggagcggactcggcctgcttggtaccataccccctgttcctgtgcccagattaggcacttcctgtatagcctccagggaaggatcaattatgttaggatgttggacccagacgaccccttcctgggtgacgcacagtaccagttatttagattgtttctcagagaacagagcgccttccggaatatttatgctgacgtgggcccagtttcacagcggcagggtagtacaagtggatttttccccgaggagggtcccgtggggtttgatgatcttgacaccgatttaatggaaccacctttcaacatcccggatatggacccaccagagttgccgtttgacgtgctggggtgggatgatcctttcagtggctga

SEQ ID NO: 9664 - RNA, 1149 nt, unidentified
  source 1..1149: mol_type = other RNA; note = synthetic construct
atggactctgacgagatatatgcatgcgcgggcgaaatcaaagccatcctggacgacgtaagaccccattaccggaagattctcatccccaaaccaaaccaggaggagatgcgaacagttttcaaggtcactagcgacttgcagctgttacagtacttcatcaaattcaggattctggaccccctggaccgcgcttatacctccccttacgctttcgcttaccgtaggggctattcagcccgtgataatgcctcccagcattcaggaaggaagtacatgctgaaattggacattagacacttcttcgaatccacgcgggcaggccagatttatagtatgtttcgcaaatacactccttacaataagaccatcctgggtacactcaccaggctggtttgtttcaacggagcactctgtcaaggcgcatgcacctcgccccaaatagccaacttggtcctgagcgattttgatcgcacaatcgggagctattgcaagtgcatcggggtgacttatactagatactgcgacgacatgactttttctgcctattggccttttaacaaggtggctgtgaaggatatggtcgaagacctgttgcgcccctatcactacaagcttaacacagccaagacccggtttctcggacccggaaaacggcttgaagtgacgggggctgtgattaatgacagagtgcacgctaaacgagagtaccgccataagttaaggcaggaactgtactatgcctgtaagtactctgtcgccgaacatctagagagaacccgacctaaatggtaccactccccgtgtacagcggagcaagtgagacacttcatatacagcgtgcagggccgtattaattatatccggatgctcgatccggaggatcctttcctcgagtatgcccaggatctgtttcaagtgctccaccttagtgaggtaagcgcatttagtcggaatggccacttcaggggctctgagcccgatgaggatctgcctgacccattagatattcctgacctgtttttcaccgatcttgaagaaccgccattcgatgttatgggggattattttccaggtgaggaattttttcatcctggagactaccccgtcccaggtccacaggacgatccactattcgggtcagagtga

SEQ ID NO: 9665 - RNA, 1476 nt, unidentified
  source 1..1476: mol_type = other RNA; note = synthetic construct
atgaaacccaccctccccaaaatggactcagcttatactttcatcaaggcttatcgccggtctaaaggttatagcgaaaaccgtaacagagcgtttcgagatacccgtgaactcctttcggtattagacgagatatctgaacactacgaaaaacactttgtctccaagaaaaattccgacgagcttagaaccgtttttagcgtgagctaccctctccgggagtatcaggagttcataagagctcaggtgctcactccactggacctggcgtacacatccagtttcgcctacgcatataggagaggattgtccacaaaagacaacgccaaggtccacgagaagagtcgatacatgttgaaactagacattaggcacttctttgagtccacacgcaagcggcttgttttcgccacattcgagaagtacacgtcttataacagaagcatcctgggaatcctaacgaagctggtgtgttataatggcagtctgtgtcaaggcgcctgcacgtcccctaccatagctaacctggtactcgctgattttgatgcctctgtcggtctgttctgtgacggcctgggcattcgatatactaggtattgcgatgatatgaccttttcttctccctttgaattcgaagccaaaaatgttgaggagtttgttaggttgcagctgaagccactgcggtactccctgaatgaccgaaagacccggtttttcagaccaggacagagactcgaggtcactggggccgtagtgaatacacgggtgcgtgccccgagagagtacaggcagaagatcagacaggatctgtattacatcaacaagtatggcttcatctttcatctcgagaaaacccgcccaagttggtactcgggtaaagctactgaatacgacatactgcacctgctcaaaatcatgaaggggcgaattgcatacgtgaagatgcttgaccctgatgatcctttcgcaagcaatgccaggaaggaactggatgccgctgcactaaggtacggagtgggagacttgagcaagatgcaagatcggcagatcagcttcgaaattgagaacgcaaaaatcctgcggttcatgacactggaagagaggttgcagcgctcagtgagtcccgaggtgcatttaatggtctggcatgccatgaggggtcttgaataccatcccgaggggaatgggggctttgtgtcagacgaggaggatgacggcctctttagcgatgaacgcgacgttcgcgataatcgctgcttcgcagacgaggggcacacctctatgcaagacgcgaacgacacattaccctttgaagctgtgaacttccccacctttgatgaagtctcaattcccccgttcgacgaggacttcccaacttttgacgaacatcgcattccgtcattcgacgaggtcattgtgccatcccctgatgaggataagactcctcctcttggaaacgaatttccagatgattga

SEQ ID NO: 9666 - RNA, 1542 nt, unidentified
  source 1..1542: mol_type = other RNA; note = synthetic construct
atggtggtcaattgggagaaaaaacgtcgcaggaggctgacagaattggaacaaaaaatcctggcagagaggccaggcgaacctgcatttaacgccggttcaggcgatctccctgtgatcggatcactgatgagcctcgtgatgctagctcgcggaaactccttctcaagcgaggaaggcttttggcgcgagtacagaagggcatccgcaatggttgatgacacttccccctattataggcactacccaatcccgaaagctaacgggcgcggctacagggaaatctacacagtggacgacgggttacgcgtctaccaggaggcaattagaggcacaatcctggatccccttgatgagaaatatagtagcaagtacgcttatgcatatcggagagggcgttcggtcagagataatgctgccgtacacgctggtcatggttatattgtcaaactcgacatcaaggacttcttcgactctactggaaagtctgatgtgtatcggatgttctcacgctacacaaattactcaagggccgcaaagacagtacttacggccctggtctgtcgagatggccacctgagccagggaagctgcacgtctcctcagattgccaacctggtcatggttgacctcgatggagagttggccgcatactgcgagccacagaagataacctactcacggtattgtgacgacatgaccttctcttccgatgaacccttcgaccacgaggctcttattaggtttgtaagtctacggctgcggcaaatgcactaccgattaaattgcagaaaaaccaaggtgttaggcccagactctagacatatcgttaccgggatcgtcgtgaataacgagcggatcagagtgaccaaggagtacaagaaaaaactccgacaggaaatctactacatacggaggtacgggataactagccacctgaagcgaatacgtccgggtgagtacacccctgtcttcgaaggcgccggaagtaagcacgagattcactatcttgcccatctgttggggcaggccgcttatgccctgtatatcgatcatgacgatgaggaactgcgcgcgatggtggactatctgaaacaggctgtgaccgaatgtgtagcctctacaggcacacggcgcagcgaatatctttccgttatttccaggcaaattttgaataaccgtatgtgcagcgtgaacgaccggctcaagattagagtgtcttgtcagtatgatgaaatcgtggtaactgccagctttcggctcatcgacgatcccgacgttcgggaggtggccgatcattatacaaaatactcccgcgttcagcgaaggtgcagaggccgctttgtgaagcctggtaggggaaccggaagaggtactgagtcggctaccgaaagtactacggcgactggcggggatgggataatttgttacgaggttgtgattccagaacgagacttctccagatacaatgaggcggtgcccgaggtcatggatgacatcacctggatttatagtgactttatgaagtacaagctgatctga

SEQ ID NO: 9667 - RNA, 1581 nt, unidentified
  source 1..1581: mol_type = other RNA; note = synthetic construct
atgaagctgcagattgaggattttgagaacgttaaggtcgacatcaaggaattcatcgagtatatcatgccttctaataaacagtcgatgaataagcttgccagaatactctacccagacagcaacgagaaggattacgactctctcactaactatctttacgtgatgctggacggaatcgagaaagattacgaggagttcaccatcaagaagaagaacgggaaactgagaaccatttccaaaccaaatgaagctctagctgacattcaaaagcgcatctatgagtacatcttgagaaacgcacctgtgagcccctgtgctgccgcttatgtaaagggcaagagtattagggatgcaacagccaaacatattggccaaccaatcctgattaagatcgatgtgaaggacttcttctacaacatattctttgattctgtgaacgatgcattcaccaacttgggatttgataaatatcaggccatcactttggcgaatttttgttgctacaaaggaagtttaccccagggcacttcaacctcccccatgctctcaaacctggtctttcgtgacttcgatgatgagatggagaaactgtgcttgaagtataacatccgctacacacggtattccgacgatatgctgttttccggcagctttgacaatgagttcgacaccaaacggtttgttccgtacgtaaagttcatgcttgaagatttcggttttcagatgaacctcagcaaaactaagataattaagcaggggcagagacagacagcattaggagtcgtcctgaatgagaagcagcaggtcacaaaagaataccggaagcaaataaggcaagaaattcactactgcagtgaacactctgtgaaatctcacttggagcacatccaggacgaaaggtttctgcttccaaacggagagcccgactatattggctatattgacaatctgaacggcaggattaatttcgctctgcaaatcaaccctgatgacatggaaatggtgtcgtataaaaatagcctcaagtctctgtcaagcagtatgtatcaggcaaaggtggtggaacagaatcagcttatggaatgtctctacaaagtgttcagtgactatgtaaactccaaaatcaagtacaccattctgtataagaagctactggaatacgggttttccaattcacaactgagcaaaatcggcatctatgaggagaaaatcgtctacgggtttgacgaagtttatctcacgaaagatgacaagggtaattacctatccttgattaccaaacattcatgctccgagcacctgggaaatgtcataatcaacccttactgtgatggtttctttggctctcgattcgacaagaatctggggtatcttacagttactagcgacaaaattgctgccgtgacgtctggcctcaccaactacgtttcctttaataacgccccgtcaaagttcttcctcagcaaaaagaagctggagatgatccgaaagtacgggaacaaagtagtggtggccgattgcagtggtgccgagtacatacgcttacagatgattgcgaatcatatcgaagtgatatga

SEQ ID NO: 9668 - RNA, 966 nt, unidentified
  source 1..966: mol_type = other RNA; note = synthetic construct
gaaacagtgtacattacaaaagcatctggaaagaaacgggagatcaataaaccagatattgtgctgaagtccttccaaaagtctgtatataagaacatccttctgcacattccgacatcctattacgctgtggcctataagaagggctctagcctaagatactcaacagcggtgcacattggcaagcccatgatcctgaagctggacatcaagaacttttttgggtccatcctctacaaaactgttcaggaaatgttcctgaaacaaggatacgattacttcatggccactaccctggcaaccttgtgttgctataagggacgcttaccccaaggcacacctaccagccctgccattagtaacatcatcatgaaggacttcgatgataaagtcgcctgtttttgctacgcccgaaatattgcttatacccgttacagcgatgacatgacatttagtggtagtttcgactcagacgaggtgatcgagttcgtcaaaaataaattgaacaagtccgggttccagctgaataataagaagaccaaactgataaagcaggggcagaggcagactgttaccggtgtagtggttaacgaaaaacagcagttacccaaaggctacaggaaacagatccggcaggaaattcattactgccagaaatatagcgtgaagtcgcacatcctgcataccaatctcacggcttatatacggcctaatggagatgtctactacaaggagtatctgctaaatttgtatggcagaattaactatgcactccaaatcaacccaaccgacgaggagatgctgaaatacagatccgtcgtgaagtcagccatagacaagcttgatattatcaaacgcaagataaacgatgagatttttaggctcgctgtcgactttttcactagcgacaaatacaagacgaacaaaatctacctctatcttaaggaatctgggtatactaactga

SEQ ID NO: 9669 - RNA, 1074 nt, unidentified
  source 1..1074: mol_type = other RNA; note = synthetic construct
atgtactggaatcgcgaaacaaacgcgatttccataagtgccggcgacatgaagatcatgcgccagtgcaacatatccatggagagactgatgcagaaacctgccaatccgcaactcccacctctttggtcaattctgtcttacgcaatgctacggagtgatggggatgcagccgtcggcatttggcgaaacttcagactctatcaaaaactgttcgagaatccaaatcagttctatttcggtaaggagatctgtaaaacagacggatctgtccgggaactcaacgtacctatgtcaagactgcgttgtgagcaagagttcgtgttcgaaaacattctgtccaagctccccgtcgacagccacgcatatgcttacaggaagggcattagtatgcaagattgtgctcgaccccacgtgggtaaaaaagtgctgatcaggctcgatattcaggacttttttggaagcgtgaccgagaatatggtttacaaccgccttctggaggataccggctacccacgcaaactctgcagatttttggccaagttatgttgctaccagcaccatctgcctcagggcgccgtgacaagccccatgctgtctaatatagttttccggcccttagacgaaaagttggctgaatttgccggtttctgcgggatggcctataccaggtactctgatgacctatacttttcaggagacgaaatcgatgtgacttcctttatctcgtgtgtgaaactggttctcggaaattccgggtttcgtctgaacggaaagaaaacccgcgtccggatgccacagcatcgacaggcagttcttggtcttactgtgaacgagaagcttcaggtcagcaggacgtacagaagaaacttgttacaggaaatctactacctggagaaattcggaaagaactgcctgggggcccagaaggaggggaattatctgcggtatgtacagcggctactcggcaaggtgaattatgcgatcgctagcggcgctgaagacccgaagttgaaagccgctgcagaaatgctgaagaagaggattttcttgatcgagagggagttttattga

SEQ ID NO: 9670 - RNA, 1065 nt, unidentified
  source 1..1065: mol_type = other RNA; note = synthetic construct
atgaaatggaaggagagaagcagtacattttgcctggagccccaggacatgcagatcattgctcagtgcaagatgagcctcacagagatggtacggcatgaccacccaaataaaaatatcccgccactctggagtgtcctgtcctatgtgatgctgcaatcaacttcacatgcaaatatttggtaccgctaccgcgcccttcgcgaaatggcctcgaatacaaagctgtggtattatacccaatacatacccaagtccaacggtggcgcacggcggatatccgttcctacgcacgccatacgcacacagcagaagtatatcctggcaaaaatactgaaaggattgcccgtgtctgaccacgcctacgcctaccgtgaagggcgctcaattcaggactgtgctaagcctcatgagagccaggacgtgctcattcacctggatttgacagatttctttggttccatcagcgaaaacatggtattcctcacgttttatagggaaactggctactctagaagtctgtgtcgatttctagctaaaatgtgctgcctgcggggatctctaccacaaggcaccgttaccagccccatgctgtcaaacattgtcttttatagatgcgatgaggatcttgcaaggttggccgctaggtacggcatgaactacactcgatactctgatgatctgtatttctccggtaatagtgcccttgatgtgggggaggtgttaaagaagattactcgcattctgttgtactatgggttcaggatcaacgaaaagaagaccaagatccggagacgtcagcatcggcagaccgtcctcggccttaccgtgaatgaccatatccaagtgagcagaaaatataggcgagacttactgcaagagctttattacctcgacagattcggagaaaactgtaaaggggctgtcgcgtgtggagattacctgaaatatatgcagcagctccagggcaagttagcatacgttttgcacgccgaccctgaaaacgtgaaaatgagggaggcgcactctaagctgatcagaaggatccaccagtactccgagtga

SEQ ID NO: 9671 - RNA, 1098 nt, unidentified
  source 1..1098: mol_type = other RNA; note = synthetic construct
atgaaatgggagggcaagcaggttcttttctctgcggctgatctccaggtcctgatgcaggctcggtttcgacctgatgaggtgccggacatggaggaagtcaaggaagggctaccacctctttggtcgcccttgtcatacaccctgtggaaatgtcacggcgaaacgtctcggaagaacctgtggcgccagcaccgtgaagcacttctcatggctaagagtggctccggatactatcatcacatgcttgtgcgaaagaacggtggaagcggcgtgcgaaggatttcagttccatgttacgagctgcgggaccaccagcggttcatatacaagaatctactcagcagactgcccttatctccgagagcgtgcgcatacaggaagggtgttcctctccgccgctgtgctgagccacattgcggagccgaagtcctcgtgcatctcgacattagggacttcttccctagcatcacagaggaaaaagtgagttttgccctccaccgcgccacaggctatgaggaagagctttgcgacttcctggccggactgtgttgcgagaatgggaggctaccccagggagcagtcacttccccagctctttctaacttggccatggctggcatggacgggaccttcggtgccatggccgccatgctggggtttacctacactcgttatgctgatgatatctacctgtcaagtagcgatcgatccgccgatgccgctaggattgtgaagttggccagagattttttaagatccgagggctttgaattgaatagggacaaaaccagaatcatcagacaggggcgtcatatggcggtgctggggctgagcgtaaacgagaaagtgcaggtgtcaagaaggtatcggagagaggtccggcagaagctgcactatctgaaacggtatggcgcagacgcacagggcgttcaagaagcaggcggacaagagccttacgcattgcacctgctcggaaaagtggggtatatactgcaggtaaatcccatggaccaacaagctctgcgcgcccgcctggaactcttgacaggtctgcaccgcttacataggggtatgcccttttggtggtccgcctga

SEQ ID NO: 9672 - RNA, 1266 nt, unidentified
  source 1..1266: mol_type = other RNA; note = synthetic construct
atggagtgggatccccgccgggaaaagcttagcctgagtgagcgcgatctcaagatcatgaaagattgcggaatgacgcccgccgagattttacgtgctgtggagagcaggggaaggattgtcccactgtggtccgtgctgagttttttcatgctctatgagacaagcgaatctcccaaggctttctggaggacctataggcagggcgaaactgcggctcgctatagggactgcttataccacgacaggaaaattccaaagcgttgtggtggtgtgagaacgatcgcaatgccaatgtggccgcttgcacaaatgcagacttgtattgccgagaaaatcctccagcatatcatgcctgatgatcacgcttgcgcataccggagaggaatgagtgtgtcagactgtgctgagcctcatcggaagaagcggattgtcatccacctggacattcgagatttctttgggaccatcagggaggacatggtgttcgatgctctattgcgcgagacaggctactcaaaaaagctcgtcagatttctttcccggttgtgctgctatcaggacagactgcctcaaggcgcgtgtacctctcctgcattgtccaatctggtatttaaaccgtgtgatgaggccatcggcgggttcgcagccagtcttgggatggactacacacggtattcagatgatctctacctgtccacctccggagaggttgacaccgggctggtcattgaaactgtgagaaagatactcgccgaccatggctttcgtctgcacaatgagaagactaaaatcatgggaagacagcagcggcagagcgtggtcggcatagtggtgaacgagaaattgaggccctcacgaacctacgttaggaccgtactcaaggacgtttattacgtttctcgattcggcgccgggtctaaccaggttgctgcctttggcgactactattcgtatttgcgtcagttacaaggtcgcgtgaactatgtgcgctgcttcatgccagaagaccgggcagtgctcgaagccgttcaaacagtgcgcagcctgataggtgcctatcacagaactcttctggacgcggtgacagcactggaggcccagtgtcgggacggatacgtagtcgtattcagcgaaaattattaccgccctctggtgaagctgaaagaacagctggctgtggtcaggagattcctaccccgagattaccgatttcatgatgccgaggaaagagtctacgccatgctgggggaagaactatactga

SEQ ID NO: 9673 - RNA, 1104 nt, unidentified
  source 1..1104: mol_type = other RNA; note = synthetic construct
atgcgctggtacccaagtgggaaactgaacttcacagccgcagatctggctgtcttgtcccatcctgcttttgcaagcaaaccttgggccggagctggagcatggttaagagctgaccctgcttatcctcctattccctcagctctggtgttcagccttctggcgggcccaagagaatctagaccggaacgcatgtggaaacagtatcgcaaactcctggagatcgcgaatgatcctgcccaatactatgtgagtcatgaaattgttcagcacagaaaaccaaggaccatttccgcccccttctatgaactggcgcagtaccagcggtggatactcaagaatatactggagcgagcccccacaaccgacttcgcattcgcctacaagaagggtctgacactggccgacaatgccagggtgcatcttgggcgatccgtaatagttaaactggatttggtccactttttcgattcaatcacatttggcatggtctatgaggtcttcgcaggtcaactgcggtatccacaggaaacggccgtgcttctggctaatctgtgctgtctcaacggcaggctcccacagggtgcttgcacttcgccctatctatctaatctttgttttgcaaaggcagacggcgagttagctggttattgccgggaaaaaggccttgcttactcaagatatagcgatgacttaactttctccggagacagaatcgacgtgaaggaactgattgcgtttgtgagggagactgtgaagaagtatgggttctctctcaactaccggaagatccacgtagacggaaaaggaaggcgtcaccgcgtgaccggcattgtgtgcaatgagaagctaaacgcaggggcagattacaggcggaaggtgaggcaggagatctactacctaagaaagtatggagccgccgaccacttgcgccgacgtaacgatccggcctacagaaacgccgatgggaccccctgtgttgagcgatactacgctgccttgctcggccggatcagctttatcttgcaggttgaccccgaacaagaggagttttggagttaccgggactacgtccgcgatctcatgctgcgtgccgccgagtga

SEQ ID NO: 9674 - RNA, 1077 nt, unidentified
  source 1..1077: mol_type = other RNA; note = synthetic construct
atgatctggcgtaagcgcgagcgaattaaccttagcgagctcgatgtttttgtgcttcggaaatacgcaggacagacaaatcctatggaggagattctgaacagcgaaatacccgaaaatttgccaccaatactgactccctaccatctccccctgtttatgcacaactttaagaagatgtactacttctgggagaattatagggacattatgaaatgctctaacgagcccagagaattttaccgcagatatgacattatgaagcgatatggaaagatgcggaccgtctataaagtgagcggtgtccttgcagatgtgcagcactggatcctgcgcaacatcctcgatgaactccccgtatcacggcatgccaccgcgtacgctaagggcaggaagatcatggacaatgcagcgcctcatgtgggcaagaagctagtagttaaagccgacattactgactttttcggcaatgtgaagtacttgagtgtatacgatgtgttcaaaaacgctgggtatagtaagtcagtcgccacactgctggccaatctgtgttgttgcgatggacacatcatgcaaggtgcctgcacctccccggctttgtccaacctgtgttttactaaaatcgattcagtgatctctgaattctgcacggagcgtggcattacctacacacggtattccgatgacatgaccttttccggggacttcgctcctagtgagctcataacttacctgcgacgggttctgaaattctatggtttcactatgaacgacaagaagaccaaagtgttatatcggcaccacaggcaaacggttacaggggccgtcgtgaatgacaaaccacagcctaccaaagagtacagaagaaggattcgccaggaaatgtactatatccgcaagtacggcgtcttgggacacatggataggcttaaggacgagaaaagctatgtgtctccaatcaactacctcgaaaacttatatgggagaatgaattacgtcctgcagtatacaccggatgacgaagaactaaaaaggtggatgcatgaggtggatagaatagagcagtcgctgttctga

SEQ ID NO: 9675 - RNA, 993 nt, unidentified
  source 1..993: mol_type = other RNA; note = synthetic construct
atggatgagatcctaaagtccaacataccggagaacctgcctcctctcttaactccatatcacatccctacactcatgcataatttcccaaaggtgatttcattttggaaatcataccgggaactgatccattgttctaatcaccctgaagagtattacaggtgtttggttttgcccaagagggacgggaagatgcggaaagtgtatgcggtaagtggggcccttgcccaagcacaacactggattcttcggaacatactggatgaactgccagtgaacccgcatgctatggcttatgtgaagggaagaagcctcctcgataacgcgaacccccacgccgggaagaaactcgtagtgaaggccgacattgaggacttctttggaagcgtgaagtacatctctgtctaccacgtatttaagtccgcaggatatagtgaaagagtctccgcagtgctggctaatttgtgctgttgcaaaggccatatcatgcagggcgcttgcacctcgcccgctttaagcaatctgtgttttgccgtgatagacgagaaaatatccgccttttgcgcactccgcgggatcacatatacccgatactctgatgatatgaccttctctggtgattttgccccctcagagcttatcacttacctgcgaggcctgctcaagttctatggcttcaccatgaatgacaagaaaacaaaggttctgtaccgccaccataggcagacggttactggagccgtggtcaatgaaaggcctcagccaacaaaagagtacagacggcgcattagacaggaggtctacttcattcgcaaatatggtgtcctggagcacatggaccgtctgaaggataataaatgctacgttagccccattaattaccttgaaagcctgatcggccgtatgaactatgtgctacagtacaacccacacgacgaggaattgctgagttggatggacgaaattgacaaaatcgagcagggtttattctga

SEQ ID NO: 9676 - RNA, 1029 nt, unidentified
  source 1..1029: mol_type = other RNA; note = synthetic construct
atgatccagactctggaagagttctgcgaatggctcgatccgtctgtgtccccccggatcttgcaaaaaaaggtgtattggctccggagcctgcgcagtgccaaaaagaaacgcaaggagtacgggctattctggttggctaaaaggggggggggatataggcctgtggcgtctccgtctcctggactgaagcaggtgcagaggggtattctgtcactgcttgcctatggcgaaattgcgccaccagctactgcgtatcgtcctgggagaaacctcctagacaacgcagcagttcacgtggggcagcctatcctggtgaagctcgatctgctgcacttcttcggcagcatacacttcccttccgtgttctgtgctatcgatcgcacactgtcccaaaaccccgagatcgctccctactccaaagagtcaaacggtaagaatgcaggcagcaccagagccgactcctttaatgccctgctgagctttttcttcactacattctgcacgcttgacggaatcctcccacaggggagtccagccagtcctatgctcagtaaccttgtcttttttcctttagaccagcaaattgccgcattttgtggccagagacatatacactacaccaggtacagcgacgacctgaccttttctggcgatttttcaccagagcccctgatcagatttgtataccagctgttgagaaagaatggattcttgctcaatcccgcaaaaaccataattgctcgacagggccggcgacagcaggttacaggtattctcgtcaatgatcatccgcaggtgggccgggattataggcgccgtatccgtcaagaggtccactacctacgacgctttggagtagcttcgcaccttcttcatgaaggccagacaggttgggccttacatcccgccccctacctccaatcactgttgggaaggattcagtttgtcctgcagatttgcccatatgaccgggagttcttagaatatcgggcctacgttctgagattgctgaagagctctctttga

SEQ ID NO: 9677 - RNA, 1020 nt, unidentified
  source 1..1020: mol_type = other RNA; note = synthetic construct
atgatccagactcctgaggacttttgtcaatggctgcagccagacgcctcaatccgcagcgtgcaaaagagtctctattggctgctgagcttgaggtcggcccgtaagaaaagaagagagtaccaggtcttctggctggcaaagcgggggggaggatatagacccgttgctgctccctccttaggattgaagaaagtccagcgcggtatactgagtttactgtccgtgggggaggtttctccccatgccaccgcttatcagcctgggtgcaccctacttcgtaatgccgccccccatgtaggccagccctttgtggtgaaactcgatatcgcaaatttcttcggatctataccgttccctgctgtttacgccgcaattgacagagcactttgtaggaaccctgagattcagagttccgccaaggcgtcatcagcacgggaaggtgccaccgagagttacaacgcggccctcagcttcttcttcgccaccttgtgtactctggacggcgtacttccgcaaggggctccaacatcaccactgctctccaatttggtgttctttccactggattgtaggattgccgcgttctgcgagggccggaaaattcactacacacgttacagcgacgatcttacctttagcggcgatttctctccagatacactgataagattcatcaggaggctcctgtgcgaacacggctttctgcttcacgagagcaaaacggtgatcgctcgcagaggcaaccggcaacaggtcacaggcattctggtgaacgaccggcctcaggcagggaggaagtttcgccgccgaatccgacaggagctctattatattcagcgatttggcctttcttcccacttactgcatgaaggtagaactggtgaatcctgcgctcctggaccctacctacactctttgctgggaaggatccagtttgtgctccaggtctgcccatatgatcgcgaatttctcgggtatcgggcttacatcctgcaacagatgaagcattacacgtga

SEQ ID NO: 9678 - RNA, 1035 nt, unidentified
  source 1..1035: mol_type = other RNA; note = synthetic construct
atgttgcgaaccctggaggatttttgtagggccgtttacccaggactgacacctgagcagtttaggaagaactcacaccagctggcggcctacgcagactcccgtaagaggagaaaatcttatagagagtgctggattcctaagaaacacggaggagcccgaaggatactagtgccatcaccaggcctgaagcaaattcagcgcgcagctgcagcactcttgaagaatggtagcgtttctccgtacgctacggcatatcagacaggccgaagtgttctcgacaacgccgcccctcatgtagggcgtgaactgttggtcaaacttgacatccggaactttttcggctccatacggtttccggccgtgtttcatgcgattgaccacgctctccgcaggaacccagaagtcggacggcactgcaaggactacccccacgggtcccgggaaagccacaattataatagtgtgctgagcttctatctggcccagttctgcaccctagatggggtgctgccccaaggcgctccttcctcacccattctttctaacctcgtgttcgattccttggattgcaagatcgccgcttactgtgagcgcagaaatatccaatatactcggtactcagacgacatgacattcagtggctgttttcatcctgaggtgctgatccacttcgtaagaaggttacttgctgaatacggtttcaccctccatgaggaaaaaacagtgctggctggaagaggttgtcggaaatctgtcactggggtggtgattaacgagactccccaagtcagccgttcgtatcgcagaaatctgcgacagcagatctattatatcagacgcttcgggttaagagagcacttgctgcatttaggaaggaccgccgatgcagggcagcccgaacagtacctccgccagctgctaggcaaagtcagcttcgttcttcagatctgccccgaggatccagaatttcagcaataccgggcgtactgtctgggcctgcttagggctcatgccggcaagaaggccctctga

SEQ ID NO: 9679 - RNA, 1104 nt, unidentified
  source 1..1104: mol_type = other RNA; note = synthetic construct
atgcgcagagctatgaatcacacattgcgcgaatttctggagtcgattaagagtaagcatacatacctgctgtttcggtacacggacgaggcctataaactacggcgctgctaccgtccagtaatccttaagaagaaaaacggcggattcagagtcctccaggtgcccgacgagaatctcaagaggttacaacgtcagttgctcacctatctgcagcacgccgaaatctccccttgtgcagccgcctatgtgaagggtagaggcctgtcagaacatgctcattatcacgcgggccggagtatgcttctcaagctggacattgaggactttttcgggagcatcagttttagcaaagtcctgtttgctgtgaaagaggccctgaaacgatctccactggtgggtcaggaacagcgatccgagatcggatggttcatcgcaaaagcttgtacacttgatggggtgctgccgcaaggagctcccacttcccccattctgagtaacatggtctttttgcacctcgatcaagagattaatagctactgcatccagcgaggaattcattataccaggtacagcgacgacctgttcttctctggcgattttagaccttcagagataatccctcttatcaggaagttactgaggcgcaacgggtacaccttgaatgaaaacaagatcgttgcagcaggaagagggtccaagaaactggttactggcgtagtggtgaaccagaggcctcaggcggaccgctcatatagaagggagattaggcaaagcatctactatataggaaagttcggactcgaagaacacctcaaacggaaggggctgctagacgaaggtatgcagcccgaggatatgcgttctgaggccgcagggaatgaggatttcggcagggaagatgtcatcatccgagcccagatggtgaaagagttgcagcggctaattggtagaattgtttttgtgcttcagattgacccacaaaaccgcgagttccaggattacaagaaattctgcataggcctgttaaaccggcttccagtcatattcaatggccggctcctgtccgaagccgaaataaatgagggctgggggtctgcttga

SEQ ID NO: 9680 - RNA, 1035 nt, unidentified
  source 1..1035: mol_type = other RNA; note = synthetic construct
atgctgcataccctggaggcgttctgtgcttggcattacggcgggggcgacccactaagactggctagacgcacccgctggttgatgaggctggcaagaggccggcgattagaaggggaataccgccctcaagagattcccaagcggaagggaggaacacgcaaactccttgtcccctcccataggttggcccacctccagcgcggaatactgagactccttgaagccggagaggtgtctgctgcagccacagcgtatgaacctggttgcagtctaaggcagaacgctctccctcaccgtggggcaagacttctagtccgtttggatctggccgactttttcggctctatctcgtttcaacaggtctttcaggctgtggatcgggctttgcggagaagcccccttgtgggccggcatctccttgacggttacgaccggctgcagagggaggagcgagtgtacaaccaagtgctgtccttttatttcgcacgcttctgcacttataggggacacctcccccaaggggccccaacttctccgcacctctcaaacctcgtattctttccgctggatgaggccctgctgcgttattgtacacggcgcggaatcacctacacgaggtattccgacgatcttgcatttagtggagaaaccttcagcgttggcgagctgctgcgcttcgtgcagaggttactggccgcacacggcttccggttgaatgagggcaagaccgtggttgcgggtcctggccagagaaaaagactcccaggtgtagttgtgagccataagctacaggccgacgtcggcctgagacggcaattacgacaggaattctactatattggcaggtttgggttggcctcacacttagagaggactggggagcagcgacccccaagtgcctacctgaggcggctgctgggaagaacagggttcgtcctccaggtgaatcctgaggatagggagtttcaggagtacctggagcgtgggaagcgctggctgaaagaacaggaagaacgagctgctgaaggttga

SEQ ID NO: 9681 - RNA, 996 nt, unidentified
  source 1..996: mol_type = other RNA; note = synthetic construct
atgctgcacaccctcgaggacttctgccggtacctctaccataaccgagacgagaggaagttctatcgctgttactaccaattactcaggctgagtagggagaaatatcgctgcagctgttatacgcttcgggaactgccaaagggagaagccggaactcgcttgttatgcgtcccaaacagagctctgagacgggtgcagaaaggaatcctggggttgttgccagctgctggcccttgttgtgtgacagcctatctgccgggaaaaagcgtcctggataatgctagaccacatctaggccagcccctggtcgtgaagcttgacatcagggcgttctttgactcaatctcgttcgctcaagtttttcgggccgtcgacagagcgctggaagcatcaccttacgtagggtgccactacctgaacgcagatgatcgatcatccctcgagaatagaaactataattccgtgctctctttctattttgcacgtttctgcacccgtggtggcagtcttcctcaaggagcccccacctccccccttctgtctaatctcgtgttcggccccatagacggtcagatcagtgcatactgcggtcgacggggcattgcctacacaagatattctgacgatatgaccttttccgggacattcaaccctcttgccttaattgactttgtgagaagggtgttggccgagaacggcttcactttgaatgataggaaaacacgcatactgaacagaggacagcgcaggaagatcactggcgttgtagctaatcagaagctccaggccccgcgtgagtaccgaagggatattcggaaagagctgtactacattcggaagtatgggtgggaaagccatctgagccacgaaaacatcgcccagggccccgaagaatatcgccgaggcctgctcggtcgcgttgggtttgtgctgcagctgtgtcctgcagatggggagtttcagcaataccggcagtggctactagagaattga

SEQ ID NO: 9682 - RNA, 1059 nt, unidentified
  source 1..1059: mol_type = other RNA; note = synthetic construct
atggaagacgccgcacggttcgagagggaaactgggctgccctattttccggatgcgcatcaatttgctgatgcctatttaccaacagacaggtccgaagaacatggtgaaaacgtgcggcgcttatacgatctggccaacgctcccagatggtattatcggtcagtgagcatcccaaagcaaagcggaggcacaaggaccctgcacatcccatacggcacgctcaaaagtgtgcagcactttctgctgcactcagtcttggaacggcttcctgtcagtccttgtgcagtggcctacgtccggggagtgagcctcagcgagagtgttagggtgcatgtcggcaagccattgttggtaaggcttgacctcaaggactttttcgatcacattggttttcttcaggtatatcagaatgccttcgccgcctaccctaaagctgtgcgggtcttgctctccagactgtgcacttacacactgccttcaggtaggtcttgccttccccagggcgcacccacctctccttacctcgccaatctgtgtatgcgccgcgctgatgacgcaatatacgcatactgtgctaggcgctccatcgcatatacgcgctacgctgacgatatgaccttcagtgggagcttcgaaccagagcgcctgattgaaactgtgagaagcatacttcgtcgtgaggggggctttgagttgaacgaggagaagacccggattctaagagcgtgtcgcagacagtcggttactggggcggtggtaaatgagaggccccgagcatctgctacctatagaagagagatcaggcaggagtgcttttattgcaaaaagttcggcgtgcgatcccatctactgagaacaaaaaaagcccctttcgtgcgaccatctgaatccgtcaaggacggatactatgtttctcagacacgctacctggagcacctgttaggaaaaatcaacttcaccctgtcactggatccgaaggacagagagatgcggctctgccgaaaggaggttctactctggctggccgaacgaaatgctgccccccgtgagcggtga

SEQ ID NO: 9683 - RNA, 1062 nt, unidentified
  source 1..1062: mol_type = other RNA; note = synthetic construct
atggattttaaccactataaagaggccttcattaaggagagccggaaaattggtttttctcttccaaacatccagcactgcctggactatgccgaggtactattctcacaccatgttccagtcatatataatccatcacatctgtctgccctggttggctacaagaaggaatacttaaaaaaggcttccctatttccaaattacttctaccgagattttgaggtggcgaaaaagaatggaacaaagcgcctgatcagcgaacctttgccctcgttaaaagagatccaaatttggatcctgcgttccatactgtataagatccccgtgtccccgtttgccaaagcctataagcctaatgtaacattgctggaaaacttgcggttccataaaaaccagtccaagatctttacccttgatctcgaaaacttcttcccgtccatctcagcagagctggtcgaggcagaatttctggaactcgggtatagtaagatagtgtctaaactactgagcagactctgcaccaggaatggaaatctgccccagggcgctccaacttctccttacttgagcaatctcattttcaagaaggcggacgccgaaattgctagctattgtaaagactacaagatccgctatacaaggtacgcagatgacatgagttttagtggggattttgaccatgaggaacttctgaagaaagttactgagacagtcgagaagctcaacctgagaatcaacgcaaaaaagacgaagctgatgacgcctaatatgagacaaaccgtgactggcgtcgtggtgaaccaaaaaccccaggtgatcttctataaacggaatgaacttaggcagaccctgtactacattcagaagttcggttttgaagagcacaagatcttcaaaaagaacaaccacaacaactacttagagcatctgctcgggaagattaatttcgtcctgcagatcaatcctaaggatgctgaattcattaagtacaaagccgtgctcttcgaccttaaacacaaacaggacctcaccgctattgagaacgagttgtttcccatatga

SEQ ID NO: 9684 - RNA, 1062 nt, unidentified
  source 1..1062: mol_type = other RNA; note = synthetic construct
atggattttacacactataaggacgctttcatcaaagaagcacataaaaccggttacagcttgaccaacattcagaggtgccttgactacgccgaggcacttttcctccacgaggtcccggttatctataacccatcacacttgtcttctctggtcggatataagaaagagtacctcaagaaggcttccctgttccccaattatttctacagagatttcgaggtagcgaaaaagaacggcaccaagagattgatttccgagcccctaccctctctgaaagagattcagatatggatactacgcagcattttatacaaggtgcccatttcaccattcgccaaagcctataagcctaaagtgactttaatggagaatctgcggttccataaaaagcagcctaaagtgttcaccctggatctcgaaaactttttcccatccatcaggatggaaactgtacaaaacgtctttcttaagctgggctacagcaaaatcatcagtaagtttctgactcgactctgcactcgcgatggaacacttcctcagggttcacctacgtcgccttacctttccaacctcatttttaaacaggccgatgccgaaatcgcgagctattgtaaagactacaagatacggtatactcgatatgctgacgacatgagttttagtggcgactttgatgagaatgaattgctgcaaaaggtcacagagacagtggagaagatgggcctgagaatcaacgctaagaagaccaatctcatgacaccaaatatgcggcagacggttaccgggattgtggtgaaccagaagccccaggtgatctttaagaaaaggaatgaactgcgccaggcactgtactacatacagaagttcggatttgaagagcaccgtgagtacaaggaaattgaccaaaagaattatctggaacacttattggggaaaatcaattttgtgctccaaatcaacccgaaggacgcagaatttataaaatacaaggccgttctgttcgacctgaaacataagaaagggattaaaaccatcgataacgagttcttcccaatctga

SEQ ID NO: 9685 - RNA, 1062 nt, unidentified
  source 1..1062: mol_type = other RNA; note = synthetic construct
atggacttcgcccattacaaagatgctttcattaaggaagctcacaaaacggaatactctttgactgatatccaacggtgcctggactatgccgaagctttatatcttcaccaggtgcctgttatttataatcccacacacctgtcaggtctggtcggctataagaaggagtatctgaaaaaagcatcgctgtttcctaactacttctatcgggactttgaagttgcaaagaaaaatggcggcaagcgactgatctctgagccgctgccctccctcaaagagattcagatctggatactgagaaacattctttacaaggtgcccagctctgcattcgccaaagcctaccgcccaacagttacactgctcgagaatcttcgtttccacaaaaaccagccaaaagtctttaccctagatctcgagaacttttttccaagcatccgcgttgaggccgtcgaaaatgaattcttgaaactggggtactccaagattgtgagcaagctgttgtccaagctctgcactcgcaatggcactctaccgcagggagccccaaccagtccctacttaagcaacctggtgttcaaagaagctgacgctgctatcgcgacttattgtaaggagcacaaaatcaggtacacccggtatgccgatgacatgtcattcagtggagactttgacgaaaatgaactcctgcagaaagtaaccgaaaccgtggaaaaaatcgggtttaggattaacgcgaagaagacaaaattgatgaccactggtatgagacagacggtcacaggcgtggtagtcaacgaaaaacctcaggtggtgttttacaagaggaatgagctgagacaagcactttactacatacaaaagtttgggttcgaggagcatcgagagtataaggagatcgatcagaagaattatcttgagcatctcttgggaaagataaacttcgtgctccaaattaaccccaaggatgccgagttcatcaaatacaagtccctgctcatcgacctgaagaacaagcaggatctgaaggcattagaggacgagctacttcctatatga

SEQ ID NO: 9686 - RNA, 1062 nt, unidentified
  source 1..1062: mol_type = other RNA; note = synthetic construct
atggatttcgctcagtacaaagaaacctttacagacaaatctcacaaaattggatactctttgcctaacattcagcggtgcctcgattatgcagaggtcctctttagccatgatgtgcctatcatctacaatcctacccatttaagtctgctcgtcggctacaaaaaggagtacttgaagaaagccgccgtttatccaaggtatttttatcgcgacttcgagattgctaaaaaaaatgggactaagagactaatcagtgagcctctaccctctctgaaagaaatccagatctggattttgcggaacattttaaacaaggttcccattagcccatttgccaaggcctacaaaacgaacgtgtccctgatcgaaaacctcaaattccataagaaccagcccaaggtatttactcttgatctggaaaactttttccaatcaatcaccatcaagctggtggagaaggagtttcaccagcttgggtatagcaagatggttagcaggctcctatcgaaactgtgtacacgtgacaagaccctcccacagggtgctccaacaagtccctatctgtccaatctgattctgaaagatgcggacgcccaaatcgccgcatattgcaaactccacaaaattcggtacactcgatatgcagacgatatgtcattctcaggcgacttcgacgagaataagctgttgcacaaggtaatagaaatagtggaaaagctgaatctgcgaatcaacaagaataagaccaagttgatgacttccaatacccgccagacggtgacaggcatagtggtgaatgagaaaccgcaagtcgtgttccataagagaaatgacctcagacaggcgatgtactatattaagaagttcggtatcgaagaacacagggagtacaaggaaatcaaccagaaaaactacctggagcaccttttgggaaaaataaatttcgtcctgcagatcaaccccaaggacatagagtttctggaatacaagtccattcttaaggacctgaagaaaaaacaagatcttaaggctatggaggatgagttactgccgatctga

SEQ ID NO: 9687 - RNA, 1062 nt, unidentified
  source 1..1062: mol_type = other RNA; note = synthetic construct
atggatttcactcagtacaaagaatcatttactgaagaagctcacaagatggggtacattgaacaaaatatagagcactgcctggaatacgcagaggtgttgttttcacacgatgttcctgtcatctataatccatcccatctttcactgctgctgggatacaagaaggagtatcttaagaaggtgagtctttttccccggtacttctatagggactttgagatcctgaaaaagaacgggagcaaacgactgatttctgaaccgcttccgtccctaaaggaaatccagatttggatcctgaggaacattttgtacaaggtggccatctcgccatttgccaaggcttacaaacctaatgtgtgcatcttggagaaccttcgcttccataagaatcagcccaaagtgttcacactggatctcgaacatttctttccttccataacaattgagaaagttgagaaagagttcagagagctgggttattccaagatggtttctaaactcctatctcggctctgtaccaaggatggtagcctcccccaaggagcacccaccagtccatacttaagtaacttgatctttaaggatgctgacgaagcaatctctgactactgtaaacagcataagataagatacacacgctatgccgatgacttatcctttagcggcgactttaatgaaaacaaattgctgcacaaggtgaccgaagtgattgagaagctgaacctgaagattaacaagaacaagaccaagttaatgatgcctaatacacgacagacggtaaccggcattgtagtgaatgagaaacctcaggtcgtcttctataagagaaacgacctgaggcaggcgatgtactacatcaagaaattcggattccaggagcaccgtgagtataaggagatcgaccaaaaaaactatctggagcacctcctcggcaagatcaatttcgtcctacagattaatccccgggatactgagttcatcagctataaaagcatcctcatagacctcaaaaaaaaacaagaccagaaagaactggaggatgccctgataccaatttga

SEQ ID NO: 9688 - RNA, 1062 nt, unidentified
  source 1..1062: mol_type = other RNA; note = synthetic construct
atggacttcatccaatacaaggaaacatttagccacgatgcacagaagaaaggctattctgaacagaacattaagcggtgtcttgactatgccgaagtcctgttcgcccatgacgtgcccgttatttacaatactacccacctttccctgcttgtaggatacaagaaggagttcctcaagaaagctgcattatatcccaaacggtattaccgagactttgagattctcaaaaaaaacgggtcgaagagacttatcagtgaacctctgccctcattgaaagaaattcagatctggatactgcgcaatatactgtacaaagtgccaatcagtccttttgccaaagcctataagcccaatatctccattttggagaacctgcggttccacaaaaaccaaccaaaggtctttactctggacctggagcatttctttccgtcaatatcttttgaggccgtagagaaggagtttctagagctggggtacagcaaaatggtcagcaagctgctatccaagttatgcatcagagatggtagcctgcctcagggagctccaacttctccgtatctgtccaatctcatttttaagaaggccgatgctgttatcagtgactactgcaaacagcataagataaggttcaccaggtacgcggatgatctatcattctctggtgactttgatgagaacaagctgctccacaaggtgacggaaaccgtgggaaaactcaacttgcgaatcaacaagaacaagacaaaactgatgatgcctaataccaggcaaaccgtgattggcatcgtggtgaatgagaagccccaggtcgttttccacaaaagaaatgagttacgccaggctatgtattacatcaagaaattcggcttcgaagagcatcgtgaatacaaggaaatcgatcagaagaactacctggaacacctccttggcaaaattaacttcgtgctccagattaatcctaaagatgaggagtttatcgggtataaaacaatcttgatcgcactcaagaagaagcaagacctgaaaacaatggaagacgagttgataccaatttga

SEQ ID NO: 9689 - RNA, 1062 nt, unidentified
  source 1..1062: mol_type = other RNA; note = synthetic construct
atggatttccctcattatacttgcgtctttacgcgagaggcatcgaaacttggatacagtcctaaaaatatccagaggtgtctcgagtacgccgaagtgcttttctctcacggtgtaccagtcctgtataaccctagccaatttgcactgctggtgggatacaaaaaagagtatcttcagaaggccgcgctctaccccaattacttctacaggaatttccatattaccaaaaagaacggaagcaagagattgataagtgagccactaccaagcttgaaggagattcagctctggatcctccgtaatattctgtacaaggtccccgtgtctgcatttgcgaaggcctataagccgaccgtctccatcctggaaaatctgaaattccacaaaaagcagcctaaggtgtttacgctcgacgtcgaaaacttctttccttccatcaagtatgatagtatacagaaggtgttcctgcagttaggctattccaagatgatgtcccggctcctgacacgattatgttcttgtaatggggccctcccacaaggtgcttgcacatcaccgtatttgtccaatctgatcttcaaagaggccgatgccgctatctcaaacttctgcatgcagagaaaaatccgctatactcggtacgctgacgacctgaccttttcaggggattttgacgaaaacgagctactgaaacatgttactgaaattatagagcgccagaatttcaggattaacggcaataagacaaagctgatgacaccaaacagcagacaagaggtaaccggcatcattgtgaacgaaaagccccaggtggtgtttcacaagcggaacgatcttagacaagctctttactatatcaagaagtttgggttcgaagagcatttagagtacaaagaaattaaccacaggaactacttggagcacctactgggcaaaataaatttcgttctgcagatcaacccccgcgatatggaatttatcagctacaaatctttcctgattgacttgaagaaaaagaaggacctcaaaatgactaccgtttttcccctgctgatgtga

SEQ ID NO: 9690 - RNA, 1062 nt, unidentified
  source 1..1062: mol_type = other RNA; note = synthetic construct
atggatttcgaacagtatcgcaacaatttcagtaaggaggctttgaaacttggatattccgagcagaacgtcgtgcgttgcctggactacgcagccgtcctctttagcaacaatgttcctgtgatctataacatatcccacctgggacagctggtgggctataagaaagagtatcttaaaaaggcgtctacttatggcgacaacttctacagaaacttcgagattacaaagcggaacggtacgaaaagactgatctccgagcccctgccaagcctgaaggaaatccagctttggatattgaagaacatcctctacaaaataccagtgtcaccagtcgccaaagcctataaacctaaggcacgaattatcgagaatctcaaatttcaccggaatcaacccaaggttctcactctagacctggaaaattttttcccctccatcaagatgaaggcaacccaaaatgtctttctgaatttgggatacagcaagtacatggccaatattctaagcaaactgtgtacaaaggaggattcattacctcagggtgcccccacctcaccgtatttgtctaacctgattttcaaatctgcagatgctctcattttcgacttttgcagacaacgagaaatcaggtacacccggtacgctgatgatcttagctttagtggcgactttgacgagaagatgctcctagggaaagtgacagatattattgaatcgctgggattcaaaatcaataacaccaagaccaaactgatgacacctaatacgcgccagactgttactgggatcgtggtgaaccagaaaccacaagtggtagcccacaagaggaatgctctcaggcaggcgctctactacattaaaaaatttggcctgaaagagcatcaggaatacaaggaaatcgtccagaagaattatctggagcatcttctgggcaaggtaaacttcgtgctgcagatcaacccgaacgataatgagtacaagaattacaaggacttcttgatcgacttaaagaagaagaacgaactggggataaaaaacgcctctcccagtttaatttga

SEQ ID NO: 9691 - RNA, 1053 nt, unidentified
  source 1..1053: mol_type = other RNA; note = synthetic construct
atggactttacacaatactcttttgctttttccaaggaagccctaaaattcggctacaccgagcaaaatatcaagagatgccttgattatgcagtggttctttttagtcacgacgttcctgtgatctataataccagccacttagctcagctggtgggatataagaaggagtaccttaaaaaagctaccctctatactaatagcttctatcggaacttcgagattgtcaaaaaaaatggcagtaagcgcctcatctcggagccgctcccatctttgaaggaaatacagctctggatcctgaagaacattctgtacaagattccggtgtcacccgtggccaaagcgtacaaacccaatgtgagaattattgaaaacctgaagttccataggaatcagccaaaggtgttaacgctggatctcaagaattttttcccctccattaagatcaacgccattaagaacatcttcatagacctgggatattcaaaattcgttagtagacttctggccaaactgtgcactaaggaagacgcactaccccagggagcacctacatccccttacttgtcaaatctgatcttcaaaaaagccgacgcgctgatatttgacttctgtaagcaacgcaaaatcaggtatacccggtacgcagatgatctctgttttagcggtgattttaacgaggaggagcttctggaaaaggtgacagatattgtagaggatatgaacttctccatcaacaaaagcaagacgaaattgatgctccctaatacacgacagactgtgatagggatcgtagtgaacgagaaaccacaggtcgtctttcataagcgtaacgccctgaggcaagctgtttattacatcaagaagttcggcctgaatgaacaccaggagtgcaaaggtattttgcagaacaactacctcgaacacctgctagggaagatcaattttgtcttgcagattaacccaaaggacaccgaatttcggaactacaaagacttcttaatcgacctgaagaagaagaatgagtggtctaaacccgtcttccaccattga

SEQ ID NO: 9692 - RNA, 1062 nt, unidentified
  source 1..1062: mol_type = other RNA; note = synthetic construct
atggacttcgcccaatataagaataccttcacacaggaggcgtcaaaaaatggctattccgagcagaacattcagcgatgccttgactatgctgaattgctgttctcacacgaagtcccagtgatttacaatactagccacttaagtaatctggtaggatacaacaagaaatacctgaagaaggcgtcatattatccgcagtacttttatcgcgactttgaaatcacaaaaaagaacggcacaaaacggccaatatccgaacctctcccgagcctcaaggagattcagatctggatcttaaagaacatcctctacaaaatccctgtttctccctttgccaaggcttacaagcctaacactgcactgatagaaaatctgaaattccacaagaaacagccaaaagtgttgactcttgacttggagaacttctttcctagtatctccgtgaagagcattgaaaagattttcatcgagatggggtactccagaatggtgtctcagttgctggcaaaactgtgtacccgggacaagacgctgccacaaggtgcccctaccagccccactctaagtaatctgatttttaaggatgccgatgtggctatcgcagatttttgcaagcaacgaaaaataaggtacacccgctacgcagacgatctgtcgttcagcggagactttgacgagaaggaattgtttgagaagattaccgagactgtagagaatctgaacttccatatcaataagtctaagaccaagcttatgacacccaacacaaggcaggttgttacgggtatcgtggtgaacgaaaaaccacaggtcgtgttccacaaaagaaatgagctccgtcaggccatgcattacatcaaaaagttcggcattgatgagcacagagagtacaaggagatcaaccaacggaattatttagaacatctgcttgggaggatcaactttgtcctgcaaataaatcccaaagatctggaattcattgggtataaagccgtcctcattgatctcaagaaaaaacaggctctaaaaatgaagaagaaccagcccctccttatgtga

SEQ ID NO: 9693 - RNA, 1059 nt, unidentified
  source 1..1059: mol_type = other RNA; note = synthetic construct
atggactttacccattataaagaggcattcattcaagaagcttccaaaaactccttcagtgaacacaatatcgagcgctgcctggaatacgccgctgtactgttttcaaacaatgtccccgtgatatacaatacatcacatctaagcgcactcgtggggtacaagaaggagtatttaaagaaagcctccctctatcctaaatatttctaccgggattttgagatcacgaagaaaaacggcagtaaaagagccatttcagaacctctgccatccctgaaggagattcagatttgggtgctgaagaacatcctgtacaaaatacccataagccctttcgccaaagcatacaagcccaatagcggcttgattgagaaccttaaatttcacaagaagcaaccgaaggtgtttaccctggaccttgagaacttcttcccatctatctccattaagagcattgagaaggtgtttttaaccgcgggttatagtcgcatggttagcaagttgctgtcaaagctctgtactagagatgggacattgcctcagggagcccccaccagcccatacctgtctaatttaatctttaaggatgctgacgccgtcattagctcgtactgcattgagcgtaagattagatataccaggtatgcggacgaccttagtttttctggagacttcgacgagaaagagctcctttctaaaatcacttctatcgtggagaacctcaatctgcatctgaacacagctaaaacgaaactgatgactcccaacatgaggcagacagtgactggaatagttgtcaatgataagccacaggttgctttccacaagaggaatgaattgcgacaggatatgcactacatcaagaaattcgggatagacgaacatcgggaatataaggaaatcaatcactccaactaccttgaacacctactcggcaaagtaaacttcgtgctgcaaatcaatgccaaggatctggagtttatcggttacaaggccgtcctgatcgcactcaagaaaaaacagcagaaaacacagatgatccagccgctattgatgtga

SEQ ID NO: 9694 - RNA, 1056 nt, unidentified
  source 1..1056: mol_type = other RNA; note = synthetic construct
atggacttctctaattataaggatacattcaccaacgaggctattaaacggggctactcagaacagaatattaagcgctgcttagactacgcagccccacttttttctaatgatgtacccgtgatttacaataccagtcacctgagcgtccttgtgggctacaaaaaggagtacttgaagaaagccgctctgcacaccaagtatttttacagggatttcgagattgttaagcggaacgggaaaaaacggcccatcagcgagcctttgcccagcctcaaagagattcagcattggattctgaagaacatcctgtataacataccagtttccccttttgccaaagcatacaagcccaatataagcctgatagaaaacttgaagttccaccgcaatcagccgaaagtgtttaccctggacctggagaacttttttccttccatcacaatcgattccattgagaaaatattcatcgagctgggttactccaagtcggtcagtgacctcctagcgaaactttgcactagggatggcaccttgccacagggggctcccacatcacccagtttatctaacctcatcttcattgaagccgacgcgcttatagccgactactgtatccaacgtaagattcgatacactagatatgcagacgacctcagcttctcaggggattttgatgaaaaagagctgttcgataaggtgaatggcatcatcaagaagatgaactttaacatcaacacggccaagacgaagctcatgacccctggatctcgccagactgttactggtattgtcgtgaacgaaaaaccacaggtagtgttccataaaaggaatgagctacgacaggctatgtattatatacagaagtttggcatcgaccaacatagagagtacagggaaattaatcagagaaacttcctggaacacctgctgggaaaaatcaatttcgtgctgcaaatcaatccgaaagacacagaatttatcggatataaatccttcctgattgatctcaagaagaagagagacttaaactatgatacactcaagatcatctga

SEQ ID NO: 9695 - RNA, 1062 nt, unidentified
  source 1..1062: mol_type = other RNA; note = synthetic construct
atggacttcagtcaatatgaagatgcttttacaaaggaagccacaaagatgggctactccccacaaaggattgagcggtgcttagattatgcagagatgctctactcaaatgacgtgcctgtcatttataactcatctcatctggccgggttagtagggtacaagaaggaatatctgaagaaggctgccctgcatacgaagtacttttatcgagacttcgagattttgaagaagaatggcaagaagaggcccattagcgagcctcttccgtccctgaaagaaatacagcattggatcctgaagaacattctatacaaaagacccgtgagcgcatttgcaaaagcttataaaccgaacgtttctctcatcgagaatttgaaattccacaaaaatcaggcaaaggtcttcacactggacctcgagaatttcttcccttcaatcggcatcgaatcagtcgaaaaggtatttgccgacgtcggttatactcggtccatcagcgaccttctgagtaagctatgtacccgcgatggatctctgccacagggagcgcccacctctccttacctcagcaacctgatctttgaggaggccgacaaggttatatcccagtactgcattcagaagaaaatacggtatacacgatatgcggatgatttgtcgtttagcggtgactttgacgagaaagagctgttcaacatcgttaccgaggccgtggaaaagttgaaactgaaaatcaacccaagtaaaaccaaattgatgactccagattctcgccagactgtgaccggcatcgtggtgaacgaaaaaccccaagtcgtgtttcacaaacgcaatgccctcaggcaggccatgtactacattcaaaagttcgggattgacgagcacagagaatacaaagagattaaccaggctaattaccttgaacacctgctgggaaaaatcaacttcgtgctgcagatcaatcccaaggattccgaatttataggctacaagagtttcctcaaggatctcaaaaaaaagcgtgaggctagcaataacagaatcatgcctttacttatgtga

SEQ ID NO: 9696 - RNA, 1113 nt, unidentified
  source 1..1113: mol_type = other RNA; note = synthetic construct
atgggcgtatctgattctaagagtccgcactccattaacgacagcgatgcaatggattttgttcattacaaggactccttcactaaagaagctctaaaaattgggtattcgcaacagaatattctgagctgcctggattatgcccagattcttttgacaaaggacgtgcccgtgatatataacagtagccatctcgctgtactggtcggctacaagaaagagtacctgaagaaagcagctcaccacacaaaatacttttatcgagacttcgagattactaagaaaaatggaaagaagcggcctatcagcgagccactgccctcactgatggagatacagcactggattctcaaagaaatcttgtataagctgcccgtctcaccatttgccaaggcttaccgaccaaacatctcaattatcgagaacctgaagttccacaaaaaccagcctaaagtgtttaccctcgacctggagaattttttcccttcaatcaagatcgaagccgtcgagagaatcttcacagagcttggttactctaaaaacatatccaacttgctcgcccagctatgcaccagggatggtcgcctgccacaaggagcaccgaccagcccttttctttccaatttaatcttcaaggatgccgacctgatgatctccgactattgtaaggaacacaagattcgctatacgcggtacgcggatgatcttagtttctctggggacttcgacgagaaaaaactgctccacaaggttactgaaaccattgagaaattggatttcaagatcaacgcagcgaaaaccaagctaatgactcccgatagacggcaaacagtgactggcatcgtggttaacgaaaaaccccaggtcgtgtttcataaaaggaataccttgcgtcaaacgatgtactacattaaaaagttcggaatcgacgaacacagggaatttaaggagatagaccagacaaatttcctcgaacatcttctggggcagatcaattttgtgttacagatcaatcctaaggacagcgagtttatccattacaaagccttcctcattgacctgaagaaaaagcaggatgccaagaacataaagagaggcctcctgttaatgtga

SEQ ID NO: 9697 - RNA, 1062 nt, unidentified
  source 1..1062: mol_type = other RNA; note = synthetic construct
atggattttaccaaatacaagaaggatttcactgatgaggcgaccaaaatgggtttatcgaagcgcaatattcaggattgcctggactatgcagaagtattagtgtctcacaacgtttcagtaatctacaacccgtcccatctctcagcgttggtcggctataagaaggaatatcttaagaaagccgctctccacacttcttacttctaccgcaattttgaaattaccaagaagaatgggaagaaaagaccaataagcgagcctctcccttccctgaaagagattcagatctggatcttgaagaacattctggagaacattcctgtgagcccatttgccaaggcctacaaaccaaagatgcggcttatcgaaaatctaaagttccataagaaccaacctaaagtgttcacacttgacttggagaacttctttcccagcataaagatcgaggctgtcgagaaaatttttctgaaactgggctacagtaagatcgtgagtgaacttctcgcaaaactctgtacgaaagacaatgccctgcctcaaggggcacccacatctccgtacctgagtaatctggtcttcagggatgccgacgcaattatcagcgaattctgcaagcaacggaagatcaagtataccagatatgctgacgatctttccttttcaggagacttcgacgaaaacgagctgctggataaggttacggaaacaatcaaaaccctgaacctgcgaataaatgaaagcaaaaccaaactcatgacacccgacatgagacagactgttactggtattgtggtgaataacaagccccaggtggagtttaataaaaggaatgaactccgtcaggccatgtattacataaagaaattcggctttgaggagcatagggtgtataaagagatctcccaggccaattaccttgagcacctgctgggaaaaatcaactttgtcctgcagatcaacccaaaagactatgagttctctgcctacaaagctctgctcattgaactgaagaagaagcagaacttgaagataaagaaagagttacccctactattgtga

SEQ ID NO: 9698 - RNA, 1062 nt, unidentified
  source 1..1062: mol_type = other RNA; note = synthetic construct
atggatttcactaaatacaaggttgactttacggcggaagcctctaagaagggcctgagcaagaataacgtgcagcggtgtctcaactatgctgaagccctgatctctaagggcatagctgtgatttacaatcctagccatcttagcgccctgctggggtataagatcgagtatctgaagaaggccgctctgcatccgtcctatttttatcgggatttcgagatcgctaaaaaaaatgggaaaaaaagggccatatccgaaccactgccctctcttaaagagatccaggtgtggatcctcaaagatatcctcgaaaaggttccagtgtccccttttgcaaaggcctataagcctaaaacgtcgttgacagaaaacctgaagttccaccgtaaccagcccaaggtcttcactttagatctggaaaactttttccccagtataaagattgatctcgttgagaaggtgtttctggagcttggttacagtaagatggtcgccaacttactggctaaactatgcacacgagacaacgccctcccacaaggagctccgacatcaccctatttgtccaatttgattttcaaagaggccgacgccattatcgcagattactgcaagcagcagaaaattagatacactagatacgcagatgacctcagtttctcaggtgactttgacgaaaacaagcttttcgagaaagtaaccaatgtggtcgagaaacttgacctacgcattaataagtcaaaaaccaggctcatgacccccgataagaggcaaagcgtcaccgggatcgtcgtgaataataaaccccaggtagcatttaagaagagaaacgcgctgcgccaggcgatgtactacattaaaaagttcggaattgacgaacaccgggtgtacaaggagataaaacaagcaaactatctggagcacttactgggcaagattaactttatcctccagatcaatcctaaagacacagagtttatggaatacaaaaccctgctgttcgacttgaaaaaaaaggaggatcttaagatccgaaagcctctaccattgctggtgtga

SEQ ID NO: 9699 - RNA, 1038 nt, unidentified
  source 1..1038: mol_type = other RNA; note = synthetic construct
atgaaatttgaacagtacaaggaagctttcgagaaaaaagcaagcatttttgggtactccgaggacaatatacaactctgcttaatctatgccgaattgcttttcaaaaacaatgtccccgtcatttacaatacgtcacatctctctgcgctcgtgggctacaacaaggagtatttaaagaatgcaaccaaacacactccgtcgttttatagggatttccagattaagaagaagaatggaacactacggactatcagcgaacccttaccttcactgaaagagatccacatttggatcctggagaacatattggccaatgtgaagctgagcccatttgccaaagcttacagaaaaaaaatccgcatcttcgagaacttgaagtttcataagaatcaacccatcgtgtataccatcgacctgaaggacttcttctgcagcattaataccgatgctgtagaggccatcttcaagtccctgggctacagccttctgatctctaatctactagctaagctgtgtacgaaagataactcactgccacaaggggcacccactagtccatgtctgtctaacatcttttttaaggaaaccgacaatctgatcgccaactactgcctcgaacagaagattaagtatactcggtatgccgatgacctgagtttttccggtgagttcaatgaaaacgttctgctcgaattcgtcaaaaactccatcgagaaaattgggcttaagattaacgaggataagattcgtttgatgcgcacaggatcccgacagacagtgaccggcatagttgttaacgagaaacctcaggtagtgttctacaagagaaacaaacttaggcaggacctgttttatatcaagaagtttggccttgcgggtcacatgtctcatagaaaaatagagaaaaccaactacctggaacacctgctcggccagattaacttcgtgctgcagataaatcctgatgacaaggagttccagggatacatgacatatctcattgagttgaagaaactcagtgaaatcagggactga

SEQ ID NO: 9700 - RNA, 1035 nt, unidentified
  source 1..1035: mol_type = other RNA; note = synthetic construct
atgaactttgaacgatacaaggaggccttcgagaaggctgcctcaaattccggatatagtgaagagaacattaactactgcctaggctacgccgaggtgctcttccgcaataacgtccccgtgatatacaacacttctcatctcagcgcgctggtgggctacaagaaagaatatttgaagaaagccgttgtgcacaccccattcttttacagggacttccagattaagaaaaagaatggtaagcttcgcacgataagcgaacctctgccaagtctcaaggagatccaaacctggatactggactctatcctttcgaatgtgtccgtgtcaccttttgcaaaggcatataggaaaaacgtcgggctgttagaaaacattaagttccacaaaaaccagccccttgtgctgacaatggacctgaccgatttctttacttccgtaaaaacaaattccgtggaagagatctttagatcactggggtatagtgacttgatcgctaatctccttgccaagctgtgcacaaaagataatagccttcctcaaggagcccctacgagcccggccctatctaatttgttctttaaacccgtggacgagaggatcgcagcttattgtaaactgaatcacatccggtatacccgatacgctgacgatctcaacttctctggcgatttcgatgctgaaaaactgaaggcatatgtcaaaggtgcggtagagtcagttggcttgatggtcaacgactccaaaacaagagtcatgaagagcggtagtcgtcagctcgtgaccggaatcgttgtgaatgagaaaccccaggtagcatttcagaagcgcaacaaactccggcaggatctgttttacattaggaagttcgggttagaggaccacatgaagcggagaaaaattaagcaggccaattacctgagccacctgttaggccaggtcaactttatcgttcatattaacccagacgataaggaattccaggattacaagacttatctggtgggattgaagcaaactctggggcatgcttga

SEQ ID NO: 9701 - RNA, 1038 nt, unidentified
  source 1..1038: mol_type = other RNA; note = synthetic construct
atgacatttgaacaatacaagatcgccttcgagaaggccgctagcaatagcggttactcagaacttaacattaagaggtgtctggattacgcaaagccactgatcgagaataatgtgccgataatctacaacacatcacacttttccagtcttgtggggtacaagaaagcctatatcaagaaggcagtctattacacaaaatccttctacacggattacgctataaagaagaaaaacggaaagaccaggactattagcgagcctctcccaagtctgaaagaaatccagacctggatattacagaatatctttcagcagctcaaagtgtccccctatgcgaaagcttataaaagaaaggttagcattgtggagaacctcaagttccattataatcagcccaaggtgtttaccctggacctgaaggacttttttccttccattaaaatccactcagtggaacagatattcaaatctttagggtattcagacctgatctcgaatctgttggccaaactctgcactaaggagaattgtctgcctcagggagcaccgactagcccctatatctctaatctgtatttcctaccagccgataatcatattagtgagttctgcaagcaacactctattcgatacacccggtatgcggatgatttgaccttcagcggaaacttcgacgaaaacgctgttcttaactttgtcagtgagcagatcgtgaagctcgagctggtgattcatcccgacaaaattaaactaatgacaccaaaccagcgccaatccgtcacagggatcgtcgtaaatcaaaagcctcaagttgtgttccacaaacggaacaaggtccgtcaggagttgtactatatcaaaaagttcggccttgccaaccacatggaacgcaaaggtatcaagaagagaaattacttggaacatctgctgggcaaagtaaactttataattcagatcaaccccaccgacactgagtttattgagtacaaagagtacctcatcaagctgaaatctgaaatttctggccagacgtga

SEQ ID NO: 9702 - RNA, 1029 nt, unidentified
  source 1..1029: mol_type = other RNA; note = synthetic construct
atgaaatttgagcagtacaagcaggaattcgaaattaaggcatcacaaagtggatattccgcggagaacattactagatgtctcaattatgctaagcctttgatagataaggggttcccggttatttacaacaccagccatctgagcgttctggtcggctacagaaaagattacataaaaagggctgtggtctacaccccatatttctatcgcgatttcgagattaagaagagaaacggtaaaatgcggaaaattagtgagcccttgccgagcctgaaagaaattcaagactggatacttgtcaatatcctagaagtggaaaaggtgtcaccatttgcaaaagcatacaggaagaaagttggcctaatcgagaacgtaaagtttcacaaaaaccaacccaaagtcctgactctggatctgaaggacttttttccatccatcaagcgggagaatgtggaatctatattccgttcctttggctactctgccctcatctctaatctcctgtcgaaactgtgcacgcgcggagggtgtttaccccaaggagctcctaccagcccctacctgtctaacatattcttcaagtcagccgatgacattattatcaagtactgcctggccaatgatatccgatatacccggtatgccgatgacctttccttcagtggaaatttcgacgagaaaatgttaatcgaactggtcgacgacaccgtgaggcagctcggcctgactctgcacccagacaaaattaagatcatgaagcctaacgaacgacagacagtgacagggatcgtggtgaatgaaaaaccccaggtggtatttcacaagaggaataagttacggcaggagatgcattatatcattaagtttggcatccaggaccatatgcagcgcaagaacattaaatacagaaactacatcgagcatctcttgggtaaaatcaactttgttcttcaccttaatcctaaggatacagagttccagaagtataaagagcacttgatcgagctcaagaagcagacaatctga

SEQ ID NO: 9703 - RNA, 1029 nt, unidentified
  source 1..1029: mol_type = other RNA; note = synthetic construct
atgaacttcgagcagtacaaggttatatttgaaaaggaggcgtccaattcaggttactctgagacgaacatccggcgctgtttgacatacgccgaaatccttttcgccaataaagtaccggtgatttacaatacaagtcacttgagcgtcctggtggggtacaacaaacgatatctgaagcgggctgtggtctatactccctatttctatcgggactttcagatcaaaaagaagaacggaaaattccgcaaaatctctgagccactcccttccttgaaagaaattcagacctggattctagagaacattcttagcaatatacctatctcaccatttgcaaaagcctataagaagaacacctccatcattgaaaatctaagattccacgttaaccagccaaaggtatttaccctggatctcgagaatttctttccctcgatcaaaaccgactctattgaaagtattttcctcaatgtgggctatagcaagatcctcagtaatctgatggcaaaactgtgcaccagggataattctctccctcagggggccccaacaagcccctatctgtcaaatatatttttcaagcccgtcgacgatatcatttccagatattgcatcgacaacaaaattaggtacacgaggtacgctgacgatttatcattcagtggtgacttcgatgagaacagcttgatggagtttgttagcaatgtcatatctgaactgaacctgaccattaacaagaacaaaactcgcttaatgacacctaatatgagacagactgtgacaggcatcgtggtgaacaaaaaaactcaagttgtgttccacaaaagaaataatctgcgaaaggatatctactacattaaaaagtacggactccataaccatatgaagttccgtaatatcaagcagtccaactatcttgaacatcttctgggcaaggtgaactttgtcctgcaactcaaccccaatgacatcgaatttaagaggtacaagaactttctgatcgagctgaagaacaagatagagtga

SEQ ID NO: 9704 - RNA, 1041 nt, unidentified
  source 1..1041: mol_type = other RNA; note = synthetic construct
atggactttgatcagtataagacggaatttgcaaccctggcaagttccgtgggatatactgaacagaatatccagaaatgcctcaaatatgccaaacctctgctcgataagaaactccccgttatttataacactagcaatttgtcgaacctggttggatacaaaaaggagtacttgaaaaaggccgtgagatatacatctagctactaccgcgattttgaaatcaccaaaaataatggtgggaaacgtaaaatctccgaacccttaccttcactgaaggagatccaaatatggattctggataatatcctctctcaaatcgaaatctctccatacgccaaggcctataggcagaatgtgactctaattgagaatctgaaattccacaagaaccagcccaaggtcttcaccatagacctggagaatttcttcaccaccatcaaacaggacagtatacagaagatttttggagagatgggctactccaggctgatcagcaatcttttgtcaaagctgtgtacccgcgatgattcacttccgcaaggcgctccaacatctccttatctgtccaacattttcttcaaaagcctggacatagagatcactaagtattgcaacgagaataagattaggtatacccggtacgctgacgatctgagttttagcggtgattttgacgaaaagattctcctcgagtttgtaactgagaagatcacaaaggcgaaattagttattaaccccgacaaggtgaagctgatgaagaaaaacacaagacaaattgtcacagggattgtggtcaatgaaaaaatgcaggtggtgttccataagcgaaataagatccggcaggacatgttctacattaaaaaatacggcctagtaaaccacatggaacacttaaagataaagaagaacaactaccttgagcatttgatcgggaagataaactttatcctgcatattaacccaaacgacaaagagttcatcgattacaagtccttcctcaacgaccttaagaataaagtcaacaaaacgaatgcctga

SEQ ID NO: 9705 - RNA, 1032 nt, unidentified
  source 1..1032: mol_type = other RNA; note = synthetic construct
atgaccttcactcaatataaacggaaattcacagcagaggcctttaagtcggggtattctcagcagaatattgataggtgtctagtttatgctgaacgtcttttttccaataaagtgcctgtcatctataatactagccacctttctggccttgtagggtaccgaaagagttacttgaagaaagctgcattattcaccacgtacttctaccgggacttcgagatcctgaagaagaatgggaagaagaggcagatatccgagcccctgccatcactgaaagagatacagttgtggatactcgagaacattctgtacaaagtcaagatctctaaattcgccaaagcttatatccccaaggtcaatttgaagcagaatctcaagtatcatgtgggaaaaccactgatcctggcgatcgatattgaaaacttctttcctagcatccgccagaacaacgtggaaaagatttttcaggagctcggatactcaaatcttatctcaaatcttctggccaagttgtgttgcaggggagaaagtctcccccagggcgcacctacaagcccgtacttgtctaatatctacctcaagccactggatgatgacgtgtccgaatactgtctcgagcggaacatccattatacccgctatgccgacgatctcaccttttccggtatgttcaacgataaagaactgtgcaaatacctgcacatagagatcgagaagttaaacctgaagatcaataacgacaagacgaaggtgatgacaccaaataccagacaaactgtaactggcattgtggttaatgaaaaaccgcaagtgtgctttgtgaaaagaaacggtattcgccaaaccatctattacatcaaaaaattcggcctagaaaaccacatggacagaattaagattaagaagcagaactacctgaaacatctcttaggccaggttaacttcgtcctatttataaaccccagcgacaaggagtttattgagtataaaaactacctgcgaacactgattattcaccctctgagttga

SEQ ID NO: 9706 - RNA, 1023 nt, unidentified
  source 1..1023: mol_type = other RNA; note = synthetic construct
atgagcttcgaacactaccagaaagaattcactagcaaggctgttaactctggctactctgaacagaacattttcgactgcttagaatatgccaagaaactcatcagtaacaatgttccagtgatctacaacaccacgaatttgtcagcactggtaggttacaaaaagtcctaccttaaaagggccgcaatctataccccttacttctatcgcgagtttgacatactgaaaaagaacggcaaaaagcggaaaatatctgagcctttgcccagtcttaaggagatccaactctggattttgaacaatatcctgtacaaggttgaagtgagtaagtttgccaaggcatatattccaaaggtgtcgatcaagcagaatctcgttttccataaaaaacaagcgaaagtgctcacaatagatctcgagaatttttttccttccattaagatcgatcaggtaatagtgatctttaagagcctggggtatagcaacatcattagctccttaattgctaagctctgctgcctgaacgattgtctgccccagggcgcttccactagcccatacttatccaacattttccttcgaaactcagacgatattatctctaagtattgtctcggaagaaatattcggtacactagatatgccgacgacatgaccttttcaggagattttgacgaggtcgaactgctgaaattcgtcaggacagaaataaaaacactgaatctgcaggtgaacgacgaaaaaacaaaactgatgctgccgaactcacgtcaggtggtgaccggaatcgtggtcaacaataaaccccaggtcgagttcaataaacgcaataagattagacaggagatgtactacatcattaagtttggtttggagaatcacatgaataggaagaacattaagaaggccaactatgtgcctcatctactggggaagatcaatttcatcttgcaaataaacccccttgataatgagttcatcgagtataaaaagcaccttaaggctctaaccctggtctga

SEQ ID NO: 9707 - RNA, 1044 nt, unidentified
  source 1..1044: mol_type = other RNA; note = synthetic construct
atgaatttcgaacagtactccctggcatttagcagggaggcatcgcagtccggatacactgagcaatctatcatccgctgtctcaaatatgctgaaaagttgttcagcaacaaagtccctgtaatttacaataccagccatctctcagttctagttgggtatagaaaaaactatctcaagaaggctagcttctatacaccatacttttaccggaacttcgagatcctcaaaaaaaacgggtctaagcgtattatttctgagccgctgccaagtctgaaagagattcagatttggatcttaaacaacatcctgtacaatatcgaagtttcaaggtttgccaaagcgtatattcggaagtcccacataaaacagaacctggtcttccataaaggccagttgcaggtactcaaactcgatattgagaacttctttacttctatcaagctaagctcaatacaggatatatttatgtcggtgtggtattcccaactgatcagtaatcttctcgccaagctgtgctgtcaccggggctctttacctcagggaggtcccacctccccctatctttcaaatttgtacctgaagagtgtggacgagagcatctatcactactgcatgcagaaagaaatccgcttcaccagatatgccgacgatatgacattcagtggcgtctttgaagagaaggggcttataaagtttgtgacagaggaactgcggatccttgacctgaagattaacgaaaaaaagacgaagatgatgtccagatccagcaggcagttggtcaccggagtggtggtgaatgagaaactgcaagtgcccttttacaaacgcaataagctgaggcaggacctgtactacatcaaaaagttcggcctggaaaatcacatgcaacgccgaaagattactaagtcaagttatatcgagcatctgctaggtaagataaatttcattctcagcatcaaccaggaagatcaagagtttttgtcttacaagaactaccttattgagttaaagagaaagtcccgtgagatccgacctgaatga

SEQ ID NO: 9708 - RNA, 1032 nt, unidentified
  source 1..1032: mol_type = other RNA; note = synthetic construct
atgtcgttcatcgtttatgaaaagctcttcactgcaaaagccgtgaaggcaggcttttcccaggacaatatccaaaagtgtttagcatacgccaagcctctgatcgataaggggctgccagtcatctataatacggctaatctgtgcgctctggtgggctataacaaaaactacctgaagcgtgctgctctgcatacccagttcttctataggaagttctttatccggaaacggaacgggaaagccaggttaatcgtggagcccctgccaagcctaaaggagattcagctgtggatcctgcacaacatactatacgaagtcaaggcgtctagatacgcgaaagcttatattaaggggaggaatattgtcgacaacgtacgctaccacagggaaaaagacattgtgctccgcatagacattaaggacttctttccttctatcggcttttccaaaattcagcttctgtttgagcagctcggatactcatccaacatcagcaacttactcaccaagttgtgttgcgtgtatgagacacttccgcaaggcgcccccacaagtccctacctaagcaacttggtccttaagaactttgataaacgacttgctgagttctgcgtagcaaagaatatacggtacactagatacgccgatgacctgactttctctttcgcaaagacaatagaccccaatgaggtccgcctgtttgttgaaaatgaactttcaaaagagggtttcagcgccaatcctgataaaactcagatactgacacctaacaagcggcagattgtgaccggaatcgtggttaacaaggtgctccagatcccaaaaattgatagaaagctcattagacaggaaatgtactatatttccaagtttggtttgcgagatcatatgaaaaagacgcaaaataccaaggccagttatctgctgcacctcttgggaaaaaccaactacgccctccagatcaatccagaggacaaagagatgaagaaatataaagccatcatctggcagatgttgaatcaagaatga

SEQ ID NO: 9709 - RNA, 1050 nt, unidentified
  source 1..1050: mol_type = other RNA; note = synthetic construct
atggattttctggagtataaggtgaagttcgtgaagaaagcgctggaagcgggttactctgaggttgaaattgaccagtatcttacctacgccaaagtgttgcttgacaagaagcttccactcatctataatacctcacatcttgcagccctcacggggtacagtacacgctatataacaagggcagctctgtacccaaaaagcttttacaggacgtttaagatcaagaaaaagaacggcaaaatgcgcgagattaacgagcccttaccttcgctgaaagagatacagctctggattaacaagaacattctactgaacatcaagcctaacaaattcgccaaggcctacattaagaaaaccaacatcctggataatgtcaagtaccacaagcggaagaagtatgtgttcaatctagaccttgtcaatttcttcccctctatcagcactaaaaccgtggagatgttctttaagaaactgggctacagcgataacctgtctaaccttttggcaaaactgtgttgctttggggacggcttagctcaaggagctccaacatcccccgccctgagtaatcacatcttgtatgaatttgacgatctactcggaagtttcgcagtagagaataacctgaggtatactagatacgctgacgatttgactttttccttcaatgatgagtttgacgtctccataatcgaagagaaggtgattaataccctcgacaagacagtgctctactcaaaactcactgttaatcgggaaaagaccaaactgctcagacagaatgatcgacaaatcgttaccggggtcgtcgtaaatgataaaactcaggtgccgtcttcatacaggaagcagatccgtcaggaaatttattacatccgaaaattcggtctgagcaatcacctgaatagactgaacgaagttcgctataactatctctatcatttgctgggaaagattaatttcgtgttactggtgaacagcgaagacaaagagatgaaagagtaccggaacgccatcaagatgttgatatccaacagacctacatga

SEQ ID NO: 9710 - RNA, 1089 nt, unidentified
  source 1..1089: mol_type = other RNA; note = synthetic construct
atgtttaaaggcccagcacgaaagctggcaggcttaaatgagatcaacatgaccgccgcacagtatgaatctgctttccgcaagaaagccctggtggctggttacagcgaggagaacatccagaaatgtctgagctatgcaattccactcctatccaaaggctttcctattatctacaacactacaaacttcgccggactggtcggttataacaagctataccttaaaaaagcggccctgttcaccgctagttattaccgtaccttcaaggtgaagaagaagaaaaagaaggactacagggagatcaaggaacctctccccagcctgaaggaaatacagttgtggatcctctataatatactgtaccaagaaagaccctcaaagtacgctaaggcgtacattcagaagaggaatctgagagagaatgttaagttccacgtgggcaaaaacaaagtcctgaatttggactttaagcacttttttccgtctattaaacaggacgcaatagagaagattttcctgtcatttgggtattctagcaacatttccaacttactatcgaaactgtgctgtctcgatggcagtctgcctcaaggggccccgacatcaccttacctttccaatctgtacttaaagaccttcgacgaagatgttttcggcttctgcaaaaataaacacatccgctacacacgatacgctgacgatatgacatttagtggggacttcaatgaactcgaggtgataaacttcatcaaagagaagatcgaagatagcccccttgaaattaacgacgaaaagaccagagtcatgaggcgcaatcagcggcaggtggttactggaatcttggtgaatgataagacgcaggtatctaaaaagtataggaataacatccgtctcgagatgtactatatcagcaaatatggaattgccgagcatttggccaaaagtaagaattcccgggccaactatttgtcacatctcctggggaagattgaatacactcttcattttaacccagatgacgtagagtttctcgagtatcggtccaaactgaagcaactgcttcccaagaaacaggatgctgagtga

SEQ ID NO: 9711 - RNA, 1035 nt, unidentified
  source 1..1035: mol_type = other RNA; note = synthetic construct
atgaacttccagcagtattctgaggctttcagaaagaaggctttggcggccaccttttctgaggatgagattatttactgtttggattacgcaaaaccgataatcgaaaaaggccttccagtagtttataatacgacacacctggcagctctggttgggtatagaaaggtttacttaaaaaaggcagtcctctataccagttacttttacaggagattcgtgatatcgaagcgaaacggcaaacctcgcacaattagcgaacccctgccatcactcaaggaaattcagatctggatcctaaagaatatcctcgagaatctgcctgtgtctaaattcgcaaaggcctacctggccaaaaaagatgtgcgcgacaatgtgcggtatcacataggcaagccaatagtgttgaagctagacatcaaggacttctttggaagcattacacagcagtcagtccagcaaatctttctggatgccaactattcatccaacatcgcgaatttatttagtaaactgtgcacccttaggggcacgctccctcaaggggctagtacctctccttacctgtccaacctcttcatgaacaaatttgacgaggtcgtaggtggatatgccattaaagagaagactaggtacactcgttacgctgacgatctgaccttctccgggaattttaatcccgacaacgtcatcgaatttgtgcagacagaaatagagaaaatcggtctgagactgaacctgtccaagaccgccgtgatgcggcagaacagccggcagtttgtgactgggattgtcgttaacgagaagatgcaagtaccaaagaaggataggcaaaatctgcgccttgaaatgcacttcattcagaaattcggattagagaatcatttgcgacgtgtgaagaataagaaagccaactaccttccccatattatcggccggattaattacttcatcactatcaaccccgacgacgaggaattcgtgagctacaaaaagtatctcatcgaaacctatgtgaatgagaacctcacatga

SEQ ID NO: 9712 - RNA, 1068 nt, unidentified
  source 1..1068: mol_type = other RNA; note = synthetic construct
atgggccccgagatatcgttctggcctcataagaagatgaatttcagccagtatgagaagaccttcagaatcaaagccactaagatcgggttttctgaggaagaaattactgcttgccttaattacgccgaacctttaattagcaacaaactccccgtcatatactctaccgccaacctggccgctctggtgggttataagaccaattaccttaaacgcgcagtgaagtttaccaagtatttctatcgagacttccagatcaaaaaaaaggatggcaaattgaggactctgtacgaacccctaccttccctcaaggagatccagtcatgggtgctgaaaaacatcctgtccgaggttaaacccaacagattcgctaaggcatacatcaagaacaaaagtctgattgagaacgtgaagtatcacaaaggacgcgagggagtcctcacattggatatcctggacttctttggcagtattaagacggcccacgtagccgggatttttagcgaaatggggtactctgctaatatcgcatctttattggctaaactgtgtacatacgatggatacctgccacaaggcgcgccaacctccccgtacctgagtaatctctatctgaagaacttcgacgatatagtgtccaagtactgctcagagaacaatattaagtatacacggtacgcggatgacatgacgttttcagggaaagaagaggacctgaatatcactagctttatcgaggttcaacttttcaatattggcctgtatctgaactcagataaaagcaagcttatgaaacggaacgagaagcaggtcgtgacaggtatcgtagtgaacgacaaactacaggttcctcgtgaggatcgggactttattaggaatgaagtccatttcttgacaaagtttggactcaatgaccacctcaataggaccctcaacaaaaaagccaattacattgaacaccttctgggtaagattaactttgcattacatatcaacccagatgacttgaagatgaagagatataaggcaaaggtgatagaatatgccaaatccatcgaggaatga

SEQ ID NO: 9713 - RNA, 1032 nt, unidentified
  source 1..1032: mol_type = other RNA; note = synthetic construct
atgaacttcgcccagtatgagaagaaattccgcttaaaggccttaaaatctgggttttctgaggataacatcgtggcctgcctcaattatgccaaacctattctggagaagggactgccggttatttacaacacggcaaatctggctgccttggtgggttaccggactacatacctgaagagagcagctaaattcaccaaattctactatcgcagctttaccataaaaaagtctaatggcaaactcaggacactcatggaacccctgccttccttgaaagagattcagacatggatattggaaaatatgctctcagaaatcccagtgtcaaaatttgcaaaggcgtacgtcaagcaccgttccctaaaggagaatgtgaaacatcacaacaacaaggaaggcgtgctcacgtgtgacattgcaactttttatgacagtgtcagattcaaggatatcgaaaagatctttaacgagctggggtattccgaggtgatgagcaatctgcttgccaagctgacaacattcaatgggagtctgcctcagggcgcgccaacctctccctatctgtcgaatcttgtcctgcgggagttcgaccagaagataagtgactactgcatcaataacaacatccggtataccaggtacgccgatgatcttacatttagcggcgaggtaaagtccctcaaactaaaaaacttggtagaagctgaacttaacaagctgggtttagagctgaacccagataagaccaaactcagaaagtttagccagaggcaaatggttaccggaattgtggttaatgagaaaactcagatacccaaattcgaaaggaacttcatccgaaacgaagtgcacttccttacccgctttggactcaaggaccatctgcggaagactaagaataagagagagaattacttgctacatctgctgggcaaaatcaactttgctctgcacattaatcccgctgacaagaagatggagtcataccgaagccaggtccaaaaaattatccaaactgatgccgggtga

SEQ ID NO: 9714 - RNA, 1041 nt, unidentified
  source 1..1041: mol_type = other RNA; note = synthetic construct
atgacctttccccaatatgagaagaaattccgggtcaaggctattaaatctggctttagcgagtatgaaatctccgcatgcttgctgtatgcaaaaccactgatcgagtcgaacttgcccgtcatttttaataccgccaacttcggcgccctcgtagggtacaagacaaattacttaaaacgggctgtgaagtacactccatacttttaccgcgcttttactatccgcaaaaagaacggtgggtcaagggagctcgtggagcctttacccagcctgaaggagattcagacctggattctagaaaacattctcagagaagtgaaggttagcaagtatgccaaagcgtatgtgaaaagtagaacgcttctggaaaacgtgcgttatcacaagggaagggaggcagtcctcaccttggacattgaaaatttcttcggatccatcacactgctccatatcgaacatatctttctgggcctgggatactcaagcaacatctccaatctattagctaaactctgtacctatgagggtgtgctggctcaaggggcacctacgagcccgtatctttccaatttgtacctccgacgtttcgatgagatcatctctaaattctgcaaccagaatgatatcaggtacactagatacgccgatgacctgactttctcaggccagaaggacgccctcgacatagtggaattcattcgcaagacactgcaaaagttttcactgaagctgaacaaggacaaagaaaaattgatggtcagaaaccagaggcaggtggttaccggcatcgtcgtaaatgaaaaacttcagattccaaaagcggcccggaatttcatacggaacgagatcttctttatcaaaaagtttgggcttgacagtcacctggagaaaacagataacaagaaatctcactacctggagcatctgataggaaagataaatttcgcccttcacataaaccctaatgatctaaagatgcagagttacaagtctatcgttctgaagatttatcagtcccgagatgaggacaagatttga

SEQ ID NO: 9715 - RNA, 1020 nt, unidentified
  source 1..1020: mol_type = other RNA; note = synthetic construct
atgacgaaccagcaactgtacgcaaaaaaattcaccgagaaggccatcgaaaacggatttagctctgattatatcgagaagtgcctttcatatgcctcccccctcctggaaaataatctgccagttgtctacaatatcaaccatttgtcgggactggtcggctacaatgttagctatctgaaaagggccgtgaaatttcctaagtatttctaccgtgagtttgagattgagaaaagtaacgggaaaaagcggaaactgcatgagccactcccttcattaaaagaaatccagctttggatactagacgagattctctataagctaaaagtcagcagatatgcgaaagcctacgtgcccaaacggagtattaaggagcacacaatataccacacagacgagccgttcgtacttaccctggacatcaaaaacttcttcaactccatccagtttgattcagtggagtccctctttaaaaagattggatactccgaaaagatggctaacctctttacaaagctgtgctttcgcgacgacgaactgccacaaggcgctcctacttccccctacattagtaatttgattctgaaggacttcgatttcgccgtgtcaaagtactgtatggaacacaatatcaagtacactcgatatgcagacgacttagctttctctggggatctcaacgctgaagaaattgagaaacttatcaaggatgaactgtctaagattggtatggagcttaatgatgagaagagaaagttgatgaaacccaatcagccacaactgataagcggtatcatagtgaataagaaggcacagctgccgaagaagatcaggaattctctacgaaacgaaatgtactatatcaagaagttcgggctgcccagccacctcgagagaaccaaccagaaaaagcctaactatttgaagcacctcatgggccggatcaattatattctgcagattaaccctagggataaggaatttatcgagtaccgcaaacatttgcatgagttaaaatga

SEQ ID NO: 9716 - RNA, 1020 nt, unidentified
  source 1..1020: mol_type = other RNA; note = synthetic construct
atgaataatcagcagttatacgtccggaagtttaccgagaaggcttcagagaacggtttctcatcagattatattaagaagtgcctgtcctatgcaaatccgctgctggagaagaacctcccagtagtgtataacattaatcatttgtccggcttagttggttacagtgtgtcttatctgaagcgtgccgtaaagttccaaaagtacttctatagggaattccagatcgagaagcggaacgagcagaaacggacgctatacgagccactgcccagcctcaaagagatacaactgtggatccttgatgaaatcctttataagctcaaggtgagcaggtatgcaaaggcctacgttcccaaaagatccattaaagaacacaccatgtaccataccgacgaaccgtttgtgctgactctggacatcaaggaattcttcaagtctatcaagtttgagtcggtcgaaagcctgtttcgaaacatagggtactccgaaaaaatgtccaacttgttcacaaagctctgttttagagagaatgaattaccccagggagcgccaacaagtccatgtatttctaacctgatccttaaggactttgacaatgccatctctggatattgcatcaagaatgaggtgaagtttacacgctacgccgacgatttggctttttcaggaaatctgaatgctgaagaaatcgagaaactcgtcaaggatgagctgagcaagatcggcctggtgctaaacgatgaaaaacgaaggcttatgaaacctaatcagcctcagttgattagcgggattattgtcaacaaaaaaccccagctgcctaaaaaagttcggaatagtctcaggaacgagatttactacattaaaaagttcgggctaaccgatcacctggagagaactaaccagaaaaaacccaattaccttaagcatctcatgggcagaatcaactatgtgttgcaaataaaccctcgcgacgaggaattcatagagtataaaaaatacctccacgagctgcgctga

SEQ ID NO: 9717 - RNA, 1029 nt, unidentified
  source 1..1029: mol_type = other RNA; note = synthetic construct
atgaataatcaacagttatatctggagaagttcacacaaaaagcattggaacacggtttcagctccgaatatataaacaaatgtctctcctacgccaaccctctactagagaataatttacctgtcatctactctatcaaccatctgtcaggattggtagggtatagcgtgtcctatttgaagcgggctgtgaaatttcaaaaatacttctaccgcgagtttgagatcaaaaagaggaatggtaagaataggacgctctatgagcctctgccatctctgaaggaaatccaactatggattctggatgagatcctttacaaactgaaagtgtctcggtacgccaaggcgtacgttcccaaaaggagtattaaggagcacaccatctatcataccaatgaacccctggtcttgactctggacataaaggagttctttaacagcatcaagttcgagagtgtggagtatctgttcttttcaattgggtatagccgcaaaatgagcaacctctttgcaaagctgtgctttagagaaaatgaactgccccagggagcccctacatcgccgtacatcagtaatcttatccttaaggacttcgacaccgaagtgagcaagtactgcatgaagaacaagattaagttcaccagatatgctgatgatctggctttttccggcaatttaaacgccgaagagattaagaagctggtgaaaaaagagctttccaaaatagggctggagcttaatgaagagaagacaaaactcatgaaaccaaaccagccacagatcatatcaggcattgtcgtaaacaaaaaggcacagctgccaaaaaagattcgaaactcactccggaacgagatgtactacattaagaattatggactggcctctcacattgaacgtactaaccagaagaaatctaactacttgaagcatctcatgggcaaagttaactacgttctccagatcaatcccagagacgtggaattcaagaagtacaaggagtatctccaggaacagtacaaaagttcctga

SEQ ID NO: 9718 - RNA, 1020 nt, unidentified
  source 1..1020: mol_type = other RNA; note = synthetic construct
atgaacgaccagcaaatctataccaaaaaatttaccgagaaggctctggagaatggtttttcaagcgactacatcaagaaatgtctcaactatgccaagcctattttggcaaataatctgcccgtcatttacaacatagaccacttttccaacctagtgggctataatgtcagttaccttaaacgagcggtgaagttccagaaattcttttacaggaagtttgagatcgacaaaaggaacggtaaaaaacggatcctgaatgaaccattaccgagccttaaggaaattcagctctggatcctcaatgaaatcctatataagaacaaggtgagtagatacgccaaagcctatgtacctaacagatctattaaggagcataccatataccacacagatgagaagttcgtattaactttggatatcaaggagttcttcaagaatatcaagtttgaattcgtcgagtctctgttcaagtctatggggtactcccggaaagtttccaatcttctgactaagctgtgctatctggaaaaagagctgccacaaggggcttcaacctcaccctacattagcaacttgatactgaaggattttgacaacgttatctccaactactgcatttctaataagatcaagtacacacgctatgctgatgatctcgcattcagcggaaacctgaacacagacgaaattgggatactggtgaacaaagaattatccaagattggactggagctgaatgatgagaagacgaagctgatgaaaccaaatcagccccagcttattagcggcatcatcgtgaataaaaaggcccaactacccaagaaaatccggaactcgttgcgtaacgacatgttcttcataaaaaagtttggactcgtgaatcatatggaacgcacaaatcagactaagagtaactaccttaaacacctcattggcaggatcaactatgtgctccagattaatcctagagataaggagtttatcgagtaccgaaaatatctgtatgacttgaaatga

SEQ ID NO: 9719 - RNA, 1035 nt, unidentified
  source 1..1035: mol_type = other RNA; note = synthetic construct
atggagaaagcctttgataagtataagaagcagtttgtcaccaaggcccgaaaaaacgggttctctgaagacaatattaataaatgcctcgactactccaagccgcttattacaaaggatctaccagtcatctataacacaacacatctctctcagttagtgggttataacttaatttacctgaggcgggcggctagattcactaagtatttctatcggtctttcaaggtgctgaagaacgataaaacctatcgcacaatatccgagccacttccctcattgaaggagatacagatttggatcctgaaggagatcctgtacaaaaacaaagtcagtaagtatgcaaagggatacgtgcctaaacggagtattaaagaccacgtgcggtaccacaccaaagagagcaaagttttgactctggacattaagaacttcttcgattccatcaagattgactacaccctgaaaatgttcattcaaatgggatattccaagagtgtaagcaatctgctcacccagttgtgttatctggagaaggggctgcctcaaggagcccctactagcccatacatcacgaatgttctgctgtacgaatttgacgaatcaatcgctaaatactgcaggcaaaaagaactcaaatacacgagatacgccgatgacttggcttttagcggtcagatcaagaaaaccgaattgataaagcttgtaagatcagagctgaggaaaattggccttaagctcaacaacgacaagatcattctgatgaaacgcaatcaaaggcagacaatctctggcatcgttgtgaatgacaaaactcaggtgcccaaatataagagaaacagcatccgtaacgaaatgttctacataaagaagttcgggttaaataaccaccagaaacgtaccaatcagactcgagataactatctgaaacatcttatcggcaagataaattacatcctgatgctaaatcccaaggataaggagtttctcgattacaagaagtacctctatgagcagaataaagcatcgcgctga

SEQ ID NO: 9720 - RNA, 1050 nt, unidentified
  source 1..1050: mol_type = other RNA; note = synthetic construct
atgaacattaccttcaacaagtacaaaaagctcttcaccgaaaaggctattaacagtggctattctgaggataatatcgtgaaatgtctctcttatgccgagccaattatcaataaaggcttccctgtcatctataatacaagccatctgtcatccctggtgggatacaataaaaactatctgaaaagagccgtgaatcacacaaagtacttttaccggaaattcgaaatctcaaaaaaggatggtactaagagggttttgcttgagcccctgccttctctgaaggagatccagaactggatcctgaacgaaattctctacaagcacaaagtttcgcgttatgctaaaggatatattcccaacagaagcattaaggatcatgttcgctaccatacaaaagaagagaaggtgctgaccctggacatcaaaaagttctttgataatgtgagcttcgaattggtggagaagatctttattcacattggatactccaagatcatcagtaacctcttaactaaactctgctttcttgacggcaaattaccccaaggcgcgcctacatccccatatatcagtaacatcatactgttcgagtttgacgagaagatatcaaagtattgctccaacaataacctcaagtttacgcggtacgcagatgaccttgcatttagcgggaagatcaaaaaaactgaactggtcaaacttgtaagatctgagctgaaggccttggggctaaagcttaataatgagaagatcaagctgatgaaacgcaatcagccacagattattagcggaatcatcgtcaatgaaaaagcacaagtaccgaagaggaccaggaaccagatacggaacgaaatgttctatattaagcgattcggtatagactcccatatgcagaaaactaatcagaccaaatcaaagctcgcttacctgaagcacttgattggcaaaatcaactacttactgacgataaaccccaaggacaatgagtttattgagtacaagaacatcctacacaaagaaataaagcctgccgggaataatgtgtga

SEQ ID NO: 9721 - RNA, 1059 nt, unidentified
  source 1..1059: mol_type = other RNA; note = synthetic construct
atggactataacaaatataaaacgcagttcagcgcgaaggccaaaaatgcaggttactctgaagataatatcagtagatgtctggcctatgcaaaacctattctcgaggagggctacccagtgattttcaacaccacacacctgtcttccctcgtgggctacaataagaactatctgaagcgagctgtagcctaccaaaagtatttctaccgggaattttccattaccaaaaagaacggggaactcaggacacttagagaacctcttccaagtttaaaagaaatccagtcctggattctgaacaacatattgtacaaacacgaggtgagccggtacgctaagggctatattcccaagcgaagcataaaggatcatgccaagtaccacacgaacgaactaaaagtcctgaccttggatatcaaaagcttctttgactctattagcttcggccaggtagaggccatcttttccaatatcggatactctaacatcgtttcgaatctgctggcaaagctgtgttttcttgagaagaatttaccgcagggtgcacccacttccccctgcataagcaatattcttctactcgaatttgacaatgtgatctctgcttattgcagtgagaagaaaattaagtacaccaggtatgccgacgatctggcgttttctggggacgtgaagaagactgctcttatcaaattggtgcgctccgagctaaaaaaactgggcctcagattaaacaaccaaaagatcaagctgatgaaacagtcacagccacaaattatctcagggatcatcgtcaataagaaagtccaggttcccaagaaaaaccgtaataagatacggaacgagatgttttacataaaaaagttcggattccagtcacatatggagaagacaaaacaaaccaagtcaaattacctcaagcatctgatcggacgcattaactatttgctcactttgaaccctaaggacacagaattcctggagtacaaaaagatcctgtatcagctggagagtactgccgataattccacccagatgtcgaataggcctagctga

SEQ ID NO: 9722 - RNA, 1083 nt, unidentified
  source 1..1083: mol_type = other RNA; note = synthetic construct
atgaaggactttacgaagtataaaaagaagttccgcgaaaaggccgaagatataggttttagcgaggacaacatcgtgaaatgtctcaactatagtgagaagctgagcaacaacaatctgcccattatctacgattcaagccacctcgctgggctggtcgggtaccatcgatcttatctgactcgtgcactaatttccaccgaatttttttatcgcacgttcaaaatcccaaagaaaaatggcaaaatccgaattatctctgaacctttaccctccctgaaagagattcagtacttcatattgaacgagatcctgtacaaacagaaggtttctaagtactgtaaaagttacatcccaaagcggaagtttagagagtatcttaggtttcacactgatgaaaagcaagttctcacactggacataaaggatttcttcccttccattaaattcaaccatatccacgaatacttcctgaatcttggttttgcaaaggacgtgtcactgtatctcgcctgcctaagtacctatacccacaaagaaaatgactttattgagttcaagcggttccttcctcaaggcgcccccacttcaccatatctgtcgaatttgatcttaaccccttttgacgataaagtcgctgaattctgcttcgacaagaagataaaattcacacggtacgcggacgacatggcttttagcggggaatacatcgaccaggaggaacttttgatattcatcaagaacgagcttaatgtatacggactagagctgaacgaggaaaaaattaacttcatgaagcagaatgtgccacagataatcagcggagtgattgtcaataagaaactgcagttacccaaagcccagaggaacgagatcagaaaggtgatgtactttattaacgagtttggcattgataaccatctcgaaaaaacaaacgaaaccagggagtactatctgtcccacctgctgggaagaattcagtacgccctcaatttgaatccggatgattccgcaatgaaagagtataaaaaccagatcatcgagatcaagaatgagcaaaatttgaagttcctcattgagtga

SEQ ID NO: 9723 - RNA, 1077 nt, unidentified
  source 1..1077: mol_type = other RNA; note = synthetic construct
atgaaggattttgagagttataagaagatcttccgggaaaaagcactgaactctgcctatagcgaagagaacataatcaaatgcctgaaatacagcgagaatctggtgaataacaacctccccattatatacaattcatatcacctcagcgggctggtcggatatcaacatgattacctttctagggcaattttgtccaccgaatttttttatcgtcacttcaagatcgagaagaagaatggcaaatccaggaagatttccgagccgctgccttccctgaaagaaatccaatacttcatcctcaaagagatcttgtacaaacaaaaagtgtctaagttctgtaagtcctacattcccaaaaagaagttcaaggagtatttacgattccatagcaacgaaaaagaagtcctcacactcgatatcaaggactttttccccagcattaagttcaacctaatccacaactatttctcaaagatcggttatagtaaggacgtggctttatatctgtcttgtctgtgcacttacacggacgtgaatgtggaaaagaaaaacaatacatccatccggtacctacctcagggtgcaccaacttcgccctacctgagcaatctggtcctcatagactttgataatgacgtagccaactattgctcagagaaaaagcttaaatacaccagatacgccgacgatatggcgttttctggagatttgattgttaagaacgagttagtggaatttgtaaatgcccagctgaaaaaatacaatctggagctcaacgatgagaaaattaattacatgaagcagaacgtcccacagatcatcagtggggtcgttgttaacaaaaagttgcagctgccaagaaaggagcgcaacgacatcaggaaggtgatgtacttcattataaaatacggcatcgagagtcatattgaaaaaacccaggaaacacgcgaatattacatttcatatctccttggcagaatacagtatgctcttaacctgaatcctaatgacgctgagctaaagaagtacaaagactttcttgtggagttgaagaagaatattctgatcctgtga

SEQ ID NO: 9724 - RNA, 1080 nt, unidentified
  source 1..1080: mol_type = other RNA; note = synthetic construct
atggacctggaactctataagcgacattttcgtgagaaggctctgaatagcgggtttagcgaggagacaatcatcaagtgtctcaaatattcggaggtgctagcatctaagaatctgccagttatctacaattcgtatcaccttgctggtttagttggctacaaacacagttacttgagcagggccataatttccaccgactttttctaccggaaattcaagattcagaagaaaaacgggaaatatagggagatatcagaaccccttccatctctgaaagagatccagtacttcatattgaaggagatcctctataagcagaaagtctcaaagtattgcaagtcctatatacccaagaagaaatttcgggaatacttaaagtaccacagcaatgaaaaacaggttctcaccctggatataaaggactttttcccgtcaatcaaatacgagttcatctacacatactttatgaaccttggctacgcaagagatgtatcctatttcctggccaccctatgtagctatgtgccaaaagcgcccaaaggagaaaagacggatctctccaagcgattcctccctcaaggcgctcctacatccccctacttatcaaacctcatcttgtctaactttgatgaccttgtagccaaatattgcaatgagaataagctgaagtacactcggtatgccgacgatatgactttcagtggggatatcatccaagaagacgaactgatttcctttgtgcagagcgaactgaataaaatcggcttgaaactgaacattgataagatcaacttcatgaagcagaatgtgcctcagattgtgagtggtgtcattatcaataaaaaggtgcaactgaccaaagaggacagaaataaaattcgcaacgtcatgtactacatttctaaattcggcctggaggatcatttgaacaggactaacgagaaaagagactattttgtgttccatctgctcggaaagatccagtatggactgagcctaaaccctaacgaccacgaacttaaacgctacaaggagattctgattgaggaaaagaagaagtattacagtaagtcttga

SEQ ID NO: 9725 - RNA, 1077 nt, unidentified
  source 1..1077: mol_type = other RNA; note = synthetic construct
atggtggatttcgagttgtataagaaacactttagggaaaaggccctgaatattggctttagcgaagagatcataatcaaatgtctcaactactcagaaaacctcgtttccaaaaagcttccaatcatttacaactcctaccaccttgcgggcctcgtggggtatcaacattcatatctgtctagagccatcaactctacagagttcttctaccgcaagttcaagatacagaagaaaaacggtaacttccgcgaaatctccgagccactcccttcattgaaagagattcagtatttcatcctggaagagattctgtacaagcaaaaggtgagcaggtactgtaaatcttacacccccaagcgcaaatttagggaatacctgaaataccatacgaatgagaaacaaatcctgactttggacattgaggatttttttccgagtatcaagttcaacaacatcttcaactactttctggcattgggatatgcaaaggatgtatcctattatcttagcaatctgtgcacatacgtgactaaagggaagaagggacagcgagtcaatataagcaatcgttatctgccccagggtgcccccacaagtccatacttatctaatctcattctgagcgaatttgacgattcagtcgctaagttctgcatccagaatcagctgaaatataccagatatgctgacgatatgaccttttcgggaggaaacattaacaaagaggacctcattacttttatcattgtggagctgaataagatagggttaagactgaacattgagaagacaaatttcatgaagcagaacgttcctcagataatcagtggcgttatcgtcaataagaaagtacagcttcccaaggccgaacggaacaaaatcaggaacagtatgtactacatttccaagttcggcttggaagaccatctaaaacggaccaatgaggagcggaattactacgtgtttcaccttattggcaagatacaatatgggctatctctgaatcctgaggacttagagctgaaacgatataaggaaatcctcatcgaggaaaaaaaaaagtactatagctga

SEQ ID NO: 9726 - RNA, 1077 nt, unidentified
  source 1..1077: mol_type = other RNA; note = synthetic construct
atgaaagactttgagctatacaagaaacagtttagagagaaggctctgaacaacagcttttctgaggatatcatccagaagtgcctgaattactccgaaaacctcttttccaaaaatctgcccataatctacaattcgtatcatcttgcaggccttgtggggtatgaacatagttacctcacacgagccattatcagcactgacttcttctaccggaaattcaacatagttaaaaagaacgggctactcagagaaatatccgaaccattgccaagtctgaaggaaatccagtactttattctgaaggagattctctacaaacagaaggtgagcaggttttgcaaatcctatatccctaaacggaaatttagggaatacttgaagtaccactcaaacgagaagcaggtgctgacacttgacatagagaattttttccccagcatcaaatacaagcacattaacaactacttcacagagctgggttatgccgaggatgtgtccagtttcctggcctctctttgtacctatagcattagcaagaagaagaaagagaaagtagagttaaacgaacggttcttgcctcagggagcgcccacctcaccttatctctcaaatctgatcctcatgaagttcgatgatacaatagccaactattgtaaggaaaagtccatcaagtacactcgctacgctgacgatatggctttttcaggatccgacttcgacaaggaaatcttaattaagctcgtgcaaagtgagctgaacaaagtagacctgaaactgaataagagcaagatcaatttcatgaaacagaatgtcccacaggtcatctctggcgtcctggtgaataaaaaaatccaactgccgaaagagattagaaacgagattcgcaatactatgtatttcattaccaagtatggctatgaggaccacattaaacgaaccaatgaaacgagggattactatttattgcatctgttggggcgtatccaatacgcactaaaccttaatcccaatgattctgagctcattaagtacaaatctgttctgctggaatacaagaagaagtattataactga

SEQ ID NO: 9727 - RNA, 1062 nt, unidentified
  source 1..1062: mol_type = other RNA; note = synthetic construct
atggaaaaaacaaactcctacaagaagaagttcacagagctggcgatcagcagcgggtactctgaagagtacattgagaaatgcttgaagtacagcgaacctctgctcaataaaaaccttcccgtgatttactccataaatcacctctcagccctggtgggttattctcagtcatacttaactaggtcgatgatttccaccagcttcttctatcggcacttcaaaataaaaaagaggaatggaaacctcagatcaatcagtgagccgctgccatccctgaaagagattcaaaactttatcctaaaggagattctgtacactcagaaagtgtcgaaatactgtaaaagctacattccaaagaagtccatcattgagtacctgaagtatcatgtgaacgagaaagaaatcctcaccctcgatctgcaagattttttcccaagtatcaagttcgagctgataaagaacttttttctgcagcttggctactctgatgaagttagctattatctgtctactctaacgacctattgtgacaagcaagaaaagtttgacgacagtcagagatatttgccacagggcgcaagcaccagtccttatctttcaaatctgatcctcaaggactttgacaataatatagggaagttctgcaacaacaagatcaaatatacacgttacgccgacgacctggctttttccggagataaaatcccctccgaggacataatcgactttgttaataaggaactcgagaaacttggtttgaagttgaaccctaagaaagtcaatttcatgaagcagaacatccctcagattatttctggcgtggtcgtaaacaataaaatgcagctgcccaaacaacagcgaaatgagatccggcagaagatgtatttcatcaataggttcggaatcgaatctcatttagaacgcattcaggagaaacgggaaaattacatcccgcacttgttagggcgcattcagtatggcctgaacctcaaccccgatgatctagagcttaaaaagtacaagaaggatctgcaagaaatttacaacaaagtcaagtga

SEQ ID NO: 9728 - RNA, 1032 nt, unidentified
  source 1..1032: mol_type = other RNA; note = synthetic construct
atgaagacattcgaaatttacaagcaggagtttaccaaaaaggcgttggacgccggctattcagctgatgagctgaataaatgtctgatttacgcagagcctttatacaacaggagactgcccattatctacaacctctctcatttcagtgcctacgtggggtataacgctaaatatattagacgagcaatcaagactgattccaccaagtttttctatcgggagtacagcatactaaagaaaaatggatcacttagggtgataaatgagcccctgccgtccctcaaggaaatccaaaagtggatcctggataatgcactgaataacatggcaatctctgcttatgctaaagcctacacttttaataggagtatcaaggatcacgtaaagtatcataagaatcagaagtctctgttgacgctggacatcgagaacttcttcaataacattaccgccgacaaagttgagaagctgttcattaacaagggatacagcctcctggtcagtaatctcatgagcaaaatatgcacactcaaaaactgtcttccacaaggtgccccaacgtcccctcggatcagcaacatccttatgttaccattcgacgacaaaattagcaagtattgcaagacaaaagggaacatcaaatacacccgctatgcggacgacctggccttctctggagaaatcaataaagaagagatagtggaacttgttaccaacgagttgaaagaacttggtttgaccctgaatatcgataagacaatcgagaagaagcagtcacagcagcaaatcattagcggcattgtcgtgaacaaaaaaatccaggtgcctcgtaagaaacgcgatgaattacgacagtccatgtactacatagagaagtttgggctcgaaaaccacctggtcaaaattaaatgctccaagtcgaattatctcaagcacctactgggcattgccaattacattatctttattaaccccaaggacgaaaagactatagagatccggactaaattgtttaagatgatcgagtga

SEQ ID NO: 9729 - RNA, 1050 nt, unidentified
  source 1..1050: mol_type = other RNA; note = synthetic construct
atgaatacattcaacatctacaagaaggaattcacgaagaaggccctcgagtctgggtatagtgcggatgaactcaataagtgtttggtgtatgccgagccactgttcaacaaaagactgccgattatctataatctgtctcactttgctgcacacgttgggtactctacaaaattcatccggcgagcaataaaaaccaacggaaccgagttcttttaccgcaaatattcaattcccaagaaaaatggctcatcccgtgtgataaacgagccactgcccagcctgaaagaaattcaaaaatgggtcctggacaatattctcaacaacatgcctattagcgcctacgccaaagcgtacacctttaatcgaagtatcaaggaccacgtaaagtatcatgagaatcaaaacgtcgtgcttactatggacatagagaacttcttcaacaacatcactagcgacaaagtggagagactatttatcgacaagggctacagccctctggtgagtaatttattgagcaggatctgcacgttaaacaattccttgcctcagggagcacccacctcccctcggatctccaacatcctaatgctcccatttgataacgagatcgctaagtattgtaagcccaagtttatcggtggtaagaaggtgcaggtaaaatacacaaggtacgccgacgatattgccttctcaggcgaaataaataaggctgagtttgttgagctggtgtctaatgaactccagaagctggatttatcactgaacgaggataaaaccatagaaaagaagcgcaatcagcagcagattatttccggcattatcgtgaaccagaaaatccaggttccaagaaaaaagcgggatgagcttaaacaagccatgtattacatcgaaaagtttggactggaaaatcatttggctcgcataaaatgcacaaaggctaattacgtctcgcatctccttgggattgcaaactatatcgtcttcattaatcccaaagacaaaaaaactctggaaattaggactaagcttttcgagatgaaggactga

SEQ ID NO: 9730 - RNA, 1035 nt, unidentified
  source 1..1035: mol_type = other RNA; note = synthetic construct
atgaaaaactttgagagctataagtcggaattcaccaagcgggcttataatgaaggttttagcagtgacgagatttccaagtgccttaactatagcgaaactctcctgaaaaagaatttgcccatcatattcaacagttctcatctttcagcactggtcggatacaacaaggattatctgaacagagtgtccaaggtcaataaaacaagctacttctatcgagactactatatacctaagaagaatggcgagaagaggctgatccgagaaccccttccctctttaaaacagatccagaggtggttactagacaacttattcatcaagctgccaatctcaccttacgcgaaggcttaccgtgcgaagaaaggcattcgcgatcatgtgcgctatcacaagaaagaggaagtggttataaccatggacatagaaaagttctttgacaatctggagtctggactgatcgtgaatatcctcctctccaaaggctactcctttcaggtagccaacctcattacaaaaatttgtacgctgaatgatgtgttgcctcaaggtgcaccaacatctccagccattagtaatattctcctttacgagttcgacaatgaaatctccaaatatacaaacagcaagggactgaagtataccagatacgcagacgatctggccttttcagggagtattcaggatgttgataccctcatcaagatcgtaaaagaaaacctagccaaaatcaacctgaagattaaccactccaaaactcgggttatgagcaaaaaagccaggcaaattatttcagggattgtcgtgaatgacaagattcaggtgccgcggaaagaccgcgatgatctcagacaggccatgtattacatcgagaaattttctcttgaggagcacctgaagaagatcgactgcaataaagctaactacatagagcatctgttggggaaggctaattacatgttgaagatcaaccccaaagatgagaaaatcaaggtgatatacaacaagctgaaggtcatgaaaactggctga

SEQ ID NO: 9731 - RNA, 1056 nt, unidentified
  source 1..1056: mol_type = other RNA; note = synthetic construct
atgagattctcatcctacgagaaagagtttaggcggatcgccgaaaagcgcaattatccttctagcgtcatagagaactgcctcaagtatgccaaagtgctgctcgataatggcgtccctgttatctataacactacacacttaagcaatctcatcggatacaccaagagttacattaagcgtgccactcatcacaccccttatttctaccggaaatacagcattttgaagaaaaacggttccaaaaggtttctgtccgaaccacttccctcattaaaggagattcagatatttatcctcactaacattctctcttcaatcaaagtctcacgctatgctaaagcatatgttagtgggaggaccctaatcgaccatttgaagtttcacaagggacagaagtgcgtcctgaccttggacattgagaactttttctcctctatatcaactgagagcatcgagaagattttcctggaaattggctataccgacatcgtgtccaatttgctggcacggctgtgtacacttgagaattcgttgccccaaggggcaccaacgagcccatacctttccaacctgtacctcaaaggctttgaccaggagctggctaaaatagtcagaccaatgggcatcaattatacgcgctacgctgatgatatggcctttagcggggatacaattgacaaagaggcgatcatcgaacatgtttctagaatgctatctggcctgggactggtacttaacccggacaagacactcctgatggtaaagcctagccggcaagtgatcagtggtattgtggtgaatgaaaagattcaggtgccccgcaaaattcgtaggtccatccgacaaagtgtgtactatataagaaagttcggattcgaaagccacaagcagaagaccaagatttacaaacgaaattacgataagcacctgctggggcttataaactacatcttattcatcaaccccaaagaccaggagttccagtcttacaaagaagaactggagaagatcattaaagacgctgataacaatggttatacacaggccggctga

SEQ ID NO: 9732 - RNA, 1029 nt, unidentified
  source 1..1029: mol_type = other RNA; note = synthetic construct
atgacctttagcagctatgaaaaacgctttacggatctcgctaagaagaggaattattcaagtgaggtgatcacaaaatgtctatcctatgccgagccgcttatacggaagaaagtccccgtgatatataatatcgcgcatttcagttcacacgttgggtatacagtcaagtacatcaaaagggccatcaagcatacagactacttttacagacattatgagatcagcaaaaagaacggaggcaagagaaaaatctcagagcctttaccatcgctgcaggaaatacagaacttcattttgaccaagattctttacaagcagaaggtgtctcgctatagcaaagcttacgtccccggacgttctattcttatgcacgcaaagtaccatgtaaataaccacaccgtgctgacgatcgatctcaaggactttttcagctccattcgaacccaccatatcgaggccatctttaaggagatcggctattcccagattgttagcaatatgttggccaaaatttgcactctgaacgggggcttaccccaaggtgcgagcacatcccccgcactttctaacatcttcttctctaagatagacgaactgattgccaaagaagtgcggcctgaaataaactatactcggtatgccgacgatctggcattcagtggggaaaccatcgacaaagaggtcttggtggcaaaagtacaaagtattctggaaccatacgagctcaagattaatgcttccaaaactaagctcatgacccaacaccaacagcagatcattacaggaattgtggttaataagaagctgcagctgccttccaaagataggagaaaaattcgccaggaactgtactacatcaagaaatacaacatggcatcacatatgtctaagaaaaacatccacaacaagaagtacgctgcccgactactgggtaagatcaattttgctctgttgctcaatccaaaagataaggagttcatcgagtacaagaaagtgatgcacgagataatccagcacactatttga

SEQ ID NO: 9733 - RNA, 1017 nt, unidentified
  source 1..1017: mol_type = other RNA; note = synthetic construct
atggaattcgagatttacaaaaagaagttcgaagccaaagcactcaaaaccggcttgacagacttagagattactgattgcctgaattatgccctgccccttatcgagaaaggactgccagtcatttacaatacaagtcacctttcaaaactggtggggctgcgcaagacatatgtaaaacgggctgctatttatacgaagagctattaccgaaacttcaccatcgcgaagaggagcgggatgcctcgtgaaataagcgagcccctgcccaacctaaagatcatccataagttcattctggaggaaatcctagagaacatcaaggtatctgcattcgcaaaagcctacaagaagaagtccaatattttggagaacaccaggtatcatatcaatcagaacaaggtggtcactctggacattgaaaacttttttccatccataacgacagataaggtggagaacatctttcgagggcttggatattccgatctgattagtaatctgctctcgaagctgtgtaccttaaataattcacttcctcagggtgctcctaccagtccgtacctgtccaacctgtttatgaagggtttcgactctaaactggctgacttctgcctcagcaagaaaatcagatatactcggtatgccgacgatataaccctgtctggcgacttcaatgaaaaagaggccatcgattacataagcgttttgctaaaagagttagacttggatctcaattgtaagaccaagataatgaagagaggacagcagcaaattgtgactggcattgttgttaatgaaaaatctcaggtgcccaggaaggagcggcttaaactcagacaagagatctaccatattaagaccaaggacctggactcacacaaaaagtttaaacagatcactcagcgcaactacctctaccacttgtatggcaaaatctcctacgtggtctttgtgaacccaaaagatgaagaattcatcgagtacaagaagtttctcaaaacactcatgaactga

SEQ ID NO: 9734 - RNA, 1020 nt, unidentified
  source 1..1020: mol_type = other RNA; note = synthetic construct
atggagtataacatttacaaggagaagttcacaaagaaagcaatcaaagaaggtctgaccgaaacagaggttaatgaatgccttatatacgccaagccattaatagaaaatgggctccccatcatctttaacacaagccacttctcaaagctggtgggagtgcgaaagacttacattaagcgggcagcaatttacagccgctcttattatagaagcttcacaattgcgaagcgtaatggaaatcctagagagatcagtgaacccctgcctaacttgaaactgatccagaactatattctcagcgaaatcctgtacaatgtgaagatatctgcttttgccaaggcctacaaaaagaagaccaccattatcgagaacactcgttaccacgtgaatcagaagaagctggtcacccttgatataaggaatttcttctcctccattaagaaagagcaggtctacattatctttaacaaactggggtactcggagatcattagcgatctcttctcaaagttatgcactctgaacgatcagctacctcaaggcgctcccacttcaccgtttttgagtaacatttttatgtccgacttcgacatgtttgtggccgattactgtacgtctaagaacatcagatacactaggtatgctgacgacatcagtctgtccggcgatttcgacgaaaaggagatcatagaactcattatagagcgcttgaaagaaaaagggttggagcttaacaatgagaaaacgaaaatcatgctcagaaatcaacgacagattgttaccggcattgtagtcaacgaaaaaaatcaggtgcccaggaaagaacggcttaaactacggcaggaggtatttcatatacggaccaaaaccctggaggtgcacaaagaaatcaaaaatatcaagaaccgcaactatctctatcatctgtacggtaagatctcttatgttgtcttcatcaatccaaacgacaaagagttcattgagtataaggagtatatcaggacactgtttaagtga

SEQ ID NO: 9735 - RNA, 1032 nt, unidentified
  source 1..1032: mol_type = other RNA; note = synthetic construct
atggactttactacctaccagaaaagatttacagaaaaggccaccagacagaagatgtcagattcggatatagccgactgcttggaatacgctaatgtactcttcaaaaacaatgtggtgaccgtctacaatacgtcacatctatcaaagctggtcggaattaggaaagcatatattaaacgcgctagcatatataccaaaagctactacaggtctttcgagattgctaagcgcaatggcaacccacgaaccattagcgaacccctgcctaatctcaaggttatccaagacttcatattagaagagatccttaacaaggtgaccgtgagcgctttcgcaaaagcgtacaaaaaaaattcctccatcaaggaaaacgtgaggtaccatgtagatcagaaaatagttctaagcctggatatccaggactttttttctagtgtgtcaattgagatggtcgagaaagttttcctggatcttggatatagcgaattgctgtccgacctcttctccaagctgtgtacgctgaacaagtgcctgccacagggggccagtacttccccttatattagtaacatcatcctgaaagggtttgacaaaaaaatcgccgattattgtctcgaccagaacatccggtacacacgctatgccgacgacatcactttgtctggcgattttgatacaggaactgcaattacattgatcgaggacgagctgctcaagctcaacttatctatcaaccgaaataagaccaaggtgatgactcgtaatatgcggcaagtggtgacaggcattgtcgttaacgagaagatacaggtatctggtaaagagagaaataagcttcggcaaaacatcttctatctcaaaaagttcgggttactggactatattgagcacgagaaaatcaagttcaacaattacctgtaccacctgtatggtaagctttcctacattgtctatattaatcccaaggatcaggaatttatcgactacaagatctacgtgaaggatctgattaagaagcactactattga

SEQ ID NO: 9736 - RNA, 1038 nt, unidentified
  source 1..1038: mol_type = other RNA; note = synthetic construct
atgagcttcgaaatctacacccggaaatttcgcgagaaagccgaaaatcttgggtattctgaatccaatatagtgaagtgtatcgattacgcctcacccatttacgagaaagggttacctattatttacaatctgacacacctgtcacgccttgttggttacgaaaaaaactacattatccaggccgccatcgctagtaagcattccgaggcatattacagataccataaggtgctcaaaaagaacggagacgtgcgaaaaataaaggagccactacccaacctgaaagctattcagtactggctgttacacaacattctggaaaagatcgagccgagtgcatatgctaaggcatacgtgaaaaaacgaggcttgaagcagaatattagatttcacaaagggcagaaaaaggtccttagcattgatatcaaggacttctttcctagcatcacgttcgagaaggtcgagaacatatttctcaccataggctattcggtagagctctctaattatctggcgaaactgtgttgcctgaaggaaaagcttccccaaggggcccctacctccccctacatttcaaacctcattttcaagaacatcgacgagatcatcgctgtctactgcaaaaatctcaacatccgttatactaggtatgccgatgacctgacatttagtggcgattttgacgagactagcttgctgaactacatcaacgagattatgactgagaacaacttcatccttaataaggacaagaccaaattgatgctgtattctgaaaggcaaatcgttacaggtatcgtggtgaatgacaaaccacagttagacaaggagacaaggaaagaaataagacagcacctctactatattaagaagtacggcctggagtcacacatggaacggaataatattaatagcaacaccttcctgacgaatctgatgggaaagatctctttcggactctatttgaatccaaaggatgaacatttgcgggattccataaactatctatcccagctgtataagcaaatcatgtga

SEQ ID NO: 9737 - RNA, 1038 nt, unidentified
  source 1..1038: mol_type = other RNA; note = synthetic construct
atgtcttttgaggtgtatgcgaaaaaattccgagtgaatgctgaaaacctcggctattccgaggaaaatgtggtaaaatgtatcaattacgcgcggcccatctacgaaaacggactgcctattatctataatctcactcacctgtccaagctggttggctttgaaaagaattatattatccaggccgccgtggtatctaaacacagtgaggcatattaccgttatcataaggtcctcaaaaagaatggggattttaggaagattaaggagcccttgcccaatctcaaagccattcaacactggatactggctaacattctggaagaaattgaaccgtctgtctacgccaaagcctacgtgaaaaaacgaggtttaaagcagaacattaggttccataaggcacagaagaaagtgttcacaatcgacattaagaacttctttccatccatcaacatcaaccagatcgagaagatctttatcgagacaggttacagcatcgaactaagcaactatctggctaagttgtgctgcctgaagaacacactcccccagggagccccaactagcccttacatttcaaacctcattctgaaggacatcgataactcaattgccatcttctgtaaagagttgaaggttcgctacaccagatatgctgacgacttaacgttcagtggggatttcgaggaggaatcgctttacgagttcgtcaacgcactgcttgagaaaaatggctttgagcttaataaagagaagacccggctcatgctcagttcacaaaggcagatagtgaccgggatcatagttaatagcaagccacagctggataaggaaacccggaagctgatacgccaagaaatttactacatcaagaaatttggcctggagtcccatatggagagagctaagctgtccggatctctttacctaaatcagctgatggggaaaataagcttcggattgtatctaaacccttcagacatgaagctgagaagctacataaaatatttggcaggcctttacaaagagttatattga

SEQ ID NO: 9738 - RNA, 1044 nt, unidentified
  source 1..1044: mol_type = other RNA; note = synthetic construct
atggactacaagacttattctgaaaggttcaagattgaggcatataatgtaggatatagtgagagtagcgttgccttgtgccttaactatgccaaaattctctttgacaagaatctaccagtcatctacaatgtcacgcatctgtccaatctgaccggaattaagaagaactacatcatccaggccgctaccgtgagtaaacactcgcacgcatactatcgggatttttccatagctaagaagaaaaagggcgaaagaaggttcatttctgagcctctacccaaccttaaacaaatccagtattggatactgaacaatattctctaccaggtgaaagtgtcaccatatgccaaagcctacatcaagaattttggcttgaaacagaacttaagattccacaaaaacaagaagaaggtcttgaatctggacatcgaaaatttctttagcgccattaaattcgagaaagtggagaaggtattcctgaacctcgggtattctaataccgtttcaaaaacgctgagcaagctgtgtacacttaaggagcagttaccccaggggtcaccgacaagcccttacttatccaacatcattatgatgtccttcgacacagaagtgtctcttttcgctaagaacttgaacatcagttataccaggtacgcggacgatctgactttcagcggtgatttcgacgaaaacgtggtcgaggattttatcgaaactaagttgctggaaattggttttaccctcaacagaaataagaagaagctaatgtacgattcccaacgtcaaatcgttacaggcgtcgtggtgaacaagaagattcaactgtcaaaggagcagcgaaaaaaactccgccagattcattattacatcaaacggtttggcatagaaagccatctggagcgccagaaactgtccaaaaaaaagtacctctctaagatactgggacagatcaactttgggctctaccttaataaacaggacaaaaatctgctggagatgaaagcatgcatcctcaaatacaagaaggagtttgatctgtga

SEQ ID NO: 9739 - RNA, 1557 nt, unidentified
  source 1..1557: mol_type = other RNA; note = synthetic construct
atggatttcaaagaatataagcagctcttctctgagaaggccaaaaacaaaggacgggacctcaattatatagactcttgcctggcttacgccgaaaggttatacgataaacaggtacccgtgatttatgacattacacacttaagtctgctggtaggcgtgaaggaagactacatccgaaggagcatcacttacactaagaagtactactggagctttgacatcccgaagtctaataacaagaaaaggacaatcaacgaaccattgcctctgctaaaagagattcagctttggattctccataacattcttgaaaagcaagctacccacccctgtgccaaggcttatgttccgcataagaaactcaaagagaacgcaaagtatcatactcgccaaaaaatagtgatatctttcgacgtacagaatttttttccctccatcaatcttgagggcgtctcaaagatattcaatatcatcggctatagcaaaaagaattcctatctcttggcaaaactatgttgcctggatgataagttacctcagggcgccccaacgagcccctacttgtcaaatctgtatatgttcagtttcgacgaaaacctaatctgctattgtagaaaaaacggaatgatctatacgcgttacgccgatgatattacaatctcgtcgcaaaaagatgtggacatcaatgcgttgactaagctggtggaggaagaacttagtaaaaagggtctgagcctgaatataagcaaatccaaagttatgcacaagtctgactcacaggtggtgaccggtattgtggtcaacgaaagaatgcgcctgcccaaaaagaaaagacagaaactacggcaggaaatgtactacctcatcacccgggggctggaagaccatataaactttatcaagtgcaagaagcgaaactatctgaaacacttggctgggaaggtgatgtacgcattgcatctggagccaagtaacacagagttcaaagactactacattttcctccagaggctgatcaatcccgattttaaacgcaagaagaagagactcattttagatagcaacgtgatccttaacgaggtgcttattgagaaactgccagaggactatactacctacatcgcgaacaacaactccataaaaaagatcaagaacctcgacctgtgttatggacctaatttatgtcacgccaattctctcctgtttgcaattatgcttaaggaacagtaccctacaatcgaggttaatatttccgagggcattgttgtccgcaccaatgggttcgcctacacccacttttgggtccacattttgcataataatgagcaggagttctgcgacgtgaccagagattgctttgagaaaaagattctgcaagccaaggaacgtcggtattacaaggtcaagaaccacactatcgatgagatgacccagaggatggcttccaataacgtctttctggattcaaaggagtacctgtccctgtactacaagaaatatcctaagtatttcgagctgtacaatacactgaacatcatgctccaccagcaatga

SEQ ID NO: 9740 - RNA, 1407 nt, unidentified
  source 1..1407: mol_type = other RNA; note = synthetic construct
atggattttaaagaatacaagcgcctctttactgagaaggcccaaaataatggcagggactcagattatattaacctgtgtctatcctatgctgagaaactgtacaatcagcaggttccggttatctatgacattaaacacttgtcactgctggtcggtgtgaaggaagattacattaggagagcaattacctataccaacaagtattactggaacttccacattcctaaattgaacggcggcaagagaactattaatgaaccattacccctcctcaaagacatccagctgtggatcctccatcatattttggagaagcaagagacacacccctgtgccaaggcgtatgtacctcagaggaagcttaaggaaaatgccaaatatcacacccgccagaagctggtaatcagttttgacgtgcacaatttcttcccatcaatcgatctcgaggcaatctccaagatcttcattaacattggctactccaaaaagaatagctttctgctcgccaaactctgctgtctcaacaatgaattgcctcagggagcccccacaagcccgtacctgtctaatttgtacatgttctcctttgacgataacattatgcgatattgtcgggagaaagggattatctatactcgttacgcagacgatattactttctctagcaagtccgatattaatatcaaaacccttacggagttcattaagcacgaactgaggaacaaaaagctctcattgaaccccgcaaaaagtaaagtgatgtacaagagcgacgctcagatcgtgacagggatagtggtgaatgaaaggatgcgtctgcccaagaaaaaacgccaagagctgcgacaggagatgtactacgtgataaccagaggacttgaaaaccacataaacttcatcaaatgcaacaagaagaactacctaaaacatctcgctggaaagataatgtacgctctgtatctggagcctagtaatacagaatttcaggactaccatacttttctgcaacggctgatgaacccaaactacaagagaaaaaagaaaaagctggctctggactcgaacatcatccttaatgaggtacttatcgagcagttaagcgagaattacataacgtgcatcgagaacgacaatagtatacagcgggtgggatctctagaactgcactatggcttaaacctttgccacgccaacagccttctgttcgcgatcatgttaaaagaacagtatccaaccgtcaaagtgaatatatctgaggggatcgtcgtgctgaccaacggttttgcctatacacatttttggatccatgttgtccagaataataaggaggagttctgtgatgttacacgcgattgcttcgaaaagaagtattacaagcaaaagaacgtcgacatcattcggtga

SEQ ID NO: 9741 - RNA, 1038 nt, unidentified
  source 1..1038: mol_type = other RNA; note = synthetic construct
atggagtttgacaaatacagtttccaattcgcacaactggccatactcaatggctacacaaccgaatacgtggattcctgtctaaagtatgccaagaaactagccgacaacaacttacctattatttacgactcagagcatttttctgaattggttggcttcaagctgtcttatatcaagaccgttgtggagtaccccaagtccttttactggatgtacaaaataaagaagcacagtggaggtatccgaaaaattaatgcacccctccccaaccttaaacagattcagtactggatattagagaatattctcaacacccagaaggtgagcccatacgcaaaggcttttgtgcagggtaagaagcttaaggaaaatgttaggttccacaggaatcggaaaattgtcatcaagtttgacgtacacgatttcttcgggagcatcagagaaaattccataaaagcgattttccgttccctgggatatatcaaccctgtggctgatctcctggctatgttatgctgcttggaccatgtgctcccacaaggagctcctacgagcccctacctgtccaacctctacatgttggactttgatactcacatcgcccagtactgcaaggaacatacaatctattatacccggtatgccgacgaccttacattcagctcagatagtaacatcgatgagtatgaactaacgtcactggtcaagaaagagctgaatattatcggcttgtacctcaataacgataagactaaagtaatgccacgcaacacaagacaggtcgtgactggcatcgtcgtcaatcaaaagcttcaggtggacaaagataagaggcgcaagattcgacaggaagtgttctatatcaaaaaatgggggctggagtctcacctccagaaaattggctgttcgaagaaaaactatctgaagcatcttctgggggagatgacctttatgctgtctctgactccgcagaacttgcagctgaaagccgacatcgaatatatcagaaaactgtgggaggagaatctgatgtga

SEQ ID NO: 9742 - RNA, 1065 nt, unidentified
  source 1..1065: mol_type = other RNA; note = synthetic construct
atgaccttcgacgaatatcgaatcaaattctctactaaggcctatcagtatgggtactccgaagtctacgtctctaaatgcctcaattacgctgctcgcctttttgacaagaaccttccagtgatctacgacttcgaacacttctgccgtttggtaggctacagttcctcctatataaaaagagccgtgaacagtccgaggagcttctattacgactataacgtgccaaaaaagaacgggaatggtgtgcgccttatctcgcagccattcccatctctgaaggaaatccagtactggatcctgaacaatattctgtacaaacttgaggtttctccctatgcaaaggcatacgtacctcaccggaagtttaaagacaacctacgctttcataagaataagaaattcgtgatcacgtacgatgtggctaattttttcccttccattaagaaggagaaaatcgaggcctattttattgaactcggttacacagagctactgagcaacctgtttagcaaactggtcacccatcggggatatttacctcaaggagctcctacctcaccctatttatccaacctctatatgaagcagtttgacaacaaaattgcagcgtattgtaagtgtaggaaaatattctacaccagatacgccgacgatctcactttttcaagtaacgaggatgtcgatatcaacgacctgttcaacaccattaaaatagagttgagcatcctgaatctggagctgaatcaggacaagacacatattatgaattcttcaagtcgccagatcgttacaggcgtggtggtgaataagcggctgcaagttcccaaagaattcagaagcgagattcgaaaagagtgctactatattaacaagtttggactgtcagaacacctcgccaggatcaagcagacaaatgaaaagtactatatcaagggcttgttagggaggataaattacgttttgcagattgatcccactaacaaggagtttaagagctacaaaaaggagatgcaaagattcgtgatccgggatattaatctggacgattacgatgtcctctga

SEQ ID NO: 9743 - RNA, 1029 nt, unidentified
  source 1..1029: mol_type = other RNA; note = synthetic construct
atgaactacaacgactacaagagagagtttaccgagaaagccctacgttccggtttctcctatgaggttctgcaggcctgcttgcaatacgctgaaaagctattttctaatgacctccctgtgatatttaaccttacccattttgcctcgctggtcgggtacaagcagacatatattcagagagcgatagtgtttacacatcatttttaccggaagttcgagattagcaaggccaatgggtcccaaagaaaaatctcagaacctctcccgagcttaaaggagattcagggttggatccttaaacacatcctgtacaaactgaaggtaagtaggttcgcaaaagcatattctcccggcatctctattaagcagaacctgcagtaccacagggatcagcccctcgttctctcaattgatgtaaaggactttttcacctcacttactagggacaaagtggaacaggtattcaaaatggctggatactcttctagcttaagcaatctgttttccaaaatctgtactctcgacggccggttaccacagggcgcaagcactagtccatatctgagcaacttgatcctgtacaagttcgacgaggagataggcagtttctgcaagcaacaatcgattcgatacacaaggtatgctgatgatatcacaatttctgggaatttcgatcccgatctcctgcgccagaaagtgcagatcgaactggacaagttgtcacttgttgtgaatgagaaaaaggtgaaagtgatgaaagctggagtgcgccaagtcgtcaccggcgtggtcgttaacaagaaaattcaggtcccaagaaacaagcggaaagagattcgccaagccatctattatatcacgaagttcggtctgcagggacacttgtcccgagaaagtgtgaatcggcgtaattacataaatcacctgttgggacaggttagcttcgtgctgtttctcaaccctcttgacaaggaatttatcgggtataaggatttcctggtcatgcagaagcagcaggactcctga

SEQ ID NO: 9744 - RNA, 1026 nt, unidentified
  source 1..1026: mol_type = other RNA; note = synthetic construct
atggaactcgaactgtataaacgacgcttcaccgagaaagctcttgcaacaggctattctgccgagaagattgagaggtgccttaaatacgccgaaaaactgctctcatacgacttgcctgtgatttacaatctcgagcacctgtgcgctctcgttgggtatcacagcagctacctattacgtgcagtagaccatccaaacttcttttaccggtccttcaagatcaagaagaacaataaccagtttagggacatcgatgaaccccttccttctttaaaagagatccaggattggatactgacaaatatcctctatcagattgccccctccaagtacgctaaagcctatgtgcccggaacttccctcaaacagaacatcttgtttcaccgagatcaacccatcgtgctgaccatggacataaaggacttcttcccatctgtcaagagaagtcagattaccgccctgttcttccggctcggttatagcatcgccatctcagaccttcttgcgaagttatgttgcctcaatgattgcttgccgcaaggcgcctctacgagtccatatttgtcgaacctgatactggctagttttgatgatgcaatcgcggtgtactgtatccctctgggcattagatacaccaggtacgcagacgatctgacatttagcggtaagtttgattgtgaagtactgaagttgcaagtgatcaagcatttgtcaattcacggccttaaaattaacgagcagaagactcgcattatgcgctttggcgagcggcagattgttactggagtcgtcgttaataaaaagatgcaggtgtccaaggaaaaaaggatggccataagacagcaaatgcacttcattaaacgtttcgggctcgaggagcatatgaaggctcggaagctgagcaaagggaactacgtgcgccatctgctgggaaagatcaatttcatcctgtacataaatcctgatgacctagagtttatcaaatatagagacgacctgctgaagctagggattgaaaaatga

SEQ ID NO: 9745 - RNA, 1026 nt, unidentified
  source 1..1026: mol_type = other RNA; note = synthetic construct
atgaggtgggatagctatgaaagaaagtttcgcgacttggcaggtaagtctggggcggcccaggaaaaaattgagagttggctgctttatgcaaaggagctgacatctaacaacctgcccattatttttgatcagacgcacctagcattgctgctcgggatagacaatgagtacctccatagaatgagtaatgccccagagtacttttatcgaaccttttacatacgcaagcgtaacgggaagcaacggcggatcgatgaaccactgcctgacctaaaaaaagtgcaatcgtggatcctcaccgaaattctgtacaaggtgccttgctccaaattcgctaaagcctacgtaccacatacctccattaaagacaactcccggttccaccgcaaccagaagatcgtggccggggttgatctgaagaacttctttccaagtataaagtccggttctgtgctttctgtgttcctgtcaatgggatacaatctgcccactgccgtgtttttaacaaggctgtgttgcttacgtgagagcctgccgcagggagcacctacaagcgcttaccttagcaatttgattatgagacacttcgacgaacagatttcagcctactgtatggaacggaagatccgttacacgagatatgcggatgatctcacattttcaggcgatttcgacgttgctgccttactctataggatcgacggagaactgaagtatcttcatctgcggaggaatcctcaaaagctcaaagtcatgcgcggcggcgatcgacagaaaaccactggaatcgtagtcaatgagaaacagcagctgcccagagagtatcgcatgaagattcggcaagagatccactacatccagaagttcggcctggacgaccatctcgctcacatcggtgagactcgaacccattatctacagcaccttatgggcaagatcgaatatgctttgttcataaaccccaaagacgagaaaatgaaagcctacagagaggtcttgcgcgcatacaggccgagggagtga

SEQ ID NO: 9746 - RNA, 1026 nt, unidentified
  source 1..1026: mol_type = other RNA; note = synthetic construct
atgaggtgggatttatacgaacctagatttcgggatctagccgagcggcagggcatcctcgataaaaatatcaatgagtacctcgcttacgcagagaatctatataagaagaacctgccagtcatatttgaccatacccacctgagcctcctcatcgggatcgataacgagtacttgcaccgcatctctaacgcccccaaatatttctatcggacgttccacattaaaaaacgcaatggcaaactgagacgtattgacgaaccactgcccgacttgaaaaaggtacagacctggattctgaaggagatcctgtacaaaatcccgtgctcaaagttcgccaaggcttacgttccaaagacatcgataaaggacaatacacgttttcacaagaagcaaaagattgtgttaaccctagacattaaggacttttttcccagcattaaatccggatacgttctgaatttgttcctttcctgtggttataacctgcctgtagctgtgttccttactcggctctgttgccttaatgagtcactgcctcagggagcacctacgtccgcctatctcagtaaccttgtcctcaagaaattcgattacaacataagcgagtactgcaaaaagaataacatccgctataccagatacgcagatgacctgactttctcaggagatttcaacatcgcctctgtgctgtttctcgtcgacacagaactgaaataccttaacctgaaacgcaacaataaaaaggtgaaggtgatgaggaataattctagacagtgtgtgaccgggattgtggtcaacgacattcaacagttatgccgagagtaccgaatgaagattaggcaagaagttcatttcatagagaaatttgggttggacgatcacttggcgcatatcggtgaacagagggtgaattatgtggaacatctgagtggcaaaatcaactatgtcctgtccgtgaaccccaaagatgagaagatgcaggaatataagaagagcatagacactatcaagtatcagacatga

SEQ ID NO: 9747 - RNA, 1038 nt, unidentified
  source 1..1038: mol_type = other RNA; note = synthetic construct
atgatggagtggaacgaatacaaggatagatttaccaaaaaggcagaacaatcaggatacaaagagagctacattgagaaaaatctggcctatgcagaggtgatcgtgaaaaagggatatccaattatctacgacgtggtccatctatcaaagctggtgggcgtttcgtatgagtacattttcaaagtaagcaatgcctctaaatacttttaccgccggtttgagattaaaaagaagaacggcaagaagcggacaatccacgagcctctacccctgcttaaatccgtgcagatgtggatactcaggaacattctggagaagaaagaagtgagcatctatgcaaaagcctacaagaaagaggtgagtctgaaggaaaacgtccgattccaccgcgggcagaaaattgtcatgaagctcgacgtacttgacttcttttctagtatcgaaccccggtttgttgataatttcttccgctctataggctatagcaaaaacttgtccagggttctcacgaatatttgcgtattaaatcatggcctccctcagggtgctcccacttctccatatttgtccaacatcgtgatgtataatctggatagaaagatctcatcctattgccgagtggaaaagatcagatacacccgttatgctgacgatatgactttcagcggagactttaagccggctaagatcatacacttcctgaagaaagagttatccaagctgaaccttgagctgaactacaaaaaaaccaagatcttgagacagaatgaccgtcagaacgtgacaggggttgtcgttaaccaaaagatccagattgatcggacaactcggaacaatttaaggctcgaaatgtacttcaagaagaaaaaccagaagaagcacctgagtaatgcctgtgaagcgggccaagagcgcaaatatttgattgggctgcttggtagagtcaattacggactccatataaacgagaaagataccgtcctgctcaattacaaggaaatcatctatgaagtgctgtcaaggtacaggatttga

SEQ ID NO: 9748 - RNA, 1035 nt, unidentified
  source 1..1035: mol_type = other RNA; note = synthetic construct
atggaatggtccgagtataaggataaattcaccgaaaaagccaaacagtcaggttataccgagaggtatatcgaaaaaaacctggcatacgctgaaatcatcgcaaataaagggtaccccatcatctacgatgttgctcatttttccaaattggttggcgtgtcctatgagtacatctacaaggtgtcaaatgccagcaagtacttttatcgaaagtttgacgtcaagaagaaaaacggtaagaaacgggtgattcacgagccactccctttactgaaaagcctgcagatgtggattctgcgcaatattctggagaaaaaggaagtctccatctacgccaaggcctataaaaaaagagtgagcctgaaggaaaacgtccgctttcatcgcgggcagaaaatcgtccttaaactggacatcctgaacttcttcagtagcattgaaagcatttacgtttatgacttcttccggtcgatcgggtataacaagtctgtgtctcgggtacttactaatctgtgtacattgaaccgtggattaccccaaggcgcttccacatcaccatacctgtctaacattgtgatgtataacctcgacagaaagattagcaactactgcaagaaaaagaagatacgttacacccgctatgctgatgacatgacttttagtggcgatttcaaacctgcaggtattatacacttcgtgaagaaggagctgagtaagttaaatctggagctcaactatgagaagaccaaaattctcggacagaatgataggcaaaatgttacgggagtcgtagtgaatcagaagatacagatagatcgaatcaccagaaataatttgaggctggagatctactttcttaagaagaaccaagagaatcacctcaggaacatttgcgaagcgggccaggagtctaagtacctaatggggctacttggaagagtgaactacggcctccatatcaatgagaaggacacagtgctcttgaaatacaaggagatcatatatgaagccctgtcacactaccggacttga

SEQ ID NO: 9749 - RNA, 1032 nt, unidentified
  source 1..1032: mol_type = other RNA; note = synthetic construct
atggaatgggaactgtataaagagagttacgagaaggaagcacagaaccacaacttaagcgatgagactatcaagtctaatctcaagtacgcctacaacctgtacaaacagaatgtgcctatcatttacgaccaattgcacttttcgctgcttgtcggtatttcctatgaatacatcctgaaggtcaccaatgcccctaagcaaagctacagacggtttagcattgccaaaaaaaatggggataagaggatcattcatgagcccttaccgactctcaaaataattcaggaatggatactacacgaaatccttaataacatcgatgtgagcccatacgcaaaggcttataggaaaaaggtcagccttaaagataatgtgaagtttcaccggaaccagaagaaggtgctgagactggacattaaggatttcttcgggagtattaaacagaaccaagtgctctccatattcttaaagatcggctacacaatagacgtaagtacgctcctagccaaaatctgcaccctttccggcaaactgccccaaggatctcccacctccgctgcgttgagcaatttggtcatgcgaggcttcgacaaagaaatctcactgtattgtaatgagaagaagatccgctatactagatacgctgacgatatgacattctcaggcgacttcaaggagcagaagctgatcaagaaggtgaagtcttatctgagttggattaggctcgagcttaacctagataagaccaacctcatgcgtaaacacaatcggcagctggtaacaggaataacagttaacgagaagatccaggttaacgttcagaaaaggcgcaaactgcggcaggaagtgtatttcattcgcaagtatggtctgtgctctcatctgcgacatagaggcttcgcagagtacgactcagagatgtacatcaaatccttgattggaaagattgggtattgtctgtttatcaacccaaaagacgaggaatttcgcgagtatttgaaatttctcaagtctgagctctcaaaatga

SEQ ID NO: 9750 - RNA, 1047 nt, unidentified
  source 1..1047: mol_type = other RNA; note = synthetic construct
atgaataatgacgagtgggagaactataagaagatcttcgagaaaattgcgcgcaaaaacggtaaatcgcagaactacataaataagaaccttcagtatgcagaaatgctggtgaaaaataacatgcccatcatttacaatgccgaccatctaggactcttaatcggcatcaaaagttcctacttttataaagtgaccaacgaagataagctcttctatcgaaagtttagcattaagaagaagaacggtgatagccggattattcatgagcctttgcccaatctgaagatcatacaaaagtggattttggaaaacatcctatacaagttggaagtctcaaagtttgctaaagcttatataccgaccattagcgtgaaagataatgtgcgatttcataggaaacaaaagtacgtactcaagctcgacattaaagacttcttttcttcactgtccgagatccacgtctacaagatctttaaaaaaatcgggtacactgattccctatctgtgctgctgagtaaactttgcacacttaagggcgtactgccacagggggcctctacctccgcctacctgagcaatttaatattgctggacttcgataagagcgtcagcttatattgcctggagaggtccatccgctatacgcgttacgccgatgatctcacattctccggagaattcgaccacaaggctctgttgaactttatcgactataaactgaaagctctcggcctgaaactgaaccagtcaaagaccagactgcttagacagaatcaggcacaggttatcacaggcatagttgttaatgaaaagatacaagtccctcgggactaccggaaaaggatccgcctggaggtgtactatatcaagaagttcgggatttacaaccacctgaaaagtaatcactctaaggtggacgccaaaacttatctcaaagccttgaacggaaagatcaattattgtctgttcatcaacccaaatgacctcgatatgaagaactacagagatattattgaggacgcataccagaagctttcaatttga

SEQ ID NO: 9751 - RNA, 1062 nt, unidentified
  source 1..1062: mol_type = other RNA; note = synthetic construct
atggactgggagtactataagaagaagtactgcctggttgcatttgagaataatatctccagtcacgaaatagaaaacaacctcttctacgccaaaaaattgtacgacagagggttgccaattatttatgacgagattcacttgggtcagctgatcggaattagccatgaatatatgttcaaagtcgccaacgacgcctcctacttctacaaatcctttaggatcaaaaagctgaatggagggagcaggaagataagcgagcccctgcccaatctcaagattatccagaaatggatccttgaggaaatcctgtacaaattgaacatacacccaagtgccaaagcatatgtaaaaggcctctcgatcaaagataacgttaagttccaccgaaatcaaaagacagtgctcaagcttgatatcattcggttttttaacaacgtcaaggaagacctgatttaccgcattttcaaggagattggctactctaaggaaatctcatggttattaacaaggttgtgcatacttaacggcgctctgcctcaaggggcggtgacatcaccttacctaagtaatcttgtgatgctcaacttcgatcggaaaatctattcctactgtaaaaagaaacgcattcgctatactaggtacgctgacgacctgactttctcaggtgagattaacaagcaccatgtcatctctagagtgaagaatgagcttttaaagattcacctgcagctgaatgaaagcaaaattcgggtgctcaaaaaccatcagcgtcagattatcaccggaatcgttgtgaataagaagattcagaccagcatcatctatcgaaaaaagataagacaggaggtgtattacatcaagaagtttggcatctataaccatatttccaagaccctggggataaccgatatcaatacggagctggagctcaaatacctaaagtctctaataggccggatccactttgtcatcttcgtaaacaagtttgataaggagatgagcacttatctgcatgacctgaaaatggtgtatgatgaactgtctaatacacacgaatga

SEQ ID NO: 9752 - RNA, 1059 nt, unidentified
  source 1..1059: mol_type = other RNA; note = synthetic construct
atggattggagtatttataagcagaagtacacatcaatggcccttgatcaaggtatagaaaccaaaaccatagaggaaaacttgagctatgctgaggtgctctataataagcagcttcccattgtgtacgacgaggtgcatctagggcagctgactggcatctcacacgactatatgtttaaggtgtccaatgactcaaagaaattctacaagacctttaggatcaaaaagagaacagggggatataggaaaatttccgagcctcttcctaatctcaaaattatccaaaactggatcctaaatgagattctgtacaagatagttgcccacccctccgcgaaggcatatcgcaaggatatctccatcagagagaatgtaaagttccaccgcaaccaggagatcgtgctaaagctcgatatacaatctttcttcaacaacatcagagagaaatatgtctacaggatcttcaaagaacttgggtacaaaaaaaacatcgccaacctgctcactaaattgtgtacgctgtctggatcgttgccacagggtgccgtcactagcccgtacctgtctaatttgatactgcggaaattcgataagaagatctatacctactgccgcaggaagggcattcgttatacacggtatgcagacgacctgagttttagtggcgaatttaacaagagacatctgatttctcgggtggagaacgaacttagcaagttaaagctgaaactgaacaccaagaaaattcgagtgctgaggagccatcagcagcaaattatcacaggtattgttgtgaacgagaaaattcaggtttccaagaaatatcggaagctgatacgacaggaagtatactacatcaataagtacggcttaaacaatcacctctcagtcaaatacaatctcgaagagagcgatgagtttaagaagaccgtctacttaaaaagcctgattggaaaggctgaatacgtgctgtttatcaataagaacgacaaagaaatgccagagtacatcgctctcctccgcaatttgctggtcaaactgaaactggaaaattga

SEQ ID NO: 9753 - RNA, 1095 nt, unidentified
  source 1..1095: mol_type = other RNA; note = synthetic construct
atgattttgaactgggaagagtacgagatcgcctttagagagaaaaactctgaactcaatagattctcccagagtgaattggagaacaagcttcgatatgccaagaaaatttatgagaatcgggcgacggtgatatatgacgccaaacacctggcagaacttgtgggggtgaaatattttgaggtctataagatcgccaacagcaatagcaggttcttttataaggaattcctcctgcagaagaaaaatggtggcgagcgtaagatcaaggcccccctgccaacactgaacatcattcagaagtggatttttgagaacatcctggcaaacttgaagtgcagtgtgtactgtaaatcataccaaaaaaacctgtctctgaaggataacgctaaatttcacaggcggcagcccattctcatgaaactggacatcagcagcttttttgataatatcagctggggactgatctacaacatcttcaaaaacctaggatactctgttgaagtctcaaccttgatcaccaaattggtgatgtacactgagaatggcaaggtcaagggcataccgcaaggtgctattacttcacctatgctgagcaatctcgttctaaaaaagttcgatgagaatattggctactactgcgtgaacaataagataagatatacacgctatgcagacgatttaactttctccgggaattttgacacgtacaagttaaaggcttttgtaaacaaggaacttcataagaatgggtttttcctgaataaccgaaagaccaaaattcttaagtccaatgataggcaggtggtgacaggaattgtagtcaatgagaaaatgcaggtttctaggaaatatcggaagaatttacgcctcgagatctatcatctgctcttccgcacccagcagcacttcgaatacaaaaagcttaaaaactacgacgagaagtcaatgtatctcaagacaatcattggcaaagttaacttcgtgctgcaagtcaattccagtgacaaagaattcaaaacctacaagaaagagatctacaagatcatagattccataaacaactcggaactgaacaagaacaattggaattga

SEQ ID NO: 9754 - RNA, 1059 nt, unidentified
  source 1..1059: mol_type = other RNA; note = synthetic construct
atgaattgggaggaatacaagaaaaagttcatcgaaagaaacgaactgactaaaagatttagcgaatctgaactgaacgaaaagttgaactatgctaagaacttgcacaataacaagatgcccattatttacaatgtggatcatctgagccgactcatcggcgtttcgtattcagagatctacaaaatcaccaacagcgagtccaagtattactacaaagagttcaagctcaagaaaaaaagtggcgggtttaggaaaattaaggctccactcccgacactgaatataatccagaagtggatcttcgagaacatacttcaaaatacgaaagcctccatttactgcaaatcttattccaaaggagtgtccctgaaagacaatgcaaaattccataggcgccagaacattgtgttaaaactcgacatcgccaacttttttgatgagatctcttacgaggtcgtgtataaacttttcaaggacttcggctactcaaacgaaatagttattgtactagcacgtcttgtgatgtataccaataacaagatcaccaaggggatacctcagggagccagcacatcccccatcataagtaatctgatcttgaagaagttcgataatgaaatcgcttcaatatgtctgaaagagaacattcgatacacaaggtatgcggatgatctgacctttagtggcgatttcgaagtgacgttcatcgaggaaattattaaggagaaactacggttgctgggtctgaagctgaacgccaaaaagagaaagatcttgcacaaaaacaaccggcagattgttacaggaattgtagtcaatgagaaactccaggccccaaggaaataccggaaaaatctccgcctagagctgtactatattctgaaccacagcaagaatcactttaacaagaatggtctgtacaaccatgacgcacgcaagaattatctgatcactgtgcttgggaaggtcaattacgtcttacaaatcaatcctcaggactctgagtttattgacttcaagaagaagctctataagcttttaaccactcagttttga

SEQ ID NO: 9755 - RNA, 1071 nt, unidentified
  source 1..1071: mol_type = other RNA; note = synthetic construct
atgaattgggaacagtacaaaaacaacttcatccagaaaaacaagatccacaagaaatttgacgagaatgaattaagcctaaagctgaattacgcgtataacctctacgaaaacaatctgcccattctgtataatgtcgaccatctttccaaagtcatgggaataaataaggagtacctctataaggtatcgaacagcaactttaaatacttttaccgcacattctaccttccaaaaaaaaatggtgggactcggaggattgatacccctttacctaatcttaagctagcacagaaatggatttacgataacattttgctcaagctggaaacatctatttattgcaagtcctacaaaccgaatttttctattaaggacaacgccaagtttcatcgtaatcagaatctggtgctgaaactggatatcaagaacttcttcaagaatatcaggcacaaagatatctaccttctgttcaaagagattgggtataacaatgatatctgcaatttgctcaccaaactggtcattctcaacgacgacaccaaaataaaaaaaattggtatcgctcagggggccattacctctccatcaatctccaatctgatcttaaagggattcgataacaagatagctgaatactgtaagcaatcaaagatcaggtatacccggtatgccgatgacctaactttttcaggcgactttaaccccaataacatcataaacttcgtggaaaagaaccttaataagcaaggcttcgtgctgaataagaacaagatcaagaagatctacaagaatgagagccagatcgttacaggcatagttgtgaatgagaaattgcaggtatccagacagtatcgaaagaatattcggctggagatatatcatctgctgaatcacactaaagagcacttgaacaaaaaagaggtgacgaactactttgagcaaagagagtatattttggcactcatgagtaaaatcaacttcgtgctgagcattaacaagaacgacaaaaagatgatcgaatacaagaacaagctgtataagctgctcagaagtctcgaccgcatgtga

SEQ ID NO: 9756 - RNA, 951 nt, unidentified
  source 1..951: mol_type = other RNA; note = synthetic construct
atgaatgttaagtatctcaccatcgagaaactgctgacagattgtaacctgtccaagaaggattttttaaccctttgcgaccttgattctaagtacgtttacgatatcttccttatccccaaaaagacaactggatttcgcaccatccgtgtacccaatgcgcaactgaagattctacagtgttggattaacaagaatgtgttaagtaaggccgatattagtaagttttgcaagtcttatcgcaagaacatgtccattgtgacaaatgccaggttgcacaaaaaccagaaaattgtcctgaagctcgacatcgcagacttcttttcctcaatatcttggagccaggtgtataaaatattcgtcgagctcaatatcaacgaggagatctctgaatactttgctaaactcgtgacgatcaatgatggagaagtgaggctgggaattccacaaggcgcttgcaccagccctacaattagtaattgcattctcaaggactttgacaacaagctgggctcctactgtattaaaagaaagatccgatacactcggtatgcagatgatctgacctttagcggcgacttcaactataagaaagtgatactgttcgttaagaagttgttggacaaattcgggttcaaactcaacaatagcaagatccgggtaatgaaaagcgggcagtcacagatcgtgactggtatacaggtcaacgagaaaatccaagtgccaaggaaataccggcataaccttagactcgagatttaccacatcctgaatcatcctaatgaccacttcaaaatgaagaacttgtacaattcagccgaaaagtcccagtacttaaaatcggttctggggaaagtcaactatatactgcaggtcaataagaaagacggtgaattcatcaagtataagaacctgctacataaaatcttggtggaagtgctgacgatttga

SEQ ID NO: 9757 - RNA, 1041 nt, unidentified
  source 1..1041: mol_type = other RNA; note = synthetic construct
atgaatgataagcagtgggaggactataagtccaaatttatcgagctcgctaagttaaacaacaagacacagaagtacattgaccagaatataaactacgcctttaacctgtttcaaaaaggcctgcctatcatctatgacacgactcatctcggtctgctgaccggaattaaaaaggagtatatctaccttgtggtcagttcaccccgacactattataggcacttcaagataccaaaatcaaacgggttcctgagagagatcgacgagccccttcccaatctaaaaatcatccagaagtggattctcaataacattcttcagaacgttcccgtcagcccatacgccaaagcctacttgcacaaaacaactctgatagataatgccaaattccacaagcggcaaaagatagtctataagctggacatccaaaacttttttccgagcatctcctctcacatgatttacaactttttctgtgaagcaggctacgatctcaaactgtccagggttctaagccgtattgtaacattgaataatggcttgccacagggagctcctacctcaccttaccttagcaatattatcttcaaggagatcgatctgaagattgcaaaatattgccagcagcataaaatcagatacaccagatatgcagatgacttgaccttctctggagacttcaactacaataaactgaagacctttgtggaatggaacattcagaagtcgggttttaacttgaacaacagcaaaacgaagatcttacctaagaataaacgccaaattgtgacagggatagtggtgaatgaaaagctgcagatttctaagaatgagcggaaaaagattaggcatgaactccattacctcaaacttgatactaacaaacacctcagtctgcgcgcgaacaacgagaaggctcaaataaagtatctgcagcagctgctgggcaagatcaattacggactccagattaatggcaaatccaaggaactactgttagggaagatcttcatccttaatatcctgaaacagttctga

SEQ ID NO: 9758 - RNA, 1089 nt, unidentified
  source 1..1089: mol_type = other RNA; note = synthetic construct
atgatgtcctcctgcttcttctttgcgaaggaaatgaactgggaaaactacgcgacctctttcgagaatgccgccttgtccaacaactttgacgcaagttacgtaaaacgttgtctggcctatggcaaagttctgttcgataagtcactgcccattatttattcactggaccacctggctaatctcgtgggctacgactccgaatttattgttgcagtgagttttaggcagaatgggtactatcggaacttctttatcccgaagaagtcaggagactatagagagatcagcgagcccttaccttccctgaaaatcatccaacgatggatcacagagaatatcctgtataggataagtgccagccggttcgccaaggcttttgtgccaaccaggtctatcaaagataatgcccgcttccacaaaaatcagaagcttgtgctgactgtcgacatcaaggatttcttcctgtcgttgtccagcaaattagtgtacaagttttttctcggctgtgggtatagtaaacgcgttagctacttcctgacccgtctgacgacactcaacggatcgctaccacagggagcccctagctccccctacttgagcaatctcctcttttctgaaagtgacgaggaaatttccacattttcaagatcagaagctattcgctacactcgatatgcagatgatctaaccttctctggcgatttctctccctgcaaaataatcaccagggtccggcgggtgctgggtaagttggaccttaggattaacgaaaagaagacacgtgtgatgaagcctcaccagagacagatcgtgactggcatcgtcgtcaataacaaattacaggccgtaagagagattagacgcaaccttcgccagaacatacattatatagagaagtttgggttcgagtaccatgtggctcgaattagggagcaccgggctaattaccagtttcatctcatgggtcaggccaattttatactcttcatcaacccacgggacaaggacgctattttcgcactggaagtccttagaaaaaacctgcaacacagcgcaaatagcgagtctcaacatgataacaattga

SEQ ID NO: 9759 - RNA, 1047 nt, unidentified
  source 1..1047: mol_type = other RNA; note = synthetic construct
atgaactggatcgattaccagaaggaattcactgccaaaagtatctccgctggctataagaaagactacatcgaaaggtgtctcacctatgcccaccggctctacgagcgcaatctcccgattatttatagtcttgatcactttgcctccctggtgggttatgagaaaagctacctgaactacattgcttatcgccagaaccctttttacaggaatttcgagattccaaagaagtcatcgggaaaacgagagattagcgaacctctccccaatttgaaaaaaatccaaaggtgggtccttgacaatatcctgtatcgggtcagcccttcccaatacgccaaagctttcgtaccaggacgctctataaaagcaaatgccagatttcataggaatcagaagatggtgctgaccctcgatattaataacttcttccctaggctgagctctaagctcgtgaagcagttcttcacaaagtgcgggtattccaagaaggtcacttattacttgacccgactgtgtgttctgaacggcggactgccacagggtgctccaacaagccccgcactggcaaacttgatgcttaaagatttcgacctaaatatcgccaagtactgcaagagtaaaaccataagatatacgagatacgctgacgatctcacattttccggcgtattcgcggaaaatgagctgataaaacaggtgaagaaggaactaaaaaagattgacctggaactgaagaacagtaagacccggcttatgcttaagcatcaacgtcaggaagttacagggatcgttgtgaataacaagctgcaagccccccgagagttccggagaaatttaagacaggccatcttttacatcgagaaatacggcttggagaaccatttggcaaaattaaacgagtttcgggcgaactatgtgtcacacctattagggcaggctaactttgtgctgtttattaatccccgcgatcaggatgccctgaaggcactggagatactcaaagactgccgttcttctaactttatgatcacttcagacgactga

SEQ ID NO: 9760 - RNA, 981 nt, unidentified
  source 1..981: mol_type = other RNA; note = synthetic construct
atggactgggaaatttacagctcccgattcgccaaagccgcacaggacaggggtgatcactatattgagcggtgcctggcctatgccaagcgcctcaacgatcaatcactgcctatcatttatagcccagatcatctgggaaaattgacaggctatgaccccgcttatctaaggtacgtggcgtacaaacagcgaagtttctaccgcgagtttagcatccctaagaagagcggcggcgtgcggtctatctctgagcctctgcctaacctgaaatccatccagcagtggatactgacttcaattctctacaagctcgaaccctccgtctatgccaaagcctttgtgccgcagcgctcaatcaaagaaaacgctcgtttccatagaagccaggaaatggtgtttacggttgatatacgggacttcttcccctccctctcagtgaagagaataaacaatattttcctctcccttggctatgagcggcgcgtggcttactacctgaccaggctgtgcagcttagatggaggtcttccgcaaggagcacccacttcgccagccctctctaatatcattttttccccaacagacaatcgtattgcgaaatattgtaccccactgggaattcgttacacgaggtacgcagatgacctcaccttttcggggaatttttctgtgagtgatctgttgaagatcatccgacgggaattgtctgctcttgagctaacactgaatgacagtaaaaccagattgatgaagaagcacgagaggcagattgttactggcgtagtagttaatgagaaattaaatgccaccagagaactgcgccgcgggctgagacaaagcgcatattacatacagaagtacgggctggagaaccatatcaaccggatcgacgagaagaggggcaactacttactgcacttgatcggtcaggctacacttggggtcagtgaattcctttgtaagagagacttcgtctga

SEQ ID NO: 9761 - RNA, 1062 nt, unidentified
  source 1..1062: mol_type = other RNA; note = synthetic construct
atgaattggaacgagtataaaaacaagttctactacttcgccaagttccataataaggacgataattacatcaacgactgcattaattacgcagagaaactcttcagtaaaaacctgcccgttatctatgacgtgacgcatttttcctatttagtgggctataaggaatcatacattatgaaagtcgccaactcccagtcaccattttatcgcgagttcctcataccgaagaagaataaggacgaatacagggagatctccgagcccctccctaatttgaaggtgatacagcgttggatcctggacgaaatacttcacaagctgaatcctagcccctttagcaaagcattcagaatcgggtattctatcaaagataacgcgaaatatcacagaaaacagaagcttgttctgaacatggatattaaggactacttcaacagcatctcaaacgacaaggtattcatgttctttaaaagcctcgggtatagtaaacaggtggcattggtactgtcaaaactctgcattctggataacggactccctcaaggggctccaactagtcccatgctgtccaatttggtgacacaacaaattgataaacgcatcgctagcttttctgctaagcataatttgcgatatacccggtatgccgacgatcttactctctctggcgactttgacgaaggatttgtcattaactgtgtcaaaagaatcctgaacagtgaaggcttctgtataaatgagaagaagacccgggttaggaagcagaatcagcagcaagaagtgaccggtattgtggtgaatgagaagctgcaggcctctaagaaataccggaaaaatctgaggcagaagatgcactacatcaaaaaatacggattcgaagatcacataagcaagctggagattgacaacaagatcaagtacctttatcatctgctgggtacagctaactttattctgaatgtcaacccatacgataaagaggccaaagattcctttgagtacttaaagcagctactattccactacaagttaaagacatccatctcggaatttgattga

SEQ ID NO: 9762 - RNA, 1062 nt, unidentified
  source 1..1062: mol_type = other RNA; note = synthetic construct
atgaactgggacgattataagaacaggttttatcatttcgccaaatacgacaataaggacgataactacatcgactcttgtttgaattacgccgagaagcttttcctgaaagacatacccgtgatatacgatgtgacccatttcagtaaactcgtcggctataaagaagcttatatcatgaaggtgtcgaattctcagggcagcttttaccgcgaatttaagattccaaagaaaaagaagggcgaatatagagatatttacgagcctctcccaaatctcaaaaatatccagaggtggatcctggacgaaattcttaacaagctgaaaccttcaccttatagcaaagcatttcgggtggggtattcaattaaggataacgccaaataccatcggaatcagaaaaaattgctcaacctcgacattaaggactatttcaagagcatcggctacaaaaaagtctacaactttttccggtccctgggttacagcaagcacgtatcagttgtgctggctaatgtctgcacgttggatgatgagctaccccagggcgccccgacttctccaatgctgtccaatcttataacacagcgtctagatctgcgaattgctaaattcgcgagcaagaacaaaatcagatacactcgctatgcagacgacttaacattcagtggagactttgaggagggaattgtgatcaatttcgttcggaaggtgctgttaagtgatgggttccttatcaatgagcagaaaaccagagtacgcaagcagaatcagcaacaggaggtcaccggtatcgtggttaacgaaaaattgcaagcatccaaaaagtataggaagtccctcaggcagaagatatactatatcaagagatacggactggaagaccacatctctaagatcgaatttgacaacaagattcgatatctctatcacctgcttgggacagctaactttattttaaacgtcaaccccaatgatgaggaggccaaggagtacttcaactacctgaagcagctgctgtttcaatacaagttgaaaaagctggatcaagaggtggaatga

SEQ ID NO: 9763 - RNA, 1041 nt, unidentified
  source 1..1041: mol_type = other RNA; note = synthetic construct
atgaactgggaagtgtacagggacaacttttatagctctgccaaaacaaaaggatacaaggagaattacatcaacaggtgtctcgagtactcaaaaatcttgttcgatcagaagctgccaatcatatacgatcaaaagcacctgtcgctgttaattggctatcaggagatctacctcattaaggtcagcaatagtcaggaacctttttatcgcgagtttaagatacccaaaaagaacaagaacgaattccggaaaattcacgagccgcttcccaacctgaaaaatattcagagatggatcctggaagaaattctcaatatacttgagccctccccttattcaaaagggttcagaaagggctatagcataaaggataacgcacgattccataagaagcaaaaaaaggtgctttcaatcgacattgagaactacttcggatctatcagttacgacatggtgtattccttcttccgcaacttagggtatagtaaacaggtgtccgtaatgctggccaatctgtgcgtccttgagggcaggctccctcaggggtcaccaacctcccccatgctatccaacttgatcaccaagcgactggataatcggattggtggatacgcgaagaaaagggggattcgttacactaggtatgctgatgacctgacctttagcggcgattttaacgaaggcgcattgatcaattttgtcaagaacgtctttgagtctgagggttttgtcatcaatgaaaaaaaaacccgggttcgcctgcagagccagcaacaagaagtgacaggtattgttgtgaatgagaagatgcaggcttctagaaaatatagacgggagtttcgcacaaagatgttcttcatcaaaaaatacggactagacagtcatctcgactatgtggaagaagagaagaagatcgagtacgtataccacctgctgggcactgccaatttcatcgtgaatgttaacccaaatgacttggagacgcgtgaacattatatttacctgaaggagttactctctgacctcaaaaagagctga

SEQ ID NO: 9764 - RNA, 1035 nt, unidentified
  source 1..1035: mol_type = other RNA; note = synthetic construct
atggaatgggaggaatacaagtccaaattctaccattatgccagttttgagggcaaggatcccgattacattgataattgcctcaattatgcagagaaactgttcaacaagggcctaccagtgatatacgaccagctgcacctgagcttacttgtcggctatgaggagatctacctcataaaagtgagcaattcgcaggatagcttctaccggaagtttgacattcttaagaagaataaacgcgattaccgaaccattagcgaacctctccccaaccttaagaatatccaacgttggatcctaagcgaaatcttgtccaagctgaaaccttcagagtactccaaagcctttaggcctggattatcaataaaggacaatgctagattccatcgtaaacagaaaaaattgctcacagtggacatcaaagactactttggttctatcgacttcaagaaggtgttcatattctttcgaaacctgggatatagtaagcaagtgtcagtgatgctggcaaatatttgtactctgaacaacggcctcccgcaaggcgcaccaacatctccaatgttgtctaaccttattacgaaaaacctggaccagaggatcgccgggttttccaagaaaaataacctgcggtatacccgctatgcggatgatttgacattctcaggagacttcaacgaagggcacgttatcgaattcgtaaaggaggtctttaagagtgaaggttttactatcaacgattccaaaaccagggttcggaaaaggaaccagagacaggaggttaccggtattgtggtcaatgagaagatgcaagcttctagaagctatagacgcgactttcggcagcagatgtactacattaagaagtatgggctcgatagtcacgtaaataatattgaaggcggagacacactgaaatatctgtatcatctgctcgggatggccaatttcatcatcaacattaaccccaacaatcaggagactaaggaggactaccactacttaaaagatctgcttcagaagctgaagtga

SEQ ID NO: 9765 - RNA, 1032 nt, unidentified
  source 1..1032: mol_type = other RNA; note = synthetic construct
atgaattgggaggagtacaagtttaaattctaccactatgcttcctttaacggtaaagaccaggactatattaacagttgtcttaactacgcagaaaagctctttaataaaggcctcccggttatatatgatcagttccatctcagtctgctcgtgggctacgacgaaaagtacctgataaaagtcagcaattcccaggagctattctaccgcgaatttaacatcctgaagaagaataagaaggactatcggacaatcagcgaacccctccctaatctgaaaaacatacagcggtggatcagcaaggaaattttgtctaatcttgagccctctgaatacagcaaggctttccgcacggggtattcaatcaaagataatgccaagtttcacaggcgtcagaagaaagtgttaactatcgacctgaaagactatttcggatccattgactataagaaggtcttcaccttttttagggacctgggatattcaaaaccagtatccgtgatgctcgccaaaatttgcacattgaacgatgggcttcctcaagggagtccaacctcgcctatgctttccaatttgatcactaaaaacctggatcatcggatcgcaggcttcagcaggaagcagaatattagatatactcgctacgctgatgatttaaccttcagcggcgacttttctgaggggtacgttatcaagttcgtgaaaatgattctgaacagtgaaggattcacactaaatgattcaaagacccgtgtcaggaaaagaaatcaaagacaggaggttacaggaattgtagtgaacgagaagatgcaagcctcacgaaaatacagacgggactttcgcaaacgaatgtactatatcaagaagtacggcctgaactctcacgtggagaaaatagaggccggtaattccttgaactacctgtattatctgctgggtatggcgaatttcatcatcaatattaaccccaacgataaagcaaccaaggaggattacaactacctgaagaacctcttactgaagtcttga

SEQ ID NO: 9766 - RNA, 1068 nt, unidentified
  source 1..1068: mol_type = other RNA; note = synthetic construct
atggtgataggattgaacgaaaatggcgatatcatgaagtgggaggaatacaaaaagaagttctaccactatgccacgtataatcagaaatcagaggagtatattagctcttgcttggactacgctgagagactgttcatgaaggatttgccagtaatctatgatcagaaacatctatctcagctcgtgggataccgcgaagagtatctgtttaaagtggctaacgcatcagagctcttttacaggaacttcaaggtgctaaagaaaaacaagaaggactatcgcgagatttcggagcccctccctaatctcaaggacatacagcgatggatcctggaccagattctgtacaaacttgaaccgtctgagtacagtaaagcgtttcgtaaaggtgtcagcattaaggacaacgcaaaatttcacagaaagcagaagaaagtacttaccattgacatcgagaactactttggcacaatcaaattcaaagccgtcttcaagttttttaagtccctcggatacacaaaacaagtgagtatgatgctggccaaactctgtgttattgatgacgaattaccacagggggctcccacttcccctatgcttgctacactgatcaccaagaatatcgataagcggttatccgcgttcgcaaacaaagaaaagatccgatataccaggtatgccgacgatctgaccttttcaggcgatttcaatgaaggttacgtgatcaaatttgcagagaaggtgataaactctgaggggttcaaggtgaatccctttaagactagggttcggcttcagcatcagagacaggaagttaccggcatagttgtcaatgagaagctgcaagccagcagacagtaccggaggaagttccgtcaaaatatgtttttcatccggaagttcggcctggaaagccacatcatcaatatcaacgtgtccgatcctaaaagttacgtctatcagttgattgggacagccaatttcattcgcaacattaacccaaaggatattgacgtccaagtggactatgaatacctgaaggagctgctgcaaacttataaatga

SEQ ID NO: 9767 - RNA, 1044 nt, unidentified
  source 1..1044: mol_type = other RNA; note = synthetic construct
atgatttgggaaaagtataaacgcaatttcactgaatcagctttgaaagcaggatacgatagcatgtacattgaagaaaacctgaaaaaggcacactccttgcatttacaggggatccccataatctacgatcagatgcacctgtcatacctggttggttatgacatcgagtaccttctgaaagtctctaacagccaaaaggggttctacagatacttcaagattccgaaaaaaaacgggggcttccgcaacatcgccgagccattgcctaaccttaagtctattcagaaatggatcctggaagaaatgttatattcttgcaagacttccgaatttgccaaagcttacaagaagaatgtgtccttgaaggacaacgccaggtttcatcggggccagaagatggttctgactatcgatatcaaagacttctttggatcaatcaggcacatagatgtctataatttctttagctcgctcggatatagtcaggatgtggcaaccctgctgacaaatctctgcaccctcaaaggtgcgctaccccagggcgccataacatctcccgccctcagtaacctgcttatgaaagacattgacaagagaattagtgcgttttccaagaaaaagaagatccgctatacgcgttatgccgatgacctcacattcagtggcgattttcaggtgggtgagattattaaatttgtcaccaccgtgttaagaagcaagggcttttcaattaacgataagaaaaccagggttaggttccctcatcagcggcaggaagtgacgggcataattgtgaaccaaaagatacaagctccatgtgagatgcgaaaagagctgcggaagaacatttactttatcaagaagtacgggctgaattcccacctcgagttcatcaagaaagacaaatatcagtatctgaagcacctactgggaatcgctaatcatatctacttcatcaatcctactgacagccgagtatacgagtacctgaattatctcaaggagctttggcaagtagagaaaatcacaagcgaggactga

SEQ ID NO: 9768 - RNA, 1017 nt, unidentified
  source 1..1017: mol_type = other RNA; note = synthetic construct
atgaactggaaatcctactctgaagcattctccaaaaaagctaagcagaataagtacgatcagaattacatcaacgaatgcctcggttacgccaaacctctgttcgagaagaagattcctattatctataaccaggagcatctcagcctgctcgtggggtattctgaggaatatctcttgaaggtatctaacgctagcgatcggttttacaggaatttcagtgtccctaaaaaaaatggttctagccgacagatatttgaaccactgcccaatttaaaggatatccagagatggattctcgaagagattctctataagtgtcccatcagcgactacgccaagagttatgtgccccggcggagcacaaaggataatgccaggtttcataggaggcaaaaaaaggtattgactctggacataaaagattttttcccaagcatcaggttccacaaaatttacctgtttttcttcaaccttggatacaccgaatcacttagtatgatgctggcgaatctctgctgccttaacggatcattaccacagggggcaatatcctcgccggcactttctaacctgatatttaagtcattcgacaagagaatcagtgtcttctgtaagtcaaataacattcggtatacgcgatacgccgacgatctgactttttccggcgactttcaaccagggatgctgatcaagttcgtcgagaacatcctagtgcccgagggctttcagctgaacaacaaaaagacacgggttagactgcaacaccagcgtcaggaggtgaccggcattgttgtgaatcagaaactacaagccccgagaaaaatgcgtagagagttgcgccagaagatacactatatcgaaaaatatggactggactcccatttagagcgctcccagattacccgcgtgaactacatcaaacatctgttgggcattgctcactatatccgccacattaatcctggcgacgagaagatcaatagctacatcgaaaagcttaaggcttacctgtga

SEQ ID NO: 9769 - RNA, 1017 nt, unidentified
  source 1..1017: mol_type = other RNA; note = synthetic construct
atgaactgggaaacatacagagtcaacttcacactgcgcgccaaggagttcgagtatgatgaagagtacattaacaaatgcctgcagtacagtaagaacctgtttgacagatcccttcctgttatctatgaccagcagcacctgtcagccttacttggctacaagtactccttcttattaaaagtgtccaattctgcgaagaacttttacaggaattttgctattagcaagaagaacggagggttcagaaaaatctcagagcctctgcccaacttgaaggaaattcagcggtggatcctcgaagagatcctctacaaaaacaatgttagcgagtttgcaaaggcttacctcaaaggcaagtcaatacgagataacgttcggtttcaccgggggcaaaaatatgtcattaccatcgacatcaagaatttcttcccatcgattagcgaagagaaggtcttcgtgctcttcattgagatgggttatagtaaaccagtaagcgtgatgctcgctaaattgtgttgtctaaacggcaagctcccacagggagcagtcactagtcccatgctgtccaatatcattatgaaacgcctggacaaaaggatagccgcatttgccgtgaagaatcgcgttagatatacgcgttatgcagacgacctgactttctctggcgatatcgagcccgggaaggtgatcaatttcgtgaaaaaggtgctcgatgcggacaattttaagatcaacgattccaaaaccagggtgatgacaaagaatcaacggcaattggtgaccggatctgtcgtgaatgagaaactgcaggcccctcgagaagtaaggcgtaagatccgccaggaactgtactatataaagaaatttggcttggcctctcatctggagaagctgaatagctataaagccaactatctgaagaggctgcttggtttgattaattactgccttctacttaacccgaaggatgctgagctgataaaagggaagaactacctcaaagaactgctatga

SEQ ID NO: 9770 - RNA, 1056 nt, unidentified
  source 1..1056: mol_type = other RNA; note = synthetic construct
atgaactggaacgaatacgagaataactacattcggctcgctaagctgtcagggaagagcgatgagtactgcattaaacagctcgagtatgccaagcatctctttgaacaagacctgcccgtgatttatacccaggaacacctatgcagactagtaggttacgcgactgagtacgtctatgccatctccaacagtgcatcttgtttttaccgcaccttctcaatcaagaagaaaaacgggaaggaaaggatcataaatgagcccctgccgtctctgaaagagatccaggactggatcctcaaagagattcttgaaaggataaacatcagcccatacgcgaaagcctacgtgaagggaagatctattaaagacaatgctagattccacaaaaggcagaacaaagttctgacaatggacttaaaggacttttttccttccattactttcggtcgagtcctgaatgtctttcgtaaagtggggtacagggaaaatgtagcagtgatgttggcaaatctgtgctgtcttcataatgaacttcctcagggcgcccccacaagtccagccttatccaatatcatagtcagcggattggattataagattgccgagttcctgaaaggcaaagagattagatacacccgctatgccgacgacttgacattctcaggcgacttcattgaaggagacattattaaaagcatcgagcgcatcgtgtgtcggcaaggtttcaagatcaaccatagcaagactagaatcaggaagagaaaccagcggcaggaggtgacgggggttgttgttaacgaaaagctgcaggtgaatcgcgaactgcgacggcgaatacgcagcgatgcttattacatcgagaagtacggcttctattcccacgtggattatacctcgcaaaatcgttccaactacttgtattatctgataggcatcgcatcatacagtctctttatcaacccttacgatgataagatgcgggagtatctcgagatctttaagaaagaacttgctaggtgtaagcaggagggagtcgatgtgtgctctccatga

SEQ ID NO: 9771 - RNA, 1044 nt, unidentified
  source 1..1044: mol_type = other RNA; note = synthetic construct
atgaaatggaacgaatatgagaacaatttcatccagattgccaaaatgcaaggcaagacagaggagtattgtatacagcagctcgaatatgccaagaagctctttgctaataacttccctatcatttacaaccaggtacacttctgcaagctggtgggatacgctgaggagtacgtgttttcagcatgtaatcagcctaaatcattctatcgcacttattacatccctaaaagaaatggcaagaagagggagatcagtgaaccactaccctccttaaaggaaatacagaattggatataccaggagattctttgtaatgtgaaagtctcttcctacgccaaagcatacgtgaagggaaaaagcatcaaggacaatgctcgctttcacaagagacagatcaaagtcctttctatggacattaaagatttctttccctccattggctttaagcgtgtgctgaatgtattccggaacataggatatagggaaaacgtggcagttttgctggcgaacctgtgctgcctgaacaattccttgccgcaaggcgccccaacaagcccagttctgtctaacattatcactagcaagcttgacgacaagatagtgaactatgtctccaaggaacggatccgctataccagatacgccgatgatttgaccttcagtggggatttcaatgaaggggacgtaatcaaaaacgtcgaaaggatcgcgaactcactggggtttaaaattaatgaggagaagacacgggtgcgtaagcggaaccagagacaagaagttacgggcattgtggtcaacgagaagatgcagttaagcaggaaaatcaggaagcgaatcagatcggatatgtactacattcaaaagtatggtgtcgagtctcatctggagcatatcggagaaagccgcgagaattacctgtatcatatgatgggtctggttagttacgctgccttcattaacccctatgatgagaacctaaagaaataccgactctttctcaaagaggaactcaataaacacgtggcactggtggacaattga

SEQ ID NO: 9772 - RNA, 1017 nt, unidentified
  source 1..1017: mol_type = other RNA; note = synthetic construct
atgaaatggagcgactacgcaagcaaacttattgaggaagccatcaagcttgattacactaaagaggctattgatgaatacttgtcttacgccgagcacctccaccgcgcgaaattgcctataatattcgaccaaatccacctgagttttcttgtggggtataagtacgaatatctgctcggagtgagcaacgccccccagtccttctacaagattttctacataccgaaaaagaacggagaagtcaggactatctctgaacccctgaccagcctgaaagagattcagagttggattctgaaagagattctgtataagtgcaaagtctcttccaatgctaaagcctatgtcattggcaaaagtattagggataacgcccggttccacaagaaacagaataaggtgctcaccatcgacatcgaagactttttcccctctatcaagataaacaaggttatcggcgtattcaggagagctggttatagcaaggcggtttcaacattactagctagactgtgttgtacggataatggcctcccccaaggcgcaccaacatcccctgcaatatcaaacctcgtaatgtattacctggatatgaggatctttgggttttgcaggaagcgcgccatacgttataccagatacgctgatgatctaacattttccggagacttcgatgacaatgaactgatctcattcacacgctcgatcctcgaacgtaagaacctgtttatcaacaaccagaagaccagattacgaaagcgacatcagcagcaggaggtgaccggagtcgtggtgaatgagaagctgcaggtgccaagagactatcgcgagcggtttcggcaagagttgtatttcatcaagaaatacgggctggttggccatgtcaaacatattaatgcaggggatccagaccggtatatccgggtgttaattggtaaggccaattttatttcccagattaatcctaacgacacggagatcaaagactacctgaagatcctttacactttgtga

SEQ ID NO: 9773 - RNA, 1041 nt, unidentified
  source 1..1041: mol_type = other RNA; note = synthetic construct
atgaagtggattgagtacaagtcaaagttcattgaagtcgcacagaagaataataagaacaagaagtactgcgatcgatggctgaaatatgcgcggaatctatgggagagggacgtgcccatcatttatacgcaggaccacctctgtgccctgctgggctacgaacctacttatgtatatgcggtgtccaactccccacacaatttttaccattgctaccagatttccaaaaaaaatggagggaagagatctatatctgaacccctgcctaacctcaaagaaatccagcgttggatcctcgagaacatcctttatcgctttgaagttagtccttacgctaaagcctacataaaggataagagcatcaaggacaacgttcggttccatcgaagacagcgtaaggtactgtcgctggacgtgaagaacttctatgaccatttaaccgattggatggtctatcagcttttcattgaggtgggctattctgagagcgtggctatgatgcttacaaacctgtgttgcctggagggatcactgccccaaggtgccccaacttccgctgccctcagcaacatcttgatgaaagacttcgattacaaaatcggggccttctgtaaaatgtacaagattagattcacccgctacgcagacgatatgacatttagtggtgacttcgacgaagtcaaggtgattagctttgtcaggaaatctctgaaagatttgcagcttaccatcaatgatgccaaaacaagggtgcggaaacaaggccagcagcaggaagttaccggcattgtcgtgaactataagccacaattggctaaatcagtgaggaagggcattcgcaaagacgtttactacatcaataaatacggactgcaaagtcacctaaagtatgtgcaggaggaaagaagcaattatttagagcacctctttgggctcataaactacgcactgtttatcaatccgaatgatgaggagatgaaacggtataagatagacatcaagtacttgatgaagaaggagaacgatgagtttaaatga

SEQ ID NO: 9774 - RNA, 1029 nt, unidentified
  source 1..1029: mol_type = other RNA; note = synthetic construct
atggaatggattgaatacgaattgaagttcgccgaaatcgccaagaaacataataagtctcagaaatactgcaagcgctggatggagtatgctaaaaaactctgggatagaggcctgcctatcatattcacccagaaccacctatgtgctctgttaggttaccagcccgtgtacgtttacgcagtatcgaacgccccttgcaatttctatcactactataaggtgcagaaaaaaaacgggggcacccggaatatctctgagcctttacccaatcttaaggaaattcagcgctggatcctggaaaacatcctctacagatttgagattagtccatacgcaaaggcctatgtgaaaaacaggagcataaaagacaacgttcggtttcatagaaggcaacgaaaggtcttgtcccttgatgtcaaagatttcttcggccacctcactgactggatggtctatcagctcttcattgagagtggctatagtgaatcagtcgcaatgatgctgacaaatctgtgttgtcttgaggggtccttgccgcaaggagcaccaacctcagcggcgctgagcaacatcctgatgaaggacttcgactacaagattggagacttttgcaagatgtttaagatacggttcactcgttacgccgacgatatgacatttagcggggatttcgatgaaactaaggtgatctcttttgtgaagaagaatcttagggacatgcagttgacgattaatgacgctaaaaccagagtgcggaaacaagggcagcagcaggaggtgacaggcattgttgtaaactataaaccccaactggctcgctccattaggaaggatatccgaaaggatgtgtactatatcaaaaaatacggtctgcagtcccatctccagtatatccaagaggagcgttcacactacctagagcacctgtttggactgataaactatgccctctttattaactctgacgacaaggagatgaaacgctataagatggatatcaagtacctgatgagcaatgagaagtga

SEQ ID NO: 9775 - RNA, 1053 nt, unidentified
  source 1..1053: mol_type = other RNA; note = synthetic construct
atggagtggaacgaatataagattgcatttatcgaagctgcacgtaaaagtggcaaaaacaacgcttattgtgagaaatacctgaattacgctgagcagctctggatgcatcatatgccggtaatttatactcaggagcacttatgcgcattgctgggatacctgcccacctatgtttacgcggccgccaacgcccctgaggacttttataggcaatttctgattcccaaaaagaatggtggaagcaggatgatcagcgagcctctgcccaatctcaaagagatacaggagtggatccttaagaatatcctgtacaaagccgagatctccacctacgcgaaagcttacatccccgggaagtctgtcaaggataatgtgcgcttccatagacgacaaaagaaggtgctttccctcgatataaaggccttctatgaccacctcacagactggatggtctttcaattcttcatcgagaagggctataacgaagctgtggctatgatgctcactggactgtgttgccttcgcggttgcttgcctcagggagccccaaccagcgcagcacttagtaacctgttaatggtcgagttcgatgaaaaggtgggcctgttctgcaaggaaaaaaagattcggtacacacggtacgccgatgacatgacattttcaggtgatttcgacgagctggaagttatacgctttgttcggcaggaactcaaatccattggactgagactgaacatgaaaaaaacaaggacccgtaaacaagggcagcagcaggaagtaaccggcattgtggtgaattacaaaacgcagctacctaagtctatcaggaaggaaatcagaaaaaacatgtactacatccagaagttcggcctggagtcacacctcgaatatattgggttggagtgtcgaaattatcgcgaacacttactaggccagatcgggtatgccttgttcatcaatccaaaggaccaagagatgaagagatacaaggagattattcacgacgtggacatatgctgtaaaaagcagactccagatcggtttgtctga

SEQ ID NO: 9776 - RNA, 1029 nt, unidentified
  source 1..1029: mol_type = other RNA; note = synthetic construct
atgaattgggacatctataaagagaacttcatacacgaggcaaagaaacaccataagaacgagaactacattaataagtggcttgagtacgcccataatctgaacagtaagaaacttccgataatctatgaccaaaatcacctatgtgagctgatcggcttcgataaaaactacgtatatgccatctctaatggaggcaaacatttttaccgtacatttgagatcaagaagaaaaacgggggcacaagaattattcatgaaccactgcccaatttaaaggatattcagcactggattttgaagaatatcctcgactatgtggaagtttcaccctatgccaaggcataccggaagggatatagcgtgaaagataacgtcaagttccaccgcaggcagaagaaggtactgtgcctggacattcacagcttctacgattcattgaaatccaatctcgtgctggatgtgttcatcgaattgggctacaagaacgatgttgcgatcatgcttaccaatctgtgctgccttaactataaactacctcagggcgctccaactagcagttccctcagcaacataattatgaaaaacttcgactactccgtgtctgatttctgtaaggataatgccatacggtatacaagatacgctgacgatatgactttttctggtgactttgacgagatcaacgtcattaggttcgtcaggaacgaactcaaaaaaattaacctgcggttaaacaatcagaagacgagagtccgcattcagggtcaacaacagttaatcaccggaatagtggttaatgagaagacccagttgcctaagaaaaaacgcaaagagattaggcaaaccatgtactacatcaagaaatacgggatcaacgagcatatgaattttaagaacatcgacaagtcctactatctcgaacacatcatggggattgtgaattatgggctgtttctgaatccccgagacagtgaactgatcgaatatcgatcgatactccaggtgctgaagaattcacaggactga

SEQ ID NO: 9777 - RNA, 1029 nt, unidentified
  source 1..1029: mol_type = other RNA; note = synthetic construct
atgagtgaagagaagaagtgccctcagatcggcagaccacgggagctgtgtagtttattgggacacaaagcagaatacgtttatggcattgcaaacgagacacataaatactatcagcattcccgcataccaaagaagagaggagggtttagggagctctatgagcctttgcccgagctgaaaaaaatgcagacatggatcctgcatcacatcctcgatctgttagagcccagcccctacgccaaagcttatcggaagggttactccgtgaaagataatgcgaagttccatcgaagacaaaaaaaggtcctctctcttgatattgaaggctttttcgatcacatacgcaggtacccagtatttcgggtttttctggatgccgggtacaagaaggacgtcgcaatgctcctggccgctctttgttgccggaatggatgtctgcctcagggggcccctacgtcagctgctttaagtaacctggtgatgctggggtttgatgctaaagttggcgccttctgtagagaacgcggaatccggtatacaaggtatgcggacgacatgactttctctggtgacttcgaagaaaccgaagccatccggtttgtgaaagaagagtgcggaaagttgtctatgaagctaaaccgtgagaagaccagagtaaggaaacaaggccagcaacaggaagtcacaggtatagtggtgaacgaaaagactcagttgccggagagcgagcgcaaaaaaatcaggcaggagatgtactacattcgaaagtacggccttgaatcccacctgaggcacctgcgagaggggcttgcatctggaaagaatcacctccaggaggcttcaggcaatgggaaggaaagctgcctgagagaaactggcacctcgcgtgacctaagcaaggagcgctatctgtcacaacttctcggtagaatttcctatgccctcttcattaaccccagggacgaggccatgcgcgagtacaaaaaggcagtgattgagtggatgaaaaccgacatcatcaagtga

SEQ ID NO: 9778 - RNA, 1041 nt, unidentified
  source 1..1041: mol_type = other RNA; note = synthetic construct
atggattggaacaaatacagggaagattttctgatcaaggctaagaatcagaagaaggataagaaatactgtgacaaatggttgtcctacgctcacaatctctacgagcaagaactcccaattatttataaccaggagcacttttgcaaactggtcggctatatgcccgaatacgtgtacgcggccagcaattctgcagatcacttctatcggacctttttcattccgaagaagtctgggggcctgagaaaaatttgcgaacccctcccaaatctgaaggaaatccaaaagtggatactggagacaatacttagcaagatgcaagtctctgtttatgccaaggcatatatcaagggcaaaaacgtgaaggaaaatgccagatttcatagagcccagaaaaaagttctgtccctcgacatacaggatttcttcagtaaaatttccccttttctggtgtacgaaactttcatcaatgtggggtataacaaggacgtatccatgatgattactatgctgtgttgcaaggagggtggtttgcctcagggcgcacccacgagcgctcttctttcaaacatcatcatgaagaacttcgacaacgtcatcggggactacattatcaagaacaaaatccgatacacacgatacgccgacgatatgacattctctggagagtttgacgagttagaaatcataaggctagtgaggcatgagctaaagaaatatggattctgtttgaatggcaaaaagactcggttacgccaggagggacaacgtcaggaggtgaccggaatcatcgtaaataaaaaactccagatctcaaaggatcagcgcaagaagatacgtcaggagatctatttcattaagaagtatggcctgcaatcacaccttacctataccaacgagcagcggaaaggttatattgaacatctgtttgggaaaatcagttacgctctgtacattaaccctaaagacgaggaattaaaagagtaccgcgaatttctcctgcagtacaagagcaacagtgagatttcgttgaattga

SEQ ID NO: 9779 - RNA, 1050 nt, unidentified
  source 1..1050: mol_type = other RNA; note = synthetic construct
atggaatggattgagtacagagagcaatttatcacaacagctaaaaaagcatccaaaaatagcggatacattaagaagaatctgaagtatgccgaaaaattgtacaatcagaaactgcccatcatctataacgcctcacatttttctaagctggtaggttatagtctgcaatatctttacgctgcatctaacgattcaagcaagttttacagagagttcgagatcaagaaaaaaaatggtggctcccggaaaattagcgaacctctacctagtttgaaggaaattcagaagtggattctggaaaacattctgaacaagatccagaaagagaaagtgagtaagtacgccaaggcatatcaaaagaagatctccattaaggagaatgtcaagtttcaccgggggcagaagaaggttctctctctcgacataacaaacttcttcctgaacatcaagatcgataaaatctacgaagtgttctacaatttgggctattccaaatctctctctacgctgtttagcaatctctgcactttaaattactcattgccccaaggagccccaacctcaccaatcctgtccaatatagtgatgctaaacttcgacaatgaaatcgagaaaatcgttcttgagaaacggataaggtatactcgttatgcggacgacatgacttttagtggcgatttcctggagaaggaaataataaagtatgtcaaggagaacctcaataagatcggcttaaagatcaacaacaaaaaaacccgagtgcgcaaaaattggcagcagcagatggtgaccgggatcattgtgaacgagaaaattcagatttccaggaaaaagagggatgagctgcgccagaccatgtattacattgagaaatacggcattgatagcttccttaagtacaaaggaattaagaacaaggtctactacttaagccaccttaaagggatcctggaatatgcttatttcatcaacaagaacgacaaaaagctgttcaattacatagagtacctcaagaacaatttcttcaaggaaaaaagctcgatctga

SEQ ID NO: 9780 - RNA, 1026 nt, unidentified
  source 1..1026: mol_type = other RNA; note = synthetic construct
atgaattggaagaattactgcgtcgagtttcgcaaggaagcggcattaaaaggaaagaacgaagaatactgtgacacctggctgcaatatgccaaagtcctcttcgacaaaggcctgcctattatttacaaccaggagcacctgtgtttgcttctcggctataaagaagaatatgtgttcgctgtgtccaattcagcttcgaacttttacaggaactatgagatacctaagaagaatgggggagttcgggagatttctgagccactcccctctttaaaggagatccagcgttggatactggataatatcctatctagcataaacatctccgtctacgctaaggcctacgtgaaaaaaaagtcaatcaaggacaatgccagatttcacaaaagacaggaggtgttgctgaccctggacgtgagtaacttcttcgatagcattagcagtgataagatctataacctgttcctggaccttggctacaaagaggacgttgttgtcatgctgacaaatctctgctgcttgaacggatggctgccccaaggtgccccaaccagtccaatgctgtctaacattatcctgagacagtttgacaatgtcatgggaaaatataccaacgaaaagaaaatccggtatactcgctatgcagatgatatgacttttagcgggacatttaatcccggacagatcatatcagtagttcggaaggaactgttccgactcgggcttcagctcaatgagaacaagacaagggtgcgcaggaaggggcagtgtcaggaagtgacgggtattgtagtgaacgaaaaattgcagctcccgaaaaatgtgcgaaaaaagatcagacaggatctgtactacatcaggaagtacggccttgagagccatatggagtactgcgatatttccaaagagaagtatttgcagcatctgaagggtcggatccaatacggcctattcattaacccttatgactacgaattacaaggctatctatcctaccttgagaatatgtacgggcagtattga

SEQ ID NO: 9781 - RNA, 1026 nt, unidentified
  source 1..1026: mol_type = other RNA; note = synthetic construct
atgaattgggacaaatactgcaacgaattttgcaaagaagcggagcacaatggtaaaaacgctacctactgtaatacctggctgcagtacgcaaagtcgctgtatgagaagaagctaccaatcatttacaaccagaagcacctgtgcctgcttctcggctacaaggaagaatatatatacgccgcttccaattctgcaataaacttctatcggacctataaaattcccaagaagaacggaggaacacgagagatcagtgagcccttgcccagtctgaaagaaattcagaggtggatcctggataacgtgcttgcccctgtaaacatttctgtgtatgcaaaagcctacgtcaagaaaaagagcatcaaggagaacgccaggttccataagagacaacctatagtactgtcccttgacgtggagcggtttttcgacagcattacttcagacaaaatctattccctcttcctaaaactcggctataaagaagatgtctccgttctgttgacgaatctgtgttgtcttaatgggtgcttaccacaaggtgcccctactagccccatgctcagcaacatcgtgttgactgagtttgacaatatcattggcaaatacaccaatgaaaagaagattcggtacacaagatacgctgatgacatgaccttttctggagacttcaagcctgggcagatcatctctttcgtgaagtacaatctcagtaacctgggcttaaagctcaatgagcgcaagatcaggacacgcaaaaaatgccagcgccaagaggtcacaggtattgttgtgaatgaaaagatgcagttaccaaagccggtccgaaagcagattaggcaggaaatgtattacgttagaaaatacggactggagtcacacatgcagtactgtgatatatcaaaggagaactatttgcagcatcttaaaggccgtatccaatatgggctgtttatcaacccatatgattacgagctgcaggattatctcggctacctggacaaagtgtacgggaagtattga

SEQ ID NO: 9782 - RNA, 1020 nt, unidentified
  source 1..1020: mol_type = other RNA; note = synthetic construct
atggattgggaggattacaaaaacgaattcatcagagtagccaagaaaaatgaaaagaacgaggattattgcgacaaatggctgaagtacgctaagaagctttatgataaacgcttgccaattatcttcaatcaggagcatctgtgcctgctgctagggtacaaaaagcagtacgtctactcagtctctaattccccggcagacttttaccggtattataagatacccaaaaagaacggcaactttcggcagattagtgagcccctcccttcgctgaaagagattcagaaatggatccttgacaatatcctggtgaacgtcgatacaagtgtgtacgcaaaggcctacataaaaaagaagtcaatcaaggacaacgctcgatttcatcgtaagcaaaaggttctcctttcactcgacatcaagaactttttcgacagcatctcctctgataagattttcgatctgttctggaatttgggctataaagaggatgtggtggtcatgctgaccaacctttgctgtctcaatggtagtcttcctcagggagcccccacatccccaatgctgtctaacatagtgttagaagactttgacaatgagattggactgtataccatggaacagaaaatcaggtatacaaggtatgccgacgacatgactttttctggcgacttccaccctggtaaaataatctccaaagttaaacgccagttaaatgatctcggcttaaaactgaatgatgagaaaacgcgaaccagaggaagaggacaaaggcaggaggtgactgggatcgtggttaacgaaaagatgcagctgccccgccctgaaaggaagaagattcggcaagaaatgcactatattataaagtacgggatcgagagccacctggagtattgtaaaatcgaaaaggcgaactacctgagccatctcaagggcaaaattgagtacgggttgttcgtaaacccatatgattacgaattgaaggagtacctaagctacctcaataatattaaggactga

SEQ ID NO: 9783 - RNA, 1059 nt, unidentified
  source 1..1059: mol_type = other RNA; note = synthetic construct
atgactatactgttggtgttggtagaaggctctttcttcatcatgcaatgggaaatttacaaacggaagtttacgcacaaggccaaaagcgccagatttgatgaggggtacatcgaacgatgccttaattatgcagagaacctgcataagcagggggttcccatcatttatgacatcgagcacttttctcatctggtcggctatgacgtgagctatcttctacgggcaagtaatgcccaggctaggttctaccgccattttaccataccaaagaagaacaacacagagcgatccatatcggagcctctgcctagcttaaaagaagttcagaggtggattctcgataacatcttggataagctggccttatcccgctttgccaaaggattcgttaaaaaccggaacattaaagagaatgcgaggttccatagaaaacagcgttacgtgctgagcctcgatattaagaacttcttcccgagcatcaagtacaaacaggtctttcacctcttttcctctattgggtattgtgaatcagtgagcaccctgttatcaaatctgtgcacactagataatagtctgccccaaggggctcctacttccccagctatctctaacttggtctgtcgacgggtggacagtagactgtcaggcttcgccctgaagaataaaatacggtacacccgttacgcagatgatattacgttctcaggtgactttgacccaggaaggatcctcaggttcacatctaaagtgctgagcgagtctaagttcactgtcaacaagaccaagacaagacttatggaacagcaccaacgccaggaggtcaccggcatcgtagtgaattccaagatgcaagcgcccagggaacttagaaagaaactccgccagcagatctattatattaaggagtttggtttggagagtcacctgaaggccaccaataataaacgcgctaactacctttcccacctcaagggcctcgctggattcgtgctgtttattaataacaaggactcggacgcaaaagaggccatcgactttctggaaactttctcctga

SEQ ID NO: 9784 - RNA, 1047 nt, unidentified
  source 1..1047: mol_type = other RNA; note = synthetic construct
atgggcttagtcgaaaagaaattcaattgggaagactatagtgaaaagtttacagttttggcacgtaatgagggacgagacgccatctacgccgagctatgcctctcctatgcccaccgcctttattccaacaatatccctattatctacgacgttgagcacttgtgcaaacttgtgggctacgataaatattacgtgctgggagcctcttacgaaacagagaagttctacaggaaattcaaaatccccaagaaatcagggggttttcggactattcacgagcctctgcccagtctgaaggagattcagagatggattctggataacatcctctataacatcaacattagcaaacatgctaagggcttcatacatgaccttagcataaaggataatgcaaagtatcatcgcaatcaaccttgcgtgctgtccttagatatcaaagacttctttccctccatcatgcggcaccgggtttatgggatatatcggagcattggatatacccagctcatttcaaatatcctatctcgcatatgtacccttaacgaatctctgccgcaaggcgcgccaacttctcccgctctctcgaacatcatttgtttcaatctggatcgtcgactggctggcttcagtaagaaatacgactacaggtacaccagatacgctgacgatatcacgatttccggtaacatcgtagccgggcgcgtgataaggtttgtgaaaaagatcctcggggattacgacttgtttctcaatgacaataagactcgactgatgcaaagacaccagagacaggaagtcacaggcatcgtagtgaacgagaaaatgcagaccccaaaggagattcgccggcatgtcaggcaggaagtgtattacatcaacaagtatggaatggacagccacctggataaaattaaggatgtcaggagcaattacgtgaaacacattatcggtatagtcaactacatcaagtttgtgaacccaaatgacagacatgcagcgcaggccctgtcaattttgatggagaactacaacaagaagtga

SEQ ID NO: 9785 - RNA, 1038 nt, unidentified
  source 1..1038: mol_type = other RNA; note = synthetic construct
atgcccagtagcctgatttggaagaaatacagtcaagctttcgccaagaaaggcaagaaggagggacacagcaaggagtacatacatacctgcttgaactatgcagaacaactctataagagatccgcacctattatttttgatccagtgcacttctccctgctagtcgggtattctccaaaatacatcatggccgtgactaacagtccggataatttttatcgacagtttagcatctccaagaaaaacgggggctcacggaatatcactgagcctctgccctcactgaaggagatacagcactggattctgaccaacatcctgaacaacattcctgtttcgaagtacgcaaaagcctacatcagcaaggaatccatcaaatccaatgctcggttccaccgaaaacagccaacagtcttatgtctcgatatcaaagacttttttggatccattcacggcggcattattttcaatctctttcgcaccatcggctaccgttcttctatagccagtttgctgaccaacctctgcatatatgatgatgcactgcctcagggtgccccaacttctccggcgttgtcgaatatcattatgaaggggttcgaccagcgcgcagccggtttctgtaagaaaagggagatcagatatactaggtacgctgatgacctgacatttagcggaacgttcttcccaaaggaaataatcagattcatcacatctgcgctgtcagaccttaagatggacttgaatcccaccaaaacgcgtattttaggacagggacagcaacagcgggtaacagggatcgtggtgaatgagaagatgcaggttccccggaaaaccaggagaaacctaaggcaatcaattttctacatcaagaagtacggtatcagctctcatcagaaccatgaaaaaatctacaagagcaactatgtccgccaccttcttggcatagccaaccatattctgtttattaatcccaaagacgccgacgctctcaatgctttatccgtgcttaaacctctgctcaataaaaagtga

SEQ ID NO: 9786 - RNA, 1026 nt, unidentified
  source 1..1026: mol_type = other RNA; note = synthetic construct
atgaactggaagaagtatcggaaagagtttaccattcaggctactgccaagtctctcgacgagaagagcatgcagcacgcgctgagctacgctcgcggcttatacaaagccaatctccctatcatattcagtcagaaccatcttagcaggctcgtggggtacaatattgactacattagaaacgcctcatctaccaaaagtgatcagttttatcgatgctacaagattaagaagaagtcctctgataccatgcgtactatttgcgaaccgttgccctccctgaaggaaatccagaggtggatcctggacaacatcctatcccaagtcacaattagtaagttcgcaaaagcctatgttgtgggcttctctattaaagacaatgctaggtttcatctgagacagaaacaggtgctgaggatcgatgtaaaagatttctttccctccattaaagggcagaacgtattccacatctttaagaatatcggttacagcgctgaagtgtccgcaatgttgacagggctgactaccctgaaaaactgcttgcctcagggagcaccaaccagcccaaccctttcgaacatatttatgaataggtgtgacgctagaatagcaggatattgtttagcccgcaaaatccgctatacacggtattcagacgatctcacattcagcggcgaatttgacgttggaaagctgatctcattcattaatatggtcttcaaggattcaggacttctgctgaataagactaagaccaaacagatgtttaagcaccaacgacaattcacaacgggtctagtggtgaacgagcgtataaacgtctgtcgcgagaaaagacggaagctccgacaagagatcttttacatcaagaaatacggcctggatggccacttgatacggaccgaggagaaacgcacgaattacatcatgcatcttctggggctgagtaacttcattactcacattaacgccaatgacagagacgcgctcgaggccaaggaaatcttacggaaatatatcacatga

SEQ ID NO: 9787 - RNA, 1029 nt, unidentified
  source 1..1029: mol_type = other RNA; note = synthetic construct
atggaatggcagcaatacaaggccttgctcatcgcagaggcccaggctaaagggtacagtgacgaaaagttgttagagacgctcgattatgccaacaacctgatcaataaatcattaccggtcatttatgacctgaaacacctgagcttacttgtgggctacaagacagcctacatccagcgggcaacccaccgcagtcaattcttctataggcggtttgagatacgaaaaaaatcgggagccacaagggttatattcgagcctctcccatctttgaaagaaatccaactgtggatcctgaaaaacattctgaacaattgtccgatctccaagtacgctaaggcctacgtaagaaagaaatctataaaggatgccgcacgatttcacaagaaccagaaatatgtggtgacaattgatatcgtgcagttcttcgagtttataaattatcccactgttcttggtaagtttattctaatgggatactcaagagaagtatccacgatcctcaccaagctctgttgcaaaaacgacagcctgccccagggtgctcctacctctccctcactgagcaatatcgtctttgcagacatcgatttcgaaatttccgagtactgctatgctaacaacatcagatatacacggtacgccgacgacctgattttcagtggcgatctggaacctaagcttttgataggaaaaattgaggggattctgctgaataatgggttcattttgaacaacagcaagactagaatcatgaggccatggcagcgccaaattgtcactggccttatcgtgaatgagaagagcaaagttcaggtgccaattgaggcgaggcgcaagctgcgtcaggaaatgtattacatcaataaattcggcctcgactcccatctgtcctacaccaagaactataaagcgaagtatctgatacatctacttggcgtggctaagtacatgttttttatcaaccccaatgataccaaggtcgcaaattacatctaccagctcgagtcttatattaacaattga

SEQ ID NO: 9788 - RNA, 1113 nt, unidentified
  source 1..1113: mol_type = other RNA; note = synthetic construct
atgatgcctttgaggttacgcctaagagattacataatctcctacaaccactgcaatgccgctgtttcatcttctattatggtgtggcagacatatcaagccgactttactgccaaggctttagctgcacgacggcctatagctgaaacggaaatcctcctggcgtacgcaaaaaatattcatgacaaagggatgcctattatctatgacatcggccacttgagtcttctagttggttacaaggtcgacttcctggtggctgcatcaacctatccacgcgcttactatcgaaacttcaggatcaagaagaaatctggggcctcacgtgtgattagtgagcccctcccctctcttaaggctatccagacctggatcctcgaaaacatactggagaagttcgaggtgtccctttacgccaaggcctacgttaaaggcagaagtatcaaagagaacgcccggtttcataggaaccagaataatgtgctgaccattgatatcaaaaacttctttggatccatcactaaggtgcgcattatttccttttttagctcccttggatattcgcgtcaggttgcgctcctgctggcaaggttatgctgcaaaaatagtcgattgccacagggagcccccacaagcccaacactgagcaatatagtcctggtggccttcgatgagaagctgtttaacgtgtgtagcctgaacaaagtccggtttactagatatgcagacgatatcacgtttagctatgagaacaaaaacctcaccggccccttgatcgagtacgcacgggaactactccggggggaaggtctggtactgaatagagacaaaactagattgatggagcggcatcagagacaagaagtaaccggagtgattgtgaacaagaagcttcaggtgcctattgagatcaggaaggatctccgccagattttctactacataaacaagttcggcctggactctcacattgagcgcattcaagaaaaaaggtcacgttatctgtatcacgtactggggctgtgtaatttcgtcctcttcatcaatccgaatgacaaggaggtcaagggctacctgatcacagcccgcgattaccttaccagcgaagagtga

SEQ ID NO: 9789 - RNA, 1038 nt, unidentified
  source 1..1038: mol_type = other RNA; note = synthetic construct
atgaagtgggaagtgctgaaagacaagatcataaaagagtgtaagttcgcaaacaagagtgagaagtatactagcgcttatctagagtactgccgaaagctttatgaaaaggagctgcccattatcgcaagtcctaaacattttagcttgttggtgggcatcgatcacgaatacgtgtgcaaaatggcctatagccaaaatttgttttaccggtccttcaagattaataaaagcaacggaaagaagcgggagatcaaagaacctctcccagacctgaaatatgttcagaagtggatcctgaacaacattctgaacaaagtggaggtcagtgattacgctaaggccttcgtcaaaaaccgtacactcaaacataacgcgaagttccataaaaaacagaatgtcgtagtcactcttgacataaaggattttttcccatccattaccctctatgacgtggctgacatctttaaagatctaggttactttgagaacgttgccttatttctcgcgaacctgtgctgttataaaaaacagctgccccaaggggctcctacatcaccatacctgtccaatctcagattccgcaagatcgacgactccatttctagttacaccaaagagctgaatatcagatacaccaggtatgccgatgacatgacattctctggagatttcaatccgcaccagttaattaaaaagatttccgacatcatccacaactctggctttaacataaattcaaagaagacccgcgtggcctacaagaacgcacgacaggaagtgacaggaatagtagtgaacagccacatgcaagtttcgaagaataagaggagggacatccggcagcaggtgtactacatcaagaaattcggtctggattctcaccttacgcatatacaggaaactagagccaattatttgaatcacctgctgggccagattaatttctgtctttttgtcaatcccaaggataatgagatgaaacagtactttgggcagattaaggatctcatgcaaaagcagaactcagatgactga

SEQ ID NO: 9790 - RNA, 1029 nt, unidentified
  source 1..1029: mol_type = other RNA; note = synthetic construct
atgaagtgggaagtggtagagaaaaacatcaaaaaggagtgcaaggcaaggcacaaagatagtgtatacattcagaagtacatcgcctactcaaaaaacctcttcgacaacgatcttcctatcatcagctccccagagcatttttccctgctgattggaatggagcaccagtatgtgtgtaatatggcatatgcggccgacagattctaccgccatttcacgatccccaagagcaatggaaagaagcgagaaatagacgagcccctgcctgacctgaagtttgttcagtcatggatcctcgaaaacattttagaaaagtgcccaatctccgaatacgcgaaagcttattacaaaggccgcacactgaagcataatgcaagattccaccgcgctcagtcaatagtcctaaccatggacattaaggagttttttagctccataagcgtccgtgacgtgactaagatctttgaggacatgggttatttccacgaactgtcttgtttccttgcctacctgtgctgtttgaataacgtgctgccgcaaggcgcacctactagcccctatttgagcaacctgagaatgaggatccttgacaataaaatctctcagtacacatcccagaggaagatccggtatacccggtatgctgatgatctgacttttagtggggacttcaatccccaccacgttatcaaagacatttcgaagctagtttatgatgagggctttgtgataaaccctgataaaaccagggtggctcgtcgaaacgccagacaggaagttacagggattgtcgtgaactctcacatgcaaatttctaaagagaagcgcaagcaaattcggcagcaagtctattacattaaaaaattcggggtggagagtcatctcgaacggataaatgagtcaagggccaattaccttaatcatctcttaggtcagatcaattttgccctcttcgtcaacccaaaagatgaggagatgaaggaatacttcaacgtgattaagaccctgttggtggatcagaactga

SEQ ID NO: 9791 - RNA, 1041 nt, unidentified
  source 1..1041: mol_type = other RNA; note = synthetic construct
atggaatggagtacactgagaaatgccattattcggaaatgtaaagaacatcgtaagggtgacgaatacagcgaggcactgctgtcttattccgaaaagttgtttgtccagaacctcccgataatcacctgcccggcccatctgagtcttctcataggattagagcacgactatgtatgccgaatggctttttcgccagaacacttttaccgccatttcaccattaagaaggcgaacggtaaagacaggtcaatagatgagcccttgccagacctaaaattcgtacagcagtggattctgtccaacatcttggaaaatgtccccgtgtctacctatgccaaggcttttatcaagaaacggggggtgaaggagaacgctcggttccacagggcccaaacagtggtggttacaatggatatcaaggatttcttcccatctatcaacttacagcagatcgtgaacatattttgtaccctcggatactcaaacgacgtgagcaactttatcgctcacctgtgttgctatcactattctttgccccagggcgcaccaacttctccttacctctcaaacatcagaatgcgcgagtttgacaaaaaagtggttgactattccagtcccctgaagattaggtatacccggtacgcagatgacatttcactgtccggcaatttcaatcctcacactgcaatcaagtaccttagtagccttgtcttcaaagaggggttttccattaatgccgaaaaaacacgcgtcgcctaccagaatgcccgacaagagatcactggcatcgtggttaatagccacatgcaggtccctaaagctcagcgcaaaaagatcagacaggaggtgtactacattaagaagtacgggctcgattcccatctgagccatataagcgagactagagaaaactatctcaaccaccttctaggaaaaatcaatttcgcgaggtacatcaatcctaaggatcaagaaatgcaagagtattacgagacgattaagaagattctgattctgttccgtaatgagagcttctga

SEQ ID NO: 9792 - RNA, 1092 nt, unidentified
  source 1..1092: mol_type = other RNA; note = synthetic construct
atgtatgcaaagaattctttggtagtacagtccataaaatgctatgtagctttgctgggggattacatgaagaaaaactactacgacaagatcattctggagtgcaaaaagcacaacaagtcccaggagttcgtggatacttacctggcctattatgagaacctgacccagaaaggcctgcccgtgatatcaagtcctaaacactttagcatgctggttgggatggatcacgattatatttgctccatggcgtacagtccaaagcatttttacaggacattttacatcgaaaaggcaaatggcatgaagagaaaaatatcggaacccttaccagatttgaagtacgttcagaaatggatccttaaaaacatcctggagaaagtgaaggtgagtccatacgctaaagcttatgtctccaactcttcagtgaaacataatgcccgatttcacaggaagcaaaaggtcgtgctctctatggacatcaagagcttctttccttccgtgaaagtgaagtctatcgtggatattttcaagtcctttggctacaccgagaatgtcagctgctttctcgcctacctgtgttgtaataactactgtctgccgcaaggcgctccaacgtcaccctatctttcaaacctgcgtctgctaaagttcgacagcataattagccaatacacctcccttcggaagattcgctatactcgctacgccgacgacttaacattcagtggtgacttcgacccttctaacctcataaggtttgtgtctaaatgtgtgtgggaggaaggattcaaaatcaacagcgacaagactagagtcgcctatggaaatacacggcaggaagttaccgggatcgtggttaatgataaaatgcagatccccaaaaccggacggaagaagattcgacaggaggtttattacattagaaagtatggtgtcagcagtcatctctcacatattaatgagacacgcgtccactatcttaaccacctcttggggaaaattaacttcgcactattcgtgaatcctaatgatatcgaaatgaagggctactacgactatattatcagcatcatcgaagatgtcgactga

SEQ ID NO: 9793 - RNA, 1044 nt, unidentified
  source 1..1044: mol_type = other RNA; note = synthetic construct
atgatggattgggacaaatttaagacacaagctatccaaaaggcacgtgtggatcgaattcgcgatatagagcttcggagctatctgtcctatgctgagaagcttgtgaaacagaatctgcctgtgatcgtagacgcagcatccctggcatcattcgttggcatcgatttgctgtatctctgtcaaatggcctatgggactgagtatttctacaggaggttccagataagcaagaagagcgggggtatgcgtgaaatcgctgagccattaccagatctgaaggctgtccagaattggattctgaccaacattcttaattacacttcagtgagtaagtacgccaaggcctacgtcaagaaccagtcaatcaagtctaacgcccggtttcaccgggaacagaaagtgctcgtctccatggatgtaaaggatttctttccgagcatcaaaatagaggacgtgtttaagattttcgtcaacctgggatatattgagaacgtgtcttggtttttagcccatctttgctgcctgaatggcgaactacctcagggagcccccacctctccctacctctccaatctaagaatgaggaacttcgacagcgaagtgggcacttacgccttggaaaacggctggagatacactagatatgccgacgacctcacgttcagtggtgatgggaatgtgaaggaactcatccggacagttagtgggttgctgctgaaaaaccacttgtaccccaatacaaagaagacgagagtcgctcgccaaaacaccaggcaggaagttaccggcattgtggttaataaaaaaatccaaaccgcgaagcagtatcgaaagaaaattcgccaggaggtgtattacatcaaaaagtacggattggactcacacctgaccttttgtcagatctcccagaaaaactacctaaatcatctgcagggaaagatactgtatgcgctgttcgtaaaccctaaagacaaagagcttctcgagtacaaagagtttattagcgacctcctgatcaagacaaaatcgtctttaaaatga

SEQ ID NO: 9794 - RNA, 1035 nt, unidentified
  source 1..1035: mol_type = other RNA; note = synthetic construct
atggattggaatgagttctgcaatcatgccaaattccaagcatccgtggatggaattaatgaagaggaactgaaaaagtaccttcagtatgcaaaacgcctggttagaaaggacctccccgtgattgtggacccatactcactggccaaattcatcggcatcgacttccactatctgtgcaacatggcttatggaacagagcatttctatcgaaactttctgatccccaagaaaagcggtggcacccgggagatttctgaacccctacctgacctcaagcaagttcagcactggatgctcaacaatatcctgaactacatcgagatctctaaatacgccaaggcgtatgtaaaaaaacagggcgtgaaatctaatgcccgcttccatagggggcagaaagtccttgtgtcgatggatgttaaagacttcttccctagcattaagaagatagacatctttcacgtattccacggcctgggttacgatgaaaacgtgtcctggtttatggcctacttatgttgcttaaatggtgagctgccacagggagcccctacctcaccatacttgagcaacattatcatgagttcttttgacaaggacgttgccagttacgcaatcgaaaagaagtggcgatatactaggtatgctgatgatctcacattttccggcgacggaaacgtggaagagcttatacgggtagtcagcgaattgctcctgaagtatcacctgtaccccaataccaaaaagactagagtggcttaccaaaacgctcggcaagaggtcacggggatcgtggtcaataagaaactccaggctgcacgtcagtacaggcgcaagatcagacaggaggtgtactacataaagaagtatggcattgagagtcacattgcgttttgtcagatttcacagaagaactatctggaacatttgcaagggaaaatagggtacgccctgtatgtgaacccgaaggatattgagcttttagagtaccagaagtttctacatgaagtctccgatagcttgcagaatcagtga

SEQ ID NO: 9795 - RNA, 1056 nt, unidentified
  source 1..1056: mol_type = other RNA; note = synthetic construct
atgcagaataaaaactgcacttgggaccaataccgatctgcattcatcgaattagctcagaagagtaacaagagcaagccgtacatacgaaggtgtctggaatacgccgaacccatttttgaaagaggactgcccatcatctttgatgttcaccacctttcaaagctcaccggcagaagcgcaaaacacatcttctccctgagtaggtttgcccgctgccattaccgctccttttcaattacaaagaagagcggaggagagaggaggattgatgagccagtggaggatttgaaatatatccaacggtggattctacacgagatcctggagcgcttaccagtgagcccatacgccaaagcgtacgtgcctgggcttagcgtgcgggacaacgcacgcttccatcagaaccaagacaagatcttgaccgtagatattaaagactttttccccagcgtgcggagtaagtcagtgtttttcgtgtttcggaatgctggttatagcgacacagttgcaacgattctatctaatctgtgttgcctggaacatcgcttgccccagggtgcccctacatcgccaatgctgtctaatcttgtgttctcagatctcgacaaggtcatagcggatttctccatacagcgggggctcagatatacccgttatgccgatgacctgaccatctctggctctttagacatcagagagactctccattttctttatccgctgctgaacaacaggggcttccgtctgaaccccgagaaaactagggtgctctcccgaaatatgagacaggccgtcaccggaatcgtcgttaatcaatacctgcaggtccctctcaacattcgcaagaacatcagacaggacgtcttctacataagaaaattcgggctcaaatcccatatggaacacatcgacgaaaccggcgataattatattgacaggctgattggcatcgtggggtacgctatttttgttaatcctcacgacaatgagatgaaggattatttctcctacctgcggagtttgaagaacgatgagaaagtacagacagcttga

SEQ ID NO: 9796 - RNA, 1071 nt, unidentified
  source 1..1071: mol_type = other RNA; note = synthetic construct
atgaaggagtcaaactattcatggaacgagtacaaatttcggttcgaacagaaggctatcgacttcggccacccgctgtctaagatcgagggtctgctgctctatgcacagaaactttttgccgcaaatctccccgttatttacgacttacgtcaccttagctacctgactggataccgtgaggaatatatgctgcgggccacgagccgaccagaaaatttctaccgatactttaggatagcaaaaaagaacggccatagtagagagatttcggaacccttgcccggactaaaagagatccaatattggctgctcgacaatgtgatcaaaaaactgcctccaaacaagctgaacaacgcctatcttgagggcagatccattatatccaacgcgaagttccacactaaacagcagaagctcctgaacattgacatcgagaaatacttcaacaacatcaccaaaaagcaggtggaaggcttcttctctagtctcggatacaatttagaggtgtcatctctcatagccggtctgttgactatgaaggatgggcttcctcagggttcgccttccagcccatacttgagctctatcatgaccgtccaaatcgatgtaacacttctcgccgagtgcagggcattggggctaagatattcccgctatgccgatgatatcagtatctccggagaatttaataccgaggaagtggtcaaaaaggttaatgccgtgctgttagcgaatgggttcaaagctaatagcagaaagaccacagtgaaaaagtctcaccaaagacagatggtaacaggggtggtcgtcaacaagaagttgagcgtcaagaaaaaagtgattaaggaactgcgccaggagctgtactacattcataagtatggcctggaacaacatctgcgaaggaaggagatacagaggcgcaattatctgaacgttctcgaaggcaaactgaattacttttgttctgtgaagcggaacaatgctgagctatcatatattcggaggatgctctccgaaatcaagattcgcgagagcgctgagcagcttcggagtgcttttgaatga

SEQ ID NO: 9797 - RNA, 1044 nt, unidentified
  source 1..1044: mol_type = other RNA; note = synthetic construct
atgcaggagtcaatcttctccaaaaacgaatacctgttcaaacttgagaagaaagctcaagagctggggttaccaaatcagtccgtgctcgggctgctcagttacgccaaaactctgcaagagaagaatctgcccgtgatcttcgacatcaaacacctgtcttacctgacaggtttcaaggtcgattatatcctgcgcgccattaagtctcctgacaagttctataggaccttttttatcaggaagaagaacggcagatctcggcagattaaggagccgctgccaggattgaagtctattcagtactggatactcaacaacattattaagaaggtccccacgtcgcgttttaacaatgcttattcgatagggaaatccaccgtcagcaacgcgaaattccatactaaacagcaattcgtgctaaacctagacatcgaggcttttttcgacaatataacggcctcaatggtaagcttgttcttttccaatttgggttataacagcgatgttgtttccgtattgagtagtctctgcacattaaatggaagtattcctcaaggatctccttctagcccctacctctccagcatcctgaccatcgacatcgatgaaaatctgtacaagtactgtcgagaacggaatcttcgctacagcaggtatgcagatgacatcaccattagcggctcatttcacgcaggagtggtcatcgccggtgtgagaaaactgctgaatagccttaacttctccattaatgactcaaagacaagggtgaagtcacagcaccagagacagctagttacagggctggttgtgaacaaaaagatagccgtcaaacgatccgatttgaaagaatttcgccaggaaatgtattacattatgaagttcggcatcgagagccatgtaataaagcagaacgtgactaaaaacaactatatcgatcatctcctgggcaaggcaaatttttatctctttgtgcggaagaaagatagtgacctttttaagtacaagacctaccttattgacgtgttaaaaggcaaaaagtga

SEQ ID NO: 9798 - RNA, 1044 nt, unidentified
  source 1..1044: mol_type = other RNA; note = synthetic construct
atgaattacaacaagtactccataatcttcaagcaggaggcgaacaaccagggactgtctgaggacgagattgaagtgtacctgacatatgccaaagttctcctggacaaatccctccctatcatttacaatcaggatcatctctcgaaattactcggcattcacccgatctacttgtatactctgactaatagctccgacaaattctacaggaagttcaaaatcaacaagaagaacggcaagaaaagaaatatagaagagccactgagtatcttaaaagaagctcagtactggattcttgaacacattttgcttaagtgctcatgtagcaactataccaaagcatttaaagccaactcatccatcaaagagaatgccaagttccacaaaaagcagaatatagtgatcaatctggacatcgaagattactttggcactatcaagggccacaaagtctacgaattttttcgcaccttggggtataacaacgaggtaagcatcatgctgaccaagatatgcacaaataaagattctctgcctcaggggagcccaacttccccctacctttctaacattataacggagaacttggacaataagctggctgagctggccaagaaggaggaatatggactgagatatacccgatatgcagatgacatcacctttagtaccaacaacaagattaacattacgaatctcatcatcgatacaaaatacgtcctaaagcaagagggtttcaagattaactataagaagaccaaggtcatttctagcaataagcggcaaatggtaacaggcattgtggttaatgacaaactccaggtgagtaagcaacagcgcaggaaggtgaggcaggctatgtattacatcgagaaatatgatctggagtcacatattcggaacattggttggcaaaagggaaaggataaatatttacgtcatctgctagggaatatcaattttgtgcttttcatcaatcccaaggacaaagaacaccttaagtacaaatcacagctcatacagaaactgaaagaaatctga

SEQ ID NO: 9799 - RNA, 1041 nt, unidentified
  source 1..1041: mol_type = other RNA; note = synthetic construct
atgttcacgaccaaacccagcctgagcgagtacaaactctccttctcaaaggaggctcgccgcaaggactacaacgattacgacattaaagaattcctggactatgcggagatactgtatctcaaagacctgcccataatctacaacatcaaacactttagcctgttagtgggctataaggagacatatttagcacgagctgccgaaacaacatttaacttttaccgctcttttgacatcagaaagaggaatggaaaactgcggaaaatcgatgaacctctcccctctctcaaggagatccaaacctggattctgactaatatcctgtacaaactcgactgcagcaaatacagcaaggcatataagaaaaagaactcgatcaagaccaacgccaagttccaccgggatcaggatgtcgtattgtccctggacgtcaaagattatttcgggtcaattcgtgtagaggacgtggagttttttttcgcagaccttggctacgaagaaaatttgtcaggcatgctcgcatctctatgctgtcttaacgggagcctgcctcaaggctccccaaccagtccatatctgagtaacctcataactatcgagctggacaacgatctttctgaattggccaagttatataatgtccggtacactaggtacgctgatgacattacttttagtggaacctttacagttggtgtgctaattaataaagccaaggaggtggccaccagatatggcttcgaaattaacgataagaagactagggccatggggaaacatgaacagcaactggtgacgggaatcgtggttaatacaaagaagttgcaggtgtccagagagcggagaaaggatttgcgtcagcagctgtactatatacagaaattcggtttggagaatcacctggcgaagcgaaacattaataagaggaactatcttcagcatctgctcgggctaaccaatcatatccttatggtcaatccgaaggatgaggaagctctgcgctacaaacaggttattttctcctacatgaacgactga

SEQ ID NO: 9800 - RNA, 1041 nt, unidentified
  source 1..1041: mol_type = other RNA; note = synthetic construct
atgaattttctgacatacgagcagaaatttaaggaacaggccgagctaagcggcaaatctgagtattatattgacgagtgccttaattatgccaggaacctcaacaagaatggtctgcctattatttacgacgatgtccacctgagcaaactgttgggcatccgcttggatttcctgatcagtattagcaattcacagaaagactactatcggtttttctccatttctaaaagtaacgggaagtcacggaaaattgcagaaccactgcccctgctgaaagaaatacagcatttcatccttgacaacattctacttaaagtcccatgttctgtctattcaaaggcctacaaaccaggcgctaaattaaagagcaatgccaaatttcaccgcaaccagcctgtcctgatcaagatggatctcaaagactattttccaagtctggacgaacatagagtgtataagttcttccatcaccttggatacaaagattctgtgtccgtgttgctcgctaagttgtgcacattgaacaaggcattaccgcaaggagcaccgacctcaccctacctcagcaacctcctgacaagggagctggatgaagatatctacctgttttgcaaagagaatgggaatctaagatacactcgttacgccgacgatatttccatctccgggaatatgatccccactaatataatcaagggtgtggtaaagatcatcgctaaacacggcctcaagattaacaaagaaaagaccgcggtgatccctaacagtaataggcaggttgttacgggcgttgtggtaaaccaaaagcttcaggcttctaaaccctatagacactccatacgcctcgagatgcattactgtatgcggtatggaatcgaggaccatataaagaagtcgaagaagattagcaacaacaccaacaagcgaaagtactgtcagcaaatgctgggaaaggtgaatcactgcctccagttaaaccctaatgacagcgaaatgaagtcctaccgagatttcctgctgcaaaagatcgtggagtga

SEQ ID NO: 9801 - RNA, 1056 nt, unidentified
  source 1..1056: mol_type = other RNA; note = synthetic construct
atgaatttttcaacctaccagcgggaattcatcgccgaagccagaaagcatgacaagaatgatgaatacatagagaagtgtctcgcatatgccaagaatttggtagataaacgccttccaatcatttacgacgagaagcacttttcccagctggtagggattgacttagattaccttctttccgccgccaatagcccaaagcacttctatcgatattttaccatcccaaaaaggaacggaaagatccggcggatatccgagcccctaccggtactgaaggaggcgcagtactacattctaaacaatatcctcaagaaggtgccttgctctatctatgcgaaggcctacaaacctggggctactctgaaaggcaacgcaaaattccacaggaaacagcccatcctggtcaaacttgatctgaaggactattttccgtctctgcacgagagtcgcgtgttccagttatttcatcagagtttcgggtacggcaagtcggtgtctattttaatgagtaagttgtgcacgctggatggaggcctaccccaaggtgcccccaccagtccatacctctccaacctgctcacctcagagatggatgacaagatataccaattttgcagctctaacggcaacctgcgctatacaagatatgctgacgacattagcattagcggatccatgaaccctagtgatataatctccggggtgtcacgaattgtgagcgagcatcatctgcagatcaacaaatcaaaaactgcagtgttcagacctcataagagacaggtcgtcacaggagtcgttgtgaacaataaaatccaagctcccaaggactaccggcgcagcatcagactggaaatgcactattgtatgaaatacggtattgagtcacacattttgagggctactaagaggtcttccgacgcagttgaccgtgttaaattctgccagagcatgttgggaaaaatcaactattgtctgcaactgaattctaaagatacagaaatgcagaggtatcgtgattacatgctcgaacagctccacggcaatgctcagtga

SEQ ID NO: 9802 - RNA, 1083 nt, unidentified
  source 1..1083: mol_type = other RNA; note = synthetic construct
atgaactttataacttacgagaagatgttcacagaggctgcccgtaaggctggcaaatctgatgattacatcaagaactgcattaactatgccaaagcacttgccgataagcatgtgccaattatcttcgacatccaccattttagccagctgatcggtatcaggctggacttcttgctcgctatttctaattccccaagaaacttctacagatatttcaccatccctaaagcatcgggcaaatttaggaaaatagcagaacctctgccaatcctgaaagacatccagcactacatcctccataacatcctgaaaaagattccgtgcagtatttatgcgaaagctttcaagccccgcgcaagtctcaaggggaatgccaagtttcacaggaatcaacagacactaatcaagctggatattaccgattactttagtaatctgcacgaatcaaaggtcttctacttgttttttcacaccgtcggatacagcaagagcttgtctactctcctgacaaagctgtgtactctgaatggcgggttgccacaaggggctcccacatccccctacttgtctaacttactgaccattgacatggacaccgccatttttcagttctgcagcgaaaacgggggactgcgctacacgagatacgcagacgacatatctatttccggagctatgaacccctccagcgtgatccacgccgtaacgaaaatagttagtgacaatggcctgaaaattaacaagctcaagacagccgtgataaaacaccacagccggcagatcgtcaccggtgtggtggttaatcagaagcttcaggcccctaaaaactatcgaaaatcaatccggctagagatgtattactgccagaagtacggcctgatttcccatttacagaagtcaggtaaatcgtctactcctcttgatgcagcgaattattgtcagtcacttcttggaaagatcaactattgtctacaactcaatgcctatgatactgagatgaaaaagtatcgggagtacatgctgaagcagttccatcattataatcaatccctctattccgccagccaggctttaaagtga

SEQ ID NO: 9803 - RNA, 912 nt, unidentified
  source 1..912: mol_type = other RNA; note = synthetic construct
atggagttcaccatttacgacgtattaaagtttaaccccttcatcatcaagaaaattttggctaacaaggacaagtactacaagatattcattatcaagcagaggaatggaaagacacgtcagattactgccccagtgagggagcttaaagtgttacagaagaacattctgaagagcttgctagaaaagatggaatattcaaagttcgctaaggcctatactaagcagaaaagcattaaagacaacgcaaactttcaccagaaacaggccttggtcatctgcctcgacataaagaatttcttcgacaatatcaggttcaacagtgtgaaagatgtctttcagaaaatttccattggcaaggccgagattctggcagaaatctgtacttaccacggaaaactgccacaagggggtgttacatcgccttacctgtccaatctaattatggaacccatcgacaaaaagatatccaacttctgctttaagtacgatctgaattatacgcggtacgctgatgatattaccataagcacccatcttctgtctaaaaatgagcgcgaacgctttgttaagctggtcattgagaatatcaacaacattctgtcagaatacagttttacactcaacgagaagaaaatcaaagtacagtatgcgtaccagcaacaaagagtgacaggcatcatcgtgaataataccatgcaggtgcctaaagaatatcggatgaaaatccgacaggagatctattatataaagaagtatgggctcgattctcacctcatgagaaaccatcaagagaaacagaaatacatcaacatccttaagggcaagataaattacgtgctgtttgttaatcccaaagatgagaagatgaaagaatacctgcattatatcgagaaccacctcagatgttga

SEQ ID NO: 9804 - RNA, 1041 nt, unidentified
  source 1..1041: mol_type = other RNA; note = synthetic construct
atggatttaaacgagtatatcgagcagttcaccaaaaacgcaattcacaagctgaatccagaagaaataaatgtgtgcgtccgctacgccaccaatttgatgaataaaggactgcctattatctacgacctaaagcacttatcctaccagaccaaatatgagacaggctttctctatctgtgtatcaactttaaagacaaggtgtatcgccagttttccatcaaaaaacgaaatgggtctgaccgcaatatttccgagcctctccccaatctgaagaacattcagacgtggatcaaaaaaaatatcctggaaaagctgtcggttcacaaggtcgctaaagcatttaggaagaaccagtctatcaaaaacaacgcctatttccacaaaaaccaagatactgtactggccctcgacattaaggacttcttcaataatattgacggcaagactgtgtatctcctgttcaggcggtgtggttacagtagacgtgtgtccaacattttgaaggagttgtgcacctttaatgattgtctgccgcaaggggcacctacaagcccaatcattagcaatttgattttcgctgcgattgacaaccgaatttacaattttaccaggaaggagaatctctactatacacggtacgccgatgatataaccatatctggaaacgacatcaaaatcaagaaggtcatcagcttcatatcaatggtacttaaggagaataacttcgagctcaaccaagacaagatcaaaatcatgcggaagaacagttgccagctggtgacagggattgtgagcaacaactcagttcttaatgcccccaaatacaagattaaagacttaaggaaggagatctattacattcggaagtacggaatagatgatcatatggcctacgttggcatcaaaaaggcgcattatatcgaacacctgatgggtatagcaaacttcatactgttcatcaacaagaacaacaaaatcgctactgaagctcttgattttctaagagaacttcagaagcagagaaatcatcccttttga

SEQ ID NO: 9805 - RNA, 1041 nt, unidentified
  source 1..1041: mol_type = other RNA; note = synthetic construct
atgaactggaccgactacaaaaagcagttcgaactgaagtgtgatttgaaaaaaatccctcaggtacaggtcgatgtgtggatcacttacgcaaggtgcttatgggagaaaagctttcctatcatatttgataaggcccacctgagtaaacttctcggctatgagtgtagcctgctagacaagataatccacagacccgggaaattctacaggtcattctcaatttcaaagcgaaacggagaatttcgagagctcaacgctccctacccaacacttaatgagattcaaaagtggatacttgtcaacatcctcgaaaaaaaaaaggtgagtccttatgctaaagcctacattaagagaaagaaaatcctggacaacattcggtttcatacaaatcacgaggtggtgatcaaattagatgtcgatgacttctttggatccatccacaagagcgccataatcaagatcttcaactccatgggttattctcggcagttgtcttttgacctggcttccctctgttgcctgaagaaaagcctcccacaaggtgcgccaacctctccctgcctgagtaatattttctgcgaacaaatcgatgcccgtctatcgaaatacctcaagaaacttaacctgtgctatacccgctactccgatgacattacaattagcggaaatatttccgacgtgcagatcccgcagattatgagcttctgtaagtacttattgtctgactacggcctgaacctgaacgaaaagaagaccaaggttctaaggcagcaccaaaaacagtatgtgacgggcgccgttgttaataagaagatgagtgcagacattaagctgaaaaaggatcttcgccagcagatgtattacatccagaagtatgggctgaattcacatatggtctacaagagaatagaccagcaaaattatgtgtaccatttgatggggaaaatccagtgggtactggcactggagaaatctaatcaggagttcttgcggtataaggagcatctcactgaaattctgaagaacctcaaattttga

SEQ ID NO: 9806 - RNA, 1041 nt, unidentified
  source 1..1041: mol_type = other RNA; note = synthetic construct
atgaactggattagctacaaggagaagtttaaggagacatgtcaaaagaagaatatcagcgagattcaaattcagaaatggttggggtacgcaagcgtgctgtatcaaaatggactgcctataatctttgataagaagcacctggccggacttctggggtttaaatgggaactcctgaggaatataatccactctcagacgaagttctatcgaaccttctatatcccaaagaaaagcgggggccggcgatgcctaaaagagccgtatccttcccttaaggaaatccagaactggataaaagacttcattctcaaaaagtgtagcatctccagattcgccaaggcttacgcaccaaaaaggtcagtgtacgaaaatgtacgcttccacaaaaaacatgcggtggtaatgaagtttgacgttgaggacttctttggtagtataaacaaatggcaggtcacttcactgttcgagaaaatgggctataatcaagaccttgcagaaatcctggctggtctatgctgcctcgacaaccatctgccccagggagcccctaccagtccctacctctccaatattttcgccaaagatatcgacaacagactgtctaagtacttgttgaagagaggtctttattacacacgctactcggacgatattactatctcagggaatatttccgataaacaggtgccacagatcattagtttctgcaaatacttactgtctaactacggcttgaggctgaacaatgaaaagaccaaaatacttcggcagcatcagaagcagtatgtgacaggagccgtggtcaacgaaaatgtctctgttgagtcaaagaccaagaaaaagctgcggcaacagatgtactatatccagaagtttggcttagagtcccacatgaatcatctggaaatcaagaagcagaactatgtctaccacttaatgggcaaaatttgttgggtgttgactctcgaaaagaagaacgaggagtttaaacgttataaagatgttctcaaggagctgctcgatgctcccaaaaactga

SEQ ID NO: 9807 - RNA, 1041 nt, unidentified
  source 1..1041: mol_type = other RNA; note = synthetic construct
atggactgggggaattatcagaagagattcaagatttctgcgaagaaaaggaatctacccgattcattcatctcagaatgtctggactatgctaagaagctgtatgacaataaggtgcctataatctttgatactgagcatctctctttgctactcggatgcaagattcagtttctctacaagatcacgaacaacttgaataagaactaccgcatctacaaaattccaaagcataacggcaaaatgagaaccataaccgagccttactctgacctgaagaatatccagcaatggattctggttaatatcctgcaaaaaatgcctgttagcatctacgccaaagcttacatctcgaataccagtctgaaatccaatgtccggttccacgtgaagcagcccgtcattattaagcttgacgtacaggacttctttccgagtatccaccaaatcagcttagtgaaactgtttaggaaatatggctatgagctgaacttatccaggatgctctccagactgtgtacctacgagggggttcttccacagggagcaccaacatccccctatattagtaacctgtactgccgccgaattgataatcgcatcggtaagtacataacaaatgcaggcttcaggtatacacggtatagcgatgatatcaccatcagcggtaatatctcagacaaacagatagggaccattattcagttttgtcggaaatgccttgccgaagaaggcttgaaactgaatgaagggaagactcagatattgcgtagccaccatagacaactggtgacgggtgtaattttaaaccaaaagatatccgccggaactaagaagaagaaagatatccgaaaacaggtgtacttcatcaaaaagtacggcctcgaatctcatattgagcacgagaagattgagaaacagaactatatctatcacctcgccggactgatcaactgggtgctttttctcgagaacaacaacaaagaattcctggaatacaaaaagttcgtcaacgagatcataaagcagattaacagctga

SEQ ID NO: 9808 - RNA, 1053 nt, unidentified
  source 1..1053: mol_type = other RNA; note = synthetic construct
atggacttctttaagtacatttcagactttacactggccgctaccgagagcgggtacaatgaggaggaaatcttatccttcctgcagtacgcccggacgctgtacgacaagagcctgcctattatctatgaccaggagcacctttccctcctggtcggcttcgattattactgctgtctcttaccaatttcaaattggcaggttgacttctacaaaaagtacgaaatacccaaaaagaacggcggtattcgcattatcgaagagccttatccagccttgaaggagatacagacatggattctgaagcatatccttgagccagcaagcctgaggtatgtttcccctgtggccaaggccttcatgccaggcaaaaatctacgagagaacgcaaggtttcacagaaaacaagaactggtcgtagcgttggatctccacgacttttttggtagtgttaaggcagtctctattttccagctgtttcggaaattcggatacaacaagagtgtgagcatgatgctctcgaagctatgcactctaagaaattctctgccccaaggagctcccacgtccccgatgttgagtaacttgatcttctacgaactggacaaaaaattgttccggtattgtcaagctcgcaatatcagatatacacgctatgcggatgatatgacattcagcggagattctttttctgtctcccatctgattgcctatgtgaaaatgctcgtggggaccaggcattataagttaaacgaagagaaaaccaacgtaatgcgtaaggggtgctgccagaaggttactggagtggtggtgaatgataagatccaggtatcaaaatcatacagagataagatccgacaggaagtgtattactgcataaaatttggggtggctgatcacatgcggaaaatcagcctgccgggctggatcactacccctaccatctacctgcaccatctccttggcaaagtcaactacgtgctccagataaaccccaaggacaaggtgtttcttgagtataggaagtgtctttgtgacctgctgctcaattga

SEQ ID NO: 9809 - RNA, 1038 nt, unidentified
  source 1..1038: mol_type = other RNA; note = synthetic construct
atgaattttaaaaaataccgctctgagttccttaaacgggccctcgagcacggctaccaacgctcagaggtggactcgctgctggtttacgcaaaggtgcttttcgacaagaacttacccattatctatgatcaggagcatctgtctctgcttcttgggtatgactatgattatctcttggcactgtgtaatagccagacaatgttctacaagcagtacgaaattcctaaaaaaaacggagccaaaagattgatcctcgaacctttcccaaacctcaaagatattcaaacctggatcctgaaaagcatactggagccggcctcagtgaagatggtgttcccgcaggctaaggcctttatgcccggcaagaacctaagagataatgccaggttccacaggaataccaatgtggtggtcgcgctggacatacacgacttttttggatctgtgaaggagaaatacatctacaacgtgttctacacaatgggctacaaaatgccaattgtggtgatgttaacgaaactgtgcactttgaacgggttcctaccacaaggcgctccaactagccccatgcttagtaatatggttttttccaacatcgacaacaagatcttcaagtattcccgtaagcgatctatcagatatacccgttatgcagatgacatgaccttctccggtaaggaaattgacgtcgagaatctgatccgctatattcggagtctcattgggcacaagcagtttctcttgaatgaagaaaagacaaaggtgatgaggcgcgggtgcagacagatagtcaccggagtagttgtaaacaaggtcctgcaggtccccaagaaatatcgggataaagtgcgacaggaagtctattacagtatgaagtacggctttacttcacacatgagaagcatagagctgccttcctggattagcacagttgaagtatacaagcatcatctgctgggtaaagttaactacatcctccagatcaatcctaaggacacggagtttttgaggtatagggattggttacgggcttga

SEQ ID NO: 9810 - RNA, 1050 nt, unidentified
  source 1..1050: mol_type = other RNA; note = synthetic construct
atggacttcaaagagtataagaaagcgtatatcgagcaagccctggccttcggtatctcgacaaatgcaatcgatattgctatcgaatatgccgagcatctgcacaacagaaagttgcccattatatatgatcagcagcatttcttccagctggtcgggtacgatgaagcttacgttatggccattgtgaaccagcctaaaagcttttacaaggagtacagtattcccaaaagaaacggcgacagaaggatcattcatgagccgctcccctctttgaaagagattcagacttggatacttaagtacatactgaatcccggagccaagatctttgtttcaagtgtagcgaaggcttatataccaaaacaatctgtgcgagacaatgctcgttttcacaagcgccaaaagtatgtgctttgccttgatctgaaagactttttcgacagtatcagctttcagcaggttttttccgtgtttcggaatatgggatattccaaggccctcgcaaccctcctctccaatatctgtatcctaaacaatagcctgccacagggtgcacctacatctcctatgttatcaaacatggtgttcaagtactacgatgataaaatctttgactactgcaaaagccgcaacatccgttacacacggtatgctgacgacctaacattttctggagacttcaattgtaaagccgtcgtgtcctttattaggaaggtcctgtcaaagaccagcttcgctattaacgataacaagactaagttcgtgagtcgcggcaacaggcaagaagtcacgggcgtggtagtgaacgaaaaactgcagactgcagccatataccggaaaaagatccggcaggaggtttactatattataaaattcggggtcgacaagcatctggaggcaattgagtggaaaagaccaattatcgagtacttacaccacttgctggggcgaatcaacttcaccctcaccattaataagaatgatagcgagatgaggaagtactacgaatatatccactccgtgctgaaggaatataaagaagaatga

SEQ ID NO: 9811 - RNA, 984 nt, unidentified
  source 1..984: mol_type = other RNA; note = synthetic construct
atggagctgctgcttaactatgcacagagcttaaactctcataacttccccatcatttatgaccagtcgcacttctccaaattggtgggatataggtatgggtacatcctctgtatttgcaatagtcctgacgtcttttacaaggaatggaaaatcaccaagaggaatgggaagcttcgcaccatccacgaaccgttgccttcactgaaagaaatccagaactggatcctgaaagaaatactaaacaccgcggttaatgagttcgtgtctccagtggctaaagcatatacacctgatcgcaatattagagacaatgccagatttcacaagaacaaaaagattgttgtctgcctcgacattgtagatttcttcggaactgtaacgtacaagcaggtgtacagcatatttcgacaatttggttacaacaagagtatcgccacactactgtcaaacctgtgcatattggagggatctctgccacaaggcgcacccactagtccaatgctgagcaatctgattttctatcatatcgacaccgctatttttaagttctgtaaggagcggaagataatgtatactaggtacgccgatgatcttagcttttctggggatttcaatgtgggcctgttgatcagctatatatccaaccttctgtcctatcacggcttttccataaacgagaaaaaaacaaaggtcttaagccgcggccggtcccaacagattaccggcatcgtcgttaatgagaagattcaggtgtctaggcggtacagaaaaagaattcgacaggagatttaccatattatcaagtacggtctggaaaatcacctcaaaaagatcgcctatcccaaaagtagcatccagtatctgcaccatctcatggggaagattaacttcgtgttactcatcaacaaatcagacaatgaggctatccgttacatggaatacctcaagtcaatctacaattcctacaagacactcatctga

SEQ ID NO: 9812 - RNA, 1032 nt, unidentified
  source 1..1032: mol_type = other RNA; note = synthetic construct
atgaattgggtcaaataccagaccaatttcatcaatagagctagtgatcggggcctggacgaaggcacaatcaattttcttcttgcatatgcgaaagcgttgtatgacaacgagctccccataattttcgataagtatcatttggccaacctggtgggttataaagtatcatacctggagcgtgctacaaaaaatacgtcaagattctacaagacgtacgaggtgccaaagaagcaaggtgggaagcgtatcatatctgagcctttacccagcttgaagcacatccaaaaatggatcctggtagagattctcaacaaactaaagcctagcaaatatgccaaggcttttatcaagaggcggaatactaagagtaatgccgtgtttcataggaataagaatatcgtccttactatcgacattaaagacttcttcggaagcatcaaggcccctgccataatagatctgttcaaaaagttggggtacacaaaccacctatcctgtctgttgggagatctgtgtaccctgaacgggaaactcccacagggcgcttcaactagccccgcattatccaacctgattttcttcgaggtggataacaaaatctccgactactgctcgtctaataacatcttctactctagatatgccgacgacttaaccttctccggcgattttaacgtgggcaagatgatcacatttgtccgcgaatgctttaatgaggccaattttaccattaacgaagaaaagctgagaactcgacgaccgcaccaaaggcaggaagttaccggcatagttgttaatcagaaactgcaggcaccaaaagattatcggcgccattttcgccaggaagtgtattatattaagaagtacggactgcagggtcacctcgagtttattaaggagaagaggaacaactatctcctccacctcattggaaaagggaactacatctacttccttaacaaaaacgacatttacgtgaaagagagtcttattttcctgaaggaactgtactttaagatgatgcggtga

SEQ ID NO: 9813 - RNA, 1029 nt, unidentified
  source 1..1029: mol_type = other RNA; note = synthetic construct
atgctaaattttcgcttcagtaaagagtacgtccagcttgacttgtttgatgatttcggaaacgaggacagaggtgctgttgtccagcagtacataaaatgcattagcgataacaaagccaagccaatcctggacacacaacacctgtcaaagcttgtaggatacactgagcagtttctgttctccgtgagcgcctcccccctgcacttctatagagagtacaagatagccaagaagaacggcggggtgaggaccctgaatgaacccctccctaccctgaaggctgtccaaaaatttatcgctggcgaaatcctgaatgatgttgaaccccataaagtggccaaagcgtttcggaagaaccacacattgcgtggtaatgctgtgattcacaggcgccgccccttcatgttaaagatcgacattaaggacttcttctcgaatatcacagagcatgcgatttatacaatgttcttcgaaattggctacacgaggcaagtgtcacggctcctgactggattatgcaccctgaataacggtctaccgcagggagcacctacctctcctatgctcagcaatttagtcatgcgggagttcgaccatacggtgtttgaacactgtgtgcagaatgacatattttacaccagatacgccgacgacatggcattttctgcaagcgatgatcgagtcaagtccctgatacccttcatcagatccgagctcaaaaaatacgggctcgagatcaaccagaagaaaacaagttatagtggccctggggcaaggaaatatgtaactggcatcgtggtgaatgaacggctcaacgttctgcgaattgaccgcaagaatatccgacaggaaatgtattacatccggaagtttgggattaacgggcatctgagaaaaaccaacaactcttcaccaaactatgtggataggttgatgggccgtctcaactttgccttcttcgtaactaaggaaccacactttcttgaggatatgcgctatctgaaggagttgaagaaagttctttga

SEQ ID NO: 9814 - RNA, 1029 nt, unidentified
  source 1..1029: mol_type = other RNA; note = synthetic construct
atgttgaacttccggttttctgaggaatacattcagctcgacctgtttcatgactttggcttagcggatcgcgagagtgtcgtttcagaatacatcgaacggatcagttctaatcgcgccaagccaattttcgatactcagcacctgagccacttagttggctacagcgaacaattcctgttcagtgtatctgcttcccctgtgcacttctatcgagagtataagatagcaaaaaagtccggcgggttgcggaccctcaatgaaccacttcctactcttaaagccgtccagaaagtgatcgtgcacgacatatttagagacgtggaaccacataaagccgccaaggcttttcggaaaaaccacacgctccgcggcaatgccgtgatccacaggcgacgacccttcatgctcaaagtggacatcaaggacttcttctctaacatcgatcagcatgctatttatactctcttttacgagacagggtacaccgagcaggtcgcaagactgctcaccgggttgtgcaccctgaacgggtgtctgccgcaaggagcacctacctcacccatgctgtcgaacctggcgatgagatccttcgataacgccgtctttgagcactgtgtgcaaaacgagattttttatacacggtatgctgatgacatgaccttctccgcagtagacgaacgcgtcagaaatattatcccctttattcgtagcgaactgaagaagtgcaggttgcagataaacgagaaaaaaacatcattcagcggaacgggagcccgtaagtatcttactggcgttgtggttaatgagaggctcaacatcctaaaggaggataggaagaatctgcggcaggagatgtactacataaggaagtttggtatcaacggtcatctgagaaaaacagagaatcacagctccaattatatcgaccgcctggctggaaggctaaatttcgcatttttcattaccaaggaagcccattttcaggaagatatgagataccttcaggagttaaagaaagtgctgtga

SEQ ID NO: 9815 - RNA, 1029 nt, unidentified
  source 1..1029: mol_type = other RNA; note = synthetic construct
atgctcaaatttcaattcgcccaggaatacgtgcagctggacctgttttcagacttcgggagcgaggatagatatgagatcgtccaagaatatatcgacggcatagccatcaataacgccaagccggtcctcgactctctgcatctgagtaaaattctcggactttctgagtacttcctgcactcggtgtccgcaagtcccgaaaacttttaccgcgagtacaaggtccctaagaaatctgggggcatgaggattatcaacgaacctttacctactctcaaactagtgcaaaaaagcattgtggacgatctgctgcggaatgtggagcctcacaaggcagctaaagcgtatcgcaagaatcacacgttgagagggaatgccgtcattcaccgcaagcggccctatatgctaaaggtggacatcaaagatttctttcccaacattgatacccatagcatctatcagctgtttttcggattaggatacactgcccaggttgcccgccttctgaccggtctatgcacactgaacaacggcttaccccagggtgcaccaacctcaccactcctttccaatttggttatgcgaggcttcgatgcagctgtcttcggccactgcatcgagaaagaaatattctacacaagatacgccgatgacatggctttttcatccaaggctccggatctgccaagcctgcttccatttttgcgtcaagagctgaaaaagtgtcgattgcagataaatgacaagaaaacagacttcgcaggaaagggggcgagaaagtttgtgaccggtatagtagtgaacgaacgactgaacatcctgaaggatgagaggagaaagttgcggcaggaaatgtattacatccgcaggtttggactgaatgggcatctccggaagactgataacgactccgctaattatatcgataggctcctgggccgtcttaacttcgcctacttcgtaacaaaagaggctaaatttcaggacgacatgaggtacattattcagctcaagcgggttgtgtga

SEQ ID NO: 9816 - RNA, 1038 nt, unidentified
  source 1..1038: mol_type = other RNA; note = synthetic construct
atgagcaagtttaaaataacgcagtctctgactcacacccagctggatttgttcaataacagctcattcttagatcacgaagagatagtgacccgatacggaaataacattaggtctaatggcgctgttgtgatctatgacaccaagcatctctccaggatcatcggatatgcagaaagccttttgcatgccatttccagcagcccgcaacacttttataggacctttgagatacccaaaaagtcaggaggggtgagagtgattaatgaacctctgcctactctgaaggaaatacagcggtttatcattgactatatcctgcgtggcgtagaaccccataaatctgctagggcctttcgcaaaaactacaccctgagaggagctgctgtcattcacaagagtcgcaactatatgctcaaactggacatcaaagatttttttgggtccatcaagtccttcggcgtctatgatatctattacaatctgggttacacctcacaggtagccggcctgttgagcgggctgtgtactctcgacggggagctccctcagggtgcaccaacatcaccattgatcagcaatttattcctgaaggatttcgatgagtacattttcgactattgcaagaacaactctattttctacacacggtacgcagacgatatgaccttttcttccaacgaggatacaatgaagcacataattggaatcgtcagatcgcgcctaagtaagcacggtctgaagttaaaccaaaaaaagacttccctgtctggcaagggagcccgtaaattcgtgaacggtatcgttgtcaatgaaaaaccaaacattctcaggagtgagcgcagatcgctgcggcagactatgtactatatcaagaattacgggattgacggccatattcgggtggcgaaaattgacacgcccaattacctagaccatcttctcggcaaacttacattcgcccacttcgtgacaaaggaggaggtttataaaaactacatcgactacatccgaagtataaagtccatccttaagtga

SEQ ID NO: 9817 - RNA, 1029 nt, unidentified
  source 1..1029: mol_type = other RNA; note = synthetic construct
atgcccgatttcagattctctcaggagtacgtgcagctggatttgtttaacgactttgggagcctggatcgccgggaaatagtcgcaacatacgtgaccgagctgactcgcaacaaagccttggtacttttcgacgtgtcacacttcagccggctcgttgggttctctgaaggtctgctgcacgccatttcggctgcgcctttttacttctatagaagattcgatgtccccaaaaaaagcggaggcctgcggaccatttgtgaaccatttcctacattaaagttgatccaacgctttattgctgaacaggtcatcgccaactccgaaccacacaaggccgcccgagcatttcgacagaatcatagtttaaggggtgccgcagtgattcataaagctagaccttatatgctgacccttgacatccgggacttcttccccaccatctccggattttccgtctatcgggtgttttttgacctaggctataccgctcaaattgcccgcttgctttctggcctttgcaccctggagaacgggcttccccagggagctccaacaagtcctgcattatccaacctcgtactacgtcggttcgatgaagttatcttcaatgagtgcaaaagtaggggagtgttctacacgaggtacgctgatgatatgacattttcttcaagggaggacaatctggcggatctgataggggtcgtgcgcaaagagctgaggactgacggattgaagctcaatagcaagaaaactgtgatggccggcaagggcgcgagaaaatacgttaacggtgtagtggtgaatgagcgtccaaatatcctgcgagagaagagaaggaacctccgcaaggacctgtactacattaaaaagtatggcattaacggccacgttcgtttttcaaatatcgacatcccgaattatctcgaccacctcatcgggaagctaacatatgcccatttcataactaaggatcagaagtataaggaagacgcagcctacctctacgagctgaaaaagctgacgtga

SEQ ID NO: 9818 - RNA, 1032 nt, unidentified
  source 1..1032: mol_type = other RNA; note = synthetic construct
atgtcaactttcgcttttgacaaggatctgcagcagcttgatctgtttgacagttttaagaacgagaaccgtgaggtgattgtcgctgagtattcccgaattattctggaaaatggcgccgcagtcattttcgataccgaacatttgtctaggcttctggggttctcacaggagctcctcttcagtataagcgctgcctcaaataagtactacagagagtacaccgtgctcaaacgatctggggggcgacgggttattaatgaacccctgcctacgctgaagatgatccagcgttttattctagccgagttgcttgacggcgtacgcctacataaggctgcccgcggataccgcaaaaaccacacactgagaggcggggccatcatccacagaggtagaccttatatgctaactttagacgtgcaagacttctttcccagcatcaatcaataccaggtgttccaggcgttgctcaaactgggctacacaaaacagatcagcagactgattactggactgtgtacactccacgatggactgccacaaggggctcctaccagcccgttactgtccaacttggtcctctatcaggcagacaaagccatctttgaccactgcgtggttcggggtctgttctacacgcggtacgcagacgatatgacattttcttcaaaagaggataacgttgtagaaatcattccagtagtgcggacacagttatccaatgtcggcctgcgcatcaacccacgcaaaactaatgtgagcaggagaggttcccggaagtatgttaatggcatcgtggtcaacgtcaaacccaacatactcaaaaccgaacgtaggagtcttcgccaggaaatgttctacattaagaagtatggcatagagggacatataaggtggtctaaggtggaggccccctattatgtggataagctcatcggacggctgacctttgcgttgttcgtgaccaaagacaagaggtattcgcaggaaatcaggtacctttccgccctgaagaaggcaatgcaatga

SEQ ID NO: 9819 - RNA, 1032 nt, unidentified
  source 1..1032: mol_type = other RNA; note = synthetic construct
atgaccccttctgccttgaatattagattcgacgatggcgtggatgaaaaccatagggaactcgtctacttatacgcttccagaatagagtctaagggactgactgtgatcctgtcacctgaacacctgggccatctgctccaaatgagactggaggacatctatgctatatcaaacgcacctcagcacttttatagagaatacagagccaagaagaaatccggcggtacacgcaagatctctgcccccctgccactgctgttgtcgattcagcggtgggtgctgaaaaacattctagagccgcaagcaatccacccagcggccaaagcatatcttaagaagtcctctattaagcagaatgcacggttccaccgcggtcagaggcacctgtttaagagcgatgttcgtgactttttcgggagcattagtagccgctgggtgtattcccattttcagtcattgggatactcgcgtgctgtgagcatggttctcacagctatttgctgcaaagagaatgctcttccacagggcgcccccacatccggatatctatcaaacatctacatgacgagctttgacaaggccgtattctcttattgtactgagcgcaagttccggttcactcggtacgccgacgacatatccatctcaggatccggaatcaatttctctgagctgagtgcgtttgtgaaccgggaattacgagatattgatctgaaaatgcacagtggaaaaacccgactcatcaggagccatcaaaggcagaaggtgaccggggttgtcgtcaatgaaaaactcggccccggccgggatttcatccgaaaactgagacaggagtattactacattagtaagtatggggtggaggagcagagtagggtcagcgggtggaacaatagcatcgcctacctcaacaacattcatggtcgcatcgctcacgcaatatttcttaccgggcacgacgcccgtttgttagaaatgaagaatgccgtagaaagcctccttcgcaaatccgagtacatcaggggctga

SEQ ID NO: 9820 - RNA, 1032 nt, unidentified
  source 1..1032: mol_type = other RNA; note = synthetic construct
atgaacttcagtgacctgaagatcaaattcgacgatggcgtggaggacgggcacaaggatctggtgcatcagtacatctcacggctggagtcccaggggctctcagttattttgagccccgagcactttggtcatcttttacagataaggcttgagcatatctacgccatctcaaatagtcctaggcacttctatcgcgaacatcaagccaaaaaaaagggcggaggaactcgcaagatctctgcaccattacccctactcctcttcattcagcgttgggtgttgaagaacatcctggagccccaggccattcaccctgctgcgaaggcatacctgaaaaaatcctccataaaacacaatgctagattccacaggggccaggcacacctttttaagtccgacgtaaaggacttttttggcagtataagctctggatgggtgtataaccacttcctcgggctggggtattctagggctgtcagcatgctattgacagctatctgttgcaaggaaaactgcctgccacagggtgcacctacatctgggtacctgtcaaacatttacatgacaaatttcgatcaggtggtctttagccattgtttgaaacggaagttccgatttacccggtatgcggatgacatttctatcagcggctctgagattaacttcaaggaactcagcacgtttatcgaccgagaacttcgcaatattgatctgaagatgcatacagggaaaacccgtctcatcagatcacaccagagacagaaagtgactggagttgtcgtgaacgaaaagttgggcccgggccgcgattttatgcggaaactgagacaagagtactattacatcagcaaattcggagtcaacgagcaagccagggtttcgggttggaactccagtactgcctatttaaataatttccatggcagagtgacccatgccctgtttctcaccggacacgacgagaagctgtccgaaataaagaatgccgtagagaatctgctgcaacggtccgaatacattcttggttga

SEQ ID NO: 9821 - RNA, 1020 nt, unidentified
  source 1..1020: mol_type = other RNA; note = synthetic construct
atgacaagctcagggatcaaaatcgttttcgctgaggcaatgaagccggagcagtcagccgctgtgagagcgtacatcaagcatttcgaagaaaaaaatctccccgccattttgtccggggaacatctgagccttcagctcggaatcaagcagtctactctgtacgctatcagtaattctgctaacgctttctatcggaccttctatgtgcagaaaaagaatggtggtaagaggcaaatatctgcacccctacctcttctcttggctacgcagcagtggatcttgtcaaaaattctccaaagtgtaacggtgcatcccgccgctaaagcctacaagaaaggcagctcaatcaaggagaacgccagatttcacaaaggacaggagagtttatttaagagcgacgtcgaggatttcttcggttccatttcccagttctgggtctatgagtttttccactccctggggtacactaccgcaatctctaggctgctggccggcttgtgttgcaaggatggcgtgctgccacagggagcggcaactagcgggtacctgagcaacatctatatgtgtgtgtttgatgacgccgtttttacctattgccaaacaaatcgtctgcggtacacccggtatgccgacgatatagcaattagtggagccgggatcgactttgataagaccaaggacattgtgtctacacttcttgaaaaccacaaactgagaattaaccttcgcaagactcggattcaacggagaaatacaaggcagaaaataaccggcgtagttgtgaacgacaggctggggccagaccgccagtttctccgacgcatccgccaggacttacactacatacgaaagtttggagtccatggccacgcacgccaacgaggcttcaaatcgcctctgttttgcattaacaatctcctaggacgtatcactcacgccaaattcttgttaggcagaaatacacctctcgagggcgagaagaagtacctggaaaggctgctggatcagatttcctga

SEQ ID NO: 9822 - RNA, 1020 nt, unidentified
  source 1..1020: mol_type = other RNA; note = synthetic construct
atgtcactcttgtcagacaactttgagtttggtgggaagatagggatagcagaaagggaagcggtagagaaatatgcccagcgactaatagacaagggcctgcctgtgatcttttcccccgagcatctttctcacattacaaatatccggctggaggctttgtatgcgatgtccaattctcaagagtcatactatcggagctttgacattcccaagaagtcaggcggcaggagaagaatcgatgccccattaccttccctcgcattcctgcagagatggaccctggataacattcttaatagcgtccctttacacgccagcgcaaaagcctaccgtaaaggaaacagcatattcgataacgccagattccatcggaagcagcgcgttgttctcaaagtggacgttaagaatttctttgggagcattgaagaacactctgccttccttatcttcaaagggctgggatacagcaagaggctgtccaaactgttatccatgaccgcgagtctacacggttccctcccgcaaggggctccaacttctggtgctctggcaaacatttatatgaagaccttcgacgatgccgtgtttaatgcatgtaaggaaagtaaagtccggtatacacggtacgccgatgacctcacattctctggaagtgactttgatacggacgcccagatcaggctggtggacaaacagctgagtaaaatcggcctcagcgtcaacgcaagaaagactcgagtgcttctgccacatgtgaggcaagatgtaaccggcctcgtcgtgaacgaaaaaatctcggttccccaggattaccgacgccgtttgcggcaggagtgctattttatccagaagttcggaatccacggccacgctcgcgaagtcaacgctgctaatcctcgcgtgcgcctggaggaggtgattggaatgttgagctacgtgaagtctatccataagaatgagccctactggtcagacgctcatagtagaatgctggagattagggcctccttcttttga

SEQ ID NO: 9823 - RNA, 1020 nt, unidentified
  source 1..1020: mol_type = other RNA; note = synthetic construct
atggattttcaagtggagagaatcgagttcggcgaaaaaatcggccttgcagagagggaggctgtcaataagtatgcgcaattcttggcttctcaatcattgcctgtcatcttctcccccgggcacctgtcctatattacgaacatgcgtatcgagtctctgtatgcaatgagcaactcccaggagtccttctaccgcagatttgaaatccccaagaaatcggggggacgcaggagaattgatgcgcctctgccatcactggctcacattcagcgctggattctagacaatatacttcaaggtgtggcactgcaccctagtgctaaagcttaccgaaagggttactctacatttgacaatgctaggtttcaccgcaagcagtccatagtgctgaaagtagacgtcaagaacttcttcggctcaatcgaggaacattctgttttttcaatctttcacgacctcggatacagtaaacgactcagcaagctgtttagcatgatagccacccttgatggcgtgttaccgcagggggccccaactagcggagcattgagcaacattttcatgcgtgcctttgacgaaaaaattttcgccgattgtaaacggcagggaatcaggtatactaggtatgccgatgacctgaccttcagcggtgacgccatcgatctgagagagcatattcggctcgtcgacaaggaatttagcaaggttggactgacattgaacagtaagaagacacgcgtgctcttccctcacatgcggcaggaagttaccgggctagtggtaaatgactccgtgagtataccccaggcattccgaagacagctcaggcaggaatgctactttatcaaaaagttcggcattcatggccacgccagagaagtgaacgcacggaatccccggatactgcttgaggaggtcatcgggaaattatcttacgttaaagccgtgcatgccaaggatccatggtgggctaagaaccatgccattatgctggaggtgcggaagaatctcatctga

SEQ ID NO: 9824 - RNA, 1080 nt, unidentified
  source 1..1080: mol_type = other RNA; note = synthetic construct
atgcagaaatctgaattgatctctcggaacatcaacgtgatttttgacggtctaacggaagcacagattgccgcagtgcaaagttactcagccagcctggcagatcgcgaccttcccaccatctatagccccgtgcacctgtgtcaggtagtcggcgtgtctccacagtacttgtttgctgtcagtaatgatcctaaacgtttttacagagggtttagtataccgaagcggaacggcggcagacgtttcattcaggagccgctgcctctcctaaaagccgtccagcgatggctcttggctaatatacttgagaaagtcggagtctcccccttcgtgaagtcttacatcaaggggattaacctgaaacacaacagccggttccacattggacaggactttgtatttaagctagatctcgagtcatttttcgatcgcatcctgacaaaggatgtcgtggaagtgttttacaaggccggatacacaagagacgtttcgattttcctcgccaaaatttgcgtgtccaatggccggttgtgccaagggtcacccacttccggcgcaatctccaatatagtgctcctcgaatttgaccttacactgttcgagttctgccggtcccgtgggttccgctatactagatatagcgatgacattaccattagcggaaagatggacgccggtaccaatttccatgagatcctgctgttcatctcagaacttgcgagcgctaacggccacaaaatcaacaaagggaaatctcaggtactgtataggcataataggcagaaggtcactggtatcgtagtgaatgagaagctgaccgtgcctagacctgtgcggcgaaggttccgacaagagttattttacttcgaacgctatggaccacgcgggcatgccgaaaggatcggagagggcttagatcagtgtgttgctaggttaataggccaagcgagtcacttgctcttcgttaggcccgacgacgagttcgttagagtgaagaaggacctgctgcttagagttctgcgccagatggatgctgacccacagtttggttttgatctggggggcaggccactgtga

SEQ ID NO: 9825 - RNA, 1065 nt, unidentified
  source 1..1065: mol_type = other RNA; note = synthetic construct
atgttgatcacaagggaaatcgacctcgtcctggatgagaatcttggtgtcgccgcgaaggaaaacatcagcgcttattgtggtaaattgtctgaaaggggacttcccgccatcctgagtgccgatcacttttcattaatgattggggtagacggacggtatatctatggtgtctctaacaatgctgacaggtactatcgcgtgtttcagttgccaaaaagacgtgaggggtttaggactatttgcgaacccctcccaattttgaaaatgatccagcggtggatcctggataacatcctgagcaaaatcccccccgcaaagtgtgtgaacagctacatagtcggccgaagtattaagagtaatgcgcgactgcacttaggccaggagtccctgatcaagctagatgtaaaagatttcttcgggagtatttctagccatcacgtgtacaagctcttcttcgatctcggctataccaaggccgtgtcagtttttctgtcccgcctctgcacctataagggctttctgcctcagggttcgccaaccagcgggtccatatcaaacttagttctaaggggagttgacgaggccctcctgactttctgtacagagagaaagattcgctacactagatacgccgacgacatgtgcttcagcggcacaaacatagctgcacctgacctaatcgaatttgtacgtaagaatctcggagagctggggctgaagctgaataacgacaagatgcgcatactcaaacaatctcacaggcagatcgtcacaggcattgtggtgaacaaaagactggcagtgccgcggttgagacggcagagacttcggcaagagatctactacctcaagaaattcggattcgtgtcccatgctatgaataccgatgactccgaccctgttgccctgcttcgccggttgattggggagtgcgcattccttatgcacattcattcaaaggacgtggtggacataagagatattgaatttctgaaagctctgctgcgagaggaactggcccgccagaggcattggacgaatggcgatgaggatcttttttga

SEQ ID NO: 9826 - RNA, 1029 nt, unidentified
  source 1..1029: mol_type = other RNA; note = synthetic construct
atgaattggagtgaatacgaggccgccatcagaagggcatgccgtgagatacacggcatcccccccgataggacacgcttactgctcgagcgggccagacgcctctacgaccaggagctgcctgtgatccttgaccaaaagaacctcgcgtggttcctggggtttgatatctcactcgtcatgtgcattgcaaatcgcccccacaaatactaccgatgtttccgaattccaaaaagaaacggcggcttccgagaacttcacgaaccactgcctaccttgaaggagatgcagcgcgtcattcttgacctgattctcgcaagactgccagtggaccccgccgctaaggcttatcagccagggtcctctgtgaaagacaacgctaatttccatacaaggcagcctctgctgcttaagctcgatgtgagtgacttcttcgggagcctgcgggaatatcaggtttaccaagttttccacggtgtcggatatcaccctcaggtggccaccttactggctaagttgacttgtctgaatggaagcctgccccagggggctccgacttcaccaacattgagcaacctgatttttagagaagctgaccaacgcatcttccatttttgccgacaggccaacatacgctatacccgttatgctgatgatctgactttttccggagactttaagcccgggttggtgatccggagagtggcctctgttattgaaaccttgggccttcggcttaatcctgagaaaaacagggtgatacggcgtcacaggaggcaggaggtaaccggagtcatggtaaataatggactaagagcagcacggagccggaggatgcatctccgccagcaactgtattacctatctaggtttggtctagcggaccaggccgcgaaacatggcacgaagacgcacctgtggatcaaccatttactcggcctcgccggctacatccggtttctggatccgtccgatagggaggccgccagagctattgcaatgctgaaaactttgcgaggttcgacatga

SEQ ID NO: 9827 - RNA, 1056 nt, unidentified
  source 1..1056: mol_type = other RNA; note = synthetic construct
atgaccgcccactccttacagagccttcctgactttaacgagtacagtgcaagattcacagaggccttaattagcagggacggtgaggactacgatccctcctacttgtcacggtgcctaagctatgcgaaaggcctcctcgagcgtcgactcccggtgattttcgacagggaacacctctgcgccctgaccggctactcttctcggtttattgagagcgctgtcggctcacctcatttattctaccggaatttcgagattccaaaaaaaagcggcgggtttagggaaatatccgaacctctgccaagcctgaaggatgtccagcgctggatttatcaaaaccttttgctccgtatccccgtttcagtggctgcaaaggcttttgtgccaggcaagaagctgagagacggcgtaagatttcacgtgggacagaagtttgtgatccgggttgatatcgctgatttcttcccctccatcacgagagggagggtcttcggattgtttaggtccctggggtatagttccgaagtctccggggacctcgcatcactgtgttgcgtgtgtgactgtcttccacaagggggcgtgtgctctccttacctgagcaatatcattatgcgcagtgccgatcgccgcctgcttgcctatgcaagggagaatagcttgcgttacacccgatacgcagatgattttacagtgtccggccagaagttctctaaatctataatcgaagaggtaatgtctgtgataaaatcagaggggttcactgtgaaccagaagaaaactagagtctctaggtcgggaggtcgccaggtagttctgggacacgtggtgaacggtaaggttaacgcccccagggaatatcggagagagctgcgaaaggttgcgtactacgtcgatcgatttggactggataaccatctcgcctatctgaatgaaagacggagcagtgcctcggactattatctgggaaaggctagtttcgtgctatcagctaatcatcgggaccgcgacgccctggatcttaaaagaatcttgctggacgaagtcgagtga

SEQ ID NO: 9828 - RNA, 942 nt, unidentified
  source 1..942: mol_type = other RNA; note = synthetic construct
atgaaatactccaaaaagttgctggataaggggctgccagtgatcttcaatagggagcatctgtgcgccctgactggctacacccctcactttgtggaaagtgcagtgggtagcccgcatctattctatcggcacttcaacgtgcccaaaaaagcaggcggggtgaggctcatctctgaaccattgccttctctgaaggacgtgcaaagatggatatatgaaaatatcctgctacgggttcaggtgagcgtagctgcgaaggcttacgtgccaggaaggaagcttcgcgatggcgcgcgctttcatgtcggccagaagttcgtcgtacgagtggatatttccgattttttcccttctattactcggaagagggtctttggcctgtttagggccatgggttattcaccctcagtttcagcagacttgagcaacctttgttgtagtgaggagtgcttacctcaggggggcgtttgctccgcctatctgagtaacatcattctccgaagcgctgacgcccgtctgctcaagtatgcccgagcacgcggcctcagatacacgagatacgctgacgactttaccatatctggagaggccttctccccatcgattctgaatgacatccagtgggtaatccggagcgagggattcgaaattaaccccaaaaagacagctgtcatgagagctgggggacggcagatggtcgttggtcacgtggttaattcccgggtcaacgcccccagagaatacagaaggggtttacgccaagccgcacactacatcgagaaatttggccttgacaatcacctggcaagactgggcgaaacacgtggatccgctcgcgagtactatttgggaaaggtgagcttcgccctcagcgcgaaccgcagtgatagggatgccctgaaactctcagaggtgctttcggtcggggggtctgagtga

SEQ ID NO: 9829 - RNA, 1065 nt, unidentified
  source 1..1065: mol_type = other RNA; note = synthetic construct
atgaacgcccactcactccatgcactcccctccttcgaagagtataagaaactgtttgtggagcgctatgttatgcgctatggaaacggaagcgacgacggtttcttggaacggtgtctggagtattcaaagaatctgctgagcaacgggttaccagtaatattttcaagacagcacttgtgcgctctgcttggctacgaggagggctacattgatgcagtggccaatagcccacacctgtactaccgcgagttcgaaataccgaaaaggagcggcgagaagcgactaatttcggaacctctcccttccctgaaagaggtccagcggtggatctacaaggagatcctgctaagggtgcctgtgtcctccgccgctaaggcattcgttccccggcggaaagttagagatgcggcacggtttcacgctcggcaaaaacacgtccttaagatcgatattgcagatttcttcccctctatcacaagagacagggtgtttggaatatttcgcctcatcggttacagttctgaagtgtcatccacgctcgcgcgcctttgctgcgtgaatgagagcttacctcagggaggtgtatgtagtgcttatctgtccaatgtggtcctgcgttctctggatggggatatcctgaaatactgtcgggggagaagcttacgatatacaagatacgccgacgacttcatcttcagtggagactcaatcgattacggttttgtcaagttcatttcgagccttattgtgtctcatggctttaacgtaaaccccaaaaagactaccgtgatgggcagggcctgtagacaagttgtggtcggccatgtcgtgaatgatagggtaaacgctccaagagaatatcgacgccgtctgagacagattgcctactttatagccaagcacggcatggactcccatctgagccatatcagtgagaataggtctggggcgcgggaacactatttggggcgagctagttttgtgatctctgccaatccaagggaccgcgacgccctcttcctccgtaacgttttgacctgcaggatggtcgacattgaatga

SEQ ID NO: 9830 - RNA, 1059 nt, unidentified
  source 1..1059: mol_type = other RNA; note = synthetic construct
atgatttcctctatccgccacgtgaaacaatcaagcaactatgaaaccgagtggagacgctacgcagcagcctttctgagtgccgctaaggccaagaaactgtcccaagatgatattgatgcctgtctacagtatgccaagcctcttactctcggcggattcccggtgatatacgacacagaccatttttgcgggcttgtagggtataccccccattacgtcctgggtgccatcaagtccacagatcggtactaccgacagttctcaattaagaaaaagagcgggggggacaggactatcctggaacctttaccctccttaaaggaaatacaacattggatccttcgcaacgtgctagagcgggtggccatccacagagccgcgaaagcgtttcagaagggcacgtccatccgtgacaatgcgagatttcacaggggacaggcttgtgtactgaccattgacatcaaagatttcttcccttcaattgggatcaatcgcgttttttcagtgtatcacaggatcggatactctaagcaaattagtagtttgttggcagacctgagctgttttgagctgagcctgccacagggtgctcccacaagcccatatatcagcaacctgatatgcagaagtctggatgaaaggttcttcgcgtacgcacgatccgctaaactgagatatacacgttacgctgatgacctcaccttttctggcgctgacattggaagttcttttgtctccaacgcctacgagatcattcgggagtacggcttcgagccaaacctcagcaagacccgcctcttgcggcagcaccagaaacaaatggtgacgggtgtggttgttaattctaagcttcaggcagacagagctttacgcaggcagataaggcagtacgcctattatatcgaaagattcggcctggagggacatgcagctgccacttctgtccagaggcgaaatttcgaacggcacttgatgggcctggcacagttcgtctgctcgctcaacccctatgatcgtgacgcccggaatctgatagagctcctcaaaattgattga

SEQ ID NO: 9831 - RNA, 1035 nt, unidentified
  source 1..1035: mol_type = other RNA; note = synthetic construct
atgaacgctgacgagaaggaaactgaatggcgcatttatagtgcctccttcttcgaagaggccttggacgtcgggctcactgctaatgagattgagatttgtttggcctacgcacagcccatcttcgaaagaggacttcccgtgatctacgacaacgaccacctgtcaaacttggtcggctacaaaatcaagtacatacagagagccgcaaaagccccagtgaatttctacagaaacttcaccatcagcaagcggtctggaaaaccacggaccatctctgagccgctcccttcactgaaggaaatccagctgtgggtgctgcgtaaccttctggataaaatgccagtgcatcctgccgcgaaagcgtttgtggccggtcgctcgattaagaataatgctcgctttcaccggggtcaaaggcgcgtcctgacagttgatgtcaaggacttcttcccaagcatatcttccgatcgggtaaaagctatttttgtaaaggctggctataattcccggattagttccctgctcgctaacctgtgctgcctaaacggcaagattccccaaggcagtcccacgagccctgccattagtaacatcgtctgtctggatatggacgaggagttttttcagtatgcccgttcaaggaaactgcggtatacacgctatgcagacgatatgacatttagcggcgatgtgattagacatagcgacatcaagcacatctacaggataatgcgaagctatcactttgagcctaacttagaaaagacccggctgatgaggccgcatcagagacagcagattaccggaataatagtgaataaccacatgcaggtttccagagaataccgaagggagcttcgtcaaaacgcatacttcatcgggaagtttgggatcgaggagcacgccgtggttaatgagatcactcatatcaggttccgagatcaccttctcggaagagcgaatcatgctctccacgtgaattcttcagaccgcgatgcaatccgactaaaagaagcattaaaaaggttctga

SEQ ID NO: 9832 - RNA, 1035 nt, unidentified
  source 1..1035: mol_type = other RNA; note = synthetic construct
atgcaagatgcttccaccgccccctcctttgaggagtattccgccatcttccggtctaccgctggggcagacgcattacagcctgagtacgtggagcgttgcctccagtacgccaggaaacacctccaggatgggcgggccgtggtatatagtgctaatcatctgtcatcacttgtgggttatgacatcagctatctgtatggggtcgcgaattctggaggaaactactaccgcacctttagtgttccaaaaaaatcgggcggaaagaggaggatctccgagcccctgccctctctcaaggaaatccagcgatggattcttacatacatcctgagccctgttcaggttcacacgcacgtcaagtcctttaggatgggctacgggctccgcgctaacgccaggtttcatagagctcagaagattgtgttgcgtctggacgtactagatttcttcggctcaataagagtgaaacgcgtggccgacttcttcctgaagctcggatacgcgaaaccagtcgcaacactcctggctggagtttgtacgctcaacgggaaactgcctcaaggggcacctacaagcccggccttgtctaatcttgtgccctggccggtggatgtaagattgtcaacttttgcccgcaatgagggaattcggtacactagatacgcggatgatatgaccttcagcggcgaattcaaacctggtaaggtaatatctatggccagccgggtgctgagggagaacggctttcagctaaatgtcaagaagacaaacgtcatgggtgaacaccagcgccagctggttaccggcgtcgtggtgaacgagaaactgcaagtgccaagaggggtccgacggggtctgaggaaggaagtctactatatcgaaaagttcggcctgactgaacatgtgcgacggatgggcgtgagcgacccaaagtatgtgagtagacttcgcggaatggctgcacacattttagcagttaaccccaatgacgaggaagctaaaaatgccttaagatttctgggcagtttgtga

SEQ ID NO: 9833 - RNA, 1065 nt, unidentified
  source 1..1065: mol_type = other RNA; note = synthetic construct
atgcgaacgcatcgagatcttgcttcttcttgggctgcctacgaggcagccttcatcatagaagccaggagacgggggtattcagatgacgacgtccgcacatgtctatcctatgccaagaagctgcacctgagtaacctccccgtgatttatgatcaggcccatttcagcgaccgagtgggatatgatattagctacatccggcgggcaagcaacgaccctgaacacttttaccgcacctttaacgtgcccaagaaaagcggcggggtccgtcaaatcaatgagccactgccctcgctgaaagagatccagcggtggattctcgacaatattctgggcgcaatgtccgtgaacccatgcgccaaggctttcgtagtgggaagagatgtgagagacaatgcgaggtttcaccgcaatcagaggatagtaataaacgtcgacgtgaaggactttttccccagtatcactcatcgtcagattcgcatgatatttcttaaagccggctattccccagaggtaggagagctacttacacaactgtgttgtttggacggggtattaccgcagggagccccgacttctccttatatctcaaatctcgtgtgcagacctctggatgagaggctgttcggttacgcgaagaagaacggtttgcgctacaccaggtactcagacgatatttccgttagcggcgatatggaacccgctgaagtccttcagttcgttaaaaaagtgtgccgggagcacggtttcaagatccaccctgacaagatcagggtgttaggaccagggagacagaaaagggtgaccggcattgtcgttaataaacatttgcaggtcccacgcaaaaagcgtagggttctcagacagagtgtgtactacatcaagaaattcgggctggatgaacacctgtctaagacaaaaaacaatcggcggaactttctcgatcatttgatgggccaagttaactacgtcctgtttgtgaaccctaaggaccgagaggctcaagattggctcagacagctgagagaaattaagaatggcgcaatcgactatcgcgattga

SEQ ID NO: 9834 - RNA, 1065 nt, unidentified
  source 1..1065: mol_type = other RNA; note = synthetic construct
atgaattcactctacacccccgagtacttcgtgaaggttgctgagcactgcagcaatgccggttttgcagcagacgccatcgaagatgtgctggtgtatgcgattcagattgccaatcaaggcctgccaataatatacgatgatcaacacttcagtcaacttgtgggctatgacttgcagtatatctacggggttacaaacgaccaaagcaagttctataaatcctttacgaagaagatgaggagcgggaaaaagagggaaatcgaccagccatacccctctctaatggagatccagtactggatactccacaacatactggaaaaaatcgagtgctctccttacgctaaggcgtatattaaaggtcggacactaaaggataatgcccgctatcacgtcggcaagaacttcatcgtcaaggtggacattaagaactttttcccctcgattaagacgggctccgtgtacaagctcttttacgattgcggatatactaagcagcttgctaccttattttctagagtcctgactttgaatgggcatctccctcagggggctcccaccagtccagctatctccaatctggtctgtcggtccctggatgaggtactgtcaaccattgcacacgaccgaaaactgtcatacacacgctatgccgatgacatcgcctttagcgccaacgagtaccctaaattcctgattagagagattcgctcatgtatgcgagatcatggattcgagctcaacgaaaccaaaacaagggttatgaggcagagcggcagacagcaaatcacaggcatcgtggtgaacaaaaaaatgaatgtatccaaggaacgtcggaggcgtatcagacaggaactgtactatatcgagaaatatggaatcgaagaccatatacgctatattaatgagactcggaaaaacaccatcgcacatcttgccggaagcttgtcctacgcaatttggattcagccgagatctgccgaactgaagaaatacagtaagatgttggctactttacacaaggaccttgagggtgaagacgatatccagactgagcagtga

SEQ ID NO: 9835 - RNA, 1044 nt, unidentified
  source 1..1044: mol_type = other RNA; note = synthetic construct
atgactacattggacctaccttacgttactgatcgctataaggaaatcgccctacaatgcgggctgagcagtaaagacatcctttccatagagcgatacgcccagaaactcgaagcgaacggtctgcccgttattttcgacgagaaacattttagcgcgttagtgggctacgatatatccctcctgtatgcaatttcaaacgaccagagaaagttttacagatcttttaacatccccaagcgcaatgggaagcttaggcagattgacgagccacttcccacgctgaaggagatccagcgatatattctcgacaatatcctgtctaacgttgagattagcaaagcctccaaggcatttagtaggcattccgacattaagaaaaatgccaggattcacatcagacagcctgagatcttgaaggtggatataaaagatttcttcccatctgtgaacatatcatcagtgtataaggccttgtatgctctgggctacaccgatagcctcgctatgctgtttgcacaaatctgttgtttggacaagagtctcccgcaaggcgccccaacatcgcctgctctggctaatatcgtctgcagggacctggatcatgacttacttaaatattgcacggataggaacctgaggtacacccggtacgcagacgatataaccatttccggggagcgtatcaaaaaggagactatcaccgaagtgcgatttatgatcaagagcttcaaattcaagctcaatgaagagaagacctctattatgagatcaggcagccggaaggttgtgacaggaatcatcgtgaacactcggatgcaggcccccagagaaacacgccgggaattccggaagaacgtatttttcattcgcaaattcggtgtggatggccacattagtcagatagaggaggatcgtaataattacctgcggcacatcattggagtcggagaatttatcctgtgggtcgataataaaaacaaggaagtcgtgagcgacctgaacttcctcaaacgcttactgaaatccgagtctgtcgtatga

SEQ ID NO: 9836 - RNA, 1122 nt, unidentified
  source 1..1122: mol_type = other RNA; note = synthetic construct
atgaaacgcaaataccgtcatgattggacggcctatgcagctaggtttaagcgcgcagctaagtctatcaacaaagacgacgaatatatcgccaattgtctgagctacgccaaaaagctctatgagaagaatctgcccgtagtctactctcaagagcacttttccttcttatgcggctatgagtataactatattttgagtgcatgcaactccgaaaaatacttttaccggaagatcgtcattaagaagaagaacggagggaatcggatcctcaacgagccattgcctagcctgaaggatatccagcgatgggtggttgagaacatcttggagaaagtggaagttcatccagccgccaaggcctatgtgcctaaaaagtctatcaaggataacgccagatttcatgtcaatcagaacgtggtgatatcagtggatattaaagatttcttcccatctatccacatatcgagggtctataacattttctcatccttaggttacagcgctgcagtgagtaaaatgctcgcggaaatctgctgttataagaattgcttgccccagggggctcccacaagcccttacctgagtaatatcgtgatgcatgaccttgatgatgaccttttcgcgtacgcccgcaggaatggcctgagatacacccggtacgccgatgatataacattcagcggcgatattaaaccttccaaactgatcgcaaccctataccagctcattactgagtacgggtttaaactgaataaacagaagatttccgtgatgagacgtggcgctaggcagatagtaactggcatcgtggtcaatcagaagatgcagtttcaacgggttagacgaaagaagctccggcaagacgtttactatattaacaaatacgggctgaacagtcactgtattcgcgaaggaattaacaagagaaattatctaagccacctcatcggagtagctaactctattctgttcataaatccgaatgacaaagacgcgcaggacgcctaccagatcatcattgaccttcttaaggatgagtcaaagctggacggacaaggtcgcctggacctgcgagtgtccgtcgaagacagcaggaccgagtcacccaagacacactga

SEQ ID NO: 9837 - RNA, 999 nt, unidentified
  source 1..999: mol_type = other RNA; note = synthetic construct
atgatctccggtattacagttgagaggatcgccgaggaaacaggtctgaatcgccgattcctcctgctcctgtccaacaacattccagactactatcggatttaccgcattcccaaaaaaaatgggaactttcgcacaatagaggccccggcttcggtcctcaagcgaattcaacagtatatcctgtggaccatcttaccccggcagatcccgtgcacccctgagaaactggcagaaaccgctgaaatcctcaagggaaatgggatctctttccatagaagcaatcttgcaaggatgctgagtgccgccaccgcattcgagcctcggtcctcaattaagaagaatgctcaggagcactgcggcaagcccgtggttgtgagcctggacgtaaagaacttctttcccagcttgaaatatgacttggtgcgttcattatttcagcgcatcgtgcacgaggatggtgtggcggttatgctgtcaaagttttgtacgcttaacggccacctaccacagggagctattacttctccacatctctctaacctactcttgcacgacttcgacatcaaactgcgacagtactgtctcgcccacaaactggccttcacacggtatgccgatgaccttacttttagtggagatccaggaaatgaggagattactgggcttatcagatacgtgaaacaagaactgggcaaattgggccttaggctgaaccatgagaaaatcagaatacaacgtcaggggatgcgtcaggaggtcaccggcgtggtcgtaaacgcgaagactagcgcacctcgcgaagtgagaagaaggctgaggcaacagatgtactacctgaacaagcactgggaaagagaatggaggaagttggatgagcactccctgaatgtcttactcggccaggctaatttcatatgggatatggaccgcgataatcctgaatttacggaatatcggcggcagctgctagagataaagcatttctttcataactga

SEQ ID NO: 9838 - RNA, 954 nt, unidentified
  source 1..954: mol_type = other RNA; note = synthetic construct
atgaattctaagttcttatatctccttgggaaccacatcccagatcactatagaatttaccggatccctaaaaagaatggtaactttcggaccatcgaggcacccgctccgattctcaagctgatccagcggtacatactggtgagggtcttgcccgttaggctcccgtggggtgagtccaggttacgtgagactgaggctagattgcgcgagaacggcatcagattcaggcccggcgagatacccagaatgctatccgcagcgagggccttcgaacgcggatgtagcatcgggaggaacgccgcagcccattgtgggaaacctattgtcgtaagccttgacgtcaagaacttcttcccatcacttaaatatggccctgtccgagctattttccaggagttggctgaggatgatgccagtgctgttatgctggccaagttttgcaccctgaatggacatctgccacaaggcgctgtgacgtccccccacctgtctaacctgctcatgcgcgactttgacgcggcccttgccgagtattctctgctccatggcttggcctacacccgctacgcagatgacctgacattttcaggagatcctagcaacgaggagatcactgaacttattagacgctgccggtcggaattagcgacactgggactgcggctgaaccgtgacaagatacggatccaacgaaaaggtatgagacaggaagttacaggcgtggtggtgaatgcaaaagtaagcgcccctcgcaagattcgcagagaactgagacagcgaatgtattacctcaataagcattgggagactgagtggcgtaaactggatgaacacagtctaaacgtgttgctcgggaaggcaaatttcatctgggacctaaatcggaacgacccagaagtggccgaatacaggaggcagctcctggaaattcgacggttttttcacaattga

SEQ ID NO: 9839 - RNA, 1362 nt, unidentified
  source 1..1362: mol_type = other RNA; note = synthetic construct
atgaacggggatggggagtccctctccctgacagggagttgccggaaaggtatgtctggcaaacagatgtttacacgcatcccctgcgctcctctggctagaactagcacacccatcatttgtgtaatatccccgtggaattttttaggaggacatactttgagatgcgctcaggttcggagcgcggctgtgaatagtaagagtctgtgtcggaaggcttctgaatatctgttccgcgccctctttgcgaagtttgtcttctctgacaagaccgccgtaagcggttttttacgggtcttcatgaaacagaacacattcacaattcagaaaatggcagaagacttaggcataaatgtgaagttcctatacctcctcagcaaccgcacccaggaattttacaagatttaccggatcccaaagaaaaacgggaaattcagaaccattgaagcaccatgcgctatcctgaagagaatccaggagtacattctgcgtttcgtgctgcctgataagatttcgttggggggtacgagatgtaccaaggccctgcagtcccttcggcgacaggatccagaagctgacgttacccgcaacgagatcacgggccttatgtcagcggcgactgcctttgaaccggggacatctattaagggcaatgctgaaaaccattgtggccgaccagtggtgatagccctagacgtgaaggattttttccctagccttaagtattcccgggtgctcgccctgtttcgcagatatactgaaactgagaacgccgctgtcatgctggcaaaactgtgtacactttacggccacctgccacaaggcgccgtgactagtcctcacatctcaaacctccttctgcacgatttggatttcaccctcaaactctatgccctggaccataatcttgagtttacccgatacgcagacgatctcacgttcagcggtaatcctgacaatggagagatctccggactcatccagatttgcaggcaggaactgcgaaagtctggactgcgcttaaacaatgataaaatccggattatgcgtaaaggcatgcgccaggaagttaccggaatcgtcgtcaactcaaagatgaacgcacccagggaggacagaaggcacctgaggcaacagatgtactatctaaataagcactgggagcacgagtggaggaagctggacgagcattctttgaatgtgttgttgggcaaagccaacttcatctgggatcttaacagagagaatcccgaaattgccgagtataggaggcaactgctggagataaaaaggtcgttccaacgtgaggccaagaaagcaatctgctcagcaccccaagacagcgcagagcaggccaattga

SEQ ID NO: 9840 - RNA, 954 nt, unidentified
  source 1..954: mol_type = other RNA; note = synthetic construct
atgaagatggcaaccttcctgctgacaatgtactgtaaaattcccaagactctgtcggagcttacgcagtgcctggggtctaccactgagtttctttattggctgtccaaccacatccaggagcagtacactatctttcagatccctaaaaagaatggaaaaacacgcacaatagaagcgccaagccaactgctaaaaaagatccaacggaggatattaagcaagatcctcttccagagagccgaacgcagcgcaatggcctttgagaagcgacgcaacattcggaaaaatgcctccgctcatctgggcgcagccgtggttctctgtatggacgtgaaggattttttcccgtcactcaaattctctcaggtcacagattacttggagtccctcggcatgcaaaggaacgtgtcagtgttagtagctaaaatctgtaccctacagggccacttgccacagggggctgttactagcccccatctcagtaatctgctattggcacctctggacaaggcgatcagaaacttctgcaaagtcaaaaagtaccactttaccagatacgctgatgacttaaccattagtggtaagatgaatgacgaagacataagggaggccattgccgtctgcaagaaaaacttcatgacaatcggattgaagctgaatcctgataagacccatgtgatgcggaacgggaatcggaaaatggtgacaggtattactgtcaaccaaaagctgtcagccccaaagtctctccgaaaaaggttgcgccagcggatgtattatctgaatcacttctgggagaaggactggcacagactgacggaagaagaactcaacaatcttcttggacttgtaaatttcgtgtggtccattgatagagagaaccaggaattttctcagtatcgtacccagctgctggagattaagcgtttttggaacagtgttcccaggtga

SEQ ID NO: 9841 - RNA, 945 nt, unidentified
  source 1..945: mol_type = other RNA; note = synthetic construct
atgattaatgggaagctgagcgaaaaactcacatccgttaatatgttagcccggaagctgggtctgaccgtcaagcagctgttttttatagtgtacaacctcgagaagttctacactgtgtatcaaattcccaagaagaacggaaaattccgcacgattgaggctccagaccctttattgaaaaagatacagggacggatcttgcaaaaactggtgagtagacacaccagcaaaacagctaccgccttcgaaaagaaacgaaacatcattcagaatgcgcagattcacctcaatcaaccagtcatcgttggcctggacgtgaaagacttctttccttcactgaaattcgagctcgtgtggaagtatttccgcgaccagaacattgcccgggaacccgccagactcatcgcaacactctgtacgtttaaagggcatctacctcagggggctgtcacttctccgttccttgccaataggttgctgcatgacttcgatgaagtcatgtcccagcattgcagacaggtaaaggtcaattatagtcgatacgccgatgacatcacactcagcggcaacatttctgatgcacttaaggagaaattgatctccttcgcaagggaaggcttatacttgtacggcctgcagctaaacaacgaaaagatccgtatcctgcgtaggaataatagacaagaggttactggaatcgtggtaaatgagaagctccaggctccccgcgaacttaggcggattctgaggcagaagatctattaccttaacagattttgggagaacgattggcaaaaacttaccgagaatgatctagacaagctgctgggtcaggtgaactttgtgtggtcgatagataagaccaactctgagtttaccgagtatcgcaaacagctgctggaaataaagcactactttactctgtcaacaaaggagaaatga

SEQ ID NO: 9842 - RNA, 987 nt, unidentified
  source 1..987: mol_type = other RNA; note = synthetic construct
atgggcggccctctgctgtcatgtgctttctcactcttcttcgtcggggggtctgtcatggtcaggtttccagatgggagtttgagcatcgcaacagtggaagccatcgccgacgttctgcaggtgagcccgaagtttctgtattatcttagcaacaacgttggtaaacactacagaattaccaagatcccaaaaaagaatgggaagttcaggaccattgaggcccccgactcttacctgaagcacattcagcgaatgattctggataacctgctcccacagtcagtcggagaaattgccaccgcgtttgagcctggcgtgggactgatggataatgttgtgcagcacgttggaaatcctgttgtgctcgcactcgacctcaaagatttcttcccatcgttaaggctccacagaatcgttagagtgctgcgcgagcttgacttccctcgagccagcgctgtattattggctaaactttgcacgctcaacggccatctaccgcagggagcccccactagtccccatctggcaaacctggctatgagaacttttgatgacagactttccctactgtgcaggcaggagaatctggcggtgaccaggtacgccgatgacataacaattagtggcaatatagaccgacattgtgcagaaagcctcatcgcctcctgccgcgtgatgctgaaggaaataggtctgcggatcaattaccgtaagcttcgtattctgaggcaaaacgcacggcaggaagtgactggtgtggtcgtcaacgagaagccatccgtacctcggcacatccggcgcgagttgcgaaaaaagatgtactatttacggcgccatggcgttgtggggtacgaacccgtgacattggaggctctacggtctttgcttggatccgtgatgtttgtgaattatgtagatcccgacaactttgagttccgccaatatgccgaggaactgaaagtcagaatcaaagagtgtgcttga

SEQ ID NO: 9843 - RNA, 921 nt, unidentified
  source 1..921: mol_type = other RNA; note = synthetic construct
atggaaaccctacccataattaggacggtggatgagcttgccgagctgctgtgcacagacgcaaggttgctgtatgctatctcaaatgagactcctgcttggtataagtgttttcagatcccaaaaaacaacggttctatgcgcaacatcgaagcccctcgcccctatctcaagacaatacagcgcagaatccaaaaaaaaattcttagctgcttcaccgtgcacgattgtgccaccgcttttctccccggcaaaaatattcgacgcaatgccctgttccatgtgaataagtccgtggtcctgaattgcgatatcaagaatttcttcccaagtcttaagtcccgtgccgtttttgagttctttaggcggaggaccgggtacgaacctgacgtctgcatgatgctgtcacggttatgtacattatatggccatttgccacagggagcaccgtcgtcacccatgctctctaatctgctcatgtttgagattgacgaaaccatatgccaatggtgtgcgaagcactacctgtcctactccagatacgccgatgacatgacgttcagtggtgaaatcgatgtacgagtgcaggcagacatactgcagatggtgaagcggaacctgaccctccttcacttgaagctgaacatcgctaagactaaagtgtatcgttctaatcgcagacagctcgtcacaggactggttgtaaacgagtacgtcggggttcctagagaaaaaattcgggagttcaggacttggctgtattatactgagcttgacattatcaacgagaacttttactacgacagcgatgagatcgaaagcagactcggcctgttgaacttctactacagcatcaactgtaatgagaacttattgcggtggcgggacagactgctagaaattaggcgaatgtacagctga

SEQ ID NO: 9844 - RNA, 993 nt, unidentified
  source 1..993: mol_type = other RNA; note = synthetic construct
atgttcgagaaggtccactgggagtactctgagtttctgcccgtgctgccaaccgtcagagacttagctgggtgccttgatgccgacccacggctcctgtaccgcattagcaatcactccgccgagttttatacaatacataccatccctaaacgcaatggggggtgtcggacaattgaagcccctcacccaattctaaagcggatacagcaacgaattctgagaaaaatcttgatgcaggtcagcacgcaccctgccgcaactgcattcgaacccggcagatccatccgggacaatgcaatcagacatgtgggccggcctgtggtaatctcgctggatatcaggaacttcttccccagcttaaaggctggcgttgtatacgcgttttttaggaaactgggctacgacgttcccgtcgccgtgctcttgacccgactgtgcaccttatacggtcatctgtctcaaggtgcgccaacaagcccccgattgagtaacctgctattgcttccggtggattgtggcctggccgcctggattgggaccaagcctgtcgtgtatacaaggtacgccgatgacctgacgctctccggagccctagagcgcgaagatgtgtcagaagctataggagtgtgcagggctgcactggctcgcatgggccttaggctcaactcccgtaaaactaaagtgagaaggcgcggaagtcgtcagacagtgactgggctggttgttaacgaatctgtgagggtccccagagagactaagcgagcactcagacagttcatgtattatttggattgcttcggatgggagtcatgtcgcgaacacttcggaccgggcgacgagatgttgcttgaccgggtcatcggtttcgtgaattttatgtgggacatggataagaccgatctggttctgagggagtggcttgaccggctcctcctgctgaagctccatcccgaacaggtacctccaccagcgtatcgtgcttttcagtga

SEQ ID NO: 9845 - RNA, 966 nt, unidentified
  source 1..966: mol_type = other RNA; note = synthetic construct
atggacgccgaggagactgcgagtggccttccggagcttccagacgtggaagctctgtcagaactgctgcagatagcgccgaagtggctatacagaatatccaaccacacacccaggttctaccgagtttatgctattcccaaaaggaatgggaaattccgaatcatagaggcccctagacccttgctcaagcgcttgcagagacgcattctcacttccttgctgaatcctgtggaggcctcaccttacgccaccgccttcgagaggggtaggagcatcgcggacaacgcaagatttcacctcaaccagccagtcgtcttgaaactggacattagaaacttctttccttccctgaagtctccccctgtgtatagacttttttttgaactgggacatccaccgccagtggctgcactactcactcggctgtgttgtttatgcggccacctcccacaaggggcaccaaccagtcctcgcctcgctaatctgcttctccgccccgccgattataggatcgccgcctggattgggagacgccccattcagtttacccgttacgctgatgatattaccctgagcggagattttggccccgaacacattgccgaggcaatccaggtttgcagacacgaactgggccggctaggacttcgacttaataggggcaagattcgcatagagcgacggtgtcggcgccaaacggtcacaggattgacagtgaatgagacactgcacgcccctcgacaaatgatcaggaagctcaggcaggagatgttctacatccggaaatatggctgggaagatcggcccgaaagcgagctgcatcggctgatcggtatcgctaacttcatccgtgatgtagacccaggtgacgccgcatgcaccgcacatttagaaaaactgcatgctatcctgtggaacaggagacagaagcagctgtctgagcagttccgtcgggggttatga

SEQ ID NO: 9846 - RNA, 4275 nt, unidentified
  source 1..4275: mol_type = other RNA; note = synthetic construct
atgaaagaaaggatcagtcctgaggtgctggaaaggcaggttctcgacgctagcgtctttgaagacttgtttgccttcctgtatcttcttgacatagagtctcccctggatgagaggtattacctgcagcacgtgattcctagatctgatggaactaagagagttctgtacgagccaaaacccgtgcttaaggccctccagcaaaaactgttacaagtcctttacgacgtgctcgagaagcctcagccttatacggagtactaccggtttcagcagaaatacctcttatcaccttgcgccacagcgtaccgacccaagatgagtgtgatccaaaatgccaattttcaccagggcaatgaagtcgtgctgaaggtggacattcatgacttttttgggtctattcccgccgccaaaatgaaatccacatgggtcgaactgctctatttctgctcaaatcgcctgatacagtctggactcttggtgcatcgaatgaagcgagagtttgtagcccaggtgatcaacactcttgccgataagatcatatatatcacatccctcaatggtgctttgccccagggatctccaacatccggggcaattgcaaacctatacatggttcagcttgatcggaagatactgcactacagcgtgcgcaacagactcaattattcaaggtacagtgacgacatgactttctctggcgaggctgaggatttgaagaccggtaagatactccatttcctgaacggattacttgggagaaatggccttcggctgaagagatcgaaaacacaggttctccggaagcataagaggcagacagtcaccggaatcgtggtgaacgccagcaaaaatgcggggcgcacctatcagcgttccgtaaggcagtctatgcactacttcaaaaagtttggtaaagagcacgctttgagaacgcacaggaccctggatgcctttctgcgtgaaatcacaggacaggtcgcatggatcctccaagtacagaaatccaataccgagttcctgagatacaaggctgagcttaacattattagccggttccatcggcagggaaagcccgtggccgaagctatggactatttacgcaatttggcccagcaggcggaacagtggaaggcgaacgaaactgtggtgatcggcgggctggagtggaagaaggaaagtgaagtttatgaaggggaagacatggatggtatatatacctttcagcgcaggggacaaaagcgctcattctttaccaggaaagccctggagaagtatgttaataatcaccccgaatggcgtctacccactctgcacgaatacgagagatacttcgatgagactcgctaccatgaccgaatccagctcggactgacgctgccgtccgatcctaggtataacggcattgtgaacggcacagagtttctgcattttaatagggtcggcgcctattggacctgcgatcttagacccagaatgacactacggatggccaaaaaccgcctcggtagaaaagtcctgtgtgtagccgcaaagaactggccatttcagcatcacctggcgaaaatccgatgcgacttaagctacgtgcgccacgatcacgtgatggacctccgcgtacccgttaacgttccaggcaccatggagtattccagcagctctgacgacacccaggtcctcctgccagaagaagccttcagtgttaaactcgtgagggagatcaggcccaacgagcccatgaccaattttcaggggatggacttcgcccttcggaagttgtctaatagtcggttcagcacaaattttaaagggctgcaactcaccgagatcccaaaagaggtgctggcctcatggcagagttcttccatgctgtttgcaaacaaccagattgaacacttcgacttacgtaatgtccctccagtcaaacttctaaacctcgagaataatagactgaagggttttgacttctccgcgctgcacccgggccttagacaccttctgctgaaaggtaatcctgggttgaagggagtggaaattccctggattcagctgatgcgacagcttcatgaactttcactggatgacttacctgaccttgtcggcactatgcctttggagtccatctacctgcaagcattaggaggggaggtctggactatcctagaaaacgagcaggaactggacgctctcattggtcaacagaaaccggtttcccacctgttggtacgctacagggttggcattgatacgctggatagccggaccctatttgagaagctgaacagaatcgccccaaagcatctgtacgtttgcttcgagcctcaagacgagggactgcgtcggcgactcgatcgtctcaagtatatgaccgcatcatgggaaaaagagatcgaagagctggatgggtacataaagaatctctccttgagaaaggatatcgaaactagggtgaccctgtttccgcaacacttagacaacaatcggatcaagcacctgatgatcgacttcagctggctcccaaacctctgcttcgaaggcgattttagaattaagcctgatagttaccacctactacaccctggaatccccactttgctacttccagcaataagtcagcggttccaccggccaacagtgttgatgaaaatcatcggcaataagattgtgccaacccagcacgaattcccggaagctgtgagtctggacgtgtgttatcccctggctaaaaagcatcgcaaaatccggctctctaacctccatactttagtgcccatgcaccaggagcatgtcggggacctggtactagtgttaagcgaggatgccggcaaacaactggagcaaggccgcatcgaggaggtctatccccgggcatacgaactcagaagcggttcgcaattttggcatgacgtaatggcccatagcaagagtgaaaagacgacatttaggcagcggattagctctatccctctgctcggcctatctatgcagtttgacgtttatagcttgtctctaccaattgagagcgtgccaaaaattaaccgctttggagtgctgaatctgactgaagtgggcgagaacaacactatgacttacaatgataccgatcttaagcagtttctcgagagatcctcgcctagcacagagtttgcatatctgtccattttcgctcacaaaaccccggctattttacagttggtgcgggattcgaagcgcaaacgcaacgccgacctgccatatgtcatccgcaaaaatatctacgctaccgagccactggaacgctcacagacgattgacgctctcagagcaggagagctattagctatatctctgtccaagcctaatcgacgggaccgtgagatcatgctcgcagcggtcgaggccaacccctttgcaatggcctttgcccataaagcgcttaagcaagacgctggctttattctggctgcaatgaacatttcgttgcggaccttggttttcctgtctaaagatctgttcaagtccaggaaccatcctaatagcgcactgcaacaggtgttgaaagctttgatggaaaggtacaatccggaagatttcaacttcatcgtaggaagactcagccgacatataaacatcgagaaagaaccagtgtacaggttcgtcctggagcccaagcccctggattcaagcgccgtgctgatgtcattcgagcaggagaagaagatccttaacaacagattctgtcagcgcagtgggatgtacaaaccaattcgtaactacttcttcaaagaagctgaaaggcggggcttcattaatgtcaatgggtacttcaacgatatattcaaggctctgtcacagaacacctccgtccgattcttggacctgtcattcgccggcggtagaaccttgtacgctctcgatcgactgggtgatatccctggcctgaggaagctgaagctgactgaatgtaagttcatcaatagtctccctgggttgaagacactggaggtgctgaacatcaaccgaacatccaatttctggtcatatcacgacggcaagacaatgcatcaatccctgcccaaccttaaaaggttagaagcaaagtacattcacattagcatgcaggagattgaggatctgatggtgcaccacccatgtctcgagtatcttgccatcagcgttacatatgatgacgagttggcagagataaatgctataattgagaaggtgtctgcccaaggaaaagtaatagaaattgtgctggacaaatccgaatatatcggggagctccccttttga

SEQ ID NO: 9847 - RNA, 4254 nt, unidentified
  source 1..4254: mol_type = other RNA; note = synthetic construct
atgatcgatcagaataatcagatcgtccagatttccgtaaatgacttcctgaagacagactttaatgttacacgtctgaagttcaatgctttgaagctgcttcatgagttggaactgtcagaggagctcagtgaggagtgctacatcaaacatgtcatccctaagcacgatgggacaaaaagaatattgtacgagccaaaacctttgctaaaagagattcaaaagcagttgctgaacctgttatacacacttaagaagcatagagactatcctgtgttgtctcggaacattaagtacaagtaccttccaacccggagcagcacagcatacctgaaaggctcgtctgtagtgaagaacgctaattttcacattgggaaagatgtggtggtgaagcttgatatctcaaacttcttcaacagcatcccaaaaaacaaaatagaactgttctggttcgatatccttaatctgaaggtcaagtacttgattcaccttggcataattgagaaggatgaaaccgaagacaaaaagcagctgattatatccggcctggcgaagaaggtactgagcagtacaaccttgaatggatttttaccccagggttctcccacaagcggctacatcgctaactcatatctggtcagttttgacaagaagatgctcgagttttgcgtaaacaaaagtttatgctacagcaggtacagcgacgatatcacagtgagcggcagcaactccgagcttgtcagtaaacaggtcataaagtttgttcagcaccagctatataagaagagcctcaagttgaagaagagcaagactaaagtcctgaaaagacacaagcggcagactgttactgggattgtggtaaatgaaaagagaagtgccgggagagcgttcaagagggggctgagaatgcagatgtactatctcaagaaattcggcctggatcatgtgagccggactcattccaatatcaattcattcctcctggagcttgcaggcaaggtgaattgggtgctgcaggtgaacaaagtggatccagaattcaagcgctacaaaggagagttgagcattattaagaggttcctggccctgggtaaaaccgtgggcgatgctaccaactacattagtgagctggaaaacaaggacttcaagatcaagaacaattccgtctttatagctggactgttctggcggatttccgatgacgatacccagacggattacccttccatagatcgaaaaaacaaatcggtgcaactattcactgaggaaagcatcgagttagctctgaaaaacaatcctggctggaggctccccaccatggacgagttcaacaatttcatcaaggaaactaacttcgaagatcgcagggttctgggaatccgatacccctttgacccccatttcaacggtctagcggatgagaatgggtatcgctattataaccgcgtgggactgtattggacgagtgacctggctcatctgtctaaagagaggtccactaaaggaagaattgctcgtaaagccatctgtttcctgagctttgaccagagaattaagaagaagatcaaccataacaccgcgtgctatatttcaagtaagacattctccctgagcgtaaacaaaaaacaaaagttcgagcttacgaacaatcggtccatcgactactatctgaatccgccactgaatgaggactttcaggcaattgttggagcctgttccattcgattggttatgtcagaagaaatgaccaaaaaacccatgatatctaagaccctctgggactccatccaactatctaaattttcagtggacctgtctaacttgaacttcgaggaatttagtttctccctcaagaatgttaatgcctcttctatactgctctacaacaacaatctcaaacacgtgaacctgacggaaattgcacctgtgaagcgcatcgacctacgaaataataagcttgagtccatcaagcttaacaatctccccaagggcgtgaagcatattaggctcgaagagaataaagaccttaagctgctcgacatcccttggaagagactattacagtccagccacgaactcacggccgaccagttgatttttgagcgtcagaaatcgcttggggaaatatacctgagcgctctagggggcgagtcttggaggactgtctcctcagatcatgagttgaacgagctgatcgattcaaaaaacgccgtggaattcctcaaggtaagattcgaaatcgggaccaataagatcgacagtaaagagctgtttaacaggttgagcaaacttgaagccatccacctgtttatagaattcgagactaaccacgagcaaatcaatcaattgatccaccgtttgaaaatgtcttttggctcaattaccccgctcaatgaacaccttaacagcctggaacgcgataacaaccaccaggagaacatctttctcaagcagtacgtgtttaatgctagcgatttgaagaatatccacctgaagtcactgatcattgattttagctggatccccaacataaagttcatcggagactttcatgttaagcccgacttatatcacctactgcatccaggaactagttttacctcactgccggcaacctctgtcgagtttcaccgccctaatattctggtcaaagtcttaggcgagaagcgcataggcaatgaacagacctacctccacgtaacctatccttttgactcaatcgaggaaaggcaccagaatatccagacaatcatcccaaagaatcagattttcatcgacgaactcattttggtgttatctaacgaaaatgagaaggagttgaaaaaaggacagattgaggaacactttcccaaactatacgcaattaatagatacaacagcaaaccacatgcatcaaagttaactaccaacctcatctattccaaacgcgtttctggtttccctctgctgggattcgcccttcagtttgatgtgcacaaactttccgtgcctctcgaatcgttctacaagaaggacaaattactgtttaacccagagcgtttcaagcgggagaaggggccaatcatggattggaccgaggttaatttcaaccaaaagattcactcggaaaaaaaaactcgcctcggaaaggaaaaccttctcagtgatctggacattttttcacacaagaaggaatcgaaaccgcctactataccaccctccgatgacaggcccctcaaccgaccttatatcataaaacacggggtgttcgccaaacataaactgtacagcgcctctgataacagtcggaacaaagtcatgactatgctcgccagcggcgaaatcgccgctaagcacctccccagtaagctgaagaatgatgaggaggtgatgttaatcgccataaagcggaacccttattccatggtctttgcgagtaaaaggttgaaagaaaaccctgcctttctgctgaaagcatgtaagatctccgcccgaaccctcgtgtttctgccaaagaaactggccaccaaacaagtgaaatctgacagcatctttaaccagctcattgactatctcctgtcttttctgacaccggcagaattccatttcgttatccacaaattaggtacacatatttcccagagtgacggcgagtaccggtattttacatgtgaggagacagccctggaaaaatcacatgtgatctcatcattcgagtccgaagtgttttaccaggaatctaccacaagagcagggatgcccaatattataaggaaaactttcctatccgaggcaacaaaacagggtatattcaattctaacgggtactataactccttggagctcgccaagcaaaacaaggagaactgtcgatatctggatctctctttctctggctaccaccatgacctaacggctctggaatctttcaagaacttaaagacactgaatctcagttataccagcgtcaattgcaaactcccaaacattccatccttagagaatctgtttgttgataatacccggaattttttcagctacaatacgcccactctgctgaatccgatattccccaatctgaagattatttatgcccgggaaacgggttatctcagcctgaaagagattacttctctgctgaatcttcttaccaagatcgagattatcgaccttagaccatacttttatatcaacgagaaggagatccttgctctccagcaacaactgattcaacagggtcgcacactggagattcccatcaaaacacccaagtga

SEQ ID NO: 9848 - RNA, 3696 nt, unidentified
  source 1..3696: mol_type = other RNA; note = synthetic construct
atgaataatagcgaattgacccacaggtccttcacggcagattttcttaaatccgacaagatcgaatacactttcaacgcgttaagactcattcatgacctcactctcccagagcattttgacgaaagctactacaacaagcatgtcatacccaagtctgatggatcaagcagggtgctcttcgagccgaagccggtcctgaaggagatccaacaccagttgcttgaatttttcaacagcatcctcgagcaggtgcctagaggctatcgccagaaagaccggattcgcaaaaagtacctgccttcatcctgcgccaccgcatacaggaagggcaagaacgtcgtcactaacgccaactttcatatcggaaatgaagcattgctgaaagcagacatcgagaacttctttgatagtatcgacgtctccgaaatgtcctctatgttcatggacttcctgtacattaagtccgggtacttatctctaattggtatcctcgatgagaattggtctgacatcgagaaagctaaagtgcggctgagcctggccaaaaaaatcgttaccgtaagtagtctgaacgggggtcttccacagggctccccaacaagtggcattttagcgaatttctatctggccaagtttgaccggaaatttcttaactattgtatccgtcacaagctcaactacagcaggtactcggacgatctgaccgtcagtgggaatcaaaaggacctggctcccggagctttgcttcaccagatgaataaactgctcaaaccactgaagctaaggcttaagaagagtaagacaaagatactgcgacgtaacaagcggcaggttgtcaccggcattgtccttaacgaaaaacgaagcgcgggccgcctcctaaagagaagcttgcggcaagagatttactatctcaaaaaattcggagagtcacacgtttcaaagcatagcagtagtaccaagaagtacctgcgggagctgtctggtaaggtttcttgggttcttcaggtccaatctgcagacaatgagttcaggcgctatagtggcgagctgcagataattagcagaatggtaaggtcagggaagacccttgctgatgctgcaagttatatccaattcctggagaataaagctaaggagctcaaggggcctgagccattaatggtctgtggcctggagtggcgtaagaatgatctcttctatgcccgtgacctgtacaatttgtttgaaagagagatgtatgctgggagagtgggagggaacaaagaggaacccggactggtattcaccagaaggggcgtcgaaaaaaagctgtatacagaagagatgatgcttagagtagtaagcaggctcattaagtggcgtctccctaccagcgaggactttgctgactatattcgggaaactttttacgaggaccgagcccttctgggtctgagagtgccaagcgacccgcagtataacggaatcgccgagaaccatggcttgtgcttttataacaaaatgggtgcatactggacagcagatatggtgcatgttaaagatcctaagagttccgtgcgagctaaggtgggacgaggagtgttctacgtgaaatcccgccattggtccaccaagaatcgcctcgatctttttgggggggagtggatgagtaaaacaactgggatcaagccagtgaacgctgtctactacttcttggaccagcgctttcacaagaatctggcgacgaatgtgcccatcaaggataggccatgggttgagtctactcagctggcctgtagcataagactggtccgcacccagtccatagagtgggaagcgcaccatattagcgataaattttggcaaagcgtgtcatccacacggttttcctcagatttaagtgggaagcacatttcttcagtgcccacaacatatctgaagaattggaacagcagttctctgctgctagcccgcaacaaactggatcagttcgacctgacagcttgtcctcctgtgaaaagaatagatttgtcgggcaataaactgaagcacttcgacttttcgtctctccccaagggccttagacacttattaattgatgatatggacgccctcgagggagctaagctcccctgggacaagctcttttcttcccttcatgagttaactatcaagaaccctcacgatgaaccccaactgaccgatattagcgaactgtacgccctaggttttgggtactcagattgcgtcgaggtgacctcagacgaagagctacaggcattaatccagaacggcgagaaaataaagttcctcaaagtgaaggtgctgctgggctcgggtgcaatctccaatgagggcctgtttgggttgataaaccaaatcgctcctctcacggtcttgattactttcttgtgcttggaccagggccttcagcagactctggatcggctaaaaatggcatccggcaacattcagccttacatggaggagctcgaggcttatctccagactgtttattctacgagcctggaagagtacaactggctgcacaagccactcgttctgaatccggatcagttaaattctaacagaatcaggcacctgattctcgacttatcatggttccccaatatcgtttttaacggggacttcggcattaagcctgacctctatcatatactgcatcccggggtggactcattacagctgccttccacctctacggaatttcatcgccccgggatcctgatgaaaattctggccgattcttatcagcctgtgccacaggaatatccctttattgtaacctatcagcctctgaatcgatggaataagcgagtggccaaaaaacacatgttgaccttgttgcccgccaatcaaaaccacgtgtcagagattgtcatcgtggtggccggaaaaagtgccaaagaatttcagatcggccgtatcaatgttaattttccgagagccgcccacgtgatgtttgaaaaggagttcctgttctacttcacccgggagaaatacagcttcactgtgtcgcgaaaaacatttgaattcccactcctcgggtatagcaggcggtttgatgtgcacaagttgaacttcccacccgaatcaatctttaggaacggtcgctggtctagccttatatcagacgtgcttgaacaagactccgagcacgaatccgccgtgcattggctagacttctattcccagaatatgggatacttcgaaggcggcgaacctaataataacgtgccccacaaaagctttaacaacaacttcgaattcgcgatattcccggcctttaaggatccagatttcagccgcctgaactcacggaatctcgagaaatttggatttccatactccgtgaaagacggagttaggttctccggcgtggattacagaagcctgtctcgggaagagctacttacaggtctgaatagcggtgaactcaatccaaagtacctgccctccaaatataaaaaggatgctgagctaatgctggctgccatcaggttcaacagttttgcctttctgtacgcacataaaggtctgaaaggagactctgatttcgtaatcaaggcaatgcaaatctctctgcgggtactggtcttcttgacaaaggacacattcaagaaccgcctgcaccctaatggattgctgcagcagatcttctcgattctttccgccaagttctctccctga

SEQ ID NO: 9849 - RNA, 4359 nt, unidentified
  source 1..4359: mol_type = other RNA; note = synthetic construct
atgagagtgaggagggttagtcaggttagcctggtaaattatcaggacctggggaaagaagttctatcatttgataacatccccaacttacctacctttaatgctctctgtctggtgcaccaattggagattgacggcccactgacagaggagttctatacgaagcacaccattaagaaacagaacggaaagctgcgcatattacatgaaccaaaacctgtgctcaaggaagtgcaaggacaactactgcagttcatatacaccaacgagaacaaggagtggaaaaatcgtagataccctaggaaagtgaacaaattcatcctgagagactgtgcagtggcataccgacccggaatttccgtggtacgcaatgccaattttcatgtcgcaaacgagttagtgatgaaactcgatatcaaggacttctttgggagcgtcaagaccgataagttgttgcccttttggctcaatttactgtccaccaaaagccactatctctatcagctggggatattggccagggaactgtcgcaggaggagaagctggtcgagctgacgaaacttagtaagaaactcgtgaacgtcatctctctcaacggattcttgccacaaggctcccccacaagtggaatcctggccaatcattacctagtgcggttcgataaattcttcctggactattgcattagaaatggactgaattactcacggtattcagatgatatcaccgtcagcggatcaaaagataagttaaagccacaggcggtcttggggactataaaccgattgattaagctcgagcagctacagctcaacaggaccaaaacacgtgtgctccgcaaacaccagcgtcaaatagtgacaggcgtggtagtgaacgaaaagaagtcagtgccaaaaaccctgaagcgggggttgcgccagcagatgtattacctcaaaaaattcggcgaggaacatattgaaaagttgaaaaccacccgccctaagtaccttcagaagattaagggagagattagctgggttctgtcagtagagaaagccaatgccgagttccaccgctactttggagagctgagcattattattcggttctgcgaagcgaataagaagattacagaagcagtggattacatagagtctgttgaagcgctcgcagctaagctcaatacccaggagtttacaatcattggcgacgtcgaatggaagaaagaggacgagctcgctgtcgaacagtcagggactgccactgaggggctggtgcagttgagtaagtggggcaaaaacaggacactctacactgaagcctcaatgatagagatcgtttctaagctgaatgatggatggcgtctccccagtaccgacgagtttgaactctaccttaaggagactctgtacgaggaccgccaacggctgggcctgagaatcccaatggatccccagtataacggcttttttaacagcattacgcatgctagagcgttcaacaaggtggctgcttattggacctcttccatgacccatctccctcatatgtctcagagtaataccaggctggggagaaacgtgttcctgttccttccaaaaaaaggggggtataaagcctctctgaatagacggtttaagaaatgtagccggacttcagggtatattcccgtcaatgatttcctgtccctaagtggaacagtttcagatggagatggccacttttatcctaggctgttttctctctatcgcaaaactcagacgtattcatctgctttcagcctcaggctggtgcgctctctgaatatcgaggccaagctaaaaacaatcgatctgtccgtgcatttttggaattccgtgtccacggcgaagcacagtaccgacctgggtaatcttggcattgcaagtgtcccgagcaatgtgctgatcaattggcagtcttccagcattctgctcgccaataacaaactgaccagtatcgacctggagcagctggctcctgtaaatagaatcgacttaagcaacaatgagctcgagaatttcgacgtgaaccttttgccgtcgtccgttaagcatctgatcctgcaccagaacaccaaactcgttgatatggttgttccaatcaagaaacttatcccccgcctacatgaatttacccttgacgctccagagctccctaccctggacttcagcgaattgtacgaaaatgctctagaacttatgttctatcggtgcgattccgatgaagaactagaccagctcatacaacagcagatcactgtggttgcactgcaggtgactgtccagatcggttccaacaagattgaaagtaccaggctgtttgaaagattgaatcaggtaaagggtttagagacactcagtatcctgtttgagccctttcatgaagacctcagaaatcgtctcacaattttgaagaacgctgaggtgtttcacctgagctctttgctggaacttaacgaattcgtagggttagaccagagccaatctgaactcttcgttgaccctatcgatgccgagcttctttcaaaaaagcacgtgttttatcctgaacaccttcagagcaactgtatacactctctcattattgacttttcttggttacctaacctggtctttaatgggaacttcaacgtcaaacccgaaaagtatcacctgctccaccctggcatccaggtcacagatttgccagctacaagtgaatcctatcaccggcccaatctgcttctcaaaatcatcggcgtacggggagcttgcccgtctgactacttctcaaacggtcagtttcagaacctgactatattttacccgttaaacagtctgttgttcgagcaggagacaaatgtgctgtttgacatcttacccactaagcaatttcacgtggagaatttcgtgctggtctgcgccaacaatgaaaaaagatcagtgagacggggcaatgttttgagcttatttcccggttccaaggccttcaagggagtagcccagagccaggggcgatcttataacaaaatcgtgggccttgggaaatcaaagaccttcttcaatttcccacttgtgggctacagcctgaaatacgatgtttacaagttgtccgtcccttttaggactatgttccgggtggtcagtgagtacaggaactcactggtgctaaacgaagagacaggtctactgaagcgcatgtccgagggcagaacggaatttagcgtattccactctagtacaaagtacgacctctctcagatgaaccaactaaatcggatatcgatcttccccatgctatatgacgacgccgccaagcggctgcaagttctcccatccatcctgcgcaagaagtacgtgatcaagaggaagcaacacgcgaatgatcctatgataggttcgctgaaccgcgaagatttactggcaaacctgaaacaaggcgcaatcgacccctttaagctctcccgacgaatgttcaaggatgaagagattatgctggctgccatttatggtaaccctttcagcttcattctggcacatccctccctaaagcttaacagcagctttgtccttgcggccctggagcgttctctgagaatcctggtgttcctgaaccagactatccgagaggagaaaagacgaaagaacgccgtgctgccagcagtggccaattacctgacagaaaagtacgcagctcaagacctttactatatcctcaatcaaatctacaggcgagtctcctatgatactaagggcatgtatacctttgtgcatgagggtaacgagcactccaagctgtctgacctgcagtctattgaacaggagttgttcacatttttcctgggcaaccgagccggaatgtccgtaaagtactacgactactttgtgaaatacgcaatcgagaagaagtactttaatgccaacggcttctacatgagccttaatatcagcgacgaagccgcattggattgtgtctgtttggacttatcgtatttgaaattgtcccagccgctgactctgccaagtatgcccaatcttaaaacccttaaactgagctttacgcggtttttcaatattgccaatgtccctctttttccatcctgtgaagagttatacttcgatggtctgaacgcttcgaacctgggcgatatcaacatcttctgcagcaagtttccgaagctcaaaaaattgtatgcccgctgctcaaattttctcatgcccgagcatttcaagactattattgagcactgcctcgagcttaacttcatcgatgtctctcatttcaacgaattcgactccatggggaaagagctgagggagctttgcaaaaaactggacaggactatagagatacgggaggatattaagaaatga

SEQ ID NO: 9850 - RNA, 1227 nt, unidentified
  source 1..1227: mol_type = other RNA; note = synthetic construct
atggggacgtattgctcccccaccacacgcgctcaagtgagagcacagctcgtagcgaccctgtggcccgcagataaatttttcatcagagagaatctcgaccagaacattaaagcctcatttaatgtggttggaaaggcagcccccaaaatgacggccaatagcgaagagctccttcggctggtaggcgccacatacaagtcccagaagaagatttcccagtacaaaaactatatcaacactcttaccaaccggggtctgcctgtcatattttcttttaggcacctggcagatgttttgggcgtcgctcccgcaaccctacacacaatgagcttccgcacagatctgtactacaagcgattcgacatccctaaaagaagtgggggaattcggaaaatctctgccccacacgagacactggccgcgatccaacggtggatcctcgaaaatataatctccagggcctatcagattatttcaccgagtgtggtgggatacgtcaagaataaatccatcaaggaccacgtgaccgtacatgctcagtcgaagcagcttgtgaaattcgatttaaaggacttcttcccaagcatttctgtggagaacgttaagcacatatttagtgagattggctattcccattctgtgagcaggactctcgccgccttagtgacactggagggcggtctgcctcaaggcgctagcacctcacctgctatcagtaacgtttttatgcagtcgttcgataacgcaatgacgactttctgtgacgaaaagtgtttcctgtacactcgctatgccgatgatattgtcgtctccggagagagcggtgtgaccgaatcactctttgacctcaaggctaagttcagtgaatttgggttaactcttaatcatggcaagacaagggtgtacgctgatctacagagggttaaatttgtgaccggtcttatactctgcgacggcaacgtgcgtttgcctaaaagcatgcgcagacggatccgcgtccaatgccatctgttcctgacacagttggaacggatgactgggctgggaccaaccgaggacaatgtttcagtaccatcttcttggcgatcccgtgaaagagtgtttgacccaacttttcccgagagagtcttggggaaactaaactattggttgttcattgagccggacaacgcttacgcgaataggatgaaggccagcatcctggagcgactggaagcactgtga

SEQ ID NO: 9851 - RNA, 1077 nt, unidentified
  source 1..1077: mol_type = other RNA; note = synthetic construct
atgctctcaaatgctgatctgctcgagcttgtcaaggcaaaatacaagacagagaagaagataaacctctacgcagagtacatcagtaaactggaagaacggagtgtcccagtgattttttctttctatcacttcagcgatatcctcggaatctccccaaagacccttagggctatgagtttcgacactcacctgttttacaagtcctttgagatccccaagcgctctggaggcatcagaaacatctatgccccttacccttcgcttgaaagcgtgcaacgctggatcttaacgaacattctcgagaaggcgttttgtgattttctacccatggtcgtcgggtaccagaagaacaaatctataaaagaccacgtgtctcctcatgcctctagtgagtgcatcctcaaatttgatctgaaaaacttcttcccttctatcctgttcgaccacgtgtatctcattttcaagaatatagggtactgtcattcagttagcaaaattttgagcagtctggtgacctttaatggctccttgccgcagggcgcctcaactagcccctgcttgtcaaacatttacatgaagatctttgacgcagaactgaccctttattgtgagcagaaaggttttttttgcacacgctatgctgacgatatagccgtgagcggcggggtggagctcattaactgcttaaagtccatcaaaaagctgttcaatgataatggactgtccctaaaccatgccaagaccaaggtgtacgaccgtgccaaggaagtgaggttcttaacaggcttggttgtcaacaaaggtgtagtacgaattcccaaagaaatgagaagacggatccgagcgcagtgtcacctgttcattaaggagatagactgcttggtttccaatctgcccaggccagaatataaactgccatccgagtcatggaaaaataaggaactggtgttcgacccaatttttccggagcggattctggggaaactaaacttctggcttttcattgaacctgacgataagtatgctctgagcatgaagaagatgatcgaggagaaactgaatgaaatcgtttga

SEQ ID NO: 9852 - RNA, 1053 nt, unidentified
  source 1..1053: mol_type = other RNA; note = synthetic construct
atgctagaaataaacgaagagatctatgaacatctcagttctcatatggaactcgatcagagagacgatctgctgaagctcatccagaagttcgatgacatgcagatcccagcaattataactttcgacatttttgcaaggaccgtgaatatcaataagaaaagcttggccgctatgtgctacggagccgagaaattctatcgtacctttaaaattcccaagcggtctggtggcatgaggcagatagattccccgtttcctagtctgtctctggtgcagaaatggatttccaacaatatcctggagaagcttgacatcgacaacgagtcggcttgtgcgtacatcaaagagaaatccatcaaaaatcacgtcgaaaagcacatcgatagcgcattcattctgaagatcgacctacaggattactatcccacgatttcaacaagagacatcatttacactttctccgagattggataccccgtcaacattagtacctcaatcgcccacatacttagcctaaacggcggtctgccacaaggcgccccttcatcgcctttactgtccaatattatcacattggggctggatgttaaaatcaaggagtattgccagaagaacaacttcttatactctcgatatgctgacgatctggccataagtggcgagaatatcagcgaagataatatactggagatctacagactcatttcaagtgaagggttcatagttaatacctccaaatcaaagctctatacacccaaacagccagtacgccaccttacaggactcattattaacaatgggaagatccgaattccgaaacagacccggaaaatggtgcggcaaaagcttttttacatccgcaactactatttgtccgacttggagtcttctagcaaccataacctgtttagccttcacgaccctctgttgctcgagagggtgctgggctacctgaatttttggctgtggattgagccagacagcgaattcgctactgtgtctatccaagagatcaagtccattaagaccaagctcttagaaagcatctga

SEQ ID NO: 9853 - RNA, 1029 nt, unidentified
  source 1..1029: mol_type = other RNA; note = synthetic construct
atgaattgggaggagtataagagcaaattccaggatcaggcgattatcgtgggtttgcctctcggggacgtggaagaatgtctgtcttacgcctttggtctgtacgaacgcggccttccagttatttatgaccaggcccatctttcatatcttgtcggctacgacgtgaaatttatcctgaaagcttccaactccaatgggccgttctatcggacctacgagatacctaaaagaaacggaggattgcggataattgatgaacccctgcctactctgaagtcgattcagagatggatcctggacgaaattctcagccaagttgagattagcgaacacgcacatgccttcgctaagaattgctccatcgtaaaaaacgctaggccccacctggcttcaaagaagattcttagcctggacattgagaacttcttcggtactatagactttccccgagtgtatagcctcttcacacggctcggctacaatagtgtggtggccactaccctcagtcacctggtaaccatcaggggcgtactgccacagggagcacctacatccccagcgatcagtaacattgtgacgttaaaaatggatagaaggttcagtggatacgccaagaaattaaagctggagtatacaaggtacgccgacgatatcactttttctggtgagtttaccagcgggaccgtgatttcttttgctaggcgcgtcgtggaggaggagggctttaagctcaatgaggcaaagacaagatccatgggccgccaccaagcacaggaaatcacaggaatcatcactaacgtgaagctacaagtccccagacaaacccgccgaaagctccgtcagatagcataccatatctctacatacgggctagatgatcatttgcggatgacgggcgaattacgtgtcaactatatctcacacatcttggggctggcctcccatgtgctgcacgctaatccacaggataaagacgccatgttcctgaaatctgtcgtttgcgttaatcagaccgactcattctga

SEQ ID NO: 9854 - RNA, 1092 nt, unidentified
  source 1..1092: mol_type = other RNA; note = synthetic construct
atggactttcctcgtgactcttttatcaaggagatcaacagcgccagaccagagtacaagaaagcagtgctcgattatgcagacaatctgttgtcgaagaacctacccgtcatcttcagtttaaaccattttgcggagctgttcggaatcgatattaatgaactcaggttcatgctcaacaacatagatgaattctatgcctactacttgataaagaagaagcacggagggaaaagacgcattgtgtctccctataggaaccttaagcgcattcaagagtggattttgcatgagattctggacaagatacaggtccatccccagtgtaagggctttgttcgtggcagcagtacactgcagaatgccaaaccgcacatcggacagcagtacattcggaaatttgatcttaaggactttttcgagtcaatcaccatcgatcggatatatggtatattccattcaatcggttacagtcccgctgtcagctatgatctcgccaccatttgcacgctgaaactatccgactataaatacgtgtctatgtccagactgcagaagaattggtttggttacctgtactccaaggagaagccagtgttggcccaaggggcaccaacatcacctgcactcgccaatattgcttgtcgaaggcttgacgctaggttttggaagtacgcactgagcaacaatgtacagtatacccggtacgctgacgatctgacattctctagtgaacagattagatccctcccaaacacagctttcgtaaacaaagttattcaagaagaggggctgactttaaattatagcaaaactgggacctacgggagatgctcacgccagatggttaccggcatcctcatcgacggcgaaaagcctagggtgcctcagaaatttaaacgacaaatttatcgccatctgcacttctgcaaaaagttcggcgctaaaaatcacttcgaacacatcatgccccagcacactaacgcccggcagtggctttatggcaaaatcatgtacgtgtacagcatcgaaccggaggaagccaaaaagatgctgaagctggcggagtccttagagtggggaatcatgtga

SEQ ID NO: 9855 - RNA, 1092 nt, unidentified
  source 1..1092: mol_type = other RNA; note = synthetic construct
atggatttcagccgagacagcttactgaaggaattggagaacaccaatgtggaatataagaaggtaattatcgagtacacggacaatctgctaaaaaaggatctccccgttatctacagcttgaaccattttgcaggtattctgggtcttgatctgtccgagttgaaaaccatcatacataacattgatgggtactatgcgtactatttgatcaagaagaagcatggcggaaagcgccggatagtgactccatataggaacctcaagatgatccaaacctggatactgcatgagattctgaacaagatccccgtccactcccagtgcaaagggttcgtgaaaggctcgaacactctccagaatgctaagccccacatctcaaagcagtacattcgcaatttcgatcttaaggactttttcgagtctatcaccattgaccgggtatatggcgtttttctgtctctaggttactcaaccgcggtcagttttgacctcgcctcactgtgtactctgaagattagcgactacaagttcgagaacctatccagatacaagaaaaactacttccgctacctgcatgtgaaacctcaggccgtgctcgcccaaggagcaccaactagtccagctctcgccaacttaatctgtagacacctggacgagaggttctggaaattttcacttagcagggggatacagtatacccgatatgcagacgacctcacattcagttctaatcagctggaacttttgccgaatacaagcttcgtgaataaaatcgtcaacgaagaaggactgcagcttaactatcagaaaattggaacatacggaaaaagttctagacaaatggtgacaggcatcctgattaatggcgagtcccctaaactgccccagaaatttaagcggcaaatttaccgtcaccttcacttttgcaaaaaatttgggacgtacagccacttcaatcacatcatgcctaattatgctcacgccaggcagtggctgtatggcaagatcatgtatgttaactccatagagcctgatgaagctaaaaagatgctctctatcgccaattccttagattgggggctcctgtga

SEQ ID NO: 9856 - RNA, 966 nt, unidentified
  source 1..966: mol_type = other RNA; note = synthetic construct
atggctggtatagtgtctgtcgaatactctgagctcatctcgatcaaagatcacatcgatgggtactatgcctactttaccatcaagaagaaacactcatccaaacgcagacgtatcgtggtgccctatcaaaatttaaaatgcattcagaggtggattctacacgagattctggataaaattcccgtgcatcctcagagcaagggctttgttaaggggggaagcactttccagaatgcctcccctcacgttgggatgtccttcattcgcaagtttgacttcaaggacttcttcgagagcataaccgtccagagggtgtatggcatcttcttagaaatcggctatagtcccgcagtaagtcacgacctggccacgttgtgcacattgaaacttaaggaagagaagtaccagagtctgagaggttacaaacagagctgtttccgatacctgtataataaacccaaagcagtgctggctcaaggagctccgacctcaccagcacttgctaacctgatttgccgcggccttgacagcaggctggccaaatttgcagatctgaatggcattcactatacccggtacgccgacgatctcactttctcagcgaacgagctggagaagctcccaacacagtccttcctgaagaaaatagtggaggaagagtccttgaagctcaactactctaagacaggaacttacgggcctgagagcagacagatggtaaccggtatcctcattgatggcgaaaagcctcgagttccacaaaaatttaagaggcagatttatcggcatttgcatttttgtgaaaagtatgggacacaggcccactttgaccatgtcatgccaggatactctcatgcgcggcaatggctgtatggcaagatactttacgtctactcaatcgaaccggagatcgccaaagacatgatcgccaaggctaacgcactggactggggactcctatga

SEQ ID NO: 9857 - RNA, 1095 nt, unidentified
  source 1..1095: mol_type = other RNA; note = synthetic construct
atggagttcccgagagactccttcatacagcaactgaacgggtgtacacctgaatatcggtcagctatcattcaatacactgacaatctgcttgccaagaaactgcctgtgatttttagtctgaagcacttcgctgggattgtcggaatggatgaaggtgaaataaggaggatcttggatcatactgacggatactacgcgtactacaccatccagaagaagcactcaaagaaacgtagaagaatcgtggtcccatatcaaaacctaaagcggatacagagatggatcttgcaagagatccttgataaggttgcagtacatcgccaggcaaaggggttcgtgaaaggtggtaataccttacagaacgcactccctcacctgggcaaaaaatacctgcggaaattcgacttcaaggactttttcgagagcatttcggccgaaagggtgtacggactgttttatgagctgggctactctccagcagtctctcacgatctggccgctctctgcacattgaaactctccgattacaagtatattagtttgaagggctacaagcagcgctgttttaagtatctgtatgacatgaacaaggcggttctagctcagggggctcccacatctcccgctatagcaaatctgatctgccgcggactagatggacgctttgccaaatatgccgatcttaatggaatccagtacacgcgttacgccgatgacctcaccttttcagccgattccctggaccttttaccgtcttttggcttcgttaacaaggtggtccgggaggaggccctcaaattaaactatagtaaaaccggtacctacgggccagagagccgacaaatggtaactgggatcctcatcaatggggttaagcccagggtgcctcagaactttaagagacagatctacaggcatctgcatttctgcgaaaaatatggcgcgcaggagcatttcagccacgtgatgccaggctatagccacgcccgacagtggttgtacggcaagattctgtatgtgtatgccattgagcccgaagtcggcaaagacatgctcgtgaaagcaaattcccttgactggggcctgatttga

SEQ ID NO: 9858 - RNA, 1092 nt, unidentified
  source 1..1092: mol_type = other RNA; note = synthetic construct
atggaatttccccgagactcgtttttgtcccttattaaggatagcccagatgagtacaaaaaggccaccactgagtatgccgatcggttgctttccaagggccttccagttatcttcagtctgaaacatctaggtgtgctgttgaatgtcgagtatagggatatgtgtatgctggtacacttccccgatggctattacgcatactttctcatcaagaagaaaaaaggcggatatagacgcatcgtggtgccttatgacaatttaaagcacatacagagatggatccttcacaatattctctctaaaatccctgtccataagcagtgcgtaggtttcatgaaaggaaaaaatacgctcgacaacgcgaaggcgcacgtgggcaagaagtacattcggaaattcgactttaaaaacttcttcgaaagcatcaacgcacgccaggtatattatgtgtttcggaacgtggggtactcaccgagcgttagcaggtgcctcgcatctctctgtacactgaagatcgaggataataagtacgattacctccccccctacaaaaaaatatggttcaaggacctgcatgacactacaattgccgtgctgcctcaaggggctcctacttccccggctctggccaacattatctgtaacaatctggataaacgctttttcagctacgctttcaagaaaaacttaacatacacgcgatacgccgacgatgtgaccttctcctgcgacgacccctcactcctgccaaacgtctctttcgtcaagaaggttgttgagagtgaagggttatcattgaacgagaaaaagaccggtacctacgggcaagacagtagacagatggtcaccgggatactgattgatggcgaaaaagcacatgtgccccagaagtttaagcgtgaaatctatagacacctacacttttgcaagaagtatggcacacacgaacattttaggcatatcgccccagacaagtctaatccaagggcctggatatatggaaagattcactacgtgaatgctattgagcctgaagaggctaaaaaaatgtttgcactggccgacgagctggattggggaatcctgtga

SEQ ID NO: 9859 - RNA, 1104 nt, unidentified
  source 1..1104: mol_type = other RNA; note = synthetic construct
atgaccatggagtttcctcggaacgacttcattacaaaagccaaaaaagcgggccattctgctgatttcatcaaggccactcttcgctatgccgatagtctggatgagaagggcctccccgtgatcttcgatcgaaaccatctggcctttctcctgatgatggatattcaagaacttctgtgctttgtgcgggaatcctcctgcttttacaaatacttcgccatcaaaaagaagcgcggagggctgaggaggattatagccccatacagcaacctccgcaaaatccaggtgtggataaaagagtgcattttggacaagatcgagcagccctattacgtgaccgcatttgcaaagaatcgtaacacgctgaagaatgctcgcatacatgaggacaagaaatacattctaaagtttgacatcgcagacttcttcgaaagtatctgtttcaaacaagtgaactctgctttttgcaatatgggctatctgcccgaagtttcgtcctgtctcgctagactttgcactagcaaaatcgacgaatacaagtattctcagttggaggagcaaaaggatattcaggccttatttgacgacctgaaaaccaagaatgaggcattcttaatccagggagctccaactagccctgctcttgcaaacattgtgtgttacagaatggatcgacggattataggactctcaaagggaataaagttcaactactccagatacgccgacgacatgaccttcagcgccgatcgtctgtcagacctccccaaggtcgggatgattagacgcattgtcgaatcagaggggtttcacttaaatgaccagaagacacagctgctacacgtcgggaaaaggcagatcgtaacaggtctgttggttgatggccacgtgcgggtaccaggcaggtataagaaagatatttggagacacatccatttctgtttgaagtatgggggccgggatcacttcaatcgaatcgcgccgggactggcgtatggcaaagagtggatcgagggtaggatcaggtatgtccacagtgtggagcctgacgtcgccaagaagatgtgggttgaatttgaaaaaatcgattggggttactga

SEQ ID NO: 9860 - RNA, 1098 nt, unidentified
  source 1..1098: mol_type = other RNA; note = synthetic construct
atgggatttcctagaaatgactatctcaccgctgctaaggataagaaacattctgacgaattcatctccgagacactctcctatgctgatgggctggattccaagggcctcccggtgatatttgaccagcaacatctgagttacctgctgtgtatggaacacagaaacctcagacaactcgtcaaaagcgccagttcctactataagtacttcgctatcaagaagcgcaggggtggccttagacggattatgagcccctatagcgagttgagggatgtacagatatggatcaaggagaacatccttgacaaaatagaactgccaaattgtgtcaaggcctttgtgaaaggacgaaatatcatggagaatgccaaaatgcacgagggcaggaagtacattttgaaggtagacattaccaatttcttcgaatctatcggcgttcggcaggtgtacgtcgccttcagaaagatgggatatgaccgctcagtcgcagcatggttggcgaacctgtgcactgccaaaattgaagattacaagtacgagcagctggaagatcaggaagagatccagaaattgttcaacgatctgtaccacaaaagcgaaccatttctagtccaaggcgcccccacttcgccaggtttagcaaacataatttgcaaccgaatggataagaggatgatgggacttgccaacaaacatggatttacgtacagtcgttacgcagacgacatgaccttttcagctgataaaaaggacaggctgcctaaagtttcaatgatccgcaaaattgtggagacagagggttttcaccttaacgaggagaagatcgaattactccatgagggaaatcgacagatcgtgactgggttactggttgataatcacgtgcgggtgcccgggcgttataagaaggacatcaaacggcacattcatttctgcctgaaatatggcgggcgcgaacactttcaccggatagcacccgggaaagccttcggcaaggagtggctagcgggcaggatccgctacattcattctgtggaacctgagacagccaagaagctgtgggctgagttcgagagaattgactgggggtattga

SEQ ID NO: 9861 - RNA, 1098 nt, unidentified
  source 1..1098: mol_type = other RNA; note = synthetic construct
atgggcttcccgcgaaatgacttcatcacagaggcgaccctccagggacgttcccagcagttcataaccgaggctttgcgctatgctgacgtcttggacgggaaggggctccccgtgatctttgataccagccacctagcctttatgcttaatatgtcccaccgagacttagtgcacattgctttcatggccagcgtcttctataagtacttcgcgataaaaaaacggagcggggggtatcgcagaattatggcaccatacatgcacctccgacagattcaggtgtggatcaacaaaaatatcctttctaaggtgcaacagcctgaatacgtcacagccttcgtaaaggggcggaatactcagatgaacgctaaaatgcatgaaaatcgtgcatacgtgctgaaggtggatctgtcgaacttttttgaatctattaacgtacggcgggtttgcgctgcctttatgtggatgggctatgaatcatccgtggcctcatgtctggcaaagttgtgcacagccaagatcgatgattacaaatatgatatgctcgaagagcagcctgaaatccagacgctgtttgatgagctgatgcaaaggcacgaaccattcctaatacagggagcgcccacctcacccgcattagccaatattgtttgcggtagactggacaaaaggatgaagcggctgagtcaagagatgggattcaactacagtagatatgcagacgacatgactttttctgccgacgaccgcgcaatgctccctaaaataaggctgatcaggaagatcgtgaaggaggaaggatttaccctgaacgagaaaaagacagagctggtccatcaaggtaacaagcagatggtgactggtctgcttgttgatggcagagtacgtgttcccggcagctacaagcgcgatattatgcgccatatccatttttgtcagaaatacggaggcaggggccacttcgatagagtgatgcatggcaaggcttatgggagggagtggcttgagggaagaattcggtacgtgtattccgtcgaaccagaggccgccaagaaaatgtgggctgagttcgagaaaatcgactggggctactga

SEQ ID NO: 9862 - RNA, 1089 nt, unidentified
  source 1..1089: mol_type = other RNA; note = synthetic construct
atgaattttccccgcaatctattcattgagaatgccaacgcagaaaaacggtctgcagaatatctgacaaagaccctcaactatatcgatagattgagcgcccaaaatctccccgttatattctccactaaacacctcgcacagctgctaaatatcgaatatcacgagctgaataacatcattgagaatcgcacatacttctacacctattatctcatcaagaaaaggacgaagggacatcgacgaatcatagccccatattcaaacataagcgaagttcaaaactggattaagaacaacatcctggacaacttaacgaccaacataaattctacagcttaccagaaaggcaactccatctccaacaacgctaagatccacgagaacaatcaagtgatcttcaatattgacctggaaaacttctttgaaaccattactgagagaaggatttacggggtttttaaatccatcggctataccaagaatgtagccattgaccttgcgaaaatctgtaccaccatcatcagtcaggaaaagtttgatgacttaaatgacgatgtgaaaacacattttgaggactacattaagctgaatgagtgcgtgctgcctcagggcgcttgcactagccctacattgagcaacctgatttgtagaaaactcgatattaggctttcaaagcttgccaataagttgggtatccagtacagtcggtacgctgatgacattacattttcgggatcactggagaaactgccgaacattaaactcttgaagaagatcattgaggaagaaaagttcaaggtcaatgacaataaggtaaagctgctgaaaaaggggaacagacagatggtgactgggttactggtcgatggaaaagtccgtgtgccacagaaatacaaaaaggaaatttttcgccatctcaggttctgcgagaaattcggtggctttactcacttcaacaagataaaccctgagaaatcttttcggaaggagtggctgcacggcaagatctgtttcgtgcatagcgtggagcccgagatagccaaaatcatgttccagaagcttaaggatatcaattgggaaaaatga

SEQ ID NO: 9863 - RNA, 1089 nt, unidentified
  source 1..1089: mol_type = other RNA; note = synthetic construct
atggacttcccacggaacctgtacattgaaaccgctaataatgaaggccactcacctgaatttctgacctccaccttgggatatatagacaatctgacgtccaaaaacctccccgtcatattttccctgaagcatttctcgctcctgattgggatggaactgtcagatgtgatcaagatcattcataatcggaattactactacagtttctatctgatcaagaagaaaaagggtggctatcgtaggatcgtcgccccgtttaaaaagttaaaactgatgcagtcttggattaaggaaaatatcctggataagctagaggtgtcacagcacgcaactggctttatcaagggacgatccattctgaataacgcgaaatctcacgagaacaacgatgtgatcttgaatctggacctttccaatttcttcgaaacaattgttgagagacgggtctacggtatcttcagttctctgggttacagcaaaaacttagcagttgagtttgcgaagatctgcactgcccagatgcctaaagagaagtatgatgagatagatcccgaaaagcaggagtattttaacaaactctacaggttgaaggagtctgtgctcgtgcaaggagcacccacttctccaacactaagcaaccttatttgtaggagattagatctgagactaagcatgctggccaacaagctcggacttatatacagtcgctatgctgacgacattacctttagcggcaaagcaagcaacctgccctccatcgaactgcttaagaagatcattgaggacgagaatttcgagattaactgggaaaaagtggggaaatacaaaaaggggcagcgacagatggtgacaggccttctcatcgacgggaaagttagggtaccaaaaagctttaagaaggagatctatagacatttgcacttctgtagtaagtatggcgctttctcacacttccaacgcatttgccctgacaaagcctaccgcaaagagtggttgctcgggaagatctactttgtatatgccatagaacctgaggaagctaagaaaatgctcaagatagccaacgccatcaattgggagatttga

SEQ ID NO: 9864 - RNA, 1089 nt, unidentified
  source 1..1089: mol_type = other RNA; note = synthetic construct
atggactttccccgcaatatctacatcgaagctgcaaaaaacgaaggccacacctccacattccttgagaatactctctcttatatagacaacctcagaagcaaaaacctgccagtcatcttcagtcttaagcacttcagcattcttattggcatggaactgtctgacgttattaagatcatccagaaccgtaacaactactactcctattacctgatcaaaaagaagaagggaggacttagaagaattgttgccccgtataaggacctaaaattcatgcaaagctggataaaggaaaatattctggacaacctggaggtgcaccagcttgcaacaggcttcatcaaaaagaagagcatcctgaacaatgcgaagaatcatgagaattccgatgtgattttgaatttggatctccgcaactttttcgaaacaatcaacgagaaaagggtatacgggatcttcagttctctgggatactccgccaatctgtgcgttgagtttgccaaaatctgtactgcccagattcctgaggacaaatatgagatcatgtcaagcgaagagcaggagtattttgaggaactgtacaacttaaaggagagtgtgctggtgcagggagctcctacgtctcccatcctgtcaaatctggtctgtagaaggttggatttgaggctgtccaagttagcaaacaagttagtggtgaattattcaaggtatgccgacgatatcaccttttcgggcgatcggaataatctgccaaacataggcattctcaagaagatcattgaagacgagaacctcaagataaattgggataaagtcggtaaatacaagcgaggtcaacgccagatcgtcaccggcctgctaattgatgggaaagtgcgggtacccaagaaatttaagaaggagatataccggcacttgcatttttgcagcaaatacggggcttatagtcatttcaagcgaatctgcccagaaaagtcatacgggaaagaatggctactcggtaaaatttatttcgtgtactccattgagcctgaggaggctaaaaaaatgctcaagatcgccaactctataaattgggaaatttga

SEQ ID NO: 9865 - RNA, 1089 nt, unidentified
  source 1..1089: mol_type = other RNA; note = synthetic construct
atgaattttccgaggaatacctatttggagttggcgaacacctcaggaaagtcgccagaattcatcgaatcaactctgaattatgccgataacctaatccactacaatctccccgtcattttcagcctcaagcacttttcacagattataggagttgactttcatcagctgctgaacgttatcgaaaatcggggacactactacagttactatttgatcaagaaacgaaagggcggatataggagaattattgctcctcacaagaacatacgctacctgcaagactggattaagatcaacatcttggataaggtgaagatccactcatccgctactggctttactaaagggaagtctatcctcgataatgcaaaatctcatctggattctgaagtacttctgaacatcgaccttgaaaactttttcgagagtattaccgagaagcggatttatggcgtgttcaagtggctcggttatcacaagaaccttgctatagagtttgccaaaatttgcacggtgaagatgcccgaagagaaattcgacaatctaaacgatatcagccaagaatactttttcgactactacctgttaaaagaagccgtcctcgtgcagggcgcacctacaagtccctctctgtccaacataatttgcattaagctggacaatcgttttaataagctcgcgaataaacgcgggatatcctattccaggtatgctgacgacatcacattcagcggtaacaaggatagtctccctagctacaacttagtgaagaagattatcgaaagcgagaatctgaaaattaactggacaaaagtgggccgatacaagaaggggcagaaacaggtggttaccggcttacttgtcaacgagaatatccgggtgcccaaaaaattcaaaaaggaggtcctgcgccatctgttcttctgtgaaaaatatggtgcagcctctcatttcaacagaatcgccccagataagtcctttagaaaagagtggctgattgggaaaatcctgtacatcaattccatcgagccagaggtagccaaaagcatgtttgagaggatcaagaaaataagctgggagatttga

SEQ ID NO: 9866 - RNA, 1089 nt, unidentified
  source 1..1089: mol_type = other RNA; note = synthetic construct
atgaattttccgcgtaatctctataaacaagaggccatccgcttgaaacgctcagcaccatttattacatccacgctgaactacatcgacaatcttattagctgcaacttaccagtgattttctccaggcaacatttggcgattctcaccggtatgagcaggtatgatatggataagatactagaaaaccgggagtactactataagtactacctgataaagaagaagcgggggggatttcggcggataattgctccttataagcagcttaaagagctgcagaggtggatcaaggaaaatatcattgaccaggttgacatcaaccagtttgcaactgggttcgttaaagacaagagcatttatcacaatgcgaaaatccacgaggacgccaacgtgatcctgaacattgacctcaagaatttctttgagagcatcacagaaaagcgggtgtacgggctattcaaatcgctgggttatgcccataacctcgccgtggatctggctaaaatttgcacatcacccatctgtgacgaaaagttagatgaactggacgagtcagctctgccttactttcaggacatacaaatgcagttcgaatctattctgatccaaggcagcccaagttctcccgccatctctaatctgatatgtcgcagacttgataggcgcttgtccaagcttgccaactctaccggcgctaattattcccgttacgcagatgacataaccttcagtggaagtgaggataacatccccaaagtcagtctcatcaaaagaatcattgagggcgaaggcttctcaattaactgggagaaggtgaagcgacacaaaaagggacagcgacagatcgtaactggactgttggtagataatgaaatcagagtccccaagaagtacaagaaagacatatataggcacctccacttctgcgagaaatggggttcccgatctcattttgaaaaaattaaccctgggaaggggtacggcaaacagtggctgctgggcagaatcatgtacgtgaatagcattgagcctaccgaggcaaagaaaatgatggccttagtcaagcagatcgattgggatagatga

SEQ ID NO: 9867 - RNA, 1053 nt, unidentified
  source 1..1053: mol_type = other RNA; note = synthetic construct
atggcttttttgcgctcattattcatcaacgaagcaaagaagaaaggtaggagcgaagagttcttgaagactacccttgaatacgctgattttctggacggcaaaggcctccccgttattttctctcctctccatttctccttgctggtgcagacagattatcattatctgaaacacctcataagtgtgaggtctgacttttacgccaactattatatcagaaaacggcgagggggcaagagaaagatctccgtgccctttgtccccctgcgcattgttcagaagtacattaacgactttatcctgaacaaggtggatgtacaccctaaggcgttcgcttttgtacgtaacaagtccatcgtcgataatgccaaagtgcatgtgaatcaagagtggatccttaacattgacattaaggacttcttcacgagtatcggagtagacaaggtgtataccacattccgctcattaggatacgtcgacaatctgtgctacgattttgcaaagctatgtactgccaaactggaagcaaagagcaagagagaattcctgccccagggggcccctacctcacctaatctctcgaacatcataatgaggaatgtggataggagattcgagaacttcagcattaaaaacgacatctgctacagcaggtacgccgatgacatcaccttctcagggaagaagtccaagctaccaaaaatctccttcctccgtaaggtttttaaagaggagggtttccaactgaatgagaagaaaacacagtattacggcccgaatagcaaccgacggtttgtcaccgggttgatagttaaagacgacgtgaaaatcccaaatcggtttatcaactctacttctcgccagatatatatgtgtgagaaacacggcgtggataaccacattgactggctgaagaaaaaccacggaattacaggcaattattactacgagtggctgatgggaaaaattgcctttattaatatggtggaaccaagtgaggctaagtttctttacgatcgggtcaatcggatagattggggtcttaaatga

SEQ ID NO: 9868 - RNA, 1095 nt, unidentified
  source 1..1095: mol_type = other RNA; note = synthetic construct
atgagctccccacgcaatctgataatacaagaggcagaggaaacacaccattcaaaggagtatctcaatgacatcctggcttactacgataagctttataatcagggactgcccgtgatctatagtatccatcacctctgcttacttatgggggatctggacaaaaaggtacccaagattattacttcccgaaacagcaactacgcaacctttaaaattaaaaagaggagcggcggcaagcgggaaatatccgccccgtttgtgcccttgagaaacatccagcaatggatatatcagaatatcctgagcaaggttcctattcaccctagtgcctacggctttgtgaagcacaagtcaatcatggacaacgccaaggtgcacgtgaatcaggatttcatactgaacattgacctgctcgatttcttcacctcaattccagaaaaacgcgtctatggaattttcaagtctctaggataccaccctaatctggcagtctacctcgccaaagcgtgtactaaaaaccttgtgaaagagatcgatatcgaggtcctggattggctgaatcaagccccgttccatcagaataattcagtactaccacagggcgctcccacatctcctcagctctccaacttagtttgtaggagattggacaaaaggctgaataactacgctgtcaagaacggttgcaaatatagccgatatgccgacgatatcactttctcgggtagcgaagttaacaacatcaagttgggtgtgatttttcggattatcaacgacgagcagtttaacgtgaatctggacaaagttaagttctttcacaagtcctctaatcgcaagatcatcacagggttaatcgtgtctgacaagattaggatcccaaaaaaattcaaacgggaaatcgctagacatctccactttacaaccatgaatggaacccagaaccacattcaacatctcagacagtaccataacttcgacaaggtcaattatcgtgattggctttacgggaaaatctgctacattaagatgattgagcccgattttgggctgaaattgatgacgaagttcaagagtatagactggggcatctga

SEQ ID NO: 9869 - RNA, 1095 nt, unidentified
  source 1..1095: mol_type = other RNA; note = synthetic construct
atgacattcaacaaagatttgttcatcaaggtttcccgcctgcggaaccattctaacgaatttataaaagagacggtggactatgcaaataatttgctggagaaagatcttccagtaatcttctctctgaaacactttagcctcctggctaacgtggattacgacgaacttgtgaagattattaacatcaggagtagcctgtacaagttctatcagataaagaagaagaacggaaaagggtttcgacaaatagtggttccctataacaacctacgctgtatacaggactacattaaaaccgagatcttggacaaagtccagatacatgataatgcaaccggctttgtgaaaggcaagagcatatacgataatgccaaaaaacactcaaaccagcaggaaatcctgaacattgatctcttcaagttcttcgacagtattacggagaggcggatctacggaatttttaagagcctaggctatgcgaaaaatctggcgctggattttgccaaactgaccactgttgccctcccagaagaatatctgagctctttcaagtttgatgaaagacgcttatacgacgagattgtccgaaagggggagtgcgtgttaccccagggtgcacctacatcccccatcctgtcaaatctcatcaccagaagactagatctgcggatgtctagcctcgctgacaagctcaaggtaaattattccaggtatgccgacgacttaactttctccggtaactatgggactgtgcctacattcacattgctggacaagatcatcaatgatgagggattccgtattaattggtccaaggctaaaatttcgaagaaaggcagacttcaaatggtcaccggccttactgtcagtaatgatatccacgttcacaggaaatttaagaaggaggtgaagaaacatatctacggatgcctgaactttggcgtcaataatcatctggcccacattcagaaggacgacattgggtactacaaagaatggttggccggtaagatctactttatttactcagtggagccggactatgctaagaaactccttgacgattacaacaagatcatctggcctctctga

SEQ ID NO: 9870 - RNA, 1095 nt, unidentified
  source 1..1095: mol_type = other RNA; note = synthetic construct
atgccttttagccaggatgaatatatagccaccgccaagtcccacggacacagccaggagtttatcgatataacagttgcctacgcccagaacctggtggctaaaaatctcccagtaatctttacaaccgaacatttgtcctcaattttggacatgcctattcttgagctcaagaccattattaaccaccgatcctccttctacaagttctatcagataaagaagagaaacggaaacggctttcgccaaatcgtgagcccatacaacaacttacgagtcatccagcagtacataaatgaggagatcctgtcgaaaatcccccttcacgagtctgcaactgggttcaccaaggggaagtctatcctcaataatgctgtgccccataaaaataagaaggccatcttgaacctcgacttgctcaagttttttgacagcatttgtgaaagaagagtgtatggtatcttcaagtctcttggctatgcgaaaaatctaagcattgacctggccaaactcactactgtggagctgccagaagattacctgaaaaccttcgaggaaaaggaactcaagtcatacagggaactcgtgcccaaggacagttgcgtcctgccccaaggcgcacctacgtcaccaacactgagtaatattatcctgcgccggctggattttaggctgtccaaacttgcagagaaattaaaggttgactatagccgttacgctgacgatattacattctcaggagatctggagaatctgccgaagattaagctgcttcggtctatcatacgcgatgaaggcctgaacataaactggaaaaaagtcgggatctacaaaaagggccggaagcagctggtgactggtctgacagttagtaatgacgtccatattcacagagatttcaaaaaggaggtgaaaaaacacatctatgcttgctgtaatttcggggtcgaaacgcatctaaggtttatggaattggagaatacccatctatacaaagagtggttactgggaaaaatctactatatcaacagtatcgagcctgagactgcgaaaaagatgatgaacgacttcaacaagattgtatggaccatttga

SEQ ID NO: 9871 - RNA, 1095 nt, unidentified
  source 1..1095: mol_type = other RNA; note = synthetic construct
atggccttcccgttcagtgagaagagcacttctgagcccgttaatcattctgatgagtttctgaccgacatcaacaattatggcgacaacctcaaaaaaaacaagctccctgtgatctataccctctaccacctgtgccagatggccgaagtccccgtgaaggaaattctccgtgtgtgtgagagcacacgcatcgagcactacaaacgcttcaaaatccgaaagaaaagaggggggtttcgggtgatacaaaccccttctgactccctgaagtacctgcagaggtggattctggttaatatcctgaatgagctggatagccacgaaaggtgctttggtttcgagaaaaaatcctccatattgaagaatgcttccgtacatcttaatcagcccgccatcttgaagctggatctgcaaaggttttacgactcgattaatgagaaacggatctatggcgttatccagagttttgggtaccacagcaatcttagtgtctacatggcaaaactgctgacagtcctacctaacgattattttttcgagtccttcaagaaaactgaaagcaatctgaagaacaagctacagaagctcaatcagggagtattatcccagggcgcccctacaagcccaaaaatttcaaacctcgtgtgccgcaggcttgaccagagaatgtatgagcttgctattaagaatgggctgaactactcacgatatgcagatgatattactttctctggcaacattgaagtcttgagaaaggtaaagaaagccgcgtactatatcattaacgacgaaaagttcttcgtgaattacggtaaaaccaagttcataaaggcaggcggaaaatttttggtgacaggcctgaacattgaaaatggttcagtgaccgtgccaaagaaaaaaaaaatggagatcgaacaccatttgtaccattgtcttaacaacggagtgatcaaccatttaaagacgtctaagatgccacaacggaattttaaggactggttactcggaaatattgcttttgtgcactcaatagagaaaaacgttgctaaggtctatttcgaacagtttaacaagatcaactggcccatctga

SEQ ID NO: 9872 - RNA, 1056 nt, unidentified
  source 1..1056: mol_type = other RNA; note = synthetic construct
atggaccacagccaggaatttctttccgatatcaaggaataccgggagagactcgatgagaaggggcttcccttggtgttttccatccaccacttatgcttactagccggtgtatcagtaaccgagattttagaaatctgtaaaagtgaccgcatacgctattataagcgcttcaaattgaagaagaagcgaggcggctttcgtgtcatacagacacccgaaaatacactcaagtttctgcacaggtggatcctcaagaacattctgaatcgggttgagtctcacgagaaatgtttcggcttcgacaaggagtcatctattgtcaagaacgcctcagcgcatctcggtcagccagccatcctgaaaatcgatctacaaaggttctatgattccatcaacgaaaagagaatctacggcgtgatccttagctttggttatcatccaaatctcgcagtctatatggctaaattgctgaccgtccggcctgacagttattttctatccacctttaagaagaaggaatcttcactgaaagacaaactggagatgctcaacgagggagttctgagccagggagcaccgacaagccctaaactggctaatttggtctgcagaaggctggacgagcgtttgaataaacttgcactgaagaatcagctgaattactctaggtacgctgacgacattacctttagtggaaacctggtgcagctcgagaaaatcaaaaagacggtgtacttcattgtgcgggatgaaaacttttacgtgaattactccaagactagattcattaagagcgggggaaactttttcgtaactggcctgagtatcaaagatggcgtcgtgaaggttcccgggaagaaaaagaaagagattgaacaccatctgtaccattgcctgaaaaatggagtgattaatcatctcaagagcgccggggtgtcgcaacgaaacttcaaagattggctgcttgggaacatagctttcgttcacgccgtggaaaaagacgtggccaaagattatttcgagcagttcaacaagattaactggcctatatga

SEQ ID NO: 9873 - RNA, 1098 nt, unidentified
  source 1..1098: mol_type = other RNA; note = synthetic construct
atgacctatcctttttatcatataaagcgcaatcaggaaccgattgtgcactcatccgagtttaaccaggacatcaagatttactcagatctgttggccaagaaagggctccctgtcatttatagcgttccacacttatgcctgcttgcgggggttcatatcgagcgtatcctgactattaccaaatctaaccgaatcgaatcgtacaagagatttaagctcaagaagaagagagggggctttcgggtgatacaaactccaaacgatgagcttaagtatctgcagcgctggatcctcaagaatatactagaaaaagtgcccagccatccctcttgtaagggcttcgacaaaaacactagtatcaaacacaacgctgacacacacctcaagtccgaagccctactgaaactggacctgctgcgattttacgactccatcaatgaaaggaggattttcggcattttcaagagcctgggctatcatcctaacctcgctgtttcattagcaaaaatatgtaccatcgtcccagatgagatgtttatcagtagttttcgcaagaaggagactgaacttaaggagtatattgtaagcaagaatgagggtatcttggcacaaggatctcccacgagtcccaaactttctaacctgatcaccatcaatttagataaaaggctggccggtttggctaacaagaatggactgaattacagccggtacgccgatgatctcaccttttccgggaacttcaaacagctgcaaaaggtaaagaaggtcgtgtatcggataatcagagaagaatctctgttccccaactacagcaaaacaaagttcattaaactcgggggaaagttcctggtcacaggacttaacattcagaataatgtgtccacagtgccaaaaaaaaagaaaaaggaaatcgagcaccacttgttccattgcattgaaaatggcgtggagaatcacatcaaaacggcaaagattaacaacaggaactttaaagactggttgtacggcaatatttgcttcgtgttctcaatcgaggagaaaaaaggtatccagtacttcaaggagtttgagaaaatacagtggcctatttga

SEQ ID NO: 9874 - RNA, 1083 nt, unidentified
  source 1..1083: mol_type = other RNA; note = synthetic construct
atgacatccccattaaataaaacattggagaatcacagtgcggagtatcagaatgaaattaaggcctatcagcacgtcctcgagaaaaatggtttgccagtcatttatagtctcaatcatctgtgcttaatggctggcgtgaatctggagcacattaagaactgttgtataagcaaccggcaggagaactacaagcgcttcaaactgaagaagaagagaggaggcttccgggtaatccagacaccccaggacgaactaaaatatctgcaaaggtggatcctcgagaacatcctgaacaaaaagaattctcacaatgcttgtaaggggtttgacccagacacctcgattaaactcaatgccgaaaaacacttaaagcaagagggtattctgaagatcgacctgcttagattctacgatagcatcaacgaaaagagggtctatgggctttttaagtccctgggatatcacccaaacttgtccgtcagcctcgcaaaaatctgcactatagtgcccgacaacacctttctgagttcttttaagcagaaagagcagcacctgaagcagaaaataaagcaggatggcttgggagtggttcctcaaggcgccccgtcatctcctaaaatttccaatctcatcacgatctctctggataaccggcttcagaatctggcagataagcataatctaaactacactcgatacgctgacgatcttactttttccggcaccattgaaacgctctcaaaaataaagaaagtggtgtaccgtatcattagggaagagaacctgtaccccaactacagcaagaccaagatccttaaacgcggtaacccttttttcgtaactggactaagcgtgcataatgacacagtgactgttcccaagaaaaaaaagctggaaatcgagcaccatctgcatcactgcattaaaaatggcgtgcaaaatcatctcacaacctcaaagatcaccaacagaaacttcaaggattggctgttggggaacatagccttcgttaatggggtcgagaaagaactgggaaagaaatacttcaagcagttcaacgagattcagtggcctatctga

SEQ ID NO: 9875 - RNA, 1095 nt, unidentified
  source 1..1095: mol_type = other RNA; note = synthetic construct
atgacaagtccccttgataatatctccgaggaaacgcctccaatccatagcgttgagtttctggctgatattatggcatacgacctcaaattgaactcaaagaatctgccagttatttactccttgcaacatctatgtctgctggctggagtcaacatcaagaatattactaaggtctgcaacagcaccagaatttctgagtacaagcgctttaagctgaggaaaaaaagagggggctttagagtaatccagacgccgactgacgagcttaagtatctccagaaatggatactggtgaatatcctggaaaaggtgccttcccactcttcgtgtaagggatttgacaaaacactgtccatcaagttgaatgcagaggtgcacttgaacaaagagagtattctcaaaatcgacttgctgaggttctatgattcaataaacgagaaacgcatctatggcgtctttaagtatataggataccaccctgatctagccgtgagcctagccaagatttgcaccatcgttcctgataacaagttcctctcttcctttaagaagaaggaattagacctgaagtgtatcatcataaagaaaacagaggggttacttccccagggggctccgtctagccccaaactctccaacctgattagcatctctctggataacaggctgagcaaactcgcgctcaaaaacgaactggggtacagtcgatatgcagacgatcttaccttttctggctcacttgaaaccctgaaaaaggtcaagagtacaatctatcgtatcgtggaagacgagaatctgttcgttaactacagcaagactaaactcctgatcaaaggaaatcccttcttcgtcaccggcctgtcggtaaataatgaccacgtgaccattccaaaaaaacggaaaatcgacatagagcatcacttatttcactgcattaagaacggtgtggaggcccatattacacggtgcgaaattaagaacaaaaatttcaaggactggcttttgggtaatattgccttcgtgtactcagtggaaaaggagctcggcgaaaagtacttcactgatttcaacaagattcagtggccaatatga

SEQ ID NO: 9876 - RNA, 1104 nt, unidentified
  source 1..1104: mol_type = other RNA; note = synthetic construct
atgacaattcctagcatcattaaaaacagcatccccaaagaaataccagctccgcccagccccgaatttttgaacgacatagctcaatacagagcacacttaattgaccagggactgcctgtgatttattccgtgcaccacctgggcctgatcagtaagttcaacatcaacaacatgattcacctctgtaacatgccccgggacggcttttacaagaggtttaagatgaagaagaagaaagggggttatcgcgtaattcagaccccctcaagcgagttgaagtacttgcagcggtggatcttaaaaaatatactcgagaatcgtccttcccatgaatgctgcaagggctttgacctcaaagcctcaataaagaataatgccgaatcccacctgaacaaagaggccattctgaagatcgatttccttagatttttcgactccatcaacgagaaacagatatatagaatcttcaagggcatgggataccatggaaacgtcgcttttgcactagctaaaatctgttccgtagtgccagataagatgtttttcaagtcgttcaagaagaacgaaaagcacctgaaaaaggttgtgctggaacacgatggagggatcctgccacaaggcgccccaacatcccctaaattgtctaatctattctgcctgtctctggatcatcgccttacacttctcgcaagcaaaaataacctgtcatacactaggtatgcggacgatttgacattttcaggtgattatgagactctgatctctgtgaagaaaaccatctacaaaatcatcaaggacgagaaactgttcgtcaatatgggcaaaactaagattcttaaacggggtagtctctttttcgtcaccggcctcagcgttaacaataaaaaggtgaccattcctaggaagaaaaagaaggatattgaacatcatctccaccattgtatcaaaaatggggttgagaatcacatgcagaagagtaatatcacgaatcgaaactttaaggactggttattcgggaacatagcctttgtctactctgtggagaaagagctgggggccgagtatttcaagattttcggatctattcagtggccgatttga

SEQ ID NO: 9877 - RNA, 1101 nt, unidentified
  source 1..1101: mol_type = other RNA; note = synthetic construct
atgacgtttccgtttaataagctgatccccatttctaatgaagagattgttcatagcgaagagttttatgaggagatccgcaaatacggctcattcttgagcgacaagaaactaccaataatttacagtttgccacacttatgtctcctctctggtgtgaacattaacaacattaagaaactctgcggctccaatcgtatagacgattacaaaaggtttaagctgaaaaagaggcggggaggattccgggttatacaaactcccaacgaagagttaaaatatctgcagagatggatcctgttcaatattctagacaagataactgtacacgatagctgcaccgggttcgaaaaagaaaagtctatcaaacagaacgctgagatacatcttaaaagtgaggccgtgttaaagatcgatctgatgaggttcttcgacacaatcaacgaaaagcgaatctatgggttgtttaagaatttcggctatcacaaaaacctcgccgtatcttttgctaagatatgcactatcgaacccaatgagaagttcatgaaatcgttcaaaaagaacgagatcggtatcaagaacttcatcattgaaaacgaagagggaattcttccccagggctcccctaccagccctaagctttcaaaccttgtcgcgtttaagctggataaaagactgtacggtctggcactcaagtccaaactgaattacagtcgttatgccgacgatatcaccttttccgggaatctggacaccttgaagaagatcaagagcattatttacaagatcatcaacgaggaacggttcttcgtgaatcacagcaagacaaagctcctgatcagaggcaatccatttttcgtgacaggactgtcagtgaacaacaattacgtcacaattcctaagaaacgcaaaatcgatatagagcatcatctctttcactgtcttgagaatggagttgaggagcacatgaagatctgtgagattaagaaacgcaactttaaagactggctgttggggaatattgcatttgtgtactccgtcgaaaaagaactgggccaaaaatatttcgactcgttcaataagatccagtggcctatttga

SEQ ID NO: 9878 - RNA, 1098 nt, unidentified
  source 1..1098: mol_type = other RNA; note = synthetic construct
atgacctattccctggacatctacaaaaaacgcgccgccgagctcaaacggagcgaggaatttattaaggaaacaagcgagtatatcgagctcatttctaaaaaggggtttcctcccattttcagtctgccccacctgtgcctgactagctccgtgtcaataaagaacaccatcactatctgtgaatcaaaccgaagagttttttacaaacgattcaagctgaagaagaaaaaaggtggatatcgcgttattcaaactccagtttccgagctgaaatttctacagaggtggatcctagacaacatacttgaaaagatcccttcccatcacagctgcaaaggcttcgacaaaaacacgagcattattaagaacgcagagtgtcatctgaatagtgagtgtatcctcaagatcgacttacttcggtttttcgattctatcaacgagaaaaggatttacgggattttcaagagtttgggctacaaggaaaatttatgcgtcagtttcgctaaaatctgcacgatcgaacacgaagagaagttctacgattcttttgaaaagtctgagcaaaaactcaagagctatcttaccaataagaaagagggagtcctgccccagggagcaccatcttctcctaaactggctaatctgatcctgcggaggctcgatcatcgtctcagcaagctttgtgagaagcggaaaataaactattcaagatacgcggatgatttgacattttcaggcaattccatcgaattgcagattatcaaaaagatcgtgtacaagatcatccacaacgagaatttattcgtaaacttctcgaagaccaagtttctcaagagaggtagtcccttttttgtcaccgggctgtccgtacacaattccgaggtgaaggtgattaggagaaaaaaaaaagaagtggagcaccatcttttccactgtctgaagaacggcgtgatgggacatttgacaaaggccaagattacaaatcgcaatttcaaagattggctgttcgggaacatatgctttatatactcagtcgaaccgattataggccaggagtatttcgacaagtttaataaggtggactggccaatttga

SEQ ID NO: 9879 - RNA, 1098 nt, unidentified
  source 1..1098: mol_type = other RNA; note = synthetic construct
atgacttttctgctcgataagtataaggaacatgcccttgcgagtaaccattcgaatgagttcatctccgagacaatccagtatgctaacttcctgtcttccaagaacctgcctgttctattcagtttaccacatttatgtctggctagcgcagtgagcataaaaaacaccctggagatatgcaactcatcccgcatagaatactacaagcgcttcaaaattaagaagcggaggggaggttaccggacgattcagacgccaacaaatgaactcaagtatctgcagaaatggatcctgaggaacattttggaaaaatttccgagtcataagagctgcactggctttgacaagctgtcatctatcaagaagaatgcagaaatacacctcaatgccgagtgcattctgaaaattgatctgttgcggttttttgacagtattaatgagaggagaatctacgggatctttaaatcattcgggtatcagaataacctgtgcgttagcctagcaaagatttgcacagtgaaacaaaatgaaaccttctacaacaccttcaagaagaatgaagacaatcttaagcaatacttgctttctaaagacgaggggatcttacctcagggagcccctacaagcccaaagctggccaaccttatcctgagaaatctggataaacggcttgaacgtttgtgttctaagtataatgtgaactactcccgatatgctgacgacctgaccttctccggcaaaaaggagaatttgctgtacctcaaaaagatcatctacaagatcatctactccgagaacttatttgtgaacattgggaagaccaaatttatagtccgaggcaacccctatctcgtaactggactctctgtacacaatgaggaagtgaaggtgattagacgcaaaaaaaaagagattgagcaccacctctatcactgtattaagaacggagtcattctccacctcatcaaaagcaatatcggcaacaggaattttaaagattggctgttcggcaatatctgttttgtctattcaatcgagcccaaggttggtcagaactacttcaacgatttcaacaaaatagagtggcccctatga

SEQ ID NO: 9880 - RNA, 1098 nt, unidentified
  source 1..1098: mol_type = other RNA; note = synthetic construct
atgacttttcccctagacaatttcattacaaaggcaaagttccaaagacactccgatgagttcatcgacgatgccaaaaactacatacagaaactcgagaaagctgagcttccgattctgtttagcattttccacttgtgcctttccgcgaaaattagtatcaagctgatcctagccctctgtcggtcagatcgcattcattactataaacggttcaaaattgccaagaagcgcggtggatataggatcattctcagccctaataacgaacttaaatacttgcagaagtggatccttattaatatcctggagaaaataccttcacataaaagctgtcagggtttcgacaagaacaagagcattaaaaagaacgctgaaatccatattgggtcggagtgcatcctgaagattgacctgctgcgtttttatgattccataaacgagaaacgagtgtacggcattttcaagagtttagggtaccataagaatctcgccgtatctatggctaagatctgcacggttgaggtgaaagagaattttctgaaggcatttacaaagaacgaatccgacctcaaaaataaaatatcctctcagaaggaaggcatcttaccccagggcgctccaagtagcccaaaactttctaatttgatcctgcggaggctggaccaaaggttacattgcctggccaaaaagaacgggattaactattctagatacgcagatgatctcaccttctcaggcaaggaggagaagctgaaagagttgaagaagatcatatacatgatcatcaaggacgaaaacttcttcataaactatggaaagaccaactttctgaaaagaggcaatcgcttttttgtcaccgggctcagcgttcacaatgagaaagtcactgtgccaaagaagtttaaaagtaacatcgaacaccacctgtatcactgcataaagaatggagtgatcgcccacacaaaaaagaacggtattgaaaaccgaaacttcaaagattggctgctgggatgtatctgttttatcaattcagtggaacccgagttgggcgaagacttctttgaaaagttcaacgagatcaattggcctatttga

SEQ ID NO: 9881 - RNA, 1098 nt, unidentified
  source 1..1098: mol_type = other RNA; note = synthetic construct
atgacataccccctcgatgtgtttttcgaatatgccaaagagatggaccattctccacagttcactgaggaagtggagaagtatgtcagctcactcctcaataggaatttacccgtgttcttttcgcttccacacctggctctggctgccagcttctctatcaaccacgttgagcgtatagtgaaatctaaccggcgcgactactataagagatttaaattggccaagcgccgaggtggtttccgaatcattcagacccctgaccaggaactaaagtatctgcaaaagtggatccttcttaatatactgaacaaggtcaattctcaccctgcatgcaaaggattcgaccccaaaagttcaatcattctgaacgcccaagaccacctgaataaggaggccattttgaagatcgacttgttaaggttcttcgattccatcaacgaaaaacggatttacggggtctttaaagggttgggctaccatccaaatctggctgtgtccctggcaaaactctgtacactgaaaccggacaacaccttttttattgcgttcaagaagaacgaactcatgctgaaagagcttatcaagaagagagatgagggcattcttccccagggtgcccctactagtccaaagctgagcaatctcatcgcacggaatctcgacattaggctcgataaactatgcaagaaacacggcatatcatatacaaggtacgctgatgacctgacctttagcggagaaaaaacgaagttgatgctgctgaagaaagtggtgtataaaatcgtgaagacggaaggcttctacataaactacgggaagactaagttcctgacccgcggcaacaaatattttgtcaccggattgtccgtacacaataagacactgaaggttccgagaaaaaaaaagctggatatcgagcatcatctccaccattgtctaaagaatggggttcacgtgcatatgattaaatccaagatcaagaaccggaactttaaagattggctgttaggcagtatctgctttgtctggagcgttgagcaggagcttggacagaagtacttcgatgaatacaacaagattgagtggcctgtatga

SEQ ID NO: 9882 - RNA, 1098 nt, unidentified
  source 1..1098: mol_type = other RNA; note = synthetic construct
atgacctttcccctggatgactttctgattaaggcccaggctgccgggcactccgacaaatttatagcagagacgacagcatatattcacaagctatctaaggacaatctcccagtacttttctcacttgagcattttgccctggaggcccaggtgaatatcggacgattaggtatgattgtccggtccgaccgtaccttttactataacaagttcaagctcaagaagcgcaatggaggcttcaggactatccagattcccaatagcgatctcaaatacttgcagaagtggctactgatcaatattctgaacaagataacctctaacgccgcgtgcaaaggctttgatcctggaacaagtattaaaggaaatgccgaaatccatctgaataagcaggctattctgaaaatagatttgctacgcttctacgattccataaatgaaaagagaatctacgggatctttaagtcaattggctatcacgctaaccttgccgtgtatttagcaaaagcttgcaccatcaagccagataacacgttcttcattgcgtttaaaaagaatgagctgctgctgaaacaggtgattgaaaaacgagatgacggcgtgttgccccaaggtgcacctacatctccaaagctgtcaaacctgatcgccagaagtcttgataagagacttcagggactctgtgacaagcacgacgttaattactcgaggtacgcagacgatttgacattcagcggtgacaaggctactttggccaaaatccagaagattatctatagcatcgtggagaaagaggggttcttcataaattacggtaagaccaaaatgctggttcggggcaacaaatatttcgtaactgggctgagcgtccacaacaacgctgtcaaggtgcctaagaagcaaaagaaagaaatcgaacaccatctgtatcactgtcttaagaacggagtgcatctccatatactcaaaagcggcctcaaaaaaaggaacttcaaagactggctcttagggagtatctgctttgttaactccattgagcaaaacctgggctctaaatacttcgagctgtttcagcggatcgaatggccgatctga

SEQ ID NO: 9883 - RNA, 1095 nt, unidentified
  source 1..1095: mol_type = other RNA; note = synthetic construct
atggattatccccttgacgatgtgcttgaggccgccagagacgagggccacacaacattgttcgtggcggatatagaagcatatgtaaaatacctcaccgcacggcaactgcccgtgatatacagcctggctcatctggccatctctatgggcatgaacatcgatatgatggtgaggttagcagagagcaatagaagggactattacaaaagattcaagctgcagaaaagggccggcggatttcgaaccattcagtcgcctgacaatccactgcgttacattcagaggtggatcctcgctaacattctcaataaaattcctagtcacccggcttgcctgggattcgacccaacaacctcaattctgaagaacgctacggtccacgtcaaccagaaggcgatcctcaagattgatctgttgagattctttgacagcatcaatgagaaacgcgtgtacggtatattcaagagtattggctttcaccccaacttgtctgtgtctctggccaaactttgcaccatcgttcatggcaaaaattttttttccgagtttcgcgagcatgaagtggaaatcagagataggattataagtgacagcactgggattctaccccagggggggccgacttctccaaagctagccaacctggtcgctcgccgcctcgattccagactccagggtctgtgtgagaaaaacggtctgaagtactcccggtatgccgacgatttaactttatcaggggacaaagatatcctcgaacgggtccggaaaaccgtgtacaagatcattcgagacgaaggattctttccaaatttgagcaagacgcggcttctgctgcgcggtcagaaattcatggttactgggctggacatatcaaacgaaaagccccgggtatcccgaaagaagaagaaagaaatcgagcatcacctttatcactgccagaagggagttcaacgtcacatccaaaaggcaaagatcacacagaggaattataaggattggctactgggcagcatttgtttcgtccatggaatcgaaccttcagtgggcaaattgtacttttccgagttcgctaagatcgagtggcctctctga

SEQ ID NO: 9884 - RNA, 1110 nt, unidentified
  source 1..1110: mol_type = other RNA; note = synthetic construct
atgaacggggattttcccaggaatgactttatacaccaagctaaagccgagggacactccaaggagttcattcaatctactaccgaatatgccgaaaagctggaaaacctaggcctgcctgtcctttattcgctcaagcacctggcactcaccttggatatcccctatattcagctgcgagagattatcaggaatcgtcggaagtactacggtttatttaagatctccaaaaaggtcaagggttatcgggagatcagatgcccccagaacacgctgaaggatattcagcactggattctgtattcaattctggcgaaagtcagaacgcacaagagttgcatcgggttcaaaaaaggggactccatcaaaaaaaatgccacaatacaccttggtcagccagctatactgaagctggacttatactgctttttcgacatggtaacagaaaagcaggtgtacaatgtattcaaaagcctaggctatcatccaaatctcgcagtcgatctggcaaaattgtgtacagtgcctgaaactggcgagtacgtgaagaagctgtatcaggacacctgtcccactaactttatataccatgataaccccttcttgccgcagggcgcgccatcaagtcctgctttggccaacctcgtcctctaccatctggatgtgcgacttaaagggcttgccgactttctgggtattcaatacacacggtatgctgatgacatcaccttctccggagaggatgatagactgcctaaaatcagcctgattgacaagatagtgagggacgaaggattctacctcaatcactctaagattttgttgcgcaaaaagggccagcagcaaaaagtgaccggcctaatcgtttcaggaactagcttacgcgttcctcggaagtacaagagagacatctggaaacatcttcttttcctgaagaaaaggggcgtgaaggagcatctcgaatacatcaagaacaagaacggatctaacaagagtgcctatcgcgattggctgctcgggaaaatcatgttcgttaaaagcattgagccgaccgtggggaataagatgctctttgagtttaatcagatcaaatggccattctacgactga

SEQ ID NO: 9885 - RNA, 1098 nt, unidentified
  source 1..1098: mol_type = other RNA; note = synthetic construct
atgaataacatctttccacgggatgcctttgagaaggtggccgaagctcgaggccattcaaaagagttcatcttatctgcactggaatacgcagacaagctgattaaaagtgagctgcccgtcttattttcaaccaagcatttttgcgaggtgattgatataacgtatggagaattgaagaagatcatcctgaatcgcacaaatcaatacggcaatttcaagatccgtaaaaagtccggtggttttcgggaaatccgctctccaaaggagaagctaaagaacattcagaaatggatactcaacaacattctgagcaaggtgagccctcatggcagctgcattggatttaaaaagggggactccattataaagaacgctttacctcacctcggtaaagaagccattttgaaattcgacctgttccatttcttcgacacagtcaccgagaagagggtgtattccatcttcaaatctctcggctatcacagtaacttggcggtagaccttgcaaagctttgtaccgttccgagcttcccaagccacaagaagaagtttctggagaacttcaacataagcgacaatcccttcccttttgattcgtttcttccacagggagcgcctacctcccccgcactagctaatctggtggctgggcacatggataaaagatttaaaggacttgccgattttctggggcttgactacagtagatacgccgatgatctgactttctcaggcaattacgaatgtttgccgaatgtcaacttcgtgaagaagattatcctggaagagggcttttatatcaacgaaagtaaaacgtgcctcaggcgggaaggacagcagcgcaaagtgactggaattatcgtctctggtgacacatccaaggttcccaaggcctacaaaaaagacatctggaagcacctgtacttcctcaataagtttggggtaaaaaaacacctccgaaacatcaaaaacaataagtcctcattccaggattggctgctggggaggataatgttcgttaggtctgtcgagttcgaggagggcaatagaatgctctacaaatataaccaagtgaattggcccttttatgagtga

SEQ ID NO: 9886 - RNA, 1134 nt, unidentified
  source 1..1134: mol_type = other RNA; note = synthetic construct
atgaactgcgagtttcctcgcaacgacttcgtgaaggaagcaataaaacaaggccacagccaggagtttattaatgaatgcctcctttatgctgataatctcacttataaaggtctgcctgtgatcttttctactaaacatttctgtgaactgctggatatttccttcaagcagttgaattacattctagataacagggaggatttctacggaacatttaacctgaggaagaaacgaggcgggtatagaaggatacagtatccgctgcccattctgaaaaatatccagagatggatcctcgattacattcttacgagggttccactgcattcatcctgtaagggcttccgccgtggggagagcattttgactaatgccactccccacctgacaaagaagacgattcttcatctggacatcgaagactacttcgggagcatcactcagaaacaggtctttaacgtgttcagtaaattgggctataataagtcgctcgcccacgacctctccaagctttgcaccatacacaaggttgagatcgagaagacaatagagacagactcattcctcgccacagaacaaaaggagtttctggagagcatcaaacggtacagccagaaaaagattgacttcatcttaccccaaggtgctcctacctctcctacccttgccaacttggtcagcgtaaagttagacaaacggctcttttcactggcagaaaagctgggcgtaacctacacccggtacgctgatgacctaacattttccaccgataccgagatactgccaagactggccattatcaagaaaattctgagtgaggaaggtttccagctgaacaaatctaaaacagcaacccggaagcaggggcagcgccagatcgtgaccggattgctcgtgagtggcgaaaaggccaaggtgcccaaaaaatataaacaggacatcctgaagcacttattttacgctgataagtatggaccaaaggaccattctatggaaatccagaaaaatccagcgactttccaagaatggctgcttgggcgaattatgtttgtcagatccatcgagctagaaacgggaaacatgatgctcgagaagtacaatcaaatcgagtggggattcaacttgaagtga

SEQ ID NO: 9887 - RNA, 1053 nt, unidentified
  source 1..1053: mol_type = other RNA; note = synthetic construct
atggacatccgtttccctagagatgcttttgttcaggaggcccagaatcaagggcggtcgcagctgttcatcgaggaatgcctcttgtacgcagatggtcttcaatacaagaacctcccggtgatcttctcaaccaagcatctgtccctgttgttagaattggagtacaaggagctgaacaacattatcctaaattcctaccggtattataagaccttctccatcgccaaaaaacgcggcggcgaaaggcaaattaagtgccctaaccacattctgaagagtcttcagcgatggattctcaataacatcctcataaatgtgcgggtcagttctgcttgcaaaggcttccgtaaaggagagtcaatcatcacaaatgcagatacacacctgggttgtcaggccattcttagagtggatctggagaacttctttgatacgattactgagaaccaggtgagaaagtctttcattaggataggctactcaactaacctgagcgtagacctggccaagctgtgtgtcactagccgattggacagcactaccggggaatatgtcagttctctgccacaaggcgctcccacctcccctatgctcgcgaatatagtggcctatcgcctcgacaaaaggctgagtagcctggccaataagcttggagtgcgatacagccgctatgccgacgacttagttttttcaggtaatactacccagctgcccaagatagaactcttgaagaagatcattacagaagaagggctgaagatcaataaccagaaaacgctgctaaggcgggaaggccagaagagaatggttacaggaatcatcgtgtccggggacaaactccgcgtacccaaaaagtacaagaaggatatttggaaacaccttcattatgctcttctctatgggcccgatggacatacctctagaatcaaagtcaacccagcgacatttaaagagtggctattaggacggataatgtacgtcaggagcgtggagaaagacgcagcagaggacatgctgaaagtgtttaacgagatttcttggggcttttga

SEQ ID NO: 9888 - RNA, 1035 nt, unidentified
  source 1..1035: mol_type = other RNA; note = synthetic construct
atgaatttcccgcgcaatgactttgagaagtacgcccgtgatgagggaaaatcccagcaatttatagatgcgactctgtcatacgtagataaattgaatagcatgcagctgcccgtcatattcagcattaagcatctggccctcacactcgactacccctacaataaaatattggacatcgcaaaccactctgaaaagtactacaagagtttcaagatacggaaaaaacggaatccgcaacagttcagaagaatcctggcacccaacccagacctgaaagtgattcaacggtggatttacaataacatcctgaagaacatcgagcccgatgagtccagcgtgggcttttcccaggggtgtagtattcagaaggccgcagctatgcacactaatcaagaggtggtgctgcgagttgacctgagtaactttttcgagaacatcacccagaagcaggtttactatgtgttcaggaaccttggttaccacaagaacctcgccgtcgaccttgctaagttgacaacgatttataccaaggaaggttcatatttaccacagggcgcacccacatcacctgcgttaagcaatcttgtcgtgagaaaaatggacaagaggctcaggtgcctgtctgaaaaactcggagtgaactatacccgctatgccgatgacctaataatttctggcaataagaaggacatccctcggttgggcctaattaaacagatcatcaaggaggaaggtttcaagctgaactccgagaaaaccgccatccagcgcgctggcaataaacagcttgttttagggctcactgtaaccaacggagtccatgtgcctaaagacttcaagaaagaaatttggacacatctgaggtattgcaaaaaatatgggccaatcgatcacctgcgatacattaataagtcggataagggggcctttaaagattggctctttggcaagatcagctttgttaagtctgtcgaacctgctgtgggagaaaagatgatgaatctgttcaacgagatcaactggccactgtga

SEQ ID NO: 9889 - RNA, 1035 nt, unidentified
  source 1..1035: mol_type = other RNA; note = synthetic construct
atgaactttcctagggacgtctttgaacaacaggcacgcaaggagggaaagtcagacagctatataaagtccgccttggtttatatcgatcgactgaacagcatggagatacccgtgatatttagtctgaagcacctcgcactgatactggacttcccttataagaagatcagcgacatggccaacaaccctaatacatactactcgacgtttaagatccgcaaaaagagaggaggcttccgggagattcaagcccctcagcccgaaatgaaaattattcagaagtggatctaccagaccattctcaaagaaattcggactgattcttcttgcatgggatattcaaaagggagctccattagggaaaacgccaatgtacacaagaaccaggaagtaatccttagagtggacatttacaagttcttcgagaatatctctttcaagcagatctactatgtgtttaaaagtctaggttacaccaagtacgtggctatcgatctagcgaaactcaccaccgtcaaaagcgaaggctctaatgtgaggtatctgccacagggagcaccgacatccccagctctgtccaatcttgttgtgcgaaaactggacaaacgcctcagaagtttatcaaataagttgcaggtgaactatacacgttacgcagatgatctgatttttagtggcgagaaaggttgtcttccgcagataggcctcgttaccaaaattattaaagacgagggcttcaaaatcaaccccaataaaactgccatccaaaaaaaggggaaccggcaaatcgtgctgggcctgtccgtcactaacggagtccacatcccaaagaaatacaagaaggagatatggacacatcttaagtattgcaaaaagtttggtcccattaagcatttggagaacattggggagtctaataaggcggcctacaaggattggttattcgggaagatctgttacgtgaaaagcatcgaacatgaggtcgggaaaaagatgatggctgctttcaatgacatctcatggccactgtga

SEQ ID NO: 9890 - RNA, 1041 nt, unidentified
  source 1..1041: mol_type = other RNA; note = synthetic construct
atgtactttcatcgagatattttcgaggaaaaagcacgagagcagggcaagtcaaacgcctttattgaatcttctctcgcatatgtcgataagctaaattctatgcagttgcctgtgatatttagtctgaagcacctggctgtgacgttagatatatcctacaagaagatcagccacatgattaagttcccaaacgagtactataacaccttccgtttgcggaagaagagcggcggagttagaatcatccaggctccaaagcccgagctgaaaattattcagaaatggatctacgttcacatcctgaaaaacatcaaagtggacagctcatgtaccgggttcacggtaggctcctccacaagtaaagtcgcccgcatgcatcagaataaggaggttgtcctaaaactcgacctggaaaacttttacgacaatatcgatcgcaaccaggtatactatgtgtttaagagcattggctacaaggaccatgtggcgatcgacctcgccaaacttactactgttaatcccataaagacacagaggaacgtttttattcttccccaaggagccccttccagcccgtctttgtcgaacctggtcagcagaaacctggacaggagacttcggttgctgtcagagaaagtgaacgtcatctatacccgctatgcagatgatctgacattctccggggagaagaaaaatatgccctccttaaaactggtgacaaagattattagcgaagaggggtttcaagtgaataataagaagacctcataccagaagaaaggcaataagcagatcgtgcttggactcaccgtgtctaacgatgtacatgtccctaagaaattcaaaagggaaatctggactcacataaaatactgcaagaaatatggtcctgtgaaacacctgataaatatcaatcaagctaaccgggccagttataaggactggctgtatggaaggatttgctacgtgaagagtgtcgaactcaaagtgggtgagaagatgatggaggaattcaatctcatcgactggccattctga

SEQ ID NO: 9891 - RNA, 948 nt, unidentified
  source 1..948: mol_type = other RNA; note = synthetic construct
atggctggcgtcgatcgcactcggctgctcaggatcacagagcagagggaccggaattatcaccggttcttgttggaaaaaagggctggaggattcagagagatccttacccccaagccgctcctgaagcggatccagagactgatctacgtgaatattctggctaccgtggaattagaccagtcctgcctgggattccgcgaaggccgatctatcaaagacaatgcccagatccatgccaaccaggatgcggtgatgaaggtggatctatatcggtttttcgacaccatttccgaaaagagagtttacggcatgtttaaaagcctgggctaccacactaatcttagtgttgattttgccaagctcaccaccctgcacccatcagagcaatattacctggagatcatgaacgacaagaatcttccagatcattaccctgatcctcattttgcccgcttaccccagggggcacctacaagtccagtgattagcaacataattgctaggaatcttgacttccgactgaggaagctagccgagaaactgggggtcaactattctagatacgcagacgatattaccttcagtggggtgcttactaagctccccaaaatacacttgataaacgacattgtccgaagcgaaggcttctttataaacggatcaaagatctcactccgcaagaaaggaacaaaacagttagtaactggcctcacggtttcgaacggtgtgcatgtacccaaaaagtataaacaagagacgtggaggcacctgtactattccaagaaatacggtgccaaggatcatctgcgtcgtatcggcaaaacaggtattagcgggttcgaggaatggctgctcggtcgcatccactttattagatccatcgagcctgaagtcggggacgcaatgctggagaagtatgaggtgattgactggtctttgatctga

SEQ ID NO: 9892 - RNA, 1101 nt, unidentified
  source 1..1101: mol_type = other RNA; note = synthetic construct
atgtccacaaacatcccacgtgacgaatttgtcttagtcagcaaggaatctggacactccaaagagttcatttcaaaggcactgtcgtacattaatacgctggagaataagaacatgccagtgatctttagtatcaagcacctttcacagattctcaacctcaactattcgttggttctcgatattattaagacccgggaacaatattaccgggggtttaaactcaaaaaacgaagaggggggtttcgatatgtccaaagccccaacagcaacttgagagagatccagacttggatacacaataatatcctgctgaacgtgcccattcacgaaaattgcttctctttcatcaaacagaagtctatacgggataatgcctccctgcacgctaatgccgaggccattcttaagctggacctgtacagatactttgagtctatcgatcagcgcaaaatctacaaagtcttcctggactttggctacacaaaaaacgtggccatcgacctgagcaagctgaccacaattctgcccaatcagtattacgaggacataatatcaaaggataagctaactcctgagaagtttgtgttgtcaaagcacggtttcctgcctcagggaagcccgaccagccctatcctgtccaatatcgtggctgaaaaattagacattaggctaaacggtttagctaaggcgttgaatgtaaaatactccagatacgcagacgatatcaccttctctggcaaaagggataagctcccaaaagtaagcttcgtggaaaagattctgaatgaagaggggttctatctaaacaacaagaaaacaaagctccgggtgaaaggacagaggcaaattgtgactggactgtctattagtaatggtgttcatatccctaagcattataagcgcaaaataaggcagcatctttattactgcaaggttcttggccccaaacgccatctccagaacattaacctggaaaagagtaacttcaaagactggttgtacggcagtatctgttatatccgttccatagagaagaacctcggcgataaaatgctggaggattttgacaagatcaattggcttttctactatgactga

SEQ ID NO: 9893 - RNA, 1209 nt, unidentified
  source 1..1209: mol_type = other RNA; note = synthetic construct
atgacgctgccgctgaagcacatactgaagaacatcaaattcaacattcaggagagggtaacagccacaatgagctttccatttaatcagtttgctttggaggcaaaggaacagaataaaagtcaggagtttatcgatgcatgtctggcctacgcgagcaacttatccgagcagggctatcccgtgaccttctctattgaacaccttgccatgcaaatcggtgtgcaatcagattatttgcggaatctcatcggcgatggcaaacgagacatcacttacgattacgaacacaaatacaaacggtacaactactttaagctgaagaagcgggatgggaactttcgtgaaatcatgtcgcccgcgaaagacctcaaattcattcaaaaatggatcctcgtgaatattctgtctaagtacagactggccgagtcttgcaagggatttcggaagagaatttcaatctacgacaacgcaaaggtgcacgagaattccgagatcatcctgaaggtcgaccttctcaagttttatgacaccattaccgaaaagcgcgtctacggactattcaaatctcttggctatgcaactaacttatctttcagcttggccaagattaccactgccaaacacagaaaaaattattggagggatttcaacaacagctccaaagaaattctatctgagttggtacagactaagcctgctatcctgcctcaggggagtccaacatcccctatgataagcaatatcctggctacaaagatggactatcgatttgagggaatggccaaaaaacagaatttcagatattcgaggtacgccgacgacctgaccttctccattacgaaagagggaagcttaccctcccttaacgtgatatcaaagattatcacccaggagggttttttcatcaatcacaagaagactcagtatctcaaaaagggttgcaagcagtatgttactggcctgacaaccaccaatgggataaacgttaataagaaataccgcaagcaaattagtgagcatatttacttttgccgcaagtacggcgttaagtcacatctcgctaggcgtaagaaagatttcccaaactcaaattcccttagcttccataactggttgtatgggcatctgtgtttcatcaatagcgtcaacagtaaagctagtaaaacactgctcgaagaattcaataagataaactggtccgtgtga

SEQ ID NO: 9894 - RNA, 1137 nt, unidentified
  source 1..1137: mol_type = other RNA; note = synthetic construct
atgtcctttagtttcaaacagttcgaaatagaagccaagaagcaagagaaatcgcaagaatttatagacgcatgcttggtgtacgccaaaaaactgacccagaatgactatccggttacttttagcttagaacacctggcgatgcaaattggtatacagtctgattacttacggaacctgatcggggatgacaaaaatgggattacaaacaactacgagcacaaatataagcgatacaactacttcaagcttaagaagaggcacggaggttttcgagagattatgagccccgctaaggacttgaagtttattcagaaatggatcctggtgaacatcctctccaaatacaagctcgccgattcttgtaaagggttccgtaagggaatctctattttccacaatgcaaatgtccacgagaattcagaattgatccttaaagttgacctgctaaagttctacgatactatcactgaaaagagggtgtacggcgtattcaagagcttggggtatgcgaagaatctcagttatagccttgccaaaatcaccaccgcaaaacatcgggacaaatactggcgcaatttcgatgatgacagcaaggagcggctcaaggaactggtaatggctaaacctccaattttaccacagggcgctcccacttcacctatgctatcaaatatcctggccaccaagatggactatagatttgaggcacttagtaagacacagaattgtagatacagcaggtatgccgatgatatgactttttccatcaccaaagagggaaaactgcccagtctgaaactcattacgaagataatatctgacgagggctttttcatcaacgacaaaaagacacgctatatgaaaaaagggtgtaagcagtacgtcacaggactgaccaccacaaacggtacgaacgtgtccaagaaatatagaaaggaaatctccgagcatatctattattgccgcaagcacggcgtggacggacatctggagaggagagtcgatttctcaggctacaacaacattaagtttcataattggctgtacggccatctgtgctttattaagagcgtgaatgaggaggcttctaaaaagatgctcgattccttcaacaagattaactggtatatctga

SEQ ID NO: 9895 - RNA, 1140 nt, unidentified
  source 1..1140: mol_type = other RNA; note = synthetic construct
atgtcatttccattcaaacagttcgaggaacaggcgagaaaacaagagaagtcccaggagtacatcgatttttgtcttgcctacgctcgtaaacttagcgaaaacgggtatcccgtcactttttctctagaacacttggccatgcagattggagtccagtctgactaccttcgaaacctgattggagatgacaagaataacatcgaatacaactatgagctcaaatataagcggtacaactacttcaaactgaagaagcgagacggcggtttccgcgaaatcatggcacctgcaaaagacctgaagttcattcaaaagtggattctcgtgaatattctgagtaagttcaagctggccgattcttgtaaaggttttcgccagggcgttagtatctacgacaatgccaaggtgcacgaaaatagcgagattatcttaaaggtggacctcctgaagttttacgataccatcaccgaaaaacgggcctatcgggcattcaggctgattggctatgtgaagaacctgagctatagcttagctaagattaccaccgcgaagcatcgggactcttattggagaaatttcgacgatatctccaaagagacactgaaagagttaatcattgtgaaacctcctattttgccgcagggggctcccacatcacccatgataagtaacatcttggctactaagatggattatcgtttcgatgccctcgctaaaaaacaaaactgcaggtatagcaggtacgcagatgaccttacattttccatcactaaggagggaaaattgccaagtctgaaactgatcacgaagattatcactgacgaaggctttttcataaacgacaaaaaaacgcgctttatgaaaaagggctgcaagcagtacgtaaccgggctaacaacaaccaacggtatcaatgtatccaaaaagtacagaaaggagatatacgagcatatctactattgcaggaagtacggggtttcgtctcacctcagcaaaagagaggaagagttctcaggctttaattccataaagttccacaattggctgtatggacatctgtgtttcataaagtccgtgaataaagccgcctcaaacaagatgctcgaggattttaataagatcgattggtttgtctga

SEQ ID NO: 9896 - RNA, 1140 nt, unidentified
  source 1..1140: mol_type = other RNA; note = synthetic construct
atgtcctttccttttgaacagtttattatccaggctcgagagcagaacaagtcacttgaatttatcgacgcgtgcctaagctatgggaaagccctcgaagaaaaggagctccccgtgattttcagcctggagcatctagcaattcagatagggatccagtccgtgtatctgcgcaatctcatcggagacggaaagtgggacataaattatgaatacgagcacaagtacaagcggtacaactacttcaaattgaaaaaacgtgacgggaaatttagggaaataatggcacccgctaaagatcttaagtacattcagaagtggatccttgtgaatatactcagtaaatacgtgctggccgacagctgtaaaggcttcaggaagggcatttctatcaaggataacgcgaaagtgcacgaaaatagtgaggttatcctgaaggtagatctgttaaagttctatgacactatcaccgagaagcgcgtgtgttctgtttttaaaagcttaggctacgtgtcaaacctggcctactcctttgcaaaaataactacggcaaaacatagagagtcctactggaaagactttgatgagaatagcaaggagattttgaacgagttggtcgacaataaacctccaatcttgccacaaggcgcccctacatctccggccatctcaaacatcctggccactaagatggattacagattcgaagccctgagcaggaaacttaattttagatactcccggtatgctgatgatctgacattctcgattaagaacggcggcaaattaccatctctcaagctcattaccactatcatatccgacgagggattcttcattaactcaaagaagacgaagtatatgaagcgaggttgtaaacaatatgtaaccgggctgacaacctcgaatggtaccaacgtcagtaaagaatatcgcaaaaccattacagaacacatctactattgccggaaatatggagttaactctcacctggagagaaggaaggaagagtttcccaagtacaataatatcaagttccacaactggctgtatggtcatatgtgcttcattaagagtattaacgagaaggctagcaagaagatgctggaggatttcaataaaatcaactggtacgtctga

SEQ ID NO: 9897 - RNA, 1140 nt, unidentified
  source 1..1140: mol_type = other RNA; note = synthetic construct
atgtcctttccattcgaacaattcattattgagtctaaggagcagaataaatcgcaggagtttattgatgcatgtctgacatacggaaagaaattggatgacaaggagtttcccgtgattttttcccttgagcatttagccatgcacatggccatccagtccgactacctgagaattctgataggcgacgacaaaaaaaacctagtgtatggttccgaatataagtatgagcgatacaactacttcaaattaaagaagcgagatggaaaattcagggaaataatgagccccagcaaggacctgaaatatatccagaagtggattctagtcaacatcgtaagtaagtatgtgctcgctgacagttgtaaaggctttaggaagaatatcttcattgcccacaatgccaaggtccacgaaaatagcgaggtgattctgaaagtggacctcttgaagttctacgacaccatcacagagaaacgcgtctatggactctttaaatcactgggctacataaataatctggcttattctttcgcgaaaattactactgccaaacatagagacagttattggaacgatttcgatgaaaattccaaggaaatcctcaaggagttaattgagaacaagcctcctatactccctcagggggctcccaccagtccaatgatatcaaacattcttgccaccaaaatggattatcggtttgaggcactggctcgcaagctgaactgcaactacagcagatacgcagatgaccttaccttttctattaaacgtgagggtaaattgccatctctcaagctgatcactaaaatcatctcaaacgaaggcttcttcatcaatgataagaaaaccaagtacatgaagaaggggtgtaaacaatatgttacagggctgaccacgactaacgggacaaatgttagcaagggataccggaaaacaattacggaacatatatactactgcaggaagtacggcgtgaattctcacttggaaaagcggatcaaagactttccgaagtataacaacatcaaattccacaattggctgtacggccatatgtgctttatcaagagcatcaatgagaacgcgtcaaagaagatgcttgaagatttcaacaagatcaattggtacatctga

SEQ ID NO: 9898 - RNA, 1140 nt, unidentified
  source 1..1140: mol_type = other RNA; note = synthetic construct
atgtcctttccctttaaagagttcactgaaaaagccaaagaagaaaaccgaagtcaggaattcattaatgcctgtatacagtacgctaagaagctgtcatctaaaaagctcccagtgattttctccctagagcacctagcaatgttaatgggggtggagtctaactatttgcgtacgctcatcgacgacggaaaaaacgacttcgtttattcgtacgaacacaagtacaaaaggtacaactactttaagcttaagaagcgcgatggaggctttagagagatcatgagtcctgccaaggacctgaaatttatacagaaatggatcctggtgaatattctcaataagtataagcttcgcaactcctgtaaaggtttccggaaggaaataagcatctaccataatgctgaagtgcaccagaactctgaaactatcttgaaggtagatctcctgaagttctatgatacgatcaccgagaagcgggtttatggtttgtttaagtctttgggctatgcgaataacctggcctatagttttgcagagctcaccactgcaaaacacagagactactattggcgaagtttcgacgcaaattccaaaaaagtcctgaatactctgtacaatcatagaccacccatcctgcctcaaggcgccccgacaagccccatgatttctaatattctggccgccaaaatggacgtacggttcgagaaattagctgagaaactgaactgcaactattccagatacgcggatgatctgacatttagcatcaaaaacgagggcaaactgcctagccttaagctcatctataagataatcagcgacgagggattctttgtcaacgagaaaaaaaccaagtacatgaagaaggggtgcaaacaatacgtgaccggtctgacaaccacaaacggagtcaacgtgagcaaagcttatcgcaagtcaattaaggaacacatatactactcaaggaagttaggggtgaagaagcatcttaaaaataggaacgaagagttcggcggctacaataatattcagtttcacaattggctgcttgggcatctctgcttcatcaagtcagttaatcaggaggcctacaagaagatgattaaggatttcaacaagatcaactggtatatttga

SEQ ID NO: 9899 - RNA, 1140 nt, unidentified
  source 1..1140: mol_type = other RNA; note = synthetic construct
atgtccttcccgtttgaaaagtttatcatcaaggcacgcgagcacaataagtctgaggagttcattaacgcttgcttggtctacggaaaaaacttagtcgagaagaagttgcctgtaattttctccctggaacatctgtctatccagattggggtcaagagtgactaccttagaaatttggtgggcgacggaaaaaacgacatcatttacaactacgaacacaaatacaagcggtataattacttcaagctgaagaaacggaacggcacctttagagaaataatggccccagctaaagatctcaagtacatccagaagtggatcctcgtgaacgtgcttgaaaattatcccctggccgagtcctgtaaaggctttcggaagaaagtcagcatatatgataatgctaaggtgcacgaaaacgcggaggtgatcctcaaaatcgacctcttaaaattctacgacaccatcaccgaacgaagggtttatggaatttttaaaagcatgggttacgtggagaatctggcatttactctggccaagataaccacagcgagacaccgggagtcatattggattgattttgaccgtaatagccaagagatactatccaagctgcttaaggaaaagcccagcattttaccacagggcgcccctactagccccatgcttgccaacatcattgctaccaaattggattaccgctttgaagcactagcaaggaagattaacttcaactacagtaggtacgccgacgatctgactttttccatacaaaagaaaggtaaactcccccctctgaagctcattaataaaatcatctcagaggaggggtttttcgtgaatacagagaaaacgaagtatatgaagaagggatcaaaacagtatgtaactggcctgaccacaacgaatggggtgaacgtgtcaaaaaaatacagaaaggaaatctctgagcatattttctattgcaggaaatatggtgtcgtttcgcatctgaagcgacgcgagaatgaattcccaaaatataacagcatgaacttccacgattggctctatgggcatctgtgtttcattaagagtatcaatgagacagcctctaagaacatgctggaggacttcaacaaaatcaattggtttgtttga

SEQ ID NO: 9900 - RNA, 1146 nt, unidentified
  source 1..1146: mol_type = other RNA; note = synthetic construct
atgagcttcccctttaaggaatttatctcaaaagctaaggaggagaacagatctcaggaattcattgaggccaccatcagctatgcggacaagctcgataagaataattttccggtcatcttttctgtcgagcatttagctatgctgatggggatacaatcatcctattttcgtcacctgatcggtgaacccaaaaaacatcactaccaggacgaacctcataagatcttccgctacaactattttaagctcaagaaaaagcgggagggctaccgcgaaataatgagtccatcgaaagacctcaaattcatacaaaaatggatcctcgtgaacatcctcgagaagaaaaacctacagaattcctgcaagggcttcaggaagggcatcagcatcaaagacaacgccatgccccacgagaacagcgacctcattctgaagatcgacctgcttaagttttacgatacgatcaccgaaaatagagtgttcggtgtgtttgcggacatgggctataggaagaacctggcagtgtctctagctaaaataaccacagcaccccacagattccagtattggaagaatattccaaaggccgagctggatatcatgggctataaacacaacaacttcccaagtattctgcctcagggcgcccctacatcaccgatgttggccaacattgttgcatccaagctggatttgcgctttgaaaaattgtcagagaagatgggattcaattacactcggtacgctgatgatctgactttcagtattaaagggaatcagcggctgccaaacttgaagctgattcgaaagattatttccgacgagaactttttcatcaacgagactaaggtcaaatatcttcggaaggggggaaaacaatacgttacaggattaaccaccgcaaatggaatcaatgtgtctaagaagtacaggcaggagattgattcccacatatactactgtagaaaatacggggtgaaagggcaccttagctggataggtgaagaaaatgagaaaagccagcgagtattaccctttcatgattggctgtatggacatatctgcttcatcaagtctattaatcctaaagccgccgaaaaactgctcaaggacttttccaggattgattggcttttcgactga

SEQ ID NO: 9901 - RNA, 1152 nt, unidentified
  source 1..1152: mol_type = other RNA; note = synthetic construct
atgaaaccgtttccttttgagcagtttattacgaacgcaataaaagaggatagaagtaacgacttcattgaggaatgcctcagatatgcatacaaactggaagtcaagaactatccagtgcttttttccattcaacacctcgctatggcaatgggcgtcaagtcccagtttctgctggcgttaattggagaagataaacgcaacattttcgattatctgactgacaatagagctaccattaagcactacaatcacttcttcatcaaaaagaagaggggcaactatagggaaatcatggccccacacaaagatttgaagtacatccaaaagtggcttctgttcaatattttgagcaagttccccctggctgagtcctgtaagggtttccggtccgggatttctatctacgataatgcctctcttcacaacaatgcgaaaataatccttaaagtggatctcctcaagttctacgatacgattacagagaagcgcgtgtacggtgtgttcgccaaaatggggtacgctaagaatctagcctattctctggcaaaactgtgtactgccaagcaccatgagaaatattggtcggactttaacttaaatgacaaggaggtcctgagctactacctggagtttaagcccccaatcttaccccagggagcccctagcagtcctacactagctaatatagtggccacaaatatggacaaaaggtttgaagggctgtcaaaaaagttgaagtttagctacagtcgatatgccgatgatctgactttctcaatcaaagacatcgggacactcccttctttggacttgatccgaaagatcataaacgaggagaacttctatatcaatgaagacaagatcacctatatgcatagaggctccaaacagtatgtaactggcctcaccgtaaccaatggagttcacaccagcaagaaatatcgtaagaaaattgctcggcatatttacttttgcaggcggtacggcgttgaaaaccatctgatcaagaacatcgatcatttcccaaattacaacatcctcaagtttcacgactggctatacggacatatctgcttcattaattcagtggacaaggaagcatcaaagcgcctgctgaacgactttaacaaaataatatggcccctttga

SEQ ID NO: 9902 - RNA, 1149 nt, unidentified
  source 1..1149: mol_type = other RNA; note = synthetic construct
atgaaatccttcccatttgagcagttcatcaagaacgccaattcagaaggtcggactcaaaatttcatcgaggcgtgcgtgcagtacgctcacaatctagaagatagggactatcccgtgttttttagtattcagcatctggcaatggccatcggaattcagagcgactttttgaccgctttaattggcgagaacgaaaacagtcggtatttgtacgaaaacgagggtgtcaaactcaagaagtacaaccacttcttcataaaaaagaagcgagggagttatagggagatcatggccccccataaagacttgaaatacatccaaaaatggctgctttttaacatcctcagcaaggttccattggctgaatcttgcaagggctttcgctctggcattagcatctatgacaatgcaagcatacattccaatgccaagataatcctcaaggtagatctgctgaagttctacgacacaatcaccgaaaagcggatttatggggtcttcgaaaaaattggatacgcaaaaaaccttgcatattccctagcaaagttatgtaccgctgagcaccacgacaaatactggtcagactttaatcagaacgataagaagatcctctcctattatctcgagttcaagcctcctatcttaccgcaaggggccccttcttcccccacacttgctaatattgtggcgaccaaaatggacaaacgatttgagggcctgggcgaaaaactgaagttcagctactctagatatgccgatgatctcacgttctcaattaatcatatagggacactgccccctctgaacctgataaggaaaatcatcgaggaagagaatttctacatcaacgaggataagattacctacatgcaccgtggaagcaagcagtacgtcactgggctgactgttacaaatggcgtgcatacgagtaaaaagtacagaaagaagatagccagacacatttacttttgtcgcaaatatggagtggagaatcacctgctgaaaaacattgagcagtttccaacctacaactctctcaaatttcacgattggctgtacggtcatatttgctatatcaatagcgtggataaggaagcctcgaagaagatgctttccgacttcaacaaaattacttggtcaatctga

SEQ ID NO: 9903 - RNA, 1149 nt, unidentified
  source 1..1149: mol_type = other RNA; note = synthetic construct
atgtctttccccttcgagcaattcatacagaatgccagagaggagaaccgatcagaaaagttcatcgatgcctgtgtgaaatacgctgaaaaactggaaagcaacaactatccagtgatcttcgcgttgccccatctcgcaatcgtgatgggcgtgcagtcggatttcctgaaagccttgataggcgaaagtaaagatatccgctatatactgcaaagcaacgagggattcaagatcaagaaatacaaccacttcttcatcaagaaacggaacaagggatttcgtgagattatggccccccacaaagacctcaagtatattcagaagtggctcctgtttaatgtgttaagcaagtatcctctaactgactcctgcaaaggctttcggaaggggatctccattcgcgacaatgcactcgttcattccgacgccaaggttgtgctcaaggtcgacctgctgaagttttacgataccatcactgagaggagggtctttggggtctttgagaagatgggttatgccaaaaatctttcttatagcttggccaaactgtgcacggcaaagcaccacgacaaatattggctcgacttttcttacagcgacaagcagacattaaccgaactctacaaagagaggccttccattctgcctcagggcgctccatctagtccgacattagctaacattgtagcaaccaaaatggataagcgtttcgatgcgctggctaaaaagatgaatttttcctacagccggtatgcagatgatctgacctttagtatcaaagatgaaggaagacttcccaatcttaaactgatcagagagatcatatcggacgagaatttctacatcaacgagaataagatcagctatatgtataaggggtcaaagcagtacgtcacaggcctgacagtagctaacggggttcatactagtaagaggtaccgaaaggagattgaaagacacattcatttttgtcggaggtacggagtggaagaacacctttctcgcaacaagaaaaagttcccatactacaattccctaaagtttcacgattggctgtacggtcacatctgctttattcattcaatagaccgcaaagcctcagagaaactgttgaacgacttcaacaagattaattggttcatttga

SEQ ID NO: 9904 - RNA, 1149 nt, unidentified
  source 1..1149: mol_type = other RNA; note = synthetic construct
atgaagagtttcccaatagaacaattcaaggaagtcgcgatcaaccaggggcacagtcaggagtacatcgatttctgcttaaaatacgcgaatcaacttattgacaagaactaccccgttattttcacaatcgaacacctggctgtggtgatcggagttgaatctgactacttaaggtttctggtgggtgatatcaaacacgagcagtttgagtttgacagatttgagtataaagagaagcggtacaattatttcaagttcacaaagaagcgcgggggctaccgtgaaattatggcccctcacaaggatctcaaatatattcagaagtggctcctattcaacatcttggacaagtatccctttaaaaattcatgcaaagggtttagacaggggattagcatcaaggacaatgccctgcctcatgaaaaaagcgacgtcatcttgaaagtcgatctgctgaagttctatgatactatcaccgaaaagcgaatatatggtgtgttcaagacaatgggctttcacggaaacctggccgtgtcactggccaagctctgcacagccaaacaccagtccgattattgggagaactttacggagaaggagaaacttattctctccgagtttatcaaaacctcgccatcaatacttccccaaggcgcaccctccagccctgcattggccaatatcgttgctacccgaatggacggtcggtttgatgctctttccaagaaaatgaatttctcttactccagatacgcagacgatctgacgttctcagtgaaagagaaggctgtactgccaccgctgaagctgatcagtaagattattcaggaagagggcttctacattaacgaagataaaatccagtacatgaagaggggaaataagcaattcgtgaccggactaactattgccaacggagtgcacacctctaaaaaataccgcaagcagattgctcggcatatacatttttgtaggaaatatggggtcgagaatcatttggataagaacaacaaagagttcaagggctataatattctcaactttcacgactggctgtacggccatatatgttatatcaatagcgtagacaaggaagcaagcaaaaaaatgctcaacgacttcaacaagatcacttggtctatatga

SEQ ID NO: 9905 - RNA, 1149 nt, unidentified
  source 1..1149: mol_type = other RNA; note = synthetic construct
atgaagagttttcctattgaacagttcaaagaggctgctaaggagcaagggcactccaaggagtatatcgacctctgccttaagtatgccaaccagttgatagataaagattacccagtgatcttcacaattgagcaccttgccgtggtgattggtgtggagagcgactatctgaggtttttagttggtgacattaagtgggaagaagtggagtttgataggtttgagtacaaggagaagcgatacaagtacttcaaattcaaaaagaagcgcagcggctatcgagagattattgccccccataaggatctcaaatacattcaaaaatggctgttgttcaacatcctcaacaaatatccactcaaggagagctgtaagggttttagacagggcatatccatcaaggataatgccaaaacccacgaaaaatccgacattatactgaaggtagatctactgaaattctatgacacaatcacggagaagcgggtttacggagtctttagagccatgggatttcacgggaacctgtctgtctcactggcgaaactttgtacggccaagcaccagcccgattattgggaggccttcactgaacgtgaaaaactgattctgtcggaattagtcaaaaccaagccgtcaattctacctcaaggcgctccttcttccccagctctggcaaacatcatcgcgactaaaatggacagcaggtttgaagcactctcaaaaaagatgaacttcttctatagtcggtatgcagacgacctcaccttttccatcaaaggcgatggcatgttgccccccatcaaacttgtgctgcggataataaatgacgaagggttctacatcaatgaagacaagatccagtatatgaagaaagggacaaagcagtttgtgaccgggttaacaatcactaacggagtacataccagcaaaaaatatagaaagcagatcgcaaggcacatacatttttgccgcaagcacggagttgagaatcacctcaataagaactacaatgaattcaagggatacaacagtctgaatttctacgattggctgtacggccatatttgctacatccattctatcgatgagaagtactctaatcgcttgctgaacgacttcaataaaattaactggttcatctga

SEQ ID NO: 9906 - RNA, 1152 nt, unidentified
  source 1..1152: mol_type = other RNA; note = synthetic construct
atgaatagcttccctatcgaacgcttcaagattctcgccaaagagcagggtcatagcgacgagtatatccgcatttgcttggagtacgcactcaagttgactgagaagaaatatcccgtgctgtttactctagaacatctggccattgcgattggcgtgaaatctagtttcctccgattactgattggcgatcttaagacagaggagaagatatccaaactgaagtaccccctcaaagaaaaacggtacaagctgttcttcatcaagaaacgcaggggtgggaagagggagataatggcccctgataaggatgtcaagtacatccaaaagtggattctattcaacatccttggcaagtatcccctgcgtgattcttgtaccgggttccgtccaaatataagcattaaggacaatgctctgatgcacgaaggagctttcaagattcttaaaatcgacctgcttaagttttacgataccattactgaggaacgagtgtacggcgtcttcaaatctatgggatatagatcaaatctggccgtatctttatccaaactctgtacctataaacacaagcctgagtactggaattctttcaactcgaaagaaaaagaactcttggcttattatgtgaaagaaatgcccgcaatcctgccacagggatgcccaagtagtcctatgctcgccaacatcatcgccagcaagatggattatagatttgaggaactgggaaagaagatgagtttctcctactcacgctacgcagacgacttgacgttttcaatcaaaggaaacggcatcttaccgaccctttcctttattaacaagataataaccgaggagaactttcacgtgaacaccgacaaaaccaggtacatgctgaaggggcagaaacagtacgtcacgggcctcacaatcactaatggggtgcacacaagcaagaagtatagaaagaaaatcgctagacacatacatttctgccggcggtttggcgtagaagttcatctgaataggatccggaaagattttctaggttactccacattgaactttcatgactggctgtatgggcacatctgttttattaatagcgttgacaaagagtactcacaaaagctgctgacagactttaacaagattaactggttcatctga

SEQ ID NO: 9907 - RNA, 1131 nt, unidentified
  source 1..1131: mol_type = other RNA; note = synthetic construct
atggaatttccattaaacgagttcattgaacttgccaagaccaaagacaaatcccaagaatatattaactccgttatccactacgtcaagaatctggaatcaaatgacttccccattattttcacccgtcaacattgggcaagcatgatgcagatacagtccacctttattgactacttgcttaatgactatggcgaggacttcgaggatgtgttgcagagtaaatactcatgcttcactctgcgcaagagaaacggcggcgagaggctgattatggctcccaaggaggatctcaagtacctgcaaaaatggatccagttcaacatcctgaacaactacaagtttgaagactcttgtaccggattcataatcggcaaatcgattaaggataacgcaaagaaacacgagtttgccgagacgattctgaaaattgacctgctacaattcttcgacacaatcaaagtcgagcgcatctattactgcttcaaaaaaatgggctacattgggaatgtgtctcacgactttgccaatctgtgtactgtggtccatcccaaggaatattggaagaaggtggacagtgaggtgaagtctgtaattggtcagacaatcaattcctccagtagagtgctccctcagggagccccaaccagccctctgctagctaatattgtggcgtctaaaatggataaaaggtttggtggactttcaaagaagctcgggtttaattatactcggtatgcagatgatttgacatttagcatcaaaaaggggcagaagctcccgtcactgaatgttatctatcagatcatagagagcgaagggttctatgtgaacaagaagaaaacgaagtttatcaacaagggctgcgctcagtatgtaacaggattgaccatcgccaatggagtcaacgttaataaaaagtaccggaagatgatcgaaaggcacctgtacttttgtagaaaatatggggtcgataatcatctcaacaaaaacaagaagactctctttggtttcaaccgacttagcttccatgattggttatacggccacatatgctacatcaaaagcatcaacgagaattgttacaagaagctgatagaagagtacaaaaaaatcacctggacaatatga

SEQ ID NO: 9908 - RNA, 1116 nt, unidentified
  source 1..1116: mol_type = other RNA; note = synthetic construct
atgccttttgacttcgaggaattccgaaaaattgctaaaagtaacaaccactccgaggagtatattttcgagacaattaaatacgcagagaagcttaacaagaaggacctgccggtaatcttttctaccgtgcacctagctatcgagctgaaaatcccctcgaatattctcaacagcctgctgaaatcctacaactacacgtttttcaatttgcataagagatctggaggcttccgtgagataatggtgcctaacgagaagctgaagtatgtccagaggtggatcaatttcaacattctgcagaagttgccactcgaaaaggtctgcaccggctttaggcccaactactcaatcttaaccaacgcaaatattcacgccaattcaaaaatggttctgaaagtggacctcctaagatttttcgatacaataaccgatcgccgggtttatggttatttcaagtcccttggctacctgaaaccactgagctacgatctggccaagctggtgactgccagacacaagaaaagctattgggactttgtgagcaaggataattgcccccagttggccgatatagctaattccaatagcccggttcttccccaaggggcccctacgtctcctatgctcgcgaatttactggcatcccgcatggatgaaaggtttatcattctctcccagaagctgaactttaggtatagtcggtacgctgacgacttgacttttagtattaccgaagaaggacagcttccctttacccgcgtgattaagaagataattgaagaggagggcttcttcatgaatgatagcaagactaaaatcttcagtcgagggatgaaacaatatgtgacaggccttacagtcacccatggtgtacacgtctctaaaaaagaccggaaagacatcttcatgcacctgcatttttgtaagaagctcgggccaaatgagcatttgaaaaactggtctaagaagaatggattaaacagagaaccatacggtttccaggattggctgctcggaaaaatctcgttcatctacagcatagacaaaatcatcgggactaagatgtttaaggaattcgacaagatcaattggtcatttgagaactcaaactga

SEQ ID NO: 9909 - RNA, 1134 nt, unidentified
  source 1..1134: mol_type = other RNA; note = synthetic construct
atgcctttccctctcgaactgtttatcctggaggccgagaaacagggcaaaagtaaggaatacatcgacgtctgtgtggaatatataaagaagctggattcaaatggcttccccgtaattttttctctccatcaccttgcccaagaaattggtgtgcagtacaaatatctgaggttcctcattggagagaacgacaacaagtacgagcataagtacaagcgctataactacttctctatcaagaaaaagcgtaacgggtatagagagattatggccccatcaaaagatttgaagtacatccagaaatggatactgctgaacatcttgtacgtgtataaactagaggactgttgcaaagggtttatgcccaatcaaggcatccttaataatgctattgtgcacgagaatagcgagaaaattctcaaggttgatctgcttaaattctatgactccattaccttcgatagggtcgtccaggtgttcgaaagcgtcggctatattaaaaacctggcaattagcatcgccaagatagtgacggcctctaatagagaaagctactggaactgctttgatgaatattccaaactgaagttgagttcgatccgcaatgctaaaactccggtgcttccccagggcgctccaacatcacctatgttagcaaatatcatagcaaccaatctcgacaaaaagatcatcaacctgagtaagaagttgaactttcgatactcccgctacgctgacgatctgaccttttccgttaaaaaaaatgaaggagttctcccatactctaagctgattatcaaactgatcgagtccgagggattcttcgtgaacccctccaaaactataatcaagaagaaggggcagcgacaatatgtcacaggtctaactgtgacaagcgatgttaatctcagcaagaaatatcggaaggaaatttttaagcacctgcattactgtcggaaattcggagtgaataaccatttagagaggaacaaggactttagaaagtacaacatcattcagttccacgattggttatttgggcacatctgctataccaactcaataaacaaggacgtagcgaataagatgttcgacatttttcggaagatcaattggtctatcagtgagtga

SEQ ID NO: 9910 - RNA, 1182 nt, unidentified
  source 1..1182: mol_type = other RNA; note = synthetic construct
atgatttattctcctgaaacatttgccattagcgcccggaaccagggtcacagtgaaccctttatcgaactgtgtctggcatacctcaataaattgaacaacaggggctatcccgtcctgttttccatccaccatctggcccaggagatcggaatacagacttcttttcttaacgagctaatcggcgatacctactatttttatgacggcgaggaaaaaattgtcgtgaggtcaaaagtcgactattttgatcaggggcggtaccgctattacaaaaagttcaaaatcaagaagcggaccgggggctaccgcgagattatggcacctcaaggcgagttaaagtacatccagaaatggatctacattaacattctgctgaagtaccaactaacagataattgcacaagctttcgtaagggaagatccatctatgataatgccaaaccacatgagcgcaagaaatacatattgaagatagatctcctcaagttctacgacaccatttcagaagaacgtatcttcgggctgttcaaagctatgggctacgttgaaaatttaagcttcgcactggcgaggatctgtaccgcgaaacactctagagacttctggaattcaatttctggagattcggctaaaatccttaagaccttgattgagaacaagcctgccatactgccccaaggcgctcctacgtcacccactttggctaatattgtggccaatcggatggacaaaagatttgtgaagctggggcagatccgagactttgaatatactagatacgcagacgacctcacttttagttccaataatttcaacagccttccgagtatcagtttcatcaaggagattgtgaaggaggagggtttcttcgtgaatcagaagaaaacgaaactgtttaaagctggtggaaaacaatatgttacagggcttacagtaaccaacggggtaaacgtgtccaaaaagtacaggaaaaacatattccagcatctgtattatgcaaagaagttcggcccacgaaatcacctcattaagtgggctaaggataataagaagaacccagacattatggcctttcaggactggctctacggacacatctgcttcataagctccatcaacaagatcgccggaaagaaaatgctgagcgagttcaacaagatcgattggactattttatga

SEQ ID NO: 9911 - RNA, 1134 nt, unidentified
  source 1..1134: mol_type = other RNA; note = synthetic construct
atgcccttcctattcgaggagtacattgaagaggcccggaaaaaacagcggtctgaagcctttatcgaatcaaccgtgcagtacgctaagaagctcgacgacaacggcctgccggtgattttttccagagcccatttcgcttcattagttgggatgcctagccgcgaaattttcacaatcctgcactaccgcgtgacccagtatgtgcagtttagcatcaaaaagaaaaacgggggactcaggcatatcatgacaccagagaagaaactgctctacctgcagaaatggatcaataaaaacatattgcagcaggtcagcgtcctggactgttgtacggcgtttgtgcccggcactagtctcgccaccaatgcatacacgcaccgaaacgcacatagaattttaaaggtagacctcacgcgcttcttcgatactataaatgagaaaagggtctttggactctttaaatatctgggatatcacccaaacgttgcatacgatcttgcccagctgaccaccgctttcccaagctatcagtactggaagtctcagtcattgaaggatttgagacaaactgtcgagaaaatcactttttacgacgcttttctccctcaaggtgccccgactagtccacagctggccaatttgattgctaagcctctggactctaggctgctaatgctctccgagaagtttggctgcaggtattctcggtacgccgatgatctggtgttctccactaacaagcctgaaggaaagctgcccccccttcacctggtaaagcgtatcatagaaagcgagggattcctagtcaatgaagataaaaccgcatatcttaagaaggggatgaaacaatacgtgacaggcctgaccgttacccacggcttccatgtgagtaagaagcagaggcaagaaatctacaaacatctttactatgcgcgaaagtatggtcccttcgagcacttgaagcggtggacaacagataattggggtgatgagagaaaaacaccttatggcttcaaggactggctgttagggaagatctcgtttattaactccatcgaccgtaagaacgggatacgcatgcttgacgagtttaataaaattcactggggcttcgagtgcgaagacggttga

SEQ ID NO: 9912 - RNA, 1092 nt, unidentified
  source 1..1092: mol_type = other RNA; note = synthetic construct
atgtcatttgatcgcaagctgttcattgaggaatgtaaaaatcaggagaaaagcgagcagtatattgtcaacacccttaagtacgccgacaatctggtgaacaggggttttcctgtcctgtttagcctgaagcacatggcttatgaactgggaatcaactatgaggacctcaaaacaattgaggatcaccgcgagaattattacaagcacttccacattaagaagaaaaaggggggcctacgacatctctctgtccctttcactaacctcaaattaattcagtcctggatctaccacaatatcttactccatcatcaccctactagtagtgcatacggctacatcaaaaatcgatctatcaaagagaacgccgaccaacacgtggctaaaaggtttattctcaatgtggacctgttgaagtttttcgaaacgataactgagcacaaggtcttcaaactgtttgtagaaatcggctatactaaaaccctttcttggtccctttcgaaattggtgacagtaccaataaaggaggattattatctccaactgtcacatatcgagcagaagctgttcaacaaaacattcgaacaggaatacggggtgttaccccagggtgcgccaaccagcccctctatttcaaatctggttctccgtaacctagacggaaagatggtggaactagccgagctgaagggaagtacatacacccgctacgcagacgacattaccttttcaggcaacgatattaagaatataccaaccaagacggaaatcatgcgggtcgtgatgagcgaaaatcttctgatcaactggaataagtggacactgcggaaaaagggcatgagacagaaggttaccggactgaacacaactcacgggttgtccgtgcctaagagctaccggaaagatgtgaaaaggcatatccacttttgcttgaaatacgggcccgagtcccatcaaaagaagatcggtgttgataaacagttctatagatactggcttctcggaaggatccattatattagattcatctcccccgagataggcaacaagatgttgaaggacttcaataacatacagtggccgctgtga

SEQ ID NO: 9913 - RNA, 1122 nt, unidentified
  source 1..1122: mol_type = other RNA; note = synthetic construct
atgagcaatgaaattgtaaacagcgtgatgagctcgagcctgtataaaattgtggagcagatctctaaatctaatcacggagacgactataagaaatccctgatagaatactcacagaacctttcctctaaaaacttaccaatcattttcgatgcctaccacctggcctatagtattgggattcagccctacagaattattaatatcatcaaagaccgggaccatctgtataatacctaccgagtcaggaaaaaaaccggcggccatagatggatcatgagccctatagaagagctcaaaactatacagacctggataaagatcaacatcctggacaaaattcaaacccacaactcagccaacggctttgtaaaggagaagtctattgtgactaatgcggagaagcacatcaacaaagaaacaattctcaacattgacctgtaccgtttttttgatacaattacggaaaagcggatatatcaactgtttaagaagttaggctacactaataagctgagttacgatcttagtaggatcctgtgtgtgaatcctccaaagaagtactggaaagaattgaagaaagagaacaagctgaagaaaaagttcatcaagatgaaaccgtccatccttccccagggagctcctacatccccaattatctccaatctcctgtgtatcaagcttgatgagattctattcaagtattgcgagaagtctcacctctcatatacgcgctatgctgacgatatcacaatgtcaggggataataagaatatgcccgagttgaagaaaatcaaatcgatcatcagacataacgggttcaccgttaacataaaaaagatccgcttcatttccaaacacaagaagcagactgttaccggtattacagtgaacaatggactatttgtggacaagaaaatcatcaaagagatctctcaggaattgtactattgcataaagtatggctacaagtcccatctcgagtataagttcaagaagagcaagattaaagcaaactacaaagattggttgtacgggaagatctgctttgtctacagtgtcgagaaagaaaaaggtgagagcttcttcaagaaattcaacatgatcgactggaatatatga

SEQ ID NO: 9914 - RNA, 1122 nt, unidentified
  source 1..1122: mol_type = other RNA; note = synthetic construct
atgtccaatgaaatcgtgaatttcattatgagcaccagtcttcacaagattgtggagcaaattaatcagagtaaccacggtaacgattacaaagagaagcttattgagtattctcagaacttatcaagcaacaacctgccgatcatatttgatgcataccatctggcctactcgatcggaatcgaaccatatagactgattaatctgattcgagatcgagatgatctgtacaatacgtataaagtgcggaagaaaagcggcggatatcgctggatcatgagtcccatggaggagctcaagatcgtgcaaacatggatcaaggtaaatatactggacaaagtcaacatccacgagtccgctaatggatttattaaagaccggagcatcgtcactaatgctaataagcacgttaagaaagagacaatccttaacattgacctgtaccggttctttgatacaatatcagaaaagagggtctaccatctatttaagaaactgggttacaccgagaagctgagctacgacttttccagattgctctgtgttaatacccctaaaaagtactggaaggagatcaaaagggaaaacaggctccgtaaaaaggtgatcagaatgaagcctagtgttctaccacagggcgcgcccacttctcctattatctctaacctcttgtgcttaaaactggaccaggtgttatacaaatactgtgagaaaagcaacttggattatactagatacgccgacgacatcaccatatctggcaacaaaaaatccatgcccaaacttaagaagatcaagtcaataattcgccagaatgggttcactgtaaacattaacaagattaggttcacaagcaaacacaaaaagcagacggtcaccggcctgacagtgaacgatggggtttatgtggataagcgcattataaaggaaattaaccaggagctgtattattgcatcaaatatggctacaagtctcatctcgaattcaagttcaaagactcaaagatcaagtccaattataaggactggctctatgggaagatatgctttgtctactccgtggaaaaggaaaaagggcagcaattgctgaagaaattcaatatgatcgactggaatatctga

SEQ ID NO: 9915 - RNA, 1095 nt, unidentified
  source 1..1095: mol_type = other RNA; note = synthetic construct
atgagcacaagtctctacaaaacagtcgaattgataaacaactcagatcattccctcgaatataaaacccttctcattaactactctcaggaccttacctcaaagaatctgcccatcatctttgatgcctttcatttagctgtgatgattgggatccaaccttacaggataattaatttgatccgggaccgcgatgctttgtaccatacatacaagattcgtaagaaatccggtgggtacagatggattatgtccccgcagaatgacctgaaaaatatccagaactggatcaaaaccaacatcctggaaaaagtggaaatccacgagtctgctaatggctttactaaggataaatccatcattaccaacgccaatgagcacatcggaaaggagatcgttctgaatatcgatttgtaccgcttttttgacaccatcactgaaaagcgagtgtatgggctgtttaaaatgttgggatataccgagaagttaagctatgacttagccaggctgatgtgtgtgaatgcaccaaaaaagtactggaaagagatcaaaaaggagaataagcttaacaagaagatcataaagctgaaatctcctgtgctacctcaaggagcgccaacgagccccataatatccaatcttctggcaaagaacctggatattagcatattcgagtactgcaataagtcaaacctgagttatacgcggtatgccgatgacatgactattagtggggacaaaaaagatctccccaatctcaagctgattaagggcatcatcagaaaaaacggtttcacagtcaacatcaagaaaatcaagtacatttccaaccacaaaaagcagactgtcactggcattaccgtaaataacggcctgttcgttgacaaaaaaattctgaaggaagtaaaccaggagctctactattgtattaagttcggctacattaaccacctaaagttcaagtttcagaacagcaagataaaatcgaactataaagactggctgtatggaaagatttgcttcatctatagcgtggaaaataagacaggtgaggagctcttcaaaaagttcaatcttattgactggtctatctga

SEQ ID NO: 9916 - RNA, 1098 nt, unidentified
  source 1..1098: mol_type = other RNA; note = synthetic construct
atgagctcacccctgctgcacatattggagcaggtggagaattccaaccactctactgaatataaaaggctgatcaaggactattcaatccggctggcttcgcggaatctacctattatctttgacatctaccatctgtcctatctgatagggatccagccctataggatgattaacatgattaaggatcgacactcactctataacgtctacaaaatccgcaaaaaggcaggcggctacagatggatcatgtcgcctatagacgacctgaagcgtgtgcaatattggatcaagctgaacattctggataacatcaacatttgcgacagtgcgtgcgcattcattaaaggaaaaagcatcagggataatgctcaaaagcatgtggggaaagagctcatcctgaatgttgacctctaccgattttttgacagtataaccgagaagaggatatatggagtttttaagagtctcggatacaccgagaagctctcttacgatcttgcccagcttgtaacggctcagccgcctaaagcctactggaaggagatcaaaaaggaaaaccggttcaagaaaaagcacataaagagcactcccgcaatcttgccacagggtgccccaaccagcccatcactctctaacattatcagcattaagatggacgagattttcgataagtatgcgaatgaatgtaagatttcctactctcgctatgccgacgatttgacattttctggtgaaagaggctccattatctccctgctggctgtcaaaaaaattattagacaacagggcttcaccatcaacttgaaaaagacaaaataccttcgcaatagtggaaaacagtccgtcactgggattacagtaaataatgggcttttcgtggataagagcgtgattaacatgataaaacaagagctgtactactgtctaaagtttggctacaaagcccatttaaaatacaagcaggccaaaggcgaatctatcaaaagcggatataaggaatggttattcggtaagatatgcttcatctactccatcgataagaatcggggggtgaacttctttaagatctataaccagatcaactgggacatttga

SEQ ID NO: 9917 - RNA, 918 nt, unidentified
  source 1..918: mol_type = other RNA; note = synthetic construct
atggtgaacgataccgccaactactacaagacctttaagttgaggaagaaaacgggcggatatcggtggatatctgtcccgaacgaggaattgaaactgctgcaccgcaagctcaacctgatgatttttatgcgcattagaccaagcgaatctgtccactcattcgttaagaaaagctccattaggactaatgctgaggtgcatgtaaatgctaagacatgcctgaatgtcgatctttacaggttctatgagtccatcacagacaagcgggtgtttggatatctgtgtaaactgggttaccaccccaatgtatcgtatgtgattgcagccctagttacgatacagttacctaaagcgttctggcaggaggtgagaaaggagaataagttcagatccaagtatatacggaggaaacctaaagcccgggttctgccccaaggctctccatgctctccttttctgtcaaatcttgtcctgacacatttagacttcagaatcgagcaagcttgtaagggcctaggctttagctactcacgctacgcagacgacattactatcagtagcaaaggcgacaatttctttgcactgaccaccctcaaaaaaattattcgaagtgagggtttcaccatcaacatccagaagatatcctttcgacgttctagctcccgtattcaggtaacagggatcactgttaataacgggatctttgtgaacaagtcactctacaaaaaagtcgtgagccacctctactattgcaaaaaatatggggtgcgcgatcatctcgaaaaggtgaagcttactaacaagagtaactacaaggactggctgttgggaaacatccttttcatcaactccgtggaacccgataaagccaagaagttgttcaccgaatttaatcagatcgatttcctcctgtga

SEQ ID NO: 9918 - RNA, 1101 nt, unidentified
  source 1..1101: mol_type = other RNA; note = synthetic construct
atgacatcaccccttgataacatcctcgacaaagccaaagccgaagagcactccccagaatatatcagtgatatcactgcatacgctaagaacctaatagacaaaaagctgcccgtgatttttagcaggacaaacctggccctgagcatcgggataccccggtcacatctcgagttcttgttagccaacagggagatgaagtacaagttctataagctgcggaaaaaacacggtggataccgttggatctcttctcctgagaaggaactcaaatacatacagggatggatcaaagtcaatattttcgacaacatcgagatacacccggccgcgtgtggcttttccaaaggtacgtccatcaaaaaaaatgcaaccgcacaccagaagcaagacttgattctgaacatcgatctgtatcgcttctttgattcaattaccgagaatcgagtgttcggaatccttaactggcttgggtatcataagaatattgctatcgacatggccaagctgctgtgctatcagcccacagataaatatttcgaagaggtggcgaaggagggaatattctccaaatccattttggaccagaaaccttcaattttacctcagggcagccctgctagtccagttattagcaacctgttaagctataagctagatgttagactctctaaaatggctagtaagctcgggattaattattctagatacgccgacgatattacctttagtggcgaaaggaagaatatggtttcgctgaacaccgtaaagaaaatcataactgaagaaggcttctacatcaacaaggacaagattaagtatctcgctcagaatcgcagacaggatgtgaccggcattgtcgtgaataagggcctgaagattaacagcaagtacaaaaaaaaggtgctcactgagatctacttttctgagaagtacggtgtaaagaatcacctgggctacttgattgaccggaagggagccgaaaaaaaggcaaattacaaagatcatctgcttgggaagatctactttatctattccgtggagccagaggtcgggaagaagatgctggagaaatacgaccaaatcaaatgggaaatctga

SEQ ID NO: 9919 - RNA, 1101 nt, unidentified
  source 1..1101: mol_type = other RNA; note = synthetic construct
atgccctcacagctcgacaatataaagaactctctagatgaggcaaacgcttcaaaggatttcaagattgagatcatcaactatagccaaaatctcgagaaaaagggcctgcctatcatattctccctccctgacttaagttttaagattggtctgccattccatgtgattcaggaaattctgaagaataagagtaaccactacaagaccttcaagatacagaaaaaaactggggggcatcggtggatcacaagtccagacgaacaactaaagagaattcaacggtggatctacgaaaacatccttaagaatgtgcccgagcatgactgtagctttggctttgtgaacgagcgaagcatcatagacaatgccaagaagcacgttaatcaggatactattctgaacattgatctgtacagattctttgatagcatcgagcagaaaagggtggcaggcgtattcaagcacctcggctatcagcccaatttagcctattccatggccgaattgttgacagccaaaatgtcaagggcctactggaaagagattgaagatgaaaaggttctttcagacacatttatcgaggagtgcccacagattcttccgcaaggatctccggcgagtccccgtattgcgaatttcatcgcccactccctggacacaagaatggccaaactggctaaaaaactggacgtgaattattcgaggtatgctgacgatttgagcttttctggcgactataaaaaattgccttccatcaagaccttacgcaagatcatcatgaatgagggattctttctcaacgagaaaaaagtcaagtactttaaacgctcccatagacagatcgttactggagtggtggtaaacgataggatatctgtcccccgggaattcaaggaaaagctccgcaccgaactgtaccattgcattaaaaaagggccagctgctcacctgaactggcttatgagcaacaaggatttcaaaatcaagaccaattaccgagatcacctgctcgggaaagcatgtttcgtctacgcagtcgagcctgagacgggtaaggactttctggagatgtataaccagattaagtgggaactgtga

SEQ ID NO: 9920 - RNA, 1050 nt, unidentified
  source 1..1050: mol_type = other RNA; note = synthetic construct
atgacaatgacggatacttgggagtccctcttcaaagagcgggccgtggaagagaagcactcagaggaatatatcgcccagtgtattgagtacgcaggaaaactacatgaaagaaacctcccagtcatctttgacttcgttcatttggcttactacctcggtatctattccgacaagttacggggcatcgtagctaatgcggagacacactaccgagcctacgaaattaagaaaaaaaccggaggcaccagggaaatagaagcacctgatgaaatactgaaggatgtgcaacgctggatctatgccaacattctgtgtagagacaagtccgtccagtcttgcgtgcacgggtttgtgccccgacttagcgaggccgataaggtccggggtgtgctgagcaatgctgtgccccattcaggccacgactggctgatcaatctggacttgaagaactttttccccaccgtgactctcactatggtgcgggactactacgacagccttggatatgaggaagaggttagtaagacgctgaccgcactgtgtacatacaaatctaggctcccacaaggtgcccccacttctccgatgttgagtaatattattgccaccaagatggacatagctctcttagagtactgcaagaaatacggaattacatatacccgctacgccgatgacctgactttctcggcaaatctggatgtggaggtacctcctttgaaggacttatatgcgatcgttttcaaacatggattcatcgttaacagacagaaaacaaagattcgtggccgtgggtataaaaaggaggtgacagggctgaccgtcactgaaggcgtgcacgtcccaaaaaaatatcgcaaggaggtgtggagggagctgtatttttgcaaaaaattcggcgtctacgaacattatcacaacatggggaccaataaggggctgtacaaggattggctgaggggcagaatcatgtttatccgccagatagatcctgcttgcggtaataagatgcttgaaaagtttaacgagcttaactggctagtatga

SEQ ID NO: 9921 - RNA, 1044 nt, unidentified
  source 1..1044: mol_type = other RNA; note = synthetic construct
atgacagaaacatgggagagcctattcaaggagcaggccctcgaggaaaagcactccgacgaatacattgtgcagtgcttggaatatgccggaaaacttcatgagcggaacatgccggtcatttttgactttttgcacttggcctcctatttaaaatgcctcgctaagcagctacagggcatcgttgcaaatgtggagtcccattaccaggagtacgacatcaagaaaaaatcagggggtaagcgtcgaattgaggcacccgactacctgctcaaaaatgtgcaacggtggatctacgtaaatatcctttgtcgtgacaaaagcctgcaaaactgcgtccatggcttcgtgcccgtcttaaccgagaacgatcgcgcgaggggcatactgaccaatgcaatgcctcatagcggacacgactggatcatcaacctggatctcaagaacttttttcacgccgtgacgcttgatatggtgaaagattacttcgattctctgggctacgaggaagaggtgacaaagaccctgacagccctctgcacactcaaaagtagattaccacagggggctcccacctctccaatgctgtcaaatcttatcgctgccaaaatggataaagctatgctggaatattgtaaagaacgcgggattacttatactcggtacgcggacgacctgactttcagtgccaatcttgacgttgaaatgccacctctgaaggagttgtacgctatcgtctttaaacacggtttcatagttaatcgacagaaaaccaaggtgcgcgggcggggctataagaaggaggttacgggactgactgtcaccgatggagtgcatgtacctaagaagtacaggaaggaagtgtggagagagctgtacttctgtaagaggtttggtgtatatgaacactatcacaacatgggcactgataagggcctgtataaggactggttgagaggaagaataatgttcattaggcaaattgatcccgcatgtgggaataagatgctcgaacagttcaacgagctgaactggctggtgtga

SEQ ID NO: 9922 - RNA, 1044 nt, unidentified
  source 1..1044: mol_type = other RNA; note = synthetic construct
atgaccgagacgtgggaaagcctgttcaaagagcgagcattggaggaagggagatcagaagagtttatttcacagtgcattgaatatgccggaaaattacacgagaagaatttacctgtgatcttcgactttgtgcacctcgcctattacctaggattctatagcgaaaagctccagggcatcgttgcaaacgtagagggtcattacaggacctatcatatccgaaagaagtccggcggtaccaggatgatcgaagctcccgacgccatgctgaaggacgttcagcactggatctatggaaacatcctctgccgggataagtccataaaagattgcgtgcacggattcgtccccgctctgactgagaaggataaagtccggggtatacttagtaatgctgcacctcactcgggccatgagtggctcattaacctggacttgaaggacttcttccatactgtcaagctggatatggtcaaagcctattttgattccctggggtatgtcgaagaagtaagtaaaactctgacggccctttgtacaatgaaatctagactaccacaaggggcaccgacctctccaatgctgagcaatctcattgccacaaagatggacgaggagatgatggcctactgtggcaaaaggggcattacttacacacgctacgctgatgacctgaccttctctgcgaactacgatgtggaaatgcccctggtgaaagagttgtatgctatcatctttaggaacgggtttatcgtgaaccggaagaaaaccaaaatcagatacagcggctataagaaggaagttacagggctcaccgtgacaaatggggtgcatgtacctaaaaagtaccgcaaagaggtgtggcgcgagctttacttttgcaagaaattcggcgtttacgagcactaccaccagatggatactgacaagggactgtacaaggcgtggcttcggggccgtattatgttcataagacagattgacccagcctgtggaaacaagatgttggaacaatttaatgagctgaattggttagtgtga

SEQ ID NO: 9923 - RNA, 1044 nt, unidentified
  source 1..1044: mol_type = other RNA; note = synthetic construct
atgactgacacctgggagagtctgtttaaggagtgcgccgtggagaataatcataccgagaattatctgaaggagtgttttgagtatgctggtagcttgcaccagcgcaacctgcctgttatcttcgattttgtgcatctcgctatgtatttcgaatgttgcgcagaaaccctgaaagggatggttgccaatgtggaaaagcattataccgagtataagatccgcaagaagagcggcggtgacaggttgatcgaggcaccagatttcctactgaagaacatgcagagatggatttacattaacatcctgtgtaaggatctctctataaatgactgcgttcacggcttcatccccgcgtttaagaacagggataaagtaagaggaatcctcacgaacgcagccccacacgccggacacgattggcttataaatgtggacttgaagaatttcttccacaccgtggagctggacaatgtgaacaactattttcactccctgggatacgaagacgaagtcgtgaagactctgacggccctgtgtacctacaaatcacggttaccgcaaggtgctcccacatcacccatgcttagtaacattattgctagcaggatggacgaaatgatgctggaatactgcaaaaagagagggattgtctacacacgctatgccgatgacttaactttctctgcggactacgatgtgaaaattcctgcacttgaggacatctacaaaatcgtatacctcaacggctttaaagtgaaccgaatgaagactaaggtgcgttacaaaggatgtaaacaggaagtcacaggcctgaccgtaacaaatggcgtccacgtttcccagaaatacaaaaaggagatactccgggagctacatttctgcaaaaagtttggggtgtatgagcattaccaacacctcaagactacaaagggactgtataaggattggttgcggggcaaaatcatgtttgtccgacagattgatcctgcctgcgggaacaaaatgcttgaacagttcaacgaactcaattggttagtctga

SEQ ID NO: 9924 - RNA, 1041 nt, unidentified
  source 1..1041: mol_type = other RNA; note = synthetic construct
atggaggaaacatgggagtctcttttcaagaaacaagccgttaaaaagaagcactccgatgaatacattaacgagtgtatgcagtatgccttccacctccacgagaaaaatctgcccgtaattttcgacatcaatcatctcagcgaatactggaatctcgacatcgatctgatcaaatcaattatagagtgtcccccccggtattacgctgagtacgacataagaaaaaagagtgggggtacgcgacacctgtgcgcacctcaccaagtgctgaaatacattcagcgctggatttaccacaacatccttctgaaggacataacaatcagtgagcatgtgcacggattcatccctaaggatcaatttgacagcaaaaggaccatcttgtccaatgcccaggcccatgaaaaatgcaaatggctgatcaacatggaccttaaagatttcttcaacaccataaagcaggaaagagtgaagaagtatttcctctctataggctacaccgaagacatttgtgagctgctcgccaaactatgtaccttacattataggttgccacagggcgctcctacatcgccaaccttatcaaacctaatcgcaagggagatggataaggaactggaatgcttgtgtgcaaagaatcattggtgctatacacgctatgctgacgacctgactttttccggcatttacatcgatgagacaccctctatcaacgagctggagaagatcatcattcagaatggatttctggtgaaccggcagaaaactaagtttcgactgagaggcaattgccagatggtcacggggttgactgtgactcatggtgtcttcgttcctaagaagtatcgtaaggaagtctggaaggagctctactgctgcaagaaatttaccccatacgcgcactgtcagtacaggtatccggataaagggttttataaagattggctgaagggccgcattatgttcatccggagcattgatccagcttgcggaaacaagatgttagacgcctttaatcaactcaagtgggtgctttga

SEQ ID NO: 9925 - RNA, 1041 nt, unidentified
  source 1..1041: mol_type = other RNA; note = synthetic construct
atggaacagacctgggagtcgcttttttccgagcaggcgggaattgaaggtcacagccaacagtacattagtgaatgtctggcttatgccggaattctgcattctcacaacgtccctgtaatctttgataagtgccatttcttctctttcttccctgacatcaagaagggaaggatggagatgttcttactgaacttgtgctgctacaagaactactctatcaaaaagaaagccggtggcgtgcggatgattagcgctccctatagtgacctcaagcgagtgcagcgctgggtttatgagaacatcctacttaaggacctctactctgtgagcccctgcgcagagggctttatgcctaaggataaagacgatattcgcaatatagtgacaaacgcaagaaggcacgccaggagcaaatggctcatcaatgtcgatatccaaaacttcttcgactcaatcaaatacgattccgtatgggagtacttctcaaaattggggtacgaaaaagaagtcgccgacgttctggctaagatctgtacctaccagtttagactgccacagggtgccccaacgtccccgatgctcagcaatttgatagtgagatcaatggatgacgcgtttgtggaactggcaagtaagtgcaagtgtttttatagccgttatgccgacgatataacactgagtggcaattccgacagcatcatgccctccatgcgggatatttaccagattgtctatgctcaccactttcggcccaataagaagaaaaccaagatttcgttttcctgtgaccgacagatggtcacaggcctaactatcactgatggggttcacgttcctaaaaaatataggaaggatgtgtggaaagaactgtattgttgtaagaaattcggggtggcatctcatattgcctatcgccatcccgaccaaggcatgtacagatactggttacttggacggatcatgttcataaaatcagtggagccagagtgcggcgagaagatgctgcaggagtttaactctatcaattgggggatatga

SEQ ID NO: 9926 - RNA, 918 nt, unidentified
  source 1..918: mol_type = other RNA; note = synthetic construct
atgaaagacacttgggagagcctctttaagaaagaagctaaaaagcagggccactctgatgccttcattcaggagtgcatcgggtacgccgccaaattgcacgccaacaatgtgcctgttatcttcgactttaagcacctgtcagccatcttcgatatggagtcgcgagacttattctttatgtgcaagcaccttggccaacagtacaccacgtattccattaagaagaaaagtgatccgaaagcaataagacttctgactgcgcccgggtggcaactgaaaaagatacaactttgcattttgcgtaacatcctgatgcgcgataattcagttagcgaacacgcacatggattcgtcaggaaaaagtcaatcgtgacaaatgcgaaggctcatgaaggagcacgatggattctctgtatggatctgaaggatttctttgggaccgtgcgcaaagggaaggtatatgattattttgagagcctgggctatgagaagagtgtggtggagactttagctacactctgtacctacgagaaccatctccctcagggtgctccaacatctccttgcctatccaacctgatggccaagggaatggacgaggaaattgaggcatactctgaacagaatggcttcgtgtacacacggtatgccgacgacattacaatcagctccaaaaccgacatcaagcccgaaaagaataccatcaacgcaatagttaggaagcatggctttcgcgtgaatcatgacaagaccaaactgcggcacaacggacagagaatggaggtaacgggtttgactgtcggcaggggagtgcacgtcccaaaagcttataaaaaggccctgttccgggagctatacttttgtagaactcagggtcccaaggaacactccgaaatggtctacaaagggaaatga

SEQ ID NO: 9927 - RNA, 915 nt, unidentified
  source 1..915: mol_type = other RNA; note = synthetic construct
atggaacatctgttggattattattggacaggtcagttcccccgtgctaacgcctgctgccaattcgattgggcttatcgggactaccggatccaaaaaaagaccggagggtttagagaaatttccgcaccaaatccaacgctgaaatggtgtcagcactggattcagcacaacattctggaacacgtcgtgaatagactcccctcatccgtgcacggctttgttcaaaataggtccatccagactaacgctctgcctcatgtgaactcagagtggatcatcaatatcgaccttaaggactactttgattctatcttccagaagaaggtcctcgatttttttctgcagctcggatacgaggactctgttagcgaattcctgagcaacgtgtgcacaaagtttagttgcgtcacttaccagagagctctaccccaaggcgccccaactagccctctgttggccaatttcttaaccatcaaccttgacaaggatctggagcgtttagcccaggaactggatatgagatacaccagatacgccgatgacataacattttcgggcctccagaaaacgtgtcctgtcactcctcgggacattgagaacattatctatgagcacggcttcaggccgaataagtctaagacccggatacgccataaggggagtaggatgatggtaaccgggctgacagtgggtaacggagtacatgttccaaaagagtaccggaagcaggtgcttagggaactccatttcgcaaaaaaatatggccccgagaaccactgtcgcaaagtgcgaaatgagaaaggttattttagggaatggttgctaggacgcataatgttcgtgcgaagcattgacaaggaggcaggggcgcgcatgctggaaattttcaatgagatcaactggatgatgtga

SEQ ID NO: 9928 - RNA, 951 nt, unidentified
  source 1..951: mol_type = other RNA; note = synthetic construct
atggaagatctcggaaatgaattcatcaagaaattgccggtgatacttgatatttaccatttaagcaacctcgttggcataaaatataatctgctcaaagacatcctctcaaataaggataagtactatcacaccttctacatctcgaaaaaaatgggcggcaaacgcaagattgaagcaccaaatgaggtgctggcattactacagaagtacataaagaacgagatactcgacaacattctggttagcgagtatgcctttggatttgtgaaagagaaaaacatcctgcttaatgcgaagagacacttgaatcaagagatgattctcaacatcgacctggagaatttctttcccactattaaggaaaaacgcgtgttctatatcttttacaagttgtgcaagtacgattatcatatcagcaaggtactgacaaatctagtcactctgcaggggaggttacctcagggagcctgtacctctcccgtgattagtaatatcgctgcctataaactggataaaagactttccacctacgccaagaaactgaacctgatctacacaagatatgctgatgacatcacattcagcggctctaaaaagatcatcaacaacttcttcctgaagaacatccagaatattataaaggagtgtgggttcgtcattaatgataagaaaacgaggttttgctctcagtacggtcggcaggaagtgaccgggctgatcatcaatgacaactacatacacattaacaagaagtacatccgggaaatccgacaagagctctactatattaataagttcggcatctcaaaccaccgtaacaacaaggacttcagtaacatgtattatagggagcatctgttgggtaaaattctttttgtcaagtccattcaccaagacattggactgtccttttttaaccagtttcagaatattgactgggaaaaatga

SEQ ID NO: 9929 - RNA, 1047 nt, unidentified
  source 1..1047: mol_type = other RNA; note = synthetic construct
atgtccaaaaagaatatttacgagcagtacaaagctaaagtgtccaataacgagaattataccgacgaaaagaagaagaagtacctggagcagattgagattctcaaagccaagaatagtgaaatcatactgaacacataccatttctccaatcttgttggcattaaatggaacacgcttaagaaaatcatcgatgatcccgacaaattttactacaatttccagatctcgaagaagacaggcggcaaaagaaccatcaacgttccaaacaacagcttggaactgtgccagaagtacattaaggaaaaaatactcgacaacgtcaaactgcattcagcagcacacgggtttgtcaataacaagtctatcattaccaacgccaaagtgcacgtcaatagcgaaatgatcctcaacatagacctgaaaaacttttttcctagcatttctcgcaaaaaggtattctacatcttcaacaagatctgcggctacgacaattctctgagtcactgtctgactaagcttgtgatgtacaaaaatggtctgccacaaggtgcctgtactagccccattatttccaacatagtaaccttcaagttggatctgagactgaagaagttgtccgataagcttggcttaaattatagccggtatgctgatgacattaccttcagtggcaataagaacgtcatcaactctaagttcctagactttgtgaaaacaatcatcaacgaatgcggatatcagattaacgataaaaagacgaggttcgagtcaaaatgtggtaggcaagaggtgactgggttaatcgtgaacaatggaaaagttagcatacctaaacagtacattcagaatctacgaaaggatctctattatatcaagaagtatgggatagaggagcataaaaaacggaacaacatctataatgcgttctatcaggagcacattaaaggacaaatcatgtttgtgtactcagtgtcaaagaataaggggatcaagctcttgaagaaatacaatctgatctttgacgacaccaagtatggaaattga

SEQ ID NO: 9930 - RNA, 1065 nt, unidentified
  source 1..1065: mol_type = other RNA; note = synthetic construct
atggaaaataagaacctctacaggaaaaagatcgagaactccgacatatcttttaatgagaagcagaagctgttatccaatctcggtaatattaaggatgactacccaataatccttaacggataccatataagcaataaggtgggtataaagtggaatgactatttgaagctcctgaaaaacacgaacaaatactaccacgtatattacatggctaagaaaagcggcggcaggcgaaaaattaccattcccgaccaaatacttatggacatccagtatttcatcaagaacaacatcctggagaatattaagattgatgaaagcgcctttgggtttcgtaagcagaaatccatcctagccaatgccacatatcatcgggagggggaaaaggtcttaattatggacatcgaaaacttctttccaagtatccataaaggacgggtgtactatgtattcaataagatttgcggttactctcgagaggtttcttacgacttgacaagactggtcacatataacaatggattgccgcagggcgcccctacttcacctatcattagcaatatcgttgcttataagctagatcttcggctgaaaggactgtcttacgtgataggtatcaaatacagccgctatgcagatgatttgaccttttccggggcagaaaacaaaattaacgacaagctcctctatactgtgagtaacatcatcgaggacgaagggttcaaattaaacctgaagaagataaggttctacggcaaaaactcaaccaagattattaacggacttgtcatcaataacgggtacgtgaccattcaaaagcgctatatcgataagatcaaacaggagctgtattatatcagaaaattcggcctggagtcgcacctgaattatgttgggttcaaaaacaaacactacgcggagcacctcaaaggcaagattctgtacgtctacagtattgataaggagaaaggcaagcagttgttttcactgtacaacgaactcaatatcgaaaataagcccaatctggtgagaggcggattcgatgagatgcccgtgctgtga

SEQ ID NO: 9931 - RNA, 1086 nt, unidentified
  source 1..1086: mol_type = other RNA; note = synthetic construct
atgttcactcgtttgagaatgttcctcatgtccctgcttgagaaaaagaagaagtacacgaaaagcattaaggtcacacaaatcaaaaacgagaacgttacccctttgaaaaaacacaccccactgaagtacgacctgccggctatctccaacgcattgcacttatctaacaaaatcggcatcaagtgggaagtgtataaagacattgcccgacatcctgagaatcactaccacgtgtttcacataaaaaagaaaaacgggggctttcggaccattgccgcgcccaatgaggagctatcgatgatccagaactatattaacgagaatatcctgttcgcatacaagatccataagtcagcctttggctatgtaaagggcaagagtattatagatgtggccaatcaccacttaaagtctgaaaactttctgtcacttgatctggagaatttctttcccagtatcggagccgagagactttattactattttgggaaactgggcggttatgataaatccattagcgacaacttagtgaggttctgcatgtacggaacagggattccccagggggcatgcacttcccctcagatttcgaatatcattgcttacaaactcgatctgcgccttggggaactgtgtcagtccaaaggactcaagtatagcaggtatgtggatgacctgacgttctctggcgagactgaacatatcaacgacaagctgctgttcaccgttcaaaagattatagctgacgaaggatttaagctcaacagcaaaaaaacaaggttcggtaataatcgcaatggtttcattattacaggcttgatgatccggaataacagtatctgtgtcccatcttcgtacataaagaagatcaagaatgaactctactacatcaataagtacggattgctcgatcataaaaagagagagaagattgagaacagcaattatctggaacatatcaaaggaaagatcaactacgtgatgcacgtcgacgaaagcaaagggctacttgtaaaagaacagtttgacaagaccatactcaagataaactccatggagtcagatatgcggggcctgctgtga

SEQ ID NO: 9932 - RNA, 1011 nt, unidentified
  source 1..1011: mol_type = other RNA; note = synthetic construct
atggacctgaatctgctggagagtagtctaacccagaaggggtatgggaagcgttacaagaagatttgcataaactatgcgaaggctcttaacgagcagggtctaccagtcatctttgacaacaatcatctctctctcttgatgggcattgagtcaaagatattaggccactacattatgaacagcaacaagttctacaaggagtaccagatcgccaaaagcaatggctcactcagaaccatctcgactccctcctacaatatgaagactattcaaagatgggtgctggacaacgtgcttagctctttcgccatccattctaatgcttttgggttcgtaaaagggaggaatattaaagacaatgcactcctgcacaccaagaaaaaggtggtccttaacatcgacattaagaacttttttccgacgatcaagttcgatcgcatcttctatatgttttaccaccatggttacaccaaggaactgtcctatactctggccgctctgactacatataatggatccctgcctcaaggtgccccaacctcaccttatatttccaacatactgtgccagagaatggacaaaaggttgctggcccttgccaaaaaaatgaacgcagattacagtcgatatgctgatgatattacgatgagcggagacgaaaatgttcgccagtatatagagacaattaagagcatcatcatcaacgaaggatttgatataaactacaagaagctgaggctacaaacagacaataatatgcaggaggtcacaggcctcatcgttaacgaagatgtgaaggtgaaacggaaatataaaaaacggctggagcagcacatttattactgtaagaaattcggggtgtatagccacttaaaaaaaatcgagtccgagtcaaagtcttactttaaggaatacctctacggcatcgcaaatttcattaaaatgatcgaacccgatgaaggattggagttcttgaagaaattagacgaaatcaactggggcaattga

SEQ ID NO: 9933 - RNA, 996 nt, unidentified
  source 1..996: mol_type = other RNA; note = synthetic construct
atggaagctatgctaataaaaaagggctatggtcagcggtataaagagacatgcatgcagtatgcacaggagctggctgatcatgggttacccgtgatatttgacaacaagcacctcagtcttctgatgggaattgaatccaacatcttgggctattacatcattagctccaacaagttttacaaggagcaccaaattgcaaagtcaaatgggtccctgaggaccattagtacacctagctacaacatgaaaaccattcagagatggatactggataacatcctgtcttcttttgcaattcacagcaacgcctatgggtttgtgaaaggccgcaatataaaggataatgccatcatccatactaaaaaaaagctggtactgaacatcgacatcaaaaatttcttcccgagcatcaagttcgagagggtgttctacatgttctaccacaatggatataccaaagaaatctcttactccctagccgcgctgacgacatttaacggagctttaccacagggtgctccctcgtcacctagtattgccaacatcatctgccaacggatggacaaacgtctcttggcgctcgccgtgaagatgaatgccgattattcacgatacgccgacgacattacaatttcaggagacgaaaacattagaaagtacatcgagactatcaagtctatcattatcaatgaagggttcgatatcaattacagaaagctcaggctgcaaactaacaaaaatatgcaggaggttaccggtcttatagtcaacgaggacgtcaaagtgaagcgcaaatataagaaacggcttgagcagcatatatactactgtaagaagttcggagtttatagccacctgaagaaaaatgagagcgagagtaaatcctattttaaggaatacctctacggcatggcaaacttcattaagatgatcgaaccagacgaaggcatggaatttttggagaagctggatgagattaattggggctcttga

SEQ ID NO: 9934 - RNA, 1017 nt, unidentified
  source 1..1017: mol_type = other RNA; note = synthetic construct
atggactacattgccgcgctgcaggaagccctgatccagaaaggttacggcaacaaatatcagaaactctgcgtagactatgcctctaatctattaaacaatcgcctgcctgtgattttcgataaaaaacatctcgccctgcttatgggggttaattatcagacacttacctactatctgatcaacacagataatttctacaaggagcacaagattatcaagagtaatggcggctatagaaccattagcgctccctcctttaacctcaaagcaattcagaggtgggtgctggacaacatcctgtataagtatcaggtgtctgacaacgcgaatggatttgtcaaagggaagtccattaagaataatgcagagtcacatataggcaaggagatcatcctaaacatagacataaagaacttcttcccaagcattacatttcaacaggttttctacctgttctataattcgggctatactaaagaaatgagcttcacattcgctaagttgcttacttttaaggggcgtctccctcaaggttccccggctagcccctacctggccaacatcttgtgtaaaaaactggatagcagattaaacggattcgccataaaaataggggccagctacagtaggtacgctgatgatatcactttttctggggatgctgacatttatcgacacatcagttttatccggaacattatcgaaagcgagaacttcaaaatcaatgagaaaaagcttcgggtccagaagagtaactccaagcaagaggtcaccggcctgatcatttctaatggagaagtgaaggtgaaacgcaactataagaagaagttggaacagcacatttactattgcaagaagtttggcgtgtttaatcatctcaagtacacgggagcatccgacaagtcatactttaaagagtacctctacggtatggcatcatacgtatccatgatcgaaccagacaccggaaaatcttacctgaattcattgaacgagatcatttgggattactga

SEQ ID NO: 9935 - RNA, 1014 nt, unidentified
  source 1..1014: mol_type = other RNA; note = synthetic construct
atggattatataaattccctgagagaagcgctgatccaggctggctacggacggcgataccagaagctttgcctagagtacgccgataatctcctcaataatcagctgcccgttatctttgacaaaaagcacttgagcctgctgatgggcgtagagcctagcatcttgggctattacatctttaacagcgataacttctacaaggaatacaaaatacccaaatccaatggggacttacgggtgctctccgccccatctttcaatctgaagtctattcagcgctggattctggaaaacatcttgtacaattatcaggtcagtaataacgctaatggttttgtgatcggcaaaagtattagagacaacgcagagcctcacattggtaaggagatcgtgattaacattgatatcaaggacttcttcccctcaatcaactttgaacgcattttctacctgttttacaatagtggatacacaaaagagatctcttataccttcgcaaagctgctcacttacaataaactgcttccgcaagggtcgccagcctctccttatttagccaatataatctgcaacaggcttgataagaggttatcagggcttgccagcaaaattaaagcttcctataccaggtatgcggacgacattacatttagcggggaagccaacattgtgaactacatcaagactttgcgtaacattattgagtcagagaactttagcatcaatgagaataagctccgaatccaaaaacaaaattcaatgcaggaggtgacaggtctaacggtaaacaacggcgtcaaagttaaacggaagtacaaaaagaacctcgaacagcacatatactattgtaagaagtacggcgtctattcccatctggagcataccggagctaaggacaaatcctatttcaaggagtacctgtatggaatggcatcttacataaagatgatagagcccgacgtgggggaatatttcctgagaaacctcgatgaaatcaactgggattattga

SEQ ID NO: 9936 - RNA, 1014 nt, unidentified
  source 1..1014: mol_type = other RNA; note = synthetic construct
atggattacctttctagactggaaaagaaactgatagagctcgattacgacaacaattacaagtccatctgcatcaaatacgccaagaagctcttggacaacgaagcgctggttgtctttgataagaagcaccttagtctgctgatgggaatcgacctgaagatcctcaactactacattgtgaataccgatgagttctataatgagaagaaaatccccaagaagaacggcaggtaccgcattatcagcatgccaagttataatctcaaaagaatccaacggtggattctggacaatatcttgtacaaactccgcgtgcattccaatgccaccggctttattcgtaacaaaagcattgtggataacgcctcctgccatgtgaataaagatgtggtcgtgaatatagacatcagcgattttttcccatccattgacttcgacaaagtgttttacatgttctataacctgggctatactaaggaactatgttacgccttgtcgaagctgcttacttataaggggatactcccccagggtgcaccctctagcccgtacatcgctaatgtcataatgatcaacatcgacttacgactggacggactcacgaaaaagattaattctaactacacccggtatgctgatgacattacaattagcgggaacaaatatattgtcctgcaattgccttttatcaaaaccatcatagagtctcaggggttcaaagtgaacctggaaaagctgaagattcagtaccgaaagtcacgccaggaagtaacaggccttgttgtcaatgacaggatttcagtaaaacgggagttcaagaagaatctaagacagcacatctattattgcaaaaggtttggggtttacgagcacttaaagtatacaggcaacgaagaaaaatcattctacaaggagtatctgtatggacatgcatacttcattaaaatggtggaacctgagtgtggtgagaggtttatcaaggagttagattccataaactgggatagttga

SEQ ID NO: 9937 - RNA, 1014 nt, unidentified
  source 1..1014: mol_type = other RNA; note = synthetic construct
atggactatctgaatcggttggagaaaaagcttaatgagctcgagtacgacgattactataagtctgcttgtatcacctatgccgaaaagctcatagacaacgaggtaccagtagtcttcgacaagaaacatttgtccttactcatgggcattaacttagctacccttaattactacctggtgaacaccgatgaattttacaatgagatcaagattcccaagaagaatgggagataccgggtaatctcgatgccatcatataatctgaagaagatacaacgatgggttctggataacattctgtacaatatcaaggtgcacaacaaagccaccggttttgtcaggaaccggagtatcgtcgataatgccaagtatcatgtgaaaaaagatgtcgtcgtgaacatcgatataagcaactttttccctagcatcgacttcaataaggtgttctacatgttttacaacctagggtacacgaaggaactctgttatgtcctgtcaaaactgttaacatacaaagatactctgcctcaaggagcgccgtctagcccctacatcgcaaatatcataatgatgaacatcgacctgagactggacgggctggctaagaaaattaattccgattactctcgctatgcagacgacatcactatgagtggaaacagagatattgtggttcacgttcccttcattaaatccataatcgaatcccagggcttcaaggttaatctagacaagctcaaaattcagtatcgaaaaagtaggcaggaggtgacaggcttggtggtgaacgatcgtcttagcgtgaaaaaggagcttaagaagtcactgcgccagcatatttacttttgcaaaaagttcggagtgtatggacacttgaaatacacagggaacgaaggcaagtctttttataaggagtacctgtatggtcacgcctattttatcaaaatggtggagtatgaatgcggcaaaaggttcattaatgaactcgacagcattaactggaactcctga

SEQ ID NO: 9938 - RNA, 1020 nt, unidentified
  source 1..1020: mol_type = other RNA; note = synthetic construct
atggactacctgtctaagctggaactgaaacttactgacaatgggtattcaaagaaatacaaggaactctgcatcagttacgcatcggcactccaaaaccgaaatttgcccgtgatattcgacattaaacacttgtctaaactgatgggggtaagatactccgtgctattttattacatcacgaagagtgaagagttttacaaagagtttaagatccctaagaagatgggaggtattcgtgccatctacgcgccatcactcaatctgaaaaaaatccagcgctggatcctcgagaacatattgacatacttcgatgtggacgatagcgccaaaggctttaaacgctccatgggcatcgtcgagaacgcagccatacataccaataaaagtctcgtctataacattgacatcaggaattttttcccatccattagctacgagaagatctacttcctgttttacaatgctggttattcttctgaagtcagcttcgctataagccgcctggtgtcgtatcagggctacctgccgcagggaagcccctgtagccctattctgtccaatatcgtttgtcgaaagatggatgaggaaatgaagcggttagctttcaaagtgggggcttcctactcaaggtatgccgatgacatgactattagtaccgatgacataaggctgttcgtttcaaaaaaagaggccttcaaggaaattattgagaggaatggctttatccttaataacaagaaggagcggatgcagtattacaaccagccccagttcgtcaccggactgctcgttaacgagggggtgaaaattagacggtcttttaagaaggagatcgaaaagcatatctacttttgcgaaaagtacggaattttcaaccacttgaagcaaattggtatggaagagaagagcttctataaagagtatctatatggcaaagtgaactttatcagatccgtagaacctgaaaccggcaagtatttcttagagagacttaacaagcttgattggacatattga

SEQ ID NO: 9939 - RNA, 1020 nt, unidentified
  source 1..1020: mol_type = other RNA; note = synthetic construct
atgaactatctcgatgaattgaaggtgaaactgattgcaaaaggattttccgacaagtacatcaaaaggtgcacacagtacgctgaaaacctttataacgagaatttcccagtcatttttgatgtgaagcatctctctatgctgatgggtatcaactacaacacgctattctattacatcatcaacactgaaaccttctacaaagagttcaagatacctaaaaagtcaggcgattataggataattgaggcaccctccttgaacttaaagaagattcagaagtggattcttgataatatcctattacacttcccggtgaacgcgtgtgccaccgggtttaaaaagcagaccagcattgtcgataatgcaaaggttcacgttaacaaagagctggtgtacaccatagacatcaaggacttttttccttccatttccttcaaagacgtctacttcctgttttataatgtaggctattcgagtcagatcagctacgcctttgcctgcctgacaactcactgtggcaaacttccccaggggagcccatgttctcctactataagcaatatcctctgcaataagatggacgagagcatgaaggtgatggccaacgaaatttccgctaattacagtcggtatgcggacgacatgaccatcagtacaaatgacatcccattgtttctgtctaaacgtaaggccttcaagcagattgtggaattctatgggttcaatctcaacaacaaaaaggagcggatgcaattcaaaaaccaggctcaatttgtgacaggactgctggtgaataatggtgttcaggtcaaaagagccttcaagaaggaggtcgaacaacaaatttattactgcgagaaatacggcatctatggccatctgcgcgctaaaggaatggccgaaaagtctttctttaaggaatacatctacgggaaagtttatttcatcaagtcagtggagcccgaggtagcagatcagtttctcgagagactgaatcgactgcattggtcatactga

SEQ ID NO: 9940 - RNA, 1020 nt, unidentified
  source 1..1020: mol_type = other RNA; note = synthetic construct
atggactacgtcgatgaactcaagatgaaaatgattaaccgaggctttagtaccaaatatatagacaagtgcaccacttatgccgaaaatctctacaataagaactccccaataattttcgacattaagcacctttccaagattatgggcatcagctatcccatcctgtttcactacatctataacaaccagaaattctacaaggagttcaagattcccaaaaagtcagggtcttacagagttattgacgccccaagtctgaatctgaagaaaattcagaggtggattttagacaacatcctagtgaacttttcaatctccaagtatgcaatggggtttaaaaagcaggtgaatattgtggaaaacgcccagatacataccaataaagagctggtctataacatcgacataaaggattttttcccttcgatcagtttcgagaatgtgtacttcattttctacaatatcgggtactcttccgaggttagctacgctttcgctaaattgatgacatataagggttatcttccgcagggatctccttgtagtcccatcatcagcaatattctgtgtatcaacctggatgagtctatgaactcactatccaaaaatattggagccaattactctcgctatgctgatgacatgactattagcacgaatgacatacctacatttctcgttaagaagggggcgttcaagaacatcatcgagttctatggatttaagctcaacgataaaaaggagaggatgcaatacaaaaatcatccccagtttgtcacaggcctgttggtcaataacaaagtgagagtgcggagagtcttcaaaaaggaggtggaacaacagatctattactgcgagaaatatggtatcttcaaccacctgaaggaactgggcctcgaggatcggagcttctttaaagaatacatatacggcaaggtaaactttatcaagagcgtagaaccagaggtggcagagaggtttcttgaacgcttgaatcgtttaaaatggtcatactga

SEQ ID NO: 9941 - RNA, 1023 nt, unidentified
  source 1..1023: mol_type = other RNA; note = synthetic construct
atgcaaaatactttcctcgacgagctcaagcagaaactgtacgacaatggttttgatgatgcctatatcggcctgtgtctcgactatagtaaacggcttatagccaacaggttgccagtcatcttcgataagattcacctcagtatgctgtttggaatggaggtgaaggagttaaccgtgctggtcaaatccatagaaaatcagtacacgattaggaacatcccaaagaagaacggggacacccgagaactgtatataccctcactgaaactgaaggagattcagaggtggatcctggacgagatcctatataacatcaaggtcagcccttattgtaccggatttatgaaagagaaaagcatcctggagaacgctcgtatacacgagaataaggcctgtgtgatgaatcttgacattcggaatttctttccctccattagattcgagtcaatctatagagtattctactattacgggtacacttctgaggtgagttactatctggccagattgtgcacagtgcataattttcttccccagggggctcccacttcaccgtacttgtcaaacattgtgtgcctcagactcgacaaacggctgagctcgttggcgtctaaatatgatgcaaattacagccggtatgctgatgacattacactgtccggtacaggaagctctatcgttcctcggctgcctcttattaaaatcatcttggatagcgagggcttcaagataaattataaaaaggtccgagtgcagaaacagcaagaacgccagattgtgaccggcctggtcgtgaacaataaggcaagagttccacgcgaggttgaacgcgaactcaggcaacagatctactactgcaagaaatttggagtaaacgaacacttaaagcgcaagaagaaaaacaagctatccgggttcaaagaacatctttacggcttagcaatgttcattaagatgatcgataacaggaagggcgaacgttacgtttctgacctgaacgaaatctcctgggattactga

SEQ ID NO: 9942 - RNA, 1023 nt, unidentified
  source 1..1023: mol_type = other RNA; note = synthetic construct
atgaaggaatacgaatatatttcccgcctgaaggcagcgcttattcaagaaaattacgatgacgactacattaaactgtgcaatgattatagctacaggctgctggagaattccttgcctgtgattttcgataaggaacacctcagtagattgttaggtctggaggaaagatatttctttcagctgtttatgatggccgatgggttttataaggaagtgcaaataccgaagaagaaactggggcagtttcgaaatatatctgtccctaccgaggtgctgaagtacgttcagaggtggatcctggacaatgtgctttacaatatacgcgtgtctgaggctaccacaggctttgttaaggggaagtctatcgtcgacaacgctaaaaaacacgtgcggaaagagtgcgtaattaatatggatctcaaggacttcttccctacaatcacatacgacagtgtttttcgactgcttaagtactacggatacactaatgagattgccttcatactgtcgaagttatgtacctttagagacgtcttgccacagggtgcacccacttcaccattcatcagcaacattgtctgttataagctggatatcaggttcataaagctctgcaacaaaatcggagctgactattcacggtatgccgatgacctcacaattagtggccccaggtacatcgtgggctacttgaacctattctccgatatcattgtagaggaagggtttcagatcaacgaatccaagacgcgcatccagtatcccaacaacagacaagaggtgaccggcctaattgtcaacgacaagatcagcgtgccaaaagagactaaaaaatacctgcgtcaacagatcttctattgcaaaaaatacggcgtgaactcacatcttcggaagatcaacatccagaagagcaactataaagaacatctgtacggaattgccttcttcatcaaaatggttgagctcgagttaggagagaaatttctcgaacagctcaatgagattgagtgggattattga

SEQ ID NO: 9943 - RNA, 903 nt, unidentified
  source 1..903: mol_type = other RNA; note = synthetic construct
gtcatctttgacaagaaccactttgcaaaactcattggcctcaagaaagagtacatatttcagatcctgatggtgaccgagatgttctacaaggaaatcagcattccgaaaaagcgcttgggagagtatagggacattagtataccagcccagggactgaaatatattcagaggtggattcttgataacatcttatacaacatccctgtatctgaagtttgcacagggtttgtgaaggaaaagtccatcattgacaatgccaaaaaacacatcaataaggactgtgtcatcaacatggatataaaggacttttttccctccataacctacaacgatgtctttttcatcttcaaatactacggatacacaaatgaagttagcttcttgttgagcaagctgtgctcttataaagggtccctcccacagggagcgcctacttctccctacatctcaaacatcattagctataaactggatgttcgatttatgctgctggccaagaagctcaaggccgactattcccgttatgctgacgacataaccatctcaggcaacaaatacttagtgaagtacctgaaggtgttcaaaaatatccttatcgaagaggggttcaaggtcaatgagcggaaaactaggattcagtactcaaataaacggcaggaggtgacgggcattattgtgaataataaactaagtgtgcccaaagagacaaagcagtatcttagacagcaaatctattactgtaagagattcggcgtaaattcgcatctcgctcgcattggcatccaaaagagtaactacaaggagcatctgtatggtatggcattcttcattaagatgatacaacaggaagaaggtgagaatatgctgaacaacctaaacgatattgattgggattattga

SEQ ID NO: 9944 - RNA, 1017 nt, unidentified
  source 1..1017: mol_type = other RNA; note = synthetic construct
atgtccagctacattgaatccttagtgagcggtttgagggaaaaaggttaccgggaccagtacattaatctatgtgtggagtattgtgagcgcctgattaataacaacttgcccgtgatcttcgataaggatcaccttgccctcgtgatgggcatcagagatgaatatctggccaagctgtttatgtttcctgagaaattctacaagcaagccagaatcccgaagaaaaaaaagggggagtaccgtgaaatatccatcccttatcagaccctgaaacatttgcagaggtggattctcgagaacattctctatagactgaaggtatctgatagctcgaaagggtttgttcccaagctgtctattgtcgaaaacgccaataaacaccttcagaaagagtgtgtgattaatatcgacattaaggacttctttccatcaatccagttcaacgagatattcaacatcttctactactacggctacacaaaggagataagcttcatcctggctagactgtgcacttatgaaggacgcctacctcaagggtccccagcaagtccctaccttagtaatctcgtgaacgttaagctggaccgacggttcgaaaacttttgcaagaaaatcggcgcggattacacacgctatgcagacgacatcaccatttctggaccaaagtatataacaaagtacatccaccagttgaaggaaatcattactgatgaggggtacaacctcaatgaggaaaaaacccgaatcctgtttaaacaccaaaggcaggaggtcacgggcttaattgtgaacgacgtcctgggtgtacccatcaagatgaaaaaatatctgaggcagcagattcattattgcaagaagtttggcgtcagcaatcatctcatgaaaataggaaatcaacggtcaaacttcaaggagcacttatttggactggcttattacatcaagatggttgagaaggaaaaaggcgagaagttcatagaggacctcaatacccttaattgggattattga

SEQ ID NO: 9945 - RNA, 1017 nt, unidentified
  source 1..1017: mol_type = other RNA; note = synthetic construct
atggatacatacacccaccggctgaagtatgaaatgaatctgcataactacgacgaaaactacataaaactctgttgcgactatagcaagcgcttggaaacaaacaatttgcctgtcatatttgacaaagttcacttctcactcctgcttggtattgaggaaaactacttagccaagctctttatgattaccgaacacttttacaagctcgctagaattccaaaacggaaacccggaatgtatagggagatcctggttcccttcaagaatctaaaagagatacaaaggtggattctgcacaatatcctctacaacatagatgtgtctagcgccactacaggattcaaaccggactcttcaatcctggagaatgccaaaccacatgtcaacaagccttgcataatcaaactggatatcaaggacttcttccccagtattggctttgaccaggtgtatcgtatcttcgcatactacggatatacaaatgaggtgtcatatctacttgctaagctgtgcacctacaaaggctatctgcctcaaggcagtcctacttctccatacatatccaacatcatttgtttgaagctggataagaggtttaaggaactttgtaagacactgaatgctgactttactcgctacgccgatgatatcactatcagcggggatagtttcatcgcaaagtatatcgacaccttcaaatccattatcgagtcggagggctttgtagtaaacgaggataagctcaaagtgcgatatagcaatgagagacagattgtgacgggtatcattgtcaacaccaaattgtccattcccagggaaactaagaagtccttacgccagcagatctattactgccgaaagtacggcgtgtacaaccatatgctgcggacgaatctcgacagagccaattacaaggactacttatatgggcttgcgtactttattaaaatggtggagaaggatgttggacagaaattcattgatgacctgaacaccatctattgggggtattga

SEQ ID NO: 9946 - RNA, 1014 nt, unidentified
  source 1..1014: mol_type = other RNA; note = synthetic construct
atggaagattacattaataggctcaaggaagagatcgagctgcgagaaattgaagagtcctatggccaattgtgcatagaatatgcagaacgcctcatagaaaataaccttcccgtcatctttgatagagagcacattgccttgttgctgggcattaactatgactacgtcaacaagatcatgctgtttacagacaagttctataaggtgtacaagatgaaaaagaagaacggcgattacagggagatcagcatcccaaatgtgcgtttgagatacatccagaggtggctgctggacaatatactctacaaaatctccgtttccgagcacgtaactggatttgtgcctaaaaaaagcatcgttgacaacgcgatcaaacatgtgaataaggaacttgtactggctatggatataaaagagtttttcccctctgttaagttcgagaagatcttcaacattttctactattacggttacaccaaagaggtgtcttactgtcttgctcgcatttgcacattagacggtagcctgccgcagggggcacctactagtccatacctggccaacatagtctgcaaaaggatggacatgcggattgagagtctctgtggaaaaatcaatgctatctttacccggtatgccgacgatattacaatctcgggcaaacggaacattatcgaatacctctctctaatgcagaacattataaaagacgaggggtttgaaatcaataataaaaagacccgggcaatgtattcaaaccgccagcagcgaataacgggactaatcgtgaacgagaaggtcaatgtgcccaagaataagattaagtatctcagacaacagatcttttacattaagaagttcggcgtcaccagacatcttgagaaaaacggttattgttatgggaatctgaaggaacacctgtatggcctggcctacttcattaagatggtgaatgaagagaaaggaatcaaattcattgaggagttagatgggatcaactgggagtcatga

SEQ ID NO: 9947 - RNA, 1014 nt, unidentified
  source 1..1014: mol_type = other RNA; note = synthetic construct
atgagcgattacttatataagctgaaggaggcactcaatttcgagaaagtggacatcaagtacagtgaactgtgtattgagtatgcatcccgcttaataaacaataacatgcctgtgatctacgataagaaacacttttcactactgctcggtatagagcagcagtatatcaacaagctggttttgtgtaccgatcgcttctacaaaaagttctccatccgtaaaaaaaacggcggcgatcgtatcattagcataccaaatattcggcttaggtgcatccagagatggattctggacaatatcatttacaacatcagggtgtctgagaatgtcacaggatttatccccaacaagagtatcgttgataacgcgagggcccacgtagattcagacgccattctcgctttggatatcaaagatttctttccctcgatcagctttgacaagattttcagactctttaactactatggctataccaccgaaatttcttattgcctggccagaatatgcactttgaacaatacccttcctcagggcgctcccacctcaccgtatcttgccaatatcgtgtgtaagaagatggacaagcgaatctccagccttagtaaaaaaatcggggctaagtatacaagatacgcagacgatataacgatttccgggaaaaaaaacatcacatcttattccaagctcataaaggacattataagggacgagggatttctagtcaataatgagaaaactcgagtaatgtacaggaatcggcagcaacgcgttacagggctgattgtgaacaagaaaattactgtgccaaaggaaaagatcagatacttgcggcagcaaatttactacatcaataaatacggtgtcgtgggccatcgcgagaagtctaaggtcaagcatcggaacattaaagaacacctgtatggactggcctacttcattaaaatggtggacgaaatcaaaggggagaagttcctgaacgacctgaataagatcaactgggaaagctga

SEQ ID NO: 9948 - RNA, 1014 nt, unidentified
  source 1..1014: mol_type = other RNA; note = synthetic construct
atggaaaatcatatagaaaagttcatcgacaagctgaaagtgatgcagtatagcgacgattacattaatctttgcatcgaatatgcagaaagactgactgacaacaatctaccaatcattttcgacatcgaacacttttcattcctggtgggcttggagaaggagtacatcaactacatcattcacaagaagaagcacttttacatagagttcacgatcaagaaacgaaaaggcgggaaccgccttctgtctattcctagcaagaagttgaagtatatccagcgctggatcctcgatgagattctgtataaaattcctgtgaacgagcatgccaagggttacatacctaacaaatcaattgtcgacaatgctaagccccacgtcaagaaaaaatgcatcattaaactcgacatcaaggatttcttcgacaacattgattacaaccgggtctttagaatcttctactattacggttacactaagaacatgagttacaagctcgccgagttgtgtacttatgaaaataagctcccgcaaggcgctccaacctccccctatatctccaatatagtatgtctgaagatggataaaaggtttagcaaactgtgcaacaaatttaacgccacatatacaaggtatgcggacgatattaccatctctggagacaattccattaccaagtacttcaaagcatacgtgagaattatagagtcggagggctttgaggtcaatgctgaaaaggtgataagcatcaaagggaatcggaccaagcgggtgacaggcattgttgtgaacgagaaactgagtgttgggagggaaatgaaacgcaagctacgacagcagatttattactgcaagaaatatggggttcgtgatcacctgaagaaaatcgagtgtgaaaaatccttttacaaggagcatctttacggaatcgcctactatatcaaatctgtagagcccatcgatggagaaaagttcttagaggaattagacgagataatgtgggagtattga

SEQ ID NO: 9949 - RNA, 1035 nt, unidentified
  source 1..1035: mol_type = other RNA; note = synthetic construct
atggaatgttatcgcatggattacatcgaaaggttgagagaacagttaatcaagcaggggtatggcaagaggtatatatacctgtgtgagcagtattgcactcggttactccaaaacggactacctgtaatttttgacaacatccacttttccctgctcctcggtatgactactcaggacctgggtaagatgatctttctgacagattccctctacaatagcataagcattcccaaaaagagcgggggcaaacgagagatttcaattcccaccgtgaatttgaagtatgtccagcggtggatcctggacaacattctgtataacattcgcgttagttcacaggctacaggattcgtgaagggcctatccattgtggataacgcccgaccgcatgttaataaagagtgcgtcatcacaatcgacatcgagaacttttttcctaccattagcttcgaaactatattccggctgttttactattacgggtacacaaaggaaatgagttatgttcttgccaagctctgtacctacgagggcaaactgccccaaggcgcaccaacctcgccatacctgtccaacatcgtgtcacttaaacttgacaaacggttcaatagtcttgtaaacaagttatctgacctgaatgcgtcttacagcagatatgctgatgatctcaccgtgtctggagacaaaaagatagtgaaatatgtgcccctgtttaaagagatcatccaggatgaaagattcatcgtcaacgagaaaaaattcagggtgcaaaataagcctgatcgccaaatggtgacgggaattatcgtcaatgaaaagatttcagtaccaatccagacgaagaagtacattaggcagcagatttactactgcaaaaagttcggggtcgatagacacctggagcatataaaaagcatacgttccaattacaaggagtacttgtacggtatcgcctatttcatcaagatggtggaaaacgactacggcacatctctcttggaggagctgaataccattgtttgggactattga

SEQ ID NO: 9950 - RNA, 1017 nt, unidentified
  source 1..1017: mol_type = other RNA; note = synthetic construct
atggatgaatacataaagaagctgaagctcctgttagagaattcggattatgaagaggaatataagaggaaatgcattgaatacgccgaacggttactgctgaatgggcttcccgtcatctacgatttggagcacctcattctggttttgggtatcaagaagaagatacttaccaagatgattttcgcttaccataacttttacagtactgtggagattcccaaaaaatcaggagggagtagaaaacttcaaattccttcagtggaactaaagtatatacagcgctggattctcgacaacattctcaaaaaaatcaagatcagcaagcacgccatcgggttctgtaatgaaaaatccattgtggataacgccaagatccatattggcaacaaatgcattttgaacatggatatcaaggacttcttcccctctgttaatttcgagatggtgtttaggattttcatctactacggatatacgaaggaactgtccttcatttttacccgtctttgtacttatgacgggtttctcccgcagggtagtccagcttccccatacatctctaacatagtctccctgaagatagacaaacggctgagcagattagcggaaaagtatcatgcaaactatagcaggtatgcagacgacatcacattctcttctaacagctcaatgaaaaagctacctgagatcatccagaaaattctgctggaagagggctttatggtgaacaaaaaaaagacccggtttcaatacttttaccagagacaagaggtgacaggactgatcgtgaacaatggacgcgtacgagttaagaagagctataagaaagagctctaccagaccatatattactgtcagaagtttggcgtcaataatcacttggagaaaatcaattgctacaagaacttctacaaggagtatctgtacggcaaagcctatttcatcaatatggtagagcctgaagagggcaaaaaaatctttaagctgctcgaggagatccagtgggattactga

SEQ ID NO: 9951 - RNA, 1017 nt, unidentified
  source 1..1017: mol_type = other RNA; note = synthetic construct
atggaaaactacatttacaagttgaagatcctgctcaaaaaaagcggatacggtaagcactactctgagaagtgtgtcgagtatgctaaccggctcatcgagaataatttacccgtgattttcgacattcaacacttctcactggtgtccggcgcccctaaagagttgattggaaagatgctgtttgctgattccaaattctattctcttgccctcattcctaagaagtccggcggggttagagaactgcacataccctcagctgagctaaaatatctgcagcggtggattttggacaacatcttgagtagaatacatgtgagccagtttgccatggggttctgcaacaataagagtatcgtggacaacgctaaaatgcacattggcaatgagtgcatcctgaacatggacattaaggactttttccatagcatcaccttcaaaatggtctttaggatattcgcgtattatggatacaccaaggaattatcctttgtatttgcaaagctttgcacgtacgaagatgtgctacctcaaggttcgccggccagtccctgtataagcaacatcgtctctttacgtatcgataagcgactttctctcattgcagagaaatatcaggcatgttacagcagatacgcggatgatatcacattttcagggaatcggggcatcaagaagctgatcgagattacttccaacgtactcgaggaagaaggattctcactgaacaataagaagactaggatgcagttcccacatcagcgccaggaggttacagggcttatcataaatgggggtatggttcgcgtgaataagaagtataagagggacctgtaccaggcctgctattactgtaaaaagtttggcgtggatagtcacctgaaaaagatcaaatgcgacaaaagcttctacaaagaacacctgtatggcaaggcctattttgtcaatatggtggaaccagatgagggaaaaaaactgttcaacctcctggacaaaatccattgggactactga

SEQ ID NO: 9952 - RNA, 1017 nt, unidentified
  source 1..1017: mol_type = other RNA; note = synthetic construct
atggaaaactacctggagagcctcaagattgagataacagaacagggatatgacgaatactacacaaccaaatgtattgagtatgcagagcgacttctgtctaacggtttacccgtaatctttgataccgatcatttgagcctagtgactggggcccctaaacagctgatcttaaagatgattttcgcaaattcctgcttttactcagaggccagacttcctaaaaaatccggtggtattagagtcttgaacatcccctctattgaacttaagtatgtacaacgttggatactggacaacattctcaagaagataaacgtgtcatcatacgccaccgggttctgtgacaataagtctatagtggataatgccaaggtgcacatcgggagagagtgcatcctcaatatggatatcaaggactttttccctactatcacgttcaaaatgatcttccgaattttcgtctactatgggtacacgaaagaagtgtcctttactttggcgcggctctgtacatttgagaactttctgccccagggatccccagcttcgccgtatctctcaaatatcgtcagcctgaaaattgacaaaaggctgagcctgctggctaagaagtataaggccaattactccaggtacgctgacgacatcacctttagtggcaatcatggcatcaagaaaatgagtagtattgtgagcgagatcttggaagacgagggcttcaaggtgaatgatggaaaaacccgccttcagtattcttatcaaaggcaagaagtgactggactagttattaacaacggcaaagttcgcgtcaacaagcattacaagcgggagctgtaccagattctctattactgcataaaattcggcgtgaacagtcacctgcagaaaatcaacagcacaaaaaccttctacaaggagcacttatatggcaaggcatattttgtcaatatggttgaaccagacgaaggccggaagctgttcgatctgctcgagtgcatccagtgggattactga

SEQ ID NO: 9953 - RNA, 1026 nt, unidentified
  source 1..1026: mol_type = other RNA; note = synthetic construct
atgaataaagaggaatatctgcaggagctgaagaatggcctcgcctaccaaggctatgacagccgctacatccaggcctgcttcgagtatgctcagaatctactgatccatggactgccagtggtttttgatgtgcaccacctctccttgctgctaggtatgactaccaagcaattaaacgcgtacatcttcggctccgggaaaagattatacagtactaagcacattagcaagaaagatgggggcgtaagagtactttcaattccttgcgaaaccctgaagtacatccagcgctggatccttgacaacattctcaagcgaatgtacatatccgaatgttgcaaaggatttgtggacgattgtagcatacttgacaatgcgagctgtcatttaggcgccgaggtcatcctgaacatggacattaaggactttttcccaagtatttcactcttgcaggtctatcgtgtgtttaggtattatggatatacccaggaactgtcctacgtcatggcaaaactgtgcacgtacagggatcagctgcctcaagggtcgcccgcttcaccctacctgtctaacatcatcgcactgaagatagataaaagactcatggctctcgctgaatcttacggcgcacattatacccgctacgccgacgacataactatttccggattcgggtgtttggagaaaatgatccccattatcagctcagttatctctgaagagggttttgtggtcaatagcaagaagacacgggtggcacgaaagggtcagaggcaagaggtcacagggctgattattaacagtggaaaggcctgcgttcctaaagagtacaagcggaaaatcttccaggaaatttactattgtcagaaattcggcgtgacaaatcatcaggagcacatcggcgacgatcaccggtattataaagagcatctctatggaaaagcctactacgttcacatgatcgagccgcacatagggaagaagatgctttctgagttggataaggtgaactgggaagtgtga

SEQ ID NO: 9954 - RNA, 1026 nt, unidentified
  source 1..1026: mol_type = other RNA; note = synthetic construct
atggataaagagaagtatatctctgaattgcgtattcaactggagagcatggaacagtcccagaaagacatcgactcctgcatatcctatgccatccggctcattgattccagccttcctgtaatctttgacaaacggcatttaagtctcttgcttggcatcgagctggaagaactgactacaatactcgcaacgttagaggagaattattacaatgagatgtctataccgaagaagtccgaagggtacagaaccttgaatgtccccgccatgaaactgaaaatgattcagagatggatcctggacaacatcctcgaacacattcccgtttcagaccatgtgactggattttgtaaggagcgtagcattgtgactaatgctaaaaagcacattggcaaacaatgcgtaatcagctttgatattaaggatttcttcccaacgattgatattgagagcatcttcatggtcttttactactatggatacaccaaggagatcagttatgctctggcaaggttatgtacctatgatggttacctccctcagggttcacctgcctcaccctacatctctaatatcctgtgcctgaagctcgacaagaggcttagcctgctcgccgagaaatatgttgcagactacacccgctatgctgacgacattacattctcaggcaactacggcctgagtaacatcatcaacattgtgaagaacatcatccaggaagaaggctttacagtcaatgagaggaagattcgagtgaagtacaagcatcagagacaggaggtgaccgggctaattgtcagcgataacaaagtgagtgtttccaaactatacaagcgcaaactttggcaggaaatctactactgtcaaaagtatggagtctcgtctcacttggagcacataaactgcaagaaatctttcttcaaggaacacatatacgggaaggtgtactttatatatatggtggagccagaagaggggcggaaactgctgattgcgctggataaaatcgcctgggactattga

SEQ ID NO: 9955 - RNA, 1026 nt, unidentified
  source 1..1026: mol_type = other RNA; note = synthetic construct
atggacaaggagaggtatttaaaaaaactggaggaagccctttctgagtctagctcctctatccccgagtcattagcatgcatccggtatgccagcaatttgctcacattcgattttcctgtgatatttgatcgaactcacctggctcacctgctgggtataaagccgtcagacctatcagccctgatctattcgatagacagctactgctaccatgagtttcacttggctaagaaaagtgggggtatgagagtgatcaacattcccagcgttgatttgaaggatatccaaagatggatcctagacaatatcatctccaagatgcatatttcagagttcgctaatggcttttgcaaggggaagtctatcttgactaatgcgctcagccatatcgatcaagagtgcgtcatcaacctggacatcaaagacttcttcccatccgtgggtattgatcgagttttcatgcttttcaagtactatggctacaccaaggaagtaagttttgctctggccaaactgtgtacataccgcggaatacttccacagggatctcctgcatcccctgccatcagcaatgtgatatgtctcaagctcgacaaacgtctgtcgaaactggcggaatcttacaatggagtctactccagatatgccgatgacctcacacttagtgggaccaaaaacattacgcagctgattcccaccgttattgctattgtggaagaggagggcttttgtgtcaatgctcagaagacccatattgcatacgcacacgagcggcagaaggtgactggcctcctggtcaacgaaggcaaagtgcgcgtgagccaaaaatataagcggaggttaaggcaggaaatttacttttgccagaagtttggcgtgtccgaccaccagaaatactgtaacgaaaacttccagttcttcaaagagcacctctacgggaaggcctattttgtaagtatggttgagccagaagtcggaaacgccttcctggaggccctggataacattgcatgggaatattga

SEQ ID NO: 9956 - RNA, 1026 nt, unidentified
  source 1..1026: mol_type = other RNA; note = synthetic construct
atggataagattaaatatctggcttcactcaggtctgccattatcgcttccggcaagtccgaaaagtactcgattgtgtgttgcaattacgctagcagtctcttaaactccaatctgcccgttctgttcgacaatagtcaccttgccagggcactggggattacccctctggactttgggaagctcttgtattccatcgacgattactgttaccacgagattaagatacccaaaaaaaacggtggtgtgcgcaccctggatattccctctatggacttgaaatatatccagtgctggatccttgacaacattctgaacaaaatgcatgtctctgactatgctaacggctttgtgaaaaatcggtctatcctaactaacgcccagaatcacatcaactcagagtgcgttgtgaacatcgacctaaaagatttttttcccacagtcaaattcgagcaggtctttaggattttcaagtactatggatacacaaaggaggtgagctatacactcagcaaactgtgcacgtatcgaggaatactgccacaaggcagccctgcttccccggcaataaccaatattatctgtcttaagctcgataagcgcctgtcagccttgggccaaaagcacgaagcgaccttctcccgttatgccgacgatatcactttctctgggaaaaaggccatcgtccaccttttgccatacgcaataaatattatccgggatgagggttttgcggttaacctggataagacccatacttcattcaagcaccagagacaggaagtgacaggattaatcgtgaatggagacaaagtgcacgtcagtcaaaagttcaaaaagagattccggcaggaaatctactattgtaagaaatacggcgtacagagccatctgaagcatattaatgatcatcatgccttctacaaggagcacatgtatggccaggcatactttataaacatggtagaacctagtctggggcaggagctgttaagactcctcgacagcatcagctgggagtactga

SEQ ID NO: 9957 - RNA, 1026 nt, unidentified
  source 1..1026: mol_type = other RNA; note = synthetic construct
atggataaaaccaattatctcaaggagattgagatcttactgaagaacaacgacgagtccaatgagaacatttctaacgtgctgaagtacgctgccaatctcctgaatctagatatgccggttatatttgacaagagtcatttagccactctgctcggattgagtgtctctgattttaaccattatgtgattggctcaaatgactcccagtataataccctgatgattcctaaaaagtcaggctctttccgcgaaatcagtatccccagcgtcgagctcaaaaaaatgcaacggtggatcttggacaatatcctgtacaagattgaagtaagtgagtatgccaccggctttgtgcgtaagaaatccataaaggataatgctaagtgtcatctcgagaataactgtgttatcaaccttgatctcaagaacttttttccaacaatacacttcgaccgggtcttcaaaattttctactacagcgggtatactaaggaagttagcttcctgctctccaaaatatgcacttacaagtcaatcctgccccagggttcgccagcaagccctcagatcagcaatattgcttgtctgaagcttgactaccggctgagcaaattatctaaatgctttagggcgtcattctccagatacgcagatgacctgacattttctggagactatgggattacaaagattatcgacaccgtaaaaaagatcgtgaatgacgagggctttgaggtgaacgaaaaaaagatcagaatccagttcaaacaccagaagcaaaacgtgacagggctgacggtgaatgatttcaaggtgcgagtcagcagagaataccttaggaagttcagacaggagatttacttctgccaaaaatttggcatcagggatcacttgcgcttcataaactccgaccgaaggtatttccgcgattatatgtacggtaaggcctactttattaatatgatcgatgtggacgaaggaaaactgctattgaacaaacttaaccagatcaactgggaagtctga

SEQ ID NO: 9958 - RNA, 1023 nt, unidentified
  source 1..1023: mol_type = other RNA; note = synthetic construct
atgaacaacaacccgtacgttaaagaattgtatagtgtgcttagtcagaagggagaaaagcaggaggatatcgacgctgcctgcaaatatgccgaaaatttgatcgctctcaatctacctgtggttttcaacaaggagcatttctcactcttagtcggtaggaagtacaaggagatcaccacattgatggctacactagagacgaactattatcacctggcatacatcaagaaaaaaaatgggggcgagaggaccctgaacatacccgcagtgtctctgcgaattatacagaggtggatcctcgacaacattctcaaaaatatgtacatcagccaatacgccatgggtttctgcaagaacaaatccatcgtgactaatgccaaataccacctggggaagacttgtgtgatcaacgtggaccttaaggatttttttccatctattacgcagaagcagattttcaacatattctactactacggctatacaatagatgtctcctatatgctctccagattatgtacttgcgaaggacggcttccacagggcgcacctacaagcccctgcttaagcaatattgtctgtctgaaactggataaacgcctgtctgaagttagtaaaagattcaaggccgaatatacccgctatgctgacgatatcaccttttcatcgaattcagacatcagcaacattctgcccatcgtgaaggagatcattcaagacgagggattccaactcaatgagaaaaagacccggattctttttaagcatcagaagcaagaggtaactggattgctggttaatggcaaccagatcagagtggataagaagtacatcaaaaagttcaagcaggagatttactattgcaaaaaatacggggtggaagaccacctggaacacattgattgtaagaagcacttttaccgtgaccatatgtatggcaaagcgtattttgtaaagatggtcgacgagaaagtcgggaaaaagctgattaatgaactggactccatagattgggagtga

SEQ ID NO: 9959 - RNA, 1026 nt, unidentified
  source 1..1026: mol_type = other RNA; note = synthetic construct
atgaataacgagggatatctggagaacctggagaaagaactgatagactccaatgaaaaggtcaaggacatcgaagcagcaaagaaatacgccaagaatcttttgaacttggggttgccagtaatctttgataaacagcactttgccctgctagtgggcagagagctgagtgagatcaccaagatgatggctatgattgagactaattattaccacgaagctaacatcgtcaagaaaagcggcaaaatgagaacgctgaatattccggccgttagccttaggctggtgcagaaatggatcctcgacaatatcttgtataagatccgtgtgtcccagtactgtaatggcttttgtaagaagaagtctatctgtacaaacgcccaaaaccatctcaaccaggattgcattgtgaacatggatatgtcagatttcttccctagtatttcacagaagcagatctttaggatcttctactactatgggtataccgttgaggtcagttacattttagcccggctttgtacctatgacggatacctccctcaaggtgcccccacttcgccctacctgtctaacattgcttgcctaaagctcgacaagaggcttgcgggactggctaaaaaatatgagagcacatacagccggtatgcagatgacataaccttctccggaaaatgtggtatccaaaagatcattccagtggcggaaaaaataatacaggacgaaggcttctccctcaatgtcaataaaactcgcattgcctactattatcaacgacaggaagttacagggataaacgtgaacggcaaaaagatgcatgtagataagagatacgtgaaaggcttttgccaggagatctattactgcgaaaaattcggggtccatgatcacctgcagcacatcaaatgcaacaagcatttttacaaggagcacatgtacggtaaggcatactatattaatatggtggacaaggacttaggccggaagctcctgtctcgcctggacaatattgattgggatgactga

SEQ ID NO: 9960 - RNA, 1062 nt, unidentified
  source 1..1062: mol_type = other RNA; note = synthetic construct
atgggaaatcgctgcacagagacttggcggctgtacatgaaaaccgaggagtatctgaacgaactgcgtaccgtgctcgtcgcagctgacgagtgcgaggcagatattgtggcagctgagcagtacgccgaaaatctgatgcagctggggatgccggtgatctttgatttgcaccatttcgcgaagctagttggcaaggaagcgcgggatattggcaacatgatgatgcatcaggaggattttttctatcgccaggtacagatcgagaaaaagcatggagggtaccgaactcttgacatcccagccatgaacctccgcaatatacagaagtggatcctgaagaacatcctctaccaaattagcgtctctgaacacgcctgcggcttttgtaagaagaggtcaattgtaacgaacgcagaaaggcatgtcggaaaggagtgcgtaataaacgtcgatataaaggactttttcccctccgtgcacggtgaccagattttcaaaatcttctactactacgggtatacaactgaggtttcttacctgttatcccggctctgtacatacagagactatctccctcagggtgcccctacgagcccctatctgtccaatattgtgtgcctaaaactggataaacgattgagtagactggccaagagctatcaggccgagtacagtcgttatgcagatgacattacattttctggcaatgccgggatcaaggctatgcttccaatagtggaagggattgtgaatgaggaaggttacctgcttaacaaagacaagacccgcatcgcctataaacatcagaggcaagaggtgaccggcttattggtgaatggaactaccgttagagtgagcaaacaatatcttaagaagttctcacaggagatttactactgtaaaaagtttggcgttcggtcgcacatggaacacatccactgtgaaaaaagattcttcagggatcacatgtacggcaaagcttattttatccaaatggtcgacagggacatgggaaaaagatatttcgctgaattggagcagatcgactgggaatcctga

SEQ ID NO: 9961 - RNA, 1014 nt, unidentified
  source 1..1014: mol_type = other RNA; note = synthetic construct
atgaactacattcagaagctgcaggagaaaatgagagagtccgagcaaagcgaacaatacatcaaaacgtgttctacttatgctcagcggttgatcgataacggtgtgcctgtggtattcgactttagccatctcgcacttctcttgggatttaaaacagcggatattgctttttacctgttcgctgaagacgatctgttctacaaggaaattgaaatccccaagaagagggggggctacaggaaaattgatatcccttccgagcgactgaaatgcatccagcgctggatcttggacaacattcttgacaatatggaggttcatgagtgctgttacggattctgtaaaggcaaaagcatctatgataatgccttgcttcacgtcggcaagaaatgcgttctgaatatggacctcaaagactttttcccttcaattaagcagaaggacgtttttaacatcttctacaagaaagggtacaccaagaaggtgagctactacctctctaaattactgaccaaaaatggtgaactgccgcaaggctcacccgcctccccaatggtgtcgaatatcgtagccgagcacctagacactcggctttcagcactcgccaaacgctactgtgcggagtatagtcgttatgccgacgatataacattcagtggcgcactgaacgtcaagaacatgattcccattatcaccgggatcattgaagatgaggggttcaatatcaatgagaagaagactagatacgcctactattaccagagacaggaagtcaccggcttaatagtcaataaaaaagtgtccatcccaaaggaatatattaaggaactcaagaaggagatctattattgcgagaagtttggagtgacatctcatctggagaggacaaacatgcacaagagtttttataaggaacacctatacggtaaggcttatttcgtgaacatgatagacaagaacatgggacagcagatactgaaacacctggataccataatgtgggagtattga

SEQ ID NO: 9962 - RNA, 1014 nt, unidentified
  source 1..1014: mol_type = other RNA; note = synthetic construct
atggggtacgtccagaagctgaaggataaaatgatcgagcagggggccgatgaaaattatgtcgaactctgcgtgtcctatgctcaaaagttatgttcaaactctgttcccgttatctttgatttcaaacacctgagcctgttgctaggatacgaaccctctgagttagccttttacctgtttgcccctgaagactctttttacacgcaaatgaagattccaaagaagtcagggggtatgcgtgagatcgagattccttcagataagctcaagtcaatacagcgctggattttgcgaaatgtgctggagaatatcgaagtacacgaagcgtgttatggcttcaccaaaggtaaaagtatttatgacaacgccttactgcacgtggggaaggagtgtgtactaaacatggacttgaaggatttttttcccagcatcactcagaaagacgtgttcaatattttctaccagaagggttacactaagcgggttagttactatcttgcaaaactcctgaccaaagacggagtgctcccacaaggcagcccagcttctccgaaaataagcaatatcgtggctctgcatcttgataaacggttgagcgaactggccaaatgctatagggctacctactcgagatatgccgacgatctgacattctccggcgcaagcaacataaaaaacatgatccccatcatcaataagataattcatgaggagacattcctggtgaatgagaagaaaacaaggtattcctactactttcagaaacaggaagtgaccggacttatcgtcaataagaaggtcagtgttcctaaagagtatcttaaggagctcaacaaggaaatctattactgcaagaaattcggcgtctccagtcatctcaagaaaactgaaaaccacaaatccttcttcaaggagtacatgtacggaaaggcatattttattaacatggtggacaaggagctcggccagaaaattctgagagagctggacacaattctgtgggaatactga

SEQ ID NO: 9963 - RNA, 1014 nt, unidentified
  source 1..1014: mol_type = other RNA; note = synthetic construct
atggaatactgtcaagagctccagaaaatgatgagggagcaagaaatggatgaaacctacatcgagctctgcacctcctatgccaaaagactgcttaaaaacgacatgcctgtcatttttgactttaaacacctctctatgctgctgggaatagaaccctacgagatggctttttacttgttcgcagacgaaaagctgtattatacagagattcagattcctaagaagcgcggcggtgtgagaatcatcgacatcccaagtgagaggctgaaggacatccagaagtggatcttggacaatatactctcccgctatactgtgcacgaatgctgttacggatttattcgggggaagagcatttatgacaacgctctgcagcatgtcaataaacggtgcgtgttaaatctggatctgaaagatttctttccatcgattacccaagaacaaatattcaagatcttctttagcgtagggtacactaagaaggttagctactatttagccaaaatgctaacgaagaacaaaaaacttccccagggatcacctgcatctcccatgcttagcaatattgttgccaaaaaacttgacagccgtttgaatggactggctaaaaagtacggcgccgtttactctcggtacgcagatgatattacattttcaggcgaaggcaacatcaaaaatatgatcccaattgtggagaagaccatccaggatgaaaagttccaggtgaataagtccaaaacgcgatattcttattactttcagcgacaggaggtgacaggcctcattgtgaataagaaggtcagtatcccgaaagagtatatcagagagatcaacaaggagatttatttctgtaagaagttcggtgtatcaagtcatctggagaaaattcagaactacaagtccttctacaaagaacacctatatgggaaggcgtacttcataaagatgatcaacaagaggaaagggaaccagatattggagcagctggacgagatcgaatgggattactga

SEQ ID NO: 9964 - RNA, 1017 nt, unidentified
  source 1..1017: mol_type = other RNA; note = synthetic construct
atgatcaggatagacctcgaaaagtataaagagttcctcagcaagaaaaacatcaagaagaagaacaaggagctgcttatccagtacgccgaacgtctgacgaataataatctcccgattatttgggacatccggcactttagcattataaccgacataccttacaaaaggattctgtcctacatctacgagacagagaagttttatcacgagattgatatccccaaaaagcggggaggtgtacgcacactcgaaattccctctctcgaactgaaaaccctgcagagagatatattgcatgagcttcttgaatgcattaacacaagtgaacaagcatatggcttcctgaagggaaagagcatcgtcgacaacgcacgacagcatgttggcaaaagatatatcttaggtatcgacatcgagaattttttcgctacaatcaatgtggacagaatcttcaagattttctattactacggctataccaaagaggtttcgttcatgctgtcccgcattgtgtgtaaagatgggtacctgcctcagggcgcccctacctcaccatacctaagtaacatagtttgcaggaaattagaccgcaggttgttgggagtggctaaaaaatatggcgcgacttacactcggtacgccgatgacatcaccttttcaggggaaattcacccagatgtgtatgtcgacctaatcaagaaaattatcgtggaagagggcttctgtatcaattccaacaagactcgaattctggggaataatcagagacaggaagtaacgggtatcattgtcaataagaaggtgaaggtcaacaagaagtataaagagtatctgcggcaacagatttattactgcaacaagtacgggatcgattctcacctggagaaaataggaaacaatgtgactggatttaaggaacatatgtacggcatcgccaactttatcaaaatggtggaacccgatgagggggagaaatggattaacaagcttaacgagataagctggtactactga

SEQ ID NO: 9965 - RNA, 1035 nt, unidentified
  source 1..1035: mol_type = other RNA; note = synthetic construct
atgacatacgacgcacaaagcgaccagtacctgttagaattggactctctactggaggctaatggaactccttttgaagacagggccatctgtatagagtatgcaaccaatctccggcgaagcggacttcccgtcatcttcgacagggatcatttggcgtttctcctgggcatcacattgcatgatctgatgtacttcgtcatgcagcaggatgatcactacgctaggtactatcttagtaagaagaggggcggtagacgccctgtagatgccccgtctgagagactgaaatctgtccagcgttggattctgtcctcaattcttgagaagatgcgcgtgagcgattatgctttcggctttgtgaagggccggagtcttctcgagaacgcgagagtccacttaggcaagcactgtgtagtaaatgttgacattgaagacttctttgcttccgttcaggcggataatgtgttcagggtgttctcctattacggttacagcaaagaagtgtcattctgcctgtcacgcctgtgtacactgagcggcgtgttaccccagggagccccaacctctccctgcatctccaacctcgtgtttctcaaggtggacaagcgtctcgctcgccttgccaagacatatgaagcatcgtattccagatatgccgacgatctgactttcagtgggcgggggaatctgggcaacatcatacctgctgtggaacatattttgcgggaggaggggtttactttgaatgatgccaagacgagagtcgccttctctcaccagcgacaggaggttaccgggctgaacgtgaacggagatagtgttagagtcccacggagctttaaacgcgacttcttccagcaagtgtatttttgcaaacgatacggtgttgattcacacctggaccggaccaaccaactctttgcattttacaaagagcatatgtacggaaaagcctactacctgtgcgaaattgagccagaggtgggtcgtagggcactgggggaactagacgccatcgagtggacctattga

SEQ ID NO: 9966 - RNA, 1179 nt, unidentified
  source 1..1179: mol_type = other RNA; note = synthetic construct
atgtgttgcgtgtcctctgcatggcaacatattgcgcacggagcctctccgatcgtaggcctgccaatagtttccctggccttccacgcaaaagatggattcgctaccgggacagtcggtactggaaccattaccgtaatcgtcgacagtaatgtgtgtttttatatggaggaagagaacctgcagattgcgctcgaaaagggcattatagaaccagccgtctatgagagagtgattgcttacaaagagagactcgaggagaaccaggttcccgtcatttacaatctgagacatcttcggaaaatattccgaatctacaaaaaggagcaggacttctttttcggggacaagaaggaggagttatataggacttttaagatccccaagaagtctggggggtatcgtaccatcgaggccccctgtgaacgcctgaaacagatccagcgctggatcaaagatgaaatcattgacaagcttgtgatgtctgaatatgccaccggatttaggaagaatctttcaatcgtcgataacgcgaaaaagcatgtgggcaaggaattggtgattgggatggacctgaaagacttttttccaagcgtgacgtatgaggaaatcttcctgatgttcaggtatgtaggctacaggaaagacgttgcacacctccttagcaagttgtgcacaaatgcagaaaacgtgctccctcagggtagtcctgctagccctagcatcgccaatcacgttctgctgaaactagataagcgtctcggcattctggctgagacaatcggagcagattatagccgctacgccgacgatatcactttttcaggaaagaagagtattgcttcaatcatacccttggtcgagaagatcgttgccgaagagaactttacgataaataagaccaagactcggctgcaatacaagaatcagcgacaggaggtgacaggcttaatcgtgaacaacaaaatctccatttcgcgggagatggagaacgagataaagaacgctatatacttcatcggtaaatacggggtgtgcgaacacatgagacacattgaatgcaacaaatccttctacaaggaacatctatacggcattgcctatttcattaatatggtggaccgggaaaaaggccaaaaatacttgcgccagttagatctgctcgagtgggagtactga

SEQ ID NO: 9967 - RNA, 1011 nt, unidentified
  source 1..1011: mol_type = other RNA; note = synthetic construct
atggagaagaacaatcttcaaattgccctgcagcagggcgtcattacccaggatgcatataatagcatcacggaatacaaacagaggcttaacgataataacgtccctgtgatctataacctaaggcatctgcggaaaattttccgaatcaagaaacgtgagcaggatatcttctttggcgaaaacaaacgttctttataccgaagtttctcgatcccaaaaaagtctggtggcgttcgccagattgaggctccttgtaagcggctgaaggaaatccaaaggtggataaaagacgaaatcgtggacaagtttgtcgttagtgagtacgccacaggattcaggaagaacatgtctattgtggataatgcccgcaagcacgttgggaaagagctcgtgatcaatatggacattaaggactttttcccctcagtaacctatgcagatatcctgttgatgtttatgtacatagggtacaggaaagacgtggcacatctgctgactaagctctgcacaaatgcagagaatgtccttccacaggggtcacccgccagtccttccatttccaaccacatcttgctgaaattggacaaacggttaggaagactggcggaaagcgttggtgccgactactctagatatgccgatgacattactttctccgggaagcggggtatctccacaatcataccgctcgtggagcagattattgaagaggaaggcttcctcgtaaacgagaataagactagactccaatatagcaaccaacgccaggaagtcaccggactgattgtgaataacaaaatcgccgtgtcaaccgctatcgaagatgagatcagaaacgccatctactttattaagaagtatggagtggacgaccacatgaagcatataggctgcaataaaagcttctatatggagcacctgtacggcatagcttactttatcaacatggtggatcgcgataagggaaagaaatacctagctcagctggacgagattatatgggcgtga

SEQ ID NO: 9968 - RNA, 1011 nt, unidentified
  source 1..1011: mol_type = other RNA; note = synthetic construct
atgggcaacgacaagctctacgaggcatcacgaagaggcgtcatttcggagaaaacttatcgcgagatcctgaaatataaggagagactccagaagaatggcgttcccgtgatatacaaccttcggcatgtaaggaagatctttcaaatccgccggaaggagcaggaactgttttttggtgcgcagcgcgaagctctttactaccagtttgagattccaaaaaagtccggaggtaaacggaccatcgaggctccctgcgacaggctgaagaaaattcagcgttggataaaggacgagatcatcgattcattctatccgagtgaatacgcaacagggtttcggaaggggataagtatcgtcgacaacgcgatgccacatatcgggaaggaattggtgatcaactttgatctcaaggatttctttcccagtgtgacatacgccgaaatcctgaaactcttcgtgtacatgggttaccgactggacgtggcccacttactgactaagatttgcaccaatagcgagaatgttctgcctcaaggctcccctgctagcccttcaattagcaacttagtccttttgaaactcgataaaaggttgtctagcctggccaaaaccatttcttgttcctattccagatatgcagatgacattaccttcagcggcaataaaagtatcaagtccattgtgccactggtcattcagatcattatagatgagggatacacagtgaatgagaacaagattcgtctgcagtatgccaaccagagacaagaagttacagggcttactgtgaatacgaaactggccgtgtctaaaaacataaccgatgaaatcgaaaaggccatctatttctgtaataagttcggagtaagctctcacatgaagcacatagcctgcgacaagcatttctatagggagcacctatatggaatcgcttacttcattatgatggttgacccccagaaaggcaagatctacttgaaagaactaaatgacctcaactgggtctga

SEQ ID NO: 9969 - RNA, 1011 nt, unidentified
  source 1..1011: mol_type = other RNA; note = synthetic construct
atggcccgccaagaggaactgctggctgccgtggaaaaaggaattatcactgaggattcagcgaatcgaattctggagtacaacgctagactggacgagcacggcctgcctatcatctataatctgaggcacttgagaaagattctgaagatccgcaagcgggatcaggagatctttttcggtccaaggagaaatgagttatatcgcgaattccagatacccaagaagtccgggggcattcgtaaaattcaggctccaaatgaagaacttaaagcgattcagacctggatcaaagctgagatactggacaaatattccgcctctaagtatgcaactgggtttcggaaaggctacagcattgttgacaacgccaaccgacatgtggggaaagagctcgtgatcaatcttgatatcaaggactttttccctagcataacctacgcggatgtaatcaaaattttctcgtacatggggtacaagttggaggtcgcccacctgcttacgcagctctgtacaaatggtgagaacgtgctgcctcaaggatctccggcctctccagctctaagcaacctggcagttataaaattagacaagaggctaggtacattggccgactctctcaattgtgactacagccggtacgctgatgatatcacattttcaggcaagaagaacattaggagcatagtccccttggtaaagaaagttatctccgaagaaggattcgaagtcaacgagtcaaaggtgcggctccagtatgcccaccaacgtcaggaggtgaccggactcatcgtcaacaaaaaggtgagtgtctccgaaagtgtggtgtccgaactgaagaatgcagtgtactactgcggaaaatacggggttgaaagtcacatgcagcatattggctgcgacaaagccttctataaagagcatctttacggcctcgcctattttgtaaagatggtggagcccgcaaagggcagagcatatctgaacaagttagatagtatcgtctggtga

SEQ ID NO: 9970 - RNA, 1002 nt, unidentified
  source 1..1002: mol_type = other RNA; note = synthetic construct
atgtatgaggacgccaaagaaaaatcaatcatcagtcaggatgcataccaactcataaaaatctacataggtcgcctcgaagataacgacatccctgtcatctttaacctgcgacacttgagaaaaatcctgaaaattcccaagcagaaacagtcggcttacttcggcgttaataggaatgaaatgtacaggaagttcatgatccccaagaaaagtggcgggtatcggaagattgaagcaccatctgaagagctgaagttaagacagctgtggattaaggaaaatatcatcgacaagttcaagatttccgatagtgcccagggctttcgtaaaaaccatagcatctatggtaatgccctgccacatgtggggaaggagcttgtgatcaacattgatattaaggacttcttccctagcatcacctaccagaaagttttcaagttctttcgctatattgggtatacaaatcaagtgtctcatctgctcacaaaaatgtgtactaacgtggataatgtcctaccgcagggatcacctgcctccccaagcctctccaacattgtactcttgaaaatggacaagagactgtcaaagttagcaggagctgtggaatgcgattacacgcggtacgccgacgatatcaccttttctggcaagaaggtgataaaaagcctggtccccattatatgcaaaattattgaggaggagggatatgacgtgaacaaagggaaactgcgccttcagtattctaatcagcggcaagaagtcacaggcctaaccgtgaataaaaaagttagcctttccaagcgaaccataaaggagatcgagaacgctatttattattgcaagaagtacggtgtacaagaacacatgactaggattaagtgtgacaagtccttttataaggagcacttgtacggaatagcgtactttatcaagatgatcgacaaagagaagggcaagaaatacctggaggagctgaacaggatcgagtggctttactga

SEQ ID NO: 9971 - RNA, 933 nt, unidentified
  source 1..933: mol_type = other RNA; note = synthetic construct
atggctacgaaagaaaaaatcgataatgctttgcagaagggcatcatcaccgccgaaactgcgaacgagcttaaggaatacaacgataggcttacccgtaacaatatgcctatcatctataacctgcggcatctgagaaaaattctgaagatcaagaagaaggaacagaataagtactttggcaacgagcgcaatgaataccacacattttacattcccaaaaagaatggcagcaagcgcatgatcgaagcgccgtctgacagactcaaaagctttcagctgtggataaaggagaacatattggacaagattaacgttagcacgaatgctagagggttccgaaagaattattccattcttgataacgccaaggaacacgtaaacaaagatctggtgatcaatatcgacctcaaagactttttcccatccattacctacaatagggtatataagatcttcgcatacgtcggatacaccaatgaggttgcccatctcctgactcaactatgcacaaacaaagaaaatgtgctgccccagggatctcccgcctctccagtcatttccaacattgtggcactgaaactcgacaaaaggttaggtgccctcgcaaacaagttcaattgctcatatactcggtacgctgacgatatcacattcagtggatgtgtgggcatcaaaaatatgctgtcgaccgttgagcggataataatagaggagaacttctccattaacgacgcaaaagtccgactgcaatataagaaccagcgccaggaggtgacagggttaattgtcaacaaaaagatcgccgtgagccctaaaatcattaaggagatcgacaatgccatttattactgcctaaagtttggcgtggcttcacatatgcagaaaattgggtgtgataagagtttttacaaggagcacttgtatggttga

SEQ ID NO: 9972 - RNA, 1011 nt, unidentified
  source 1..1011: mol_type = other RNA; note = synthetic construct
atgatggagcatatagagaaggcctatcaggctggggtcattactgaggaggaaaagaggttgattgaggagtataaccagagactgacggacaataatgtgcccgtgatatataatctgcgccacctgaggcagctgctcgggatccataaatctgctcaggacaggctttttggagataagaagtgcgattcgtatcgggttttccatattccgaagaaaaatggcggcctgagagaaatcgaggcccctaacgaagaattaaaacgcattcagttatggatcaaggagaacattctggataaattttccgtcagccaatttgcaaagggtttcgtgaagggcgtctcaatttacgacaacgcggtgcagcataccggtaaagagctggtagttaacatagaccttaaagacttcttcccttccattcagtacagagagatctacaagatttttaagtacatcggctataccgactctgtctccaagctgttgactaatctgtgtactaacgctaggagcgtgttgccccagggaagcccagctagtccaacaattagtaacctcgtaagcctcaaactcgacaaacgtctcgggcgactggcagacaaaattggcgcctcttataccagatacgccgatgatatcaccttctccggtaagaagacaatacagaagtacatcgagctgattcgaaaaatcatctacgaagaagggtacgagataaatgaaggaaagtttcggttgcaatacgcgcaccaacggcaggaggtgacagggcttatcgttaataaagaggtcgcaattccccaaaagcgcataaacgaattggaaaatgccatctactattgcaaaaagtatggcgtggtggatcacatgtcacacatcggatgtgaaaaaggtttctacaaggaacacctctacggcctggcctattttatcaaaatggtgaaccctgagaagggactgaaatatcttctacagctaaacgagatcgaatggccaatctga

SEQ ID NO: 9973 - RNA, 993 nt, unidentified
  source 1..993: mol_type = other RNA; note = synthetic construct
atggcaagcaccaaggaactgcagaaagcctacgagtcgggctacataacacaaggcgacatgagtttgattgaagagtataatcagcgactcctttctaacaatgtccctatcatctacaatctgcgacacttaaggcagttgctgggcatacgcaagaaagaccaggacaaactctttggcaaggataggaaagattcatatcgcaactttaaagtaccaaagaagagcggggggtttcgcagtattgaggcccccaatgaacagctgaaaaaaattcagctatggatcaaggaaaacatactggacaaattcaccgtttctgagcatgcaaagggctttaaaaaggggttctccatctacgataatgcactcccacatgtcggcaaagagctcgtgatcaacttcgatcttaaggatttctttccaagcatcgattactgcgacatttacaagattttcaagtacatcggatacacagacggagtgtccaaactgttgaccaagctgtgcacgaaccccgaaaatgtcctaccccaaggatcacctgcctcacccgtgttgagcaatcttgtttccctgaagcttgataaaaggctcggcgaactcgccaagaggatcggtgctagttacacccggtatgctgatgacataacattttctggggaggctaacattcagaagtatgagatcctgattagagagatcatcttcgaagaggggtaccgggtgaatgaagacaaattcagacggcgtctgtatttccagaaacaagaggtgactggtctgatcgttaacgacaaagtgtccattccgaagagaaagataaaggagatggaaaatgcgatttactattgtaagaagtacggtgtgactaaccacatgaagcatatcaactgtgagaaaggattttatagagaacacctgtacggtttagcctatttcattaagatggtaaaccagcctcaaggagagaagtattataaaaactga

SEQ ID NO: 9974 - RNA, 993 nt, unidentified
  source 1..993: mol_type = other RNA; note = synthetic construct
atggcctttgacaaaggaatcatcgatgagtgtcagaaaaagctcctgacggagtacatagagagactgcacatgaacaatgtgcccattatatataacctcaggcatctgaggaagttgtttgatattccccgagacgaacagaacaaattctttgggcacgagcggagcctgctgtacaagacattctatattccgaagaagaatggtgggtaccgcaaaattgaggcaccaaatgaaaaactcgagaagatccaatgttggataaaggagaagatcctagataatttcaacgtctctgaatacgcgaaaggatttaaaaaagggactaacattgtggacaacgcactccctcactgctctaaagaggtactgatcaatatcgacattaacaacttcttcccttcgattaaatactcctcagtgtttcggatgtttaactatatgggatataccaaagaggtttgccaccttcttacccgtttgtgcacaaacgctgaaaatgttctgccacagggtgctcccaccagccctgctataagtaatcttgtgaacttgaagctggacaagagactgtcaagcttagccatttccggtggagcggcctacactagatatgctgacgatattacctttagtggggacaagttgatactgaagtatatcaagctcatcaagcgcattatcaatgaggaaggctactccattaacgataaaaaattccgcatccagttcaagaatcagcggcaggtggtcactggcctcatagtcaattcccgagtgaaggccaataaacagatcttcaatgagcttgacaaagccatctacttcatcaagaggtatggcatccaggatcatatggcacacgaaaacatcaacagatctgcatataaggagcatttatacggcctggcctactttatcaatatgatcgataggacacaaggcaagtactacattgaacaactaaacagcattgaatggctgtattga

SEQ ID NO: 9975 - RNA, 1008 nt, unidentified
  source 1..1008: mol_type = other RNA; note = synthetic construct
atgtcaaactacatcgagaaactaaaaaagcgaatgctgcagcaagaacttccaaacgattatatagaagagtgcatcagctacgcgactaagctcctgaataagggattacccgttatttttgacagcgaacatttcgctaaacttgtgggaattaactatgaggatctgcggaaactcaccataagcgataattacaaagaagtgaagatcccgaaaaaaaatggcattaggaccctgctcatccctaatcaagatctgatgttcgtccagaagtggatgcttgtcaatctcatttccaaggtgaaaatttcaaagcactctagaggtttcatcaagaatacctccctggtggataacgccaagcatcacgtcaaaaaagagtatgtcatcaccttagacatcaagaacttcttttcaagtatccacaacgtggtggtttatcgtattttccggtctttaggatatacaaaagaactgagcggcctgttcactaaacttctggtgactaaagatggcttgcctcaaggtgctcccacgagcccttacctttctcacatagtatgcaagaagctggaccgcaagatattcatagaactgaagtccctgaagaattgtgactttacgaggtatgcagacgatattacaatcagtggggagtacgatattaccgagaagattgagaatatcattgggatcatcgagagtctcgggtttgagatcaatctaaagaagaagaggcatcagctcagatctcagcagcagatggttacagggttggtagtcaacgacaaggtgaacattccaaagtcctatatacgcaaattgaagcaggaaatttactactgtaagaaatacggcgtgaattcccacatgaacaagacaaacattaacaattcgaactacaagctgttcctgtttggaaaagcctactacatcaaaatgatcaacaaagacctcggcgagaagtttttgaaagaattggacgagatcgactggccctattga

SEQ ID NO: 9976 - RNA, 1008 nt, unidentified
  source 1..1008: mol_type = other RNA; note = synthetic construct
atgcacgattatctgatcaaactgaagagtgcaatgcagtcgcaggggtgcccccccaactatataaatgattgtaccaagtacgcaagcaagctgttaaacaaaggtctgcccgtcatttttgatcgggaacacttttctcgcctgattggattcaaactggaggagttggaagaactgctcaagaaggacaactaccgtgttgtcaagattcccaaaaaagacgggcacagggatctgtacattcctaacccaagactgaaattgatacagaagtggatgctgatgaatcttatcagcaaggtcaaaatttccaaacatgccaggggcttcatcacagataccagccttgttgacaacgctatcgagcacgtgaataaggacttcgtggtgagcttagacatccgcgactttttccctagcattaataagtaccgcgtgtatcggatattccgatcactgggctattgtaatgatttggcgggaatttttaccgcattactcgtgactaataatggcctcccacaaggcgcccctacttccccttatctgagtcacatcgtatgcaaaaagcttgactctagaatatcaaaggagcttaaacatttcgaggggtgttcctttacgaggtacgccgacgatttttcaatttctggcggcaatgaaattttggagaagatcagcaacatcatatacattatctcctctgagggatttgaactaaacttctcgaaaacaaggatccagagtaatagtcaaaagcagctcgtgacagggctcgttgtgaatgaaaaggtaaacgtgccaagctcatacaaacgaagattgaagcaggagatctattattgcaaaaaatacggggtcaactctcatatgaaacggctcggaatcaataaatccaactacaagctgtacctttacggtaaggcttactatatcaagatgatcaaccagaagctaggtgagaagttcctctccgagctgaacgaaattgactggccgtattga

SEQ ID NO: 9977 - RNA, 1092 nt, unidentified
  source 1..1092: mol_type = other RNA; note = synthetic construct
atggttctcaatctcagctttgtttttttctgcaacaatccactcctttgctgccttaagagttcactcggcagcgggactatgtctgagtatctcgattcgcttcgaggtaaaatggtaagcaccgggtacagcacagagtacatagagctgtgtataaagtatgcgaatgacctggagaacaacaatgtcccagtgattttcgacaaggctcattttctgctgttaactggcctgaaaacgtccgaattgcgcaacatcctgacaaacaagcccgagcattaccacgagtttgagctgttggtgaactatagacttcggaacattttggcacccaatcctctgctaaaacaggttcagaagtggatccaggtgttcatattaaagcccctgaaggtgtcttcctgggccactgcctacaagccggggacaagtataattaagaacgcaaaggtgcacgttaaacaagattgtgtcattaatctcgatctgaagaatttcttcgactcaatcactagcgtccgcgtacataagatttttcgctcagccggatatacaaaagaactagccaccttgttcacacaaatctgcaccctggaaaagtgtttaccccagggcgctcctacttctccttacctgagcaacttgatctgtcggaatcttgatcaggacctggccatcttctgccagtctagggcaattagatttaccaggtatgctgatgacatgaccttttccggaggcgtggagatcgaaaactacattccaaatatcagaaagaccatcaccaaacacggctttgtgattaatgaagataagtcacaggtcctgttcagaaatcaaaggcaggtcgtgacgggacttgtggtaaacgacaaggtcgctatcaaaaaagaattcatccgaaagctcagtcaggaaatacactactgtctgcgtttcggtgtgtccaaccatattctgaattcccggatcaacaaaagtaactacaaagaccacctatttgggcgggtgtattatatcaggatggtgaataaacctctcggagacatcttgctcaaaaaactggagtctattgattgggagtactga

SEQ ID NO: 9978 - RNA, 1011 nt, unidentified
  source 1..1011: mol_type = other RNA; note = synthetic construct
atgtcggagtatacagataatttacggaagtccatgctggaacttggcaattccaacgactacattgaactgtgcattaactacgcccggaaattagagaaatctcacgtgccgattatatttgataagatccactttctcgtcctcactgagctgaagtccagtcagctaaatgatttcttgaacaatagggccggttactacagggaattcgagttgatcataaataaccgaaaacgcgaaattcacgcccccaataatatcctgaaggagttacagaagtggatacagttgtatatcctgaagcccctgagggttagcgactgggctacagcttatatccctgggacctccatcattaaaaacgccgcaatccatatcggccaggaatgtgtggtgaacctggacctgaagaacttcttcaactctattagcgccgttaaagtccatagggtatttagagtcgctggatacactaaggagctggctaccctattcacgaaaatatgcacggtgaataattgcctccctcaaggggcaccaaccagcccctacctttctaatctggtgtgcattaagctggaccaagaacttgcggatttttgtcaatcactgggtattcggtttacaagatacgcagatgatatgactttcagcgggggcaaagagatcgtgaaagtgctcccacagatttataagattatctccaaacagggtttccttatcaacaatgacaagaccaagatattgaattgtggacaacgccaggaagtcaccggacttgtggtaaacgacaaggtgagtgttaaaaaagagtttatccgtaagctctctcaggagatccatttctgtttgagattcggcgttagcaaccacatcctacgcacaggcatccgaaaatcaaactataaggaccacctgtttgggagagcctactttattaacatggtcgacaaatcactcggagacgatctcctgaagaagctgcagagtattgattgggagtattga

SEQ ID NO: 9979 - RNA, 1023 nt, unidentified
  source 1..1023: mol_type = other RNA; note = synthetic construct
atgagcaattctctgaattatctgattctgttggaagagcaaatggtacaggaacaatacccgactgacgatatccaactcgtcaaactctacgcacagagactcatttccaactccgtggccgtgatcttcgacttcgatcacctttgctatctcctggagtgtagccctgaggatatgcgctcctatatgtacaacaaggaatacaactatcacagttttgagatccctaaaaagagtggtggcactagacagctagaggccccaagttaccccttgaaaatgattcaacgttggattctggatcatatcacatgtcaggtgccaatctctagccacgctttcggcttccgaaaaaagaggagtatattggacaatgctaaaatacacgaaggccaggagtgtattgtgaacatcgacattgctaacttttttccctccataaaggggatccagatttacaagctgtacagatatctcggatacaccaagcaggtcgcttcaattctgaccacactgtgcaccaaggacgactgtcttcctcagggagccccaacctccccttacctgtcaaatatcgtgtgcaagaagctggataagcggatctctgggttagcaaatgcgataggggcaaaatatagccgatatgccgacgacatcacattaagcggatcttcgtcaatcactaattacatcggaaccctgaagaaaatccttacagacgaaggctttatcattaactacaagaagctccggattcagtttaataatcagaaacagatggtgacgggcttagttgtcaaccagaaggtaaatgttcccaacgagatgattcgcagcctcaggcaagagatctactattgcaaaaaatacggcgttaacggtcatatgcggcagaggaacatacgcaactcaaattataaggaacatctgtatgggaaagcctacttcataaaaatgattaaccccgatctaggtcttgatatgatcaggcagttggatcagattctgtgggagtattga

SEQ ID NO: 9980 - RNA, 972 nt, unidentified
  source 1..972: mol_type = other RNA; note = synthetic construct
atgtacaagcagaactgtaacagccagtatattaaactggtgatcgattatgccgaaaatctgttgaagaacaatgtcgaggtgatatatgacctagaccacattagcctgctcactaacaaatctatcggagactttctcgacatcaataactactacaaggagattcaaatcagtaaaaggaacggggagacacgcactctggctattccggatgacaatcttaagtccgtacagaagtggatattgaaatcaattctggagaagatgcccatatcaaactcagccaaaggttttaagaaaggcttgagtatcgtcgagaacgcaaagccccatacgaacaaagattgcgtactcagcctggacctgaaagacttttttccatcgatcacccagggaagtgtttatttcatcttcaaggagattggctatacagaggaagtcagcaggttgctgaccagactgtgcacataccaaggacagctgcctcaaggggcacctacttctccctatattgcaaacctggtctgccggaaactcgatattaaattacaggagttcgcttgcaatcaaaatatagcctataccagatacgcggacgatctaaccttctctgctaacaaggaactcagcgagtatatcccacgcatcaaagagattgtgatcatccagggttttaaggttaacgactctaaaaccaggtgtcgataccgacaccagcgtcagcttgtgacaggcttagtggttaataatgaaaaggtgtccatacctcgggaactgaagcggaagttaagacaggaaatccactattgtaaaaagttcggcgtccatgggcatctttattgggggattaagtactactccaattacaaggattaccttctcggcatggccctgtacgtgaagatggtggataaaaatctcggaaaaaagctgcttgaggaaatcaagtccatcaattgggaatactga

SEQ ID NO: 9981 - RNA, 1065 nt, unidentified
  source 1..1065: mol_type = other RNA; note = synthetic construct
atgtggctcatcaaggattttctcgtgggttcccccctgataggagttgaaaacatggacaattacctggagaaactggaacgagagatgaggaacagaaatttcgatctcgagtacataaacctgctgaaggactatgctaaaaggctactggatcacaaagttgcggtcattttcgatcaagaacatttcagcctgctcacagaggtccctgtagacaccattaaagcccttctgaataacttcaattcatacaacgagatccagattcccaagaaaaatggtgggaataggaccttgttaattccgaacgaggagcttaaatcaatccaacgatggatcttgaacaacattctgaactctattccaattagtgattacgccaaaggttttaagaaagggctgagtatagttaagaatgccgaggtgcacaccaataaggagtgtctacttaacattgacctcacagacttcttcagcagcattgagagccagcgcgtgtataaagcttttcgttatatcgggtacactaaggaaatctcagctatgctatcccggctgtgtacctataacaattttttaccccaggggagtccaacctctccatacctcgcaaacatcatatgcaaaaagatggacaaaaggctcttttccctttgcaaggataaaggcatcgactacacgcgctatgcagatgacttaacattttccggagatattaagctcagcaagtacctgcctattatctctgaaatcgtagaagacgagggctttcagatcaacactaccaagactcggatttcgtatcagcaccatcggcaggtggtgactggattgacggtcaataagggattgaatatccctcgcgatatgaagaaaaagctgtctcaagagatctatttctgcaagaagtacggagtgcagggccacctggctcagacaggccagacatattccaattataagcattacttgctgggcaaggcctacttcataaagatggtgaacaaagaacttggcgaaaaattcatcagaagaatcgccgaaatagcatgggactactga

SEQ ID NO: 9982 - RNA, 1008 nt, unidentified
  source 1..1008: mol_type = other RNA; note = synthetic construct
atgaacttgctgagtctggaaaaggaaatgattaagcagaattacgacaaggagtatatcaacattgttaaagtctacgctcatagactggtcgagaataacattccgatcatattcaactttgagcacctttgctttctgactaactactctacagaaaagctcaggtacttcatccataataatcagagcctgtataaggagatagagattgagaagaaaagtggcaacacgcggttaatttccatcccaaataacgaactaaaggtgatccagcgctggatcctggacgaaatcctgagcaaaattcctctgagccctcatgctaagggcttccgcaaaggacaaagcatcataaacaatgcacaactgcacaccaacaaagagtgcgtgatgaatctggacattcaggatttttttgggtccgtgactcagaagcaggtgtacaagatctttagatatgttgggtataccaaacaggttagttccattctctcactgctgtgtacgaaagatggcgtattgccacaaggcgcccccacttcaccctacattgcgaatctcgtgtgcaaaaaattagacaagcgtatatctaacctcttcataaacaagcccattaattacacacggtatgccgatgatattactgtctccggagaagcaaccattaaggactacctccctatcctaattaagatcatcaccgatgaaggcttcgaaatcaacacaaacaaaacacgaatccaatattcgtacaataggcagatcgtcaccggtcttgtggtgaaccagaagatcaatgtcccaaaaaagatgataaagcagttgcggcttgagatctactattgtaaaaagtatggtgtagccgggcacattgataaaaggcatatagagtactctaactacaaacaccacctttttgggaaggcctattatatcaaaatggtgaaccccaagttgggacagaagttcctcaatgagttaaatgagatcaattgggactactga

SEQ ID NO: 9983 - RNA, 1008 nt, unidentified
  source 1..1008: mol_type = other RNA; note = synthetic construct
atgaacattgacaccctgaaaaaaatgatggagaatgagcaactgtcagaggactatataaatctgtgcgtgacctatgctcgttccctggaggataaaggacttcccataatctttgactccattcatctggctaaactgatagggatcggaaccaaggagctatatagctattatgaactcgcgcaaacactgtacagcactgccgttatccccaagaaaacgggcgggtcccggaaactgaacgcaccatcagaaaacctgaaatacattcagaaatggatcgtagagaatgtgttgtaccgactcgatacatctaaggtggccacaggctttgtaccccagaaaagtatagtggataatgccaagcctcacgtgggaaaggagtgtgtgattaacctcgacctgaaggacttctttcccagcattaagtacgtgtggatctataatctgttcatcagcttaggttatactagacacctgagcatgctctttaccggcatttgcacgcttaataacgaattaccacaaggcgccccgtcctcaccatatttgtctaacctcatatgcgagaaattagactctaggctgagtagtcttgctgaaaacatgggcgcatcttatacccggtacgcagatgaccttaccttcagcggagacaaggaaattaccaagtacattaagctgatcaagagggtgatcaaggaagaaaaatttgagctgaacgagaagaaggttcgcgtgagattctcctaccaccagcaaatggtcacaggtctaattgttaatgagaaactctctgtccctcagaagacaaagaaatacttgcgccagcagatctactacgctaagaaatatggagtctcctcgtcattgcagaaacagggcgtcactaagagtaactacaatggtcatcttttcgggttggcctacttcatcaagatggtcgaacctgattgtgggactaagtttatcgaagagctcaagcagatcgattgggagacttga

SEQ ID NO: 9984 - RNA, 1008 nt, unidentified
  source 1..1008: mol_type = other RNA; note = synthetic construct
atgaaaatcgacacactcaagaccaagatggaggatgaacagttcagtgaagattacattaacctgtgcgtgtcttacgccaggaacctcgaggaaaagggactgccaattattttcgattccatccacctggcaaaactcattggtattgagacgaaagaattgtattcgtactacgagcttgcccaaatcctttatcgcactgcggtgatccccaaaaaaacaggcgggagtaggaaactgaatgctccaagcgagaatctcaagtatattcagaaatgggtggttgagaacgttctgtatagactggacacttccaaggtagcaaccggattcgtgccccagaagtctattatcgacaatgctaagcctcacgtgggcaaggagtgtgttatcaatctagatctgaaggactttttcccttccataaaatatatctgggtgtacaacttgttcaagaacttaggctacacacggcatctgagcatgctgtttaccggcatttgcaccctgaacaacgagttaccgcagggggcaccctctagcccttatctatccaatctcatatgtgaaaagctggatagccgcctctcaggacttgccgaacacatcggcgcttcctatacccgatacgccgatgacctgactttttctggtagtaaagatatcgtgaagtacatcaagctgataaagagagtcatcaccgaggagaagtttgagcttaacgagaaaaaagtcagagtccggtttagctaccatcagcaaatggtgactggcctgattgttaatgacaaattgtcagtgccccaaaagacgaagaagtacttgcgtcagcagatttactacgctaagaaatatggtgtatcttcatcattggagaaacagggagtcacaaagagcaattataatgggcatctttatggactcgcctacttcataaaaatggtcgaaccagacagtgggacagagtttatcgaagaattaaagcagatcgactgggaaacttga

SEQ ID NO: 9985 - RNA, 1008 nt, unidentified
  source 1..1008: mol_type = other RNA; note = synthetic construct
atggacatcaagtcacttgccgccgagatgatgaaaaagaactacgacaaagagtatatcgatctgtgcataagctatgccataaacctcgagaagaacggcatgcccattatttttgactctatccacttggccaaactgataggcattgagacaaaagagctgtattcatactacgagtttgccccaaggttgtataaggtcgcggtcgtgccaaagaaatccggggaaaaacgctttcttgatctgccaagtgagaacctgaaatacatccagaagtggattctcgagaacatcttgtataagatcaaagtgagcgactatgccactggattcgtgcctcaaaaatctattgtggataatgcaaagccccacatagacaaggaatgcgtcgtgaatctggacctccaggattttttccccaacatcaagtatatctgggtgtacaacctgttttacaacatcggatacacaaagcacctctcaatgatttttgccggtatttgtactctggaaaataaactccctcaaggcgcacccagctctccttacatcagtaatctgatctgtcacggcttagatacgaggttatccgatttagcgattcacatcggcgctcagtatacccggtacgctgacgatataaccttcagcgggaataaagagattgcaaagtatatatccctgatcaaacgtatcatcaaggaagagcatttcattgtaaatgagagaaaggtgcgagtgcagttcaagcatcatcagcaaattgtcaccggtcttgttgttaacactaagctctcggttccgaagaagaccaaaaaatacctaagacagcagatccattacgctaagaaatatggggtaaatgactctcttattcagcaggggatcaataagagcaactacattgatcacctgtatggattggcttacttcattaaaatggtcgaagaaaagtgcggatccgaattcatcgaagacctagatacactggactgggagagttga

SEQ ID NO: 9986 - RNA, 981 nt, unidentified
  source 1..981: mol_type = other RNA; note = synthetic construct
atggtcgaggagcagttcagcgaagagtatataaagctttgtgtgacttacgccactaacttgatcgagaatggtctgcctataatttttgacgctcgccacttgtcatgcctgataggaatcgataccaaagaactctattcctactatcagctggcgagtaccctctacagaaaagctgtgattccaaaaaaatctggagggtcgaggaccattaatgccccctcagaaaatctaaagtatattcagcgatggatcctagagaacatcctgtataagatcaactccagtcaggaagccactgggttcgtaccacagaagaatatcgtcgacaacgcatcttaccatgtaggcaaagaatgcgtgatcaatcttgatatgaaagatttcttcccatcaatctcttttgtccaagtgtataacttgtttaaccggtctggctacacaaaacacctgtcaatgatactgacgggtctgtgcatgtataataatgagctgcctcagggtgctcctagctccccgtacatcagtaaccttgtctgtaagaatttagacctgcgtctctccaagttggcctcccaaataggggcaaagtataccagatacgcagatgacatcacatttagcggagagaaagtgattgtgaagtacattaagctcatcaagagggttatcaaagaggagaacttcaacattaatcacaagaaagtgagagtgcaattcagctaccatcagcaaatggtgacaggcctcgttgttaacgaaaagattcggattccccccaaaacaaagaagtatcttaggcagcagatttactacgctaagaaatacggcgttacgagcagcctgtctaaacagggccagaccaaggccaactataagggccacttatttgggctggcccattttatcaagatggtcgagcaggaatacggagataatttcatccgcgaactcaaagagattgactgggagagttga

SEQ ID NO: 9987 - RNA, 1008 nt, unidentified
  source 1..1008: mol_type = other RNA; note = synthetic construct
atggacattaataagctgaagaacaacatgctaactgaggagtatgataaagagtacatcgacctgtgtatcagttatgcctacaatctggagaagaacggctttccagttattttcgacagtacacatttggctatgctgattggaatcaaagtgaaggagctttactcctattacgagctggcacagtctctgtacaagaagattatcatacctaagaagacaggcggtaacaggattctgaatgccccctgtgaaaacctcaagtatatccaaaagtggatactagataacatcctgaacaatagcgagagccttgacgtttctaccggattcgtgcaagggaaatctatcgtggataatgccaaacagcatattggtaaagaatgcgttattaacttggacatcaaaaacttcttcccgtctatcagatacatccaaatctacaacatctttcgctcgttcggctataccagacacctctgcatggtgtttactggtctttgtacgtacaaaaatgtactccctcagggagcaccaacatcacctctcctctccaaccttgtatgcaaacgcctcgatactaaattactggatctggctaatcacattggcgcatcctacactaggtacgccgacgacattacattttcaggggaaaaggtcataaccaagtacatcaagttaataaagcgggtgattaaggaagagtatttccaggtaaatgagaaaaaggtgcgggtgcagtttaaacaccaccgtcagatggtcacggggctggtcgttaataccaagttgtccgtgcccaaaaagaccaaacgatatttgaggcagcagatctactatgcgaagaaatacggggtcaacaatagtttagaccggcaagaagtgagcaagagcaattatgagggacatctctttggcctggcttatttcataaaaatggtcgagcccaaaaacggcgtggaattcatcgaacagctgaagcagattgattgggaatcatga

SEQ ID NO: 9988 - RNA, 1008 nt, unidentified
  source 1..1008: mol_type = other RNA; note = synthetic construct
atggacatcatcaaactggagcagtcaatgcgacttgaaggccatagggccgactatattaagctctgcaaggactacgcgatcaatctgaaacggaatgaactccctgtcatttttaacatcgaacatttggctaaactgattggaattaacgccgacgagtgctatgcatactaccaactatcctctaacttgtataacgagctcttgatccccaaacgcacagggggacaacgcgttatcaacgcaccaagcgagaatttaaaatatatacagcggtggatactcgacaatatattgtcaaacgtttcgattagcgtccatgctaatggtttcattaatgagcggagtatcgtgactaacgctatacagcacatcgggaaaaagtgtgtgataaacctggacatcaaggacttcttcccaagcattacctacatccaagtttacaatctcttcaataggctcggctattcaagacatcttagtatggtattcacaggtctgtgtacacttgataacaaattgccccaaggagcccctacgtccccctacctgtctaacatcatttgcaaaaatctcgatgatagactgagcctgttagctagtcacattaacgccagctactccagatacgcagatgacatcactttttccggcgatagagggattacctcttatatcaagctgatcaagaaggtagtccaggaagagcgttttcttataaacgagaaaaaagtgcgagtgcagtttcagtaccacaggcagatggtgacaggtttaattgtgaacgaaaagctgtccattccgaagaagacccgcaattacctgaggcaggaaatctattactgtcagaaatatggggtcaaggatcacatgagcaaaaagggcctttacaagactaattatcagggccacctgaccggactagcccagtttattaagatggtggattctaagctgggcgaggaatatctgaagtccctggacaagatcgattgggagtcatga

SEQ ID NO: 9989 - RNA, 1137 nt, unidentified
  source 1..1137: mol_type = other RNA; note = synthetic construct
atgacactgtttaggagagctttaaacaaagtgataccgcagcgccgcagcttttggggaatgcgtaagaagaagccatctagtgtagtcaattggaaagagcccgtcgagaacattttagaacgaaaaatggatctgcagaagttatacgaggaattgcagaatggcaatcatgacgaagactatactgagctctgcattaactacgcccggactcttctaaacaacggcatgagtgtgatattcgacaccgatcatctatcgaagctcattggaattagctcccacgagctgtactcttattatttgtttgccaacaatctctacaccgaagttaagctccctaaaaagaatggatctttccgcacaatcaatgctccctctgagaacctgaagtacatccaaaagtggatcctcgacaacattctttacaacaagaactgtagccactttgcaaatggctttatcaaggacaagtcaattgtcgataacgccaggccacacgtcggcaagccttgcgtgattaatttggatatcaaagacttcttccctaccatcaagtacatagacatctacaaacttttcaagggcttcggctatacatcccatctgagtatggtactgactggactgagtacgtataataatgtgcttcctcaaggggccccaacgtccccctatctgagcaatttgatctgtagaaatctggatgtcaaattcgaaagcctcgcgaaccggatctccgcttcatacaccagatatgccgacgatatcaccttctctggagagaaaagcattactaagtacatcgcacttataaaatccatcatcaagtccgaagggttcaccatcaatgaaaagaaagttagggttcagtatcagtaccacaaacagatggtgactggtctgattgtgaatgagaaactgtcagtgccaaaatcaacaaaaatgtacctgcggcagcagatttatttttctattaagtacggggtgacaaacaacttggagcgacagaacattaataagtcgaactacaaagatcacctctacggtatcgcatattttataaagatggttgaacccctggtgggtgagcaatatatcaaacaactgaacgggatagactgggagagctga

SEQ ID NO: 9990 - RNA, 1014 nt, unidentified
  source 1..1014: mol_type = other RNA; note = synthetic construct
atgaacaattatatatctacgctgactgacaggatgattaaggaagggtatgagactgattatattaaaacggtcgtaggatactctgaacgactgatgcagaaagatctgccagtgatattcgacctggcgcatctggctctgtaccttgatgaatccgaagagacactatccgaaatggttaataacagcaccagcttctactccaaggccaaaatcaaatctaaaaagggtaaggtgcggaacatttatatcccttacgagaagcttaagaaaattcagatttggatcctctacaagatcctgtataaagtagaaacacccaagtgtgtaaaaggatttaaattaggcagttccatcgtcgacaatgccattccgcatgttaataaaaactacgtgttgaatctcgactttaaaaacttctttgagacaatcaaggagaaacagatcatcaccgttttcaccagcttggggtacaacaagatcgtgtctagtgccctgtcaaagatctgtaactacaacggaagtttgccccaagggtccccctcttcaccatacctttccaatctggtctgccggaacttggacaataagataatcgagctgattaagttcgaggatgtgacatatactagatacgctgatgacctgactttttcatcaaaccaaaagcttgactctctgatacctcttctcgaagagctcattgtgagcgaaaaattcaagataaacgaaagtaagacccgcatgcaactcaaaaatcagcgccagttggtgaccggcctggttgtcaatagccaggtcagtgtgcctcgtaaatatatcagggagctaaggtcagagatttactattgcaagaagtatggcgtgagcggccacatggacagaaagggcattctgtacagcaattacaagctccacctctatggtaaagcactgtacatcaagatggtggataaatccaaaggggagtcgtttttaaaggagttagataagatcaactggcagtattga

SEQ ID NO: 9991 - RNA, 1014 nt, unidentified
  source 1..1014: mol_type = other RNA; note = synthetic construct
atgtcccaactggaagagttgaaaaagctggacatacctgtgttctgcaacctggaagaactccgcgagaacatcggaactaacaagaagttcttctacaaagtactctattctcacaacaagctttataaggaaatcactattcccaagcgcaatggagggaaccgggtgctcaacgtgccaaatatcgcattaaagagcatgcagcgatggatcctggacaatatactgtataaagtgcagagtgatccatcagcgaccggcttcatgcctatgaaatccattgtcctaaatgctagcatccatctgaagaagaagtacatattgaagatggatatcaaggactttttccctagtattgatttccgtaaagtgcgcagccttttttttgaactgggctacaataaagacgtggccacggctttagccaatatctgcgtgtttaggggacagctgccgcaaggtgccccaacatccccctacttggctaatctggtctgtagagagcttgataagaggattgacaatctctgtaggaaatatcgtctctcatatacccggtacgcagacgatattaccatttcgggaaatagtaagatcttctggattaagggtatagtcgaagaaataattaggtcataccagttttccctcaacaacgagaaaaccatctttttaaaacccggggaccggaaacgagttactgggattatcgtaaacgagaaacttagcgtccccagaagcgttaccagaaacttgcggaaagagatctactttatcaagaaattcggcctggaggagcacctagataagaattccttcaccggcagcaaagaacagtacatcgcccacctgtatggggttgcctcatatattaagatggtggagctgacaaagggcattttcttcattaaccagctgaactctatcttttctgggaacgagcagctggaaacaggcaaaaatctccatatagagtttgcatctatcgactggacaatctttggtgagtga

SEQ ID NO: 9992 - RNA, 1023 nt, unidentified
  source 1..1023: mol_type = other RNA; note = synthetic construct
atgtcagagaagatcaatctaactgtcctttcaattgagagtattacctcccttgaagatctccgcaagaaaatgggggtgaagaaaaagtatttctaccgggtgttgttcagccacgataagttttacagggagatcgaggtgcctaagcggaaatctggtcaattcagaaagctgagtgttccatctatggcgctgaagaatatgcagaggtggatactggacagtattctgtacaaaatcagcgtgaatgaaaatgcaatggggtttgtgccctcaaagagcatagttactaacgcttacaaccatcttgccaagaaatatatcctcaagctggatatcaaagattttttcccttctatcggatttggaaaggtgttggacattttccaaaagctcgacttcccggcagaaatctctagtgctctggccaacatctgcatctacaaggacgagttacctcagggcgcccccacatccccatacctcgctaacatcatttgtaaacagatggacttcagaataggcagcctctgtaagaaatacgagttgaattatacgcgatatgccgatgacattactattagcggcgacaggcgcgttttttggatcgagaaacagattgagaagatcgtaaattcatgccatttcacactgaacaaagaaaaaaccgtccggcttaaacccggggataggaagcgcgtaaccggaataattgtcaatgaaaagatctctgtgcccaaaaatataaagcgtaccttacgacagaacatctactacatcgaaaagtatgggctggagagccatctggacaaaattcagtttacaggcttgtccaaccagtatataagacacctctatggcatggcatcctttattcagatggtggagattgaacggggtattgaatttatcgataagctgaactccttattcaaccaaaaaaacgatacagactaccagattagcgaggatgatctactgtcgttcgaccacatcgactggtccatcctggacatatga

SEQ ID NO: 9993 - RNA, 1026 nt, unidentified
  source 1..1026: mol_type = other RNA; note = synthetic construct
atgaggcacctcgatttttcgttttctaatgaaaacatcccagttttctcgagcttggaggaccttcgcaaaaagatgggcattagcactgcttttttctataaggctatattcgcgagcgacttcttttataaggagatcttgattcccaagcgcaaggtggggaaatttcgaaccctgaaagttccacccgtatttcttaagaatatgcagcgatggattcttgacaatatcctgtatttcatcagctgtcatagaaatgcaaccggttttatacctaacaaatctatcgtggacaatgcactggtgcatgtcaggaagaagtacatcttaaagatggacatcgaagatttcttcccatctattaacttctacctagtgcgggaagtattcattaaaatgcactactccaaagtgatctcaaatgccctggcctcattgtgtatctgcgaagggcagctccctcaaggcgctcccaccagtccatatatcgcaaatctagtgttcatcgacattgatattcgcattagccagttatgcctcaaacataacctgaactattccagatacgccgatgatataactatttccgggagttccaatatcttttgggtgcggaaagttgtcgaaaagatcctgaaggagaagaagttcaaggtgaacaaggataagactgttattatcaaacctggcgataaaaagcaggtcacgggcctgatagtcaatgatcagctctcagtgcctaaaagcacaatccgggagctgcgtaagaacatctactacattaaggagtttggaattgacagtcacctcaacaaaataaagtacgagtatgccaaggaaaaatacattgactccctgtatggaacagcctctttcataaaaatgatctcaccggaaaaaggaatcaacttctttaacgagctgaactctatcttcagaaggggtaaccagtacaattccgagcagatagaacccagttttattgactttagcgagacacaatggaccgtcttcgagaattga

SEQ ID NO: 9994 - RNA, 1218 nt, unidentified
  source 1..1218: mol_type = other RNA; note = synthetic construct
atggacgaatctagctatttgtccattaatggatacaagtacctgagtctttatgaagccccactgcccataacacgggcaaagttctgtaaatttcttccatggggtgtcctactgcgaggaggcccccaaccccattgtcccaccggaaagggtttctataaagtgaagctggtgctggtgactcaaaaacgctttaatatgatcaagttcgacaagatcatctctctcgacatccccgtgttcctcaccttagaagccctgcgcaagaacatcgacattgacaagaaatacttttaccgcactctcttttatcgcaacaatctatacaagtccatccagattcttaagaagaacggcagcgattataggcagattaatgcacctatcttacccctgaagaggatacagcggtggatcctggagaacatcctctataaaataccaattgaggattgtgcccacggctttgttagggggaaatcaataattaccaatgcttatccacacgtcaactctaagtacatcttgaaaatggacattgtggatttctttccttctatccactttggcttgatcaagaaattcttctacgatttaggatactctaacacgatagcatgtgccctggcgaacctatgcaccttcaattcgcagctgcctcaaggtgctccgacgagtccgtatcttgctaatattatctgcattgagatggacaaacgtatccaggggctctgcaaaaaaaacagactgaaatacacacggtatgccgatgatataacaatatccggcaactcaaatgtattttggatcaaggacattgttgaaaagatcgtgaactgctacgggtttcagattaatcagaataaaaccgtggtcatcaagccaggagacaggaagaaggtgactggcattattgtcaacgagaaattgtccgtccctaaaagcatcgttagaaaattgcgacaggacatctactacattaaaacctttgatctggagagccatatggaaagaatcagtttcactgggacaaagcaacagtacatttcacagctttacggggtggccagctttattaagatggtagacatagacaagggcctgtattttatcagtacactggatagcatcttcaagcctttctcaccttccattgctgaggttgatctcgagctcgatgattatttcgacaatctcttcaacgacctgttctga

SEQ ID NO: 9995 - RNA, 999 nt, unidentified
  source 1..999: mol_type = other RNA; note = synthetic construct
atgaagtataaagtagaagtgtttcctgcgattgattctattgaggatctgcggaacatgatcggtgtgcagagcaattatttctataagtgcctctactccaacgaatacttctataagaccgttaagatacccaagagaaggaatgacgaatacagagagcttacaattccaaccatggctttgaagaatattcagcgttggatactggacaatatcctctacaaatttagcgttcatccatgtgcaaaagggtttgtacctggaaagtcaatcattgataatgctatcccacacattaacaaaaagtacgtggtcaaaatggacgtgaaaaattttttccccagtatctcgtttaaggatgttaggatcctgtttttgaacctggggtacaaaatcgaggtcgcaattgctctggccaatctatgtacctacaagaacacattacctcaaggttcacccacctctccctatatagccaacctgatcttctacaagatcgacaaaagaatatccggcttttgcaataagaacaaccttacttatacgcggtatgccgacgatattactatctcaggaaagtccaacatctctttctccattaagattatcaaccagatcctgacacagaaccgatttgagctcaacgacaaaaaaacaaaagtgctcaagccgggcgatcgcaaaatcgtcactggcattatcgtgaatgaaaaactgaccattcctaaagatttcatacgcaatgtcaagagggatttgtattacattaaccggttcggcttgttaaatcaccttaacttcatcagcatcgccgaggacaatagtgaatactatctgaacagcctttctggcaagattagtttcattaagatggtggactacaaacagggatacatactccaaaatgagctagacaacattatcgggtataatgacaagcatgaggaaaagtacatcgatctggaggatatagacatcaagtgggagaaactgtga

SEQ ID NO: 9996 - RNA, 942 nt, unidentified
  source 1..942: mol_type = other RNA; note = synthetic construct
atgataggcattaagtccgattatttttacaagtgcctgtatagcaatgagtacttttacaagactgtcaaagtgccaaagaaacgcaatgatggttacagagagctgacaatccctaccatggcattgaagtctatacaacgatggatccttgacaatattctttacaactttcccgtgcatcattgtgctaagggcttcattcccgggaaaagtattattgataatgctatccctcacatcaataagaaatacatcgctaagatggacattaaaaacttctttccttcaatctctctgaaggacgttataatgctgtatctgaatttgggctataattataaggtcgcaaccgcccttgcgaatctttgcacttacaaaaatcagctcccccagggatcgcctacttctccgtacattgccaacttaatcttcttcaaaatcgataagcggatttttgggttctgtaaaaaaaactacctcacgtatacaaggtatgccgacgatatcacaatcagcggccgtacaaacattgcctttagcatcaagataatcaaccagattctcaaccagaataaatttgagctgaacgacaaaaagaccaagattctgaaacccggtgatcgcaagatcatcaccggaattatcgtgaatgagaaactgaccgtaccaaaagatttcataaggaatgtgaagaaggacatttactatatcaagaagttcggcctagcctcccacctaaacttcatagatttcccaatcgaaaacagtgaatattacctcgactccctgtatggaaggatcagcttcataaagatgattgactacaagctggggaacatgttacaaaacaagttgaacaacttcatcgactactcaaaacggagagaggaaaaatatattgatctcgaagacatcgacattaagtggaaaaaactgtga

SEQ ID NO: 9997 - RNA, 996 nt, unidentified
  source 1..996: mol_type = other RNA; note = synthetic construct
atggtcaacaagacctatttggcaataaactcactcgaggagctgcgaaacatgatcggcattaaaagcgactatttctataagtgtctctatgtgaacgaccacttttacaatgtcattaagattcctaagcgcaaaaaagacgagtacagagaactgatgatcccaaacatggcattgaaaaatatccagaggtggatactcgataatgtcctttatagacgccaggttcataaatgtgccacgggatttgtgccacgcaagagcatagtcaataacgctattcctcatgtgggtcaaaagtatatcctgaaaatggacatcgagaatttcttcccttccattacctttaagcaggtgcgtaaaatcttttccgaaatgggctacaaatttgagctggccaccgctttggctaacttatgcacagtgaacaaccaattaccccagggggccccaacttccccctacatagccaacatcatcttttacaacatcgataaaaggatcttctcttactgccagaagaataatctgagatacacccggtatgcggacgacattacaatttcgggaagtaataaggtatctttcagtaaggagatcattagggaaatagtcaatcagtataacttccggatcaatgagtctaagactatcatgtttaagccgggtgacagaaagaaagttacaggcatcattgacaatgagaaaattagcgtacccaaaactctgattcgggaagtgcgaaagcagatttacttcgttaataaattcgggctggaggaacacctcatacggaataactattcacttgattacgagcagcaattcattatgtcaatctacgggaagatttccttcatcaagatgattgactttaagaaaggagtgagcctgcagaagaagtttaatgaagtgcttggcaacatagaaagttctaacatgtacagggataacatcgatttcgatgatatcgaactacactggatcaattga

SEQ ID NO: 9998 - RNA, 948 nt, unidentified
  source 1..948: mol_type = other RNA; note = synthetic construct
atgaaattaatcgacaatgggctggacgatctttcccgcccggtcttcctctgcacaaaggatatacaacaggccattggaatagaccctaaaatcttttataccttcctcaaccctaagaacatttcctacatcaagatcaagattcctaaacggaaaaaaggtgaatatcgagagctgtctatcccaagtccagcactgaaaaacctccagaggtgggtcttggagcacatactgtactcattcccttgtcatgggtccgcaaacggctttattccgaacaaatcaattgtgacgaatgctatcccccatattagcaaagagtacatcttaaagatggacttaaaggacttcttcccaaatatcacgttttccatggtgaaaaatcagtttttgacaatggggtacaatgaccacgtgagtcactctttggctctgctgtgcacatataatgattctctaccccagggtgcccccagctcaccttatctcgccaatttgctcttctcaccctttgacgagctgatttacactcactgtagcaagaataacctgtcctatactagatatgccgatgacctcaccatcagcggcgggaagtacattctgaatattccacagtatgtgaaagacatactgagggatagtgactttcagatcaacaactctaagactctaattatcaagaagggcgacaagaaacaagtgaccggaatcgttgttaacgagaaaatatccatccccaagaattatctcagagaacttcgtcagataatctattacatcaacaagtatggccttgattctcatctgaagaagattgattacaaaggaagcaagtacaagtacattaacagcctgtacggcaaagcgagctacattaagatggtagatttcaagaaaggaatcaagatcttcaccgaactgaacaaaatctcgcttgattga

SEQ ID NO: 9999 - RNA, 1002 nt, unidentified
  source 1..1002: mol_type = other RNA; note = synthetic construct
atgtcctccgataagaacccactgtccctcaaggaggagtggtccgctgaagacatcaagaaatacagctccatgttgaaacgcaacaatgttccggtgatttttgatacagaacattttcggaggctcttaggactggagaaaaccgacttttacaacattctcttcaagctggagtatcaataccacgaagtcgaaataccaaagaaaaagcaaggggagttgaggacactattccttcccagcattaaactgaagtatatgcagcgatggatactggacaacattctctacagccaagagtgtaataatgaagtgacaggattcgttcccagcaaaagtataattgataatgccaagcctcatattgggcagaaatacatcctgaaacttgatattcaggacttctttccttcaatcagcaagatccgagtttttctgatgtttaagcacttcggatatacgaatgacctgtctaacactctatcaaacatttgcatctacaagaatgagttaccccagggcgccccctcaagtccatatatcgcgaacctcatctgtaagaagatggataatcggtttctcggcttgtgcaagaaaaacaacctgaagtatacccgctatgcagatgacataactatttctggcggaaagtctgtgtataagttcaaacagttcttcatcaacatcgtgaccgacgaaaaattcttcgtcaacaagaaaaaggtgaagcttctgaaaaacggggacagaaaacaggtaaccggtattgtgatcaacgagaaactgtctgtccctaagaatgtgatccgggatctcaggagagacatctactacattactaagtacggcctgaatagtcatctgaaacgtaccggcaatatcgcctcatcgaattataaagctcacctgtttgggaaagctaagtatatatacatggtagacagagagaagggtgccttgtaccttgaacagttagatgcaatcgattgggagacatga

SEQ ID NO: 10000 - RNA, 999 nt, unidentified
  source 1..999: mol_type = other RNA; note = synthetic construct
atgaactcagacgacaaactcagtaaactgaaggaaaactggaccgctatggagatcgaaaactacagctcatctctgaaaaaaaaaggggtaccggtgatctttgacgttgagcatttccgcaggctcctaggcttgagaagcgaggacttttacagtatattgttcaagctcgaataccattatcacaaactcgagatccctaagaaaatcgtggggacttatcggcagctcctgctacccagtatcaaactgaagtatatccagcgatggattcttgataatattttgtacacccaatcctgcattacagaggttacaggttttattcccggaaaatccattgtgaataacgctagacctcaccttaagcagaagtatatcttgaaactggatatcgaggattttttccccagcatagacgagaaacgagtgtttaacttgttcaagaactttggatacacgaaccggctggcaaggaccctttcgcggttctgttcttatgaaaatgaactgccacaaggtgctcccagctctccatacattgccaatctgatatgcagaaagcttgatgcccgtctgactgcactgtgtgccaaatatgccttaaattatacacgctacgcagatgacatcaccatttctggcggaaggatggtgttcaaactgaagaagcacatcatcaacatcatcagcgacgagaacttctccattaataagagcaagattaagctcctcacagccggggatagaaagaaaataaccggaatcatcgtcaatgaaaagttatccgtacctaagaaagtcgtgcgcgaactgaggcaggagatttattacataaagaagttcaacctggagtcacatatgaagaaaactggcaacgtctccaagtcaaattataaggggcacctttttggcattgcgaaatacattttcatgatagacaaggatctgggtacctactacctggataagttaaatggcatcgactgggaatga

SEQ ID NO: 10001 - RNA, 984 nt, unidentified
  source 1..984: mol_type = other RNA; note = synthetic construct
atgaagaaatggaccgatcaggatatcagagagtataggaacaaactggaggctaatggagtgcccgtcatcttcgacctggagcacctgcgtagactcatcggcatcgagaagaagtacttttacaaggtcttctacaaactcgaataccaatatcgcgagattactatccctaaaagaaagccagggcagtttaggatactctcagttccctctcgtaacctgaaacttattcaacggtggatcctagacaacatattgtattgcatagagtgcggcgagattgtaaccggtttcataccactgaagtctatcgccgacaatgcaaaaccgcatacgcagaagaagtacatttataagttcgacctgaaagatttcttccctagtattcctcgcaggaaggtgtactatctctttagaaacctgggttattcatcagatctcagcaatgctttggcgacactttgttgtttcaataactatctaccccagggagctccgacaagcccatatattgccaatatcttatgcggcaaattagaccggcgaatcaactccttttgtcagaagaacaactttacctacacacgctatgcagacgatcttaccatcagcggggacgaaaaactcgtgcactacaagagtctgttccgaaaaattatcaatgacagcggcttctgttttaatgaagataaggccaggctgattcgctgcggtcagcggaagctgattacaggaatagtggtgaacgaaaaagtgactgtacccaggagttatgttcggtcgttgaagaaagaactgtactacatccataaatacgggctgaagggacatttggagcactgcgatattaagactcctccaaatatatactccaaggaaatcattggcaagatcaatttcatctccatggtcgattctaaactgggggaagagtttaagtccttatttaaggacgcccttaaaaagaacaaaattttttga

SEQ ID NO: 10002 - RNA, 960 nt, unidentified
  source 1..960: mol_type = other RNA; note = synthetic construct
atgaactggacagaggagaatatcactaattacaagaacaggctcatcgaaaagggagttcccgtgatttttgatattgagcactttaggcgcctcctcggaatcaagaagtcttacttctacaagctgttttatgggctgaaataccaatacaaggaagtcgaaataccgaaacgaaagataggtgagtatagaaaattgacggtgccatctaaaaacatcaagaaaattcagcgttggatcctggagtttatcctgtactccaacctgtgtgatgattgcgtaactggatttatccccaccaagtccattgttgaaaacgccctacctcacatcgggcacgactatatttacaaattcgacttgaaggacttctttccctcaatacctcggagcaaagtcttttatctttttaaagacctgggctacacggctgagttaagcaactatttggccagtttctgttgctataatgactgcctgccccagggagctcctacctcaccatatattgcaaatcttgtctgtaaacgccttgataagaggctgaagattctgtgcgagaggaacggctttacctacacaagatacgccgatgatatcaccattagcggcgacttcaaaatcgtgcatttccgaaacttatttgaaaccatcatagaagactcgggtttcattataaatgagctgaagactaagctcatccggaatggccagcggaaaatagtcacaggcgtcgtggtaaatgaaaagccaacaattagccgcgagtacgtgagggagctcaaaaaggagatctacttcatcaataagttcgggattgaaaaccatatgaagagaattggggaggcgggtagtgtgaaggactatcgacgcaaaatctatgggaagatcaacttcgttaaaatggtggatcgggaactgggcctagagcttcgtagaaaagtgaattccttctga

SEQ ID NO: 10003 - RNA, 1074 nt, unidentified
  source 1..1074: mol_type = other RNA; note = synthetic construct
atggacttggaccttttgaagagcaagttgatcgaaaagaacattccactcaatgacattgaagcaaccattagttacgcgcagaccttaaaaaataacggcgtgcctatcatcttcgatatgcagcacctccgacgccttctcaaattgacggagtccgatttcaaaagactgtactatgccagggatctacagtatcggacaatcgagatcccgaaaaacaatggttctggaacaaggaccctgagcttaccctccatagacctcaaatacatacaacgctggatccttgacaatattctgtacaacgtccacgtacatgagtacgcaattggctttgtcactggcaaatctactgttctgaacgccagccatcacatcaatcaggagtatgttctgaaaatggacattaaagacttctttccaacaatatccggcggccgagtttatggactctttaaatgcctgggttacagcagcagtgtggccctgactctaactaacttctgtatctaccaaaatagcctgcctcagggagcccctacctctccctatatttctaatctcgtatgtaggaagctcgaccaaaggttagagcttctgagtagaaagcgtaagctgaagtatacccggtacgctgacgatatgactatctctggggggagaaagatcaagaaaacgataccatatgtgaagcagatcatagaagaagagggatttcggtgcaatgagtccaagacaaaactgatttacaagtcaaaccgccagcaaattacaggcatagtggtcaatgaaaagctgtcgatccccaaaagtatgtttaagtcactgcggcaggaaatctactatatgaagaaattcggggtgtcatcccacctggataagaaggggcttaagcataagtcacatgtgaaggagcactactttgggctggctaactatattatgaaggtggacagagagaaaggtaagcagatcttgaacgatctaaacgctattgattggatttccaaatctcacaaaggaaataagcagttcaccgcacaggaaaaaaacaaagatatctacgagtga

SEQ ID NO: 10004 - RNA, 1005 nt, unidentified
  source 1..1005: mol_type = other RNA; note = synthetic construct
atgatcgaacgcaatgtccctaatgaggagatcgaaagcacgctgagttatgcccacattctgcaggaaaacggcgtgccgattatctttgacagccagcatttgaggcggcttctcaaactgacagatactgactttaagcggctctattactccaaagagatgcagtatcggactcgggagattcccaaaaacaatgggagcggcaccagaacgctgtgtattcctagtctggatctgaaatacgttcagcgctggattctggataatatcctgtacaaagtgaagataaacgagcatgctattggtttcgtgaagggaaagtcaaccgtctccaatgccgggtaccatatgaatcaggagtatgtcctgaagatggacatcaaaaacttcttccccactatttctaattctagggtgtttggactttttaagtcactcggctactcaagttccgtagctatgactctcacaaacttctgcacatataataatgagctaccccaaggctctccaacctccccatacatctctaacttagtgtgccgtaagctggaccgacgattggagctgctttgtcggaccagggggctacagtactcgcgttatgcagatgatataaccatttctggaggtagaaaaatcaagaagaccataagtttcgtccaaagaatcctcgaggaagagggctttaagaacaacgagaacaagatgaacttaatctacaaaagcaaccgccagcaggttacaggggtagttgtcaatgagaagttgtccgtgcctaaagtgatatacaaaagcctgaggcaggaaatatattacatcaggaaatatggccttgaatcccacttggacaagaaagggttaaatagaaagtcacacgtgaaagaacactactacggactggcgaattatatgatgatgatcgataaggacaagggacaacaattcattaacgaactcaacgccatcgactggaagcgcaagagcctcggtagagactga

SEQ ID NO: 10005 - RNA, 1071 nt, unidentified
  source 1..1071: mol_type = other RNA; note = synthetic construct
atgaaggacagcatgggttccgttatctatgctctgctgaacaagaaagacggaaaaatggacctcgccatccttgaatctaagatgattgagcagaacattcccaccatggatatcgagtcaacaatcagctatgcaagggccctgaaagacaacggcgtgcccgttatattcgacattcagcacctgcgaagactgctgagaattaccaagtccgattttaaacgtttgtactacgccaaaaagaatcagtataagaccgtggagataccaaagaataacggaacgggatctagattgctgagtatcccctcaatcgacctcaagtacatccagcggtggattcttgacaacatcctgtacaaggttgaaatcaataacctggccattgggttcgcaaagggcaaatctgtcgttgtgaacgcttcataccatataaaacaagagtacgtactcaagatggacattaaggacttctttcctaatattacagcaaatcgcgtgtttgggctcttcaaaagcctgggttattcatctagcgtggccatcacacttacaaatctgtgtacgtataatgattccctgccacagggagctccgacctccccttacatttcgaacttaatatgtcggaagttggatagtaggctaaagaatctctgccaaaagaggaatctgaattttagccgctatgctgatgacatcaccatcagcggggggaagaaagtcaaaaatactattccttgcgtggaaaagatcttggaagaagagggctttaacgtcaacgagcagaagactcggatcatcttcaaatctaagagacagcaagtgactgggatagtggtgaacgagaaactcagtgtgccaaaaagcatttacaagaacctaaggcaggaaatttactatatgtcgaagtttggcgtcgagagtcatcttgataaaaagggcctcaaaaacaaatctcacgtgcgagaacactactatggtttagcgaactacttcctgatggtcgatcgcgtaaagggcgagaaagtattatccgagcttaactccataaattggaatgattga

SEQ ID NO: 10006 - RNA, 1011 nt, unidentified
  source 1..1011: mol_type = other RNA; note = synthetic construct
atgaatttggaggtactcgaaagcaaaatgtccgaggagaacatttccttggaagaaatcgagagcaccctttcctatgccagaaatctgaaggaaaatggcgttcccgtcatctttgatatccagcatttgcgcaggctgctaaacctgaataagactgatttcaagcgtatatactacgcacgacagcatcagtacaatactatagagatcccaaagaacaatggcaagggcactcgaaccctctcaatcccgagcttagatctcaagtatgtgcagagatggatactcgacaatatcctctacaaaatcgaagtgtctgagtacgctaatggatttgtgaaggggaaatccgtcgtcaccaatgccaactatcacgtcaagcaggagtacgtgttaaagatggacattaaagacttctttcccacaattaccgcaggtagagtgtttggtttgtttatgtccatcggatactcttctaacgttgccatagtcctgacgaatctttgcacatataacaactcaattcctcaaggtgctccaacttcaccctatatctctaacctgatttgtagaaatctggacctgcggcttagtctactgtgcaataagcggaacattaaattcagccgctacgctgatgatatcacaatttcgggcggaaggaaagttaagaagaccattcctttcattcggaaaatcataaatgaggaagggtttatcgtgaaccaggagaaaaccaagctgctgtacaagtcagggaggcaacaggtgacaggcattgttgtgaatgacaaactgagtatcgcgaaggaaattttacggaaactgaggcaggacatatactatatcaagaaattcgggctcaatagccaccttgagaaaaagaacatgatcaacaaaagtcacgtgcgcgaatattattatggaatggccaactacatcctcatggtagatcaaaacaagggccagaaactgttcaacgagctgaacaagattaactggaaatga

SEQ ID NO: 10007 - RNA, 1014 nt, unidentified
  source 1..1014: mol_type = other RNA; note = synthetic construct
atggatctgagtatcctcaaacaggagctgatgtctagagatttaaattctgtggacgtggaattcatcataagttacgcgcagtccctcctggacaaggacattcctgtgatattcgatctcgaacacctgaggagactgttgggactcaagcggagcgatttcaagcaggtctactatgccaatagcaaccaataccacaacattgagatccccaagaacaacggatcgggaactcggaaactgtctctgccttcagataaactcaagaaagtccagagatggattcttgactacatactgtacaatttcgaggttaacgagaaggctaccggctttacactagataaaagcatcgtgaccaatgccaacttccatactaaccaaaagtttgtgttgaagatcgacatcaaagacttttttccgacaattacgagcaacagggtgtatggtctgttcaagtcattcgggtataacaattcaatcagcctggcacttaccaaattatgcacacatgagaattgtctcccccagggcgcacctacttctccatatattagcaatctgatctgccgccaccttgatattcgccttaacgggctagccaagaaaaacaacctcaatttttccaggtatgctgacgatattaccttctcaggtgaattcatcccctccaatatagtcgaaatggttcaatggattctgattgaggaaggcttctggatcaatgagttaaagacaaagttgctgaacaagagtcagcgacagaaaatcaccgggatcatcgtgaaccaaaaactctctgtgccaaaagaaataactaaaacattgcggcaggaaatctactacatgaagaagtttggggtacagagtcatctggagcgaaaaaatctgcagacgaagaccaatgtaaaggagcactactttggccttgttcgttttattctaatggtcgacaatgaaatgggcaaaaaactgtcctatgagttgaagaagattaactgggactcctga

SEQ ID NO: 10008 - RNA, 1149 nt, unidentified
  source 1..1149: mol_type = other RNA; note = synthetic construct
atggatttgatactgctggaacaagagttaaaggccatggagctggacaacgacatcatcaacaactacataagttacgcgagcaacctcaagaataataatgtgcccgtgatttttgagttggaacaccttaggaagctgcttcacatcagccgtgaagagttctttggcatctactatagtatcaagtaccagtaccatacgatttatattccgaagagcaaaatcaagtacgaaaccaacaaagggattacccgccagagtaagaagtacattctgcccaaagtctactacgacaacgaggttaggcacaagttcaagcgctataataaggtaatcacagacctaacaaacaacaaatcctcttactatcgtaaactggaccttccctcaaaaaagctcaagtacatacagcggtacattctggataacatactgtatcgggtggatgtgcataatgccgcacacggctttgtgcctggcaaatccactatctcgaatgcaagagtacatgtcggtaatgagttcgttgccaaactagatatgagagacttttttcctgctatcaccgcacagcgagtgtatggattgttcagatctttcggctacaataagagcctttcattcacactcacaaaggtgtgcacttacaatggaagcctgccacagggagctcctacttctccctacatatcaaatctgatttgtcggaagttggattacaggattagcaccctgtgtatcaagaacaacctcaatttctcacggtatgctgatgatattacgatttctggggggaggaaggtgaagagagtcctgccaatcatcaaagacatcattaagaacgagggatttcgaataaacgacgagaaaaccaagatcctccacaactcccataaacaaaaggtgactggtgtggttgtaaaccagaaggtgagcattcctaaatccttttatcgcaatttgcgccaagaattatactatatgaacaaattcggcgtctcctctcacctgctggaaaaacagacaatgtttaagtccaataccaaagcctattatttcgggctggttcattattgctatatggtcgacccaatcaaaggtgaaaaacttttacagctcctcgagaaaatcaattggaatagttga

SEQ ID NO: 10009 - RNA, 999 nt, unidentified
  source 1..999: mol_type = other RNA; note = synthetic construct
atgtggactaaggaatccatcaaaatttatgaacgccagctcgaaagtaataggctgcctgtgatctttaatatcgaacacctgcggcgtcttattggcgtcgagaagaaatacttctataagctgaccaatagcgtggatgcatcatacatttccaggtttatcgacaaacggaacggcggtaagagaaaactcctgataccagggtttaatctgaagcttatccagacctggatcctccataatatcctgtacacacagcctgtgtttacatctgccactggcttcatcaagcagaaatctattatcgataacgccactccgcatatcggcaagaagtatattttcaagaccgacatttctgatttcttccctagcataaagtttaagaacgtattcctgcttttcttgaattttggatacacaaaggaggtgtccaacgtgctcgccatactctgcacatatgaagggtatctgccacagggagctcccacgtccccctatttgtcaaacctgatttttcgagacttcgacaagaaattagagaatatctgtagtctcagcgagtataagtataccagatacgctgatgacattacgataagctccaatgaaaaaatcagctctatcgaggtcgattacctgtcgaaaactatcgagcagagcctccaaactatcaataacttcttgaagttgaacctggacaaaaccacagtattaaggcccggtcaacggaaaattattaccggcgtgctagttaacgaaacactgaatgtcccaaaaaagatactgtcagagattagactagagatttactgtctgcagaagtacggggcctcaaaccgcatcgaggcatataaccagaagcacaataccaacttagataaatacagttaccgacagaaactttatggaaaaatctgcttcgttaacatgatcaatcccaagaaagcggaaaagttctacgagcaattttacgacattaactggataaagtga

SEQ ID NO: 10010 - RNA, 999 nt, unidentified
  source 1..999: mol_type = other RNA; note = synthetic construct
atgtggacggaggagtccatagagaactatgaacgtttgttagagagcaaaggtctgccagtgattttcgacgtcgaacacctccgccgactcatcggcgtgaagaagaaggatttctacaaattgacaaacagcattgatgcatgttacacttgtaggctgattgacaagcggaacggggggaagagggagctacttataccctcgttcaatctgaagattatacagacctggattttgaataacatcctgtacacccaaagcgtctccagctcagctacaggcttcattaaaggcaaatctatcgtggacaatgcagagccacatatcgggcataagtacatcttcaaaaccgatatcctcaacttttttccctcaatcaaactacgcaatatcttcctgctatttttctactttgggtacaccgtagaagtctcttatatccttgccagcctgtgcacatatgagggatatctgcctcagggcgctcctacctctccctatctcagtaacctgattctgagagactttgacattaagctgcagaatatctgctcctcactgaattatacctacaccagatatgctgatgacattactattagttccgacactaagatcactaagttctacattgagtacctgctcgataccatctctcagctcctgaactcaatcacatactttctcaaactcaacctggacaaaactaaagttttacaccctggacagagaaagataatcacgggcgtgcttgtgaataaacggcttaatgttccaaaggaactgttaagcgagattcgactggaaatctactgtcttcaaaaatatggagcctccaataggcttaaggcgtataacctcaaaaacaatacagacttgaacatagccagttatcggcagaagttgtacggtaaaatttgctttgtgaacatgatcaatccgatcaaggccgaaaagctgtatgatcagttctacgatataaactggatgaagtga

SEQ ID NO: 10011 - RNA, 999 nt, unidentified
  source 1..999: mol_type = other RNA; note = synthetic construct
atgatgtggaacgaacagagcattagaaattacatcgggcttttggaatctaaaggactgcccgtcatttttgacttagagcatctccgaaggttaataggggtggagaagcaatacttttacaagctcaccaactcaattaacgagtcctactcttttttcacaattcgcaaaagaaacggagggagccgaacaatttccatccctttcagcaatctgagaacgatccagaattggattttgaacaacatactgacaacacaacaggtagctgagagtgccacagggttcatcaaaggtaaatctatcgtggataacgcaaaaccgcatataggccacaaatatatctacaagaccgatatcgtggacttcttcagctcgattaagtttaagtctgtgttggccctctttctacggcttggttatgttaaggaagttgcgtatatcttggcccggttttgcacctatgacggatatctgccacagggagctccaacttcaccttacatctccaatcttatactgtacaacttcgacattgagctacagaaaatctgttgcttgagtaaattctcttacacccgctatgcagatgatatcacgatcagttcaaatggcgagcaccttatcgactccaatctgctgagcgccaccataactaagctgctccaggatatctcctttgaactcaagatcaatttcaagaagaccaaagtgctgcaccccggtcaacggaagattgtgactggcgtattagtcaatgagaagctaaatgtccccaaggaaattatctcagacatcaggctggaactgttctgtctcaacaaacacggcctgagtaaacgtattaagcactacaatgaaaagcataagactgctctgagcgttgcactgtataggcagaaaatttatggcaaaatctgctttgtgaacatgattaaccctaaaaaggccgagaagctttttcaggagttctacaaaataaagtggctcctgtga

SEQ ID NO: 10012 - RNA, 1023 nt, unidentified
  source 1..1023: mol_type = other RNA; note = synthetic construct
atgatcaaacaggtgatcttcaatatccaactttctgacctcccagagcaggagaaaaaagacctcatctactacgcagaaaacctgtatttcaagcaatgtcccgtaatattcgataatcagcatctcatgaaactctttgagctgcaggatcacgacctgaagaggttcatgacagaaaataccaatcactactccattaagaagagaaatggcgatctacgtgaggtatggaaacctaactacaagttaaagaccattcagaaatggatactgaagaacatcctgaacgaaattaaggtgagtgagtgcgcccatgggttcgtgaaaagtaagagcattctgactaatgctgaaactcaccaatacaaagaacagttttgggtgttttccatggatattaaagactttttcccctctatcaagtatcatgaagtcaaacgaatctttatgggtatagggtattccaatgaggtgtcagaagccctgtcactgcttaccactgttcatggaaagctggcgcaaggcttccctacctctcctatgcttagtaacttgttcttcagagacatcgatgaggagttccagcagattgcaagcagataccatattcgctattcacggtacgctgatgacatcacattttccggcgtccagaagaaaggatatctagtgctctctgagaagctgaagcaaatagtcacgagcgtcttgagcaagcacaatttcatagtgaacgaagccaaaacgcgcttgatgaaaggcaagcacccaaaaattattacagggctggtcgttacctcgcagggagtgaggatcccgcagaagtacatccggcggttaaacaaagagatctattactgccgaaaatttggtgtgaacggccacctcaaatatcagggtttaatcacaattgctaactacaagggatacttgatcggccttgccaggtttatctatatggttgaccccgttaagggggcaaagtttattaagatgattaaggacctggattgggactga

SEQ ID NO: 10013 - RNA, 1023 nt, unidentified
  source 1..1023: mol_type = other RNA; note = synthetic construct
atgttcgacaagatcctggacaacattaagaaaagctctctgctcgagaaagaaaaggaggcttacattcagtatgcacgtaacctgcatctgaaaaattcacccatcatcttcgacataaatcagcttgttatgttgttcgatctcccgaatgacaacataaaggagtttgtcttagagaataccaatcaatacaccatttccaaaagggatggctcatccagggaggtctggaaaccttcttacaaactgaagactatccagcggtggattctgaagaacattctcttcaatatcaaggtgtctgaaagcgcccatgggttcgtgaagaacaagagtattctgacaaatgccgaagtacaccagtacaatgaaccattttgggtgtactcgaccgatatcaaagacttctttccaagtatcaagcagaatgaggtcaagaagattttcctagagattggttacacagagaaagtgagcgaggctcttagctctcttactaccatcaacgaatcattggtgcaaggctttcctacctcacccatgattagcaatatttactgcagagaaatcgatgaagagttcaaaaaacaggcgaacaaactgaatatctcctattccagatatgcagacgatataacttttagtggcccacaaaagaacggctacctgaagctaatcaaaaacatcaagaacatagtcctccacaactttcgcgagaataacttcctgataaacgagaagaagacacgggtgcgcaagaataagcacaccaaaatagtcacgggaattgtggttagccaatatggagtgcgaatccctcagaagtactataggcggttgaacaaagaattgtactactgtcagcgattcggtgtaaacgaacatcttaagtatcacggattaatcacaatctccaattttaagggctatctcatcgggctggccagatttatttatatggttgaccccgataaagggtccgagtatattaaaaaaatccagaagctcgactgggaatga

SEQ ID NO: 10014 - RNA, 1023 nt, unidentified
  source 1..1023: mol_type = other RNA; note = synthetic construct
atgattaagcaagtcttgcataatatcgtgctgtcagacctgtcggaggaggaaaagaagttttttatgcagtacgcaaaagacctgcactctaatcactgtcccgtaatatttgacattaatcagattctccgcctattcgaactccccgatgatgatctggagaaatttgtcatcgataacacaaaccattactatgtgtctaaacggaatggggagcccagagaagtttggaagcctaactataagttgaagaccattcaaaagtggatattgaagaacatcctgaacaaaatcgaagtcagtgcttgtgcccatggcttcgtgaaaagcaaatctatcctgacaaatgccgaagtgcaccagcatcaggagcctttctgggttttcagcacggatattaaggacttcttcccgtccattaaatacaaggagatcaagaagatcttcataggtatcggctacagtgacgcggttagtgaagccttctccctactgaccaccgtcaataaagagctcgtgcaaggatttccaacttcacctatgttaagcaacatctttttcagagagatcgatgaagaattccaacagctcgcctcccggtataatatcagatattcccgctacgcagacgacattacatttagcggcgtgcagaagaaaggctaccttaaattggtaaagaagatcaaggagatagtttcatgcgtgcttagcaagtataacctgatcatcaataacaagaagacccgacttatgaaagacaggcacaccaaaattgtgactgggctggtcataacaccacagggggtacgtattccccagaaatacatcaggcggctgaacaaagagatctactattgccagaaatttggtgtgaatgagcacctgaagtatcacggactcattactattgctaactataaaggctacctgatcggacttgctaggtttatatacatggtggaccagtctaaagggattgagttaattaagaagatccaggaactcgattgggattga

SEQ ID NO: 10015 - RNA, 1023 nt, unidentified
  source 1..1023: mol_type = other RNA; note = synthetic construct
atgctgaacaaagtaatcaacaatatacggctttcggacattgaagaggtggagaagagagaactgatccattactccgaacagttatactctaagaattgccccataattttcgacgtgaatcagctcctgctgctatttgaaatagagtccgacgacctggagaattttgtgcttaacaacaccctccattatttcgttaaaaagcgcaacggcgaaatgagagaagtgtggaaacctaattataagttgaaggcaatccagaaatggattctgaacaacatcctgtataatatcaaggtcagtccccattcacacggtttcgtgaagaagaagtccattctgactaatgcccaagtccaccttcacgaagaccctttctgggtgtttagcaccgatatcaaagattttttcccgtctatcaaacagaacgagattaagtcaatcttcatggaaattggctattccaagccagtcagcgaagtgttttgtctgttaacaaccgttaatcagaagctggtgcaagggttccccacttctccatacatcagcaatattttcttccggaacatcgatgagaaatttcgcgagatcgagtacaaatactctatacgttacagcagatatgcggatgacatcactttcagcggaatacagaagaagggatatctcacattggtcaacaagcttaagcagatcatttcaaacacactgagtaagtacaacctgacaattaacgagaaaaaaacccgactcatgaaggataaacacaccaaaatagtcacgggcctggtgttgaccagtaaaggtgttagggttcctcaaaaatacatccggaaaattaacaaggagatttactattgcgagcgatttggcgtaaatgagcacctcaaataccatggactcattactagggccaattaccgcgggtatttaatcgggctggctaggtttatctatatggtggacagcatcaagggcgctgagctattgaagaagattgaagacctcgattggaattga

SEQ ID NO: 10016 - RNA, 1023 nt, unidentified
  source 1..1023: mol_type = other RNA; note = synthetic construct
atgattaagcaagtgctacacaacattgagctctcagatatctgcgaggaagaaaaaagaaagctcatacactatgctgagcagctgtacagcattcattgtccggtcatctttgatgtagaccagttgctcctgctatttgagattaaggtcgatgagctggaaaagtttgtgacggacaacactaatcattacttcatcagtaaacgcaatgggaaatctagggaagtctggaatcccaactacaaactgaaagcgattcagaagtggatccttaagaacatactgaataacatcgaggtttctaactgctctcacgggttcgtgaaaaataagtccattcttaccaacgcacaggttcatttacaccaagaacccttctgggttttttccacagacatcaaagatttctttcctagcattaagaagaacgagatcaaaaagatcttcatgggaatcggatattctgagagtgtcagtgaggccctgtgtctgctgaccactgccaatgagtcactcgcacaaggctttccaacgtccccagccatttcaaatatcttcttccgaaagattgacgaggaatttcagcaggtggcttccaaattcagcatccgctattcaagatacgccgacgacattacttttagtggcatacagaataacggcagcccctctttggttaaaaagctgaagaggatcattagctataccttgtcccgatacaacctgtacatcaatgaaaccaaaacaaggctcatgaaaaacaaggatacaaaaatcgtgaccggtctggtggtaacatcgcagggagtgagagtgcctcagcggtatatccgtatgatcaataaggaaatctactattgccaaaagttcggggtcaacgaacatcttaagtatcacggtcttattactatagctaactacaagggctacctgataggattggcacggttcatttacatggtggacagcatcaaaggcgccgagttaattaagaaaatacaggacctcgattggaattga

SEQ ID NO: 10017 - RNA, 1023 nt, unidentified
  source 1..1023: mol_type = other RNA; note = synthetic construct
atgatcaagcagatcttgcataatataatctcttccaacctgtcgaaggaagataaagaaatacttacgcaatacgccgaaaatctctacctgaaaaacttccccatcatctttgacgttaatcagttctttctgcttttcgagttaacagacaacgatctggagaaatttattatcgacaacacaaaccactaccatattaataagaggaacggtgaactcagagaagtatggcaacctaatcacaaggtgaagataattcaaaagtggatcctgaagaatatcctgaataagatcgaggtaagcccatatgcccatggctttatcaagaacaagtccattttaaccaacgctgaggtgcatctgtaccaagagccattttggatcttttcaaccgatatcaaagatttcttccccagtatcagctacaacgacgtgaaaaaaatattcatggagatcgggtacagtgacaaagtttcagaagctttctcactgctcaccaccgtggatggaaagctgatccagggattcccgactagccctatgctctccaacattttcttgcgagatatcgatgaggaatttcagaaaatcgcggtcagatataatatacgctattctcgttacgccgatgacattacctttagcggcattcagaagaaaggatatctaactctcgtcaagaacatcaagcgcattgtgtctttcattcttgagaaacacgacctggctataaataatgagaaaacgcggctgatgaaggacaaacacactaaaattgtgactggtttgattgttacaagtaagggcgtcaaaatcccccagcggtttataaggaagctttccaaggagatttattactgccagaagttcggggtgaatgatcacctgaagtatcaggggatcattacaatagcaaactataaaggctacctcattgggttggccaggtttatctatatggtggacaaaatccagggcgcaaagttcattaaggaaatttacgacctagactgggattga

SEQ ID NO: 10018 - RNA, 1023 nt, unidentified
  source 1..1023: mol_type = other RNA; note = synthetic construct
atgattaatgacatcctaaagaacatcaagttgtctaagctcagcgaagagaatagggccagtctgacacggtacgctatatccattcataacaataactgtcccatactgttcgataagaatcacgttctcttggtgtttaatttagtggaggaagacctgcaaaagttcattaaggagaactcgaacaagtatttcatcaagaaaagaaacgggagcctgagagaggtgtggcagcccagctacaaagtcaaagagatccaaaaatggatctacaaaaacatcctgaacgatattcaggtcagcgaatgcgtccatggcttcgtcaaaaaccgttccattctaactaacgctcagaatcacatacatgaagacaagttttgggtattcagtatggacattaagaacttctttccatctattcgaatcgaacgaatcgaacagatattcctcaaactcgggtactccttggaggtttcaaaagccctgagtctgctgtgtaccgtggacggtaagctggtgcagggatttcctacttccccttctctgagcaacatcattatgcgggagattgatgaagaatttaagaccattgcagacaggtataatcttaagtattctcgctacgccgatgatatcacattttcaggcgatcagaagaaaggctacctgattttggttaagcgcctggagaagatgatctgctttatacttaaaaacgccgacttcgagataaataactccaaaacacgcctcatgaaaaataaacacgcgaaaattgtgaccggattaatcgtagattcagacggagtgaggattccaaaaaaatatatccggaagttgaagaaggagatctactactgcaaaaagttcggagtcaatgagcaccttaaatatatcggtctgatcacgatcgctaattacaaggggtatctgtttggccttgcaagatacatatatatggtggaaaaggagctcggcatcatgttcattaagcagctcaatgatttagagtgggactga

SEQ ID NO: 10019 - RNA, 1038 nt, unidentified
  source 1..1038: mol_type = other RNA; note = synthetic construct
atggacaacattgtgtttcagaatattaacaggtccagtcttacggataatgagaagaatcatcttaccattatcgcctcttctctgataattaagggagttcccgttatcttcgacatacatcaagtgcggttgctcttcgggatagatggcgaaattggcatcttcgtgcagaagaattgtgctaagtattccatcctgaagaaaaatagggacgaacgaacaatttaccagccctcttacaaactcaaaaaaattcagcgctggattgtgagcaatatcctttcaaagatcaagatctctaagtcatgtcacgccttcgtgccagagaaaagcatactcaccaatgctaaagcacatgttcacgaagatcctttttggatctacaagacggatatcattaacttctttggggagatcaacttcattacagtgaaggacattttctttagcgtcggctatagtcaagatgtgagcgaaatactgaccagcttgtgcatgtatgacggcgtcctggcccaggggtttcctacctcccccataatttccaacatcgttttatccaacttcgacgaagaactggatgtgatcagccagagatataattttgtctacagtcgttacgctgacgacattaccatctcagggacacagttaagaaacaaggatatagagaagatcaagaacatcatcacttacaaactgcaccacctggggttcgaaatcaacaagaacaagactaagttctttggttttaaggcggataagaaagtcactggtgtcgtaatcaaaaatggccaactgttttgcccgcagaagtacaaaaaactgctaaacaaggagctgtactatattaacaagtatggagtggattcacatctcatccacaatgagaaaacactaatctcgaactacataggatacttgtacggctatgcaggttatatcaaaatgattgagccagacgtaggagacgagtatgtgaaaaaactcaacagcattttctggatctctaattccgagcaggcccctagttga

SEQ ID NO: 10020 - RNA, 930 nt, unidentified
  source 1..930: mol_type = other RNA; note = synthetic construct
atgaacttcacaaacacaaagcagattaaatccgtgtttaagatctctcaagacatgaccgtcgagaaattcgtgtctaagaacatcaaccagtactacttcatcaagaagaaatcgaagaatccccgtcagatttacatcccaagcattcagctgaaaactattcagaagtggatcctgaagaagattctgacgaaagaatttagctccagtgaagttgcgcatggctttattagtgggagaagcatagtgacaaatgctagagagcatttgtataaagaaccatcttggatccttacgatggacataaccaatttttttgactccatccgatttgacagtatagaacatctgtttcgccagcacggatataccaaggaggtgtcaaggacctttgccactctttgtacctatcgcggcaagctcgtgcaaggcttccctacttctccttttctagctaatctgtacctcaaatccttcgatgtgtacctgaagtccaaccttcagaaatataacgtaaagtacacacgatacgcagatgatctgacattctcagggaatatagagaaaaactacgagtcattcatcttggagagcgagaggatggtcgagaagggtttaaccaagttgcaactgagggtgaacagcaaaaagacaaatatccagactaaagaacggaaaatcgttactggtatctggctctataagaacaagctgagtgtatcaaacaattacctcaagaaattcagacgggagatttactattgcaagaagtatggcgtgatcgatcacctcattcacaccaacaaagtcgaaattagcaatttccacggatatatgtacggaaaagcctatttcgttaaaatggtcgacgagaatttagggatgaaacttctgaaggaactgaatgatctaaactggcccatgtga

SEQ ID NO: 10021 - RNA, 933 nt, unidentified
  source 1..933: mol_type = other RNA; note = synthetic construct
atgaaactgaagaacacaaaccagattaagaagctcttcaaaattaccggcaatgatatctcctcattcgtgactgacaatattgcctcagaattcaagatcaagaagagtaacaaagagcggattatagtcgttcccagcctgcatcttaaaagtatcttcaggtggttattggataacatcttcgaaaaggagttcattcctcacgaatgtgtgcatgggtttgtgaagaataaatccattgtgaccaacgctaaagcacacctctaccactccccaaattgggtctatacgatcgatatcaacaactttttcggtagcataactcgaaatgacgtgttgtcgatctttatcgaaaaaggatggccgacttctgtagctaatgcgttcgcagatctgtgtacatacaaaaacacattaccacaaggattccccacgagcccatgcttggctaatgcatttctcaataagttcgacactcacatccacgatttttgcaagacctatggcattcgctatacaaggtacgccgacgatctaaccttctcttccaccgactttgtctctgtgaaaaagatcaacgaggaggtttcatgtactctgaaaaagcaaaacctgttccttaatcctaagaaagagcatctgcagaaagggaagcacaagaagataaccggcattaacatcaatggccataagctggtaagttctagacgctttagaaagaagttcgacaatgagatctttttctgcaagaaatacggcatcatggaccatctggccagaaccgggacacttacacggagcaactttaaatcctacatgtatggtaaagcctgctttattaacatgattgaccaggatctaggacagcagtattttcgtaagctgcagcacctcaattggcccgaaatacctaataacgcctacttttga

SEQ ID NO: 10022 - RNA, 1020 nt, unidentified
  source 1..1020: mol_type = other RNA; note = synthetic construct
atgctggaaacaatccttaacaacattaatcttggcaacatagacaaggagaataagaacatactgatcgagaactcaaagtacctgtattcaaagggccttccaatcttcttggacgagcgccacgtgtctcttgtattcaacatcgagggaaacatcaaatctttcgtggagaatagtactagccaccatatcattaaaaagcacaatggggattcgcgggatgtcttcgtgccgtcagaacatctgaaagaaattcagaattggttgctggtgaacattctcgagaaaaagatgatcagcaatagtacttacagttttgtcaagggcaagtccattattgatcatgcgctgaatcacatctatctgaaggacttttggttagttacgttcgatgtcaaagatttcttccctagcatcaggaaagacgctataaaaaacatcttctttgagctcgggtatacctccgacattagcgacaccctaagctccttctgttccattaaaaataatctggtgcaaggctttcccacctcacctatcattagcaacatctatttgaacgaactcgattctgttctgcaggaattttgccagagtcacaatataacctattctagatacgccgacgatctggccttttccggagaaggggaaaagatccaaaaatctctatacgacaagttataccagctcgttgtaaatacgcttgccatctatgaactcaagctcaacaaaaacaagatcaagatttacgactacaaccatcccaaaaaactgacaggcataatgctgaccacaaatggcattagggtgcccttgaagattaagaaaaagatactcaaggagatctactactgcgagaagtacggagtggaggaccacttaaagaaaactgggcgtctggagttggcaaattacaaaggatatatctatgggatagctggttttatcagaatggtcgaaccagagacaggtattcagctgtttcgacggctggataacatttattggggttga

SEQ ID NO: 10023 - RNA, 936 nt, unidentified
  source 1..936: mol_type = other RNA; note = synthetic construct
atgaactcaattctggtgagtgagcagcagattaaactgctgttcaaaatagccatgacagaagacgtcatagatttcgttaaggataataacctcgtgtactccaaatgcaaatataatggcgaaactcgatttataagctctccatccgagcacttgaaaatcatccagaggtggatcgtggacaatatactcgtgcagaaaagcatctcagacgtggcccacgcgtatgtgagggagaagtccatattcaccaatgccagagttcatgtgggcaacaaggcaatcctgaagatggacatttcaaacttcttcgattcaatccccattacaaaagtgaaggagatctttctaagcctgggatataattctgccgtatcccaggtctttgctgaactctgcaccaataatgggtacgtgcggcagggctttgtcacaagtcctttcatcagtaacataatcttgaaggactttgatgacaagttgatcaacacacttaaaaagtcctgttattccaagtatgagttcaaatacacgcgctatgctgacgatattactatcagtagcaagtacaaggttaaaagcaagctcaaagagatcgagcaagaagtgatggatatcttagaagtatctggttttagcgcaaatctcggaaaaacccgtttaattatcggggaaagcccgaaaaagatcactggcatcattgttaaagagtcgtcaattagtgtacccaacagatttaagaaggaactgcttaaggagctgtattactgtcggaagttcggtgtcattagccacctgatctacaccgggaactacggcaagctgaattacattgaacatctgaaaggactagctatgtttattaagaacaccgaccagaagttctacgagtctgtcatttctcaaatttccgagctggatcttaactcttga

SEQ ID NO: 10024 - RNA, 936 nt, unidentified
  source 1..936: mol_type = other RNA; note = synthetic construct
atgattcccaaattgatatcagtgcagcaactgaaaaagctattcaagattgagcttacctctaatatcgaggattttgtggagaataacaatcaggtctatccccgtatcaagaagaacggcgaaatcagattcatttcctctcctaccatccacctcaaaagcattcagaaatggatcgtagagcatatactttccaagaaggactgctccgaattctgtcacgcctacgtgaaggagaagagtatttttacaaacgccggcacgcatattggcaaccagaatctactcaagatggacatacataacttttttgacagcatcccacacattagcgtgaaaaatatcttcattaccatggggtacaacttggaggtgagtcactctctggccctgctttgcacttataagggctacgtaaggcaaggatttgttagctcaccgatgatcagcaacattatcatgaaagagttcgatgactggataataaaatcactgcacgaagaggaatacctgaagttcgattttaagtacagcaggtatgcagacgatattgctatcagttctaagaagaaggcggtcgcccccttagtgattatcaaggaaaacatttccgattacctcgagaaatatgggttcatcgtcaataatgataagatcaaactgatcaagggaaaaggtcctaaattgatcacaggtatcgttgtcaaggacaactcgatttcagttccaaacaaatacaagcgcaaactgctgaaagaactgtactattgtgagaagtatggcgtggaatcccatctgttatacacaggacagtacgggaaaactaactataaagaatatctcctcgggatcgcaatgtacataaagaatactgacaaccagttctacaataccatccgggagcgaatagatgctctgaatattgactattga

SEQ ID NO: 10025 - RNA, 1011 nt, unidentified
  source 1..1011: mol_type = other RNA; note = synthetic construct
atgttggtttttcagcgaccttcatccaagagaatggccttttgtgtaggtgggttcatcgtgaaagtgtctagaagcataagtgtgaagcaagtctctgaggctttcgggataaacgaaaatatagatgagtttgtggacaattcctcatggttctacccaattgagaaaaaaaatggtgacatccggtacatttttattgccaacaatcagctcaaagctattcagtcgtggattctcgagaacattcttgaggacgtaaaaataagcgacgcagcaaacgcgtatgtgtccaaaaagtccatctttactaacgcccagtgccatgtcggctacaagggcatgatcaagctggacatcatgaatttcttcgatgcaatcaaccgagatgacattagcaaaatctttgaaaaccttggcttcagcaaagatgtcgctatgctctttgggaagttgtgctcaaacaagaatattctgaaccagggcttttccacaagcccgatgctgagcaatatcttcttctataagtacgacaagcttattgaaaagatcttaaacgagaagtacggaaaaaacacttttgtgtataccaggtatagtgatgatattaccatcagtacgtctaaaacgtttactttcgacgacttgatgaaactgtccagcgagatagaaaacctgctgctacccaagtttaagatcaacaagatgaagaagaagatcattctgggaaagtaccccgctaaggtcacaggaatcaatgttttcaaggagtatatgtcagtgtctaagaaaatccgccgcagaattaaacgtgaaatccactattgtgagaaattcggggtttctggacatctaaaatacgtcggcgagtataataggcaaaatttcttcgggtacctccgcggtaccgcccactttataggcaatacagacaagaaactggccctgaagttactggaacggatcgatatgctggaattccgggatagggtgacccagaaaaaactctga

SEQ ID NO: 10026 - RNA, 993 nt, unidentified
  source 1..993: mol_type = other RNA; note = synthetic construct
atggcaaattcttatattaaacgccttgaagccgcgatgacagaacagggggcagaaaatgaggccatctcgcgcgccgtcgactatgcttttaacctcctgaaccagaatttgcccgttctgttcgatgacattcacgtcgctgaggtcttactcctgagtcgactcagtctctactcatatcacacctttccagttagccagatcgataagactagaattataactgctcccagtcttaacctaaaacagcggcagaagtggatattgtccgaaatcctgaacaaaattcccagcagcgagcatgcccacggtttcgagagcggccactctattaagaccaacgcccttatccatgctaacaatgactacgtgttttgcatggacataaaagattttttcccgtcaattagtcgccagagcgtatgcgaaattttcaggaatgtgggctacagccctaaagcctctgacatgctgtccaaggtgtgctgttataacaattgtctgccccaaggagccccaacatcccctaagctctctaacattttcttcgcaaagattgacgcggagttggctaacttagccaagctcaacaatgcaatctactccaggtacgcggatgatatgaccttttcatcaaaacacgacatccctgctctgcacaaggcagtggaggaaatcatcggaaaatacaatttcacgctaaaccacaagaaaacaagagtcttttacccagggcaaccgaaaagaatcaccggcctgatcgtgcagaacggttgtattcgtgtacctaagcattttaagcggcgactgcggcaagagatacattattgtaggcagtatggagtgactgttcatctggaaaatacaaatgcctcccattgcatcaattatagggagcacctgtacgggaaggcctacttcgtgcacatgatcgagccagataccggcgataagctgttgaacatgcttgacgagatcgactggatgtga

SEQ ID NO: 10027 - RNA, 1008 nt, unidentified
  source 1..1008: mol_type = other RNA; note = synthetic construct
atggactatgtttatatcaccaatcttatgcacggcttattccagaagggttatgacgataagttcgtcatacgatgttgtaaatacgcggaaaagttaatgcgcaagaacctgcccgtgtttttcgacgaggagcatatatacgaggtactaaggacccgcggcatttctctggaggactcctatcacacatttgatctgatccatgacaacaaggtccgcacaattctggctccttccaagaagctgaaggcgcggcagagatggatcttggacaatatcctcaataacatcaaggtcagtaagtacgcccacggatttgagctgaatcggagcattaaaactcacgctcagctgcacgctaaccacgattttgtgatttgtatggacatcaaggactttttcccaagcatctctgaggaaaaagtctttaccctgtttaagcagatcggctatactactagagcctcacaagagctaactcgtctctgttgcttcaaaggggcattgccacagggagcccctacctcgcccaaaatagccaatataatctgcaagaggatggatcgagagatacaaagattcgccaaagagaacgggattacatactccaggtacgcagacgatctgacatttagctccaactcagagatgccacaactgatccctgagattacagctatcgtgaacaagtacgatttcagtatcaacactgagaagacccagtcttttgtttgcggcgaaccgaaattcattacgggattggtggttcagaacggcaccgtgagggtccccaaacggtacaaacgggaactcaagaaagaaattcattactgccagaagttcggggtgcttattcacctggaaaatagcaatgccacgcatttcgtgaattacagagagcatctctatgggaaagcatattacgtacacatgattgaacctgatatcggtgaaaaattcctcgatgaacttgacaaaatctcatggcccgaatatatggtgtga

SEQ ID NO: 10028 - RNA, 1056 nt, unidentified
  source 1..1056: mol_type = other RNA; note = synthetic construct
atggaacagaacgtgaaagacatgtacatagaaaggctctgtcacaccctcaacgactcaaaactgtccgatatgcacaagaacaagataatttcatacgctcagcagcttctggacaaaaatatgcccgtactttatgacaagaagcacatcgcgatgatttttgacctacggaacattcgactgatcagctccaactataacaaattctacatcgacgagaagcacaagaagcgcttaatcgaggctccttcgaagaaactcaaaagtatccagaagtggatcctcaacaatatcttagagcaactggataccagcgagtatgcctacggctttagaaaaggtagaagcatcttgcagaatgcgctttgccatttgggcaagaaaaatgttctctgtctggatattaaggattttttcggttctatcgacgaaaaaacagtcttctggctcttccggaacatagggtttactagcgaggccagtaagaccctgaaaaaactatgttgctataaaaaggcccttcctcaaggcgcacccacgagtccgtgcattgctaacatcgtgtgcattaacatggataagaagctggcacagttagctaaaaagtataatgccgtgtatagcaggtacgcagatgatatcacattttcctctgacgaggacattagcttcctgaataaggaggttgagaagattatacggaagtacaacttttttctgaacgacaaaacaaagtactacagtggcgatcatccaaagttcataactggactggtcgttcacaaagacaaaattagggtgcctaaaaagatcaagagagaattgtcaaaggaaatccatttctgtcgaaaattcggagtggatatgcatctgaataactctggggccgaaaaacgcgtaaattaccgtgagtatttgtacgggaaggcatactatattaagatggtcgagcacgaaactggagagaaattcctgggcatgctgaatatgatcgattggccagattgggccctggggtcctccaatacctctgacaatgaatcagtgctctga

SEQ ID NO: 10029 - RNA, 1005 nt, unidentified
  source 1..1005: mol_type = other RNA; note = synthetic construct
atggagcccaacgactacgtgaacagactgaggcatgccatggaaataagtgaaaatccaaggttcagccccgagtacattgcccagtgctgcacatatgccgagaatctcctgaagcagggactgccagtgctttttgaccaaactcacatacgtaaagtcctcggtatggccgcgcctcggctctgtgactaccataggtttacgatcccaaagcataatggttcccggatcatcacagctccgtctcgcaagttaaaacttcgacagcaatggatttaccaaaatatccttatccgaaaggaagcatctccatatacgcacggatttgtgccagagcgaagcattgtgacaaacgccatcctgcatataggttacgcctatacctattgcgtggacatcacagacttctttccgagtatcaccaaaaaacaggtcctgcccattttccgcaatatggggtatagcgggtccgcggccaacactctgtgtgatctctgctgctgtgatggagtactgcctcagggagctcctacctctccctacttgtcaaatatgatatgtagggacttggacgatgagctgggcgccatggcaagaagatttagaggcattttcactcgctacgcagatgatatcgctatctccgctaaccagcagcagcctcaattgctagatgctctggggctaattctcggcaaacacgggttcagcatgaacttggataaatgccggatttacaatcctggacagcccaaacggattactggcctcaccgttcacaacagagtgtcagtgccaaaggcattcaagaggaagctgcggcaggaaatccactattgtcagaagtttggcgtcaccgcccaccttgagaacaccaaggctgcacgctccattcattatcgtgagcacttatatgggaaggcctactacgttaagatggttgagcccgaactgggcgcgcacttcttagacgaactgtcgaaagtagactggcctgagtga

SEQ ID NO: 10030 - RNA, 1275 nt, unidentified
  source 1..1275: mol_type = other RNA; note = synthetic construct
atgggaaagtacaagtatattgatcggctaagacaggccatgggcggcaaatattctgaagagtacattaactactgcgcagaatatgccgccaagctgcttgacaagaatctgcctgtcatctatgacgctcgccacgtggacgagatactccgtctgcacgggatcaagcccgattgttatcatatctttgtaattgccgggaagaataaagagagaaaaatcactgctccgtccagagaaattaagcaacgccagcagtggatactggaagagatcttggagaagcaggacgtgtccgacaactgtcatggatttgtcaagaagaggtcgattttaacaaatgccaaaatgcacatgggccataaaaacatactcaacttggacattcggaatttcttcccatctattacagagactatggtgatattccaatttcagcagatgggctatagcaagtccgcggcggaagcattagcaggcgtttgctgttatgagggaaaactgccccaaggggccccaacctcaccctatatgtccaacctaattctcaagaagatggatcaggaccttgaaaatttctgccagaagaagggaattacatatacacgctacgcagatgacatgagcttttctagtaacgaggaaatcgaaggatttttcaaggacatcaaattcatcataggtaagtactcattcgagatcaacgagaaaaagacctgctactaccaggatccataccgcaaaatcgtaacaggcctgttggtcaaggagaacgaggtttgcattcccaaaaagttcaaaagaaagttcagacaggaaatctactactgtaggcaccttggggtgcagcggcacctcgagaatacgggtaaccaggaacggactggctttagggaatacatgtacgggaaagcctacttcatcgcgatggtcgaacctgaggccggtaaaaaatatctcgaggctaatacctttgatacctttaaagtggaacctagtctgatgacggtctttgaacaaagtcatacctgggatgagctcatctgtcacttcgtggacagctacgtggtggagactgacaaaaaggctgtgagcgccttctatgatcgaggttatatcgctgagaaactgaaaggcctggagactgaattggctctggaatgcaggataacccttaacggggaggagaggtggattcgtaatgttatcattcggggagagatcgaggattcagagtacgcaatgatttttctgcgagatgaaaagacctga

SEQ ID NO: 10031 - RNA, 996 nt, unidentified
  source 1..996: mol_type = other RNA; note = synthetic construct
atggacaagaaggcctatattgttagactggagaatgccatgaaagggacatactccaaagaatatatcgacgtgtgcacgaagtacgcaagctcccttttggataaggatctgccagtcatatttgatgagacacacctttatgagatcctccagctctacgctataaagccagacgtataccggaagtttcatattctcggcaaacgcggaaaactgaggaccatttgcgcaccttcgcgatctctgaagctccggcagcgttggatcctggacaacattctcgaaaaaatccctgtctcagagtgttgtgaaggtttccgcaaggatcacagcatatacactaacgccaagaagcatattggctacgaacagatgttgaatatagatatcaaggacttcttcccatctatcgccgagaagaccgtgattgaaatcttccacgagattgggtacagtagagcagccgcggatgagttgggtgctatttgttgccacgacggctgcttacctcaaggcgcacccacctccccctatctagctaatttagcttgtcgagaaatggatcgggagcttcttgaattcgcccagaaccataagttgatatataccaggtatgcagacgacatgacgttttctggcaacgtagaaatggataaactgatcaaagggatcgtgcagatcgtctatgcccacggctttatggtgaacactcgcaagacacgcatctcaactggtaatcagagaaggctggtgactggaatcattgtgaagaaggacggactggctgttccgcggaactacaaaaggaaactgagacaggaaatccattactgcaaacaatttggagttgctaaccacctcgagaatacaagcagtgagagaaaagcgaatttcagggagtacctgtatgggaaagcctattacatcaagatgattgaacccaaaaccggggagcaatttctacgtgagctggacgagattcagtggcagtga

SEQ ID NO: 10032 - RNA, 1062 nt, unidentified
  source 1..1062: mol_type = other RNA; note = synthetic construct
atggacgagtatattgtgaacctcaagaaggagctgatcaagaaggagaaatctatagagtacatagaccgatgctgtaaatacgcaaagaaactgctggacaacgggaagccaattatattcgatgccacccacgtcaaaatcatccttaagatggaagggatcaagaggaacgggtatcattactttaatgccggcaatatttacaaacagagattaatcgaagccccctctgtgaatctgaaagctagacagcggtggatcgcaaagaatattttagagaacgagcccctgggcgattggattcatggatacgtcaagggcaagagcataatcaccaatgccctggtgcacgccggaaaaaaaaggatcctccatatggacattaagaactttttccaatccatcacagacgagatggtggagaatgagttcgctaaaatgggatacagtgagtcagctgcgaaggaactgactagtatttgtactttctccgccgaaatggtctactggcaagaagtagaaaaactggaggatattagctcatcccagaaatatcttcctcacggtgcgccgtcaagtccatggttgtctaacctcgttttccagaacatcgacttgcagatcttggacattctcaaaaacaagaacatccaatacacacgatatgctgatgacctgatgtttagctccaattcggataagctagtgtggcttaaggatgagatcgaaaagctcgtgtctaagaatggtttcgccattaacgtaggtaagacgaagctgttcgaagaaaaagaccagaagctaatcatgggcctgaacctcaccaacgggataaagattcagaattcctacaaacgcaaactgcggcaggagatctattattgcaagaagtatggcatagagaatcacctgcaaaaagttggagcaagcaatcgcagcaattttgtggcatatatctacgggaaggtttattttgtcaaaatggtggagcctgaattgggcaaagaattactcgaaaaccttgatcagattttccaggaggagcccctgttttactga

SEQ ID NO: 10033 - RNA, 1056 nt, unidentified
  source 1..1056: mol_type = other RNA; note = synthetic construct
atgaacgaatatatcatccgtctggaagaagagttacgtaaaaacaacaaggaagaggcttttataactgcatgctgcacttatgcccgaaaacttctagaaaagaataagcctgttctgtttgacgctgaccacgtggataaagtcctgcgaatggagggaatcaaacgcgatggttaccatacatttaatgccggaacaagaaagaaagctagaattatcgaagccccatcagtgtccattaagaaaaggcagaggtggatagtaaagaatatactggagggcgaagaactggggggctggatccatggttatgttaaaggcagaagtatcgtctcgaacgctaaggttcacgctggcaaaaagcggatcttacggctggacatcaagaatttctttccctctatcaccaaaggcatggtggagaaaattttcagcgccatggggtacagtcccagtgcagccggagagctggcagcaatttgtactttcagctctgatatgttgtaccaggtgaaggggaggaccgaagaagaggaggcgtccgaggagtaccggtatctgccacacggtgcccccagctccccttatctcgcgaatcttatcttccagaatacggaccttgaaattctggagtctctacagggcagagagattagatattctaggtatgccgacgatatgtttttctcatccgacacagaagagttgcagcagctggatgaagagatagaagggattctgagcaagcatggcttccgactcaataaaaacaagaccaaacttatggctgagaaggatcaaaagctcgtcatgggtttgaacatcaccaacggaattcgcgtgcagaactcatacaagcgcaaactgcgccaggagatttactactgtaataaatacggcatccaagaccacctggagcggacagggaataagggcaagagcaacttcatggggtacttgtatggaaaggcatactttgtgaacatggtagagccggccgagggaaagcggctcctcgaagagttagacaggctcttcgccgatgagcaatga

SEQ ID NO: 10034 - RNA, 996 nt, unidentified
  source 1..996: mol_type = other RNA; note = synthetic construct
atgtacaattatgaatacacaatcaggctttgcgagactctgaaaagcctgagcgccgatgacgtgtacatatcaaagtgttgcaattatgctgaaggtcttctggacaaagaactgcccgtaattttcgatcccacccacctgaaacagatcctacgattggacgatatctccctggatgaatatcacatcttctacatcgataagaagaacggcggcagtagagaaatcaacgcaccatctgaggaactaaagaaacgacagcggtggattctgaagaacatcttggagaagatctctattagccacaatgtacatggattcataaaaggcaaatccatcgtcagcaacgcaagaaaacatttgaacaaggagtacgtcctcaacatagatatcaaggacttctttcccagcgttaccaaatactccgtggagaagatttttaggcggatgggctattgtaactctgttgctcagctgctcgccagagtctgttgttatcgcggagggctcccacaaggagcacctacatccccgtatctcgccaatttagcctttgacgaggtggatcaggagattatcaatgtggttcggaatcgcgacattacatatacaagatatgcggacgatatgactttctcagctaactatgacttatctacgttcaagaaagaagtgtacaagagtttggggaagtaccgcttttcgcctaacattatgaagacccatcaaatgtccggggaaaaaaggaagctggtcactggccttattgtggatgataaagtgaaagtctgcaagaagtacaagaggaaactgcgtcaggaaatttattattgcaagaagtttggggtgaccaatcacctgcggaattgccactcagagaaaagtattaactacaaggagtacctctacggaaaggcttactttataaaaatggtggaggagatcgttggtgagaaattcctcgccgaccttgactcaatcgactggtactga

SEQ ID NO: 10035 - RNA, 987 nt, unidentified
  source 1..987: mol_type = other RNA; note = synthetic construct
atggagaacaattatatctaccgtctgaagattaacatgtttgagcaaggctttagcacctcctacattgataagtgctgttcttatgctacactcctgatttcacagtcacttcctgtgatttttgataagaaccacctggatcagatattgatgctggacactctgaaactggattgttaccacgaattcgagatttataccaaggggaagtccagaatcatactagcacccagtaaacctctgaagagcagacaaaggtggatactcgacgaaatcctgaacaaactaccaactaaccagtgttgccacggattcgtccagcagcatagcatcaagacaaatgcagaaatgcatgtgaataaagctcaggtactctgcatggacatccacaatttctttccgagcattaacatagaccaagtcttcgaagtgttccatcgggtcgggtatacctccgacgtggcccaagccctggctcagttgtgcacacataatgggattcttccccagggcgcgccaagtagcccagatcttgccaacatcattttcaatcccattgatcagcagatcctcaactcaatctccacaaaagacataacgtatactcgctacgccgatgatttgatcttttcttcttctcacgagatcgacttcttaatccccctgatcagtgagattatctccacgaatggcttcaaaatcaataacgataagacccacctgatgaagaatccttacaggaagatgattacaggattaattgtgaccgacactgttaaagtgccaaaatactacaagcggaaatttaatcaggagctcttttattgcgagaaatacggagtagcctcgcatcttaagaactgtaggacccacaagaaggttaacttcaaggagtatatgtatggtaaagcctactacatcaaaatgatagagcctgacctgggtgaagaatacctccgacgcttggacgcaatcagatggtga

SEQ ID NO: 10036 - RNA, 1182 nt, unidentified
  source 1..1182: mol_type = other RNA; note = synthetic construct
atgctcaaagctaacgaactgattatcctgtcctacattaacaagtttcagaggatcgatctctatgagattcagaaaactattaacgagcccctggtgcagttaatggattccatctacaggctctacgaaaataaatacatcgtcaacgacggcatagataaattttctgttacagagaaagccaaagaagagaatattggaagctggaatatctggactctgaagtataaggagaaaaacatcaacaacaacgtgttcaagtacaacaaaaagtatacgggtgaattttgtgacaatggagtccccaagatctcgtctgtgcatcaaataaatgacatccttgaactcaaccacattgacattgagtcatatcacggattcgttttgagctacggcgggaagaacagaatgatcctggcgccagggttaaatctgaaggagaggcagaaatggatcctgcataacatacttgaaaagattcctgtggaagactgcgctcatggcttcgtgaagggacgttctataaagactaatgcagaagtgcacgttaataagaaagagatcgtgtgtctcgatatcaaggactttttcccgtcaattaagagagtgcaggttgagaatgtgtttttggaactgaactatagcgaagaggtagccaagaaaatatcttccctagtcacctacaatgatgagcttccccaaggggcacctaccagcccatatcttagcaatctcgtattccgcaatgtggatatggggctgaaaaaattagccaaagagaatgatttggagtatacacgatacgcggacgacataaccttcagtgctaatcatagtattgacaacatcatcaaggaggccgaagagattatcgaacgcgcaggttttatcgtgaatgaggataagacacacatcatgaaggataactatcggaaaatggttaccggactagtcgtcaatcacaaagtacggatacctagtgcttataagaagaagttccggcaggaaatctactattgcaagaaatacggggtgtcacagcacctgcgagcaattggtagagaaaacgccgtcaactttcaggagtacatgtacggcaaggcctactatatcaaaatgattgagaaggagctgggcgagaagctcctgttgcaactggactccattttcggcgtctga

SEQ ID NO: 10037 - RNA, 1125 nt, unidentified
  source 1..1125: mol_type = other RNA; note = synthetic construct
atgaggaaagaagtccagaaggctctggaggattacatcagttattttgggattcaaaaggcaaaagagcaactcaaatcatataagaagcattccgagaagtataacaaaaagggttacgttttcttcgacgaaaatcactttgacaagatagtggagagtaatacgcagatcggggtttaccaggttgactactattacgacgtctacaaaataccaaaaaagcggggtggatacagagagattgcttctccatctctggaattgaaaagcattcaggagtttattaacgagaacattctgctctatggcgacgtttctgattattgccacggatttgtcaaggaacgctcaatcgtgacaaacgcccttaaccattgcaacaaagaacttgtaatctgcatggatattaaggacttcttcaaatccatcaagatcgaggatattatatctgtcttctccaacatgggctacaataaagaaattagcaatgcactgggcatgtggtgttcatttaaaggggccctagtagccggtagcccttcgtcacctgccctgtccaatctagtgttcagcaagctggacgagatcatcaatgacatttccatcaagtacaaattcatctactctcggtatgcggatgatatggtgtttagcaccaataaaaagaacgctaactacaaccagttaatcgaggaggtggagaagtgcgtgaacaacttcaattttagtataaacgctgagaagacaaagatttatcccaaatgtggaaaacaggaagtgaccggcttgattgtcaacaatactgtgaaagtgaagtccaaaattaagaaggaagtgctcactcacatatactattgtgaaaagtttggcttcgaaaatcacttaagcaggtatgataaggagtatatcctgaagaacagtatcgagcagatcaagatcaaacgacatttcatcaattacatccgcggaaagattaatttcatcaagatggtcgagccccttaatggcgggaatgtagagaagagatacctggaagtgtttgccgaagaagaggcaaaactcaaattggaggagaaaccgatagaaattggatttgaagagctggacgatatctacatatga

SEQ ID NO: 10038 - RNA, 999 nt, unidentified
  source 1..999: mol_type = other RNA; note = synthetic construct
atgagcaataacctttccaaacacaatgagaagaatgactacgaaaagaaaatcaagtcatactcccagaagatccatgagaatggggttcccttgatttttgattccgagcaccttcgtcggataattggcgtgaacaagaagagcttcttagagattattaactctatcgacatccagtatcatacaatctatgtgcctaagaaaagagaagggttcagagagataaacaaaccaagcattaacctgatgataatccaacgatggatcctcgaaaatatcctctacaagaagaaggtgcataacaacagctttggattcgagcctaaaaaaagtgtgatcagcaatgctaaggaacacctcaataaaaaaaccgtgctgtctgtcgacattgaggatttctttcactccatcaaggaggactatatcaagaagatttttctagacatgggttataccaagaaactgtccgaactattggccaaaatctgttgctttaatggcatgctgccacagggttcaccctcaagcccgtacttgtcaaacatttactgtattgagctcgacaaagacatttacaagctctgccagaactacgatctgaagtactcccgctacgcagatgatatcacgataagtagcaataaccacattaattctgaggaagtgataaccaacctgattaaaatcttcaacaagtacggattcgagatgaattcttctaaaactcgcgtctcgctcaaagggaatagacaaattgtcacaggaattctggtgaacgacaagctgaatgttagtaagaaataccggaatgacttacgacaggaaatctattatcttaacaagtatggccttgaaaaccatctggataaacgggatgatataatgaggaggagtaactataaagagtatatctatggcaaggtaaactacttgaagctgtttgacatcgagaaagccaataactactatgaagtactgaataggatcgattggtga

SEQ ID NO: 10039 - RNA, 990 nt, unidentified
  source 1..990: mol_type = other RNA; note = synthetic construct
atggagatctcagcccacccacaggcgttgtccaagctgaaaaacctcgggctcccagctgtgtcaaacttgaatgaattatcgtcacagatgcgtctgtcttctggtcttttacagcaactcatttacaagtccgatgaccactaccacgtttactatcttgacaaaaaatctggaggaaagcgggaaatagcacagcctagccgcgctatgaaggcagtccaatcatggattctgcgcaaaatactctataggctgagctccagtggcaatagtaagggcttcgagattggcgaaagcatactaagcaatgccaaaccccatgtcggtgcacatgtgctgctaaacatcgaccttgaggatttttttcattccgtgccggccagcaacgtgtattccatttttcattcgatcggatacaacaagaacatcagctatatcttgacatccctgtgtaccttcaatgggagactgccccaaggggcccctacttcccctaagctgagtaatcttgcgtgtcagcgactggactctaggattcagggttattctgggcccaagggaattatgtacaccaggtatgccgatgatatcactctgtcagccagaaatgaagctaagatacgcaaagctcagcctatgattgaggagataatccaggatgaggggttcatcatcaaccacaaaaagacaaaaatctgcggtactaggaagcgaaaggaggtgacgggcctggtcatcagtcccaattctgtgggcatcggcagaagcgagtatagacggattcgggcagaagtatacagcatgctcacatctgacaattcaaagctgccaaccatcaatgggcggattgcccatattaaatccgttgacaaaaacaactacgagaagattaccaagtacatcctcagcttgaaaaaaaagcacccagaaaacgatctcttcaacctgatagtttgcatcaagggccacattagtcagggagtatga

SEQ ID NO: 10040 - RNA, 984 nt, unidentified
  source 1..984: mol_type = other RNA; note = synthetic construct
atgaccacccttcaggatagcaaaaacctctctaggctcaaaaatctgggtttgcctccagttacgaatctggacgaactgagcagtcaaatgaggctctcaacagggctagtgcagcagcttgtttataagagcgatgatcactacaaggtctaccacctggacaaaaagactggcgggaaaagagagattgcccaaccttccagagctatgaaggccgcccagtcgtggatcttgcggaatgtgctgagtcgccttaattcttcacagaactccaaaggttttgaaataggcgagagtattctgagcaatgccgcaccacatgtcggcgctcacgtgctgttgaacattgacctagaggatttcttccattctgttccagcctctcacgtgtatagcatttttcacagcatcggatacaacaagtcaatctcccatatattcacatgcttatgcacctttaatggccggttaccgcaaggagcacccacgtccccgaaattatccaatttggcctgtcagcgtctggacagtcgaattcagggatactctggccccaagggaattatgtataccagatatgcggatgatatcactctgtcagcatttaacgaggcaaagattagaaaggctcagccaatgatcgaagaaattctccaagatgaggggttcatactgaaccctcgcaaaactaagatctgtggaacacgaaagcggaaagaggtaactgggcttgtgataagcacagactctgtaggcattgggaggaagaaatacaggcagatgcgggcggagatctacacaatgctgaagtccgacaccagtaaactcgctcaggtgaacggttggctggcctatatcaagtccgtcgacgaatcgaatttcaaccgcctcattaaatacatcatcgccctgaagaacacctttcctaacaatgacatctttgactcaatccccttcatcaaagctactagccccaagtga

SEQ ID NO: 10041 - RNA, 999 nt, unidentified
  source 1..999: mol_type = other RNA; note = synthetic construct
atgacccagtattccaatattaacaatctgagcagactcaagaacttgggcctgcccccgataggggatctcaacgagttaagtaaccagatgcggctatcatctggtctgattcagaaattggcctatctgtccgacgagcactacaaggtatactacctaaagaagaaatcaggtgggcagagggagattgcccaacccagccgcgctatgaaggctgtgcaatcctggatcttacgcaagattctctatagattgagctcttctcagaatgcaaaaggctttgagattggagagagcatcctttccaatgccactccacacatcggcgctcatgtgctgcttaacatcgacctcgaagattttttcaacaccattccagcatcgcatgtttactcaatttttcacagtataggctacaacaagactatctccaatatcttcacgcgtctgtgtacctttaaagggtatcttcctcaaggagcacctacatcaccaaaattgtccaatctggcttgccagcggctggacagccgcattcagggatacagtggacccaagggcatcatgtacactcgatacgccgatgacatcacactgtctgcgtttaatgagacgaaaattcgaaaagcgaaacccataatcgaagaaatcttaaaggatgaaggattcttcatcaacgactctaaaactaagatatgcggcacacggaagagaaaagaagtgaccgggcttgtgatttcaattgatggagtggggatcggccgtcgcaaatataggcagattagggccatgatatatacaatgctgaagtccgacggtagtaagatcgagcaggttaatggctggctggcctacatcaagtctgtcgacgagaagaattatttccggctggtcaaatatatcctcaccctggagaagaacttccctgaaaacaagatttttgagagcataagtagcatcagggaaaaaagagtcgataaggggaactacctctga

SEQ ID NO: 10042 - RNA, 975 nt, unidentified
  source 1..975: mol_type = other RNA; note = synthetic construct
atgccaaaccaccagattgtaacttcactttcacggcttaagaatctcggcctgccgcctgtgaccaatctgaaagagctagctagtcagatgcgattgagtagcggcctcctgcaacagctggtgtataagagcgatgaacattataaggtttactacctagacaagaagagcggcgggaagagggagattgcgcagcctagcaggtctatgaaggccgtccaagcttggatccttcgcaaaattctgtacagactgttttccagccagaatagcaaagggtttgaaactggtgagagcatcctgaacaacgccacaccacatatcggcgcacacgtcctgttaaacatcgacttagaggattttttccactctatcccagcaagccacatttattccatttacctgtccatcggatataataagaagatctccaacatcttgacttccctctgtaccttcaaaggtaggcttccacaaggagcccccacatcacctaaactgtctaatttggtgtgccaccgattggatgcacgcattcagggatacagtgggcccaaaggaatcatctacacaagatatgccgacgatatcacactcagtgccttcaacgagagtaaaattagaaaggctcatccgataatcagatctatattggtggacgaaggctttaccgttaatcagtctaagactaagatctgcggtacacggaaaaggaaggaagtcaccggcctgataatttctaaagactcagtgggaatagggcggaagaaatatcgtgaaatgcgctcggagatttacaccatgctccagacagatccctcaaagctgcctaaaatcaatgggtggctgtcctatattaaatccgtggatacgactaactacaaccggcttattaagtacattaccaaactcaagacgacctttcccgacaatctcctgttcgagaaaatcttattcatacagaagaagtga

SEQ ID NO: 10043 - RNA, 972 nt, unidentified
  source 1..972: mol_type = other RNA; note = synthetic construct
atgggctctcagtataccaataatctgtcccagctgaaaaacttaggcctcccggctattactaacctggccgagcttgccagtcaaatgagattgagcgtggggttagtgcaaactctggttttcaaatctaacgaacactaccgcgtgtatttcctagacaaaaagagtggaggggaaagagagatagctcagccttctcgggcgatgaaggcagctcagagctggatcctaagaaagatcttgtaccggctcaattcaagccagaacagcaaaggctttgagataggggagtccattctctctaacgccgcaccacatatcggggctcatattctcctgaacatcgatctcgaggatttcttccacagtgttcccgcttcacacgtgtattcaatctttcactcaatcggctacaacaaattgattagtcagaagctgacgagcctgtgcatatttaaaggtcgactgccccagggtgcgccaacctctcctaagctgtcaaatcttgcatgtcagaggctggacagccgcattcaaggttacgccggatccaaagggattatgtatacacgatatgccgacgatatcacactcagtgccttcaacgagagcaagattaggaaagcaaagcctatgatcgagaagatagtactggatgagggcttttcgatcaatcacaagaagacaaaactttgcggaactcggaagcgcaaggaagtcaccggacttattgtctccgccaacggtgtcggcataggacgggaagaatacaggaagatgagagccgagatctacaccatgttacagtccgacccctccaagttggcccatatcaatggctggctggcatatatcaagtccgtggacacgaccaattacgcgcgtctcattaaatacatcaggacactgaagaagatttttccagattctgaagtgttcaacctgattcccgctatcaaaaaaaattga

SEQ ID NO: 10044 - RNA, 975 nt, unidentified
  source 1..975: mol_type = other RNA; note = synthetic construct
atgaccatccctagcagtcccaccgacctctcacgtctcaagaacttgggtctgccgccaatcaccaacttaaaagagctcagttccgaaatacgactgtccaagggtttcctgcagaaactgaattataagagcgatgagcactatctggtctatactctggataagaaatccggcggaaaaagggagatagcacagcctagtagggctatgaaagccgtgcagtcttggattttgagaaagattctggtcagacttaaatccagcaaaaacagcaaggggtttgaaattggcgagtcaatcctttctaacgcgagcccgcatatcggggctcacgtgttgttaaacatcgacctcgaggatttctttcactccgtaccagccagccatgtttacagtatcttccactcaatcggctacaataaactaatctcccacatcttcactaacctgtgtacatttaatggccggttaccccaaggagcccctacttcacccaaactgtctaatctcgcttgccaacatctcgactcaaggatccagggatatgccgggattaagggcattatttacacgcggtatgccgacgatataaccctctctgctctaaacgagtcgaagatacgaaaggccaagagcatgatcgaagaaattgtcgtggatgaagggttcatcatcaataagaagaagacaaagatctgcggaacccgcaaacgcaaagaggttacaggtctggtgattagcaaggattctgtgggaattgggcgcaaaaaatacaggaagatgagaacagagatttacacgatgctgaagtccgagcccgcaaagttgccacaggtaaatggctggctggcatttatcaagtctgtggacattaagaactacaatcggctgaaaaaatacatacttactctgaagaaggtgtttcctgaaaatgacattttcgaacttatcccaagtatacagaaaaaatga

SEQ ID NO: 10045 - RNA, 987 nt, unidentified
  source 1..987: mol_type = other RNA; note = synthetic construct
atgagtgatacaaacacttccaacaacctgagccagcttcggaatctgggtctgcccccagtcgccactcttgccgacttagcgagccacatgcggctctctgtgggcctgcttcaattgctgtcatataaaagcgacgaacattacaaggtttactacctgaaaaagaagtccgggggaagaaggcaaatcgcacagccatcgcgggccatgaaggctgtgcagtcctggattttacgcaaaattctgtccaggctgagttcctcagccaatagtaaagggttcgagcagggcgaatccatactctccaatgccttaccccacgcgggggcccatgtgattcttaatatcgacttggagaacttctttaacaccgtacccgcaagccacgtgcactctgtctttcggagcatcgggtacaataaaactatctctcagatcttgacaaacctgacaacctataacggacgactgccacagggcgcacctaccagccctaagctgtctaatctgacatgccagcaactcgatgctcgcattcagggctatgctggtcctcgcggcatcatttatacgaggtatgcagacgatattactctgtccgcctttaacgaatctaaaatccgtaaggctcagccgatgatcgaggagattgtaaacagcgaaggtttcactataaacgacaagaagaccaagattagtggaacgcgtaaaagaaaagaggttaccggtctagttatttcaatcgacggagtgggcataggccgacaggaatatagacgcatgagagcagagatctataacatgctcacagaggattctgataaattgtcgcagattaacggatggctctcatacatcaagagtgtggataagaccaattaccacaggctaatcagatacatactgaagctcagggggcatatcaagaatgaggctgtcttctcagaaatagcctgtctcaataaatacaccaatcaaagctga

SEQ ID NO: 10046 - RNA, 972 nt, unidentified
  source 1..972: mol_type = other RNA; note = synthetic construct
atgactacactgtccaaaaactatccccttagaaacttcgggttgcctgtcatctcctctttagaagactttgcttccagcacaaggttgtccgtgagctttattaagtactacctctttcaaacagactcccactataaggttttctcgatccccaagaaaaagggcggtgagcgcatcattgcccagccatctcgaaatctgaaggccatacagagctggattctgcggaatattctggatagactatcttctagcgaaaattctaaagggttcgaaaaaggcgactccatcctgaataacgctttgccccatagtggcgctagttacatactttcaattgacatcgaggattttttcccatcaattagcgcaaacaaagtgcactccgtgttccggtcactgggctacaattccgacgtttgcaagatcctgaccaccttctgtacttataagggacgtctgccgcaaggagcgccaacgagtcctaaactagccaatcttgtgtcgcagcagctggatgcccggattcagggctatgccgggcctaagggtatcatatacacaaggtacgctgatgacttaaccctctcaagtaacactgtgaagaaactcgagaaggcaagagatattatcggcctgatcagtaaatcagagggcttgaagataaattccctgaaaacgaaactgaccggaagccggtctaggaaaagcgttactggactcatcgtgaccaaggagggggtagggatcggacgagcaaagtaccgcgaactcaggagtcatatctacaacctgtttaaggacaataatggtgatatcaacaagctcacaggtcatttatcttatgtatatagcgtcgacaaacgcaacttcaagagactcaaaacctacatcaacaacataagcaagaaatatcctaaccccatttactttctgcacctttcaaaaattgccaatgtcaagaagtga

SEQ ID NO: 10047 - RNA, 963 nt, unidentified
  source 1..963: mol_type = other RNA; note = synthetic construct
atgacaggaatctatcggcttaaaaatattggcttgccggtgattaaaaatattgacgacctggctcattttaccaggttgtcttcaaccaaactaaattacctgagcaattcgagcaagttcctgtacaaagtgtacgccctccctaagaagggatccgggattagaatcatcgcccagccttcacgggagcttaaggccgtgcaagcctggatcctccgcaatatcttagaccggctgtcctcctccgattgttccaaggggttcgaaataggttcaagcatactggataacgcaaagccacacattgggtcaaactacatactgaacattgacctaaagaacttctttccctctatctctgctaataaagtgtacagtgtcttcagctctcttggctacgagaagaaggtttgcatccttctgaccaacttttgtgtctataatggatttcttccccagggcgcacctacttctcccaaattagctaacctgatctgcagtaaactcgatagtaggattcaaggctatactgggcccaggggtctgacatacacgagatacgcagacgatattacaatcagtgcgaacaccatcaaaaagattatcaatgcccgcgatttcctcgaaacaatcataaatagcgagaatctgagcgtgaataaaaataagacccagatcagcggcgttcgaaaggccaaaaaagtaacggggttgattgtaaaccaggctaatgtcggcattggacgtggtagatatcgcgagatccgagccgaaatacactacgtttatctcaacaagaagactaatctgcatagaatcaacggacatctggcatttgtctactccgtggacaaaaaaatgtataacaagctggtggcgtatttaaacaagctcattgagaaaaacccacactgcttgttgaaggatctcaacatattcaaaaacctgatcaagaagtga

SEQ ID NO: 10048 - RNA, 1020 nt, unidentified
  source 1..1020: mol_type = other RNA; note = synthetic construct
atgcagttagataacaggaaattccagttgaagatctttaatctcccagtcatcgagactatcgacgacttggctgagtgtactcgcttgtcaccgcccctgattaagtacctgacttatcgggcagaccacctctacaaggtgttccatatccccaaaaaaattggggagtttagagagatagctcatccctgtcgagagctgaaggctattcagggttggattctaaggcacattctcgataaactgtctcccagcgaaaattctaaggggtttgaattaggatcctctactctcgaaaacgccagcccacatatcggctccaacttcttactaaacattgatctgaaggatttcttccctaccattgtagcaagcaaggtgtacggagtcttccacagcataggttataacaagaaaatcgccggcgccctgacctcgctttgcgtgtttaagggcagacttccgcagggagcccctacatccccaaaactggctaatctggtttgcctgaaactggacgccaggattcagggatatgcaggtcctagaggaattgtatttacgcgttatgcagacgacatctcacttagtgcccagacactcaagaagatccagaacgcgaaaaaccttattcacaccatcgtcgcgtcagagggccttgaaatcaataatcggaagacctctatcagcggcaccagaaagcgcaaaaaaataacagggttggtgattaccgaaaacagtgttgggatcggccgggatctaacacgccaaatacgtgccaagattcatcacctgtttatagaaaagtctaccaatttctcccacgtgaatgggctgctggcttacacttacagcgttgacaaaaagagttatcgaaagctcgattccttcatagagaaactcaaactcaaataccctttgtgcccagccaccacagagctgtataaaatcaagaattcaacgatcacccaatttacaaaggtgtgttacaggacttcccggatcaagaagctgtga

SEQ ID NO: 10049 - RNA, 963 nt, unidentified
  source 1..963: mol_type = other RNA; note = synthetic construct
atgccccaggattcacatatttacagactgaggaatctggggctcccggtcatgaagtccagcgaagactttgccaattatactaagttgagtgcaagccgaattagactgctgcatctgcgcgctgataagttctataaagtataccgtctgcctaagaaaagtggaggaaccaggctcattgctcaaccatccagagagttgaaggccctccagggctggatcctacggaatattctggataaactgcgggcgtccgatcaatccaaaggtttcgagattgggtcgtccatcctggacaacgctgcccctcacacaggcgccaactttatattgaatatagatctggaggacttctttcccagcataaaggccaaccgcatctttagcatatttagatcaatcggctacaacaaggagctctgtgtgctgttgacgaatctgtgtacatactcaggcagacttcctcagggggcacccacctcacccaaattagccaacctgacttgcgcacagcttgacgcacggatccaaggatacgcaggaccaaaggggatcatttataccaggtatgccgatgacatcaccctaagtgcacagaccgctactaaaatctacaaagctcgctatttcctcgactatctgatcgccgatgagggatttactattaaccgtcagaagacgcgagtctatggtacaatgtcccgcaagtgcgtgacaggcttagttgtgagcgagtctgccgttggcatcggtcgagaaaagtaccgggaaattagggctcagatccaccaccttttctctgggaaggccgactcttataggtacttaaacggcctcctcgctttctgcttcagtgtggacaccaaatcttaccgcagggcgtataaatacatgcggaagcttcaggaaaaatacccaaattctaacgccatgaatagcatcattcctgagaaggaatga

SEQ ID NO: 10050 - RNA, 972 nt, unidentified
  source 1..972: mol_type = other RNA; note = synthetic construct
atgatgactacacagaacatttatcggttgcgtaatctgggactgcctgcaatgaaaagtctggaggatttcgcctccttttcccggctcagcccatcgaagatcaggcatctcagtcgaagcagcgagtttctttacaagacttacaaagtcccaaagacaaatggcagttataggctgatcgctcagccgagtagggatttaaaggctgttcaagcctggatccttagaaacattctcgatgaattatcttgctcaagctattcaaaagggttcgagtctggcatgtctattctcgataatgccaaaccacacatcggctctcagtatgtgttgtcagtggacctccaggatttcttccccagcgtcagcgcaaacaaagtgtacggtgtgttctcctccgttggctacaacaaggagatgtgtgtgctgctgaccaacctatgtgtctttaagggaggactgcctcaaggcgcgcccacatcacctaagcttgcaaacctggtgtgctctaaactagacagccggattcaggggtatgctggtcccaaaggaatcacatatacccgctacgccgacgatatcactctttcctctaattccgccttaaagatacagaaggccaagagtttcctcggcaccataatcagtgacgaggggtttaaaatcaacaagccaaagaccaccctgtccggggtgaagaagcagaagaaaatcacgggtttggttctctccgacaacaatgtcggcattgggtcactgaaataccgcgaaattagagcagaaatacattacctgtttgcgggtaagtctaataattacagaagggtgaacggattgctgtcattcgtatattccgtagacaagaaaatgtacacgcgattgcacgcttacataagcagcctgaaaaaaaaatttccccaaagccctgccgcttcatctctgaataaggaaatcgtcatttcgcgctga

SEQ ID NO: 10051 - RNA, 975 nt, unidentified
  source 1..975: mol_type = other RNA; note = synthetic construct
atgaccattaacaatatctatcgcctgaagaacatagggctgccggttatgcagtctatcgaggacctggcaaaacacgcgagactgagtatcgaaaagattaggtatctgtcagtcagagccgaatttatctacctgacttacgaattgccaaaaacaaacggcaagacgcgggaaattgcccagccctcaagggagcttaaggcaatccagtcttggatactgcgtaatatcctagataagctttcaccctctatctacagtaaagggttcgagaaaggtacttcaattttagataacgccttcccccatattggcagcaccttcgtgttaacaatagatctcgagaacttttttcctacggtgaaggccagtaaggtgtttaccttattcaaatccgtgggatataataaggaaatgtgcgttctactgaccaatttgtgcgtgtacaaaggtgggttgccccaaggcgcacctaccagccctaaactcagtaatctgatctgtgacaaactcgatagccggattaacggctacgctggaccaaagggcatcgtctacacacggtacgctgatgacatcacactttccgccaataatattcagaagctgcagaaagcgaaggatttcattggtactattatctccgacgagaactttaagatcaacaagagcaagactaaactttgtggaactaagcgacagaaaatgatcaccggactggtcctgtcggagagctctgcagggataggacgagtgaaactcagagagataagggctaaaattcatcacgctttcgttggcaagcacaatgagttcgaccacattaacgggctgctgtccttcacatattccgtagataagtccagctataagaaactctaccgctttatcgacaagatgaataaagactatccagactctttggccgtactcgaacttcataagaacctgttgaagaaacaactccagtga

SEQ ID NO: 10052 - RNA, 960 nt, unidentified
  source 1..960: mol_type = other RNA; note = synthetic construct
atgacttccaacagcatttaccatctgaaaaacctcgggctccctgctttaacatctctggatgagtttgcccatgctatgaagctgggatctaacacagttcgctcactaagcatctcttccaactcactctataaaacttacaaggagcccaaaaagtcaggcggctttagggagatcgctcagccctgtcgggaattgaaggctgttcagagctggattctgaggaatatattggataagctcaattgctccccttacagtaaaggctttgagaaaggaaagtcaatccttgataatgcacagccgcatgcaggcgcaagctacttgctttctatggacttagaaaatttcttccccagtatcggtagttataaagtgtacggtgtgttctccagcattggatacaataaggaaatgtgcaagcttctcaccaatctgtgtacctattatgacagtttgccacagggcgccccttcttctcccaaactggctaacctaacctgcagcaggctggacgccagaatccacgggtatgccggaccaaaaggaataacgtatacacgctatgccgatgacatcaccctgagtgccaacaccgcagtaaagatagagaaagccaaagcctttatcggcacaatcgtacacgatgaagggcttaaggtcaacaaaaccaagactaagatttgtgggactaagcggcaaaagaaggtgacagggctggtcctgtctggtaattccgtgggcattgggcaaaagaaatacagagaattgcgttccgcactccaccgaattttcgtcggtagatcgactgagtactcgttcgtgaatggctggctgtcctttacgtacagcgttgacaaaaaagcgtataaccagctgtacttagtgattgactccctgagcaagaaatacccacagtcagatgctctggagcacctctatgcgaagaagggatga

SEQ ID NO: 10053 - RNA, 960 nt, unidentified
  source 1..960: mol_type = other RNA; note = synthetic construct
atgacgtccaagaacatttactcactcaaaaacatcggactgcccgctatggctagtatcgatgacttcgctaacgaagcgcggctctcgcctggcaagattagatacctttctgccactgccgaatcccactatagaatatacccgataccaaaagtggggggaaagagccgcctgatctcccagccctcaagggaacttaaggccgtacaggcttggattctgcgaaatatcctggacaaactgtctagcagtccctgttctaagggcttcgaaattggcacctcaatcctcgacaatgccaggccacatataggcagtaactacgtcctcaccatcgatttggaggattttttcccgaatgtctctgcatccaaggtgtttggggtctttagctcgattggctataacaaagagttgtccattttgctcaccaatttatgcacgtattccggtggcctgccacagggagcccctacaagccctaagttagcaaatttggtgtgcgcgaaactggacgcccgaattcaaggttacaccgggccaagaggcatcgtttatacacgttacgcagatgacatgacttttagcgcccacacagctagcaaaatcaggaaggtaaaacatttcatcggcacaatcatttccgatgaggggtttaaaattaaccacaagaagaccgccatctgtggaactaagcgccagaagaaggtgaccgggctgatcctgtcagagtcttctgttggtataggaagggtgaaacatcgggaaattcgcgctaagctacaccacctgttcacaggaaaaagtgccgagttcagccatgttaatgggcttctttcttatacttacagtgtggacagacggagctataacaagctgtactcatatattgcaggtctatccaagaaataccccaattcaaacgcaataatcgagatcagccctaaaatcgtgtga

SEQ ID NO: 10054 - RNA, 960 nt, unidentified
  source 1..960: mol_type = other RNA; note = synthetic construct
atgacttccaagaacatttattctctcaagaatctgggactgccagccatggtatccgttgacgactttgctaacgaatcgcgattaagctcagcaaaaatcagatacctatcagccaccgccgacttacattacaaagtgttttccatccccaaagtcacagggaagagccgcttgatctcccagccctctcgcgatttgaaggctattcaggcatggatccttagaaacatcctggataaactgagttcaagttcttgtgcaaaggggtttgaaagaggttccagtatactggataatgcacggcctcacatcggaagtaactacatacttacgattgacctggaaaatttctttccgtctattgccgcttccaaaatttatggtgtttttagctcgataggctataacaaacagctgtcagtgctgcttactaatttgtgcacctataagggcggtttgcctcagggcgccccaacttcacccaaactcgcaaacctggtatgcgccaagctcgacagcaggattcaaggctacgctggaccaaaggggatcgtgtatacaaggtacgcggacgacatgactttcagcgccaacaccgctctgaagattaccaaaaccaaacaattcataggcacaatcatcagtgatgaggatttcaagatcaattcccagaagacagtgattagcggcaccaagaaacagaaaaaagttacggggcttattctctctgagaatagcctaggaattgggcgtgtgaagtaccgggaggtcagggtgaaactgcactacttattcaccgacaagctcagcaacttctcttacatgaatggaatgctggcctatatctatagtgtcgataagaaaagctacaacaagctgctctcatatatagctaaactcaagaacaagtaccctaattctatcgcggtgaattttatcaactccaagaataagtga

SEQ ID NO: 10055 - RNA, 969 nt, unidentified
  source 1..969: mol_type = other RNA; note = synthetic construct
atgagcagcaacaatatatatagccttaaaaacctgggtctgcccgctctcaaaaagatcgaagatttcgcttttgtgaccagactctctcaggggaggataacctatctggcatacaggaccgagcacttatataaaacgtacgacgtccctaagaaatccggcaagaagcgcgaaatcgcccagcccaatcgtgagctgaaagccgtgcaggcctggattttgcgcaacattctggacaaactttccagttcgccacactccaagggattcgatctcggcaccagcattcttgaaaatgcagtaccacatcaaggagctaactacatcctgacgttggatctggaggacttctttccgtctatctcagctaataaggtttacagcatttttagctccatagggtataacaaggaggtcagtagtctgttgactaatctgtgtgtgtttaaggggggcttgccccaaggagcgcctacaagtcctaagttagctaacctggtttctgccaagctcgatgcacgaattcatggctatgcaggcccaaaggggatcgtctacacacggtacgcggatgacctcacattatcagcccagtcagtgcagaaactggagaaggccaaaaacttcatagacaagatcatcacagacgaggatctcgtgattaatcgctcaaagaccaaattgtgcggtacaaagcggcagaagaaaattaccggactcgtgctatcccagaacaatgtaggtataggccgggaaaaacttagagagattagagccaaaattcactacctgtttatcggcaagaacatcgactactctcacgtgaatgggtttctggccttcacttacggagtcgacaagaagtcttatactaagctatacaggttcatcgagaaaatgaaagcaaagtatccctccagcgaagctgttactgaactgcataacaaagccatcaaacgaatctga

SEQ ID NO: 10056 - RNA, 975 nt, unidentified
  source 1..975: mol_type = other RNA; note = synthetic construct
atgccaaataaggcccatttatacaggctgaaaaacttgggactgccagcaatcgaatcaattgaaggttttgccgataaaacacggatctccttggagaagattaaatacatctcttaccgctcaggtcatctctacaaggtatatgagatccctaagatcaacggaaagaagagacgaattgcccagcctaaccgggagctgaaggctgtgcagagctggattttacggaatattctggacaagttgtccactagcgagcactgtaaaggcttcgaaactgggacctccatcctggacaacgcggtgccccatgtggactctaactatgtgctgacggtcgatctggaggactttttccagagtgttaaagccagctccgtgtatcgaatcttcaactcgataggctataacaaacaagtctcatctatcctgactaacatctgtacatctgatgggggtcttccccaaggagcacctacttcgcccaagcttgctaatcttgcatgcgcgaagcttgatagtagagttcacggatatgctggacagaagggcatcgtttataccaggtacgccgacgatataacactatcagctcagaccccaaagaagatctacaatgccaagcagttcatcggcaccataatttctgacgagggattcgcaattaataaggctaaaacccgcatttccgggacaagaagccagaaaaaaattactgggctcattctatctgaaaaccgcgccggtattggcaggaataaataccgtgagataaggtgcaaaatccactacttgtttgtgggcaagaataaagattatagtcacgtaaatggcctgctcagctttacgtactccgtggacaagaaggcctataagaaactctatagctacatcaagatgctcaagaacacctacagtgatagcaaagctggggacctgctggtcgccgaaatcacaaaaataccggcatga

SEQ ID NO: 10057 - RNA, 972 nt, unidentified
  source 1..972: mol_type = other RNA; note = synthetic construct
atgtccaacaagtcatatatttaccgactgaagaaccttggactgcctgccatagagtctatcgatgatctcgcagacgcttgcaggctgtctctgggtaaagtgaagtatctctcttatcgtactgaatacctctacaaggtcttttgcatacctaagaaaaccggcaagaccagaacgatctcacaacccaaccgggagctgaaagcactgcaagcttgggttctccggaacatcttggacaagttatctagctctgaacatagcaaaggcttcgataagggcgcctctattctggataatgcatcaccccatgtgggagccaactacatcctgacaatcgaccttgaggacttctttagcaacgtgaaagccagccatgtttacaagatctttcacagtatcgggtacaatgacaagattagtgccatactgaccaacatttgcacttttaaaggtgctttgcctcagggggctccaacatcccccaaattggcgaatctggtctgtgcaaaactggactcccgacttcatggatacgcgggaccaaaagggattgtgtatacacggtacgcggatgatctaacgctgagtggccaaaccccgcagaagatctataaggcttcccagttcattgggaccgtaatatcggacgaaggcttctcagtgaataaggccaagacaaatatttgtggcactcagaaacagaaaaaagtaaccggcttggtggtttccgagcaccacgccggaatcggcaggcagaaatatagagagattcgcagcaagatacactaccttttcgaaggaaagtccaatgatttccaccaggtgaacgggctcctagcctttacttacagtgtcgacagaaaaagctataagcgcatctattcatacgtcaataagttaaagctcaggtatagtgggagcgaagcctccaagaagattgctgcagagatcggtatcaaagcctga

SEQ ID NO: 10058 - RNA, 969 nt, unidentified
  source 1..969: mol_type = other RNA; note = synthetic construct
atgaatgagaagcagaaaaaatacgggctcaagaacttaggtctgcctgccattgagacaataagcgaccttgctaacgaaattcgactgagtgataacaagatccggtacttggcctatagggcccagcatctttataaggtttatagtatccccaagaagagcggtggaagcaggctgatcgcacagccttctcgagaacttaaagcagtgcagggctggattctgagaaatattctcgataagctgtccgcctccgaacattcaaaaggatttgagaaggagagttctatcctggataatgctatgccccacgtcggcgccaattatgtactcaccgtcgatctgcaggacttcttcccaagtataaaagccaacaaagtctactctatcttttatagcgtgggatataataagctcatctcctcagtgttgacctctatctgcacttatgacggtcgcctgctccaaggagccccaactagtcctaagttggcgaatcttatttgcgcaaagctagactccaggctctcggggtactccggcccattaggtatcgtctacacaaggtatgccgacgacatcaccctgagcgggcaagctgcgcgcaaaatatacaaagcacgtgacttcattaacgtcataatttcatccgagggctttaaggttaacgaaaagaagacaaagatctgtggcacgcagcgccagaaaagaattaccgggctggttgtgaatgagaatcacgctggaattgggcggaaaagataccgggaaattcgggtaaaactgcatagattattcgtggggaagtctgatgattacaatcacgtgaacggctttttgtcctttgtgtacgatgtggactacaagtcttacaaaaaactgttcctctacatcaacaacctaaaggagaagtatccgagctcaagcgctggcctgaacatcttccccgagatcaacaaatcatga

SEQ ID NO: 10059 - RNA, 975 nt, unidentified
  source 1..975: mol_type = other RNA; note = synthetic construct
atgaccagcgctaccccttctcaagtctttagacttcgcaatctcgggcttcccgtcatgtcctccttggaggatatgagtagggagatgcgcctaagcgtggacattctgcgactctacatttatcgggcagataagtattacaaagtgtactcacttccaaaaagagatgggaagagatcccgaataatttcccagcccagcagagaactcaaagcactgcaggcgtgggtgctcaggaatatactcgacaagctgcatagtagccctttttctaagggcttcgagaaagggcagtctatacttaacaacgccagtccacacgtaggcgccaactatgtcttaaacattgatctggaggactgcttcaacacgatcctgattgaaaagatatacactgtgttccactccttaggatataactcaacaatctccaatgcactagcccgcttgtgtagctttaacggatcattgcctcagggtgctcctagctcaccaaagatcgctaatttagtcttgaccaagctggactaccggatccatggatatgccggtagcaagggcattgtttttacaagatacgcagatgacttgacactgtcggctcaatcccttaaaaagatcctgaaggccaaatctttcgtttgcagtattatcccctctgagtctctcaaggtaaactacaataaggtggcgattcacggtcccaaagccaggaaagaagtgactggcctggtgctgagcatcgacaatgtaggcgttggccgtatcaggtaccgggaaatccgctcgaaaatccactacctcgccgtgaagcgtaatagtgactttgaacatgttaaggggctgatcgctttcgtgaaatcagtcgacaagaaaaactatcggaagctgatgaccttcagcaataaaatgtctgagacttatggagtggatctgtccgtgctgtttccgaagaacaagaaagccatttga

SEQ ID NO: 10060 - RNA, 966 nt, unidentified
  source 1..966: mol_type = other RNA; note = synthetic construct
atgacttctatcattcaaagccaggtctttaggctcagaaatttaggcctgcctgtcatgtccactcttgatgatatgtcccgtgagatgcggctcagcgtggaaatactgagaatgctaatttacaacgcagacaaatactatacagtctactctgttcccaaaaaagatgggcgacgcgtgagggtaatatcacagccatccagaaaactgaagtcattgcagtcctggatactgcggaatatcctggacaagctgtactcctcaccattcagtaaaggattcgagaaaggccagtctattctgaataacgcatctcctcatatcggggctaattatatcctcaatatcgaccttgaggacttttttgacaacatacccagtaggaaaatttacaccctgtttcacagcttgggatataactccctggtgtcaaatgctctgacacgagtgtgttcccacaagggttctctgcctcaaggggcccccagcagccctaagatcgccaatttgattctgaccaaacttgattatcgcatccaaggttatgctgggggcaaaggtatagtctttactagatatgccgacgatctaaccttgtccacccagtctctgaaaaagatcgtgaaggccaagaagttcctctgcacaatcatcccaacggaagacctcaaggtgaattaccggaaggttgtaattaacggcccccgtgcgaaaaagagcgtgacaggactcatcttatcaatcgacaacgtcggcattggaagggagaagtacagggagattaagagtaagatccaccatctcgcagttggccgcacctctgattacgaacatatccagggacttgttagcttcgtgaaatcggtggataaaacgaactatcggcgccttttagccttcagcaagaagatgagttcgatttacaaactgaacattaaccagttgttcccgagtaagaagtga

SEQ ID NO: 10061 - RNA, 966 nt, unidentified
  source 1..966: mol_type = other RNA; note = synthetic construct
atgaacaatttttcttctaccgacgtctttagattgaggaactttggactacctgtgatgtccagtttgacagacatgtcccgagaaatgcgcttaagcgtcgaactgctaacacttctgattactagagcggacgatttctataaggtgtactctgttcccaaaacgggtaccgagaagggagagcgggtcatatgtcagcccagccgcagactcaaagccttacaggcttgggttttgcgcaacatcttggataagcttaattcttcaccttttagcaccggctttgagagggggcaaagtatcaaagacaatgcaaatccacatgtcggctccaacttcgtgctgaatattgatctggaggattttttcccctcaatttcgtcgaacaagatctataccgtgttcaacagcctgggctataataagtatatcagtagcgtgctcacaaagatttgctgtttcaagaataaactccctcaagggtcaccagcctcccccaagctggccaacctcgtgtgcatgcggctggatcatcgtatacatggctatgccgggatacgcggaatcatttttactagatacgctgacgatatcacactttcagctcagtccttaaagaaaatcgagaaggcaaaggactttctgttcagcattattccgaccgaacagctgatcgtgaactacaacaaagtaatcatcagcggtccacggaaacagaaaaaaatcactggcctggtgctttccattgacgacgtagggataggtaggcagaaattcagggagataaagtccaagatccactacctgagtgttgggcgatctgaaaactacgcacacgttggcggactgctggctttcacgaagtctgtcgatgaaaagaattaccggcgtctcattgtgtttgcccagaaactcaacaagaaattcaatctggacctcgataagcttttcaaacacggatga

SEQ ID NO: 10062 - RNA, 960 nt, unidentified
  source 1..960: mol_type = other RNA; note = synthetic construct
atgaagagcacagagcacttgaatacctttcgactccgccaccttggactgcccgtgatgaatgatctgcatgacatgtcaaaagcgacgagaataagtgtggaaacgctgcgcctattaatttatcgtgccgactttcgctacaagatctatagcatcaagaaaaagaacagtcactcaatacgtaccatttatcagccaagcagggaactgaaagccttgcagggttgggttctgagaaatattctggacaagcttagtagctcccccttctcgatcggcttcgagaagaatcagagcattcttaacaacgctacccctcacataggggcaaatttcattctgaacatcgatctggaggatttctttcccagcctttccgctaaaaaagtctttggtgtgttccattctctcgggtacaatcggactatctcgtcctccctaactaagatctgctgttacaaaaacttgttgccgcaaggggctccaagcagccctaaactggccaatttaatttgttctaagctcgactatcgaatccagggatatgcagggtcccggggcctcatctacacaagatatgctgatgacctgactttgtcagcacagtcaatgaagaaagtcttaaaggccaaggacttcctgttctctatcattcctactgaaaacctcgtagtgaacaccaaaaagacatgcatctctgggcccaggtcccaaaaaaaagtgacaggcctggtgatctcccaggagaaagccggcataggacgcctgaagcataaggaactccgggccaaaatccaccacctattttctggcagaagtaagaacattgagcatgtaaggggttggctcagttttgttctgtcagtcgattctaagtcctacaggcggcttttcgtttacattggaaagctggagaagaaatacggctggaatccactctctaagaccaaaacctga

SEQ ID NO: 10063 - RNA, 963 nt, unidentified
  source 1..963: mol_type = other RNA; note = synthetic construct
atggagaacgaacactacatgaatacttttaggctcaggaacttggggttacccgtaatgagcgacctgtccgacatgagcaaggagacaagggtgtctgttgaggccctgcgcctccttatttatcgggctgactatagataccacatctatacattggataagaaaggacctggcaacaaaaagcgcacgatctatcagccaagtagagaacttaaggcgttgcaaggatgggtcctaagaaacattctggacaaactgtcttccagtcccttcagcatgggcttcgagaaaaaacagagtatcctcaataatgctactccccatgttggcgctaatttcatactcaacatcgatctcgaggactttttcccttctttgaccgcacacaaagtgtttggtgtcttccattcgctcggctataacagagcaatagcatcctccctgacccgtctgtgttgttataagaatctgctgccacagggtgccccctcaagtcctaagctggccaacttaatctgctcacggctcgattatcggatccaaggatacgccgggcgtcgaggcctgatttacactcgctacgccgatgacctgaccatcagcgcgcagtcaatgaagaaggttgtcaaggccaaagatttcttatttagcatcattccatccgaaggactagcaataaacaaagagaaaacctgcatctctgggcctagaggtcagaagaaagtgacagggctggtcgtatctcaggacaaggtgggagttggcaagaggaaatcaaaggaaataagggctaaaatccaccatatttttgtgcggcgaagcaatgaagtggagcaggtgaaagggtggcttgcctacattctttccgtggatgtgcggaatcacaaacgcctggtcgcttacattaacaagctggaaaagaagtacaattggaacccgtttaagaaggaggaccattga

SEQ ID NO: 10064 - RNA, 960 nt, unidentified
  source 1..960: mol_type = other RNA; note = synthetic construct
atgccaagtgccactaactctcatgtctatcagctaagaaatcaaggattacccgtgatgtcttccattgttgacatggcacgggaagttcgcctgtcggtagagatgttgcgatttctgacttaccgcactgactacctctacaagacatttgagattgagaaaaaagggacgacatccaagcgcgtgatttgtcagcctagccgtaagctcaaggctatccaaggctggattctgaggcggatcctggataaccttcggtcctctgagttttcaaaaggattcgaaaaaggtcagagtatcctagataatgccgtgccccacgtcggcgccaattttatcctgaacattgatctcaaggacttctttccctccgttgatgctagtaaggtctacggcgtgtttagcagcttggggtataacaaagagatctcatccattctgacaaatctgtgcacttataaaggaaagctgccgcagggtgctccaaccagcccaaaacttgcgaacctgacctgtgcaaggttagacgccagaatccagggatacgctggctcaaaagggataatatacacccggtacgccgatgaccttaccttcagcgcacaaaccttgaagaagataatcaagacacgattcttcattcagactataattcctacggagaagctctccgtaaataatcataagacactgctgtgcggccctaggaagcagaaaaaagtgacaggacttgtgatttcacacgacaaaactgggattggtagacagaagctcagagagatccgttctaagatacacaaaatctataccggggaaaaaaccaataccaatcatgtctacggcttgttaagctatgtgtatagtgtggataaacgcaactataggaagctcatcatctacatcgaaaaactgaacaagaaatacaacaagtctgaattcctgaagatcaagaagtga

SEQ ID NO: 10065 - RNA, 960 nt, unidentified
  source 1..960: mol_type = other RNA; note = synthetic construct
atgaccctcgtgacagcgactcatagtcacgtctatcagctcaggaaccaaggtttaccagtgatgagcaccatctcagacatggcccgtgaggttcggctcagcgtagaaatgttgaaattcctgacctacagaacggactatctgtacaaaacatatgaaatcgacaagaagggcaagggttctccaaagcgcattatttcccagccttcccggaaattgaaggctatccaaggctggattctgagacacatcctcgatcacctgagcagttcagaattttctaaagggttcgagaaaggccagagtattctggataacgcagtcccccatataggcgccaacttcctgctcaatatagacctaaaggatttctttccttccatctccgcttccaaagtgtatcggatctttcgaagtttaggatacaacaaagagattagcagcgtgctgacaaacctgtgcacttacaagggcaaattgcctcagggaagcccgacttccccaaagctggccaatctaatatgctctagactggatgcaagaatccagggttacgctggacggcgcgggataatttatacgcgatatgccgatgacttaacactttcagcacagactctgaaaaaaatcgagaaggccaagttcttcataaaaaccatcatccccaccgaagacctgaaggtaaataattccaagacattgctttgtgggcccaggaggcagaagaaggttaccggactcattatcagtcatgacaaggccggcattgggagggagaaacttcgcgagattcgttcgaagattcacaagatctttactgaagagagccttgaatataatcacgtgcgcgggctcctggcttacgtttcttcagtcgataagaagtctcataggaagcttgtgatgtacatcgacaaactgaccaaaaaatactctggagtggagtttattatctga

SEQ ID NO: 10066 - RNA, 984 nt, unidentified
  source 1..984: mol_type = other RNA; note = synthetic construct
atgaaaacagaaagcacagccaatatataccgcctgaaaaacctggggctgccgcccttagctactatcgaagatattgccaatgcaacgcgtctttctccagaatatatcaaatacctcgcttttcgcaccaacttcctctataagactttcaccattccaaaacggagcggcggtaatagaaagattgcgaaccctagccgcgccttgaaaggcattcagggatggatactgaggaatatcctggataagctgtcctcatccgagtttagcatgggctttgagaaaggaacctctatcttggacaacgccctaccacacacaggatctacatttatccttaccatcgatctcgaggattttttcccctcaataactggggaaaagatcttcggcgtgttcaactcaattggatacagcagatctatcagccatattttggctaacttatgtctattcgaggggagactgcctcaaggcgccccaaccagtcctaaactggcaaatctggtatgctcgcggttggattctagaattaatggctacaccggtcccaaaggcattgtgtacactaggtatgccgacgacatcaccctgtcctcccagtcgctcaacaagctttacaaggcttacaactttataccctttatcttacaggacgaaggattttccctcaatcccaacaaaacaatcttttctgggacacggaagaagaaaagtgtgacgagtcttattattagtggtgacaccgttggaatcgggcgagaaaagtatagggagatcaggagcaaattccacaaagagttcactgggatcacaaccaacaaggagcatctgcacggctggatctcattcataaattcagtcgatcgaaagtccagcattaagctcaagaattatatagcgtgcctgattgaaaagtatcctgactccgaggcaagtaagaatttcctgaagatcacggagaaaaacaagactcagtga

SEQ ID NO: 10067 - RNA, 993 nt, unidentified
  source 1..993: mol_type = other RNA; note = synthetic construct
atgcagaaaaatacaatctacacgcttaagaatctcgggttgccagctattactaccttagacgacctttcttttctcacccgcatctcccgggaacgcattatcctcctgtccacccagcataaacggttctacaacaccttcctgatgcctaaaaagtcaggtggccacagacagatttctcaaccgagtcgtgacctgaaagcactgcaaagctggatcctgagaaatattctagataagctatctgccagtaaattctccaagggattcgaaaaggggagctccacccttgacaacgcaacaccccatataggggcgaattatatcctgtcattagacctcgaggattttttcccctccatcaaaagcggctatgtttttagcatttttcgaagcatcggttataatgtccccgtttctcacactctgacaaacctctgcgtctataacggaggactgccacagggagcccctacaagtcctaagctggccaacttggtctgtagccggctcgatgctcgcataagcggctatgccgggaagaaaggcattacttataccaggtacgccgacgacatcacattcagtgctcagactgcgaagaaaatcaccaaagtgtactctatggctaagtttatcatccatgatgagaaattcgtcattaacaagaacaagacttacttttctgggacaaagaagaataaaaggattactggtctggtagtgacggaaagaagtgtgggtatagggagggttatgctgcgatcaattaaggcaaaaatccaccacctgttggtgggaagaaatgatgatcttccccacatcattggcctgttatcatacatatacggcgtggacaagaagaactacaaacaccttataaggtatatccagaaattgtcgctgaagtactccggcgtaccacaggagctcaaggatatggtggccaagcataataacctggcagcctcaaccttgtccgaggtgtga

SEQ ID NO: 10068 - RNA, 981 nt, unidentified
  source 1..981: mol_type = other RNA; note = synthetic construct
atgaccaaaaagatcatctttaagctgaaaacgcctcctaagatcaatgatatccacgatctcgcccgggaaactcgcttgagcgaaaagcttatttcttacattgcttatcgctctaacttcctttaccgaacttactatgtgccaaagaagtccggcggtaaacggctgatcgcccagcctgcccgtgaacttaaagctatccaaagctggatattgcgcaacattttagagctgaggccctcttccaatcagagcatgggcctggaaagagatcaatcgattttaaccaatgccttaccacacatcgggaatgggtacctcttgaatatcgatctagagaactttttcccgtccatcaaatccaagagagtgtttcatttgttcaaaaagatggggtttaacaacaacatttcaacgatattcaccagaatatgcacattcaatgatggcctgcctcaaggggctcccagctctccaaaaatagcaaatctgatttgttcgaagctggatgccaggattcagggatacgtcggcaagaggggcatcaattataccagatacgcagacgacctgacttttagtgcaccaagttacgagaagatcaataagctggagattttcattaagaagctgatctccgacgaggacctctttatcaactcaaacaagaccacattttcaggaccgcgcaaacagaagaaagttacaggtctggtcctaacaaacgacagcgtgggcattggcaggggaaaatataaggccattcgggctcggatctattactacttcctgggtatagagaaagacatcgcgagtattaatggatatctctccttcatctatagtgtagaccagaaacgttactcaatgctccagcattatatcagctctctcttcgaacgattccccgtgataccctctgcaaactttgggcagtttactaacattcacttccttccccagagcgcgctgggatga

SEQ ID NO: 10069 - RNA, 987 nt, unidentified
  source 1..987: mol_type = other RNA; note = synthetic construct
atgaaggacagcaaaacagccaaaaaatacagactcaaaagtcttggactgccaatcattgaatccgcagacgactttactcgtctgctaaaaatatcaagcagtatcatccaacagataagcaagcagacaaccaaggatagattttacaaagagtacaggattccgaaaaagtccaagggttttcggcagatagctcaacctgtgagaaagttaaaggcccttcagatttggatcctccggaatattctggataaactaactacttcggatagtagcaaaggcttcgagaagggcaccaatatcaaggataatgtgaggcctcatgtgggcgcccgagtcatcatgtcactggatttggagtcctttttccccagtatcagcagcaacaaggttttcggcattttttactcgttaggctataatacggaagcaagctggcttttcacgaacatttgcacatataagaacaaactgccacagggatccccctcttctcctaagctctctaacttgatttgttggaaactggattttcgcattgaaggttataccaataagcgcgacattgttttctcacggtatgcggatgacctgaccttcagtagcaaatcaatcaaaaagatcatcaaggctaagaacatggtaaagcacataatagaagacgagggcttcgtcataaacgaggataagacaaggatcatgggtccctctcgccagaaaaaggtgaccggattgattgtatccgggcataaggtggggatcgggagaaaaaaataccgggagatgcgagtgaagattatcaatctctttactcacgaatctgacgacttctcacacgtcatgggatggatgtcctacattaattccgtcgacaaaagcgtgtataagaggctgatcctgtacattgagaagctgtctatccagttttccaactctatcgctgttgaagagttcaaagccctcatcaagaacgggaatctgtga

SEQ ID NO: 10070 - RNA, 960 nt, unidentified
  source 1..960: mol_type = other RNA; note = synthetic construct
atgtccaacaacggaatcatcaagttgaatatgttcggcctccctgtgatacagactctggatgattttagcttcatctcccacatcagtaaatataccatataccagctgagcaagaattccgactactattacaagatctacttcatcaagaagaagtcgggcaaacaccggaaaatctgccagccttctaggaagctcaaaggactgcagtcttggattcttgtgaatatcctggaaaagattaaggtcagtaattcatgcaagggatttgagaaaaattcttcaacactcgacaacgcaatcccccacgcgggagctaataccattttaacgcttgatctgaaggatttctttccctccatcacatcaaaccagatcttcaacatcttcaaaactctcggctataatgacctgattagcacagtgtttactaatatttgcacatttgacgggtgtttgccacagggtagcccatgttctcctaagctcgccaacttgaccgcctggaaactagactcccgtattcaggggtatgtaggaaaaagaggcatttcctatactcggtatgccgacgatcttagcttctcaggtctaaaccccgtcaaagtggtgaacatcatcccgatgatcaaggaaataattgaggatgagaacttcctgataaacaacagtaaaaccagaatcagttcttctgggcgcgctaaaattgttacggggctggttattaccgacgagaagattggcatcggtaaaaagaagtttaacaacgtcaggtcaaaaatacatcatttaagtatgccaagggaaaatgggaacataaaacttctcaatgaggtacaaggctggctgagctacctgaattccgtggatcgcgaacgattgattaagacccaaaagtacatcgaccatctgaatcaaaaataccccaatagcatgattaagtttctggtgaagtga

SEQ ID NO: 10071 - RNA, 966 nt, unidentified
  source 1..966: mol_type = other RNA; note = synthetic construct
atgtctaataacggaatcatcaagctcaacatgttgggactgcctgtcattcagactttggatgattttagcttaatcactcacgtctctaaatataccatttaccagctgagcgagaagagcgatttctactactcaatatattcgatccccaaaaaatccgggaagcctcggattatctgtcagccatctaaaaagttaaagggttttcagtcctggattctcgtgaacgtgctggacaagatcaaagtatctagctcatgtaaaggcttcgagaagaaatcatctacactagataatgcaatcccccataagggagccaatacaatactgacgctagatctgaaggactttttcccgaacataaccagtaagcaagtcttcaacatttttaagacccttggctataacgatctgatatccacaatctttaccaatgtgtgcacctacaaagaatttctgcctcaggggtccccttgcagccccaaactggctaatctgactgcttggaaactcgacctgcggattcagggttatgttgggaagaggggcattaactatacccgttatgccgatgacctctcattcagcggccttaatccagccaacgtcgttagaatcctgcccatgatcagtaatattatcgagagtgagaacttcatcataaaccactctaagactagaatcgcaagctcagcacgcgccaagattgtgacgggtcttgtgatttccgacgacaatattgggattggccagaaaaaatataagaacgttcgagctaagatccatcatctgacaaaaccaatcgagaaaggcaatgtaaagttacttaatgaagtggctggatggctctcctacttgaatagtgtggacaagaacaggctcgccaaggcgaataagtacattaacgagctgtacaagaaacacaccaaatccatgatacaatacctcatcaagttggactga

SEQ ID NO: 10072 - RNA, 960 nt, unidentified
  source 1..960: mol_type = other RNA; note = synthetic construct
atgtccaagagcgagataatcaagctgaacatgctgggcttgcctgtgatccagacaattgacgatttcagtctcatcactcacattagtaactacaccatttttcaactgtcgaaaaattccgacaactattataagacgtacgatatcccgaagaagagcggacgacctcggcaaatatgccagccctcaagaaagttaaaagggtttcagagctggattcttgtgaatatcctggacaaaactaaggtatccagttcatgcaaagggttcgaaaaaaagacctctaccctggacaacgcactcccacataagggcgccaatacaattctgactatagatttgaaggacttctttcccaccattacttctaaacaggtgttcaacgtttttaagacattgggctacaacaacctgatctccacaatcttcacaaacatttgtacttacaagggttttctgccacaggggtccccttgttccccaaaactggcaaatctatcagcctggatgttggaccttcgcatccagggatatgtgggtaagcgcggaattaattacacgcgttatgctgatgatctatcattttctgggttaaatccaagcaatgtcgtgaatatttaccccatgataaagaccatcgtcgagtcagagaagttcaaaatcaacaatagtaagacccgggttgccagcagcgcgagggctaagatcgtcaccggcttagtaattagcgacgaaaagatcggcattggaaaacaaaaatacaagaacgttagggctaaaatccaccatcttacactgccctctgaaatggggaacgtgaagcttctcaatgaggtgggcggttggctctcttatctcaactctgtggataaggaaagactgtccaaagccaggaaatacataaatgagctccacaagaaaaaccctaaaagtatgatccagtatctggtcaaatga

SEQ ID NO: 10073 - RNA, 960 nt, unidentified
  source 1..960: mol_type = other RNA; note = synthetic construct
atgtcccagactaactccatcaaactcaatatgctgggtctgcctgtaatacaatccattgaggatctaagcatgctcacgcatatctctaaatacacaatctaccagctgtccattcacgccgataagtactataagacatatgagattcccaagaaatcagggcgcaatcggactattagccagcccaacaagaaacttaagggcttccagtcatgggtcctcagaaacattctggataaggtgaaagtcagcgactcatgtaaaggattcgagaaagggtcttctaccgtcgaaaacgcactgccacatcgaggagccaatacagtgctcagtatggaccttaaagacttttttcctaccattaccatccaacgggtgttttccatctttaaggttttcggctattccgacttgatatcgacaattctagctaacatcacaacttatgcgggcgcattgccccagggatctccatgcagtccgaagctggccaatctcagcgcctggaagctggatcttcgcatccaaggttacgtggggaagcgtgggatgaattatacgaggtatgcggatgacctcactttttcctcgttaaacccaagcaacgtcgtaaagatcattcccatgatcaaggaaatcatagagagcgaaagtttcttcgttaatcactcaaaaacccggatcgctggatcaagtagagctaaaatagtgaccggcctggttattagcggtgaaaatataggggtgggcaaacagaaatacaaaagaatcagggctaagatccaccatctgaccctgcctgccgagcaggaaaactctaggctgctgtacgaggtgtccggctggttgagttacttaaattctgtggataagaaccgattgctcaaggccaaggagtacattaaggagttaagcgaaaagcaccctgacactctgatcgcaaaccttaacaattga

SEQ ID NO: 10074 - RNA, 960 nt, unidentified
  source 1..960: mol_type = other RNA; note = synthetic construct
atggccaagacagagatcatcaagttgaatatgctgggactccccgtgatacagtctatcgacgactttagcgtcgttacgcacatttccaagtatacaatttaccagttgtctcaccactcagacaagtactacaagacctttgagattcccaagaaaagtggaggaaaacgtaccatctgccaaccttcaaaaaaattaaaaggtctgcagtcctggatcctcgtaaacatactgaacaaaatccaagtgtctccatcatgtaaggggttcaggaagggctccagcacactcgacaacgccctgccccacattggtgctaatactatcctcaacctagacttaaaggattttttccccaccgttagttccaaacaagtctacaacgtcttcaaaacaattggatacaataagctcatcgctactgtgttcacgaatatttgcacctacaatgatatgctgccgcagggctccccatgttcaccaatgctggcaaatttaactgcctggaatctggatctgcgcattcaggggtatgtggggaagcggggcattagttatacccgatatgccgatgacctgagctttagcgggctgaatccaaccaaggtcgttaagatcatacctatgataaagaccatcatcaacgatgagaatttcgaggtcaaccataagaaaactagaatagcttctagcgctagagcgaagatcgtaacaggcctaattgtgaacgaagacagtgtggggatcggtaaacagaaatataaagatcttagggccaagattcaccatttgatcctgcctactgagcagaaaaacgaaaaacttctctaccatgtgggcggctggcttagctatcttaactctgtggacaagctccgcttgcagaaggcaaagaaatacatctcggaactgacaaagaagtatcctaccactctgattgcacggctggataaatga

SEQ ID NO: 10075 - RNA, 1005 nt, unidentified
  source 1..1005: mol_type = other RNA; note = synthetic construct
atgtctaaaagcgataagtttaagctctccatggccggcttacctgtcatggagaatctgaatgatttttcccgcctgacacacatttcaaactacacattgttccaactctcgaaatattcggacaagtactacaagcattactacatccccaaaaagtccggtaagccgcgtcttatatcacagccctgccgaaagttgaagggaatccagagttggattttgaataacatcctggacaaactctgcgtcagcaattcctgtaaaggattttctaagggaacctccatcatcgacaatgttgacccacataaacattctagcgtagtgttgacaatcgacatcaaagatttctttccttccataaggagagataaggtgtacaacatcttcaaggccatcggctacaacaagttcatgagcaccatctttactaacctatgcacttgtaatggcgcccttccccaaggaggtccgtgttctccaaagctggccaatctgagcgcatggacccttgatgtgcggatccagggctatgtgggccggagagggataacttacacacgatacgctgacgatctcacttttagcaccacgaacccacagaagcttataaagcggattagtactattacaagcattattgaggacgaaaaactgcacattaacccttctaagactaggatcgcaggtagtgccagggcgcggaaagtaacaggcctcattatcaccaatgaatcattcgggatcgggcgccaggtttatctcaaagtcagggctaaaatacaccacctcaccctgaacagagaacagaagaatttcgatctgattaacgaggtccaggggtggctggcctatctaaagaacgtggacaaactgagatataaaaaagcagcggactatatccgctcattaaaagagaagtatccagcaaccctgataagtcaaattatcctgcctcccctgattttagaggttgctaccgtgattacggctgtggaatga

SEQ ID NO: 10076 - RNA, 960 nt, unidentified
  source 1..960: mol_type = other RNA; note = synthetic construct
atgtccaagacagacaacataaagctccatatgttgggcctccctgtgattcagatggtggataacttcagccaagtgacgcacatttctaagtataccatttaccagctctcaaagcactccgacaaatactacaagacttatacaatccctaagaaatctgggaaactgagagagatcagtcaaccctctaaaaaactcaagggcctgcaaagttggatcctggccaacatcctgaacaagttaaaagtcagcaacagctgcaaggggttcgagaagggctcatccatcgctgacaatgcagagccacataaagatgccaatacaattctgactctggaccttgaagattttttcccaactgtgaagaggaatcaggtttactccatctttaagactatcggatacaataaggcaatttcaacgatcttgactaatatttgcaccttccagggcatcttgcctcagggatcgccttgttcgccaaaactagcaaatctcagcgcaagcaagttagacgctcgcatccagggttatgtgggcaaaagaggcattaactatacacggtatgccgacgacctgagtttttccgggctatcacccgctaaggttgttaagatcattcccatgataaagagcattatcgagaacgaaaatttcgtcgtaaaccccgagaagacccgaatagctggagccgcgcgggccaaaaaggtcaccggtctgataatttccaataacacctttgggatcggtaagcagaaatacaaagatcttagggcgaaaatacaccacttgaccctgccatctgaacagaccaacaccaagctgcttaatgaagtgatcggatggctgtcttatctgaatagcgtggataaaaaacgcctcagtaaggccaacaagtacattactaagctgacggataaacatccgacaacattagtagccaaacttaaacgttga

SEQ ID NO: 10077 - RNA, 990 nt, unidentified
  source 1..990: mol_type = other RNA; note = synthetic construct
atggtggaatctacatccggcctgattaagaaaggttccaaagacaatttccgcctgaacatgttgggactgcctttaatccagacaatgggcgacctgagctccctcacgcacgtgtcagagtacaccctctacaatctttctaagaacgctgacttccattataggatttatgatatccccaagaagaacaaaaccccacgtgaaatttcacagccctccaaacgactgaaaggcctacagtcatggattttggttaacatccttaataagcttcgcgtgtcaaatcattgtaagggatttgaaaagggaagttccattgcggataatgccgaagcacatatcggagcaaatactatcctcaccatagacttgaaggatttttttagctcaatcgattcgattaggatctacaacattttcaagagcatcgggtacaattctttgatagctactgccttaaccaatatttgcacatttagaggcgttttgccccaggggagcccatgcagtccgaaactcgccaacctgtccgcctggatgatggacgtaagaatccaggggtatgtgggtcaaagaggtatcagttacaccaggtacgccgatgacataagtctgagcggactgcacccttccaaagtagtgaagctgttgcctatgattgagagcattattaacgacgagaaattcgtggtcaattctgacaagactcgaatcgcagggagcgctcgggccaaaaaggtcacaggcttagtcctgtctgataattcgtatgggatcggcgctaaaaagcttaaaaacatacgggcgaagatatatcaccttgttctgccagaagagcaaaagaacatcaaactgctgaacgagctcaagggctggctctcttatatcaatagcgtggataagcgccggctggagaaactccacctgtacatcaagaaactcctaaacaagaaccccgagacgctactggcacagctgagtatttga

SEQ ID NO: 10078 - RNA, 969 nt, unidentified
  source 1..969: mol_type = other RNA; note = synthetic construct
atggtgaagaacgagaatattcggctgaatatgttgggtctacctataattcagtcaatcgacgacttctcccacattacccacctgtcaaagtataccttatatcagctcagcgagaaaagcaattttcattacaagaagttcccactgaagaaaaaaactggtggtacccgtactatctgccagccctcgaagaatctgaaaggcctccagagctggatcttggtaaacattctgaacaaactgaaggtttcagactcttgcaaaggcttcgagaaaggcagctcaatcggagataatgcccgccctcatatcaacgctaattgtatcctgacaattgacttatccgacttttttggaactgtcacagacatccaagtttataacgtgttcaagtctataggatacaataaactgatcagtaccatgctgacaaatatctgtacatgtgacgggagtctgccacagggctccccatgcagccccaagcttgccaatttggtgacctggaagctggataagcggatccagggttttgtggggaaaagaggcatcacttacacgaggtatgcggatgatctctctttcagcggactgcatcccgccaacacggtacaaattcttcctgtcgtgaaaagtatcgtcgaagatgaggggttcattataaacccgaaaaaaaccagggtcgctggggcatctagggccaagattgtgacaggacttgtgatttctaacaataagtttgggataggcaaaacaaagtacagaatacttcgaagtaagatctaccacttgactaagcccaaagaacagaagaacactgacctcctcaacgaggtgaacggctggattgcatatctgaaatccgtggataaatcccgctttaataaagtcttcaagtacgttaccaagctaaagaaggaacaccctaagaccctcgttaaccaaattacgatctccaataactga

SEQ ID NO: 10079 - RNA, 972 nt, unidentified
  source 1..972: mol_type = other RNA; note = synthetic construct
atgataaagaatgagaacatacgcttaaacatgctgggacttcccattattcagtctatcaatgacttctcccatattactcacctctccaaatatacactgtaccagctcagcgagaagtccgatttccattacaagaagtttcctctgaagaagaaggctggtggaacgcggaccatctgccaacctagcaaaaatttgaaggggctccagtcttggatcctcgtgaacatcctgaacaagctcaaggtgagcgatagttgcaaaggttttgaaaaaggatcttccatcggagataatgctcgtcctcacatcaatgccaactgtatcctgaccctggacctgtctgacttctttggcactgtctctgacatccaggtctacaacgtgttcaagtctattggctacaacaatctgatttcgaccatgatgacaaacatttgtacgtcggatgggagtcttcctcaggggtcacccagcagcccaaagttggccaacttagtctcctggaagttagataaaagaatccagggtttcgtagggaaaagaggcataacttatacccgatatgcggacgaccttagtttttcaggcctccatccggcaaatacagtgcaggttctaccagtcgttaaaagcattatccaggacgaggggtttcggattaatcccaggaaaacacgagtgtccggcgcttcaagggcaaaaatcatcactggcctggtgattagtaacaaccgcttcggaatcggccaaaccaaatatagaattttgcgggccaagatttttcaccttaccaagcccaaggagcaaaataacatcgacctgctgaatgaagtcaatggttggatagcctacctgaagagcgtagataaactgaggttcaacaaagtgttcaagtacgtgtcaaagttgaaaaaagaacacccaaaaacactaatcaaccagatgaccatagccaatattgtttga

SEQ ID NO: 10080 - RNA, 963 nt, unidentified
  source 1..963: mol_type = other RNA; note = synthetic construct
atgaacaaaagtaatattatccgcttgaagatgctcggtctgcctgttatggaaaaggtggatgactttgctgagttaactcgtttgagccgttctatcatctaccagatgtcgtcctttgcgaatgaatattacattacataccagaggccaaagaaaactgggggtaagagaacgatctcacagccatccagaaaattaaaagctctgcaagcgtggatcctcgtgaatatcctgaacaagttaagcgtgtctccctcctgtatgggattcgagaaagggacctctacctaccagaacgcaaaggcacacataggcgcaacagccattctcaccgtggatattcaggatttctttcctagcatatcccagcgacacgtttttaacatttttcgagccgtcggctacaataatctgatctctatcatactgagcaagatttgcactttcgagaataagctgccccaagggggaccctgcagcccaaagctcgccaacctggtcgcttggagactggacaacagactacaaggatacgttggcaaaaagggcattagctatacaaggtatgctgatgacctgtccttcagtggacccatgccatctaaggtggtcaggagtcttcctttcattaaatcaatcattacctcagagaggttcgaggtaaatgacaagaaaacgcgcatcgcaggcccgagtcgcgccaaaatcgtgaccggactcgttgtcgggaacgatggcgtagggatcggtcgggaaaaatacaaactgtttcgggccaaaatacaccggctgaccaaacagactgagcagacaaatcttaagttgctttccgaagtgcatggctggttggcctatctgcatagcgtggacgtcaaacggcttaataaggccaagaagtatatcgctaacctcaaaaacaagtatcctgaatcactagtgtccaagattaactggaagtga

SEQ ID NO: 10081 - RNA, 981 nt, unidentified
  source 1..981: mol_type = other RNA; note = synthetic construct
atggcgcgtaaaactctgaagaagaccgacaatgtccgattgaacatgctcggcctgcctgtgataggaacactcgatgatttctcagcgttgacccacctgtccaaatattccattttccagctctccaagaactcagggaagtactacaaagtttacgagattccaaaaaagtctggtaagaagagagaaattgcccagccaagtcgcaagctcaaggcccttcaaagctggatcctggtgcacattctgaacaagctcaaagtgagcccctcctgcaagggatttgagaaggggcagagcatattagagaacgcaaaccctcatgttggcagcaacgccatcctcaatattgacctgaaggacttttttccttcagtgaagtctaactacgtgttcaacatcttcaagtctttaggctatgaccataccatcagcactatccttacaaatatctgcacctttcaggggaaactgccccaagggtcgccatgttcccccaaattggccaaccttgcttgctggcagctcgacaataggatccagggctatgtcgggaagcggggcattacctatactagatatgccgacgatctgacttttagtggtctgtctcccaataaggtaatcaaaatagccaagacggttgataaaatcattcagaatgagggtctactgatcaataccgataagacacacttcgcaggaacagcaaaagctaaaaaggtaactggactggtgatcaatgacaaaagcgctggcattggaaaaaagaaatatcatgaacttcgggccaaattctgtaaccttgctaagccggagaatcaggaaaaaaaagataagctgtaccacgctataggctggttgagttttttaaagtcagtggatattgtccgctacaaaaggatcctgcactacattgcagccctgaagacgaagtaccctaacacacaactagacatgatcaaaaccgaccagtga

SEQ ID NO: 10082 - RNA, 966 nt, unidentified
  source 1..966: mol_type = other RNA; note = synthetic construct
atgacaagcacaatccgtctgaagatcctgggtttgcccaatatcaccgatcttgaggattttgcctacctcataaatctgtccaagaactcaatctaccagctgagcaaaaactccgaatattactacaagacctatcagattgccaaaaagaacggaaaacttcgcgatatctcacaaccgaacaaacagcttaaaggcatccagttgtggatcctgaacaatatcctgaataagctcaaagtatctgagtacagcaagggtttcgaaaagggtcagtcaattagtgataacgtgcggcctcacattttctctaattgcctgttaaacatcgatatcaaagacttctacccatctatcaattccattaaggtctacaacttgttcaagagcattggctacaataatctcattagcaccttactaaccaatatctgtacctacaaaaactctctgccccagggaagtccttgttcacccaaaatatccaatctgatttgctggaaaatggactcgaggttgcaggggtacgtcgggaagaaggggataatattcactaggtatgctgacgacatcactttttccagtattatgcctgataagctgattggagtgctgccatttgtggaaaagatcattatcgatgaaggctttaccttaaataagtacaagacgaggtttacaggcaaactcagacgccgggagataacaggcctggtgatttatgacaacaactttgggataggacggaaaaaactcagaattattagatccaaggtctacaatttcactaagactactgacaacgtgaaccataaagcactacaccatctttatggctggatgaattacatcaagtctgttgacgaggttcgatataagagtttgctcgagtatatcaaactgctgtatcaaaagaatcccaaaacagacatcaagacgctctataactattataacagctga

SEQ ID NO: 10083 - RNA, 1002 nt, unidentified
  source 1..1002: mol_type = other RNA; note = synthetic construct
atgaaaaggaagaataacttcaagttgaacttgtttggcattcccataataaatacccttgatgatctgagccttcttacccatataaccaagtctacgttatttagactctcaaaaaagtcgtacctgtactacaaagagtacactgtaccgaaaaaaaataagggagtgcggaagatcagtcaaccttccgccaagttgaaggggatccagtcctggattctccagaacattctagaaaagcttaaggtcagcccatcttgcaagggtttcgagaaagggactagcacagcagataacaccaaacctcacgtgggtgccaatgccatcttagtcgttgacatcaaagacttttatccttcaatcaaagggaatttcgtgttctctctgttcaagctcatcggctataacaacctgatcagtactattctgactaatctatgtgtgctcaatgactcactgccacagggctctccttgcagccccaagatcgctaatctggtggcgtggaagctggacattcggatccagtcttacgtcggaaaaaggggcattatttacacgagatatgctgacgatctgacatttagctcaataaacccagccaacctgattaagatcttgcccattgtgaaagacatcatagagagcgagaacttcgagataaacaagaataaaacccgctttataggaattagtcgatgtcgcaaaattacagggctcgttctgagtgataataacttcggcgtcggcaagagaaagtacaaaaacattcggagcaaagtgtttaagctgaaggacatcgaaaaaatcgaggacgacaaggaaaagcgaaaaatcaaggaaatgaaggaggtatatggactgatcgcttatctcaaatccgtggataaagaaaggtacttacgtatcctggattatatccgcacattgtccgttaagtatcccaattccatcctcaccaatatttccttcaacactaagacaaccattgcaaaatga

SEQ ID NO: 10084 - RNA, 966 nt, unidentified
  source 1..966: mol_type = other RNA; note = synthetic construct
atggccagcccatctcagacctccaagcttaggatgttagggctccccatttttgatgacctagagagcttcgcccaagtcactcgcttatcaaagaagttcctctatctgcattcttcattcagcgaccagcactacaagaagtacttcatccctaaaaaaagtggaggacaaagagagatctctcagccatccaaagctcataaagccattcaaggctggattctccgtaatatcctggatctgttgcaggtgtctcaggcatcgaaaggctttgcaaaaaaacaaaccactgcggacaacgccattccccatattggagctaatgctatcctcagtttggatctggaggacttcttccctagcattaccgccaacaaggtgtacagcatctttcactcactgggctattctaagcccatatctatcatgctgacctcgatctgtacttgtggggggaagcttcctcagggttccccatgcagtccgaagttggcaaacctcgtatgcatcagacttgataatagggtgcaggggtatgttggagcgagaggcgttacttacacacggtatgccgatgatctgacttttagcgctgctcaccccggtaagctaatgcacattttcaacttcatccggaggataatcacagaggaaggcttttccttgaacgaaagcaaaacccggctggcaggcacacgactgagaaagaaagtgacaggactcgttgtcaccgaaggcgccgtcggagtgggtcgaataaagtaccgcgagctgcgctcaaaggtatttaacctcacgaaaacacaggacattttttatgaccagaaggagattaatgagatctacgggtggctgggttacctgaagagtatcgactccaaaaggtacgagaaactggtgtcccagatagaaacgcttaagaaaaatcacaaggaaacctcccttgactatttactggtgtga

SEQ ID NO: 10085 - RNA, 1014 nt, unidentified
  source 1..1014: mol_type = other RNA; note = synthetic construct
atgaacacgaagatgcgccttcacctactggggctcccctcaataagcagcatagacgaattatccgatacaacccatctgagtaagtcacttatctttaggctcatcaaatacaacgataagttttatcgcgtctataaactccccaagaggaatggtggttatcgagaaattgctcagccatctaaagaacttaaggccttacaggcttggatcaaccggaatattctggaccgcctggaggtgagccccgcatgtaaaggctttgagagagataccagcatcctggataatgccactccacatgtaggctctaacgctgtgctgatattagacatcgaagactttttcccgtctattaccgcgaataaggtgtgctcgctcttcaaaaggattggctatccctcccaggccgcagctatcctagcgaagctttgcacgtttaagggcagattgccccaagggtcccctgcaagcccaaaaattgccaatttggtgtgtctccgacttgacctgcgtattctcggctatgtcggaaagagaggcatcgtgtacactcggtatgccgacgacttgaccttctccgggccttcaacctcatccctgctgaaactcttgtacgtcgtcaaaacaattatcaatgacgagggtttcgaaataaacaactacaagactaggatcataggaccgtcgaggcagcacaaaattacaggactgatcgttaacaacagcttcgccggaattggccacagacagatgcgcgttatccggagtaaggtacatcgtctgtgcaagtacgatgcatacagtgtgcctcaaaaggagctaaatcacgtgatggggtggctggcttttgttaagggtgtggatacaaaacggagtttgattctgtatcggtacatccaggggctcaaggagaaataccctgattccggaatccagaaactgaagattgatttcctgctgaataagccttctaaaagatctatcgccagcggggagccagacctgtga

SEQ ID NO: 10086 - RNA, 954 nt, unidentified
  source 1..954: mol_type = other RNA; note = synthetic construct
atgtcttccgacagaatacgccttggactgattggacttccgaagttggtcagcattagcgacttgagtgatgccattaggttaagtaaaggtctattgttccggtgtgcgaaatacccaaataagcagtactatacctatacgatccctaagaaaacgggagggacacgagtgatctcacaaccttccgcagaactgaaggctgtgcagggctggattctgcgtaccatcctggatcgcctctctgttagcccagcttgcaagggtttcgtgcctggcgcaagcacccgagataatgcaacgccccatatcggcgccaaagcaatcatgtgcctcgacatacaggacttctttcccaacgttaaggcttctcatgtctactccctgtatcggactatagggtatagtacccaggtggcctcgatccttacttctctctgtacctttcatggcggactgcctcaaggcgccccgacatcacctgccttagccaatctcacctgcgtaaggtttgatgcgcggatacttggctacgtggggaaaagaggcattgtgtacactcgttacgccgatgacttgacattttccgcctattcatacagtagcctcccacgggctctcccaatgattactaagatcattgaatccgagggtttcctggtgaatcggcagaaaacccgcatcagaggacccgccagaaggcacacagtgacaggtctagtggtcacccagaacaacgttggggtggggcgcaagacttatagggagctgcgagctaaattacacaggctggccacaatgcccatcaaggcagttaaaaggaaggagattgctaaggtcaagggatcaatggcgtacctcaacagcgtcgacaaagtacgcagagatagactggacgactacctgatccacctgaaaatgaactatcccaagtctatcctgactaagatgtga

SEQ ID NO: 10087 - RNA, 972 nt, unidentified
  source 1..972: mol_type = other RNA; note = synthetic construct
atgtcgagcgataaatacagactgagtctatttgatctgccaaaaatcgatagccttgaggacctgtcatatttgtccaggctgtcaaagggtcagctctatcgtttcgccaaatactctgactggttctacaaaagctacaggatccctaaaaaaagcggaggggaaaggattatttaccagccctcttttaagctgaaagcaatccaggcgtggatcctgcgtaatatcctcgaaaggctgtccatttccagtgcctcaaaaggcttcagtattgggtctagcattaaggataacgtgaagcctcatgtcggcgcaaatgccatccttgccattgatatcgagaatttctaccccagcatacccgctaatagagtgtggttcgtgtaccgcaccgccgggtattctccacagattgctgctgtcctcacatctttaacaacctacaattcattcctacctcagggtgcaccctcatctcctcgactgagcaacttagtttgttggtccctcgataaacgaatgctcgcgtttgtgggaaaacgggagataacttatacccggtatggcgacgatctgtccttttcagcctcttcataccaagttttgagtaaaagctttcacactatcaagtccatagtaagaaacgagggattctctctgaacgagtcgaagacacgctttatgggaccggcaaagcagcgcagagtaaccggcctgatcctgtatgaaaaccagtttggcatcggtcgcaagcaatacaggatcttacggagtaagattcataagatgtgctttataccatccgacgaaattgactccttcctccttaaccacattgccgggtggttgtcctatgtgaaagacgtcgacacgaatcggtacaataagctcgctaagtatatcctggacttgaagaagaagttcaacagtagcgctgttagccttctgaacgtggagatctccgcctga

SEQ ID NO: 10088 - RNA, 1005 nt, unidentified
  source 1..1005: mol_type = other RNA; note = synthetic construct
atggataataataacaacattgcgtcatacttcctcggaatccctaccatcaataatcagaaggacttagccaaccacctgaacctttccgagtatactttgcataaggtgatcaaatgcactgataagtattacaaggaaatccgcattcccaaaaaaaatgggggtacccgtagactggcctgtccttcaaagaagttgaaagctgtacaagcttggattttacgcaacattctcgaccatctttctgttaatccaagcgccaccgcatttaagaagcggacaaatatcacaagcaacatagagcggcatactgataatcaattcttcctctgtctggacatagataacttcttcgaaagtattccgcagaagaacatcaacaatttttttaaggccctggggtacaataagcacgtgtcctttattttagccaagatttgcacctacaagggatttctccctcagggcggagtgacctctcccgcactgagcaacctgatcaatatcaagctggacaaacggatatcaggctactgctccaagagaaatattgtctatagcagatacgccgacgactttactttcagctccaacaatccaaataagctgatccagtcgattaagatcctgaaaaagatcatcaatgaggagaactatcagttgaacaacaacaaaacaaggatcattcgccccggcaatgcaaaaaaaattacaggccttctcattactgatgaaggtaagatatctatcggacgaaaacaaaggaaaacactaagggctacgatctataacagtctgaacaatgacaaccttacgatccaggagaagatagatatcgaaaatcacattaacgggtggctgtctttcttgaaaggcatcgactataacagttaccagcagctactgaagtggaaagaggagttcgagaaaaaagcgcagaccaacaaaatagctaaacaactcgagaaggaagagtttgaagaaatgctgcgatccttctga

SEQ ID NO: 10089 - RNA, 990 nt, unidentified
  source 1..990: mol_type = other RNA; note = synthetic construct
atggacaataacaacaatatcgcgtcatactttctagggatacccaccatcaacaatcaaaaagatttagccaaccatttgaacttgagcgagtacaccttatataagatcatcaactactccgacaagtattataaggagattaacatccctaagaagaatgagggcataaggaagctggcctgtccttccaaaaatttgaaagccattcaggcttggatactccgtaatatccttgatcccctcagtactaatccgtctgccaccgcattcaagaaagagacaaatatcactagcaatgtggagcggcatctggataaccagttcttcctgtgcctggacattaacaacttctttggctccatcccccagaagaacatcaacaactttttcaaaactctggggtacaataagcacgtttctttgatgcttaccaaaatctgtacgtataaaggcttcctgccacagggaggtgtaacttctccagctctcagtaatctgatcaacattaagcttgacaagcggataagtggctactgcagcaagaggaatatagtctatagcagatatgctgatgacttcacgttttcatccaacaatccaaataagctcattcagtccatcaaaactatccagaagatcattaacgacgaaaactacgagctcaacaacaaaaaaacacgaattattcggcctggaaactctaagaagatcacaggcctgattattacagacaacaagaaaatcagcatcgggagaaaacaaaaaaggattctgcgcgcaacaatgtacaccctgtacaataatgatgccctaacccaaaaggagaagattgaaatggaaaatcacatcaatggttggatagcatacctgaaaggaattgactataattcacacaagcagctgctgaaatggaagaaaaagttttcgcatgaacgcgatcaaaaagtgatgaaagagcttctcaagcagtttcagatggaactctga

SEQ ID NO: 10090 - RNA, 1056 nt, unidentified
  source 1..1056: mol_type = other RNA; note = synthetic construct
atggtcagcatgttcattgatccactgaaaaatcacaagaagcggctcaacatggataacaataacaacatcgctagctatttcctgggcatccccactattaataatcagaaagacctagccaaccatctgaacttgtctgagtattcactgtacaaggtgattaacttcaccgactggtattacaaaaaggtccagataccaaagaaagacgggacattccggaaccttgcctgcccatctcagacgcttaaagccattcaagcatggattctgcgaaacatcctggaccctctgtccgtgtctgccagcgctaccgcattcaagaaggaaaccacaatcaagtttaatgtggaaaggcacagcgataaccagttttttctctgtctcgatatttcgaatttcttcgaaagtatccctcaaaagaaggtgatctccttttttaaagccctcgggtacaataaacatatagccctgatactgagcacactttgtacctacgaaggaagtcttcctcagggaggggttacttctcccgcgttatccaacttaatcaatactaagctggacaaaagaatcagtgggtactgctctaagaagaatatcgtatatagtaggtacgcggatgattttaccttctcctccaacaatccgaataaactcattcaggctcggaacatcattaaggagattatcaatgacgagggctatcaaatcaacaaaaagaaaacgcgtttcatccgccccggaaacagcaaaaaaattacaggcttggtgatctcagatgataataagattggcattggtcgaaagcagaaaaaaatactgagagcaaagatccaccagtatttcttaaaggaccaattgactccccaggacaaagaggagctgaagaatcatatagagggctggataagctacctaaagggtatcgactacaactcattcaagcaggttcaaaaatggcagagggagttttcattgaaggccaagaaagagaaaagaaagaaagcagctgaaaagaaggaatttcaggagctcctgcgctccttttga

SEQ ID NO: 10091 - RNA, 960 nt, unidentified
  source 1..960: mol_type = other RNA; note = synthetic construct
atgaacattgccgcttatacgctgggtatccccaagatcgactcactgctggatttgtctaatgcaattaatctctccgagtatacccttcagagaattctgaactccgttgacgaccaatattacctgattaagattccaaagaaggataatagcttccgggaagtgtattcacccagtcccgcactaaaggctatacagaaatggatcctcgaaaacatcctgcagcctatagctgtggatccatccgccaccgcctttcagaaaggagtcactatcagaaataacgttgagctccatattgataatcagttcctgctttgcatggatatcaaggactttttcccttctattaagaagaacagagtgtaccaactctttcgaagcgtaggctacgatgaacacatctccttggtgttttctcgcttctgcacctataaggagttcttgccgcagggcgcagtcacaagccctagtatatcgaacattatcagtatcaagcttgacagacggttaaatgggtactgttctctgaggaatatcgtgtatagccgctacgccgacgatttcacattctcaagcaacaatactgacaagctgaggaaatccataaacatcttgaaagcgatcatcgaggatgaggggtacaccctgaacactagtaagacccgattactaattccaggtaataaacgtaaggtcacaggactcattatctctgacagcaaaagcatttctattgggcggaaacagcgtaggatcctgcgcgccaaaatccatcactcgatctttaaaatggagaaaaacacagactcctggaggctttttaacaagcacattaacggatggttaagcttcctgaagggcatagattatgaatcatacatttccctcctgaagtaccgggagaatctcaaacagaagaaaaaagaacaagaggacataatctcagtgttttga

SEQ ID NO: 10092 - RNA, 972 nt, unidentified
  source 1..972: mol_type = other RNA; note = synthetic construct
atgaatatagctgcttactctcttggtatacccaaaatcgagaatttgaaggacttcagtaacgagatcaatctgtctgagtatacactgcaacgcgtactcagctccgtgaacaaacagtacaacgtggggaaaattcccaaaaaggatcagtcatttcggactattttcatcccaagtaacgcgctccgcgccatacagacctggatcctgcggaacattctagacttgatatccattcacccctctgcaatggcctttcggaagaataccacaattaagaacaatgtggaggttcacattgacaatcagttttatctgtgcatggacgtacaggactatttcccatcggtcggcaagaacaaggtgtatcaactgtttcacagcattggcttcaataagcagatggccctgatcttttccaacttctgtacatacgaaaatttcctgcctcagggagcagtcaccagcccgtccatcagcaaccttgtgaacatcaagctggatagacgcatcaacggtttctgctccattaggaatatcgtgtatacaaggtacgccgatgatttcgtctttagctcaaataatagtgacaagctgaaaaagagcatttcaactcttaagaccattattgaggatgaggggtacaaactgaacgattctaagactaggctcctatctcctggaaacaagcgaaaaataaccggccttatcgttagtgacaaaaacaagatctccatcgggcgtgaaaagaggagaaaattgagagctcgaatccatcattcgatcttcaaactcgaagaggacaagaatttagcatcctggtacgaaatgcacattaatggatggctgagctttctgaaagatgtcgatcaaatctcttaccagcatctcgttgactataagatgaagctcgaggacaaaaaaaaaaagcaggatgaattgatggacgaattaacgtcagtgttttga

SEQ ID NO: 10093 - RNA, 939 nt, unidentified
  source 1..939: mol_type = other RNA; note = synthetic construct
atgaatataactgcttattctctcggccttcctcgcgtcgataacattgaggagttgtcctacaaaataaatttgtcagaacacaccctccacaaggtcctgaagacagtagatctgcagtacaaaactatccacatcccaaaaaaatccggatttacaagaaccgtgcatagcccttcaatggttctaaaagcgattcaagcctggatcctgcggaatattctggatccgatcttagttgatcccgccgcaacagcctttgtgaagaacacgaatataaaggacaacgtcaagcggcacaatggcaataggttttttctctgcatggacattgaggacttcttccatagcatcggtcagaataaagtgtaccagttcttcaagggactggggtataatagtcacatgagccttgtgttctcgaaattttgtacctacgatgactatctcccacagggggcagtcacctccccctcactgtctaacttgataaacatcaagttagaccgcaggattttcggctattgctctagtaaaaacatcgtgtattctaggtacgctgacgattttacttttagttgtaataacccccacaagcttatcaaggctaagtacatgctagaaaagattattgaggacgaggggtacgaactgaacgagaacaagacccgaattctcagaccaggtaatgcccgtaagataacaggcctcattgtagccgaagacggaaagatcggcatcgggagaaaaaaaaaacggctgattcgagcaaacatctataacctgtacaataaggatctgcctgacgacgagtataagaaactggaaaaccatatccagggatggttcaactatctgtacagcgtggatcaggtggcctaccatcagcttaagaactaccaatccgaggttaaattgaatagcatcttcgctttctga

SEQ ID NO: 10094 - RNA, 975 nt, unidentified
  source 1..975: mol_type = other RNA; note = synthetic construct
atgaacattgctacttatagcctgggcattcccaagattgagaacatagaagagttgtctcacaagattaatttgagtgagtacacgctacacaaaatcctcaaaagtacagaccagcactacaagatcattaagattcccaagaaaaacggtgagtttagggaactgtcttgtccatcattcatccttaaagggatccagaagtggattctcaagaacatcttaaccccgaattcgatagaccctagtgcgactgccttcattaagaccaaagggatcaagaacaatgttaatcggcatcagggaaatcaattcttcctttgccttgatatcgacgacttcttcccttccatacagcaaaacaaggtgtataatctcttcaagagcatcggctataatccccatatctctctggttttatcttcactgtgtacctacagaggagtactgccacaggggggtgtcaccagcccaacaatctccaatctggtgaatatcaaattggaccgccgaatatccggttactgctcgtccaggaacatagtgtattctagatatgccgatgattttaccttttcaagcaataaccctcacaagctgactaaaagcatcgcaacaatcaagagcataattcaggacgagggctacaagctgaacaacaagaaaacaagattcctgaagcccggcaacaagcggaaaattacagggctcgtcctgagcgacgagactggggaatttggaatcggcaggaagcagaaacgcatccttcgggctaagattcatacgctggtgtttaagctcaatgaaaacgataagagttggaaagccctaaacgaacacatcaatggctggctctcatacctcaagggaattgattttgaggcttattcccagttatccacttacaaagaggacctgaaagataaaaaagcaaccttgtctgccaaacaacgtgaactgttcgatctgttttga

SEQ ID NO: 10095 - RNA, 1002 nt, unidentified
  source 1..1002: mol_type = other RNA; note = synthetic construct
atgagcaatatagcctccagatttttaaacctgcccacaattaataacctgaaggatctgagtttactgatgaatctcagtgaacacttcctcaatcaactctcaaggaatgtggactaccagtacaaagaagtgaagattaagaagaaggacggatcaaaaagactccttgcttgcccgactcagagactcaaagccgtgcaagcatggattctacgtaacattcttgaaaaactcagctgcgattccagcgctacggcatacatcaagggttataacctgaaaaacaatgcccagatgcatacaggatcatctttcttcttgtgtctggacatcaaagattttttcggcactattccacagaaacatgtttaccagctattcagggctctgggttacaacgagcacgtgtccattatcttgtctaacttctgctgttataagggggtcctgccccaagggggagtgacatcacctatactgtccaacctaatcaacattcgactcgacagacgcatacagggttatgtctctaagaggaatattacctatactcgctatgccgatgacattaccctgagtgccaataaccctgacaaactgatcaaggtcaaagggttcgtagagaagattatcaagaacgagggctatatcctgaatgagaacaaggcaaggtttctgcggcccggcaacctggtgaaaataaccggattagttatctccacagatggctcgatttctatcggccggaagaagaaacggttgttgcgagcgaaaatccacaaactgtactttgacaccaatttgtccaaactggagaaagacaagcttagcctccatataaatggctggtttagcttcttgcgctctatcgatccagatgggcttaaccagctcaaactttacaccaagaagcttaagcagaaaaagatcaagcagaagaagtacaagatcagccaaaaaatgaataagcagaaggaacaccagctgagtatcttttga

SEQ ID NO: 10096 - RNA, 954 nt, unidentified
  source 1..954: mol_type = other RNA; note = synthetic construct
atgtccaatctgtttggcatacctaatatagaagggattaatgacttcagcaacaagaccaacatttcgtcttacacgttgtttaaaatgagctctaaaccggacctcaactataaaaaggtgctgatccccaagaacctaggtcgtgggactagagtcctggcttgccccagctataaacttaaagctatccaggcatggattctgcgcaatatacttgacaatattcagtcccatcgaaacgcaacagcgtataacggaaaaagtctggacgttaacctcaagggccatgtggggaataagtttctgatctgtatcgacatcgtgaacttctttcccagcacgaaacgggagcgggtgtatgacctttttaaatccttagggtacaatgagcagtctgccatcatgttgactaaattctgcactttcgaaggtggattgccacaagggggagttacctcccctgctctgagtaatctcattaacaaggacctggatgatgagatctctaaatactgtaacgcaaagtcaatagcctacacccgatatgccgatgatattacaatcagctccaataacaagaacaagctagatgaagccttaaaatacatcgagaaggtgatacaaggccacggctatcaaatcaaccgggataaaacacgccacctccacccaggtaagcagcgcaagattaccggacttgtatattcaaatgatcagaaggtcggcattggcagaaggaagaggaggatcctgaggtctaagatctacaattacgaaaacaaggagaagttcagcagtgagtcaactatgatctacaatcagattattggatggctgagcttcctcaaaagtgtggactccgaatcatataaatacctgaagacctactggaagacactcagaaataacgacttggagacagaggtcgccgctaccaaacaggataagtga

SEQ ID NO: 10097 - RNA, 1113 nt, unidentified
  source 1..1113: mol_type = other RNA; note = synthetic construct
atggctgtgcgaaggcctgggcgcaagcagactctcacagctgtgagtcggaggcaagtcgcacctcgagcagcccttgcctctctgctggtattcgttatgtgtttctgggccagagccggaccaccacctaagcctggaggagcccgcgtggcttctgactcatacaggcttcgggtgttcggccttccggtcattgagagcgtggccgagttagccgccgcaacgcatctgagtccagccttactctatcacctgtgtcagtttcccgatagattttaccgcagatttagtatccctaagaaatccggagcaggtgccaggcaaatccgatgtcccgcgaggcccctcaaagccctccaagcttggctgctgcgcgccatattggattccgtgaaggtccaccccgccgctactgctttcagaaagggccacggcctgcgtagcaacgtgacaccacatcgcgagaatcggtactttctctgcctggacatcgaggacttcttcccctcaattggctacgcgaaagtctggaccgtctttcggactctgggctataatgctcacatgtcgcatgtgttcgcgtccatttgcacatgcgatggcgtcctgccacaggggggagtgacttctccagcgttgagcaacatcgtgtgttttcggatggacgcgcgcttagcagggtattgcggtaagcataacgtagcatatacaagatacgctgacgacatgacattgtctgctacctcccctcgggttctcgttgccgcaaggaggatgtgcacgaggataacacgcgatgaaggtttcgcactgaatgagcgtaaaaccagagtgatgggaccccggcagtgtagacacgtaaccggcctggtggtgagcgacagaggtaccgtcggggttgggagaaggagggaacgcgttctaagagcagccattgctaggggcgcaacccgagatactgggctaaccgatgccgaaggccggagactgaggcaccgcatccgtggatggttggattatctccaggacgtagaccgtccgcgggctgatcggctgaaacgataccgaaccgcccttcttgaacggtggcaggtgtcagaccaggcttga

SEQ ID NO: 10098 - RNA, 951 nt, unidentified
  source 1..951: mol_type = other RNA; note = synthetic construct
atgtccggcaaccgttacagacttcggatggccggcctgcccctcatggaagacttgaaggacctggctgactatgttcacttaagcgccggactgctgtatcggctgtcaaagtacaacgacaagttctataagagtttccagctgccgaaaaagtccgggggctttcggatcatcagctgtccctcaaaggacatgaaggctgtacaggcgtggatactaaggaatatactggaccaaatccacgttgcagactctgctacaggattcagaactggaaagaacattcttgataatgccaagtatcacgagggcaatcgatactttctgtgcttggatatcgagaacttctttcctagcatccagtacgccaaagtgtacaccgtgtttaagacaatcgggtacaatactcatatttcccacattttcgcatccctctgcacttgccgagggaagttacctcagggtggcgtgacaagtccagccctgtcgaatatcatctgcattaggctggaccatcgcatttctgggtatgtgggaaagaggaacgtagcgtacacgcgctacgccgatgatatgacgttttcatctctgagcccagggcggctagttgggattaaacgcgtcgcattaaaaatcatcagggacgagggctttgaacttaacgaaaggaagaccagattcctcggcccttgtagacaaagaaaagtcactggtttgattatttccgatgactcactgggtgtgggtaagaaacgcaaaagaatacttagggccacaatccatcgactcgtgaccgctgatctcagtgagattgagcgtcagaaactgcggaatcacatagatggatggttcgcttatatgaacagcgtcgatcccaaaggattcgagcagctcaaaacctatgaagaacgcctcagcttggcatgttctggcgaggataccatctga

SEQ ID NO: 10099 - RNA, 1011 nt, unidentified
  source 1..1011: mol_type = other RNA; note = synthetic construct
atgaccgataaaagcaaaaagagttacctgctgcaactattttcacttcctatcctaaacaatctcgaggatttgtcagtttgcacacacttcagtaagaagatcctctaccgattgtctaagttcaattcgaaacattatgcacgatttagtatcccaaagaaatctgggggcaacagagagattctgtgcccctcgctggaaatgaaggccatacaggtctggatactgcgcagcattctcgagaaaatccaagtgagcaaggctgccactgccttcagaccaaagaccagtatagctcagaacgtcgaccagcatctcggaaatcaatatgtgtattgtctggacctggaaaatttcttcccgtccatcagctacagcaaagtttatacaatcttcaataccatcggctatattccccatgtggcacacatccttgccagcttatgcacttgtgacggcaagttgcctcagggagcagtaaccagccctgctctgtccaacatcatttgtctgcgcctggacaacaggctgaatgcttacgttggagcaaagaacatctcttacacgcgttacgccgacgatatctgttttagtgctctttccgactcacggctgtggggcattagaaacacggtcaagcggattatagaatccgagaagtttgtgattaacaagcagaaaacacgcatgcaggggcccactggttgccggaagataacagggctcgtgtttaataaagattcttatggtgtggggaggaagaagaagagagttttgagggccaaaatctttaactacatttctaccttcacctccatgtctcccgacgtgcagctcaaaactgcccagcacattcacggctggatctcctttctcaactcagtagattcccagggatgccaacagctgaccaaatttagcaagattgtgttcaatcaggccgtcgtggcgaaaaaaattgatcctgcgaagatcccagcaccattccttaaagtcttatcaaggtga

SEQ ID NO: 10100 - RNA, 957 nt, unidentified
  source 1..957: mol_type = other RNA; note = synthetic construct
atgctggatacaactgatatactgcgcatcccacggataaaagacctgaaggatctggctttccaaaccaaattaagcattggtctactgtataagatggtgaatatccccgataagttctacattcagattgaaatcgacaagaagaatggcagaaagcgcaagatcgagtgtccttcaaaaaagatgaaagctattcaggcatggatcctgcgaaatgtgctggataagatcgatgtgaaccccagtgcaaaggccttcaggcgaaggatgaacttgagctcgaacgttaagccgcacgacaacaataactactttctgtgtctcgactttaaagacttcttttgctctatcaacttcgggagtatttacaatatcttctctgtgttggggtatgatgactcaatgtgctttattctgacaaggctttgctcttacaacggaagactcccacagggaggggtgacctcccctaccttgtccaatatcgcctgtatcaagctggacgagcgcctctccaactatctcgggatacgggatattgtatatacgcgttatgctgatgatattacgctcagcgccaagcagcctgacaaactgcttaaagccttaccaactgttaaacagattatagaggaagagggatacaccctgaacaatgacaaaaccaggattttgggccccaaactacagcggaagataacaggccttatttatgatggtagtaaatttggcatcggccgcgagaaaaagagaacactccggtcagcgatctacaactatgtctacggtcgtgacgaggaagacgaaagggaaagaaaatttcaatggatcaacggatggatgaattacctgaagagcgtcgacaaaaactcctacaatatccttaagaactactggatccagttatcttgcaaggccgaggtcgcagtgactaatgagaatactttcgactga

SEQ ID NO: 10101 - RNA, 957 nt, unidentified
  source 1..957: mol_type = other RNA; note = synthetic construct
atgtctgaggtcaaacaccggctacggctcctggaccttcctttctttgaaacaatcgaagacttggctgcgctgatccgggtggacgcaggtagattacgcttgctgagttcacatccagagaaattttatcggacatatcggatatccaagagaagtggaggctggcgcaagatctgttcaccttccaaggaactcaaggccattcaggcttggattttgagaaacgtgctggataaactatcaccatctcaatacgcgaccgcctatgtatccggcaagcgactccttgacaacgtgagcccccacgccaacaatcgttacttcatctccatggacattaggaacttcttccccagcgttacctcgtttcgcgtcagggctatctttgaggccttggggtatagcatgctggccggcagcacattagctagactgtgctgctactttcatggtctgcctcaaggtggcgtcacttctcccgccctctctaatcttgtgtgtctgagactcgatcgacgtttagcaggcctggccgccaggagaaatatagtgttcacccgttatgcagatgatattacattcagctccaataaccggaacgcactctgccgcatgctgccaatcacttacaaaatacttattagcgaacgctttcagccaaatgaggacaaactgagggtgatgggaccgcgagttaggtgttccatcacggggcttgtgaaagatgcgtctgtgggacggttcgggattggcaggcacaagaagtgtgccatgcgagccgtgatgcataatctgctggctagacacgaagcttcacctgactacactgatgaggcatcgatcgtaggatggttgagtttcctccagagtgtcgatggggagtcttacaggcagatgacccgctactggaagcagcagaaggacaaatggctgtgcagcgtcaggcccgtttga

SEQ ID NO: 10102 - RNA, 942 nt, unidentified
  source 1..942: mol_type = other RNA; note = synthetic construct
atgaacaatatcgtgcacaggatgcagctcattggtctgccgttctttgacactgtcgaggaactggctgcgctcattcgaatcgagcctggcaggttgaagctactcagcattcatcccgaacgcttttacaggacgtatcatataaggaaaaagagtggcggctggcgcaagatttcttcaccatccaaggagctgaaggccatccaggcatggatcttgcgaaatatccttgacaaactgtctccttcaccttttgcaaccgcctacctgaaaggaaagaaactgatcgataacgttagcccacacgcctctaatcggtatttcttatccgtcgacataaaagacttcttccccacagtgatgaaggatagagtgtgtctgctattcgaagccctgggatatagtaacagagctgccctcgctctgacaaggttatgcagctatttctcagggcttccacaaggaggcgtcacttcgcccgccctttccaacctggtttgcctgaggctagatcgccggttagccgggttgtcttcacggagaaacatagtgtttacccgttacgctgatgatatgacattttccaccaacaatagaaacgcactgtgtcgactcctgccactggtgtgtgaaatccttcggagcgagtggtttgaacctaacgagaataaacatcgcttccttgggcccagagtgcagtgccggattactggactcgtaaaaaatgcgtctgaggcaagattcggtatcggcaaggctaagaaaatccgtatgcgggccatcattcacaatttgctggcagagaatcgtccacacccggactatcctaccgaattgagcattatagggtggctcagttacctcaagtccgtagaccccgattcccaccgccaaatgatgcagtactgggagaaacagaagagcaagtacaagcattga

SEQ ID NO: 10103 - RNA, 951 nt, unidentified
  source 1..951: mol_type = other RNA; note = synthetic construct
atgctagaaaatatccaaaggctaagactgttgggccttccggtcttcgataacatcgaaaacctggccgcattgatcagggtggacagcaagagactcacaatactcgtgctgcagagtgagcgattttataggacctatcgaattcccaagcggtcaagcggttggcggaagatttccagcccatctaaagagatcaaggccatccaggcttggatcttgcgtaatattctcgataagttgtcaccctcagcctacgctactggttacattcttcgcaaaagacttgttgacaacgtcaatcctcacgcaagcaaccgcttctttctgagtgtcgatatacgggatttctttcccatgattggctcctggagaatacgcagactcttcgaggtgctgggctactctgagatggcagcggtaactcttaccaggttatgcacatatttcgggggactgcctcagggtggagttacctctcctgctctgtccaatttggtgtgcctgaaagtcgatcgcaggttagggggactggcctctcaccggaacatggtgtttacccggtacgcggacgacataactttctccaccaataatcgcaacgccttatgtcgggtgctcacactggtgttcgagattatcagaaatgagggctttgaacccaacctggagaaagtgaggcttctcggcccacgaacgcaatgtcgaattaccggcctggtaaagaatagctcggaggctcgtttcggtatcggaaaaaagaaaaagatcaggatgcgggccgttatgcataacctgctggtgaaaggccgtcatgatagtacttacccagacggggcatccatcgaaggatggctgtcatttctcaagggggtcgaccctgggagtcacgaacagatgacacgctattggaacacgctaaaggccaaatacgggagcaagacaagatga

SEQ ID NO: 10104 - RNA, 945 nt, unidentified
  source 1..945: mol_type = other RNA; note = synthetic construct
atgaagagcaactctgaattgttgaggttgctgaatctgccagtgttctccgacgaggaggaattggctagcctcatgcacataacccccgagaggatcaagatgctgtccaagttccctcatcggtactataagaaatacaagatccctaaaagcaacggcaaacttcgagaaattagacagccgagaaaagatctgaaggccatccaagcctggattctgaggaatattttagacaaactcagccctaccacattcgccacggcatacataaaaaacaggaacatcagcgataatgtgaccccccattccaataatcgccactttgtccttctggatttagaagactttttctcctctatctcaattcggcgtgcggcaaaagtgttcctcctgattgggtattctaagaaggctgcgtcaatccttgcacgcctctgcacatgtgatggctctctcccacagggtgccgttacctctccaagtttaagtaatcttattgcagctaagctcgacagaaggatcgctggttatactagccgacggaatataatatatactcgctacgccgacgacatcacactgtctagtaacaaccccgctacactgtcactgtcgcttcctcgcatcattaagattatcaaatccgagcacctgaagccaaatatggataagctaagagtgctaggacccagaaagcggtgctcaatcactggcctggtaaaaaataactccgagccggaatttgggatcgggaagaaaaaaaaaaagcaaatgcgtgccgttattcatcactttctctttaacttgtccaaagacgataagtataccaataaggcctcaataatcggatggctgaactacctgaagagcgtcgacaaggagtccttcgagcagatgaataactactggaaccagctgattaaaaaaagtaacagtgtgtga

SEQ ID NO: 10105 - RNA, 975 nt, unidentified
  source 1..975: mol_type = other RNA; note = synthetic construct
atgagctcacctcgggtgtggacctcactgccaaacattatcatgtctactacagaattgctgcgattacgggatctgccggtgtttgataatatcgaggagtttgcatccctgtgccatatttcgaaaatcgatatttctgctatccaatacaacgcctaccctttctataggcgatacccgatgctgaaaaagaacggtaaaattcgcatcgtgtatcagcccaatccaactgtcaaggctatacagtgctggatacttcggcacattctggacaaagtaaacccctccgagtattccaccgctttcagaaagaataaaagcacactagacaacgtttcaccacataaacacaataggtttttcttccgtacagatatcgtcgacttctttcctaccattaataggagccgcgtgttctttctctttaagaacatcggctacgacacgaagcaggcgatcttattggccagactgtgtacgtgttcaaatctcctgccccagggagcagtgacttcccctagtatttctaacttggtcgtgaataagatggacagaagacttgctggctatgccaataagaaaaacatcgtgtataccagatacgccgacgatcttacattctcatctaataatcgctccgtgcttaataacagtattcggctgatcaagcgcatcatcgaggaggaagaattcattgtcaacctcgagaagacaaatttcataggaccaagtaagagttgcaaaataactgggttgattaagaatacctccgaacccagttttggcatcggtaaaaagaaaaaaaacaggatgcgttgtgttatgtactaccacatcgttaaaaagatcaccattgaccccaattactctagcgacaacagcattatagggtggctaagcttcctgaactctgtagataaggccagctttaagtatatgaacaactattggctctccctcaaggcactgtga

SEQ ID NO: 10106 - RNA, 978 nt, unidentified
  source 1..978: mol_type = other RNA; note = synthetic construct
atgcgttctaacaggaccgtcctccgactgttcgatttgccaccattttccagtctgaatgaattttgtgctctagcccatttcaacacggcaagagttagggtgatcgctaccgagtcgaagcgattttacaagagatacaacatacctaagcggtctggaggcgagcgcgagattctgcagccgacagcagaagtgaaagccatacaggcatggatcctgagaaacattctcgataaactgaaggcctctaactccgccactgcgttcactaggggggtgtctctaatgctgaacgtgcagccccatgccagtaatcgctactatctgtgcatggacatcgaaaattttttcccctctgtgtcctcattccaggttcagcaagtgttctcggctatcgggtacagccctaatgtgtcatactggatgaccaagatctgtacagttggaggccggttaccccagggtggagtaaccagccctagcttgtccaacctggtgtgtctcaagctcgatagacgccttagcggatacgccgcaagtaagggcctggtatttactcgctacgcagacgatatgaccttctcctcaaacaatcctaaactcttgcgaaattcagtggccaccgttcggcggatagtgcaggccgagggtttcatcattaatacgaagaaaacacaccttgcgggtccaaaccttagatgcgtcgtaactggcctggtgaaaaacgccagcatgccggcgtttggaattgggaggaaacgttatcgcatggtcagggctgaaatccacaacttcgtcatgcgtgggggggccaagcggtataattccaaagagagcatttccggcatgattagttttatcgagggcatcaatcgcgctcaaggcgagtctttacggaagtattggtatggtctggagcagtgcagcagagctcaagtcataattgacccagaaacagacaggcccacacagtga

SEQ ID NO: 10107 - RNA, 933 nt, unidentified
  source 1..933: mol_type = other RNA; note = synthetic construct
atggccaagtacagccagagtctctacacccagcgtcttctgtctctgcctatccttcagtcaattgaagacctctccgttaagacccgcctgccgtcccctctgttgtctcagtatttgaacgataattcccggtactattgccacatttccgtgcccaagaaaaatggagggtataggcccattgactcaccaaatcggcaactaaaagctattcaaagatggatccttagacatatactggagaaattgcaaccaagcgtatacgcgacaggctttgtgcccggaatcgcccttaaacgaaatgctataccacacactggaaatcagtacatactgaagctcgacctgaaagattttttccccagcataaaagcatcgtacgtgtacagcgtctttcgggcggcagggtactctaaacagatagcatatagcctgacaagcatctgtaccctgaacggctatttaccgcaaggcgctcctacttccccatgtctctcaaacctggtgtgcctccgtttagatcagcgaattggaaagtattgcgacagacacgccctcacattcacgcgctatgccgacgacattagcatctctggtaacaagctatccatcgtgaaaaaggcttgggtagtcatcaaattgattctgagtgaggagggctatgtgatcaacaagaaaaaagagatgctttctgggcccagaagtaagagggaaatcacaggcttagtcgtgacccctaagctggggattggtcagaggaagtacaatatgtaccgcaataagatcttccacctgtgtcataagaacgataacgaatcaattctgatcatccagggtatcctcgcctacattaagggcgttgatcatgaccggtatagtaagctgaaaaggtactatgatgccttgaagaccaaggaggttactgaatga

SEQ ID NO: 10108 - RNA, 912 nt, unidentified
  source 1..912: mol_type = other RNA; note = synthetic construct
atggccaagcactcccaaagcttatatacacagcgactactgagtctgccaatactgcagtcaatcgaggatctcagcgttaaaaccaggctcccccacgccctgctaagtcagtatcttaccgataactccaggtactactgtcacatcaaagtgcctaagaagacatcaggttaccgctcaatagactctccaaatcggcagctgaaggctctgcagcgttggattttacgcaatatcctcgaaaaactgcagagctccccgtacgcaaccggatttatttctggcatttctctgaagcaaaatgtgcagcctcatagcgggaatcagtacatcttgaagctggatatcaaagatttcttcccttctattaaggcctcgtacgtttattccatctttagagcagcaggctattcaaaaaagatcgcgttccatcttacgtccatatgtacactgaacgggtatctgccccaaggcgctccctcttctccctgcctctccaatttggtgagtctgcgcatggaccagagaataggcaaatattgcgaccgacacgccttgacttacactaggtacgccgacgacatcagcatcagcggaaacaaactttccgtgatcaagaaagcctggacagtcgtcaagttgatcatttgcgaagagggttatagcatcaacaagaaaaaagagatgctcagtgggcctcggagtagacgggagattactggtattatagctaccccaaagttaggcattggacaaaactcgtataactcctaccggaacaaaatttttcacctcagcaagaagggagatccaaatagcaaggaaattatcctcgggatcctggctttcattaaatcagtagatctggagaggcatgacaaattgcttagatactacaagaagctttga

SEQ ID NO: 10109 - RNA, 918 nt, unidentified
  source 1..918: mol_type = other RNA; note = synthetic construct
atggtgaatcactcacagtcgttatacacccaacgactgctcagcttgccgattcttcagagtctggaagatcttagcgtaaccatgagactgcctgtcagtctgattagccaatacgtgaacaacaacacaaggtattactataacatccccttagcaaagaagaatggaggtctgcggtctatcgattcacccaatcgccagttgaaggccattcagcggtggattctgcgcaatatcctagaaaatctgtctccatccggctatgctaagggattcgtcccaaaattatcgctgctggataacgcgttgccccatggcgggaatcagtacgttctcaaaatagaccttaaggacttttttccttctataaaagccacacacgtctattccgttttcagagcagtgggatacagcaaaaacataagctattacctgactagcttttgtacgctcaatggctacctcccacagggctcaccttgttctccttacttgtctaatttggtgtgcctgcggctggatcagagggtgggtaaatatagtgacaagaatgctctcatctacactcgatatgctgatgacatcacaatttcagggaacaaactatccacaataaagagggcctggaaagtgattcgtatgatcatcgaggatgagggctttgtcatcaacaagaataaagagatgctgagtgggccaagatctaagagggaagtgaccggcctgattacccaccccgtagtgggacttgggaccaaaaaatacaacttctatcgcaacaagatcttccatctcactaagaagaacagctgcgaatcccatgaggtcattaatgggatcctggcattcgttgcctccgtggactccaaaaagtacgagaagctcaagctttactatgacggtctaaacatctga

SEQ ID NO: 10110 - RNA, 939 nt, unidentified
  source 1..939: mol_type = other RNA; note = synthetic construct
atggctaacagatatcaggggctgttcacacaaagattactctctttacccattctccagagtatagacgacctggccatcaggactaggttacctgtgtcactcattagcaagtacctccgcaacaatacccggtattatcggcatctggttttgaagaaaaaaacaggcggcttgaggccgatcgacaatcccaacgtggaactgaaagctctgcagagatggatactgaagaacctgcttattaatctgtccccatccatctatgccaaaggattcattaagggaatttcgatcactgaaaatgccgcgccacacagcgggaaccagtacatcctatcaatcgatctcaaggattttttcagtacagtgaaggcaagccacgtttttaccgtattcaagagtgtgggatactctaaaaagatttcctacgccttgactagcatctgcaccctgaacggtgtgctgcctcagggagctcccacatcacctgctctttccaatcttgtgtgcctgaggttggatcagcgtattggaaagtattgtgacaataaagccctgacatatacccgctacgccgatgatataacgattagcggcaataaactagcagtgatccgaaaagcatggcgtattgtccgacttataattgaatccgaaggctacttcatcaacaaaaacaaagagatcctctcagggcctcaatctcaaagaaaagttaccgggctgatcgtcacccccaaggtaggcatcggccgcgaggagtacaatcattaccggaaggagatctttatactcgtcaaaaaggatgacgagtattctacttacaaaatccagggtatcctgagttttataaagtccgtcgacatcgagcggtataagaagattaaggaatactacgagtctattgtgaagaagccaacgaagaaaagcgagtga

SEQ ID NO: 10111 - RNA, 921 nt, unidentified
  source 1..921: mol_type = other RNA; note = synthetic construct
atggcctctcgatatcagggcctttttactcagcggttactgtctttgcccatacttcagtccgtgaatgatctggccattcggacaagattacctgtgaatctcgtttccaagtacttgcgggataatcatagatattatacacgcctccctctgaaaaagaaaaccggagggttcagacctatcgactccccaaacacagaactgaaagcactgcagagatgggttctcaggaacctgctggctaacctctcgccctcaatctacgctaagggctttataaagaaaagcagcatcacggataatgcggcaccccacgcgggtaaccagtacattctgagcatcgacctgaaggattttttcacaaccgtgaaagccagttacgtcttcactgtgtttaaatccgtgggctactcaaagaaaatatcttacgctctgacgagtctatgcactgtaaatggggctcttcctcagggcgccccaacatcacccacactgagcaacttggtttgcctgcgtctggaccaacgaatcgggaaatactgtgaaaataaggcactcacctataccaggtacgccgacgacattaccattagcggaaacaaacttactgtgattcgtaaggcctggggaatcattaagttgatcattaaagacgagggttacaccatcaataagaagaaagaactactttcaggaccacaatcccagcggaaggtcaccgggctgatcgtaacgccgaggatcggcatcggcagggataaatacaactattatcgcggggagattttcaaactcgtcaagaaaggtgacacctatagtatagatcgcttaaacggaattttgtctttcatcaagaacgtggataaggacaagtataataagctcaacgagtactataagaagataactactagctga

SEQ ID NO: 10112 - RNA, 927 nt, unidentified
  source 1..927: mol_type = other RNA; note = synthetic construct
atgccaaaccaatatcaagggttgtatacacagaggctgctgagtctacctatactccagaccctcgatgatctggccactaagacacggttacccaagactctgcttgttaagtacatccacgacaacgagagatattacaactcctcctacattaagaagaaatccaaagatctcagaactatcagcaatcctaatcgcgaactgaaggctattcagcgctggatcctgcgaaatgtgttgtcatctttaagtccctccccttatgccaacggcttcataccgaagaagtcaatcatagataacgcccggccacatagggggaatcagtacatcctgtccatcgacttaaagaacttcttcacaaccgtgaaagcttcttatgtgtttacagtgtttaagagcgtagggtacgccagcaaaatggcatactatcttactagcatttgtacgctcaacggagttttgcctcaaggagcaccaaccagtcccatgctttcaaatctggtgtgcctacgaatggacgaacgtatcggaaagtattgcgaaaacaaagctctgacctattcgaggtatgccgatgatattaccatttcaggcaacaaactggcagtcatcaaaaaagcttggattattattcgcaagatcatatctgaggagaatttcacagtcaataagaagaaagagatgctgagcggcccccagtctcagaggaaagtgaccggtgtgattgtaactccagaaatcgggattggtagagagaaatacaactactttagaaagcggatctttatcctcgttaagaaaaacggcgacaatatgagtaatgtcgtcaatggaatcttggcgcacgtgaagagcatcgacctgggcaagtacaagaaacttaacgactactacgagcagctcataaataaaacgatttga

SEQ ID NO: 10113 - RNA, 933 nt, unidentified
  source 1..933: mol_type = other RNA; note = synthetic construct
atgatgaaaaaccagggaatctatacccaacggctgctgagcttgccaagtttaaatgatctcaatgacctgagcatccatactagactttctcatgacttgatttccaaatatgtgagcaacaacaagcggtactatcaccattttaatatgactaaacgcagcggcggagtgcgacccatcgaaaacccagatgaggaactgaaggccatacaaaggtggattctgagaaacattttggacaagctgtttccctctatctatgctaaaggtttcgtcaagaagatgtcgattttaaacaatgccaaaccccacttggaccatcagtacatcctcaacatcgaccttaaagattttttcagccacgtaaaggcatctcacgtttttacagtgtttaatgcgctgggttactctaaaatgatgagttactacctgaccagtatatgtaccctgaatgggtacctcccacagggcgctccgacctctcctagcctctccaatttcgtgtgcctccggctggatcatcgcattggaaaatattgcgaaaacaaggcactatcatacacgcgatatgctgacgacatatgtatttccgggaataaactcacagtgattaaagacgcatggcacatgctgagggtaatcatcgagagtgaggggttcataattaactcaaagaaggagaagctgtccgggcctaaaagtcgtcgcgaagtcacaggacttattgtgaacccctccctcggcatcggcagatcaaagtataattactaccggaagaagatcttcattctattaatggccaacgatcctaagagggagcagatcatttctggcatcctttcctatgtcaagtcagttgatgccaaaaggcacatctacctgtgcaagtattacgattcaatcaagctgaaagcctccactagcatatga

SEQ ID NO: 10114 - RNA, 948 nt, unidentified
  source 1..948: mol_type = other RNA; note = synthetic construct
atgacctatatctctaacaagcagaaaacgaataacagcggactgtacacacagagaatgttggccctgcctgagctccagtcactgaatgacttcgccgctaagatcagggtaaccccagaacttctcacaaagtataccgggaataataaacatcactatgccgtgcatcaagaagaaaaaaaaacgcccgggcagtaccgtgaaatctccagtccaactagtgagttaaaggccctgcagcgctggattttgcggaatatattggacaaactgagtccctcaccatacgctaaggggttcatcaagaagaaatgcctgtttgataacgctaagcctcacgagggaaaacagtacgtcctcaacttggatctaaaggactttttctcaagcgtgagcagcaagaatgtttgtaccctctttaaatctcttggctacccgcctctcctgagctatcagatgaccaacatatgcactctaaacggttgcttaccacaaggcgcgcccacaagtccggctttatcgaatctggtgacaattcggatggattataggattggcaaatactgtgagaagtacgcactcacttacactagatacgcggacgatatgacaatttctggcaacaaactgtctatcgttaagaaagcacggatcatgattaacaagattatcagagaggaaggattctatatacaccccaagaagaataagctgagcggtccttcagtcaggcgagaggtgaccggtctggttgtgaacgagtcccttggaatcggcagagaaaagtataacttttaccgcaccaaaatgttcaagctgcacaaagagcagcaccccaattttgaatccgtctcctccgggatcattgccttcgtgaggtctgtagacatagtgcgagcccaaaaactgcatgcatattttgagaagcttcgcatcaaaaactga

SEQ ID NO: 10115 - RNA, 930 nt, unidentified
  source 1..930: mol_type = other RNA; note = synthetic construct
atgaatacccaccagggcaagtacacccagcagctgctatccctgccaattttggagaatgttgacgatttgagccagtcgctacggttgccgaaggaggtgatctctaagttctcactgaataacgataagtactatcaccgcatcgaaatgaaaaaaaaaacaggaggcatccgacacatagagagtcctttacgggaactcaaagccatccaacgctggatcctccggtatattctcgataaacttgctccctccatctatgcaaagggctttgtgagaaaaaagtccattatcgataacgccaagccccatgagggaaatcagtatgtcctgaatttggacctccaagatttcttcactaacgtgcctgcttcacatgtgtatacactctttcggaacattgggtacaacaacaatatagctttcatactgacctctttttgcactaagagtggataccttccacagggtgcccctacaagtccagccctgtccaatttagtgtgcctgcgcctggaccatcgtgtctccacctactgcaaaaagagggcgcttacttacacacgttatgccgatgacttatgtatcagcgggaataaaattctgatcctccaaaaagcaagctacctgataaagatgattatcgcagacgagggctttacggtgaacaccaagaaagaaaaatttctgggccccaaagtccgaagagaggttactggtctgacagttacccccagaattacgatcagcaaaaaaaactactgtgtgtataggaagagaatctacgacctcgtaaggaacgaggtccagaacaagaatgaaattatcagggggatactttctttcgtacaatcaatcgacaaggaaaaggggaagaagctgagcaccttctaccagaagcagatttctctgattactgacatttga

SEQ ID NO: 10116 - RNA, 924 nt, unidentified
  source 1..924: mol_type = other RNA; note = synthetic construct
atgaacacccaccagggcaaatatactcagcagctgctctccttacccatccttgagaatatggatgatctcgctcagttcattcggctgcctaaagaggtgatctccaaattttcgttcaacaaccacagatactaccatagaattgaaatggagaagaaatcaggcggtattcgatatattgagagccctgtaaaagagttaaaagcgatacaacgttgggtccttcggtacatcctagacaagcttagtccatccgtttacgcaaagggatttgtgaggaaaaaatcaatcctggacaatgccaagccacatgaaggaaaccagtatatattgaacctggacttcaaggacttctttaataatgtgcaagccagccacgtgtataccctgttcaaaaacatcggatacaacaacaacattagctatatactgacctcattttgtactaaagaggggtatctccctcaaggggctcccacatctcccgctttgtccaatctcgtctgcctgcgtctagatcatcgcctgtctacatactgcaataagagagccttgatctacacacgctatgcagacgatctgtgtatctctgggaataagatactgatcctgcagaaaagcagctacttgattaaggaaatcatccgcgatgaaggtttcacgattaacactaagaaggagaaattcctcggcccaaaggttaggagagaagttactggccttacagtgacgccgaagattaccatcagtaagaaggactactgcgtctacaggaaacggatttatgatttagtgcgaaatgaggtacccaataaacacgagataatcaagggcatcctgagttttgtgaggtccattgacaaggacaaggaaaagaaactcaccgccttttacaacaagcagacctctatcattcggtga

SEQ ID NO: 10117 - RNA, 939 nt, unidentified
  source 1..939: mol_type = other RNA; note = synthetic construct
atgaataatcaccagggcaaatatacacagcaactgctctctctacccatcatcgaaaatatggatgatatctccctttcctcacggctgcccgtagaagtcatcgccaaatttagcttcaagaacgacagatactatcacagaatcgagatgaagaagaaagctgggggtgttaggctgatcgagtccccaatccgcgaactcaaagccatccagaggtggattctgcgaaatattctggataaattgtccccgtctatttatgcaaaaggctttatcaagaaccgcagtatacttgacaatgctaagcctcatgagggcaatcagtatattctcaaccttgacctgaaagacttcttcacaaatgtgaaagctagtcatgtgtataccttgtttaagaacattggctacaacaatactgtcgcgttcgcccttacctcattctgcactaaaggagggtacctccctcaaggagcacctaccagcccagctatctctaacctcgtttgtctgcgactggaccaccggattagtacctattgcaagaagagagccctcacatacacgaggtacgccgatgacctgtgcatatcagggaacaaactgcttaccattgaaaaggcatcctacctaattaaggagatcttgggggatgaaggatttagcataaacgagaagaaggagaaactcttaggccccaaagtcagacgtgaagtgacaggattaactgtgaccccaaaaattacgatcagcaagaagatctactgtttatacaggaaacgcatatacgatctggtacggaacaagatccctaacaagcatgagatcatcctgggtattatttcgtttgtgcagtcaatagacaagggtaagggcaagaagttgactgccttctatgagaaacagaagagcctgattctgccctctttgatagtgtga

SEQ ID NO: 10118 - RNA, 942 nt, unidentified
  source 1..942: mol_type = other RNA; note = synthetic construct
atgaatgcctatcagggcaaatatacacagcagctgctgtctctgcccatcatcgaaagtgtagaggatcttagctacttgatgagactccccaaagagacaatcatcaagttctcaacgaaaaacgacaaatattaccacaagatcgaaatggtgaaaaaaaatggaggaattcggttgattgagtccccaatcaaggagctaaaagcgatccagagatggatattgagaaatatacttgacaagctgtctccctccgtctatgctaaaggcttcataaaaaacaagtccattctcgataacgcaaagcctcacgagggaaaccaatatattcttaacctggaccttaaggatttcttcaacaacattaaagcctcttacgtctacaccacatttaaaagtatcggttaccaatccaacattgcatttattctgaccagtttttgcaccaaaggagggtatttacctcagggcgctccaacctcacccgccttgagtaattttgtgtgcctgcggctggactaccgtatatcaacatattgtaaaaagcgagccttatcctatacgcgctatgcagatgatctctgtatcagcgggaataaaattcatactctgcagaagagctcttacctcattaaggaaattttactggatgaagggttcatcatcaacattaagaaggagaagtttctgggccctaaagtaaggcgcgaagtcacaggcctgaccgttactccaaagatcaccatcaacaagaagaattacaacatttaccggaagaggatctacgacctagtgaggaatactgttccgaacaatgtggacatcattaatggtataatctcgttcgtgaagagcatcgataatgacaaagctaacaagctcaataacttttacaagaagcagctcgacgagatcaagaatagcactataaaagtgtga

SEQ ID NO: 10119 - RNA, 948 nt, unidentified
  source 1..948: mol_type = other RNA; note = synthetic construct
atggtgtatagctctaaaaactccacaagttcgacctatagagcccgcatgactggcttgcctgaaatccgatcagtaaaggagctaagtcatctcctgagaatcccagagagcacgctgcatagttttagcaagaagaatcataccattggctatgtggaattctgcatacctaaaaaaccgaacggtttcagggtgatccacgctcccgtcaggacattgaaatacatccaggcttggatcctgcagaatatactttaccactttaagagccacaagtctgccaccgggtttgagaaaggctgctctatcttagagaatgccaaaccacatgccggccagagctacgcaattaacgtggacattaaggacttctttaattccatctcttccgacaaggtgttcaacctgttctccactattggttacgagagggagatagcatggatcctgaccaatttagttacattcaaaggacacctccctcaagggtccccctgttcacccaaaattgccaacttgatttgtcatagactcgatgcacggatttacggcttttgcaaaactaagaatatgcagtacagtaggtacgcggacgatattaccatctcaacttctcacagaaagaacatatcacagacacttcggttcattaacaacgtgatcgagtacgagaattttagccttcggaacgaaaaaacaaatgttttcgggcgcggaaacgctaaaattattaccgggctggttgtctccaatgaaatccgcgtcggacgtgaaaagtatcgggaaatccgagcgaaaatgtacaaggctataaaggaagatgataagtacgagaaggaatatctcgacggatatctgaactttctcaaaggtgtagatgccaagacgcaccaactgctgatcacctatcaggagaagatcactaaaaagctaaagagcatctga

SEQ ID NO: 10120 - RNA, 1137 nt, unidentified
  source 1..1137: mol_type = other RNA; note = synthetic construct
atgaaggaactaggcttattttgttccattaagtcgtataactgctcattccttgggacaattgagatcgtgccttttctctttagacggatcttcacgaatatgaatagtgatgcactgtacaatctctcccaacagatggataccaaatatccaattatcaccgacgtgctgaggaataaaaaacatcattacaaccagctggatgcgaagaagaggaatgggaagatccggaaactctacagcccgagcaaaatcttgaagtattaccagaaatggatcgccactgagattctgagtaagacaatgatacatgagtgttgtaccgcataccagaagggcatctcattgaatgagaacctgattccacaccagaaacacatgtacttcctttgcgtcgacatcgaggactttttccagtcaatcaacttcaaacgcatacttcatctcttcaagaaactgacaaacgatactcaaatggcctactctttgtccgaactgtgcactttgcacaagaccctcccccaaggtgctgttactagccccgtcttatctaacgccgttaactatcgcctggacaagcggatccacggctacgcaaaaaaacacggactggtgtatactaggtatgctgatgacatcacgattagtggaaatgacatgggtgctatcaaatccgcctactacacagtgaaatgcataattgaaagcgaaggctataagttcaacaaggagaagactagaattctgaagcccggagtaaagcgaaaagtcaccggcttgcttataaatgaggaacaagagatcagaattgggcgtgaaaaataccgggagctgcgctccatgatctatacatacaagaatagtcgagccattaccggagtggaaaaagagcatctcttccttagaataaagggttggataagctatctgaaacacgtagactttaagacatgtaagatgctgctagagtatattaacaagatctatgtgaacgatgagaagaatcctttttcattcctcgacaaaaggtctgatgaaatggggtacatcattcctcagctgcagcagctagaatctaatatgaactttctgaccagcgagaacacccacgttaacttagtgattaagaattga

SEQ ID NO: 10121 - RNA, 1035 nt, unidentified
  source 1..1035: mol_type = other RNA; note = synthetic construct
atgaattctgacgctctttacaacctatctcagcaaatggatacaaaataccccatcatcacagatgtcttgcgcaacaaaaaacaccactataatcagctggatgcaaaaaaacgcaacggtaagattagaaaactctacagcccgtcaaagattctcaagtactaccaaaagtggatcgccacggagattctgagcaagactatgatccacgagtgctgtaccgcgtatcagaaggggatctccttaaacgagaatctgataccacatcagaagcatatgtatttcttatgtgtggatatcgaagactttttccagagcataaacttcaagcggattctgcacctgtttaaaaagctcacaaatgacactcagatggcttatagtctgtcagagctatgtacactccacaagaccctccctcaaggagcagtaacatcccccgtgctttcaaatgccgtgaattaccgcctggataagcgtatccacgggtatgccaaaaagcatggccttgtttacacccgatacgccgacgatattacgatcagtggcaatgatatgggagctatcaaatccgcctattataccgtcaagtgcattatcgagtctgaaggctacaaattcaacaaggaaaaaacacggattcttaaacctggtgtgaagcggaaagtgaccggactgctgataaatgaggagcaggaaattagaattggcagggaaaaatacagagagctgaggtcgatgatctacacttataagaatagtcgagcaattaccggagtggagaaggaacacttgtttctgaggattaaggggtggatatcctatctcaagcatgttgacttcaaaacttgcaagatgctgctcgaatatatcaataagatatacgtgaacgacgagaaaaacccctttagctttctggacaaaaggtccgacgagatgggctacatcatcccacagcttcaacagttggaaagcaacatgaacttcctgacttctgagaatacccatgtaaacttggtcatcaagaactga

SEQ ID NO: 10122 - RNA, 942 nt, unidentified
  source 1..942: mol_type = other RNA; note = synthetic construct
atgggtgaactagtgttcaccaaagtgaccaaagatctcaagaccaaatatcctatcctcaaggatgttatcaacttcaaagagaagcattaccagactatatcgatccgaatgaagaatgggaagctgagaactatccataacccatctaaggccctccggtattatcagcgcgcaatcgttgagaagtttcttaatgaggtccccatacacatttgctgcaccagctatcaaaaaggtaaaagtctgaaagcaaacgtacttccacatgccaataacatgtatttcttacacgtagacatcgccaatttcttcgaccacataaagttttcacaagtgcacaagctgtttacggatttgattgaagacaagtatgaagctaagttctacgccgagctgtgtactctgaaaggcactctcccccagggagcaataacatctccctccatttcaaatgctgttaacttcagaatggatagcagaatttttggctacagcaaaaagcacaatatcgtctatacaagatacgccgacgacattactctgtcctctaatgactttgctagcatccagcgctcactttacgtggtgaaacagatcttgcaagatgaaggataccagctcaatacgcggaaagtccgcatcacaaagcctgggatccagcggaaggtgaccggcctattaattaacgaggatcaggaggtgcgtgttgggaggaagaaatacagggagctgcggtccatgatttacaactacaagaacaatacaagcgtgacaaggaaggagaacagggcgctgttccgaaaaattgtgggctggcttagttacctgaatgtcgtggacgaaaagacctacagtttgatggtcatgtatataaagaagctgtatggaaacaccaaaaacccgtttgaaacaatgctgatctccaaggagaaaatttga

SEQ ID NO: 10123 - RNA, 2058 nt, unidentified
  source 1..2058: mol_type = other RNA; note = synthetic construct
atgggaaagcacaataaaggcaaagtgatcaagaagtactacaatcctctgaccccactggaggtattctttaacgagcttaattcctttctcagagtctacggcctgaaattcagctacgaagactattgcaacttcatcaagaataagaacgagtactatacgacctttaccatcaaaaaaaagaacgggggactcagaaggatcgatagccccaacaggctgcttaaacacatccataggtacatcttgttcaagcatctgtacaacttcaaggcccatccttctgctacaggttttattagaggcaggagcatctttgataatgccaattatcacgtcaacaagaatcatgtgtacaaactggacctggtggactttttcccatccataacaaaagatatggtgttcaacgtgttcatcagcaagggttataattccgagatttctacggtcatgtcagaactctgcactctgaacaatgttctaccccagggagctcccactagcccggcaattagcaatcttgtttgctatcgcctggataccaggctgagcagcctcgccaaaaaatgtaaactctcttatacccggtatgccgatgatattacattcagtggctggtacattaaaaaaggcgtcacaaagctgattgagaaaattatcacagacgaaggttttaaggtttcaaaggagaagaccaaactgatcaagaataaaaagaacttccgtcaggtcgtcactggcgtggttgttaataagaagctcagcatgggggaaaagcgctatctcatgttgcgcgcaatgattcacaactgtaaagtgaaaggtatttaccaggtgcagatggagacaaaagagaagcacggcaaagggtattttgcgaggagagacttgtatagtgcaaaggtggatatgttcaattaccttctggggatcgtagaactctttcggcagatgaaggactataaacgatatttgacgatgctgcgggacctctattaccttgactgggttagatactacgtcgaagccggagaactgaatgcaaacgaactaggaatcatgagaaagaaaattatcgagaggcggatcaagaaatttgtgcgatccgagctaaaggatataaaatcccggtcagattctctgaacaacaagctcaaacgctataactcacggctcgagcggctgaaagagtacattcgccaaaatacctatagtgaaaaagagcggctgatcgacgaattcctgagactgcaggaacggatagataccttaacacaagagactaacaacatgtccaggtttctcagctttgtcagtgacttcattagtaagaactggggaagaagcctgatgaaattattgaatagcgtgaccgaggaggtggaggagactatgagtaccaagtacactgtgcagaacaattttataaagttgggcaatgagttccttgagaagaatattaacgtgaacctgtctgtcaactacaacaatataaacgttgaagggtccctgtcaaaacatatttcgccagataagccctttagcaacatctcatacttttggggattaatcaggtccaatcgtgggtacatcaagtggttggacaagtacttcaataagtctggattccgtttacttactgacgagataggcgatgatccaaagtacaagtccataagtatcctaatgtccatatacccttttgtgggcggggaaaataaggaatctgctatccgaaaggtggaacgctttatcgacattttcaaacgcttcaaggaggagatgagaaacaagggtatatctgtagagttacgcatcttggacaaagactcatctgccgaaatacacgacagggtgatcatcttcgaagagaatgcttacacagtaccttccattgacaccctgatgcgagggcaacactcatatattttccccattaatccgatcgatttcccttttgatgaatattggaaccgttcgttcgatattctttctgaccgaaacaagattaatgagctgatcgacaaatatgtgaacaacaagaaaaagtga

SEQ ID NO: 10124 - RNA, 1779 nt, unidentified
  source 1..1779: mol_type = other RNA; note = synthetic construct
atggtgaagaaattcattaacaggaatagcgaatcaaagttcctggatgatctacgtcgacatattgattttgaattgactcaggaagatctggacatattcttccaggacaagtataacaagaagaacaagctccattactcttcttattcaatcagtaagcactccgggaagaaacgcaggataaacgctccaagcagagagttaaaaaaagtacaggagtacatactgtacaaacatctttactacttccccgtgcacaaaaacacatacgggtttattaagaacaagagttacgtagacaacgctaaacagcatatccggaagccgcacgtgtttaaaaccgacgtggaagattttttccccaacatccggcatgaaaggatcttcagcttccttgtgaatgggttttcatccaaggactacgactcagtcttcgattccaatccccaactggaaattagaaaacagcgaagaggttatagcgagaaaattgctacccttataactgaattggttactctggacggatccttacctcaaggagccccaacatctccagcgctgtcaaatctcatctgttttcctttagactatagattgagcaggtttgccaagaaaggacgcctgacctatacacgttacgcagatgacatcacatttagcggtaagtatattaggaaggacttcatcagtaagatcaagacaattatcgtggacgaatgtttcaagattaacgaggacaaaagtaagtttatctcccgtaagcgcgcacgaattgaggtgacagggctggttgttaataccaaactgtcttacggtcgagagagatacaggaaaattaaagccatgttagaccaatgcaagaagaacggcatttcttccctgaataaggataacaatgacgaaactggcattaaaaatcacatcgacttttaccaacacattataggcaagatcgatatcttcaatcagatcaagcactacaaaaagcacatggtactcctgaaaatactctttcagatcaattgggcagactactatacgaaacaagaggatcttctcgagagctataacaagcacaatcatagttcattcacatccacggagctgggagagattcgcaaaaaaagcatcgagaaactgacccacaaagccgtgctcaaacaggaaagggaagataaaaaacgggatacccggcgggccgcgtattatgcaaagaagaataaatcgatcctggaggacataaagaccaaactttcccagcaagatcagttgatttccgtgtactcagagacactctctaaggagtatgaggacaagtataacttgattgaaaagattcaggctgatcgcctgaagatccaggagctggagaaaaacctcgaagatgccaataaaaaagctaagcaggctgaaaagttcaataccgatctgactaagatcttggaccgggtggacaagaattctaagacccttgagagactggagaaacagggccagaaaacgcaagacatcgttacttccatcgataagaaaattgatagcatcgcggacaggctaggcaagaacatggtcagtctgtttgatgccataaaagagtctaaggaagccatcactaaggagattaaggcaaaccatatctcgctcgagaaaggcatcgaagagattcacaaggccacccagatgctggtcgaaatacagaaagacaaggaccctgatctctgggaacggtgccgcgagaaggtccagaagagactaagctggtggaaggtctga

SEQ ID NO: 10125 - RNA, 1626 nt, unidentified
  source 1..1626: mol_type = other RNA; note = synthetic construct
atggagcaactttcacccatttgcgggcgggtcaaagttctcaacgaggctgactataacaacgagttccaatatttcaaacagctgaagagtaaaaagctgccatacatttatgatatcgaccacttctgtaagctgattcaccttagctctaaccaggtaaagttcttcctgtcacacaaagaaaaagcttacgtcacctttcgggtcccgaagaaaaatggggacttccgcgagattaacgctccttccaaaaaaatgaaatacatccagaggtggatcctggacgaaatactttacaagcttaaccctggagagtacgcccacggctttatccctggcaaaacagtttatacaaatgcagagtctcatgtcaacaaggacctggtgttaggaatcgacattaaagatttctttccctccatcaagtttgtgtctgtgtacaatgtttttaagagcgcagggtatacagagaaggtggccaggcagctagcagacctctgcacctaccattggaaattgccacagggagctcccaccagtccaatgctcgccaatctggtggcactcgatctggacaagaaaatatcccagtattgcaagagagctaacttcggttattcccgttacgccgatgatattactattagtggtagctacgacctggccatccacaaggagacaattgtccgcatcatcaatggggcgggattcgaggtgaataaccagaaggtgagaatggtttctaagggctcaaggcaaaaggtgactggcttggtggtgaaccataaagtttcaataggacgaaccaagaaaaagacgataagagccatcgtccacaatatactgatgaatggaccggtgttggagaatagatgtaacgacccatttttcagagaacggatcttcgggcacctcggttgcgcttctgccattgaccccgaatttgccctgcctctaattgattcgttgaaaaagattgactggtctgagtattgtgaacacatcaaggaagtaaaagagagcgagattaataagaatcggatcaagcggataaacaaggtcttaatcgtcaagttcgacgaactgggcttcttcaggaagattggggaagtgcctcgagatgcatttacggaagagtttaaaatcaagttgggcaccctgcaggagatgtgcagtaaggagatacacggcgtagttgcatgttccaactgcctgaacgtcaaaaatgaaatctacaaaagctgcatgaagtacatactcgggcagtatacaggcactaccggcggtcatcatcatggtcatgagatctacgacatgaaagcggtaacagattacaatggcgaaaatattgtggtggcctttctgatgaagtccgggactaacagtcccactaaagaaaattcagtgtttacccaggcttttgattgtgccggatataacgagaacatcgaccttattagcttagtgagcaatcacaatctctccaataagctctgtgagcgtctggagatcatgattcgcgataaaaaccgcggaaaagaaaaggagcaactgtactgtcttatcatgaaaagcgaaatggaaaggatcctatatgatttcaacaagaacaaggattgctga

SEQ ID NO: 10126 - RNA, 1683 nt, unidentified
  source 1..1683: mol_type = other RNA; note = synthetic construct
atgactgaaaagcttacgaaaaacgaacggctcaaggtgttattcgacgataggatagaagaaggcgttgtacccaaactatcagaagaagactacaacaaggagttcaaatactttacccaattgaaaagcaagaagctgccgtatatctacgatattgaccacttctgcaagttgactaattcctctagtaagcaggtgaagtttttcctaagtaacaaggagaaggcttatgcgacattcaaggtccctaagaagtcaggcgatttcagggagattaatgccccatcgaagaaaatgaagattatccagcggtggatactggataagatcctctataaacttaaccctggcaattacgctcacgggttcattcccggcaaaacgatttacacgaatgcaaaggctcacgttaataaggatctggtacttggaattgacattaaggactttttcccctctataaagtttgtggcagtctacgacgtcttcaaatttgcaggttacaccgctcgcgttgcccgacagcttgccgaactgtgcacatatcactggaaattaccacagggagccccaacttcaccaatgcttgccaacctggtggccctcaacctggataaaaagattagccagtactgtatcagagagaactttgagtattcccgttatgctgacgacatcaccattagtggatcgtataatttagcgatgcacaaggaaataatcatcaagatcatcaacgagaatggcttcgaggtgaactacaaaaaggttcgtatggtgagtaagggatccagacaaaaagttaccggactcgtagtgaatgacaaagtaggtatggggaggaccaaaaagaagaccctgcgggctatcgtgcacaacatcctcatgaatgggccggtgtttgaaaatcgggacaacgatcccttctttagagagcgcatattcggctacctggggtgtgcaaacgccatcgatcccgagtttacatctcctctgatcgacagcctgaaaaaaattgactggtcagagtacgaggagtgcattaaggaaatcaaagagtcagagatcaatgtcaatcacatcaaacgcatcaacaaagtcctgctggtcaaattcgatgaattgggcttttttcgaaagatagcagagctacctgaaggagcattctccgaagaatttaagactaaattggaatctctccaagaaaaatgtgacgtgaaaattcatggtgtggaggcttgctctgattgtctggatgtcaaaaaggtgatctataacaagtgtatgaagtacgtcctcggacattacacaggcaccacagggggtcatcatcacgggcatgaaatatatgatatgaaagccctcacagactacaatggcgagaatataactgtggcctttctgatgaagtccgccaacaagcctgccaaggagaataacagcaacaaagagaatagtttggtggttcagaccctggattgtactgattataatgacagcatcaaccttatttccatcgtgtctaataacaatctcagcaacaaaagctgcgagagactggagaaaattattaagggtatgagcaaagggaaggagaaggagcagttgtattgcttcatcatgaagaaagagatgaagaggattctgtacgacttctataaaaactaccagtcctcctga

SEQ ID NO: 10127 - RNA, 1695 nt, unidentified
  source 1..1695: mol_type = other RNA; note = synthetic construct
atgactaaaaggctgacaaagaatgagaggttgtccattcttttcgacgattgtatcgaggagggcattgtgccggttttgaatgaggccgagtataaggaacagttcaagtacttcaagaagctgaagtctaaaaagctgccctacatctacgacattgagcacttctgcaaattaagcaatagctctagtgatcaagtaaggttttttctgtccaacaaggaaaaagcttacactacctttaaagtgcctaaaaagtctggcggttttagagagattaacgccccttccaaaaaaatgaaaaatatccagcggtggatactcgacaacattttgtacaagctcaattatggggactacgctcacggattcgtgcccggaaaaacgatctatacgaatgccgaagtccatgtgaataaagacctagtgctgggcattgatatcaaggatttcttccccagcatcaagtttggggcggtttataatatttttaagagcgccggctatagcgttagggtggctcgacagctggccgacctctgcacctatcactggaagctgccacagggggcccctacatccccgatgctggctaatctcgttgcattaaacctggatcagaagatatcccaatactgtattagacgtaactttggctatagtaggtatgcagacgacattaccatttctggaagctacaagctgcccatgcataaggagaagattatcaagatcattaacgaaaacggtttcgaggtcaataataagaaagttcgcatgctgtcgaaggggagtagacagaaggtgaccggtctggtagtgaatgataaagtctcaataggccgtactaaaaaaaaaaccctgagagctatagtccacaacatacttatgaatggtcccgtcgtggaaaatcgcaatgaggacccattttttcgggagaggattttcgggcatctgggatacgccaaagccatcgatccaggcttctctacccctctaattgaatcgctaaaagagatcgattggtccgaatataacgagcatatcaaagagatcaaggagaacggcattaacacaaaccagctcaagcgggtgtataaaacaatcttggtcaagttcgatgagttgggattttttaccaagatcgcagagctcccagagggggcattcactgaggaattcaaaatccagttgaactccttaaaagagaagtgcgatgctaaaactcatggagtagaagcatgtagtgattgtcttgatatcaaagacgagatctacaacaagtgtatgaagtacatcatcgggcactacactggtaccacaggaggacaccaccacgggcatgagatctatgacatgaaggcgacaaccgagctgtacgacgatacaattgccgtggccttcgtcatgaagtcaggcgacatatctaataagaaagaacgccgaaagggcactgatagcgaaaactcagctttccggcagttctttaaatgtacctgctatgaggacctcgaccttatatcaatcgtgacgaactttaacctcaacaacgaactttgcgaagaactcaagatcatgatgcgaaataataacaaagcaaaggaacgcgaccaattttactgcctgataatgcggaacgaaatgaagagaattctttacgacttcaacaccaaaaaggccgaaaatctgacatga

SEQ ID NO: 10128 - RNA, 1653 nt, unidentified
  source 1..1653: mol_type = other RNA; note = synthetic construct
atggagatcagcaataatgagaagctgaagatcctctttgactcttacattgaaacagccatcataccctctttgaatgaagacgagtataggaaggagttcaagtccttcaaacgcctgaaaagcaagaaactgccctacgtgtacgacatcgatcacctgtccaacctgacgaactcttctagcaagcaggtccggttctttctgagcaataaagatatcggatacaccactttccgaattccaaagaaaatgggcggttttagggaaattaatgcatcctccaagaaattgaagattatccagaagtggatcctgaacaacattctttacaagcttgatagttcagactatgtgtacggttttattcccggcaaaacaatttactcgaatgcccagatacatgtgaatcatgacttagtcctgggcatagacattaaggatttcttcccgagtatcaagttcgggagtatctaccacatttttaaatccgcgggttattccaataaaatcgcttggacttttgccgatctgtgcacttatcattggaagctgcctcagggcgcgcctacatcacccatgttatccaacctggctggcaagcgactcgatatgagaatcgccaagtattgtaaccgtcggcatttcacttacagtaggtacgccgacgacataaccatttccggatcttataagctgccaatgcacaaagagaaaatcatcaagatcattgaggggaacggctttaccgttaataagaaaaaaacccggttgttcagtaaggggtcaagacagaaggtaacgggcctggtggttaatgataaagtctcaataggtaggaagaaaaagaaatggatacgcgcaatcgttcacaacatacttatgaatgggtttgtggccgagaataaagaaaatgacccttttttccgcgaacggatttttggccacctcgggtataccaatatggtggattctgaatttgcaagacctctaatcgagagcttgaagaagattgacctgtctgaatataacgaggctattatagaaactcgagagtctgaaatcaaggtgaactacctaaagcggaagagcaaaagcattcttatcaagtttgatgatctggggttttttcaaaaaatcgccgaattcccagagggcgcattcaacgatgacttcaaaaaccaaatcaacaatttgctggaaaagtgtgagaaacacggagtggaggcttgtagcgattgccttgacatcaaaaacgaaatctacaagaagtgcatgaaatacatcattggtcattacacagggaccaccggcggacatcaccatggacacgagatttatgatatggaagctgagacaagactcttcggaaagacaatagctgtcgcattcatcatgaagtcaggaaccagcgactccacgaaagagaactcgatattcaggcaggtggccaagtcattccgctttgatgggattgacctcatcggcattgtcaccacaagtaatttaaaatcagagctcctagaagacctcaaaagcctcattatgaatcacaacaacggaaaaaagaaggagcagctgtattgcctcatcatgcgtccagagatgaaaagaatcctttatgacttcaacaaggtagttactaactcctga

SEQ ID NO: 10129 - RNA, 1692 nt, unidentified
  source 1..1692: mol_type = other RNA; note = synthetic construct
atggtgtcagtggagaacaagctgactgaagacgagaaactccaaatcctgtttaagaactacactgaagaagggataattcccaatcttaccgaggaggaatatgaggagcagttcaagagttttaaaagactcaagtccaaaaacctcccttatatctatgatatcaaccacttctgcaagctcaccaattcctccctgaagcaggtcaacttgttcctttcgaacaagaagaaaggttatattaccttcaagcttcccaagaaaaatggagacttccgagagatcaacgcccccagcaaaaagatgaaatacattcagcgttggatactggataatatcctgtacaagttgaacagtggggactacgcacacggcttcatcccaggtaagacaatctttacaaacgcgaaagtgcacgtaaatcaggatttggttctgggggtggacatcaaggacttctttccctccatcaattttaggagcgtgtattacgtattcaagtcagccgggtatacaaagaagatcgcatggacactggctgacctatgtacctaccattggaaactgccacagggagctcccaccagccctatgctggctaatctggtcgccttaaagttggacaaaaagatagccaagtattgcgcaaggcgcaattttaggtactctagatacgccgatgatgtgactattagcggctcatataagttaccgatgcacaaagaaaagattattggcatcattgaagacgacggcttcgttgtcaaccatgagaaaacccgaatgttcagtaagggatccagacagaaagtaaccggcctagtggtgaatgataaagttagtatcggccggaataagaaaaaaaatctgaaggccattgtgaacaatatacagacaaacggacctgtggccgagaatcgttcaaatgatccgttttttcgcgagcggatctttggccatcttggctgtgcaaacgccgttgacccagaatttgccacgccattaatcgaatctctgaaaaagattgactggtccgaatacaacgagcacatcaaagagataaaagagagtgaaatcaacacaaatcagcttaaaagagtgtcaaagactatcctggtgaagttcgatgaactcggatttttcaccaaaattgtggaactgcctgaaggtgcttttactgaggagtttaagaagcagctgaacaacttgaaggagaagtgttctactaagattcatggggtcgaagcctgctctgattgtctagatgttaagaacgagatctacaagaaatgcatgaagtacatcattggccactatacaggaacaaccggcgggcatcaccacggtcatgagatctatgacatgaaggctaccactgagttctatggagacactattgctgtcgcgttcgtcatgaaaagctccgacatcagcgacaaaaatgaaaggaggaaaaacacggactctgagaactctacatttcgccaattcttcaaatgtacctgctacgaagatctcgatctcattagcattgtcacgaactttaacctcaataatgagctgtgtgaggaactcaaaataatgatgcggaataacaacaaagcaaaagagaaggatcaattctactgccttataatgcgggacgagatgaagcgcattctgtacgatttcaataaaaattgcgggtga

SEQ ID NO: 10130 - RNA, 1509 nt, unidentified
  source 1..1509: mol_type = other RNA; note = synthetic construct
atgagtaacaaagaaaaagcttactccacctttaagattcctaagaaaaacggaggactgagggagatcaatgcacctagcaagaagatgaaaaatattcaaaggtggatcttgaacaacatactgtacaagctcaatgccggaaatttagctcacgggtttattccagacagatctatcctcacaaacgccagcattcatgtcggccaggacttggtgctcgggatagacataaaagactacttcccgagcatcagctttcggagtgtctattacatatttaagtccgctggctataccaagaaaatcgcttggagtcttagtgacctgtgcacttaccattggaaactcccacagggggcacccacttcccctatgctagcaaacctatccaccgtggatcttgattacgaaatcgataactattgcacacgtaggaatttccgttactcacgatacgcggacgatatcaccatttcgggctcttataaactgcccatgcacaaacagaagattatcgaaattatcgagaggaatggttttgtgatcaacgaggagaagactagagtgctttccagagggtcccagcagaaggtaacaggacttgttgtgaacgataaggtttccatcggaagacggaaaaagaagatactacgcgccatcgtgcacaacatccagaaaaatggggccgaaaccgaaaaccgggagaaggatcctttcttcaaagaaaagatctgtggcgagctggccttcgctaagatggtagatcccgatttcgccaatccgctcatagagaagctcaaaggttttaattggctgagctacgacgaaaacctgaaaaattctcgagattctgaactgattgtgcgctctctggaaaaaaagcactacttccacccagttgacgccaataacatcatcgagagtgaaagcgacttcttaaaggctattgccactacgattacagaactcaagcattatattgaggatcggcgatggacagagccattttgggacgaagcgagagaagtagagatggacggcaaaaaatataagatcccagcagtcccaaagaaggagtccaaaatacaacccacaatccatatattcttctgtcgcaatttacttccttttggaattcacgtgctccgcgagactgacgaagggattggtaagctcgatttcaaattcctggtgaccattaaaggcaatattcctgtcaacgtttgtgctgagttcaaacttgcccataatgaggagctggagcacggcttgaccaaacagttgccgctgtatctgaaggcgagccccagcaaatcaggtctgtttctggtcatgtggtttaaggatgagaaggaggagtattttaagcggcccactaaccagaataagacgcaaatgctgaagtacctggaggaaaccatcaaaaagatcaacgagtgcggcaagttcaagatcgaatcagtgttgattgacgcctcgaaaaggccctctgcatcacactcatga

SEQ ID NO: 10131 - RNA, 1719 nt, unidentified
  source 1..1719: mol_type = other RNA; note = synthetic construct
atggccaataggctcactaaaaacgagcgaatgaaagtgctgttcgataactactttgaagaaggaatcatatccccgctgagagacgtggagtacaatgacaacttcaagtcctttaagaaacttaagagccagaaactgccttacgtgtatgatgttaaccatttctgttttctctccaattccagcagcaaacaggtgaactatctgctactcaagaaggaaaaagcgtacgtgacgttcaacctccctaagaaagcgggaggctttcgagaaatcaacgccccgtctaaatcaatgaagcacattcagaggtggatccttgaccatattctgtacaaaatgtcactgggggattatgtgcacgggtttgtacccaaaagaagtatcttgactaatgcctctatccacgtaagtcaaaatcttgtcctaggtattgacatcaaagactttttcccttctattgatttcaacagcgtgttcaggattttcacaagtgtgggttacacacaaaaagcagctcatttcctggccgccctctgcacctacaagtcgaagctcccccaaggcgcccctacctctcccatgttagcaaatctagcaatagcttccttggacattattatcgacaaatactgccggcgccggaactttaagtacagccgctatgctgatgacataaccattagcggcagtcataatctgccaatgcacaagcagaagattattgagataatcgaagggaacgggtttaccgtcaatgaggagaagaccagattacacagcagaggctcacgccagaaggttaccggacttgtggtcaatgacaaggtcagtattggacggtctagaaagaagaccctgcgggctatcgtccacaacatcttgaagaacggatatgaaattgaaaaccgtgagaaggacccctttttcaaagagaagatctttggcgagctggcattcgctcgaatggtagagccagattttgccaatccactgatcgagaagctcaagtgcgctaattgggcgagctatgatgagcagacaattgattcaagggagagcgagttactcatgcggagcctggagaagaaatcctatcacaaaccagtggacgcaactcaaataatcgaatccgaatccgatttcctgaaggctatctcttccacaatagcagagttgaaacactacatcgaagatcgtaggtggatagaacccttctgggacgatgcccgcgtgattgaaatcaatggggagaaacacaaaatccccgcctccccaaaaaaagagacgaagatccagccaacattgcatgtctttttcaataggaaccttctgcctctaggtgttcaggtgctgcgcgagactgacgaaggggttggaaaactcgatttcaagttcctggtgacattgaaaggtaatatccctctgaacgtttgtgctgaatttaagctggcccataatgaggagctcgaacatggcctgactaaacagcttcccctgtaccttaaggcatccccaagtaaatcaggcatttttttagtcatgtggttcaaggacgacaagggcaagtatttttctaagcctatcagccagaataaatctcagatgttgaacatgatcgaggaagcgattaaggagataaacaacaaagaggagttcaagattgaaagtatcctgatcgatgcctcaaagaagccctcagcctcgaataactga

SEQ ID NO: 10132 - RNA, 1743 nt, unidentified
  source 1..1743: mol_type = other RNA; note = synthetic construct
atgacaaggaaagttgccgagaatatcaagttgaagatcctcttcaatgattatttcgaggacggaatcataccgacactcaaaggtaaagagtatagcgacaatttcaactcctttaaagtcctcaaatcgcaaaccctcccttatatctacgatgtgcaccacttctgttttctgtcaaacttctctgcaaaacagattctctttttcctgaagaacaaagaaaagttctacgtcacttttagcattcctaagaaaagtgggggattccgggagattgatgcccccagtaaacagatgaagctcattcagcaatggatcctgaataagattctgtacaagatctccataggtgattatgtgcacggctttgtaccaaagcggtcaatccttactaacgcttccaatcatattaaccagaatttagtgctgggaattgatatcaaagactttttccccagtattgacataaaaagggtgaccgagattttcttgtgcatgggttacactcagaaaactgcatctttcctagcggaactttgtacatacgagggcaaactcccccagggagcccctacatcaccaatgctcgctaaccttgccgttaaagagcttgatatcgctattgatgactattgtaagaagcggaactttaagtacagcagatatgcagacgacattaccatatcaggcagccagaaactggccatgtacaaacagaaaatcatcggtattgtcgaatcgaatggctttgcggtgaatgaaaaaaagacccgtctacacagtaaatcctcacgtcagaaggtgacaggcctggtggtcaacgataaattgtctatcggccgcgagaacaagaaaaagctgagggctatcgttcataacattctgatgaaagggcccatcgcagaaaacagaaacaatgacccatttttcagagagagaatatttgggtacctggggtatgccaacacaatagctcccgaattcgcaaccccacttatcgagtccattaagaatatcgattggagcgagtactacgaaagcatcaaggaaatcaaggaaaatgagatgaacatcaatcacatcaagaagatgaacaagaccatacttattaagttcaacgatctggggttttttcgcatggtagtggaatttcctgaaggggtcttctccgaggctttccgaaatcagctggacaatctacaagaaaagtgcggcgaacatggaatcgtggcctgctctgattgcctggacattaaaaaggagatttacagcaagtgtatgaagtatgtgattgggcagtacactggaaccaccggtggccatcaccacggccatgagatttacgatatgaaatccaagaccgatttatatggagacagcataacggtagctttcctgatgaagagctccgcgccgaagaaggagagtaaaacgaagaataaagccaataagacctctaatcggcgaattacggccgttgacgattctctctttcgccagttttatgagtgcacaaggtacgagaacatcgacgtgatagccatcgtcactaattccaacctgaataacgagttgtctgaaaggctggaacagttaatcaagaagataaacaaagccgacaacaaggaacaattgtattgtttgatcatgagaaacgagatgaagcgcatcctgtacgacttcaataagaaaacaaccaatgagactggccaatatgacaatgcatttaacaacatgtga

SEQ ID NO: 10133 - RNA, 1683 nt, unidentified
  source 1..1683: mol_type = other RNA; note = synthetic construct
atgacaaataagatcaccgaaaacgagaaattcaaaattcttttcgacgactacttcgaagagggtgtagtaccgtctttaagcaaggaagagtacaatacgaatttcaagtccttcaagaaactcaagaagatgaagctcccgtatatttacgaccttgaacatttttgcaacttgtcaaacagtagttctaagcagatcgggttttacctgtcacacaaagacaaggcttattccacatttaacttacgtaagaagactggagggcttcgggagattaacgccccggccaagaacctgaaacacgtgcaaaggtggatcctcgaccatatattgcacaaaattgatgttggaaccagcgcgcatggcttcgtgccaggacgctcaatcgtaaccaacgcaagcatccatgtgaaccaggatctggtgctggggatagacattaaagacttcttccctagtatttcagcaaatagcgtgtattatgtcttcaagcgggtgggctatgccagagaggtatcgcgactgctcgctgaagtgtgcacccataattggaggcttccccaaggggctccaacttcccctactctggccaacttggtggccctgtcgctggatagtgatatcgagaaatactgctccaaaaggaactttaagtattccaggtacgcagatgacattactatctcaggaagctctaacctcccaatgcacaaacagaaaatcctggagatcatcgagaagaatctgttcattgtgaacgaggataaaaccagaatgtttagccagggaagtaagcaaaaagtgacaggcttggttgttaatgacaaggtgtccataggccgtaacagaaagaaaaagatacgcgccattgtccacaatattctgaagaacggtcccgttagggagaatagagagaaccatccattcttcaaagaaaagatcttcggcgaattggcgttcgtgaagatggtcgatcccgagtttgcaaatccactgatagttaaactgaagcagctcgattgggaggattataacaaaaaaatcgaggatagcaaggaagccaaactacgagtcaattctcttatgcgcaaatcttacgcagagcctatgtacgttaatcagaagatcgaatcagaggatgatttctttaaagccattaccgacatctttgaaaaactccggtggtacgtggaggaccagcgctggactgaagctttttggaacgattgtaatcctcctacccccaagaaagaaacgaaaattcagcccacactcaagatgttttttaagcaggagctgaatcccataggaatccatgtggagcgggaaacacacgaggggatcgggaccctggactttaagttcctcatcacaattaagggcagccctctggtcgtgtgtgccgagtttaagttagctcaccacaaaaagctcgaacacggtctaacgacccagctgccattatatttgaaagccagcctgtccaaatccggcatatttcttgtcatgtggtttaaggacgagaaagaggaacacttcaaggaacctactaacaagaataagagcgagatgctgacatacctggagggcaaagtcaaggaaattaatgagaacgaagacttcaagatcgaatctatcctaattgacgcgtctaagaaaccctctgctagtcaatcctga

SEQ ID NO: 10134 - RNA, 1980 nt, unidentified
  source 1..1980: mol_type = other RNA; note = synthetic construct
atggataagctaccgaatgacgacaagctgaaaataatgttcaaccactacttcgaaaagggcatcattcctaagctctctaagaacgagcacatcaacaatttcaactcattcaagaagttgaacgccaataatctgccctacatctatgacagggatcacttctgtagcctgtccaacagcagctctaaacagatcggatactatctgttcaaaaaagagatcgcctattctacctttaaccttccgaagaagaatggttctctgagagagatcagtgcccccgctaaacccatgaaatatgtacagagatggattctgaaccatatcttatacaagctggatgtcggggacttttcgcacggattcgttcccgggaaaagcattgttaccaatgcatcaattcacgtcaaccaggatctggtgctaggcattgacctcaaggacttctttccaaacattcaatttaacagcgtgcgttatatctttaagtcagcagggtacagtccaaaggtcgcctcattactggctgagatatgtacgtaccatcacactcttcctcagggagcccccacaagtcctacattatcaaatttggtcgcactcaagctcgacaaaaagatagcgacctattgtgcgaaacgcaatttcaagtattctagatatgccgatgatataacaatctccggaagctccaatctgcctaagcataagcagataattatcgagatcatcgaaaaaaacggctttattgtgaacgaggacaagactagaatgttctctcaggggtctaaacaaaaagtgactggtttggtggtcaatgataaagtgtctattgataggaagcgaaagaagaatatccgggcaactgtacacaacattctgaaaaatggtccagagatggaaaatcgggagaacaatccttttttcaaggagaagatctttggcgaactggcgttcgtaaagatggttgatcctgactttgccaatccacttatcgataagctgaaacagcttgattggattaactacaacaagaaactctccaatcccagggagatggaactgatggtgcgcagcctccaaaaaaaatcctgcatcgacccagagacttataatcagccaatcgaaagcgagggcgatttccttcaagtcatttgcgacgtgatagcagaaatgaaaaggggcattgagaagccgcgggcctacaaagcattttggaacgagggttctacagaaattctagacggaaatgaacataagatcagccccacgcccaaaatcgagaagaacatccagaacataatcgttctgttcatcgaggaccgactgctgcaccaggggatacagaccatcgaagagagtgacgaagagatcggctacttcggattcaagttcttatttaccacccagaaacgtaaagctttgaatattagcaccgggtttaagcttgctcacgatagtcaactcgaacatgggttgattaagcagctcccatcctatctggaggcctccagctccaaatcaggcatttttctcgtcatgtggtttaaggacgaaaacggaacatttttcaataagcctatcaatcgctcaaaatcggagatgctcgcctacctgcgggaaacagtgaaggaaatcaatgagaacgaggatttgaaaatagagagtatccttatcgacgtgtgcgagaaaagtagcgccagcaaaactgaatacaagaacgaccatgacgatgaaggtggcaaggggaagaacattagctattacctgtcgataataaagtgcaagattcagaaactgtggaaaatcatcattggcctcttagttctcattggcctgttggctgatgctattaatggatggcctgtgatcaaggaatttatgacgtctatatccaccagtttcattaactactcctcttacattttctcactaaacattcagctgtcctccatctttgctgtgtttttcaaatga

SEQ ID NO: 10135 - RNA, 1707 nt, unidentified
  source 1..1707: mol_type = other RNA; note = synthetic construct
atgcccgaatccatgatactcaccgtctcacagtttgaggaatttatggagagcattaaacccccattatcttccgaggacattgagttccagcgtaaacactttgagaagttgacctacaacaaactcccatacttttttaacgttgatcatctggccaatagcatagggttctcctctccacagctccatttattcatctcaaataagcgcgtggcctattccactttcaagctgcctaagaaaaatcgggggttcaggctgatcgatgcaccatctaaagacatgaaaatcgtccagaggtggatcctggataacatcctctacaaactgaacgtcggcgagtatgcacacgggtttgtacccggcaagtcaatcgccaccaacgcttccattcacgtcgcgcaagacctagtgctcggaattgatctcaaagactttttccctagtattactcttggacgcgtgattgggctgttcaggggcatcgggtacaacgaggaaattgctcatgcgctgggcgaactgtgcacctttaattggaaacttcctcagggggcccccactagtccgatgataagcaatttgatcgcctggaatattgacattaaactctccggtttctgcaagaagcgaaacctaaattatagcaggtacgcggacgatatcaccataagtggaggcaagaggctgccaaagtataagacccttattttccgcaaaatcgaggaagaaggctttagcatcaactgggagaaagtgcggctccatgatcggggttcaagccaaagagtaacaggattggtggtcaacgacaaggttacactgggacgaaagaagaagaagacacttagagccatagttcacaacattgtaaagaatgggcccgagactgaaaatagagaaaatgagcccttctttaaagagaagatctttggtcaacttgccttcgctaaaatgatagaacccgattttgccgatagtctgcttgactcactgaaacacgtggactggaactcttacgacaagaaactgacaggtttaatcgagggagaactgtcggtgcggtctttggagaagaagaaatactgcattccagttgttgaggatcaggacatcaaatccgaaacggacctgctaaaagtgatctgtgatgtcataaccgaactgcgctattatgtggaggatagacgatggattgacgctttctgggacgatagccgtgaggtggaagttgatggaaataagatcaagctgcccgctttccctaagaaagagacgaagatacagcctactttgtacgtatttttcgacaggcgcctgtaccctctcggcatccacgtctctcgggaaacagatgagggcatcggcaaactcgatttcaaattcatggtgacaacgaaaagtcacatcccgttgctaatttgtgcagagttcaagttggcacacagcacaaagcttgaacatggtatcactgtgcagctgccagcttatctgaaagccaatagatccacctctggcttattccttgtgatgtggtttaaggacgaggaagagaagtttttcgataagccgaacgatcaaaacaagctgcagatgattgaatttatcgaggacaagattaacgtgataaagtacgaggaggaaattgacatcaagtcaattctgatcgacgccagcaaaaagcctagtgcatcgaatctctga

SEQ ID NO: 10136 - RNA, 999 nt, unidentified
  source 1..999: mol_type = other RNA; note = synthetic construct
atgcgcatgaccaaggatcagatcctgaccgaagaccagtttaaagtgttcatctcctcaattaagcctccactctcggaagaagagcacgaatctcagtgttccagctttaagaaacttaaaagaaacgaactcccctacatcctgaatatcgagcaccttgcagagctgactggctccagtcccgcccaactccacctgtttataagcgataaacggaaggcctatagctctttcaaactgccgaaaaaacggggcggatttcgtaagatcgatgctccatctaaaaagatgaagactgttcagagatggattctggataatatgctatacaaactagacgcagggaactacgctcacgggttcgtgcctaataggagcatagcaacaaatgcttctgtccacgtagggcaggagctggtattgggaatcgacattaaggattttttcccatccattacactgaaacgggtcgtgggattattccagagtatagggtataacgaagaagtttctcacggtatgggtgagctctgcacctttaattggagattgccgcaaggcgcgccaactagccctatgatttccaatttgattgcatggcatatcgacatcaagttaagcaagttttgcaacaagcggaatctttgttattccaggtatgctgacgatatcacaatctcaggcggcacagagttgccccgctacaaaacgcttattttccgtaagatcaaggaggagggcttttcaattaacgatgagaagacgagggtgcatgggaggggtagttcacagcgagtgactggcctggtggtcaacgacaccataaccctcgggagagagaagaagaaacgactgcgcgccattgtgcataacatcgccaagaatggacctattgccgagaaccgcgacaacgacccctttttcagggaaagagtgttcggacatatcggtttcgcgaaaatggttgagcccgacttcgccaagagtctgcaatga

SEQ ID NO: 10137 - RNA, 1647 nt, unidentified
  source 1..1647: mol_type = other RNA; note = synthetic construct
atgatcctgatagatagccagtttaagaaattcatggactccatcaaaccacagctaagccgagaggagtatgatctgcagctcacttcttttgaaaagctgaagaaaaacgagctcccatacatactcaatatcgaccacctggcacatctgtccggtatttcaccccagcagctccatctgttcatcaagaacaagcggattgcgtacagctctttcaaactgccgaaaaagaatgggggcttccggagcattgacgccccttcgaagaatatgaagcttgtccagagatggattctggacaatatactgtataagctcaatgccggcgagtatgcacacgggtttgtaccaaagaaaagtattgccaccaacgctttggtacatgtgggccaggaattggtgctgggtatagacatacgcgatttttttcccaccattacccttaatcgggtggaaggactctttaaaagcatcggttacaacgaggaaatctcttacgctttaggagaactgtgcacattcaactggaggcttccacaaggagctccgactagtccaatgattagtaatctcatagcctggcgaatggacatcaaactgtccaagttctgcgaaaaaagaggcctgatctatagtcgttacgcagacgatattaccatctcaggcaacaagaatttgccccgctacaaaacactgatcttccgcatcattgaggaggaagggttttcaatcaacgagaagaaagtcaggctcctaggaagagggtcatctcagaaggtgacaggggtgattgtgaatgataagatcagcctgggaagaaaatcacgtaaaaggctggaggccatcattcataacattctgaagaatggacctatcgccgaaaatttgaacaacgatccttactttaaggagaagctcttcggtcacctaggcttcgccagcatgattgagcctgatttcgcattgcctctgcttcagtctctcaagaagatcgactgggaaccctacgactgtgcgcttgaaacttctaaggagtcagaattaaactacaagagcctgtctcgcgactcccactccaatctgattaagtttgacaaccttggattctttaaggacgtggaaaccctgcccctgaagtggaaagatgagctaatcactcaattagacgagcttaaggaaaaatgcgaagagcagagtatcgacgcctgtaagaactgtatgcacgtcagaaaagagctctatgagaaatgcattaagtatatcctcgggcattatgtcggatgtacatgcggtccccaccacggccacgaagtttttgacgttggcggggaaacggacttatatggggatagcgtgtttgtcgcttttcttgccaaagctggcaaactcgaccgcaaatcgaaagattccctattccatcaattcttcgagtgcaccattcaggagggcttggatgttatctccgttgtgacgccagagatactggataaccggctgaaaatggatctgaggatcctgtttcgggattgcggcaaagagaagttgttctgtttgatcatgcgggatgagatgagtaggatcttatactccttccaacgaattatatccaataacatgtgtgaggacgaaaagaaggcaccttga

SEQ ID NO: 10138 - RNA, 1683 nt, unidentified
  source 1..1683: mol_type = other RNA; note = synthetic construct
atgaattgctctgccatttgtgatgagaagcaattcgaggaatttatggactctctgcagccctctatctccaaggaagaatatgatacccagtacgaaagctttctgatgctctccgagaaaaacttgccttatatttacgacctaaaccatctaagcctgctcattggcgagagtaccaagcagctcgacttttttgtgagaaacaagcgcaagatttatgtgtcctacaggatgaagaagaaaagaggcggatatcggactatcgacgtcccatctaaaaagctgaaattcgtgcagcgctggattctccagaatatcctgtacaatatcaaggtttccaagcatagtcacggctttattccaggaagatctatagccactaacgctaaaatccacgtggggcaggagctcgtcatggggatcgatctgaaagacttctttccttcgataaagttcaaccgcgtgcgggggtttttcaagtcagtgggttataacaatcacattagtaccattcttgcggatctatgcacctttaactggcagttaccacaaggcgcgcccacatccccgatgatatcaaatttaattgctagtcggctagatcgtaggctggccggattctgcaagaaaaaggagttgctttattcaagatacgccgacgatatcactatttcgggtggcaaggtgcttcctagatacaagacactcatctttaggatcattaccgaagaaggatttgagatcaattgcgaaaaagtgaggatccagggtcgtggttcttgccagcttgttaccggcctggtcgtcaacgataaagtgtcaattgggcgaaggaagaagcgaatcatcaaaagcttagtccacaagatatccgaaaatggatctattgaagcaaatgagacggaaaatccttttttcaaagagatggtgtacggactgttgtcatttactaatgttgtggacccggagttcgctcagcccctgattgaaaaactgaaccttatcgattggaaggagttcaccgaggcatacagtcagtaccagaaaagcgagatcatagaacggtcctttaagaaatgcccaaccataaggcgaattctgttcaacgacctggagttctttaagggcataaaacttatcccccaaaatgagctgacaaaggagttcttgaaagaactcagcttactgaaagagaaatgtagcgagcataagaaagaaaactgtcaggactgcctgcttacagaagaaataagcgataagacatgtatgaagtacattctgggtcactatatcgggtcaacgggcggcgctcatcatgggcacgaggtctacgacatcggcgagatcacggagtataaaagtcaggaggtattcgtagccttcctcatgaagagcaaagacgacactaattccaagaactccctcttcactcaattctttgattgtaccgagaatggagggatagacatcatctctgttgtgagtacagaggatctggaccacaagacaatcctgcgcttgcaaagagtaatgaaacagttcgccaaggagcacctgtattgtctcattttgcgcaaggaaatggcaagcattctctactcctttaaaaaagagttctccaaaaacaaccgggaaaagagcttgttccataacggagatcaaagctcactgctgatctga

SEQ ID NO: 10139 - RNA, 1602 nt, unidentified
  source 1..1602: mol_type = other RNA; note = synthetic construct
atggacctggaaagacagaagatcaatttcgacattccctaccaaagctttaatcagtatcgtagggacttcaggttcgccaacaagcacctaggcacacagtgcattaagttctgcattaattatgccaaagctttgaagaagaagaatctcccgatcatttacaatctggaacatctgagccaccatgtgaaactgtctaagaaatccctatacttcatcatcaagcagaaggagaaattttatcagcttttcgagattccaaagaagaaagaaggagtaagaaacattaccgccccatcaaagatcctcaaaaatgtccagagatggatcctagactgtatcctgtacaacatagatatccataagaatgccacagggttctacctggataaatccatcatcaagaatgcgaacttccatttaaaccagaagatggtcctgaatatcgacctgaaggatttcttcccctccatcaaaaacaagcgaacttaccacatatttagcagctgtggttacaaccattccgtatgtaagatcctgagtgagctctgcacctttaataacgagctccctcaaggatcacctgcatcccctatgatcagtaatatagtgtgtaagtctctggattcgcggctgtttggcttctgtaagaagaacaacctgaattactcgaggtatgccgatgacattaccatttctggagaaaggaacctcaccaagtacatcctcttcattttcaagatcattgagaatgagggttttaagatatctaccaagaagattcgacttactggaagagggaatgcacaaattgtgaccgggataacggtgaacgacaaaatttcattcgatcggaagaagctgcgcaagattcgggcgataatccacaattgcaaaaaaattggaccagagaaagctaataagaataaacacccctttttccgggagtatttgtatggctatgttgcttttctgaaacccatcaaaccagaactctctaaaaaatggaaaaaggagctcgacagcatcgattggggcgcatataaaaagaaatacgacgtggacatcatcattaacgattctgaaaaggaattgagtaacccaactgcctttatttcctactcctgggacagcaaaaaacaccgcgagtgggtcatcaggtttgctgctaaccttattaagaacggtattaacgtgttaatcgatgaatgggaccttaaagactataacgatgacctgaactactttatcgagtgcgggatacgtgattcaaaccacgttatcattatatgtacacccaaatacgcaaagaaagctaacaaacgccttggtggagccggcattgagacagccattatcacaggggagatatacgagaaaactaatgcaggcaaatttatcccgatagccttgaattaccagaaaagcatgaaagaatgcctccctacgtatctgaagaacaagttcacttttgatttcaatgaggaagaacgctatgaagagaagatcgagctgttgttaagaaagatttataagaagcccaagtacaagaaacctaaacttggcaccatacctgactttaaaagtaaggatatctga

SEQ ID NO: 10140 - RNA, 1173 nt, unidentified
  source 1..1173: mol_type = other RNA; note = synthetic construct
atgatccttgagagtctgaacttgcccaagatttacaacctggagtccttctctactgagatcggcttgagcactaccatcctatatttattatcccaaaggcaggacaagttctatcatcaggtcattatccccaaacggaagtctggtaatcgaaccctcagtatcccatcaatgagcatgaaaatcgtgcagaagtggataaaactcaagattctcgacaagattcctgtgagtaattgtgccatggcctttcgcaaaggcaattcttatggcatcaagactaacgccgagttacacaaatacaatacgtacattctgaggttggatctgaaagacttcttcaacaacataaagaaggagaaggtgtttttcctgttccgggaaatcgggtacaataattacattagcaacatcctctctaacatttgcacatttaatgagagtttgcctcagggtggcatcacctctccgtccatttccaacctcatatgcaaaaaactggacattagactggagagcctggcatcgaaaagagatattacctatacacgatatgccgacgacctgatcttttcatgcaatgacgaagttcttcttatcaagacaaagaatgcaatactggacattctgaagagtgaaggaatggaggtcaacaaactaaaaaccaagttcataaggcccggctcacggaaaaaaattactgggctccatatcgataaaaaccgtgttattgtgcctcgcgatacaaagcgcaaggtgagagctatgatacactatagcatcgctactggagattattcaaagctggacgagatcaaggggtatatcagctttattagctccatcgaagagaattatatctccaagatcaaatcctacatcaacaagatagcgaataatgagcaatacaggctctttgaagacatcgtggaatcttacaacaagaacaaaatcttcaaggacctggacaccatgaacttcattgatgagtacatagaggaaattgacggaatcgagtatgatcttagctcaacatacttttacaacagaatcgacttcttgaagaaaaatgaacttcaggaagtcattgataacataaccaatggggaggataataacgtagatgatattgctaccacatacctggataatgaaacgtgtccattttga

SEQ ID NO: 10141 - RNA, 1140 nt, unidentified
  source 1..1140: mol_type = other RNA; note = synthetic construct
atgcacctcaaatatagtaatctgatgaccctggaaagtctgaacctcccaaaaatttataacctggagtccttctctaccgagattgggcttagcactacgatcctgtacttattgtcccaaaaacaagacaagttctatcaccaggtgattataccaaagaccaaaagtggcaatcgcactctgtcgataccttcaattagcatgaagattgtgcagaaatggatcaaagtaaagatccttgacaatatccccgtgtcaaactgtgcaatggcgtttagaaagggcacaaattacggtatcaagatgaatgccgagttgcataagtacaatacctatattctcaagctggacctaaaggattttttcaacaacattgagcgcgagaaagtcttctatctatttcgggagatcggctataacaactacatttctaatatcctctccaatatctgcaccttcaacgaagtgctgccccagggtggggtcacatctccttctatttctaatctgatctgtaaaaggctcgacaggaggttggaaaacttagcaagcaaacgggatataacgtacactagatatgccgatgacctgatctttagttgcaacgacgaggtgctgttgatcaagataaagaacgtcatcttagatatcctgaagtcggaagggatggagataaataagctcaagacaaagttcattcgaccagggtcccgtaagaagattaccggactgcacattgacaaaaataaggttgtggtgccccgagataccaaacgcagagtgcgggctatgatccattatgccatcacaaaagaggactactcaaaacttgacgagataaaaggatacattagctttatctcctctattgaaggcaactacatcagcaagattaagagctacatcaataagatcgttaacaatggacagtgcagactttttggtcctatcgtagaaagctacaacaagaacaagatcttcaaaaaccttgagctcgtctcctgtattgaagaaatggattgggttatcactaaaggcgctttctacaatagggagaagtatgaactgaaagaagtcatagagaaatcaacagagtacggcgaagataacataaatggagagacttccccgttttga

SEQ ID NO: 10142 - RNA, 1137 nt, unidentified
  source 1..1137: mol_type = other RNA; note = synthetic construct
atgtttataattaaggacgacatccgcaaatatgggaatctgatgattctggaggccttagacctccctaagatttatgaccttaactcatttggcagggaaatcggtttaagcaatacaatcctgtaccttttgagtcaaaagacggaaagattctataagcagaccaagattcccaagaagaaatctggcacacggcagatttctataccctccatcagcatgaaaatcgtgcaaaagtggattttgatcaacattctggagaaaatacccatatcaaattacgctatggcatttcgaaagggatcaaagtacggtatcaaaaccaatgctgagctccataagtataatgagtgcatcatccggattgatctgaaagacttcttcaactctattgaaaaggagaaggtcttttacctattcaaatccattgggtacaacaacctgatctccaacatcctcacaaatatctgcactctggatgggtgtctgccacagggagcactcacctccccgatcctcagcaacttaatttgtaggaatctcgatagacggcttgagggcttgtgctccaaacgggatatgatctatacaaggtatgccgatgacatcattctgagttgtaacaacgaagtcctgcttatcaaaacgaagaaaatcgtttctgccattttgtgcgatgagggttttaagattaaccagtcgaaagtgaagttcatgggagttagttccgccaagagagttactggcctacatatagaagaaaataaagtagtggtcccacgtatgctgaaaaggaaagtgcgaaccatgatccaccacactattgtggtaggcgattactcagaaatagacaagattaagggatatatcgcgtttataagctctattgagcctaactaccgcaagaaggtgatcgagtacataaataagatcaccagcaaacagcagtaccgcatctttaaagaaatcgtggacgggtacaatagcaataagatcctgaaggagtgtaaagatatggaatatttcaacgaggaatgcaatgaggacattgagaacgatttctacagtgagagagagaatttcataaacatgctgctcaaagaaaagaacgacactggaagctatggcgagtga

SEQ ID NO: 10143 - RNA, 1209 nt, unidentified
  source 1..1209: mol_type = other RNA; note = synthetic construct
atgtttactatcaaaagggtgaagtaccgaaatattattatcctcgaggccctgaatctgcccaagatcttcgacataaagtcattttcaatctccattgggctgacccctacaatactgtatctgctgtctaaggaaacggagcgctactacactagtatcaagatccccaaaaaaaaagtgggtacacgtcagctaaggattccgagcttttccttgaagctggtgcagaaatggatcaaaatcaacatacttgacaagattccaatctccgactcagctatggctttcagaatcggcaaggattatggcattaagcaaaatgccgaattgcacaagtacgatagttacattttcaaaatcgacctaaaggactttttccactatatacatcgggagaaagtcttttacttcttttacaacctcgggtacaataaccttataagtaacatcttgagcaacatttgcaccttcaacgatgtgctgcctcaaggcgcagtgacctcccctagcctcagcaatctgctctgcaaaaagctggattcaagactcgaaggtgtggcttcgaagcggggaatttcttacactaggtatgccgacgacttgattttctcttgcaacgataaggtcctgttaataaaaacgcagaagatgatctatgagatcgttgaagatgaaggatttcaggtgaattctgagaaggttaaattcatggggcccgcgacaaggaagagtattaccggcctcttaattgtcgagaacaaggtcattgtaccaagatctctgaaacgcaaagtccgacgtatgatacattacatgatcgcaactagtgactattccagacttgatgtagtgaaggggtatatttcctacatttcaagcatcgagaagaagtatatcgagaaaattaagcggtatatcaacaacatggtcaacaatgaccagtataaggttttcgatgacatcgttaatctctacaacgagaatatctttcttgagtgtaatgaaatggagcatgtttcttttgagagctgtattgatatagtggacggaaccgtgctggatttcggggaacactacgtagatgaacgcatcaccttctttaaaaaacacaacatctgtggacggctgagctccttaggcatcgaatatgaggagattgcagccacagtgaatgtgacaagcgaaaatgacggcggaggtaaatga

SEQ ID NO: 10144 - RNA, 1191 nt, unidentified
  source 1..1191: mol_type = other RNA; note = synthetic construct
atgaaagtgaaatacgaaaataccgtggtgcttggaattctcaatctgcctaagatttacgacctctatagtttttccgaagaaattggactgtctaccacaattatctacctgctttcaaagaaaaccgaccggtattacaacactattcacatccctaaaaagaagaagggtcgcacaagacagatcgacatcccctcattctccatgagaatcgtccaagaatggatcaagaataagattctagacagcattccaatctcggattcagccatggcatttcggaaagggaagaaatatggcataaagaaaaacgctgaactccataagaataaccagtacatcctcaagttagacttcgaaaacttcttttcgaatatcaacaaggagaaggtattctatatctttaagtccatcggatacaacaacaccatctccgatatcttgacgaatatctgtacatacaatgagtctcttccccagggggcaattacctccccgagcatctcaaacattgtttgcaagatgctggactctcggctggaaggactaagcaataaacgcaacatcacttatagtcgttatgcggatgatctgatttttagttccaatgatgaggtactgttgaaacgcaccacgaaagtgattttcgacattatcaatgatgagggcttctacatcaacaaggagaagatacgattcatttatccacagatgcgaaagtctattacaggcttgcttattgcagaaaacagggttgtcgtgcctaaggagatgaaaaggaaagttagagccatgatccacaacatgatcgccagcgctgactacactgacattgataaggtgaaagggtatatcgcctacattagcgggatagagtctgagtatatagagaaagtgcgtgaatacgtcaacaaaatgatagaaaaggagcagtacaaagtctttgatgacgtggtcaccgaatacaacaaaaataaactgctgaagggcactgaggatatggagctcttacccataggtagctgcatagaagaagacgagctgggcttttattctcaggacttcgccgaggattattacgaggaaaggatcgagttcttgcaagagaaatacccagaaaaggtgaagaagctgagcatcacatataaggaggctaatagtgagaacaatgaggagctcctgatatga

SEQ ID NO: 10145 - RNA, 1227 nt, unidentified
  source 1..1227: mol_type = other RNA; note = synthetic construct
atgcttaccatcaataacctcaaatactcaaactccatcattatagacaccctgggattacccaagatatacgatataaacagcttttcgacagaaataggcttgtcacccactatcctgtatctgctgtctcagaaacaggatctcttctacaaggacacctatatcccaaagagggatggcagcaaccggcaaatatccattcctagtattagtatgaagctagttcaaaagtggatcaaggtcaagattcttgacaaactttacatcagtgacatgtccatggcgtttcgacggggtaatagctatggcattaaaaaaaacgccgagcttcacaggtatgacctgtacatcctgaaaattgacctcactgacttttttcatagtattgatcgcatgcggatattttatctgttcaaagggatcgggtacaataacttgatttccaatatcctcactaacttgtgcacatacaaggagagactgccacagggagcagtaacgtccccggtgttatctaatttggtgtgcgaaaaaatggataagcggctatcaggcgttgcctctaaacgcggtatttcttatacaaggtatgccgatgatatgtacttcagctgtgatgacgaaatactgctgagaaaaacgcagtccatgatttatgaaatcattaaggatgaggagttcaagatcaataataagaaggtgaagttcatgggacccagcagcaggaaatgcatcaccggcctggtcataaatgactctaaggtagttgtgcctagagaaatgaaacgaaaagtccgcgtcatgattcaccacggtattgctacaggggattactcaaaagtggactccatcaagggatacatctccttcatcagcagtatcgagaaggactatgagaacagaattaaaaagtactgtcagagcctcatcgataaagatcagtataaggtgttcgatgacctcattgagaagtacaaccagaacaagtttattgacaccaatgagatgaagcaagtggatgaggacgagttactgtacgaattcgaaggcattgagctcaatcatatcgactcatacatctatgagcgtattgagttctataagaagaacaatctggagaacaagatgaaagacttttacatcgagaacaaagaaatcgcttgtgtgctgaatgaagaaatcatcatgaattctgacgataacaacgaagacttcgggttttga

SEQ ID NO: 10146 - RNA, 1062 nt, unidentified
  source 1..1062: mol_type = other RNA; note = synthetic construct
atgctgaccatcaagaaccttaaatactccaattcaatgatcctcgaaacactggggttgcccaagatttatgacattgagagtttttccacagagatagggctctctccaaagattctgtacctgcttagccagaaacaatacttgttctatcagaacaagcagattcccaaaaaagacggtagtagccgccagatttctatacctagtacgtctctgaaattagtgcagaagtggataaagattaagatgctagacaaactcccgctgtcagattttagcatggcctttagaaagggcaagagttacggcattaaaaagaatgcggagctccataagtatgacagctatatcctgaaaatcgacctgaaagacttctttcactccatcaataagaccaaagtgttctacctctttaaaggcgtaggttacaataaccttatcgcaaatatactgaccaatatttgcacttacgaagatagggtccctcagggcgctatcacttcaccagtcatatctaatctgatttgcaagaagttggattatcggctgtctggagtggcctctaagagaggaatatcctatacacgttacgccgatgatatgtattttagctgcgatgatgaaatcctgctcaggaaggctcagaacatcatttacaagatcattaaggaggatgacttcatcatcaacaacaaaaagatcaagttcatgtccccccattcaaagaagtttgttaccggattaatcatcaatgataccaaggttttggtgcctaaagagatgaaacgaaaggtgaggagtatgttacaccacgcaattgccaccggggactataataacattgacagcatcaagggctacatatcattcatctcctcgattgagaaagactaccgcatcaaaattgagaaatattgtgaagagctcatcgacaaaaaacaatatcgggtgtccaacgatctagtcgacaaatataacaacaacaacttcctgaagacaaagagcatggaatacatccaagatactgaattcaatgagtacgaggaacttattttctga

SEQ ID NO: 10147 - RNA, 1215 nt, unidentified
  source 1..1215: mol_type = other RNA; note = synthetic construct
atgagtcaaaatatccctacactgctcatgaattccctcaagctaccctactttgaaactatagaagagctcagtgaattaacccggctcagcactcagcttctgtattgcctgtcaaccaagacgtctaaatactacatcattaagaagatcccgaagaagaatgggggtcttagagagctctctatcccctcttacacactgaggattgtacagaggtggatcttgacagaaatactgaacaaaatactcccatccgatcgagcaatggccttcagaaaagggaaggactttggacacaagcagaacgcctattatcacgccaacacattgtatggcctgtcaatcgatattaaggatttctttccctctatcacagtgaataaggtgtacactatctttagcacgttgggttacaactcctttgccgccactatactcactaatctgtgcacactggagggcaaacttcctcaggggagcccttgttcccctgctatatccaatatcatttgtagctccctagatcgccgtttcgttgggctttgtgaaaaaagaggaattcggtattctcgctatgcagacgatatgtacttcagttgcgacgataagattcttctgctaaagaacttccccatcattacgcgcatagtggaatcagagggctttatcctgaacaccagaaaagtccattttcacactccatcgaataagaaacaaattaccggaatcaccgtcagccccaccaacattgaggattatgtggagttaaaggctcctaggaccctgaaacagaaaatccgggctgagatcttcacatgtttgattagtggacagtaccagaacaaagaccatattttgggtgaaattgcgtatgtcgacttcatcgaaaaagagaataaaagcaagtacctggaacgaatcaaaaactacattggcaaacagctggtgaaaatccagctgttcccagagctggtgatggagtacaacaataataagttctacgaggacttaccactggctatctctatagacattaacatagttaccgaggaggacttcgatgatatcgagtgtctgtttcgggagaggaagaagttcctccaaaagaatggcatcaaagacatctgcaagtatagcaagtggccggacatcatcattaactcatcctataacattgccgaaaatattgcagacattgaatgcccattttga

SEQ ID NO: 10148 - RNA, 1035 nt, unidentified
  source 1..1035: mol_type = other RNA; note = synthetic construct
atgagtcaaaaaatatcaccactcctgattaattctctaaaactccctgtgtttgagactttagaagagctcagcgaaattaccagactctctacacggctgctgtactgcctaagcaagaaaactgacaggtattataatgtcatcgagattcccaaacgcaacggtaaaatgagggagatttcaataccttcctatacccttcacattgtacagcgctggatcctgatggaaatactgaacaaacttgtgccatcttcaagcgccatggctttcaggaagggcgataacttcggacacaagcagaacgcaatctatcacgctgacactttgtacggcctcgcaatcgatttgaaagattttttcccctcgatcacggcgaataaggtgtacacacttttcagtaatctggggtacaaccacttcgcagccgctatcctgacgaatctttgtaccctggacgggagacttccccaaggctccgcgtgttctcctgctatctccaacataatatgcatgaatatggataagaggctgatcggtctgtgtgagaagcgtggcattcgtttcagccgctatgccgatgatatgtacttcagctgcgacgacaaactgttactcctgaagaactaccctatcatcaaaaagatcatagaggacgagggatttttgctgaacgaacggaagacacattttcacaccccatccaataaaaagcagattacagggattaccatctcccccggaaaggccgagaacgccgttgaactgaaggccccgcgaaaactcaagcagaagatcagagccgaaatttttacttgcctaatgacaggcgactataagaatagagaacatatcttgggggagattgcatatgtggaattcattgaacgagagaataagtacccctacaaagatcggatccgccattacatcgaggaaaagagtaccaaaattcagtacttcccagagctggtccaggcttataacgagaaccggttttttaaggacatgccgttattggagggaaaatga

SEQ ID NO: 10149 - RNA, 1206 nt, unidentified
  source 1..1206: mol_type = other RNA; note = synthetic construct
atgaggaaaatctctcagtctttactcattaacagtctagggctgcctagattttctaccatcgagcagttttccgaaataacaggtctttctacccgtctactgttttgtctcagtaatctcaccgagaagtactatcgcaataaaaagattcccaagaggaatggagatatgcgggagatctttataccatcctacaccctgcggatcgtccagaagtggatccttaaaaacatactgaacaagatcgtcccgagcaatcagtcaatggccttcagacgtggttcttcttttgggaacaagcaaaatgcggcatatcacgcatatacactgtatggactttccatcgacctgaaggacttcttcccatcgatttccgctaataaagtttacaacatcttcagcagcctcggatataacgagtttgccgccacaatattaaccaaactgtgtactctcgacagtaagcttcctcagggatcaccctgttcacccgccattagtaatcttgtgtgcattacactggataaccggttggctggtctgtgtcagaaacgcggcattatctatacacgatacgctgatgatatgtatttcagctgcgacgataagactttattgctgcggtactactacgccttcaaacagatcattgagaatgaaggcttcgtgatcaatgataggaagacacattttaacaccccttccaatcgcaagcgaatcactggcgtaaccatcgttcaacaccatctggatgaaaagtttgagctgaaagcaccaaaggagatgaagagaaaaattagggcggaaattttcatgtgcctgatgagcggcgattacaaaaataagggcaaaattctcggcgagatcgggtatgtgagctttattgagaaggacaataacttcaactacatctccagcattaagcagtacatcactactacggcagaaaaaatcatatactttccagagctggtggatgcctataataacaacctcttcttcgacgacttggaagaaattgaatcagctctcattgatccgaaggacgaagaggagttgtactattatggggacatgtacaactccagaaaaatctacttgaacaaacgcaacctaagtgacgtgtgcacgtacaaggattggcctcaggtcataacctcccaaaataattcaagcacggacaacactgacctgcccttctga

SEQ ID NO: 10150 - RNA, 1149 nt, unidentified
  source 1..1149: mol_type = other RNA; note = synthetic construct
atgaaggtaaataatctgctcataaagtctctaaacctgcccgagttcaaaaacattaaggagctgtctatcctgatcggcgtgtctagtcgactgctttactgcctgagccaaaacaccgagaagtattacacccacaaaatcattcctaagaagaatggaactaaccgctgtctttccatgccatcctataccctgaaaattgttcaaaggtggatactgaagaggatcatagagaagataatcccatccaaatcagctatggcatttagggtggggaaaaattttggctataagcagaacgcgtcatttcattcggatactttgtacatgctgagcatcgacctgaaagacttcttcgacaatattaaatcgttcaaggtctattgcttctttatttctatcgggtactgtgagtttgccgccatgatcctcacgaaaatttgtacattggataataagctcccacaggggggagtgtgcagtcctgctcttagtaatctcttactttcatccctcgataagcggttgattggattatcagaaaagagaggtattagattcacccggtacgccgatgatatgtgcttttcctgcgataataaggtggaactgctgaagatttttcctaccatcaagaagattatcagcgaacagggattcattatcaacgaccataagacgtattttagtactcccagcaacagaaaaaaaattacaggcatcactatcagcaaaaagaacaacatcattgaactcaaagccccccgcaaattaaaaaagcagatccgtgtcgaaatatttcagtgtattgtgtccggtgactactctaaaaagaatcacattattggggagatcgcccacgtaaactttatcgagaaagagaacaagatcaagtatatcaacaacatgaagaagtacatcgaaacaacaggcaaaaaaattagctgcagccccgaactcgttaccgcttacaatgaaaaccttttcttcaacgacataaacaaactagagatcatgccgctgatcaatatcgcatgccgcaggaatgcagtggatttcttcaaaaatcggaaagagtacttgggtaagcgacatatagtcgacatatgtaagtataatggcctgatgatttactgtgacatatga

SEQ ID NO: 10151 - RNA, 1227 nt, unidentified
  source 1..1227: mol_type = other RNA; note = synthetic construct
atgtcaaacttgaagcgcctgaactatatttacataaacacgctgaagatccccgcttttcagaatatttacgagctgtcacgcctcaccgggatctcttctcggatgctctattgcctgagcaaaaataatgtggagtactacaagactttcacgatccttaaaaaaagtggagatccccgaacgatcaatgcccccctgtacagcatggctataatccagaagtggatcttacgcaacatcctagaaaaaattacaccttccaatagggccatggcctttcggaaagggtccgagttcggttgcaagatgaacgccaagtatcatgttggaactctgtacggtctttcgattgacctggcagacttttttacttccatcaaaagcaacaaggtctattgtctgtttcgtaatttaggctatgctgaaacagccgccaccatacttaccaatatatgtaccctagatggtgcacttccccaaggcggggtgtgctcacctactataagtaatctcatctgcatcacactggacaatagactgattggaatgtgtgaaaagaggggcattaggtatacaaggtatgcagacgacatgtacttttcttgcgacaataaagatttgctgaagaaaactttcccgaaaataaagactgcaattgaggaccaaaacttcaccattaacaacaacaagacaagatatcacaccccaagcaatagaaatcagattacaggcgtggttattgtcaaaaccaaccagtacgaagagtacgaactaaaggccaagaggaaactgaagcagtctctgcgtgccgaaattcacaacgctatcatgaccggcgattacaagaacaaggggcacattctcggcattatcagctatattaactttgtggagaaggaaaacagtgacaattacctcgaaagaatcaaagagtacatcgtgaagtgcgcaaacaagatcatcttcttcgaagagttgattaaagcgtacaacgagaaccttttcttcaataacatggagaagatcgcgtatgataaggatcagatcgtagacttcttcaaagaggaggattcctacctcaagttgctggataaacgcatagagcgggaagcttatctccagaaataccatcgggacgatatctgtatgtatttagattggccacgaggattggaccctaacaataataatgacatcggactgatggacgattgtccattttga

SEQ ID NO: 10152 - RNA, 1239 nt, unidentified
  source 1..1239: mol_type = other RNA; note = synthetic construct
atgcagaaaaacaacctcctgttgataaactctctggggatcccttacttcgagtgcttagaagagttttcccggataataggattaagtaccaagttgatctacctcctaaccaataagaccgagatttactacagttttaaggaaattcccaagaagaatgggaaaaaacgcattatcgccatcccctcctacacactgaaaatcacccagaggtggatcctcaaaaacattctgaacaagattaggccaagcgactatgtcatggcttttcgcaaatctagcaataacaacaagttcgacatcaagaaaaacgcctactatcacagtgatagcctgtatggtctatctattgacctgtctgacttcttccctagtataaatgctgcgaaggtctacagaatttttaaaggaatcggctacaacaacacagcgagcgctattctgactaatctgtgcacattggaaaacaaattgccgcagggtgcagtgtgttcacctgctctgtcaaatcttatctgcatgcgtcttgatagacgactttttggcctgtgcagcaagcgcggcgttctctatacgcggtatgcagatgacatgtatttctcctgtgataataagggccttctgctcaaaatgtttcccatcatagagaagattatcaaaagcgaagggttcattatcaatcaagacaagttacactaccacaccccaaaaaataagcatctgatcactggagtagtgatcagccattcaaacgatacatccgaactcaaggtgtcgaaggaattcaagagaaaaataagagcagagatcttcaggtgtatcatgacaggcaattatgaaaacgccgcccatattaaaggagaaatctcctatgtgtgttttattcaatccgaaaacaggcaggattacaagcagtccatcattcagtatattaaccggacctcaaaaaagatagagtatttttgcgaactggttgacgcctacaatgaaaatttcttcttcgatgagcaagagccattggaattccttgacatcaataaactcgagattgattgccctgagaaggacaccgacaactatgatcagtacctgtttgagacaatcgaggcaatttttcagtaccgaaaagagtacatcaagaataataacctgactgacatatgtaagtaccagaactggcccaagaacactactgagaatgagtttgatgcctcttctgaggagacgccattctga

SEQ ID NO: 10153 - RNA, 1182 nt, unidentified
  source 1..1182: mol_type = other RNA; note = synthetic construct
atgaacaaaaatttcactaacagcttcatcctcaacgcccttaatctgccaattatacgcgatctcgataccttctctaattccatcggggtatctaaacggctgctttatctgttatcacagtcaagtgaggagtactaccggagtttctttatatgtaagaagaacggagatcagcgggaaattcatactcccacctacagcctaaaactcgtgcaaaggtggattctggaagaaatccttgagaagatcgacgtgtctgaggagtccatggcatttaaaaagggacccggcaacgggatcaaaaagaatgccgagatccatctgtactcgctctatttactgcagctggacctgaaggacttctttacatctataaagcgcgagaaagtcttttacctatttaaggatctaggctacaatatcgtcgtttctaacatactcgcaagtttgtgtacgtataacggctatctcccacaaggcggggttacctcaccttatatttccaatttggtgtgctacaaactggacaaaagactcaaaggtctgtgcgctaaacgcgacatcctttatacacgttacgctgacgacttgacctttagctgcgataatcgagaaaccctcaaaaaggtgcagaaagtgatcgaggatataatcgaggacgaaggcttcaatgtgaattccttaaaaacaaggcttctgagcccttccagtcacaagaaggtgaccggtatcactgtcaatgagaaaaccgtaaaggccagtaagaagctgaagagagaagtccgtacaatgatccaccacgcatttgttacaactgattatagctccaatgacaggattaggggctacattgctttcattagctccattgaggaaggatataaggacaccatctacaagtacattaataaactggtgaacaacgagaactataggatgttcagagacattgtggaggcgtacaataacaacaagatcttcaagaacatggaagacatgaaagacatgaagtttgagaagagcgggtacctggtcgaagaatatctgaatgatttggcccaggagcgggcctcatttctgagaaaccgagatattcagactgacctgttcacaaactcgagcgctgatgagatcgcctctacgtcaatggaacgcaaggattttaaagatttgttctga

SEQ ID NO: 10154 - RNA, 1188 nt, unidentified
  source 1..1188: mol_type = other RNA; note = synthetic construct
atgaagaaatcctataccaactcattcattctgaatgccctcaatcttccaatcatacgggacttggatactttcagcaactcgataggcgtgagtaagaggctgatttacctactgagcgaatctactgaggattactacaagaactttctcatccctaaaaaaaacggtgaacaacgggaaattaacacacccacttactcactaaaattggtgcagagatggattctagaggagatcctggagaagattggcgtcagtgaggaatccatggcctttaaaaagggccctggtaacgggattaagaagaatgctgaaatccacttatactctctttacctgctccaattggacattaaagacttcttcatcaacatcaagagaaaacgtgtgttttatctgttccgtgatttgggatacaatgtggctatctccaatattctcgcaaatttatgcacctataaggactatctgccccaggggggcattacatctccatacctctccaacctcatatgttataagcttgacaagcgattgaaaggcctgtgtgccaaacgggacatcctgtacaccagatacgctgacgatctgacctttagctgtgacaatagagagtcccttaagaaggtacagaaagtgatcgaggagattatcgaagatgaaggattcaaaacgaaccccctcaaaactcgcctgctgtcaccttcttcacataaaaaagtcacgggaatcaccgtcaatgagaggtatattaaggccaacaagaagcttaagaaaaaagtcagggcgatgattcaccacgcattcatttccgccgactattctagcaatgattgcatcagggggtatatagcattcatatctagcattgaggagggatacaaggacacaatctgcaaatacatcaacaagctggtgaataacaaaaactaccggatctttgaagatatagttgaggggtataacaacaataagatcttcaaggacatggaggaaatgcgcttcaaggaaacagtttttctggatccggactatccactgaattcgcatttaagcgatatagttcaggtacgcaccgattttctccagaatcgagatatcaagatcgacgtgtttcccgatagcagtgaagacgagatcgctagtgccaatatggaagagattgagatcgatgacctgttttga

SEQ ID NO: 10155 - RNA, 1197 nt, unidentified
  source 1..1197: mol_type = other RNA; note = synthetic construct
atgaaaaagcattacactaactcgttcatcctaaatgcattaaatctgcctaatatccgcgacttggaaaccttttctaatagcattggtgtgagccaacgactcattcagttacttgccaattccgcacacgtgtactacaacaacttcagtatcccgaaaaagaatggaactcagagagagatcaacactccaacctatagcctcaaactcgtgcaaagatggattctgaaagagattctggaaaagatcgatgtgtcagaagaatcaatggcctttaaaaagggcctggggaactctattaagaagaatgccgagatccataaatacagcgtctacttgctccagctggacataaaggacttcttcatctcaataaagaaggagaaggttttctatctcttcagggatctgggatataatatcgtggtgagtaatttgcttgcaaacatatgtacgtacaacggctttctcccccaggggggcgtctgttcaccatacataagtaatcttatctgctacaagctggataaacgcctcaaaggtttgtgtgccaaaagagatattctgtataccaggtatgccgacgatctgacattttcctgcgataacaaggaaacactaaagaaagttaggaacatcatcgaagacattataaagaacgaggggtttgagattaaccctcttaaaacacggtttctgtcaccctcttcccacaagaaagtcacaggcattaccgtcaatgacaaccggatcaaagcatctaaaaagctgaagaagaaagtaaggtccatgattcaccatagcttcgttagcgcggactatagcagtaacgaccagatccgcggatatgtgtcttttatcgattctatcgaggagggctacaaagacaagatttgcgaatatatagaccgtcttgcgaacgataaggactacaagtattttgaggacattgtcgtggctttcaacaacaataaaatcttcaaggagctggctgacatgcccttcgaggatttatcctttaacgaccccgatgatcctgacgatctggttacctactttatctccaattccgtggaagaaagatacagttttctgaaggatcgacggattaaaattgatgccttcccagatgagtatgaagacgaggtggctgccgctaatcagaatgaaatagaggtagaggacatcttctga

SEQ ID NO: 10156 - RNA, 1110 nt, unidentified
  source 1..1110: mol_type = other RNA; note = synthetic construct
atgaagaacgatttcacgaattctttcatcctgtactcgctcgatttaccgataattaaggatttcgaaagcctatctaactctgtgggcattagtaaaacaatgctgtacctcttgtcgaaaaaaacagacatgttttacaactccttcgacatatgcaaaaaaaacgggaccaagcgagaaattaactcacctacctattctctgaaacttgtgcagcggtggattctcgccgagatccttgagaagattaaggtgagcaatgaatctatggcatttagaaagggcattggcaacggctgtcgcaaaaatgctgaacaccacagatatagcctttacctgctgcagttagacatcaaggattttttcacttcaatcaaccgggagcgcgtgttttatctgtttaagagtctggggtacaattctttggtgtcaaatatcctggccaatctatgcacctataagggttatctccctcaaggaggagtatgtagcccctacattagcaatctgatttgctataagcttgacaagcgtttaaaaggcttgtgtagtacaagggacgttctgtacaccaggtatgctgatgatctcaccttttcctgcgacaataaagttatcctccgcaaggtcaagaatgtgatcgaggacatagtaattgatgaaggattcgcgattaatccaagcaagacacggctgctttcccccagttcccataagaaagtgactggtatcacggtcaatgacaacaagataaaagcatccaaacagatgaaaagaactgtgagggctatgatacattatgcactggtcaacagggactactctgaaaaaaacgtgatccgagggtacgtctcatatatcgactccatcgaggaggggtacattgataagatcaagaactacatcaacaagttgactgagaaagattactcctcctcaagtgagatcgtcgagagcttcaataaaaacaagctgttcaacgatctgaacgacatggtttataatgaggccagcatcatagacgaagcctttgattgggatattttcgagctcgacacatacaagcacatcagcgccaccaagcaggaagacgactttaatttctga

SEQ ID NO: 10157 - RNA, 1053 nt, unidentified
  source 1..1053: mol_type = other RNA; note = synthetic construct
atgaccacagatttcaccaattcgttcattttgaattcactaaagctgccgatcattactaacatagattctctggcaaacactcttggcctgagcaagaccattatctttttgctgagccaaaagacatcatactactacaagccctttaagatccttaaaaaagatggcaatagccgacagattttttctccctcatattccttgaaactcgttcaacgctggattctcaacgagattctggaaaaaattgatgtgtcccatgagtcaatggcctataagaagggtaatgacaatggcatcaagaaaaacgcggagatgcacaagtataatctgtacctgttagaattcgatttgaaggacttctttacttccataaaacgggagagagtcttcttcatgtttaaaaacctgggatataacaacatggtcagcaatatcctcaccaacatatgtacatataacgattacctgccacagggcggagtgtgtagtccttatatttctaatctcgtgtgctatagactagataagaggttaagtgccctgtgtgggaagaggggtatcgtttatactcggtatgctgatgacctgacgttttcttgcgacaacaagcagagccttaaaaaggtgaaggacataatcaaagacattattgagagcgaacagttcaaaatcaacgatagtaaaacacgcctgctgtccccaacgagccataaacgtgtgactggaattacagtaaatgacaataagctcaaagccaacaagaatatgaagaagctcgtcagggctatgatcatcaaaagtttattctcgatggactacatcaacaataatatcatcaaggggtacatcgcatttataaattccatcgaagacgggtacaaatgcaagattatagagtacatcaacaagaccatcaacaaatctcttccttattccaacgaaatggtgattgcctataacgagaacaaattcttcaaggaaaccaatgatatgtgctaccacggctacgacaatatcgatgacaaatacgaggactacgaggggtga

SEQ ID NO: 10158 - RNA, 1179 nt, unidentified
  source 1..1179: mol_type = other RNA; note = synthetic construct
atgatccaaaaggattacacggactctttcatattaaatgcacttaatctcccgaccattagcgacttggactccttgtcagatgcctttgcaatcagcaaacggctaatatttcttctgaccaagaagaccgagaactactacaaaaggttctacatcaagaaaagggatggcacttcccgtgagatcttgtctcccacatactctcttaagctgatccagcgctggattctcaaggaaatcttagagaaagtgtcactgtctgaacaggccatggcctacaagaaagggaaaaataacgggattaagaagaatgccatgcaccacagatactcactctatatactggaaatggacattaaggatttcttccactcaatcaagagggaacgtgtgttctacctctttaaaaacctgggctataataatatggtgagtaacatcctgaccaatctgtgtacatataatggctatctccctcagggaggtgtttgcagcccctatataagtaacctgatttgttaccgcctggacaatcggctgtccggcttgtgcggaaagcgggatatcctgtacaccaggtatgctgatgaccttacgtttagtagcgataacaagcaaactctgacaaaggcgatcaacataatcatcaacattattgaggacgagggttttaaggtgaacaagaacaaaacaagactcttatcaccaggcagtcataaaaaagtcaccggcattacagtcaacgattccaagatcaaagcttccaaacagctgaaaagaaccgttcgcgccatgattcatcaggccattgtcactgcggactactcgcaaatagaccggattagaggaatcgtttcctatatcaattctattgaggtcggataccgcgagaaggtaatcacttacattaatagcctaagcaacaaagactatgcttttttcgaagaaatcgtggaacgattcaacgataacaaaatcttcaaggagatccaagacatgaattataagggttatgattacgacgatcaggtgagtttggagcttgagaaaattgtatccgctcgacaggaatatctcgggaagatagggaaggtggattttctgtctgcacatattcagagccagcaggacgagttcaaaaccaatgccgcagctactaaggagacatacgaatga

SEQ ID NO: 10159 - RNA, 1182 nt, unidentified
  source 1..1182: mol_type = other RNA; note = synthetic construct
atgaaatctgacttcactaattctttcatcttgaacgctctgaatctccccgttatgaaggatctcaatgacatttcttacctgaccggactgagtaaccagttgctctttctgttaagtcagaattccgagtcgtactacaagaagttttatctggacaagaagaatggcgaagtgcgggaaattaactccccatcatatagcatgaagctagtgcaacggtggatcttgtcagagatattagagaaggtgaaagtgagtaacgaatctatggctttcaagaaagattttggcaatgggagtatcaaaaacgcccgctaccaccagtattcactgtatatcctgcaactggatcttgagtctttcttcgattcaatagacaaggaacgaattttccttgttttcaaatcactgggatacaacacgtatatttcccacgtgctaaccaatatttgtacactgaacggcacactccctcaggggggcgtatgtagcccttacctgagcaatctgatctgctataagttagataggcgtttgacaggcctgtgcagcaaacgcgacgtcctctacacccggtatgccgatgacctcaccttttcgtgcgataacaagctcacacttaagaagattaagaatatcatcgaggacatcatcattgatgaaaacctcaaaatcaaccatttcaagacgcgactgctgtcccccggttctcataagaaagtgaatggtattactgtcaacaatggaaacctgaaagcaagcaaagaactcaaaaaaaaagtgagagcgatgatacaccacagcatagtaagcgaggattacagtaagaacaacattattagggggtatgtctcctacataaattctatcgagaagggttacttggagaagatcaaagagtacattatcaacatcttcaagaaggactacaaccatttctcctccaccgtcaatgccttcaacgagaataaactttacagagacattgaatccgccgagtacgttgagtttgtgggagcaggctatagcgacgactacgaatggttgtactatgaagaaagaaggtttgagtttctggtcgagaaaggatatcttaaggggcttcgcgactattttaaaaaagctgagaatctgctagtggaaaataaggatgatgaggacccaactagcatcttttga

SEQ ID NO: 10160 - RNA, 1221 nt, unidentified
  source 1..1221: mol_type = other RNA; note = synthetic construct
atgaacaacaaaaacaacgtgaccaattcctttattctcaacgcactcaatctgcccatcatcaaagatctagagtccctgtcaaaccatatcggcatatcagaaaaactcatctacctcctgtcagtacgcaatagtgaattttatgaaagcttcaccatccctaagaaagacggcactgaaaggaaaattgaatcccctagctatagcttaaaattggtgcaacggtggatcctgaaggaaatcttagagaaaataccggtgtcagtccactcgtttgccttcaatccaggacggaatgggattaaagacaacgccgagctacacaagttctctttgtacctgctccagatggatattaaagacttcttcaccagcatcgagtataaacgcgtcttttacttgttcaagaaccttggctacaattccttcattagcaagattcttactgagatctgcacgcatgaggaacgactgccccaaggaggcgtctgctcaccctacatttccaacctcatttgttacaggttagacaatagactgcagggtctgtgtagtagcagagatattatctattctcgctatgctgatgacttgacatttagctgcgacaacaaagaggcacttcggaagattaagaaggtcatcgaagagatcatttttgacgaagggtttaaagtgaatcacaagaagacacggtacactagcccttcctctcataaagttgtcaccgggataaccatcaacgaccagaagatcaaggtccagaaggaccttaagagaaaagtgagagcactgatccaccacgcgatagtgtgtggggacttctctgagatcaacacaattaagggttacgtgtcctatataaatagtattgaggtgggctatcgtgagaaggtcataacctacattaacaagctgctgatggagaaagattataagtactacaatgacatcgtggagtctgtaaatggaaatctgatgatgaaggagcagatcagtatggtttatgacgagtacgttgacgatgagtacgttgatgacgaatatattccagccgacatcgtgtttgccgaaacaattctgaggaagcgaatagattttttcaagaaaaggggaaaggagctggaaatcgaagataagtataaagagtacttcgaggacgaggtagcttctactgtggttgtggatgctgatgatgatgatgaactcccattctga

SEQ ID NO: 10161 - RNA, 1287 nt, unidentified
  source 1..1287: mol_type = other RNA; note = synthetic construct
atgaacaacacccacagcaacaccattctgctgaataatctccaattgcccatcatccacgacattttcgacctcagcgataatacacgcatctctgacgggaagctctacttgttattccagttccataactactactacaacacgttctttatcaacaagaagaacggcaaaaagcgggagatcagtagtcctcaaagaccactgaaacttcttcagaagtggattttggaggagatactgctgaatatcaaggtgagcgccgaatcacaggctttcatacggaagaagaatggcattctggagaatgctctcctgcataaagacaacttgttcttgcttcaaatggatatcgaaaactttttcccgagcattgatgacaaacgcatcttttatttcttcaggcagattgggtataactccttcgtgagcgacatactgaaaaatgtatgtactttcaagggcaaactccctcagggaggtgtttgctcgccatatctctcgaatcttatttgctatagccttgatcgacggattgctggactgtgcgcccggagagatatcatatatagccgctacgccgacgatctgtccttttcttgtgacaataaagacaatctgaggaaaattcgtcccctagtggaattaatcctgtcaaaagagggctttaaggtgaataagtccaaaacaaggttctccttttcacacaaaacaatcactggactgaacatcgcaaaagataataacaacatgaacgtcgtcaaagtgcctcgtaagttaaagagaaaagtgaggagtatcatacattactcatttgtctccggtgatttttctaatcagaatgttgttctggggtacatcgcctttatctattctattgagcccgagtacatttccaagatcataaagtacattcagtccctgcagaacaaggactataagttctttagcgatatcgtgaacgcatttaataagagtgacctggcaaagatttccaacttttgttggaatttcgatgacacctatgaatctaagatagacgtagagaaggtcctcagaaaatacaaaatttcagatcgcaaggacctggatctgttcgcggagtatctaccagatgaatactggggcttccaggaaaagtttgagaagcgatttttttacctcaagaggcataaagtccttactgaccacttagtgtctatctaccaaaacaaactgtatgacctcaacttcctaaatagagaagactctaccaacagttttcaccaggatttgttcgaattctga

SEQ ID NO: 10162 - RNA, 1245 nt, unidentified
  source 1..1245: mol_type = other RNA; note = synthetic construct
atgagcaaggaccctacaaatattttcatccttaactcgctcaagttgcctattatagaggatctctacactctgtcgaatagtaccggcatatccttgaaaatgatctacctgctgagtaagaaccctggaaatttctacacaaaccacaaaattccgaaaagcgatggaacattccgcgatatctatagtcccaatttatctctgaagatcatccagcgatggattttggaggaaatcctgtgtaacattgaaaattcatcagaggctactgcttttaagaaagggcttaatggaccctacgagaacgccgcttatcataaagacagcctgtattttctacagatggacattaaagacttctttccatctattactcgtaagcaggtgtactatctattcaagaacctcggctataacaaatttatttccaacattctggccaatctaagtacgctgaataacaagctcccgcaggggggcgtatgtagcccatatctctccaacctgatctgctataaaatggacagaaggctgaagggactgtgctctaagagggatatcttatatacccgatacgccgatgaccttaccttttcttgcaataataaggtcgccctccggaaagttaaacaggtcgttgagaagattgtgattaacgaaggctatctcatcaaccacaagaaaactagatattcttcaccaatctctcccaagaagatcaccggtgtgacaatcacctcccaaaagaaactgaaagctgacaggcaaataaaaaagaaagtgcgggcaatgattcataaagcaatagttacaggggattaccagcataccaacaagattctgggctacatcgcctacatcaactccatagaaaaggattacaaggagaaaatcatcagctacatagagaagctcatcgacaaacagtataagcacttcgacaaggtagtgaaggcatacaattccaataaattctttcgcagcttgcctgacatgacccaagtggatattaacactcaattagccgatgagaagcttaaatgggagctgggtatcgacgtctatgactactacatcttcgaggaatacaaaaacatgttggaacagcggattgacttcatggataagaaggggatttttgatcaggagctgaagaatgagtttgagagaatcaatgatgaagtggcgagctcacttgaagacgaaataacgcccccaaaagacgatgacatccagttctga

SEQ ID NO: 10163 - RNA, 1119 nt, unidentified
  source 1..1119: mol_type = other RNA; note = synthetic construct
atgattaagcaacaggatcagttctactcttcttttcaactgttgaagaaaaacgggagctacagaaatatatccaaacctaagttctctctgaaattaactcagcgttggatccttgaggaaattctatacaaaatcgagacaagtaacgaggccctggcgttcaaaaagaacgttaacgggcccaaggacaatgcagaacatcacaaatatagcttgtacttacttcagatcgacctggagaattttttcccgtcgattaccaaaaagcaggtgttctacatctttaagaacatcggctatgataataaggtatccaacactctttcgaatttgtgcacctataaagacgtcttaccacagggtgcagttaccagtccttatctcagcaatctcatctgctataaactggacaggaggttgaaaggactttgtggtaaaagaggcatactctatacgcggtatgccgatgatctgacattctcatgcaataataagaacgacctcaagaagattttcaaggtggtccagaagataatcaactcagagggataccagatcaatagcgataagacccgctttctgtcacctgtgtcccataagaagatcacaggaattaccgtggacagcaaaaacaagttgaaggctgataaatctctcaaaaagaaagtgcgagccatgatccacaaggctatagtatctggcgattatagccagagtaacaagatcaaaggctacatcagttacatagattccattgaaaacgggtattacaagaagattatcgagtacattcacaagctaatcaataaggaatacaagtcctttcatcaagttgtcgattgttacaattctaaccgcaacaaactgctgaaggaccttgagaaaatggagtatgaggactttattgaggaaccacccgagaatctggatgaatccgacatagaggattatatcggggaacaatttaaagactacgtggacattctcaaggaacggaaaaaattcctgaacaagcacaatttcagcgtgaaagagattaagcacgaactgtcactgctgactattggagaaaaacccctgcccaagaacacaggcaaaccagaggacctcttttga

SEQ ID NO: 10164 - RNA, 1227 nt, unidentified
  source 1..1227: mol_type = other RNA; note = synthetic construct
atgaaaagagactttaccaacacctttatccttaatagcttagagcttccagtaattgacagtctcgatacactgtctaatcaggttgggatttcgaaaaggatgctgtatctgctgtcacaacagacaaacaaatactacaaacagttccagatccccaagaaaaacaatacatttcgtgagatctctagtccgtcctacagcttaaagctggttcaaaggtggattctagaagaggtcttctataaaatcaacgtgactgacgaggcactggcctttaaaaaaggcgttaatggaatcaaacagaatgccacgtatcacctctactctctctatatattaggcatagacatcaaggacttttttcctagtattagcagggaaaaagtgttctacctgtttaagaatctcggctataataacttcatcagcaacgtgctgagtaacttgtgcaccctagataattctctgccacagggggcggtgacttcaccctatatcagcaacatcatctgttataatctggatcgacgcattaaggggctctgcgaaaagagagatattgtgtacagccggtatgccgatgacctgaccttctcgtgtgacaataaggatacactcaagaagatgtacaaggtgcttgaaggaattattgtcgatgaaggattcgaggttaatcgctctaagacacgatttctctcacccatcagccacaagaaactcaccggaatcaccattgaccaccaaaagactaaggcagataaagaactgaagaaaaaggtccgggccatgattcataaatccatagtgaccggtgactactccaacaataacataatcttgggctatgtatcattcatcaactccattgagaatggttacaagaagaaggtcataaactacatcaacatactgatcatgaaggactacaaacactatcctgatctagtggacgcatacaataaaaacaagttgttccaggagctcaacaatatggtgcagattgacttccacacgtctttcgcttttgacattaaaacatactaccggcagtactttaagcatgggttcgacctggatgaaatggagtattacgagtatcttaacatgctggaatcccgcagagtctatttggagaagtaccatttgaaggacactgagctggagaaagagcttggcaccctgcaatccgctgctgatatcgaagaagatactgatcttttctga

SEQ ID NO: 10165 - RNA, 1152 nt, unidentified
  source 1..1152: mol_type = other RNA; note = synthetic construct
atgataaaggagtacattaacaagacctttatcgagtctttggacttgccaatgatgaaatcattcgacgatctggtccagaatctcaggctcagcgcaaaactgatgcactggctgacttcttcttcctccggaaagtacaagacgttctacctcatcaagaaggacggctccaaaaggcgcattgatgcaccagctagaagcctgaaaattgtacaacgctggatacttgataacattctggccaaaatcaaagttagcccctattcatttgggttcaagtctggcgagaagggtagtcctctggtgaagtgcgctgagaagcacaagaacaacctgtacatcctgaaagtggacctgaagaatttttatcctagcatcaacaaggagcgagtctactacacctttctcgacctaggctataacagttccgtggcgaacttacttactgacatatgtgtgcgcgacggatatttgccccagggcgccgtaacaagcgcttatctggcgaatcttatttgtcgagatttggattaccgggttgcaggttactgtaacaagagagacatcatttacacgagatatgctgatgatctgaccttctcttgcgacaatcgcgaaactctccataagtcattattcacaatacggaggataatcgaaggagagaagttccagcttaatacaaacaagattcacttcatgacccctaaatgcaaaaaatccatcctcgggattaccctaaatgacacctccattaaagccccccgggaaatgaagcggatggttaggtcagtgatccattatcaggtggctacaggagactacaccgataatgacaaaatcagagggtacatcagttatatcaacagtatcgaagagacatacaaggatcaagtcctgagctatatccagaaacttgccgagagccagctgtgcctatttgaagaattggtcgacgccttcaacaaaaataaactctaccaggagctgccggatatgattctgcgtgatgccggggactttgtgaatgcctatgaagaagacgagtttatgactgcagtgtattacgaacatcgtgaattcctgatcaagtacggcctgctcgaggaggagacagatacttcgaatttagaggaaattcccttttga

SEQ ID NO: 10166 - RNA, 1113 nt, unidentified
  source 1..1113: mol_type = other RNA; note = synthetic construct
atgattgacaacaagaacaagatcattttggactctctgggactgccctgtctcgtcagctttgaagatctggtgaaggcaattcgtctggactccaaactgatttattggctatcctccgaaacagagaataaatacaagactttcgagataccaaagaaaaacggaggcgtgaggataattcacgcccccgtgtactctctgaaacaggttcagaagtggatcctctgcaacattatctacaagataaaaacctccccttatagcctcggcttcaagcgctcctcaaatcttggatcaccactgtatatcagcgcgcagaatcacaagtataacctgtacgtgctcaaattggatctgaaagatttttatccgagtattaccaagaagacagtttacaatctctttctatctatcggctataactcacagatcgccttccttctgaccaatatatgtactcaccatggtgcattaccacaaggcgctgtgacatcggctcacctcgctaacctgatttgtcggaaaatggactacagattggccgggtactgtcagaagcatgacattgtctttactcgctatgctgatgatatggccttctcgtcagataatcgagacacccttaagaaagcctacaagacaatttgcaaaataatcaaggacgaaggatttatcgttaatgatcttaagaccaggttcatgactccaaaatgcagaaagcaaatcctgggcattacgatcaatgacaaccagattaaggtgagcaaggacttgaagcggaaggtcagggcaatgatacatagaagtattgccacaggggaatacaacaataacgacgtaatcaaaggttacatcagctatatcaactccatcgaacccgggtacctggagaaaaccaagaaatatatcagcgagttaatcacgaattctcctttggaactttatcccgagatcattaaccggttcaatagcaacaaaatctacagtgacttacctaatatggaactgaaagagccttcttactttgtagagagtccgtacgatactgattatatgaataacgagtacgagctccaccaggattatctggaggggataaagtgcaaatga

SEQ ID NO: 10167 - RNA, 1104 nt, unidentified
  source 1..1104: mol_type = other RNA; note = synthetic construct
atgaagaaatacataaataagactgtgctggatagtttaaaccttcctatacttaccagctttcaggacttagtcgagcagctgcgcctcacggacaagaaagtctactgggcttcctccaatcacattatcgacaaatacaacacattctacatcaagaagagcaacggaaataagcggagaattgacgagcctaaatattcactcaagatcatacaacgatgggtgctggagaatattctgtataagatcaaggtatcaccctactcttacggattcaagtacacggaaggttcaccattggttgcatgctctaacaaacatcgcttgaaccttttcgtgctgaaaatggatctgaaggacttctacccatctatcagtaaggagaaagtgtatttccagttcctcaatatagggtataatacaaaggtcagcaacttgcttaccaacatctgcacttataacaactccctgccacagggcgcggtgacttcagcctatctagccaacatcgtttgccggaaaatggattatcgtattgccggctattgtaataagagggaaattgcttacacaaggtacgctgatgacttgatctttagcagtgacaacagggagctgttacacaacacatacggaatgattgaaaaaatcatcaccgatgaaggctttacactgaacaaggataaaacaacctttatgagccccaaaaatcataaaaaggtcctggggatcactatcaacgataatcaggtgaaggcacccaaaaagctaaagagagaggtgagagccaagatccactaccagattgcaacctgtgattactctgaacagatgaaaactaagggctacatatcctatatcaatagcattgagccgaactacaaagagaaggttaccaaatacattaccggtctgagtaagtcgccactgtgtctcttccctaatgtagtcaaggcctataacgacaataaatatttctctgagctgcctaatatgatcctcaaatcctatggggactttgtgcaaccctctctgattgaagagtttgaggagcacattaattccgaatatctcaagtacctcagcgaacattccaaatga

SEQ ID NO: 10168 - RNA, 1158 nt, unidentified
  source 1..1158: mol_type = other RNA; note = synthetic construct
atgaacaagtattccaataagatcgtgatagagagtctggggttacccatgctaacttgcttcgatgacctggtcaaggaggtatccctttccgaaaaactggtttactggctgaccaagcgcgacgctgagggaaggtacaatcctttcttcattaagaagaaagacggcaataaacggaaaattaacagcccttcactggccctcaaaatagtgcagagatggaccctggagaatatcctctacaagatcaagacatctcagtactcatatgggtttaaaagagatattcggaaagggagcccattggtctactgcgcagagaaacacaagaataacctttacatcctgaagctggacttgaaaaacttctatcctagtatcaagcgtgagtcggtgtattacatcttcaagaatgttgggtataacgccgacatctccaacttactcaccaatatctgcgtggtgaatgatgaactcccacaaggtgcagtgacgagtccctaccttgccaatctcgtgtgcaggaagctggatttcaggattgcgggttactgcaataaacgcaatattgtctatacccggtacgcagacgacctgacttttagctgtgatgacagggagctcctgcgaaagatctacggcatgattaagaaaattgtagaagacgaaggcttttgtctaaaccaacggaaaactgtatttatgacacctaaaaaccacaaggaagtccttggagtgacaataaatgatggcctcttgaaagcccccaaagaggtgaagaaagatatacgagcaatgctccattatgaggtggcgacaggcgattatgctatgaacgatgaaatacgcggctatgttgcctatgtcgattcaatcgagaagaattacaagaacaagtgtattagctacctgaagagactttctgagtctaccctatgtttgttccccgatgtcgtgaaagcctataactctaacaagatctacaaagagttgccagacatgaaggagaagcaggttgctgatttttgtgaagaggacgaagacgagttcgctaacatgatctaccaggaacatgagcagtatctgattctgaaaggaatcttaaacaagacgaatgaagaagacattactgacctgcagaacccgttttggtga

SEQ ID NO: 10169 - RNA, 1152 nt, unidentified
  source 1..1152: mol_type = other RNA; note = synthetic construct
atgaaaaagtacagcaataagacagtaatcgagtccctgggcctgccaatgctgacttgtttcgatgacctcgtgaaagagctgagcctctcggggaaactcgtgtattggcttaccaaacaagacgcagaaggtaggtataagacctttttcatcgagaagaaggatggtgacaaaagaaagatcaacgcgcctagcctctctcttaagatagtgcagaggtgggtcctcgagaacattctttataagataaaggctagccagtatagttacggctttacaaagggcgacagaaaaggaagtccactggtgtactgcgccgagaagcataagaacaatctgtacgtgtttaaactcgacctgaaggatttttatccctcaattaagcgggagaaggtgtactatgccttcgccaatatcgggtataacgcagacgtctccaatctcctgaccaacatctgcgttgtggatgatgaactgcctcaaggagcagtaacgtctccttacttagcgaatctcatctgtcgaaaactggacctgcgtatcgccggttactgtaataagcgcaacattgtttatacgcggtatgctgatgatttgactttctcatgcgatgatcgggaactattaagaaagatttacggcatggtgaaaaagattgtagaagacgaagggttttgtttgaatcagaaaaagaccgtcttcatgacccccaaatctcataaagtggtgctgggagttacaatcaatgacagtcttcttaaagccccgaaagaaattaagaaatcaatcagggctatgatccactacgaagtggccacaggggactacacaatgaatgataaaatccgcggctacgtcgcctatgttgactctatcgagaagaactacaagaacaaatgcataagctacctacagaagctgtcagagtccaccctgtgcctattccccgatgttgtcaaagagtacaactccaacaagatatataaggagctgcccgacatggtcgagaaacgagcaactgatttcgtggaattgaaagacgctgatgacttttatgacatgatttactacgagcacgaagagtatctgatttccaacggattgttaaatgagaaggaagacattactgatttggaagagccattctga

SEQ ID NO: 10170 - RNA, 1116 nt, unidentified
  source 1..1116: mol_type = other RNA; note = synthetic construct
atgaaacaatactccaacaaagtgatcattgactcactccacctgcctatgctgacctgtttcgaagatatagttcgcgaggtgcgcttgtctggaaagctggtctactgggttacaaaaaaggatgctgaaggcaaatataagactttctacatcgacaagaaggatggaacaaaaagagagattaacgcacctagcctcagcgttaagatcttccagaaatggatcctggaaaacatcctgtacagaatttcggcttctcagtatagttatggatttgaacgaggaaggcggaagggctcaccacttgtgcactgcgcggagatgcacaaaaacagcctttacgtcctcaagatggatctaaagaatttttacccctccattaaacaggaaagagtatttttcgagttcaggaacaaggggtacaacgacgaagtcagttccctgttgactaatgcttgtgttcgtgacgacaagttaccacaaggtgccgtgacctccgcctatctggctaatctgatttgtcgcaagctagatgcgaggattgccgggtactgcaataagcggaatattgtatatactcggtatgccgatgatctgacatttagctgcgatgacagggacttacttaaacgaattttcgggacgatcaaaaaaatagtggagaatgagggtttccttctcaatgagaataagaccatctttatgaccccaaaaggccataagaaagtgctcggtgtcacaataaacgataatctgatcaaggcccccaaagagttgaaacgtatcatccgggcagtgctccattatgaagtctccacgggcgactatagtatgaatgacaaggtaagagggtatattgcatacatagatagcatcgagaacaactacaaaaacaagtgcatctcttacctgataaagttgtcacagagcaccctgtctttattcccggacattgtggaggcctacaacaataacaaaattttcaaggagctccctgacatggaggagaagaaccccatcgactttgtggacctggaggatgtgaacgacttttcagatatgatctactgggaacatgaagaatatctgattagtcacggcatcaataagtga

SEQ ID NO: 10171 - RNA, 1113 nt, unidentified
  source 1..1113: mol_type = other RNA; note = synthetic construct
atgaagaagtacaacaataagatggtaatcgaatccctgggcctacccatgtttgaggacatcgagacgctggcagaagaaacgcggcttaccgagaaacttgtcttctttatcactaaagaggatgccaaaggccgctacaagaaattttatatccccaagaaggatggtacctccagagagattaactcaccatgtatgagcctcaaggtgattcagaggtgggtgttggagaatatcctttataaagtgagggtttcacagtattcaatcgggtttgtgaaaaacggaaaaggaagtcccctggtccagtgcgccgaaaggcacaaaaataacctgtacattctgaagatggacttgaagaatttcttcccttctgttgagagagggcgggtatataaccagttcctccaactcggctataacacatatgcttctaatctgctcaccaacatctgtacactcaatggatccctgccgcagggtgccgttacttcgccttacttggcaaatttagtctgctacaagatggatattcgaatagccggctattgcaataagcgggatattacatacactcgctacgcggatgacctcattttctcttctgacaatcgtgatctgctgagaaagatatacgggatgattaaaaagatcgttgaagacgaaggcttcgtcgtaaacgaggagaagaccagatttttaagccctaaagtgcacaaagaggttattggcgtgacagtgaacgacggagtgattaaggctccaaaagaaatgaagcgcatggtcagagcaatgatccattacgagattgtgaccggagactatagcgacaacgagaaaatccgtggttacattgcttacatagacagcctagaaaggaattacaggaacaagatcatcaagtatatcgagaagtacttggatgacactatcaccctgtttcccgagcttgtggagaaattcaatcaaaacaagctgtacaaccagattccagacatgaaacagcacgacatctcccgatttgtgaatttcgaagatgaagccgattattacagtatggtggtcaacgagcgggaagattatctgagtcgccatgggatagctatatga

SEQ ID NO: 10172 - RNA, 1065 nt, unidentified
  source 1..1065: mol_type = other RNA; note = synthetic construct
atgtttgaggacatcgaaaccttagccgaggaaacacggttgactgaaaagctaatatacttcctgtgcaaagaagatgcagagggaagatatgtcagctttaagatacccaaaaaagatggcagatacagggatattaacgcaccttgtatggctctcaagaccctgcagaaatgggtactgcagaacatcctgtacaaagtgagagtgagtccatattccattggcttcaaaaaagatgggaagggttcccctctactgcagagtgccgaaagacataagaacaacctgtacatcttgaaaatggacctcaaagatttctttcccagcgtcaagagggagcaggtgttcaatcaatttcttcaactcgggtacaatacgtatgcttccaatatgcttaccaatatttgtaccctcaacggatgcctgccgcagggtgctgtcacatcaccttacttggccaatctcgtttgctataagatggatgtacggatcgctgggtattgtaacaagagggacatcatatatacccgctatgcagacgatcttattttctcttgcgataatcgggacgggctgcggaatatctacggtatgatcaagaagatcgttgagaacgagggattctgtttaaacgagaagaagacgcgatttctgactcccaaatcacacaaaaaaattgtcggcgtaactgtcaatgatggccttgtgaaagcgcctaaagagatgaagaaaatggtgcgcgccatgctccactattcgattgtttctggagattactccaataatgacaggatacgaggctatgtgtcttacattgacagcattgagaagaattaccgtaagaagattgtgaagtacatcactaactacatcaacgactcaatcacattgttcccagatgccgtgaagaagttcaacgacaacaagctgtttaacgagatcccagatatggtgcccaaaaagataagcgacttcgtggactacgaggaggaagacgactattttcagatgatcacatatgaacgcgaagaatttctgaccaagcatggcattgaggtttga

SEQ ID NO: 10173 - RNA, 927 nt, unidentified
  source 1..927: mol_type = other RNA; note = synthetic construct
atgcaaaacatcttatacaaggttagagtctctcagtactctatcggctttattaaaaacgggaagggcagtccactggtgctctgtgctgaacgtcataaaaacaacctgtacatcctcaagatggacctaaaggatttttacccttccatctgtcgcgccaaagtatacaatcaattcctgcagcttggttacaatacttatgccgcgaatctgatcacgaacatttgcattctagacggaaagtttagccagggcgcagtcacgtccccctatctggcttcactcgtttgctacaaaatggacaccaactggcaagatatcgtaataaaacgcgacatcgtgtatactcggtatgccgatgatttgacctttagctgcgacaaccgggacgaactgcacaagatctacgggatgattaaaaagattgtggaggacgaggggttcacccttaaccagaagaaaacacagttcctcacacccaaaggtcataaaaaagtggttggcgtgacaattaatgacgggatgctgaaagcaagcaaagatttgaagagatccgtgagggcgatgatccactatcaaattatcaccggagattatacaaagaatgaacagataaggggctacattgcttatatagactcaatcgagaagaactacaagaagaagatcattaagtacgtcactggatactgtcaggacaccataactttgttctctgatgctgtgaaggccttcaatgccaataaactgtttaaggagatcccggatatggtgcagaaggacatttcatcctttgcaaaatgggaggaagatcagagcgattatatggagatggtcatgtatgagcgagaaagttatcttgccaagcacggactgatcgaatcggatatagaggacgaaagtaatttagagatgttcgagtga

SEQ ID NO: 10174 - RNA, 1110 nt, unidentified
  source 1..1110: mol_type = other RNA; note = synthetic construct
atgaaaaagtacaccaaccagaaccttattacctctttgaatctgccattcgtgactgatatacacagcctttccatgcaattaagactcagcgagaaattggtttactttctgacaaatgagcgcacctacaagaagtatcggatctttagaatcccgaaaaaggatgggactttcagaaccattagtgcacccatcgcctccctgaagattgtgcagcggtgggtcctcgaaaacattctctacaagattaaagtctcagactatagctacggattttcaaggaatcgtaaggggtccccactcgcagcctgtgccgagaaacatcggaataacctgttcatgctgaagatggacctcaaaaatttctaccctagtatacagcgcgaccaggtcttttttcaattcctgaacatcggctacaatacctatgcggccaatttgcttactaatatttgctacaaccaggatggcctaccccagggtgcagtgacctccccttacctggcaaatatgatctgttacaagatggatgttcggatcgctagttattgcaataaaagggacattacgtatacgcgctatgctgacgatctggcgttttcctctgacaaccgagatagcctgaggaacatctatggcatgataaagaagatagtcgaggatgaaggcttctctgttaatgacgaaaaaacatgtttcatgacaccaaagaaccacaaagtactcttaggagtaactattaacgatgccaacattaaagctcccaggcagatgaagaaaatggtgcgaagcatgatccacagagccgtcatcaccggtgactattcactgaaaaatgtgatctgcggctacgtgtcgtatattgactctattgagaagggatataaggacaagatcaagaagtacatccataaatactacgaagaccctataacactgttcaaagacgctgtggatgcctataataagaacaagttttacgaggacatgcccgatatgaagaaccgtaacatcgacttctttttggatggggatgaatgggatgaggacgaagtgcttacagctttttatgaggagcgcgaagccttcctaatcactcataaatga

SEQ ID NO: 10175 - RNA, 1014 nt, unidentified
  source 1..1014: mol_type = other RNA; note = synthetic construct
atgattgacaagaccaataagctgattctggactccattggtatcccttatttttgggacatcaactcatttgcgcagaaggtgagatataccaataaactcttattcttcctcagcaattacaaagccgtcgagagatacaacattttctacctcactaagaagaatggcaaaatgcgaaaaatcatggcccccagctttagtctgttgatgctccagcgctggatccttcacaatacactgtataagatacgagtgtctgagtacagctatgggtttgtaaaatctaactccgactctgaatccccattagtcgaggttgccggcgcccataaaaatcacaagtacatcctgaagatcgatataaaggatttttacccgagcatttcaagggctcgggtgttctttttgttcaagaacctggggtacaacttctgctgcgcaaacatgctggccaacatctgcactaacaataacgaactgccccagggggctgctacaagtgcccgtctggcaaatattctatgtacaagattggatgctcgtatttcgggctattgtaataagagggatataacatacaccagatatgcagacgatctgatttttagctgtgataataggaacgtgctacatcacatatacaagatgataaacaccatcattcaggatgagggtttcgagattaatcaatccaaaactcggttcctgagcccaaagaatcacaaagtggtacttggagtgacgattaatgacggctactgcaaagcagaccggaaactcaagcgcaaagttcgcgcaatgatccattcttcaatcgtcaatggcaattattccgaacgggccatcatccaaggatacattgcctatttctcatctatagagaaagactataccgaaaagatcaagaggtacatcaacaagttttatggaactcttcctaaagataaggctatcgcgtacaacaacaacaagttccttaacaaaatgcccgacatgagtacgcagagttga

SEQ ID NO: 10176 - RNA, 1128 nt, unidentified
  source 1..1128: mol_type = other RNA; note = synthetic construct
atgtttatgatcaaccaaaccaatatctctctactcaagttgcgtagtttgcctatctttaatgacctgagctctatgtcaagagtcaccggcttttctgaacaactgctgtactactatgctatttcagacgatgcgaaaaaatataccattttcgagatcccgaaaaaagattcatgtaatacccgcaagatatacgccccaaactatgcccttaaaattctgcaacgatggatcctggaaaacatcttatacaaaatcgagtgctccgagtacgcattcgctttcaagagagatatggggtcccccctgaagaagaacgcactagtgcataaggaacatgtattcttattggagatggacctcgaaaacttcttccacagcatcaagaggcagagaattgtctacctgttttccaatcttggctataacgtccctatctcgaactggcttgctaatatttgtacttatgaggacattctgccccagggtagtgtgacggccccctacttgtccaacctggtatgcctgcagctggacaaaagaatagcgaagtactgttcgaagcgagatattgtctatagtcgctatgccgacgacatcacattttcttgtagcaataaagctgtgatcaaaagcatctacggaacaataaagaagattatagagagcgaacacttcactattaaccagaagaagaccaggtttattgggaaaagctctaggaaatccgtgactggcgtgatcatcgataacgactgcattaaagcaccaaaagagtacaaacggctcgttaggtgcctcatccatcgggccataatctcaggcgactattccaatattaatcggatccgtggttacatagcctatatctctagtatcgaggatgattacatgcagaaggttgtgaagtatattaacactttcaagaccaagcgggatgttatatttctcgatagcacagtggagatgtttaacgcaaatatttttctcccaggagtcgaccagatctcccagattcgcatgacaatggaggaagaagataatttcggggactacgtgacggagaggctggagttccttaagaaacgccacatgaaggtgcctcccgaactgggaaagttatga

SEQ ID NO: 10177 - RNA, 1029 nt, unidentified
  source 1..1029: mol_type = other RNA; note = synthetic construct
atgaatattggaaacaatgtggtcctaaacactcttggcgtgcccgttattaactctttcgagcatctttgtgagcaactgtcgatcactgagcagctcttatactatctaacttatcggaaggaacattgctactacgaaaccgaaatccctaaaaagaatggaaaaacaaggatcctgcatgtgccaaacttgtctctgaaagttgtgcagaaatggatcctgaccgaaatcctggagaagattttcgtgagcgagcagactatggcttttgtgccccacaagaacggcttgagagaaaacgcagagagacacaagaaaaacatattcttactcgagatggacattacgaacttttttggtacaataaccgaagaacaggtctactccctgttctgcaacattggctacggatcaaaagtcgcagggatactggctaatctttgtacctacgataattacctgccgcagggagccgtgacctccccatacatcgcaaatttggtgtgctatcacatggattctaggataaatggctactgttcacggaaggatatcgtttatacaagatacgctgatgatctcaccttcagttctaataatcggatgctgctcaacaaagtcgagcgctttattaaatatatcgttgtagacgagggctttacgattaacgaaaaaaagacccgctatttttccaacgatgtgaagaaaacagtaactgggatcacaattaacgatgacgacattcacgtcgacaagaattttaagcgtaacttgcgcgcccagatctacaatagtatcaagacaaggagctatgataataattcccagatccttggtaagatcgcctatgtaaattcaatagaggacgggttccgagacaagatggagaagtatatcagcagcataattatccgaagtgaattcgtgcaagacctggatattgtgaacgcctttaacgcgaataagctgttcgccaaactccccgacatggtcttcatgaatgaggacaaaaaccctttcatttga

SEQ ID NO: 10178 - RNA, 1029 nt, unidentified
  source 1..1029: mol_type = other RNA; note = synthetic construct
atgaacatcggaaatagcgtggttctgaacaccctgggggtgccagtcatcaattcatttgagcatctttgtgaacaacttagtgtaacagagcagctcctgtatttcctgacttacaagaagaagtactgctactttgaaaagaagatcccaaaaaaagacaagaccgagcgtacacttaatgtcccgtccttgagcctgaaagtggtgcagcgctggattctgaaggaaatcctcgagaagatatatgtgtccgagcaagctatggccttcatacctcataagaatggccttcgagaaaacgccgaacggcacaaaaaaaacattttcctcctggagatggatattacgaacttttttggaactatcactgaacaacaggtttaccgcctattttgcaacattggctataactccaaggtcgccggagttttggccaatctgtgtacgtatgatggttacctccctcagggggcagtgacctctccttatatagcgaacttagtctgctaccatatggacgctaggattaatgggtattgtagccggaaggatattgtgtacaccagatacgcagacgatctaaccttttctagcaataacagaaccctgttgaacaaggtggaaaaattcatcaagtacattgtagctgacgaaggctttaagatcaacgacaaaaagactaggtatctgtctaatgatgttaagaaaaccgtcacagggataacagtgaatgacgattcaattcacgtggacaaaaagttcaagaaagatttacgggcccagatctacagatcgattaaactgaaagactaccagaacaactcacagatcttgggtaagatagcttatgtgaattccatcgaggagggctatagggacaaaatcttcaaatacatcacagacgtgattactaaacccgagtttacaggccacatcgatatcgtcaacgcattcaatgataataagttctttcccgatctccccgacatgatgttcaaggaggtatgggagagtccattcgactga

SEQ ID NO: 10179 - RNA, 1029 nt, unidentified
  source 1..1029: mol_type = other RNA; note = synthetic construct
atgaacatagggaattccgttgtgctgaataccttgggggttccagtgataaattcattcgagcacttatgtgagcagctgagtgtcacagaacagttgctttacttccttacctacaaaaagaagtactgttactttgagaagaagattcccaagaaggataagactgaaagaacactgaacgtgccatccctgtcactgaaagtcgttcaacgatggattctcaaagagattctggagaagatctacgtttccaaacaagcaatggcctttatcccgcataagaatggactacgggaaaacgctgaaagacataagaagaacatcttcctgctggagatggatatcacgaacttctttggcaccatcaccgaacagcaggtataccgcctcttttgcaacattggatataactctaaagtggcaggaattctcgccaatttgtgtacatatgatgggtatctgcctcagggcgcagtgacatccccttacatcgccaacctcatttgctatcacatggatgctaggataaatgggtactgcagtcggaaagatatagtctatacgcgctatgccgacgatctgacttttagtagctctaacagaactcttctcaacaaagtggaaaagttcatcaagtacatcgtgactgatgaaggcttcactatcaatgacaaaaagacccgttatctttctaatgacgtcaaaaagacagtgacaggtattaccataaatgacgactcaattcatgtcgacaaaaagtttaagcgggatttaagggctcagatttatcgatcgattaagttgaaggactatcagaataacagccaaatcctgggtaaaatcgcctacgtaaacagcattgaagagggctacagggacaagattttcaaatacatcaccgatgtgatcactaaaccagagttcaccggccacatcgacatcgtgaatgcgttcaatgacaacaaatttttccctaacctacccgacatgatgtttaaagaggtatgggagagcccctttgattga

SEQ ID NO: 10180 - RNA, 1020 nt, unidentified
  source 1..1020: mol_type = other RNA; note = synthetic construct
atgaacttatccaataacgtgattctgaataccctcaatgtgccaatcatcaacggctttacacacctggcagagcagttatcactgacgcaagggctgctctacttcctcacgtacaaaaaagattattgctacacccttaaggaaattccgaaaaaagacgggactttcagaaagatatgcgtacccaatttaagtttgaaagttgtgcagaaatggatcctcgttgagattctcgaaaaaatcgacgtctccccacaggccatggccttcgtccccaagaacaacggactgaaaagtaatgccgaatatcacaagaagaatatcttcttgctagagatggacatcaagaacttttttggcaccatcaaagagggtcaagtattcaagctgttttgtaacatcggatataacactaaagtgtccactattttgacaagcctgtgcacttttgatggggagcttcctcagggggctgtgacaagtccctatctagcaaacctgattctgtatcatttggatatacgtctgaacggactctgttctaggaaagacatcgtttacaccagatacgcggatgatctctcgttcagctccaatgaccgcgccaaactgaatggtatcgagaacttcgtgaagaatatagttagcgatgaaggatttgagattaacgagaagaaaacccgctatctttcaaatgacgtcaagaagagcatcaccggcataaccatcaacaacgaagaaattcatgtcgacaagaagctgaagcgggacattcgagcacttattttctctagcattgcctctaagaactatgctttgaacgacaaaatacggggttccattgcttacgtgaattctatagagcctggctaccaggagaagatgatcaattacatcgagaggatcatcaataaagatgagctgaagaacgaccttggcgtggtgaagacattcaatgaaaataagctgtacaaggtcctgcctgatatgaagtacgaagaatcaccctttatttga

SEQ ID NO: 10181 - RNA, 1020 nt, unidentified
  source 1..1020: mol_type = other RNA; note = synthetic construct
atgaacatgtctaacaacgttattctcaacaccctaaatgtgcccataatcaatgatttcaagcacctcgcggagcagttatcactgactcaagaactgctccatttccttacctataagaagcagtattgctacacccagaaggaaattccgaagaaagacggcacttcccggaccctttatgtgccacatttggctcttaaggtagtacaacgttggatactgaaggagattcttgagaagattaatgtgtcttaccaggctatggcattcgtccccaaaagaaatggattgagggtcaacgccgagtaccataagaagaacatcttcatcctggagatggacatcaagaagttttttgggagcattcaaaagaaacaggtattccagctgttttgtaagattggctataatactgacgtgtcagctgtgctggcaaatctctgcatctatgaggatgtcttgcctcagggagccgtcacgagcccttatattgccaatctggtgacataccacctcgacgttagattgaacggtctatgttctcggaaagatatcgtgtacacacgctacgccgacgatctgagcttttcctccaataatcgaacaaaactgaactccatcgagaaaatagttaagtatatcgtgaaggaggaagggtttgagattaacgagaaaaagactaggtacttaagtaacgacgtcaaaaagaccataacaggaataaccatcaataacgaagaagtgcacgtcgataaagctctcaaaaaaaagattcgcgccatgatctttaatagtatcgtgaacaaagactacacacggaatgataaaatcaaaggtagcattgcatacgtggatagtatcgaaatgggctataaggagaagatcctgaactacattattcagatcacggaaaaagggcagttcaaaaacaatatagacatcgttaacgcctacaacaagaataaattcttcaagtcactgccctatatgcaatacgaagagtcgccattttattga

SEQ ID NO: 10182 - RNA, 1005 nt, unidentified
  source 1..1005: mol_type = other RNA; note = synthetic construct
atgaatacaaattcaaacctcattctcaacacactgggtgtgcccatcatctacgacctggaaagtctctcagagaggctgtcaataaccaagaccttcctgtatatgctatccaggaagcagcacctcttctacgaaaccgcagaaatacctaaaaaagatgggagcacacggaaaatccacgctcccgtgctctcccttaaggtcgttcagaagtggatccttgttgaaattctagagaaagtccgagtttcgccatacgcaatggcctttgtgcccgggaagaatggcttgaaagagaacgccatgctgcataaggaccggttattcattttagagatggatatccatgacttcttcggatccattactcagaaggacgtgtttcagcttttcaccaagatcggctataattacaccatcagcgcaattctggcaaacctgtgtacttatgaagaagtcttaccacagggcgccgtcacttctccgtatattgctaatctcatatgctacaacttggatatgcgcttgagcgcgctgtgcaataaacgagacattgtatacacgcggtatgctgatgaccttagcttctccagtgataatcgcactcggttgaatcgtatcgagaggctgttgagagagatagtgcaagatgagggttttgagattaacgatcgtaagacacggtatttttcaaatgacaggaagaagaccgtgacgggcatcacaataaacgaccgcgagattcacgccgatagaaaacttaaacaacgcatccgatctaaaatctttcatgctgtctccgaggccgactacagtgaggccgctcagattagaggactgatcgccttcgtagattctatcgaagacggatacagagatcagatggcgtgttatctggaggggctggccctgaaggaaagcctaaggagatctgcaaaggtggtgaaagcttacaacaacaacaagctgtttcaagacctcgaagacatgatgcctctgtga

SEQ ID NO: 10183 - RNA, 915 nt, unidentified
  source 1..915: mol_type = other RNA; note = synthetic construct
atgaaaaacattaaagatttcgcgaaagagctgtctctcgacgtcaagactattgaaaaacttacgagggacaatttcaactattatcacttcaccattccaaaaggcaatggagaaaagcgtctaattacagctcccaagggtaaactcaaagtgatccagaaatggatcctcgtgaattgtctagaaaaatttgcagtcgctgaatgcgctaccgccttcattaagggaaagcatggtatacgggtgaatgcagagtcccaccaatacaacaaatacattctggagtttgacttaaaggacttctttccgaacattagtttttgggacgttcagaacctgtttctcaggatgaatctgtctcagaagctgtccatcttgtttgccaagctatgcacatatgatgggtatcttcctcagggagcaataaccagcccctatatctctaatctgatctgttacgacctcgatctgaaattacttgagctctgtgattactacgacatcacatataccagatacgccgacgatcttacctttagctccgatgaactgtacctgttgctctcattaatgcaggagatcagctcaattatccattactatgggttcaaggtaaactacaataagacaaaagtgctgcttcctagcaataagcaaactatcactgggatcaccgtcaacaacggcgagataaaagtggacaagaagctgaagagaatggttcgcgccaagctctactatggcattaagaacaatgacataaaggacttcgatattttgctgggcttcatttcgtatatctgctcaatcgagatcgattacaaatccaagatgatcagttacgtgcagtatctgttgaataaattcggccgacacgataactgggggctgctgaagatattgaacaagtga

SEQ ID NO: 10184 - RNA, 915 nt, unidentified
  source 1..915: mol_type = other RNA; note = synthetic construct
atgaaaaatataaaggacttcgccaaagagctgtccctggatgtgaagactattgaaaagcttaccagggacaattttaattactaccacttcacgattcccaaacgcaacggcgagaaacggctgattacagcgccaaagggtaagttgaaggttatacaaaagtggattctggtgaactacctcgaaaggtatgctatcgctgaatgtgctaccgccttcatcaaaggggagcatggtatcagagtaaacgcagaggcccatctgaacaataaatatatcctagagttcgacctcaaggactttttcccaaacatcaagttttgggcagtccgagatttatttctgcgcatgaatttgactcgtaaaatcagtctgctgttcgccaagctctgcacatacaataaaagattgccccagggcgctattacctcaccttacattagtaacctgatctgctacgatctggatttagaattgcttgagctttgtaacaactatgacattacttacacgaggtacgcagacgacctgactttttctagcaattccctctatctcctgttttcgctgatgaaagagatctctgatatcatacggagccacggattcaagatcaactacgagaagacaaaaatcctttatccttccgccaaacagaccataaccggcattacaataaacaatggaacaattaaggccgacaagaagctcaaacgaatgatcagaactaagttgtactacggggtcaagaataataacatcaccgagctcaccaaactcattggatatatcgcgtatgtgaacagcattgaatcagactataaattacggctgtacgattatttctcttccctacttcagaagtttagcaaggaagatagctgggggctactgaaaatcctgaataagtga

SEQ ID NO: 10185 - RNA, 1002 nt, unidentified
  source 1..1002: mol_type = other RNA; note = synthetic construct
atggtgaatttcttttataacagtgacaagctgcaggagtacctccaattgccccaaatctatacgctggacgatcttgcgtactttctattatttacgaaggaacagctgcacgatttcagctatcgaaaaaacgaacattacgtgacattcctgatcccaaagaaaaatagcaccgaaaaacgggtgataaatgcccctaagaaacgtttaaagatggcccaaaagctaatcctcaaagagatattggagaaagtaccctgttcttctgcttctgctgcctttattaaaaaggaaaatgggctgctcaagaatgcactgactcacaaagagaatctgttccttctgaaaatggacttcaagaacttctttcagaacatcaatgaagccaaaataatccagatctttgagaaccttggatattccccctacattgcacttcaactggctaaactgtgcacctttagcaagaaactccctcaggggggcatttgcagcccatatttgtcgaatctcgcgtgctacgagtttgacaaagatatctcatcctattgtgacgaaaagaatattgcctacactagatatgctgacgatttgctatttagtgccaacgatattgatctcctgaagaatcttaagaacgacatttactcatacaccaagaagcattccgttgcaggtctgaacattcagataaatcacaagaagaccaaactgatcaagaatactagtcacaagaaggtgacaggcatcaccattaacgaccagaagatcaaagcctccaagaaactgaaaaatacaatccgccagaacatacggtataacttgattcataaccagttcgacaataagctgatcggaaagatcgcattcgtcatctcaattgaggataaggagtacaaaaacaggatcttcaaatactgtaagaggattgagaacaagttcaaactcaacaaaaaggaaaaccagctcctgaaagtcttatacaagatgacaaagtga

SEQ ID NO: 10186 - RNA, 981 nt, unidentified
  source 1..981: mol_type = other RNA; note = synthetic construct
atgaacaagattgaacttctcaagctgcctaagatcgagaacctgaaggatcttaatcatctgctgctttttacagagaaacagctaaacgactttgtgcggctcaagtccgagcagtacgtgagtttcaaaataccgaagaagaactcaatagaaaagcgcatcatcaacgcacccaaaaagtacctaaaactggcgcaaaagattatcttgaatgagatcctcgaaaaagtcccctgcagcaatgctgccaccgccttcatcaaaaacaagaatgggctctttgaaaatgccaatatgcacaaggataatctgtatctcttgaagttcgacttctgcaacttttttcaaagcattaagttcgagcggatccgtctcttgtttattgagttgggctataacccaaagatttccaagattctggcagagctgtgcacatattgtaaagaacttccacagggtgggatctgctctccttgtttatctaacctaatatgtctggagttagataatgacttgttagaatactgcgaaggaaatgatatcaaatacactaggtatgccgatgatctgtttttctcatcgaacaataaagaagtgctgctgaaactgaaggaagacattgagacgctgattctgaaacatcgaaccgagttctttgacataaagattaacaggcagaagactaaattcatcacagagccctggcataaaaaggtgacaggcatcaccataaacaacaacaagatcaagaccagcaaaactctgaaaagagatattcgcagagagctctatttcacgatcatcaaaaacaaaaccgactacaataagctgataggacagatcgctttcgttatatctatcgagaaagactacgccgaaaagattaaaaaatacgctctctccatctgtgagaagaataatatccacgagcacaagattattcagattcttgacaaaatggtcaagagtcaggtatga

SEQ ID NO: 10187 - RNA, 1014 nt, unidentified
  source 1..1014: mol_type = other RNA; note = synthetic construct
atgaataacgtgaactctcgacctttccttctgggtattaacgggttgccagtcatgaccaatatctcagatatctcgcgtcagattggcatctccagcaggcggatatacgaatataccaactataccagcagtttttaccacacattcgaaattcccaagacagacaaatctattcgcatcattaatgccccctttagtgggcttaaaatggttcagaggtggattctggaaacgatactgtataagattaaggtggacacaccttcatacggatttcttaaaggtaaaaagtcaccgactaagcagaatgcggagatccatagcaataacttatacctcttccagaccgacatcatcaatttcttcacaaacgtggatttcaagcgagtctatagcatttttctcaaaattggctacaacaaggaagtgtctctcactttggccagactatgctgcctggatggttatcttcctcagggcggggtaacctccccatacctgtcccatctcgtttgtttccgcatggaccgtcggattatgggcctgtgccagaaaagggagatcgtctactcacggtatgcagacgacatcacgttgtccagcgacaataagaatgatctgaaaaaagctagagtgtacctagagcaaataatatcagatgagggattcgaaatcaacccacgcaagaccaggtactcctttcagaaaaagctggtcactggactgacaattcacaataacaaagttctcgtgcccagaatattgaagcgcgaactcagatccaagatctataacaccattgtgtttaacgactattctagttgtgaggtcatcctgggctacgtaagctatatcaacagcatcgaaaatgggtacatcaacaaggtgaaagattatatcgagactctgctgaataataagtctatagagcccgagaggttatctattatccggctcaactacaagaaatcccctctgggaagttggatggagaatgtgcacactcaatga

SEQ ID NO: 10188 - RNA, 906 nt, unidentified
  source 1..906: mol_type = other RNA; note = synthetic construct
atgaatcggttagacaaactcatattggaaattggtctgtctagaaacgtgatcgaaaactacattacattcgctgacaagcactataagtcccattacttgccgaagaaggggggcggaaagaggaccatagattgcccaggtaagaatctcaagaccatccagcgatggatccttaaagagttccttaacaaactagaggttaacaaacgagcaaatgggttcgtcaagaataggggaataaaacgtaatgcgttgtaccacctcaaaaagaagcacattctcaccgtggatattaaggacttcttctactctatcagccaaagacaggtgtttgagacactgaacgccaattataacgatagggactttgcactgaagatcgcaaaaatttgtacctaccagcggtatctgccccaaggcgctcctactagccctgctctttcgaacctggtgtttaaacccattgacgatgagattatgaagtactgcaattcagaactgatccactatagtaggtacgccgacgatctgacgttttcaagtgataataaacagagcctgcagtacgcttacagatttatcaacgacctgctctataagaatggcttcaacctgaactcaaaaaagactcgctatctgagcggcaaagggaatatgtccgtcacaggcgttaatataaacacaggaaagcccaaggccgatccaaaacttaaaaaacaagtacgggccgaattacaccattacatcattaaggagaaggagattaacctaaacaaactcgccggaaaaatctccttcatccgcagtatagaggaagactattctcagaatttggacttctacatcaagcgcctgtataaaaaaaaggcctttatccagaagatggcgtccaagactcattga

SEQ ID NO: 10189 - RNA, 903 nt, unidentified
  source 1..903: mol_type = other RNA; note = synthetic construct
atgaagaagtttgaaaatttcattctggagatcggccttaccaagagcgctatcgaaaactatgtgactttcagtgatgcgagctacaacactttctacataccgaaaaaaaagaagggcgaaaaacgtgtgatcgactgcccaaacgccaacctaaaagccattcagagatttttcctgaagaagtacctgaacaaggtggaagtcaacaagcgagtgaatggttttgtacctaaaaggggtatcaaaagaaatgccctgttccatatgaaaaacaagtatctgctcacaatagacatcaaagatttttttcccagcataagccagaaaaaggtttttgaggtgctttacgagatctattatgataaggactttgctctgaaaatggccaaactgtgtacgtacaagaggtccttgcctcaaggagcaccaacttcccccgccctctctaatctcgtcttcaagggaattgatgacgagatcatgaaatactgcaattctgagatggttaactactctcggtacgcagatgacttaacattcagttcagacaacaaaaactccctacagtatgtttataagttcgtatcacacctgttgtacaccaacggcttcaacattaataaaaagaagacccgctatctttcaggcaaagggaagatgtcaattacaggagtgtacattaatagtgggaaacccaaggtgtccagcgagctgaagaagcaactccgggctgaattacaccagtacattatcaatggcaaggagatcaatttgaatcaggtcagtgggtatattagctttatctcgtctatagaggatgactacttgaaaaaagtggagtcctatatcgaaaagctcaaaaagaagaagaccctgatgcttacactgaaagcagaatga

SEQ ID NO: 10190 - RNA, 1038 nt, unidentified
  source 1..1038: mol_type = other RNA; note = synthetic construct
atgaatagtttccgtgacacatatttgtataactacaaggacaccttagatgagatcatttcaaaaatcaaggacttcttactgacagaaacatacaagaagattttcaaggatgaagacaaactccagtatataaaccacttcaccttccttgatatactgagcaacacgaaaaagttctataccaaacggatcatctataccaacaaaaaggaacggattgtgtttgagccctctgtggagctgtacctgatccagaagttcattttgtacaactacttgatacagagagacagctccttaagtgaaaatcttacttcctatcggaagaattactctgttaaaaacaacgccatcaagcacataaataagaggaccatcattaagattgacatcaagaacttcttcccgactatcaatagatatcggatctacaaatgcctgttgaatctaaacatcgaggaaaagaaagcatatctgtttagcagactgctttcttatcaggacaagctcattctcggaacccctagctctccatttctgagtaatctggtttcccgcaaactggatctacgaattgaagggtacattaaagcttaccaaaaatcaaaggtgcatatctcttatactcgctactccgacgatatgacattttcctttaaccagaggatcaatacccagaagtttatctcgtttatttaccagatcatcctcgatgagggctttgtccccaattacgagaaaacccagataatttccagcaatcacaaacaaaaggtaactggcatcattgtcaacagggacacgatatcagtgagtaaaaaagagagggatgacgtggagttcatcatcaaactctggcttaattatagcaaggacatagccctccagaaatacaacaagatcttcaagaagaactacacaaatgaacgcgatttccatcaaattctgaaatcgaagatactgtacatcaagtttatcaacgatgaacaagggaaaaagctgattcgaaaatttgaggagattaagattggttga

SEQ ID NO: 10191 - RNA, 969 nt, unidentified
  source 1..969: mol_type = other RNA; note = synthetic construct
atgcatcggctgaagtacaattacggctcagaaaacaatagcctcgacttgttaaacctcttcggcttcaccaataatgaacttcgttttttcagtatgtccaagaaacgccggtataaaaaaatcataatccccaagcgggacggttcaaatagaatcctgcatgcaccagtttataaactgaaaaacgctcagaggatcattctcaagaacattctgtacaagaagcacaatgatctgctgatagacaatatcactgggttcatccccaataaaaacattaagaacaacgccaacttccatgttgggaagaagtacatactaaaggtcgacattaaggacttttttccaagcatcactcaagatcgagtctatggtcttttgaggaaagagtacaatttagatcactctaccagcatgtatctcagtagcctgtgcacatataacaatcagctgccccagggagcgcctacatctcctatgctggccaatctcatcgccagatttttggattaccgaatcattggcctgcttaaatcttataatctgaatgaggggcttgagttaagttactcacgctatgctgatgatctcacgttttcctttaataagaggatcgacataaacctgttcattaactacgtgatctccatactaattgaggaaggcttttacccgaattacaagaaaattcacatgatctctagcggaaaacagcagaaggtgaccggcttggtggtgaacgataaagtctcagtgggacgcagatactacaagaagtttaagtcgatcttctacaatatctccaaaaacggtttcgatgacgaactgaaaaagtggaacaacattaactccaaaaagattgagtcggtggaaaagtttaaacaagtaatcggagggtatataagcttcattaaggacattagtcctgactattatgagaaactcaagcagttcaacgtactgtga

SEQ ID NO: 10192 - RNA, 966 nt, unidentified
  source 1..966: mol_type = other RNA; note = synthetic construct
atggcccagaggaaaaaaatcccacagatccctgcagaacagagccacctgtacggcattaagtctccccacgctttggctaacaggctggggtgggagctggataagcttcgggatttggccaaatcaggtggctatcgtatttataatcaccgaaagacaggtcgcgagatccaagagccaggtgccgcgttgcagtcactgcataagcaaatccataagtacctggccaggatccaggcacctgactacttacactccgccgtgaaagggaaaagctatctgagcaacgcacaggctcacgtaggcgacatcccgctcatcaagatcgacattgccaaattttatcagtctgtcccgcagcacaaggtgatgcatttctttcgggatgttatgaactgcgctaccgacgtcgcagggcttctggcaaacctcatttgctttagaggagccctccccacaggaagtagcgtctctcctataatctccttctacacgtacaaattcctttttgatgatctagctgacttggcggctggccacggactcactatgacttgttacgtggatgacattaccatgtctggccctatggcctcgagggaagtgctacacgaggcccgaacaatgatattccgggctggccttcgggcgcataaagacagaagtttcagtcctgatggaccaaaaatcgttaccggagttgcggtgagcaagcatgggattggcctgccctttgggcgctggcagaagataaggaatcagatacgggaactcgagcgctgtgacgacgacaatcaaaagctggcaatctatcagcagctgatttcacgcctctacgaggcaacccaaattgatccacgatgcagaatttccgccgagtatcaccatgcccgtttcagagaactgaagagagtattagctcaagctgcatccgaacccgtgcccttgaagctggccgcctga

SEQ ID NO: 10193 - RNA, 966 nt, unidentified
  source 1..966: mol_type = other RNA; note = synthetic construct
atgacccagaggaagcgaaatcagcctatccctatagagcaatcacatctgtacggaattaaatcaccacacgcccttgccaatagacttggctgggagctggataaactgcgcgacctgacaaagtcaggagattacagggtttacaaccacaagaagactggcagggagatacaggagcccggtgctgccctgcaatctttacatcgccagatccataaataccttagccgcattgaaacaccggattatttgcactcaaccgttaaaggcaagtcctatattagcaacgcacaggctcatattggggaggtgagtctcatcaagatcgacatagccaagttctaccaatccgtgagtcagcacaaggtaatgcacttctttagagatgtaatgaactgtgccccagacgtcgcgggtttcttggcaaatctgatctgttttcgcggagccttgcccaccgggtctagtgtgagccctatcatcagcttctatacctataaactcctattcgacgacctagcagtgctggctgactcccacggcctgacgatgacatgctatattgatgatatcacgatgagcggcaaactggcaagtagaaagatcctgcatgaggcccggcggacaatattcagagccggattacgtgcacacaaggacagatcgttttccccaaacgggcccaagatcgtcaccggtgttgctgtcactacttatggcatcgctctgccatttggccgttggcagaaaattaggaatcagattcgggaactcgaacgatgctctgatgacaacaaaaagttggtgatctatcagcagctcatttcccgactgtacgaggccactcagatagaccctcggtgccggggaagcgctgaatactaccatgcgcaatttaaagaacttaagagggtgctcgctttagtggggcacgggcccattgccctctctatgaccgcatga

SEQ ID NO: 10194 - RNA, 951 nt, unidentified
  source 1..951: mol_type = other RNA; note = synthetic construct
atgtccacaaagtctccaaaggagaaagcactggtccgcattcccattgaacgttgccatctatacaaaatcgggagcccacacgccctcgcaaaacggttaggctgggatcttaataagctggatgatctcgcagcctacgggggatataaagtgtacaagcataaatataccggaagaaccatcgaagaacctggtgcagctctgcagagtcttcatcgacaactgcatcgctatctgtcacggatcgaggtgcccccttatctccacagtgccgtgaaaggaaggtcctacttgtctaacgcgcgagctcacgttggggacggccgaatcatcaaaatcgacatagccaagttttaccagtccgttcctcaacaccgcgtgatgcacttcttcagggacaggatgaaatgcgcgcctgatgtttccggccttctggccgcgctgatatgttacgatggacacctggcaacaggttctgcaatctcgccgctgattagcttttacgctttcgagagtctttttgatgacttggcaaacattgcttgcaagtatgacctggaaatcacatgctacgtagacgacataacgatgtccggtaagcgcgcttcattcaaggtgttacatgaagtccgcagaaccatctttagagccggcctacgggcacataaagaccacgccttcgcctacaacagccccgggatagtaactggcgtggtggtcactggccaggggatttcattgccattcgaaaggtggaagaagattaagaatcagattaggctcctcgaggcctgtgagatcagagatgacaagctggagatctttcccagcctggtcagccggttgtatgaggccgctcagattgatccagcctgtcgttctaaggctgagtattatcacgccgcgtggagaaaactcaagtacgagaaaatggcccgggctgcttga

SEQ ID NO: 10195 - RNA, 978 nt, unidentified
  source 1..978: mol_type = other RNA; note = synthetic construct
atgccaaaggccaaaaggaagtcctcgcaacccatcccaatcgagcgttgtcacctctacggcattcgctctccccacgccttggccaatcgcctgggatgggaccttaacaaactagatcagctcgccgcctatgggggttacaaagtgtaccctcataagcagactgggcggatgattcaggaaccaggggaagccctacagtccttacacagacagatccaccactatctggctagggtggaggcacccgcctatctccattcagccgtgaagggccgctcatacgtttccaacgcgcaggctcatgtgggcgcaggaggactggtgaaacttgatatcgcgaagttttaccagagcgtaccgcaacacaaagtgatgcatttcttcagagacgtcatgcattgcgcacccgacgtcgcaggcctgttggcaaatttgatctgttttcacggtaaactcgcaacaggaagcgcagcctctcccataattagctattacacctacaaatccctgttcgatgaactgaaggctctggctgactgtcgcggcctgaccatgacctgctatgtcgacgacattacaatgagtggtccgggggccggtagagccgtcttacacgaagcccgaattctcatccatagggctgggctgcgggcccacaaggattgtgccttccagcctggcgcaccacggcttgtgactggggtgattgtaggagatatgggcatagatctccctttttcacgttggcggaagatcagtgaggcggttagagaggtcgagaggtgcgtggacccagtgcagcgactggagaagtatcctaagctggttagtcggctgtatgaagctgctcaaataaacagcagatgcatgacgcgcgccaggtaccaccatgagagatggcgagcccttaaaaggtctttacaggctgcacctttgaatgctggaggcggccaacccgttatcgcggcttga

SEQ ID NO: 10196 - RNA, 972 nt, unidentified
  source 1..972: mol_type = other RNA; note = synthetic construct
atgagccagggcaagcaggccaaacagcccagaatcccgatagaccgctgtcatctgtatgggattaggtcacctcacgcgttggctaaacgcctgggctgggaactgaataagctggattcacttgcagcctacggcggttatagagtatacaaccataaagacactggcagagagatccaggaacccggggccgctctgcaaagtctgcaccgacaattgcacagatacctggccaggatagaagtacctgtgtacctacacagtgctgtgaaggggcgaagctatttgtctaatgctcgtgctcacgtgggagatggaaagctcctcaaaatagacattgccaagttctaccaatccgttccacagcataaggttatgcattttttcagagatgtcctgtcctgtgcccccgacgtggcaggattactggcgaacctcatttgctatcgcggcgtgttggcgaccggctcgtcaatcagcccaattatctcatactacgcctataagtcccttttcgacggactagctggcctcgctgcgcagcatggccttgtgatgacgtgctacgttgacgatattactatgagcggtcctggtgcatctagggccgtgctccacgaggcacggtctgcaatctttaaagctgggctgagggctcacaaagaccgcagtttcacaggagacacagtcaagatcgtcaccggggttgtggtcggacctgatgggatagccctgccattttcccggtggcagaaaatttctcacgccgcaagagagatcgccgcctgcagtgacgacgccgagaagcttcgcctgtatcccaaattagtcagccggttatatgaagccgcccagatcgattccaggtgccgaagccgggcggagtttcatcactgtcagtggagggatctcaagcggcgtattgccgcaggcgctctgatcgcagcagcagtggataaggccgcttga

SEQ ID NO: 10197 - RNA, 972 nt, unidentified
  source 1..972: mol_type = other RNA; note = synthetic construct
atgtctaccaatcgccgcaggacagatcagcgaatccccattgaccggtgccacctttacgggataaggtcccctcacgccctggctaagagactgggatgggacttgaacaaactagacggattggccgcatatggctcttacagagtgttccaacataaagagactggtaggttgatccaagagcccgggccggcactccagagtttacatcgtcaactgcaccgctatcttagtagggtccagatgcctgaatatttgcacagcgccgcgaaggggcggagctacttaaccaatgcgcggtcacatgttggcgccggtgcccttatcaaagtcgacatagccaagttttatcagtcagtcccacagcacaaggtaatgcactttttcagagatgagatgcgatgcgctgaagacgtggccgggctgctggcaaatttaatttgctttgagggtaagctcgcaacaggttcggccattagtcccataatttcctactactcttacaagaacctcttcgatagtctcgctaacctagctaataaacatggcctggtgatgacctgttatgtggatgatatcactatgagcgggcctaacgcaagcaatctggtgctgcacgaggcccgtacaatgattttccgagccggcctcagagcgcataaggatagacgctttccctcatctgcaccaaaggttgtgactggcgtcgtcgtgaccgaccagggagttgaactgcctttctccagatggcagaagatccgggcacagattagagaaatcgagggactgggcaacgccgcagacaaactgaggctttacccacgcctggtgtcccggctctatgaggctgcccagatcgatagccagtgtcgggccagggctgaatattaccacgctcaatggcgccaggctaaaaggcaggtggccatcggctccatggctgacggaacggaggctgtagccgcgtga

SEQ ID NO: 10198 - RNA, 963 nt, unidentified
  source 1..963: mol_type = other RNA; note = synthetic construct
atgtctaaagcacggaagaaaaaactgccacagatacctttaaatcagtgccaccttttcagaattctatctattcatgccttggctaaaagaataggatgggaactggacaccctgaacaagattgccaaagatggcagctatcgaattttcaagcacagggaaactgggcgtcagattcaggagcccggcccgttactgcaaaacctccaccgccaattgcaccggtaccttagtcgtgttcagactcccgaatatctccattctgccgtcaaaggtcgctcttacctgacgaatgcgcgcgctcacataggctgcgataacctgatcaaaatcgacatagcaaagttctaccagtcagtatcccagcataaggtcatgcacttttttagggataccatgcaatgcgcccctgacgtagccgggctactcgcaaatctgatctgttttaacgggatgctggcaaccggcagtagcataagtccaatcatctcatacttctcctataagaagctgttcgatgatatccacaatatcgctctacgcgagaacctggtgatgacctgttacgtcgacgatatcacactcagcggtaagaacgcaagcgggaaaacattgcataaggtgagaacaaccattttccagtacggattacgggcccacaaggacagccagttttcggagggaaatcccaagcttgttacgggtgtgatcgtgggcaaagaggacattgctctgccattttccaggtggaagaaaatccacctccagatcagagagattgaaggctgttcagacatcgagcagaaactcaggctttatcctaagctgttgtcccgactgcatgaagctatgcaaattgaccctaagtgcacagctttggccaagaaacatctcactgattttcggctcctgaagagacggggagtggtgaagactctgccccttccaagggccgcgtga

SEQ ID NO: 10199 - RNA, 942 nt, unidentified
  source 1..942: mol_type = other RNA; note = synthetic construct
atgaagaccgctaagaagcaccgaccacttattcctctggaccgctgccacctttaccggatcggcagtccgaaagtgctggctaagcgtatcggttggaagctggacaccctagaagatttatcaatgaacgccaagtaccgcgtatttaggctcaaacggtccggaaggcaggttgaagaacctcccccgccccttcagtctctgcatcggcagatacatggttatctgtcaagaattgagacacccaactacctgcactctaatagaaaaggccgctcctatatatctaacgcaaaacctcacgtgggggcattggcgatgattaagatcgatgtgaaaaagttcttcccctctgtggaacagcacaaagtcatgcacttttttagggacgatctgaagtgtgctgctgatgtcgctgggttgctggcggccttattgtgcaaggatggcaaactccctactggctcctcaagtagccctatcattagctattacgcttataaggccatgtttgacgacatccagagtttcgccgcaaagaaccacttggtgatgacttgctacgtcgatgatataaccctcagcggagcgaatgcaacactccgccagctgcatgaggttcgaaagatcatcatgagacacgggctcagagcccataaagccaagtggttcatgggtctgggcgccaagccagtaacgggggttatggtgacaaaaaatggaattgagctgccccacagcagatggaaggccattaaagccgacctcaaggctatcaaacagtgtgccaatcgggaggaaaaactggagatctacccaaagctggtgtcgaggctgtatgaggcttcccaaatagacccaggatgtaggaaactcgcagacattcatcatcgtctttggaaagaggcactagccggcgacgtccaattagccgcatga

SEQ ID NO: 10200 - RNA, 942 nt, unidentified
  source 1..942: mol_type = other RNA; note = synthetic construct
atgtctaagacaaagaacaagactattgtgcccattcctttggaacgctctcacctctttcgtgtacgctcaatccacctgttggctaagaaactgggttttaccgtcgatggtctggagagattagccaacgacgccaaataccgtatctttaatctgaaggagtcaggaagactcgtggaggaacctccgccagtgctgcaggctctccacaggcgaatccaccggtatctcgcaaaaatcgaagtgccggagtacttacacagcgcagtcaaaggccgaagttatataaccaacgctaaggcccatgtcggggtaggccctatggtgaaaatcgacgttaagaagttctttccaagcgtccctcagcatcgggtcatgcagttcttccgagacactatgttgtgtgcggctgacgttgccgggctccttgcaaatctgctgtgtcggaacggaaggttaccaacggggtccagcgcctcacccattatttcgtattactccttcaaggcaatgttcgatgagatcgagggcctgtgcgtggctaatcagctgaccatgacctgctacgtggatgacatcacaatcagtggcgccggggctaatagggcccttctacatgacgttagacagatcattactcgcaatggactagcctcacataaagcgaaatttttcgatcaaagtagaccaaaagaggtgacaggcgtgattgtgaagggcaacggaatcgatctgccccatagcaggtggaaggccattaaagagagcataagggaagtaaagaaggcaggttccgatgaggaacggcttgcactttatcctgctctgatatctaggctccacgaagcttcccagatagacccctcctgccggcccattgccctgcatcacaaccaaaaatggcgcgaattgcgcagagcggtggttgcccactcttga

SEQ ID NO: 10201 - RNA, 963 nt, unidentified
  source 1..963: mol_type = other RNA; note = synthetic construct
atgactcgcaaaaaagctcgccgggaccttgaacctgagcagtgctggctgtacgcaattagttcccccgccgatctcgctcataggctgtccaccccgcgacataaacttaaagcttcagatttgtcccctctcgcgcgcgatactggcaattataggttgttccaaattgaagatggcaacggtaagtctagagccattcagtggcccaagagacgactccaaacattgcacgctcgggtgcacaccctgctgagcagggtagcagtccccgcctacttgtactcagccgtcagaggcaagtcctacgtcgacaacgcatctgcccacaatcctctggtcccgacaatcaagattgacgttaagaagtttttcccaagcgttagccgggctgtgatcttcgattttttcttccagcgcatgaggtgcaggagggatgtggccggcctgttagctgacattttaacatttgacgcgcatctacccacaggaggtgccgcaagcccaatcatcgcttattattcttttaagcccatgtttgacgaaatccacaaattcgcgctctctcagggcctgataatgacgtgttatgtggacgatctgactctaagtggggtacgggccagcaagaatacactccacgagatagggaagatcatctcacgaagcgggttaaaatcccataaagcccgtgctttcgcagcgagtcagccaaaagtgataacgggagtgtgtaacaccaagtcgggaagaagagtgccaaataaactgcaccttaagattaagaaggggttcgatgacctgaccgccgccaaaactcctctggagatcaaccggatcgcccagccacttctgggaagactccgggcagcaggtcagatagaccccaaatttcgtgctcgcgctgacaccgtttctgccaacattgccgcaagttcagtgcaaaccaagacttccccttga

SEQ ID NO: 10202 - RNA, 993 nt, unidentified
  source 1..993: mol_type = other RNA; note = synthetic construct
atgacgagctgcgagctggtcgatcccatgcgaaaaaagcccaggaccgatctcccgctcagcgactgctggctgtcagcgatcgactcaccatccacgctggcgcggcgtttatctaccccaggccataagttgtgcgttgatgatctctcttcttttgccagagacacagggaattacaggttgttccctatctttaacgagaaggggaaggcaagaccgatacagtggccaaagcgcagactgcagggagtgcatgcgcggattcataagttgctatcacgggtcgctgtgcccaagtacctgcactcggccgtgagggggaaaagttatatctccaacgccgcagctcacgaccctaaaatgccaactatcaagatcgatgtgaaaaagttcttcccctctgtctcccgagttgtcatctttaactttttcgcaggaccgcttaaatgtcggcgtgacgtggcaggccttttggccgatattctgacttttgacgcccacctgcctaccggaagcgcagctagccccattatcgcttactattccttcaaaccaatgtttgacgaaattgcccagttcgccgagagtctcggtctgactatgacctgttatgttgatgacatggcactatcaggaccccgcgccaataaaggggtgctgtatgcaataaggggcattattgcaagacacggtttaaaaagtcacaaggcccacacattcagcggattacaacccaaggtagtgacaggcgtctgtaacaccgctgccggtcctagggtacctaataagctgcatctcaagatcaagaacggcttcgacgctcttgccaaggcacagaatgcggtggaggaaggcaaaatactccgcccacttctgggcagaatggaggccgctgctcaaattgaccctgcctttaaagcccgagctaagacagttcgggctaagtactcccgccctaaagatgtggggggtctggaaaaaatcgaatga

SEQ ID NO: 10203 - RNA, 966 nt, unidentified
  source 1..966: mol_type = other RNA; note = synthetic construct
atgctagagatttccgattgttggctatcagcgatcccatctcctgctatactggcagcccgcttatcaactgatgcaaacaagttaacagttgccacgcttcaagagttgactaaggacgacggcaactttagagtgtttcccctggtgggaaacaatggtaaggtacgcataattcaggagccaaaacgccagctgcagaggattcatagtagagtccacactctgctgtcccgggtgatggctcccgattatctgtattctgctgttaagggaaggagctacgtcggcaatgcccaggcccacgatcctaatcaccctaccgtgaaagtcgatatcaagaatttcttcccgtccatccctcgggtagctgtgtacaacttcttccaccggcagcttaaatgtcgcgtcgacgttgcagggattctcgccgacctgctgacgtacgatggccatctcgccacagggtcagccgcaagcccaattctcgcttactacagctacgaagctttgtttgacgaagtgcatgagtttgccaaggccaggggtctgaagatgacatgttacgtggacgacatggcattatccggaccaggagcagacaagagcaccctctatgaagtcaaaaaaatcatagcccgacacggcctgagatctcataaggctcatgcgttttcgtctgctcagccaaaagtgatcacaggtgtctgcaataccgtgagtggcccgcgtgtacccaaccgactgcaccttaaaatcaaaaacgggttcgatgccttggcctccgcaagtacccaaagcgaaaagctgaaagcactcaatccccttattggcagactcgaggccgccgcccagatcgaacccatctataaggcacgggtggcgactttgcgtgcggattatgccgacgttctcctgaccgctagaaggcccgtgtgcgctgagcctgcttgcgttgtggggtga

SEQ ID NO: 10204 - RNA, 930 nt, unidentified
  source 1..930: mol_type = other RNA; note = synthetic construct
atgaataaaagacggaccaacctgaagctcagtgactgttggctatacgcacttgccagtcccacggatcttgcgcgccggttgcagactgcaaagcatccaataaaggtggctgagctgagcatgctcgctaaagatgccggaaactttcggctgttctcccagaccaatgcggccggcaaatctcgacagattcaagaaccaaagaggcgcctgcagtgggttcacgggaggatccacgcattgttgagtcgcgtggaggtgccaggttacctccactctgcagttaggggaagatcttatatctcaaatgctgctgctcatgatccaagcatgcctacctttaaggtcgacgttaagaagttctttgccagcgtgccccggtccgccatcttcaatttcttcgtcggccccatgaagtgcaggagagatgtggcccgtttactggccgacattcttacctttgacgcccaccttcccacaggttcagcagcctcgccgatcctggccttttacgcgtttaaaccaatgtttgatgagatagagcagttcgcactggcccacggtctgactatgacatgttatgtggatgacatggcactgtctggaccccgcgccaacaagtccaccctgttcgaagtgaggaagatcatcgcacgacatggcctcaagagccacaaggcccatgtgttcggcgctaaccaacctaaagtcctaacaggcgtatgcaacacacctacgggacctagagtcccgaataaactgcatatgaaaattaaggctggcttcgacaaactcctcgccgctaccacacctgacactagatcagaagctctgcgacccctgttagggaggttggaggcagccgggcagattgaccctgggtttcgggcgcgtgccttaactgtacgcgctgcttattccaaatga

SEQ ID NO: 10205 - RNA, 969 nt, unidentified
  source 1..969: mol_type = other RNA; note = synthetic construct
atgactattgctggcccagtgaagctcaggcggagaaaacgggcccgcttggatctgaaactgtctgagtgtggactgtacgcactggccagtccggctcacttggctgggatactcagtacacctggctgcaagttttcagtcgaagagctccagggactgagccgcgatgaggggaatttccgcctatttgacctggtgtcagacggaggcaaggcgcgtaggatcgaatggcctaaacgcaggctgcagcaggtccagcggcgcattcacgtgctcctgtcaagggtggaagtgccagactacctccactcagctgtacgtgggaagagctatctcaccaacgccgccgtgcactccgcagagatgccaacagtgaagctggacgtcaagaaattttttgtgtccgtccccagagttgcggtattcaacttcttcgcaacaaccatgaaatgcaggccggacgttgcaggcctgctcagtgatctgttgacttttgatgcacatcttcccaccggcggggcagcctctcctatcatggcgtattatgcttttaagagcctgttcgacgagatatacgctttcgccagctctcaaaatgtcactatgacctgctacgtggacgatatgaccttctctggtggagccgttggcaagcggttcttgtatgaagtgcgacggatcgttgccaggcatgggttaaagtcccacaagtccagaatgtttgatgccagacagcccaaggtcgtgacgggtgtgtgtaatacgacagatggtgccagagttcccaacaaacttcatgcgaaaatcaaagacggattcgataagctttcgaaggctgacggatccgcccagaaagccaagattcttcctccactgctaggccgattagaggctgcagggcaaatcgaccccagatttaaagcccgagccgtaactttacgggctgcacatcagagcggccgttga

SEQ ID NO: 10206 - RNA, 969 nt, unidentified
  source 1..969: mol_type = other RNA; note = synthetic construct
atggcccctaaaaacaaggcctcattgcgcattgaggactgctggctgtttgctgtagcgagcaaagaagacctcgctcggaggctcagcaccgatagacaaaaaataagcgtgagtgatctcgagaggttaagcgcagacgcagggaattatagattattctccatccgccagggcacaaaagaacgacctgttcaggaaccaaagcgcgaattgcagcagattcatgccagaatccatagactgctgtccagggtggttgtcccagaatatcttcattccgccgtgaaggggaaatcatatttgacgaatgccagagagcatggacacggaatttctataatcaagatcgacgtgaagaagttttttccatcagtgccgcggttcagggtgttcacctttttcaagatagtcatgaagtgtcggaaggacgtctctgggctgctggctgacctgatcactttcgatcagcgtctccccactggatctagtgcttctcccatcattgcttactacgccttcaaacccatgtttgacgagatttcacggtttgcagagtctgcaggcctcaagatgagttgttacgttgacgatatgactttttctggctcgaatgctaacagatttaatctgtacgagatccacaagatcatttcaaagtatgggctgaagtcccacaaaatgaaatacttcgtggatcaggagccaaagatcattaccggtgtctgcaacacacctagtggagagcgtgtcccgaacaaactgcacctgaaaattagcataggcttcgaggaactacgcgccgcaaaatcccacacaagcgccgtaaagttgctgcgaccccttcttggcaggctcgatgcggcaggccaaatcgatcctcgtttccgggctcgggccctaacccttcgatccacattcaagaccaaatcccgcattagcaacggtgccatcaagggtagggtgtga

SEQ ID NO: 10207 - RNA, 933 nt, unidentified
  source 1..933: mol_type = other RNA; note = synthetic construct
atgcgtaaacgccgcaatgacctcaggttagacgagtgttttctgttcgctatcgagagccccagggacctggctaggagactcagcacaaagtctatgcagttttcggaggcagatctactgggactgagtgccggcatcatagggaattacaagctgtttaagatcgatgggcgcccaatccaggaacctaaacggcggctccaggctgtgcacttgcgagtgcacagactgctctccaaagtggcagtccccgagtatctccattccgccgtcaggggccgttcctacatttctaatgctgccgcacacgcacgcgatgagccagtgattaagatcgatatcaagaagttcttcgcttctgtgcctcacgccgccattttgcgatttctgagaacctcactgaggtgccggtcagacgtcgctaagcttctggccaatcttctgacctttgagggaaagatacccactggctctagcgccagtccgatcctggcctattacgccttcaagcctatgtttgatgaaatatccgcattggcgacgtcattaggtctgaccttcacatgctacgttgacgacatgacgttcagcggtcgtgccgccacaaacagcactttgatgcagatccggactattgtagcgcggtatggtctaaagtctcataaagttcgaaagttctcagctaacgatcccaaagtgatcacaggagtttgtgtcgcgtccgaaggcgacagaataccaaacaagctccatcggaaaattgcagccgacttcaaaagcctcgaagtaggggatgaaggcatgcagagagagaaaaccctgtccagtcttttggggaggttacaagctgctggacgcattaaccctgtgtttaaagcacgagcaagcacccttagagcgtcggccagtcgcagaaggcaatctatttga

SEQ ID NO: 10208 - RNA, 933 nt, unidentified
  source 1..933: mol_type = other RNA; note = synthetic construct
atgaaaaaaattaggagagatcttcgactcaacgaatgctttctgtatgccatagatagcccggccgaccttgcatggaggctcagttctaaggctatgaagctggacgccaaggatatcgacttcctcgttagagggagcgccaactacaaattctttaagatcaaggatcggcctattcaagagccaaaggcgaggcttcaggcagtgcatttacgggtacataggttgctgtctcgcgtcgctgttccagcctatctgcactctgcggtgaaggggaaaagctacctaagtaatgcactggctcacgatgcctcccagcccctgatcaaggtggatatcaagaagttttttgctagcgtccccgaagacgcagtggtccggttcctgagatcagactgtaaatgtaggagtgacgtcgcgcgcctcttcgcatccatgttggtctgtaatgggaagattgctaccggttcatccgcctcacccattctggcctactacgcattcaaatccatgtttgatcagatcgcaactcttgccggcgagcacggactgactttcacctgctatgtggatgacatgacactgagcggacctaccgccacaaatgccatggtgattaaggttcgagctatcattgctaaattcggcctgaagagccataaggtgcgtcgattcaacgcctcctctccaaaggtggttacgggcgtatgcatcatgccagacggcatacgcgtgcctcagaagctccacttagcgatttcgagaaactttcaggaaagaagcaccgagacagacacaaaaaaacgcgagaaaataacggccagtctacagggacgtttggacgccgctggtcggatcgacgctaaattcaagtctcgggcagatacttttcgcgcttccaccaaaaaagcccaaccttcagtgccctga

SEQ ID NO: 10209 - RNA, 960 nt, unidentified
  source 1..960: mol_type = other RNA; note = synthetic construct
atgaagaggtatgcactggaccaatctccatttttcaaactaaagagtcgacaaaagctgtcaaaaatattggacgctgatcttaatgagctggaggtttttgctagaaatgaccccgtcgataactataaattgttcgaaacatctggcggtaaacctcgacccgtgcagtgccctaagcatagattacaggtgattcacagaagggtctgtgatctgctggcgcgtattgatactccagattacctgcactcagccattaaaggccacagctacttatccaacgccaaagcccatgccgctaatgtgccgatggtcaaagttgacatcaagaagttttttccctccgtaaccatcaacgctgtcaagcgcttttttcttaaaactatggaatgctcacctgatgtggctgccctccttagtaaagtgctgaccgtttacggccatctggcaaccgggtcatccgtgtccccaatcctctcctattacgcacaccgcgacatgttcgaagagatcgctcatttgagcgcgggaaggggcgcagtgatgacctgttacgttgacgatatgtgcttctcgggagagacagtaacacggaagttcctaagcgatgtaagagtcattatacggagccacggcctcaagtctcataagatccactatttctcatccaatatgccccgcattgtgacaggtgtggtcgtgactaacagcgggattaaactccctaacatacgtcacaagaagatcgtggacggatacgcccagttgcaggccgctctgtctgacgaggaaaagcttaaactgctgccgagcctcatagggcggatcaatgaagcagcacagattgaccctcgctggacccccaaggccaaacagctcacgctggagatgaagaggatcagctctatcgcggccagtagtatgaacccaagctcccggccatctagttgggcctga

SEQ ID NO: 10210 - RNA, 939 nt, unidentified
  source 1..939: mol_type = other RNA; note = synthetic construct
atgaaccgacatcctctcaaccaaagcccgttcttcaagttacggtctaggaaaaaactcgcgaacattctcggactgggtctgaaggatcttgaagtgttcgcgcagaatgaagccgatgagaattacagactgttcgagatcagaagaggcgggaaagctcggcctatccaatggcctatcccctgcctgcagcgcatccacaaaagggtgtgcgacctattggcccggatcgagacgcccaattatcttcactcagctataaaaggtcggtcttatctttccaatgccaaggctcacagtggcgatacagccttggtgaaggtggacatacgtaagttttttccttcggtcactgtacagagcgttaaaagcttcttcttaaagaccatgggatgtagcccagatgtcgccgcagtcctgtccaaagtcctgaccgtatacggacatttgccgaccggcagtagtgtgtccccaatcttatctttctatgctcatctggatatgttcggggagatagaacagctggcccgtaagagaggggcagttatgacatgttacgtggacgatatgtgtttttcagggaggtcagtgacacgcaagtttctctatgaagtgagactgatcattcaccgccacggcttgaagacccataaaattcactgctttgcacccggcgttccacggattgtcactggggtggtggttactggagacggcatgaagctgccaaacaagaggcatcaggccatcgccgaggacttcgctaaatttcaatcctcactcgacgagaaacagaagctaaagatttttcagtccctgctgggccgcgtaaatgaggcaagccaaattgagccccgatggaagaacaaagcaacatctctttgtcaggaagtgaacaagatgctctactgcggaaggcagaatgacggttgctga

SEQ ID NO: 10211 - RNA, 906 nt, unidentified
  source 1..906: mol_type = other RNA; note = synthetic construct
atggccctacacgcactaaaccagtctcaactctacaaggttatgtcgcccgcagaccttgccagaaggctgggcatcttggccgaagacctggaggaactggcgaacaggaccgacaactataaacgctttaaagtaggggcccagaagaagcgccacgtgcaggagccaaaggaccggctgaaacaggcgcacaataaggtgaccagatggctcagcaggatagagacacctgattacctgcattcagccgtacggggccgttcttatatcacgaatgctgccgtgcactccgctgattccaacctggtcaaagtggatatcagatcatttttccagaatgtcactacgcacgccgtctatttattcttcgctaagaccatgaagtgtcgaggtgacgtggcaatgctcctggccaaactccttactgttgacggccatttgcccacagggtcatctgtgtcccccatactttcctatttcgctcataagccgatgtttgatgaaatcgccaagctggcatctcacgtggatctgcgcttcacagtttacgtggatgacgtctgcctcagtggggagaaagctagcaggagtgtactcttccaggtgcgcggaattattgcaaagcatggactgaagagccataaatgccacttctttccaacaggagtgccaagggttgtcaccggaaatgctctgacccttggcggtgtgcggttacctcatgttcggcacctgaaaattaagaaggcctttgacgaactggataaaatggcagaggggcccgcccgtgagaaggctttgaaagccttaaaaagccggctctacgaggctgcacagttggaacctgtctggggtgcccgagcgagaagcctgtttggcagaaaggctcaagtgactagttga

SEQ ID NO: 10212 - RNA, 951 nt, unidentified
  source 1..951: mol_type = other RNA; note = synthetic construct
atgaagaattaccccatcgatcagagccctctctacaagctccattctaaacgaaaattggagaacatcctgtgcaccaatctggatatcgagaagatggcaaactatgagggtaagaacttcaagttcttctatattacccaggggaataaaaagagaaaggtcgagtccccaatccctgagatacaagagcttcatcggaagattgctcgcttgctgtgccgcatcgacccacccgattacctctatagtgctactaaaaagaggtcctacttgagtaacgcccagcggcacattggccgacacgccttgatcaaggtggacatttccaagttttttccgtccgtgtcccggctcaaagtgtataactttttcaggttcaagatgaagtgctctcccgacgtgtctgccattattgccaaacttttaaccgtcgatgggcacctggctactgggagctctgccagccctatactgagctattacgcaaatatcgatatgttcgaggagctctaccttctggcaaaaaatcgctcagctaccatgacgtgttacatcgacgatgtgtgtttttctggtgaacacgtctcaaagaagctactttacgaagtacagaagataatccgcagacacggatacgtgaaccataaacaaaaagcccggtattacagtcctggcgaagtgaagttgatcacaggcgttgccgttacaagcctgggagttagattaccactaagacgtcatagggccattcgagacggctatacacacatttttaccgcaaaaactgactccgataggctgacacagctggaaaaacaggtaggacggctgtttgaagcctcgcagatagacccaagtttcaaagacaaggctaaacgcgcgtcacaagctagggcaaatctcaaacgtagactgctgagcaaggcgttccatcccagctcaccgtga

SEQ ID NO: 10213 - RNA, 921 nt, unidentified
  source 1..921: mol_type = other RNA; note = synthetic construct
atgaatacgcataaaagggtaccgctcaagggatctgcacttttccgactaacgtctcccagacggttagccgagatgttgctggtgccaagggctactttagagcgcctagtggaagcaggcgacgataactatctggtcagaccagatcgaaagtccgggcgtattatcgaggagcccaaacctcagcttaagctgatacatcaaagatttgctagactcctggcccagatcgaaacaccagactacctccacagcggggtgaaggggcggagctacataaccaatgcaaatgcacacggagccgatgacgcgtgtgtgaagctcgacattaaaaagttcttcccctcctcttccagccatcacgtccaacgcttttttgaagatgtgttggaatacccccctgatgttgcttcacgcgccaaacagctcctgacccatgatggccacctgccgacaggagggaacgcttcaccaattctgagtttttgggcatacaagcctatgtttgacgagatcgacacccttgctcgcgagaatgactgcgaattcaccctgtatgtagatgatatgtcgattacaggagtcttcgcaaaccgcaagttccagcaggctgcccggaagatcatagcgaggtatggccttcgcgcccacaaggccaaaacttttagcccaaaccagcccagggtgctgactggcatcgccaagaccaggagaggtagggaggttcctcaccgtcgtgccaaaggtattgcccagctggagcaacaggaggccgaggcagaaacaaccgccgacaagctgcgggttatgcctagtttgatcggtaaattgtcagaagcggctatcgtcgacccctcctggactgctcggaaaaacgctgccgtgcagcggagacgaaagatgaaagcgagtggctga

SEQ ID NO: 10214 - RNA, 939 nt, unidentified
  source 1..939: mol_type = other RNA; note = synthetic construct
atgagcatgtctaagcataaacgcattgccctgaagggctcagcgctctttcggctcacatcacctaggcggctggctgaggtcctgctactttcaagaagtgccctggaacgcctcattgtggcgggggacaccaattatattgttcgcttcgatcagaagtcaggccgaatcattgaggaacccaaaccccaattaaagttgatacagaagagatttgcccgacttctgagccaaatcgagacacccaattatctgcatagcggagtgaagggtaggtcctacataacaaatgccgatgcccacgaagccaaccaatcctgcgttaagctcgatatcaaaaagttctttccatctagcaactcccaccacgtgcagcgctttttcgaggatgtcctggaatacccgccagatgtagctgcccgtgccaaacagctgctgacttatggaggtcatttgcctaccggtgggaacgcatctacgattttgagtttctgggtgtataaacccatgtttgacgaaattgaggctctgtcccggcagcacaattgtaagttcactctttacgtggacgacatcagcataactgggttgtttgctaacagaaggtgccaacaggctgtgcggaaaatcgtgagccggtacggccttagaactcataagaccaaagcattctctgccgggcagcctagagttctgacaggagtcgccaaaacccggaggggccgagaattacctcacagacgcgctaaaggcatcgcagagttagaacagctagagacagccaccgattcgacggcgaaaaagatgaagctcctgtccactctgattggcaaactgagtgaggcaaccatcatcgacccactctgggcaggacgcaaagaggcagctgtaaagaggaggagaaagctcaagcaggaggacaggatcaagcgttga

SEQ ID NO: 10215 - RNA, 942 nt, unidentified
  source 1..942: mol_type = other RNA; note = synthetic construct
atgtcaacccacaaacgggtgcccctgaaggccagcgctctttttaggctcacaagccccagaaggttggctaacatacttatggtcacccccactgcccttgagcgcctggtacgctggggagatgaaaactatttggtgcgacctctcgcccaggtcgaaggtaaggcgcccagaatgattgaagagcctaagccacagcttaagctaattcaccagaggttcgcccgactgctggcccagattgaaactcccgactacctgcattctggcgtgaaggggcggtcctacataaccaatgccaacgcacatacagcagacaaggcttgcatcaaactcgatatcaaaaagttcttcccaagcagtagctcgcactacgtgcagcgctttttcgaggatgtactagaatatccacctgacgttgcggcaagggcaaagcaactgttgacgtacgacggccatctgccgacaggcgggaatgcttctaccatcatgtctttctgggcctataagccgatgtttgatgaaatcgccgccttagcagtcgagctcggctgcgagtttaccgtctacgtggatgatatgtccatcacgggcgtgttcgctaaccgcaaatgtcaacaggccgctaggaaaatcatcgcacggtatgggctgaaagcgcacaaagccaattcattttcaccaggccaacccagagttctgactggtattgctaagactcgacgggggagggaagttcctcaccgtcgtgccaaaggtattgccgagttggagcaggtggaagcagccgcaagtaccgtggaggacaagatgaaagtgctgccttccctgattggaaagctcagtgaggctgcaatagtggacccatcctggacaggaagaaaagacgctgcggtccatagacggcgcagattaaaggttggagccggggctgagtga

SEQ ID NO: 10216 - RNA, 927 nt, unidentified
  source 1..927: mol_type = other RNA; note = synthetic construct
atgagcacacacaagagagtgcctctgcgcggaagcgcggtatttaagctgacctctccgcgccgtttagcagagatgctcctcattccccgaagtacccttgaacgcctgctcgatttcggcgatagcaactacctggtcagacatgacagaaaatccaaccgcacaattgaggaacctaaacctcagctgaagttggttcagcaaaggttcgctcgactgttagcccaaatcgaaacgccagattacctacactcaggggtgaaaggtcggtcatacatcacgaatgcaaatcaacatggggccgagcaggcctgtattaaattggacgtgcagaaatttttcccatcttcaagttcccattacgtgcagaggttctttgaggaaacccttgaatatcctgctgacgtagcctctagggcccggaggctgctcacttacgatggccacctccccacaggaggaaatgcttcaactatcctgagtttctgggcctataagccaatgtttgacgagatcgatgctgcggctaagagactcggctgcgagtttaccctgtatgtcgacgacatgagcatcaccggcaagttcgccaatagagaactgcagcgggaggcggccaagattgtggcactttatggattgcggactcacaagctgaagaacttttcgcccggccagccacgagttctgacaggagtcgccaaaacaaaaagggggcgggaggtgccccataggagagctaaaggcatagcagatttagagcaggaagaagccagcgctaccactgcagtggagaaactgagactgttgccgtcccttatcggtaagctctctgaggccgcagtcgttgactccagttggagcggtaggaagaacgctatggtgctacaccggcgtcgcttgaaggcagggatatcccgctga

SEQ ID NO: 10217 - RNA, 966 nt, unidentified
  source 1..966: mol_type = other RNA; note = synthetic construct
atggcaaggcggtgcgccaaaagagttagccttaggggctctgctcttttcaagcttaccagccccgcccgtctggcccacatactgtgcatctctcctggccagctggcgtacttggtgcgcaacgctgaagccaactacctcgttaggacagatagaaaaactggcagactgatcgaggagcccaaggcactgctgaagcaggtgcacgcacgcgtggcaaaactgctccagcagattgaaactccagactatctgcattcgggggtaaggcagcgcagctatgtgactaacgcttcacaacatggagcaaaggactctgcggtcaaattggacattaaaaagtttttcccgagtgtgcgtgcagctgccgtgtattcatttttccacgaactcatggaataccccgcagacgtcgctagccgcatgactaggctactgacaatcggtggacatttaccgacaggcgggaacgccagttgtatcctgtctttctgggcctacaagccaatgtttgatgagattgccgagctagccgtggccaagtcctgtgcctttaccttgtatgtcgacgacatgaccatcagcggcaggttcgcctcccgcagtatgcaacaggcagctcggcagattgtaggcagacatcgattgagagcccacaagaataaagtgtttgtccctaatcagccacgcgtggtaacaggggttgctgtgacagtccggggactggagttacctaatcgacgggccaaggcgattgatgatgccacccaagttgtgactcacaccgccgatgggtccgcgaaattagctctgcttcctgtgctcatcgggcgggtttcagaggctgcagaaatcgatcccgcgtggaacggaaggaagacggccgctgtcaatctcagacggacgctcaccggcagaatagctaccgcttcccgacctggtggaggtgagccacccgcatga

SEQ ID NO: 10218 - RNA, 939 nt, unidentified
  source 1..939: mol_type = other RNA; note = synthetic construct
atgaaaggaaaaccacacaaacgtgtcagcttgcgcggctcagcactgtttaagctaacttctcccgtacggctagcacagatattgtgcatccccccagctcaacttgaccgtctgttaagacggggcaataccaactactgcgtgcggaccgatcgaaagaccgaaagactgattgaggagcctaaggccctcttaaagcaagtccatgctagggtcgctcatttgctcgctcaggtggagacgccagcctatctccacagtggaatcaagaagcactcctacatcactaacgcggcagaacacagggtggaaggtggtgccgtgaaactggatgtgcagaagtttttcccttctgtccgagctgcggccgtttgtcattttttcgccgacgtgatggagtatcctatggatgtggctagtagaatgacaaagctgctgaccattaacggacatcttccgactggcgggaatgccagctgtatcctgtcgttctgggcctataaaaacatgtttgacgagattgcagcactggccgcagccaagggctgcactttcacactctacgtggatgacatgaccatcacagggcagtttgccacacgagccatgcagaaggaagcgcgcgccatcattgggcgctaccggcttaaagctcacaaaaccaagatattcagccacaggcagcccagaatagtaacaggagttgcaattaccgcccgcggcccagaactgcccaataggagggcacgcaagattgcgatcacaatggccggagtagaggccgctgccactgactcacagaggctcgccctgatgccttccctgattggtagagtctctgaggctgttgaggttgatccgctttgggcagggcggaaagcagctgctgtgggcatgcggagaacgatcaggtcccgcgtggaaaaaagcagatga

SEQ ID NO: 10219 - RNA, 912 nt, unidentified
  source 1..912: mol_type = other RNA; note = synthetic construct
atgtctcacgatagaaatcagagcatcctgtataaagttacatcacctcagatgcttgctgataggctactcataagtcggggggagttgcacgcacttctggctaacgcggatccttacaaacgctggatcgataagaagtccggacgcgcgattcaggaacctcggccaaagctggctaaagtgcatcgacgcattgcaactctgctcacacgtatcgatactccagcctacctgcatagcgccaagaaggggaggtcttacatctccaatgctgccgctcattccgttgacgacggatgcgtcaagattgacgtgcgtagattctatccttcagcgcgggctcaggctgtgtaccacttgtttctggatcggatggcttgtgacggcgacgtagccggaatgcttgcaaagctcctgacggtcgacggtcacctgcccacaggttcgagcgcaagtcccattttgagctattttgcgtatgaggacctgttccacgagcttgccgtcttagccgaggcctccggatgcaagatgactgtgtacgtcgatgacatagtgtttaccggcgcaggcgccacccgaaggctcttattcgaagctagaaaggcaatcgggaaaagacatctacacgggcataagaccaaactgtttcgaccaggccaaccccgcattgtgaccggtgtcgccgtgacaaacaatggccttcgattgccgaaccgccgccaggtgaggatagcagaggaccaaaaactgttcgatgacttgcccctcggacgtgagaaactcattgttgcccggagactcaccggcaggctgttcgaagcctctcagatcgatgcaggctggagagtaagggccgaagccatggccgctctgagagacgatatccagaggaaaatcgggcggtga

SEQ ID NO: 10220 - RNA, 909 nt, unidentified
  source 1..909: mol_type = other RNA; note = synthetic construct
atgtcttatccacgcaatcagtccatcttctacaaaattacctctccccaaatgcttgccgatagactccgggtgaccctggacgaactcaatgaactctgtgctgcctccgataattataaaagatggacggacaagaagaccggccggccgattcaggaacctaagcccaaactggacaaaatacacaaacgggtggctgccttactggccaagatggagacacctgattacttgcatagcgccattaaggggaaatcgtatatcacaaacgcctcaggacattctgtgggcacaggatgcgtgaagatagacgtcaggaagttctatcccagtgtcagatcacaggctgtacaccatttctttctcgatcgaatgctgtgtactggcgatgtggcagggatcctgaccaaactactgaccgttgacgggcacctccctacgggctcttcatccagcccaatcctgtcctattttgcctacgaggacatgttcgaggcgttggccgctttggccaaggcgaacggctgcattatgacagtatacgtcgatgatgtggtgttcacaggtaccggggctactaggggtcttttgtacgctgcacgtaaggtctttgcaagttaccggttatacggccacaagaccaaactgttccgcccaggacagcctcgcatcattacaggtgtggccgtcactaaagagggaatgaagctgcccaacaaacgccagcgaggaattgccgatgacctagcaacttttgacagccttccgaacggcagggagaagcttgttgttgctagaaggctgactgggcgtctctttgaggctagccaaatagacccagcatggagaagcaaggcggaagcaatggcagccgaaagggacagtctgcagcggatcatctcctga

SEQ ID NO: 10221 - RNA, 927 nt, unidentified
  source 1..927: mol_type = other RNA; note = synthetic construct
atgccagagaggaggagttatccgagggatcagagcaggctttacaaagttaaatcaccagcccagctggcggacatcttctttctgcagcctcacgagctggatcttcttctcgacgccaatgagaattatatccgctggaccgacaaaaagaccggacgagaaatccagcgccccaaaccactgttggaaaaggtccaccggagggccggcatgctgctaagcagaatcgaaactcccgattttctacatagtgcgataaaaggtcgatcttacattagcaacgcacaaagacatatgcccgatgaacccacagctaagattgatgttcgcaagttctacccttccgcccgggcacaggctgtattccacttcttcagagacaggatgttatgcgacggggacgtggccggtatgttggcacggttgctcacggtggacggacaccttgctaccggttcctccgtctctccaatcctgagcttttttgcatatgaagacatgttcacagacattgaggctttggcaattgagagaggatgcgaaatgacgtgttacgtggacgatatggtgtttaccgggcccggcgccacaagacggctgatttacgatataattcagattgtgcggcagtatcggctctggggccataaaactaagctgtttaagcctggccaacctaaggttataactggggtagcagtgatccgcgtgggacaaagactgccgaaccgtcggcagaagaccatcgctgatgaaatggatgtcctgaaatcgactagagatgacgctgagcgactcgccatcatccgtcgcctcctgggccgattatacgaggcggcccaggtggactcttcatggtatgtcacagccgatgctatggccgacgagaagcgcgggttagagcgtagatccgccagggcttga

SEQ ID NO: 10222 - RNA, 1029 nt, unidentified
  source 1..1029: mol_type = other RNA; note = synthetic construct
atgaatatgcccaaagctaagtcaagtaaaaaactgaagctggaggagtgcttcctgcacagtgtggcgtctcctgtggaccttgcaaggcggctcctcatagatcttccagacttagagagactcgcaaacgctgaccataggtttaagcaatggacaaccaaaaaagggagaaagattcaggagccggttcgcgaactccaagtcgtgcatggtcgcgtcatgagactactatcagcagtcgaaccacctttatatctgtattccgccgttgcaggccgcagctacattaccaacgcacgtcagcatgtcggagcttatccgaccgtaaagctcgatctgcagaaattcttccccagcgtgaagcgggcagctatccggaatttctttgtcagggagatgaagtgtgccggggacgtggcgagtatcttggcgaagattcttacatgcaacggcgccttacccactggcagcagggcttccagcataatgtccttttacgccttcaaatccatgttcgatgagttgggcgacctggccatcgccaataactgcacaatgaccgtctatgtagacgatatcgccatttcaggtgaaggagctcgacctcggctcctggttaaggctcgtagaatcatcgcccgatacgggctgaagtcgcacaaaactaagttttttcaggcattgcaggcacgcataattaccggggtggtggtagacccagcgggaattgcattgccccactccaggagggttcagatcgaaagaggccttgccgtgctcgcggctgaatgtgacccaaagtggaagctggagatcctgacacgcctggtgtctcgtgtgtacgaggctgcccagattgcccccgctgaatttctggccctggccactgagcttagcaaggcccgggcagagttgctaaaaaaagccagtgaactggctgtggccagcgttgctcctgatcggcgctcccacctgcgactcgtgcactctgatgcctcaacgtctgatagagtcgcctctccttga

SEQ ID NO: 10223 - RNA, 1017 nt, unidentified
  source 1..1017: mol_type = other RNA; note = synthetic construct
atgacacactacaggaaatcatatgcgatctcaaattcaccctttttcaagctgtccagtaagaagaaattgtctgaacttttgggagtgagcttacacacgattaccgacattcgccaaagcgggctacacagacagtaccgtatctttaaggataaaaagacgagacgccttatcactgagccagttggcgagcttctgagggtgcacaaaaaaatcttaaagctgttcaaacggatccagccacccgcctacctgcatagcgccataaagaaaagaagctacaagaccaatgccgaggctcatctgcagaaccggaggaccctgaaaatcgacctcaagaaattctttccctccatcaggtttcaccacgtctacggcttctttctgaagaacatgcagtgtagctccgatattgcgaccattcttgcaaatctgtgtaccgcagacaccaaatctcatggcacccacctccctactggttcgtgcataagtcctctgctgtcctattggattaaccagaacctctttgaccaacttcatgatatcacatctcaggaagggtgccatatgacattgtacgtggatgacattactatttccggagaaaaagccacacccgaattcctgaataagatagcaatagccatcaactctcacggttataagtaccacaaagttgcctgctatggcaatggagtagctacaatcactggattgatcgtcaatgaaggcaagctagagctgcctcatgtgagggcccagaagatcagacgtctggaaaaggaattgatggaggccgagaatgatatcgatcggaagagaattctgaacagtttaatgggccggctcactgaggcagagcagattgtgccagcatataccgctaaaaagaacgagatcatgaaactcttcaagaacatttggggggacattgtccagcaacgcgctcaacgagctcagctcaagcgccgaatcaagaaacagccggtgctcgccgacatagctgggggttga

SEQ ID NO: 10224 - RNA, 1014 nt, unidentified
  source 1..1014: mol_type = other RNA; note = synthetic construct
atgatgaccagccggagaagcaaaaccccccacagatatgagattgagttcagccccctgtaccgcctgtcaaataagaaaaaacttgccgcactcctgaacgtggacgtgtccattatatcttcaccggataagtctaagctgtgctcacagtataggatctttgtcgacaagaaaaccaagcgatttattacagaaccaatcggagatcttttggctattcaccagcgcttactgaagttcttcagcaggatcgcacctcccgaatacatacacagcgctatcaaaaaacgctcttatctgactaatgccgaggcccaccggaaatcttcaaatatcctcaagatcgatatcaagaagtttttcccctccattaagttccaatgtatctacggttttttcctgaataccctcaagtgttcctctgatatcgctactattttagccaagatctgcacagttcagacaaacaattatggtacgcacctcccaactgggtcctgcatttccccaatcctaagttttttggcaaaccagcaactttttgactccatcaagattatttgcgagaaggaaaaatgtaagttgacactgtatgttgacgacatcaccatcagtggggaaaacgcttcaccagctttactcacgctcattgccatggagatcttcaaacatggctacggataccataagattaagatctacaaggatcagcctgccattataactgggctggtggtctacaacaaaaaagtgtgtctgcctcatgagagagccaagaagattagggagctgatcgatgctctgaaaataagcgtgggccctttgcggcagaagatgctggcgagtcttgtaggcagactaagtgaagcagagcatatagaaagtcaatataaagcgaagcgtgtctccatcatatctcagtaccggaaagagtgggacgaagtagtggccaatcgaaattcgaagtgcaaagttagcaggaacaaaaaattggcaaaaaacaacacctga

SEQ ID NO: 10225 - RNA, 1002 nt, unidentified
  source 1..1002: mol_type = other RNA; note = synthetic construct
atgacgaaaaatcccacacggggttccaaaaaatacgacctggagagctccccactgtacaggctaagcaacaaacggaagctggcggatcttctcggcgtggagccatcgaaaattctcggactgaagaagtccgcaatttgctctcagtacaagatattcaaggacaaacagacttctcgctttattaccgaaccccactccgacctgctgctagtgcacagaaggttgctggacctcctcacccgcattcagtgtcctccctatttgcactccgccagaaaaaaacacagttacaagactaacgcggaggcccatcaacacagctctgccgttctgaagatcgacatacgaaaattttttcccagcgtgaaattccattatgtttacgacttcttcaagaatgagatgtcttgcgctcctgatatctccactatcctcgctaaattgtgtacagtgactaccctgaagtttggcattcatctgcctactggttcatgcatcagcccacttctcagctttctggtcaataaggtcatgtttgatgaaatcgacgctctgtgcagagcccacgactgtaagttcacactttacgtggatgatatgacgatttccggcgataaggccagcagagctctgttaacatcgatcgcaatgatcatacatagattcggctatgggtaccacaagatcaagacctaccaccaggtaccgaccgtgatcacagggctcgttgtgtataagggaatgttaaggctgccacatcggagggcaaagctcgttcgtgtggcatcacaagccctggcccaggccgtcagtggcagtatgcgcaagaagctgttagggagtttgataggacgcttgtcagaggctgaacagattaaccctctatataaggtaaggaaggaggtccttctgacacggtataaatctgaatggcagaccatcatggatgagcgagtcgaaaagtcacttaaagtgcgtggaaccaaatctaaatga

SEQ ID NO: 10226 - RNA, 1026 nt, unidentified
  source 1..1026: mol_type = other RNA; note = synthetic construct
atgaaaatcaccaaagcgaaggagccgcagcgatatgagattgaaagatcccctctgtacaaactgtctagcaagaggaagctgagtgaattactcgaagttgaattgaccaccctcagttctttggagaaatccgggctgactagccagtacagaatcttcaaggataggaagacaagaagggtgattaccgaacccatagagcagctggccgtcatacacaagcaactgctgaagctgttctcccgcatcgctccaccctcatatgtgcactcggcgattaaaaaacgcagttacaagaccaatgcggagcagcataaggatcccgccaacgtgctgaagattgacgtgaagaagttttttccctctattaagttctcccacatccatgacttctttctgaatggtttatgctgttcaaaagacattgccgtgatcctgtctaaactgtgtactgtccagacggtgaaacacggcgtgcatctgcctactggctcatgcatcagtccaatcttgtcctttttggcaaacaggcgcatgttcgatgccgtgaagaaaatctgcgatcgggagggatgtgtctttacagtctatgtagacgatatcacagtaagcggagtcaacgcaacacgagcactcctcagcgagataactaccgttattcacaagcatggctatcagtatcacaagattaagacttaccatggacaacctgcactcgtgacgggccttgttgtagccgacgggcgtctcagacttccacacgaacgtgccaagaaaatcagagagctatccaaagcccttaaggcactgcgggcttccaaaagcacaccactacggtcaaagatgcttgctagcctcgttggtcgattgtcggaggccgaacacatcaacaaagcttacaaacctcttcggcagaaaattttaagctcttacagcgccgagtggtcaggggtgatcgcttacaggctgcgcaagagtcggacaaagaggctaatgcgcaattgcgtgataaccgcttcttga

SEQ ID NO: 10227 - RNA, 1062 nt, unidentified
  source 1..1062: mol_type = other RNA; note = synthetic construct
atgacacagaaaaagaagactggcacaccacagcagcataggtacacaatcgatagatctccactgttcgggttgagctcaaagaaaagactctccgagctcctgggcgtggagctccgtcttatacgagacgtggagaaggcagggctgacacggcagtataagatcttcgtagatcgaaagtctcggagatttatctgccaaccggttgacgaactggagaagatacacagacgcttgctcaaatatctgatacggatagcccccccttcctatgtgcattcagccatcaagtccaggtcttatcggagcaatgccaacgctcacttactgaacggccccgtcttaaagatcgatatcaagaaattcttcccttccatcaaatatgaccgtatccattccttctttttcgataccttcaagtgcgctccagacattgccactattcttgcaaaactgtgtgtcgtgtgctccaagaaccacggagtacatattcccaccggttcatgtctatctccggcaataagctacctggccaatattaaaatgtttgacaggatcgcggaaatttgtgccaaggcaggatgcagatttaccttatacgtggatgatattaccattagtggcgccaaagccaatcatcagctgctcggggaagttgcttcggttatttttcagcgcgggtacaaataccacaaaaccaacgtccagcaaagcggccacgctctgatcacgggtctggtggtgactcctcaaggactgagattgcccttcaagcgagttaagaaaattagggacctatcagagactctctttgctgcgagcgtgctgaatttggcacaggcccggaaacgcgagatccttgctagtctggtgggatgtcttagcgaggcggaacagattgaaagtaggtacaaattgattcgcgcacgcatcgtcgaggagcactgcgacacgtggaacgaaatcgtcaagaacaggaccaaacgcgcagctctcaagcgtcaacaggctacacgggccgtgatccctccagccatgaagaattgtacctctaagtga

SEQ ID NO: 10228 - RNA, 993 nt, unidentified
  source 1..993: mol_type = other RNA; note = synthetic construct
atgacaagtagtttacgcaaaccaaagcagtacgagttagagaagtctcccttcttccagttgaagagtaaaaaaaagctcgcagagttgctgaacgtttctctgccttcactcagtcggactcaaatcgagaagttggcttcctgctaccgcattttcgtggatagagagagccgcaggtttattacagagcctgtcggagagctgcaggtaatccatcagcgtctgctccaatattttagcaggatcgcccccccagattaccttcactccgccagaaagaaaaggtcatataagtccaatgctgaacagcatattggcaacactaatgtgctgaagatagacatcaagaagttctttcctagtgtgcaattctcttacatccatgacttctttagcaatcaactgcagtgtgcaccggacattgcggcaatactggcgcgactttgtaccgtgaagacgtccagacacggcgtacacctgcctaccgggtcctgcatctcaccggttctgagctttttagccaacaagcccatgtttgatcgggtcgctgctctttgtgcctctcagaggtgcactttcagcctctatgttgatgatattactatttccggcgctggagccacgcatgccctcttgacatctattgccgtggaaatcaacaacgcaggttatgggttccacaaaatcaaatcgtactttagcgaaccagccgtcgtcacagggctcatagtcacccacgaccgcctgtgccttccccacgaaaggcagaaaaaaatcagggaagtggctgaagcgctgcgtatctcaattgacaccggcatcagagagcggctactggcctcactcgtgggtagactgagcgaggcagaacagatagataccaagtacggaaattaccgaaaaattgtgctagccagatattccgctgactggaagcgagttgtggcacatcggctggctcggatgaaaaaatctgccaagcgcccatga

SEQ ID NO: 10229 - RNA, 1068 nt, unidentified
  source 1..1068: mol_type = other RNA; note = synthetic construct
atgaagcctagtcccaggaagccgaaacagtatgaactggagcaatcaccattatacaaactttcctcgaaacgtaagctggcagagttactgcaggtcgacctcgtcactctcggagtgaccgaactggctaagctgacatccaattacagaattttcgtccactgcgagacaggacggtttataactgaacccgtgggcaccctgataccggttcataagcgtcttctgtctttgttcagccgagtagtgccccgggactatatccacagcgccacgaaaaaaaggagttacaaaaccaacgcagagaaacacatcgggaaccagaacatcctcaagatcgatataaagaagttcttcccaagcgtcaggttctgttacgtgcataattttttcgcgaatacgctgaaatgcagccccgaccttgctactatcttagccaagctatgcactgttcggacaaaaaagcatggagttcacctgccaactgggagctgcatcagtcctattctctcttttttggctaatagggacctatttgatagaattgagaagctgtgtattgaggccgactgcacctttacgctctatgtggatgatgttactatctccggtccaaacgcaacccgcgcgctgctgacacgcattgcaatggaaatccacaaaaacgggtatggctaccataagataaaaacctaccacgctgtccccgccatggtgaccgggttgattgtgaccgagggacggctcattctgcctcacgcaagatgtcaaaagatcaggcaatacgcggaagccttagaatgttctgtgggcggccagattcgcgaaaagctgctcgcctcacttgtaggtcgactgtcagaggcagagcagatcgacgctaagtatagaacagccagacaggacgtccttaagagatatgccgtagattggggtcgagtgatggccctccgcattgctagtgccaaacatcgcgctcggaagacagcttctgtgaataaaccttccacaaccttgttggatcagcagggcgacactgtgaggagcatcaccgcctcctcatga

SEQ ID NO: 10230 - RNA, 1035 nt, unidentified
  source 1..1035: mol_type = other RNA; note = synthetic construct
atggcaaataaccctacgcacaagaggaaacagtatataattgccaaaagccccttttttcgcctgcattcacgacaagcactggccgaactcttaggaatcacattgccacagatggaagcactggcctcatcaccaagcgatgccctctaccggatgtacgacgatgaagcatcaggccgctatattacagcccctttgcctgagctccagcggatccataaaagaatcgcccgtctgttttccagggtgattcctcccgcataccttcagtccgccaccaaaaagcggagctataaaaccaacgctgctatgcatcggaagaatttgaggattgccaaggttgacatcagacaatactatccctcgattacttttggcgcggtcttcaacttcttcaagaaaaagatggagtgtagtgtggacgtgtctaccgtgttaactaaaatttgcaccgtaagcgctcgaggcagaacacacctgccaaccgggtcctccctgtctcccatcctatcttattgggtgcactccgatctatttaaccgcatcaagctgatttgcgacagtgcagcctgtgtgatgagtctgtacgtcgatgacatcaccgtgagtggaacaaatgctactgcgtctctgatctcaaaaatagaggcagagatagcgaaggccggcctgacaagccacaagattaaggtgttcgatcgcgtcccggcaacagttaccggggtgatcgttcacaaaggtcggctcgctcttccacacgagagggccaaagatataagactcttgagaggaatcatggctaaactcccgcttgccgaagctgaggccgacgcaactctttcccgtctggttggtaagctgaatgaggcagagcagttcgtcaccgggtacggcgccatcaaaaagaatgtcctgagcgaacatgctagcgcctggaaccggattactgcggcgagggtagctaagtctaaggccgccgcccgccgaaagaggttaaaggctgctgctacgagaatcagtaagtcttcctga

SEQ ID NO: 10231 - RNA, 1026 nt, unidentified
  source 1..1026: mol_type = other RNA; note = synthetic construct
atggctacaatcttgacgaagagaaaccagtacgccattaccaagagtccctttttccgtctgcactctcgccagacactcgcgaagctgcttggaatcacactgctcgaaatggagacacttgcttccaggccctcaaatgcgctatatcggatgtacgatgacagcgcctctaaaaggcatattactgcaccactccctgaattacagcggatccacaaaaggatcgctcgcctgtttagtagaattattccccctgcgtacctgcagagcgcaacaaagaagaggtcctataagaccaacgcagccatgcatagagacggacaaaaaatagccaaagtggatataaggcaatattaccccagcattacattcggcgccatattcagctttttcaaaaatcgtatgcagtgtagcccagatgttagtaccgtcctgaccaagctttgcactgtttctacgaaggggcggacacacctgccaaccggttccagtctctccccaatcttgagctactgggttcactcagagcttttcgatagaatcaagtctatctgcgatgacctgggctgtaaaatgtcattgtacgtggacgacatcaccatttcgggaaagaatgccgacgcagctctggtgactaagatcgaacgcgagatagagaaaaccggtctgaccgcccacaaaattaagatctttgatgggattccggctactgtgactggcgtggtggtacacaaaggacgcttagcattacctcatgatagggcgaaggatatccgaatgctgagagaggcattgaacaaactccctgaaaaagacgccgactcaacactctctaagctaatcgggaaactgaatgaggccgagcagtttgtggcaggttatggcgccattaaaaagaacatactctcggaccatgctccggtctggacccgcattaccactgtacgagtcgaaaagtccaaggctgctgcccggcggaaacgactgaaggccatcggcacgagcgggtccaagacttcttga

SEQ ID NO: 10232 - RNA, 1020 nt, unidentified
  source 1..1020: mol_type = other RNA; note = synthetic construct
atggccaagtcccagactactagaaagcagtacaccaaaaatcggtcgccattttttagactggagagtaggcgcaaactggctaccctgctggctacaactctgaaaagcttagaagagttggccgggttgccttcaaatcagcggtataaaatgttctttgaacaagagagcgggagatacatcaccgagcccataggtgagttacgacgtgtgcacaagagaatagcaaagttactctgcagagtttctccccctgatttcctgcagtcagcgaccaaaggtaggtcatacaaaacaaatgccgaagcacacattggtggacagaatatcatcaagttggacatcaaggagtactatcctagtgtcacatttggagcaatctaccattttttcctcaacaaccttaagtgttctcaggacgtggccacactgcttactaaaatttgtaccgtttctgcgtgcggcagaacccacttgccaaccggatcttccttgtctccaattctgagttactgggcatattcccaccttttcgatgagataaacagcctatgtgccgccaagggatgcacgatgaccctctatatcgacgatattacggtaagtggcccgaatgccgacaagctcctgcttgccgaaatccgcaaccgcatagatgcaactggcctagtcgcccacaagttcaaagcgtcccaggggatgcctatcaaagtaactggcgtgatcgtgctccgggatggcattacactgccccatgaccgggccagggatatccggaaactccaagctgagcttgccacaacgtccccagaagaagtcgaccccactctgagcaagctggttggaaagctcaacgaagcacagcaattcgtggctacatatggggagattaagagggccgtgctgaggcagcattcaaacgcttggaatcgaattgtcaccgagcgcgcaacccaaagccgtagggctatgctgcggcgtcgacgcaagacagctgtgaagaaagctagcggctga

SEQ ID NO: 10233 - RNA, 930 nt, unidentified
  source 1..930: mol_type = other RNA; note = synthetic construct
atgtcagagcagccaaaacgctaccctattgaccaatctccactgtattcgctatgcggtaaaggcaagttcgaaacggtgatcggggtgagttgggatgcggtacctgagctctgctccagctccaattatcgagtatggaccaatgagaacggacgggagatccaggccccattcaagggcctagccgctactcacaggaagattgggctgctgctgtcaagaattgacgttcccggatatgtgtattcacaaaaggggcggagctacgcagacaacgccagacagcacctgggacaccatcccgttatcaagaccgacatccaaggattttacccttcgatctctagagcccgggtctacggcatgtttagacaggatttccactgtgctgccgatgtggcagcccgactggctgatatttgtagctaccagggtcttcacctccccacaggcagccccttgagcggaagagtcgctttcttagccgcccgccatctgtttgacgatatagccaagctcgcttccgcgagcgactgcacatttactgtgtacgtcgacgacataacccttagtggggctaatgcaactaagaggctgctggcagaggttcgaaggttgatcgagaaacatggcctgcgctctaagaggggcaaatctaagtcattctctccctcctccccgaagagtgttacaggagtgattttggtgggcgaagatgtgagactccctaattcccgccaccagaaaatctgggaaacccgccgtgcacttctcacagccaccggtgaagagcggttgaaactggaacgtcagctcaaagggagggagcaggaagctaaccaggtgctttgttctccacggaacatagagccgcctagggtcagttggcggttagtcggcctgagccatgctgggatggcatgctga

SEQ ID NO: 10234 - RNA, 903 nt, unidentified
  source 1..903: mol_type = other RNA; note = synthetic construct
atgtccgggttccgcaatgctatgccgagcagcgcccctaggaaagcctacgccctcaaccagtcaccacttttcaggctgcggggcaagggacgttttgaggatgtcattggggtgaaatgggaatctgttacagatctattagccgccgagagttttcgtgtgtggaagggccctaaagaccgggagatccaggcgcccatccattggatggccgcggtacataaggtcattgctgatttgctggctagaattgaagtgccagactatgtattctctcagaagggcagaagttacgctgacaatgcccggcaacaccttgggaaccaccccgtgataaagacagacatcaacaagttctacccatccgtgactagggcaatggtgttcaggatgtttgtcagagactttgaatgtgccgccgatgtggccgatcgactggctgatatttgctgttacaggcagctccacctgccaaccggttcccctttgtccgggagagtcgccttttttgccgcgagaggattattcgaagacatcgctaaactggctgtggcatcgggctgcaaactgaccatctatgtggacgacattgcactcagcggcccgaacgcaacaaagcggctgctcggtgaggttcggatgctgatcgcccgccacgggttgaaaagcaagggtaagaagtctgcaactttcgccgctggagctcccaagagtgtcaccggcgcagtaatcgttggtgaggagctgcgactgcccaatgaacgccatcgcaaactccacgagacgcgctcagcatatgttgcggctgatggcgacgaacgagccaaactgggaaggcagcttcggggacgtcagcaagaggccgcacagatactaagacctgtggcacgcgctacctga

SEQ ID NO: 10235 - RNA, 936 nt, unidentified
  source 1..936: mol_type = other RNA; note = synthetic construct
atgaagtcaaaaggcaccccagagaggtaccccctgcaccagtctccactgtatcggctaaagggaaaaggccagttcgaaaaaatccttggcgtcgagtggtccgccgtcaatcgcctactcgcagcgggtaactacagagtgtggaagaatgataagggacgggaaatccagcaacctctgggctggttagcccatgttcacggaagaatcgggaaactcttgtccaggattgagctgccggattacctctattcacagaaagggaggtcttatgctgataacgcccgggaacatgttggtggcgtgcctttgattaagaccgacatccacaaattctatcctagtacaacaagacagatggtgtatcgcatgtttgtggtcgactttatgtgtgctgaagatattgctcattgcctcgcggatatatgttgttacagacagcgacatttgcccactggcagcgcgctttctgggcggattgccttctttgccgccaagcacatgttcgacgacatcgctgacttggccaatgacgaacaatgccgtatgacggcatatgtggacgacgtgactatcagcggacccgctgcaacaaagaagctgcttggggaggtgcgaaaagtagtttccaaatacggttacaagacaaagcaacgcaagtcgaagacctacgccgccaccagcgtcaaagtcgtaaccggagcagttgtggtggggcgggaactgagattacccaacgagcgacacaggaagatatggcaaactaagcaggagctgctgaggtgcgagagagaggagaaagccccactgatgagggctctgcgtggacgcctgcaggaagcatcccagattctcaataacctgagcggcgacttacacaatagtgatctcatgcttgggcggagcctgtctaaccgcgatggcagttcatga

SEQ ID NO: 10236 - RNA, 921 nt, unidentified
  source 1..921: mol_type = other RNA; note = synthetic construct
atgagtgagagcctttctcgtctgatgcctaagcagtacgccataaaccagagtccactgtataaactagtagggctcaggcagttagagttatgtttaggcatcgacctcgagagattggacaaactcctgaaggatggttcctatcggacttgggttaacgataacgaccgagccattcaacatcccctgggatggctggcgcaagtccactctaagatagctcactacctggcgaaaattgaaactccggactatgtctaccacaagaagggccgctctcacgtgaagaacgcttcagagcatacaggttaccatctggtagccaagaccgatattagcaactactatcccagcatcacaagagcaatgctaaaatcgatgtttgtgaagaagttcaagtgcgccctggatgtggctgggatccttgcagacatctgcacctaccagcgcacccacttggctaccggtagtggcgtcagcggctacctcgcattctgggcaagtaaagacctgtttgacgctgtctatgaactgtcccgggccagaggatgtgtttttacattgtatgtggacgatctcaccatttccggaaatgctgccagcaagaagttgctgactgaggtgcgggccattgtcaagaggaatggccttaagaccaaggaaactaaaagcaaaactttcgctgcccacgccacgaaaatggttacaggggtggtgcttaaggggaatgaatctctgctctctaataaacgacataaggaaatcgctgataaccgcatcgcaattgcaaatacaggcaatgcgaatatcaaggccaccctgcagaaatccctcaaaggaaggctgatggcagccaaacagataatcgattccaacgagatcaaaacagtgacgtcatcagaccttatttactcatga

SEQ ID NO: 10237 - RNA, 915 nt, unidentified
  source 1..915: mol_type = other RNA; note = synthetic construct
atgcagtccaagaaaacgcctgaccgaccttatccccttgcgtcaagcccattgtacggaattcgggggaaggggcaattcgagcgcgccataggcttaacctgggaccagacagatagattactgcataggaggtattaccgggtttggacaaccaagaaggacagggagattcaacagccactctacgagctggaaaagctgcatgcccggatcgccaacttgctggcaagaatagagatgcctagttatgtgttcagtcgcagggggcggtcttacgtggagaatgctgacagacacaagggcctgtcccccctcatcaagaccgatctcactaagttttatccgtccacaagctggccgatggtgtttagactgctagtatctcgctttaactgcgccaaagatgtcgcacacagactcgcagacctgtgttgctaccagcagaaacacctgccaaccggatctgcattgtcaggctatctcgcattcttcgctgcacagccaatgttcgaccggatcgccgatatccttgggcgacacggatgtgagatgactctttttgtagatgatctgaccgcctcaggcgcgggtgctacaaaacacgctctggaggaagtcagggccgaaattcgtcaccatggcttcgctactagtgaagcaaaatccaaagtctaccgcgctgctgcccctaaactggtgacaggtgcaattgttacccccacgcgcctgatgcttcccaacaagcagcatctgaagatttgggccgcccgtcggagcttgcctgttctacctaaaatcatgcgtgcggccgctcttagagctctccgaggtaggatccagcaagcccatcaggtgctcaattacagcggccccacttttgaattagccgcgcccgtggagccatcgggatga

SEQ ID NO: 10238 - RNA, 918 nt, unidentified
  source 1..918: mol_type = other RNA; note = synthetic construct
atgagcgcacggccaacctatccactggaccagtctcccctgttccggctcccctcaaagagacgtgccgctgaggtcctgggtatagacttgcaccaaatagagcagctggtaggcgaacgcaactatcgggtctttgtcaatgcaaagggtcgcaccattcagcatcctgtgggagagctggcgggcgtgcataagaggattgcgtccctgcttggccgacttgacgtgccctcgtatgtgcgctcagtgaaaggcgaaagttacgtgagcaacgctgggagtcacgttgggaacgggccgctgatcaaaacggatatcgcccagttttatcccgggacaaacttcagtgcagtgtacggatttttccggagagacatggggtgcgcacctgacgtcgctcacttactggctcgcctgtgttgtttccgccagcgccacctacctacaggaagctacctctccggcccactcgcctttttcgctcatagagccatgttcgatcagatctactgccttgctcaggataggggttgcgtaatgacatgttacgtggatgatatcgtcatctctggaccaggagcctcaaaggaactcttgtacagggtgcgagggctgattcgtgctgcaggtcggacctccaaagatgacaagtccaagacctttccggcacataagcctaaaactgttactggagtcatcgtgacttctgacgccttgcgtctacccaatagccggcacaaacaaattcacgaggcaagggccgcgattagagccgctggtggcgatggagaacagatgagccttagagcctctctgcgagggaggttacaagaggccggccagattgccaattggaacgttaggaatcctggcggcggcgtactcgtgagaggggttgttccagacgtgtcctga

SEQ ID NO: 10239 - RNA, 1026 nt, unidentified
  source 1..1026: mol_type = other RNA; note = synthetic construct
atggttaagcaaatcgatcgctacccactggagaggagccccttgtacaacgcgaagagtctgaagaagatctcgtgtctgctaagcctgtctagcttgaaggtgaacaaaaatgacagatccaaacccatgctccagaagctgtataagcttacaccgactgacctggacaattttgctgcccagcagaactatactataaaggagctgattgacaaaaaggggaagagtcggtcaaccgaaatccccgcgatcgatctgaagtggctccattacagactggagcacttgctgaaaaaaattgagccacctccttaccttttctcagcaattaaaggacggagctgcaaggataacgctagaatgcatgccaccaatacgcagctgttcaagattgacatcaaaaccttctacccaaacatcaacttcgggaaggtctataatttttatcggcacatcctccattgtgaacaccacattgccacaatcctgacaaaaatttcaacgtacaatggccatttgccaaccggttcccccttatcacccattttatccttttacgcctgtaagccgatgtttgatgaaatttatcagcttgctctcgaacacaattgcgtcatgacactatacgttgatgacatctgcgtgtccggagataaagctaccaaagctctgctgtggaagatcaaacagataatacataggtacgggctcaggtatcacaaggtgaaattttacttccagaaacagccaaaaaccgtgaccggcgtcatagtaacagagaacagcattaagctccctaaccgccgtcaccaggcaattactgaacgaataacctatatccagtctccttctatcactgcaaaggagaaacgacaagccaataattctctgctcggccagcttaacgaggcaatgcaattagagcctaaactggccaagacaaaagccttgctaatccagcaaggtgtgcttaagccccacatgtccctccctcgcagtaacagcaagagaaagactaaatga

SEQ ID NO: 10240 - RNA, 954 nt, unidentified
  source 1..954: mol_type = other RNA; note = synthetic construct
atgacctcaaagtacagcctcagtcaatctccgctctttaaattgaagtctaaaaagaagctggcagatttactgggtcagtcactgggcgatttacagtccctggccaaatcgaacgataactataacgtctataccctaagtcctaagagcaagctagaccacccctactttctcagaaaggagcgacaggtgcaggaggtgcggcctcatctgaagaatgtacacgagcgcatcttgaatctgctgaaaagagtacaaacccctgactacctgcactctgcaacaaaaggaaaatcctaccgtagcaatgctgaagcgcatttaagcaaggacgtcatttacacagtcgatattaaatccttctacgagtcagtgacgttcggcaggatataccatttctttcactccacacttaaatgttcccccgacatatcccacctgcttaccaggttgtgcgcgtataaacgcaatctgccaaccggcagttgcatctctccactgctgtctttttggactaatgttacaatgttccaggaactggacctgtttagtaagaccaacggcttgaccatgacgctctatgtggatgatctgactttcagcgggacagacctcccaaaaaagacttgcttcaagatcgacaagatcatagccagctatggatataaaccccataagcaacagttgtacatcaacaagaaggccaaaattgttacaggccttgccctctgtggagctagacttgatatccctaacaagagacgtggtaagattcgggtgctcattgaggcaattgccagggaacgcgacgcagaaaagaaagagaaactatgcaactcacttgtggggatgacttatgaagctgcccaatttaatcgagggtacgccaggctgatcgctaaacagatccggaagaagtgtccctgtactcggcagcagattaatctctga

SEQ ID NO: 10241 - RNA, 954 nt, unidentified
  source 1..954: mol_type = other RNA; note = synthetic construct
atgaaaaccaaatactccctgtcccaatcacctttttacaagctctccacgaagaagaaactcgctcaattactggggcaaccactggctgatctgcaggccttggcgaagtcaaacggtaattacaacgtctataccctgctgcccaaaagcaagctcagccatccctattttgtgaagaaagagagacaggtccaggaagtgcgcccacatcttaaaaccgttcacactagaattcttaacctactcaagcgtattaagacccctacatacttgcactcagctacgaagggtaagtcttacaaaactaatgctgagtcgcatctgaataggaatgccctttacaaggtcgacatcaaatctttctatgagagcataagtttcggcagaatctatcacttcttccacgaaatcatgaagtgcaacgaagacgtggcccatctcttgacccgactgtgtgcatatcagcgaaatttaccaacaggcagctgcattagccctctcctgagttactggaccaacgtaacaatgttcgacgacctctacatatttagtagggcacacggcctgactatgacactgtatgtggacgatcttactttctccggaaacgagatttctaaaaggacctgttttgagatcgacaaaattatagccggatatgggtacaaaccgcataagcagaaacagtactcaaccaagaaaactaaaatcgttacagggttggcactttgcaatgatcgcctggatatccccaataaacggaggggcaagatcagagtgttgctggaggccatatcccaagaaaaggatgccgcgaagaaggagaagttatgcaactctctagtaggaatgacttatgaagcagctcagtttaacctgcgctacgcccagatcattgcaaaaaaggtgcggaagaagtgtccctgtgcccggcagcacatcacaatttga

SEQ ID NO: 10242 - RNA, 966 nt, unidentified
  source 1..966: mol_type = other RNA; note = synthetic construct
atgtctagggaccggtacgccatcgaccagtctccgctgttcaaactaaagaccaagaaaaagctcgcaacactgctcgactccagcgtgagggaattacaggcattatctgtcagcagtgatagctatagagtgtttgacttgcccgctgagtccctggttcagcaccccctgtttgcccgaaaatcaagaaagattcagcagctgaaacctgaactggatgcgatccacaggactcttcataagtacctcagccgcatcaacgtgcctgactacctgcatagcgctgtgaaatgtaagagctacgcaacaaacgccaagactcactccggctgtctctatctgtatcgtgtggatatcaaaaagttttacgagtccgtgaactggagaacggtctaccggttcttttataaaaccctggactgcgctccagatgtatccgccctcctaaccaatatctgctgctacgaggacaagctgcctacgggtagttgcctgagtccaattctttccttctttgtgaaccaagagatgttcgatgaactttatgagtacgccagtcagcgggatttaaccatgaccgcctatgtggacgacattgttttctcaggacgcgaatttcaccgcattaatgcgcacagcatccgagggataatcaattcttatgggtatgagtgtcataaagagcggatatgtcccccacgcaaatcaaagattgtcactggcctgtctgttacccgtacaggcgtagccataccccataagagaatggctaaggccagggtccttttgcaagaattggccaaaaggatgcggcagtcacataaggaaaagctctgtgcatcgctcacaggtatgatcactgagatgtctcaattcgatcgagcaaaagctaaatacctggctactctgggaaagaagtactgcagaacaattcagaatattcacttcaagttgtgcaaatga

SEQ ID NO: 10243 - RNA, 906 nt, unidentified
  source 1..906: mol_type = other RNA; note = synthetic construct
atgcagaagaaaagacaggggaattatccactgaatcagtcccccctttataaactatgtaacaagcggaaccttgcagctgagttcaacctgacactgcgcgagctggactccttactcaaacgccaaaacaattaccgggcttttttcctgacccaaggtgaaaaaaagcggccagttgaagcgcccaagcccatcatcgaacgcgtgcacaggagactgtttcagctcctcacgcgtatcaccccgcctgagtacctgcatagtggagttcgtgggaggtcctacgtatcgaatgccgagcagcataggaaaaaccctgtgctgtacaagttagatatcgtgaagttctatcccagcacaaagcaatggcacgcctttgaattctttaggtccactatgaagtgtagcagagatgtcgccggccttttagctaaaattgtcactgtagatggacacctgcctactggcagttgcctctctcagataatggcattctacgcacactttgatatgtttgaggcattgtatgggctcgccacatcttacaacctggtgatgacatgctacgtcgacgacattgtcttcagcggaaataagattcccaaatctttccagctcgaagccaaaaaaataatacagagctcaggcttgctctcacatccacgcaaggagaaattgttttttggtgagaagcctcggattgtcaccggcgtggtgatttcccagtctcagctgaaaattccgaatagacaacacctgatgatcaaggaggctctattcgaattgccaacccttgtggccgactcacctgagcgagagaagctgtataggcaggtggttggccgaatcgttagcgcgagtcagatcgaaccaaagttcttcaagcataagaaagtgaagtga

SEQ ID NO: 10244 - RNA, 924 nt, unidentified
  source 1..924: mol_type = other RNA; note = synthetic construct
atgaaaaaggaggagaagaaaaggggcaattatgccctgaatcagtcccctctctttaagctacgctctcagaggagactggcccaactgctgcgtacccctcttaatgatatctatgggttgctgaacactggtaacaactacagagtgtttccacagggaaaccggacttgccatgaccccaagccaaagatgaaaggcatacataaacgcctccagattcttctgaatcgcattgctccccccgagtacttgcattcagctacgaaaggtcggagctacgtcaccaacgctgccgcgcacttgggcaatgacgttctccacaaactcgatatccgaaagtttttcgacagtacaacctataagcatgtccacgacttttttaagaacaccatgcagtgctccgcagacgttgctgctctcctctcccgtatcacaacatacgatgataggctgcccactgggagccctatctcgccaattctagcttacttcgcacacaaatctctgttcgaccagataaatcaagaggccacggccaccaacgtgatgatgacttgttatgtagatgacctgtccttctcaggctctaccgtgccgaaagcagtcctgagaaaggcgaaaaaagggattattcagagaggacttgagtaccataaggaaaagcggttccagaagggagacacaaaaatcgtgacaggagtggccttacgcgacgagcaaatgttactgcccaataagagacacaaaaagattcacgaagaaaaacaaaggagtcttgagatcgatgatgccaagaagaagcgggaaatcattcacaaattgataagccagactggcgaggccgcacgaatcgaacctagccagttcgaacctctgaagcaggcactgatgcaggtgaggcggaacttaccaaagccgtga

SEQ ID NO: 10245 - RNA, 1068 nt, unidentified
  source 1..1068: mol_type = other RNA; note = synthetic construct
atggcaaagaccctcaagctccacgaaagtccactgtacaggctgacaagtaagaagaaactggccgcccttttcggagtgaaagtggccgatattaaatttctgaggaagctcgacgggaattatagagtgtggcccctaaagcagaaacaccaagatgtgctggccggcatgcccgtaagcgataaagtgcggatggtgcagcagcctaagcctactctggatgcctttcagcggcgtcttgctaagttcctgggcgctatcgaaaaacctgactatgtgtactcggcaacaaaaaagcgctcttacctcgagaacgctctggtccatcgccacagtcagccggctttgaaggtggatatcagatctttctatccttctgtgaagcgcagggccgtcaaatctttctttgaggaacagttgggctgtgcagaggacgttgcacatgtacttagcgagttgtgttgccatgaaggcaagctaccaaccgggtccgcgctgtcccctgtcttaagctacttctcatgcgcccccatgttcgccaggatcgcagctctggccgacgccaaggggttacgatttaccctgtacgttgatgacatggtttttagtgggaccggtctggacgacaaattcttggctcaagtactgaacgagctcaatcgggaaggatatagcggacacaaagtccgattttataaggccaggcggccgaaagttattactggtgcggtcgtctggccatcacgtgtcgatgtgccccacaagagacgatggaagatgaggctctatgagcgtgctcttaaggtggccaaacctgaggacaaggcgatcctgggacgcgcgctgttagggcagtacagagagtccagccggataaacccatccttcaaggtggcagctagcagactccaaaaatttatggacgatatgggaggtaagacgaaggcagccaaaccccggaaacgacccaggggcagatcctcctactcactattccttagccgcatttcacggttgagagctgaagtggccgctgttcgcacagtagcaggctctgccccatga

SEQ ID NO: 10246 - RNA, 1077 nt, unidentified
  source 1..1077: mol_type = other RNA; note = synthetic construct
atggtaaaaaactcaggatatagcatcgatcagtccccactatttaggctctccagcaagaaaaagttagctgggctactcggcgtgtctgtcaagtacctccacagcattctgacccttgacaactatagaatctgggaggcgccccaaaagtaccaggacattctggctgggtttcctcctccatctaaaacacgcaaaattcaggagcccaagcagttgttgctccgcctccacaagaagttatcaattttcctgtcaaggatcaagaaacctgacttcgtttattcggctacaaagggtaggtcttacgtcgataatgcccgggaacacatgaatttcggcagagcaatcaaaatcgacatcaaggacttttaccccagtgtaaggcgaaaactggtgcgcgattttttcattaacgacatgcaatgcgcacccgacatcgcctatgtgctgtcactgctgtgttgtgtgaaggattccctgccgactggatcccctctgagcccagtgttgtcatacttcgcctgtagtcgcctgttttgcaaaatcgcccatatggctgccgttaagaatctgaagttcaccctttacgtggatgatatggtgttctctggcgcgaatgccacacggagcttctgctaccaggttgtcaaggaacttgcttataatggtttcataggtcataagatcacaaggttttccagcagacaggtgaaggtgatcactggagtggccgtatggcctcacaaaatagggataccccataaaaggcagaaacgcattcggttctttgagcgtgcatttaaactgaacaacaatccggatgagattaagattttgggcgggaccctgatcggccaatatcgagaggccgaacggctccagcccggatctagcatgcgagcaagaccaatccaggaacggcttaacctcattaatttgcagtgcgtttccgtcagtccagtcactaaaaaacgtcggagacgtagattaagcagtaagctttctaagggcatcatagacacgctgcaaacccagaagaacaaaaagaaaaacgacatttccagtgagtga

SEQ ID NO: 10247 - RNA, 1065 nt, unidentified
  source 1..1065: mol_type = other RNA; note = synthetic construct
atgatgcacagcctctgctatccactagatcagagccccctttacatggctggcagtaaagtacggctgtgtgagttgctgggcatcaccaccaaggatctgaggctcttgctggctctcgagaactaccgggagtggaccgcaaagcagaagctggccgacaaactcgccaacctcccggcgaagtcccgaaacattgaggagcctaaaccactgctgcgcctcctgcacaaacgcatagcgttgttacttgacaaaatcgaaaagcccgatttcctatactctgcacgcaagggctgttcatatttttccaacgctttacagcatcagaggtcagagggggcggtccgtgttgacattaagtctttttatccctccgttcgacagcgcatggtgaaagaattctttgagagtcaaatgcggatgcctgccgacgtagcacatactcttgccaagctctgctgtcacgatgggaaactacctactggctctcctctttcaccaatcctgtcctacttcgcctgcagcccctttttcagtcgggttgccgctatcgctgaccggctgggattgcagttcacactttacgttgatgatatggtctttagcgggaaaggggctaatagagctctggccgaccagattaaacgcgaactggcgggcgtggccctgattggacacaaagtctcgtatttcccagcaggaggcgccaaggtgatcaccggggcagctgtgtttcccgacagaattgaagtgccgttcaagcgacaacgcagaatcaggaagttcgaggaagcctttgccaagacgacaaatgtggcaactaggggagcgggtacaccttgggcagcttggggccctggagcaggaagacctggtccaggtccacgtgctaggcccgtggaggtgagattggcagccctggaggcacgtacaccggaaatccacggcaaggccaatgccaagaggcgaaagaaacccgtcgggaaatctataatgagagaaatagccagaaaggccgccgtgctgcgggagcataggttagaagctgacgtctgcagctga

SEQ ID NO: 10248 - RNA, 942 nt, unidentified
  source 1..942: mol_type = other RNA; note = synthetic construct
atggtcgagcctcgaacatatccgctgcaacaatctccattatataggctgacctctaagaagagactggccttactgctgggtatctcagcctccgagctgaagctgctgtgtgatctccaagattacaactttaaaagatgggaactcggtcagcgcgagagagataaactgatcggtctgcccgctaaggcgaaaaaaaggagtattcagcagcccaaaaccgccttgcatgccgtgcacaagcgtattgccctcttgttgggccggatagaaaaacccgctttcgtgtattctgccacaaaacggaggtcctacgttgataatgctatccagcaccagagagacgaaccatgcgtgaaagtggacgtgaaggagttttacagacatgtgaagttcggacgcgtgaggcgattcttcctagagaatcttcagtgcgccgacgacgtggcacatgttctagcgatcctgtgttgtgtcgacggggccttggcaactgggagtgcggtgagccctgtgctctcgtattttgcctgcgcttccatgttcgccgagatcgaggactttgctcagcggcgaaggctggttttcacactctatgtcgacgatatggtcttctcaggagctgctgctaaccgggctttcgcagatggcgtaagataccttctcaagggaaaggggttcgtcggccacaaagtcacctgctaccgcgcccacgacgttaaggtggtcacgggcgtagcagtacgagccggctttgtggatctcccttttagccggcaggggcggatacgtcgcactgaagtggcatttgcgaagagcaccgacccaaacgagctgcgcattttaggaagagcccttctgggacagtacagggaggcagaaaggatccgtcctggcattaaggcaaaggcagctcccgttgaagcccggcttcgctga

SEQ ID NO: 10249 - RNA, 1119 nt, unidentified
  source 1..1119: mol_type = other RNA; note = synthetic construct
atggctaatgcccgtgcataccctctgacgagctcgcccttttacagactagcttcaaaacagaaactggccgctattctgggcgtgagtctcagagatctccggctgcttctgaagcagccagacaactatcgcctctgggatacaagacgccgacgtcgggacgaactggtggggatcccacacaaagctcgagccattcagcagcccaagcctctgctggcgatcatccacaaaagattggcaattctgatcggccggatcgagaaacctgactatgtgtactctgccaccaaggcccggagctacttcgataacgccaggcctcatgccattggggaacccacggtcaagatagatatcaagaacttctacagtaacgttaccaggcggttcgttcgggatttcttcgagcgtcgcttacagtgttcccccgacgtcgcacacgtgctgaccgaactgtgctgtatcacaaccgcatcaagttcagcgctcccaaccgggtccgctgtatctccggtgctgagtttctttgcctgctctgagatgtttagaagaattgcggagatagctaaggaccatggtttgattttcactctttacgtggatgacatggtcttctccggctccaaggcaaacagacatttcacttccaaggtggtgcacgaattggccaaaaatggatttgtcggccataaaatcacacactttcggggggatgccactaaagtggttaccggagtagcggtatctgctggccgcgtggaccttccgtttcggaggcaaagaaaaatccgccagtttgaggaggccttttgggcagccacaaatcctgaggacatatcactgctcggtgctaccctcctcggccaatatcgagaagctgagcgcattaagccaggtactaagcttcgcgcattggcagttgccgcccgactggaaaagcttgggctatccaacggactgcctccatctgtgaagaaaaggaggggatatcccggaaagaggttagatgcaaagcgattcgacaggttgaggagcgctgtcagcctaaatcccagcaccactagcggaggtccagagacattagttaatacaggcgtcgtgatggccgcttga

SEQ ID NO: 10250 - RNA, 1107 nt, unidentified
  source 1..1107: mol_type = other RNA; note = synthetic construct
atgaaggcccccaaacgatacccctatcaccagagccccctttacgctttaacctccaagaggaggctcgccgatatcctgggtgtgccactgaaggacctggttttcctggcctctcttaaagaccataattaccaggtttggccgctgaaacagaaacgtagagatcagctcgcgggcatcaagcctcctgaaaaatcccgatttgtccagcagcccatgcccttgatgaggctacttcacgatcgtatcgcctcacttctcgggaagattgagaaaccgcagttcgtgttctccgcaactaagggacgcagttatctggacaatgccctgcagcacagggacaacatcgcgcagccagcgttcaaggtcgatataagaagcttctaccctgccgtgaaatcacaatgggttcgccgcttcttcgaggtcgacatgaaatgtgcaccagatgtggcccggtttctcgcccggctgtgctgtgtcaacggagcattgccgacaggcagtccaatatcccctacacttagctactttgcttgcgctccaatttttcgatggatggcagaatttgccgagtccaatggcttggtgttcacactctatgtggacgacatgttcttttctggtgctaaggctagtaaggacctctcaaagctggtgctgggtcatctggccgcgaacgggttccgaggccacaaagttgctcattttagagccggccaaccccgtgtaatcactggcgctgccatcagccaggacggagtctcgatcccctttaagcggcaaatgcggattcgcctgtacgagagagccttcgcatctacaaacgaccctgaggcaattcaaacgttaggaaaagctctgttgggacaatatagggaaggggaaaggctgcagagggggagtagagagagggccaagcctatacaggatcgcatggatgctattaacgcagtacggtttgaggaattaactcaggtgcaaccaaaacggaagaagagagggcccctaagcaccgctgcaatgaaaaatcacgtgcagaagctcagagagcggcgctctggccagttgcatcctgtgaccgataccccacagtggcagtga

SEQ ID NO: 10251 - RNA, 969 nt, unidentified
  source 1..969: mol_type = other RNA; note = synthetic construct
atgatctccaaaaagcagtacaataaagaccaatctccactgtactctataaaaagtaagagacggctagccaggattctggaaacagacgctaaaaccattatccgcctggccagtgacacttcaaagcactataaactgtgggaaaccaagcagaagcccagagataaaatctgcaacatcacgcacacacctagaaaaatccaggagccaaaagaggacctgctgaagatccataaaaagattgctaagttcctgagcaggatcaaaaaggaggaattcgtatatagtgcaacaaaagggaggtcgtacctcaataatgctgaattccataaggaccgtattcatgagcctagctttaaggtcgatattgagaagttctacccttctgtcaaaattaagaaggtgcacaacttctttcagaacgaaatgaaatgcgcaccagatatagcccgcttgctcgccaaaatctgctgtatccacggcgcgctacctaccggatcccccatctccccgactctgagctattttgcatgtaaggatatgttcagctggattggcaatcttgccaggtcaaataatctctgttttagcctgtatgttgacgatatgtttttctccggggaggcagctagccaagagctgagaaacaaagtgataacacacctgaaaaagaatgacttgcgtggacacaagatttcccatttttcagccaacaagactcgggtgattacaggagtggctatcacgcccaaaggccttagaattaccaacaagcgacataagaagatacggatctacagtaacgccttcttccgctcaaaatctcccgataatatccagaccttagggaagactttacttggtcagtaccgggaagcgagccgagttgagccacacctcttgcaacgcaccggtaaggtgcagtctaggatggacctctttaaggataagtcccagaacatgtga

SEQ ID NO: 10252 - RNA, 1131 nt, unidentified
  source 1..1131: mol_type = other RNA; note = synthetic construct
atgaggccactcggccggttccttttcatgctgcagggtgaacaagagatggttcggaaaaaggaggagaagaggtacagcattacctctagtcccctgtatggcctctctagcaaaaagaaattcgccgaacttctcaagatcgatctggccgacctgagatttctggccaagttcggggattccaactttaaggtatggtccactgcccagaagttggtggatgaagtggcagggctgcctgccaaaaaatccagggtcgtacagcagcccaaaattgtgctctcagtggtccaccggcggatcgctgagtatttatcgcgcatcgagcgtcctgaatttcttcacagtgctacaaaaggaagatcatacctgaccaatgccatggtacatgcttggaacatgccggggtgcaagatagacatcaaggagttttacccatctgtgaaaaggaatcttgttaagtcattctttgagaatcgcctgaaatgtacacatgacgtggcgagcttcgctgctgacctttgcacctacaatggcgccttgcccacgggcagcgctgtttctccaatactgagctttttcgcctgccttgagatgttcgaacggattgatctgctcgcacgccaaagagatctgagattttctctatatgtggacgacatgttcttctccggtgacaaggcagacaaggggatggccaagtcggtcgtggatctgttgtcccgccatggatttgtggggcacaaagttgtgtgttttagtgctaacgaaaccaaactaattacaggagtcgctatcaacggctgtgaaacttccatcccaaacgcacgacaaaataagatgaggttgttctcacgtgcattacgccgagagcgcaaccgagaaagagcaattctcctggcccaggcgctggttggtcagtttagggaggccgagcggctacagcctggaacaaaagcgagggcactgcccttcgaacgacgcctcataaagctcaagggcgcagagaagaaaactgtcagcgtcgtgcgtagaagaagacggaggagtcgaccgaaagtcttgacgagcaccctgctgagggccattgccttaatgcgggcggctcctaagatcgtgaatgtgtga

SEQ ID NO: 10253 - RNA, 954 nt, unidentified
  source 1..954: mol_type = other RNA; note = synthetic construct
atgcccaatgggtactccattaaccagagcaggctgttcaaattagccaacaaacgcaagctcgccggtattcttgggatcactattaaagaactgagtctgtgcgcaaataccgcaaacaactaccggctgtggtcaactaagtccaagtatccgtctaagctgcagatcctcagccacaaaccccgggatattcaggagcctattggcctgctgcgacggatacaagatagactgagtgatttattggtgagaattgaaacccctgaatatctgctaagcgcaaagaagggcggctcctatgtgaagaatgcgtccctacatatggggtttggacaggtgattcgcatcgacataaagggattctacaaaaacgcttccgaggtgttcgtgttccgttttttttggcatgacctgcaatgctctcaggacattgccagaattctcacagacctcatatgttggaatggttgccttcccacgggaagtcccgtttcaccaattatctcattttttgcataccgacctatgttcgacgaacttcacgctcttgctttagctatcaatgcagtcatgacagtttggatcgatgatatcgtgttcagcggagacaacgtaaatggcaccttgatcccaaaagcgaagatcgtgatcaagaaatctgggttgcaggggcacaagatctctgtcttcaataggggccaggcctcagtcgtaaccggagttgccatcacagctgacggccagctgcatatacctaacaagcgctataggaaaatccgggctctggagaacgagtattgtgccgcatcgaaccaagctgacagagccatatacggtaaagccctgatcggtcaatactttgaggggagccagttggatccaggcctcgcgaagaaagccaaggtcctccaggccgatatgaaatgtaagaacagcaatcacccaaggtga

SEQ ID NO: 10254 - RNA, 936 nt, unidentified
  source 1..936: mol_type = other RNA; note = synthetic construct
atgtctaaagttctgaggaaatcatacccagccgctcaatcacctctgtttcgtctcagaagcaaagcccgattggctgagctcttggacgagactcccagacgggtcagagaactgatcacagacaagaattattgcgagtggttcaccaaagcaaagtatcccgactctacacacccagctctggtgcataaaccccgtgcaattcagcagccgctaggtgctttagatatggcgcaaaggcgactcaactcactactgtctcggattgaacttcccgattatctccacagtgctagaaaggggagatcttaccggaccaatgcagccgcccattccagtgctggacgagcgataaaggttgacatacgccaattttaccggagcatcaacgacagttacatccatgcattctttcgggacgtcatggaatgttctcctgacgtgacccacatcttgacagagttagcatcatttgaacgatatctgcctactggaagcagcctcagcccaatcgtctccttcttcgcctattggcccatgttcgataagctgaactccgttgccagtagcgtaggcgctcagatgacagtgtatgtggacgatgtggtgattagcggtcctggcgtctcggggtcacttattcctatttgcaagcgcataatgaaggatcacgggctgaggggccataaagtggcttactaccactccggcaagactagggtggtgaccggggttgccgtctctcccagaggactgtccattccaaataaaaggctgatgaagatccgggcacttcgccaggagatggatgccgccgtagatccggcaaccaaggccttgtacaaacaggccgtgctgggccagcttagggaaggaagtccactcgacccttcctttcgcacgtactcccaggccatcgagcgcatggcgtga

SEQ ID NO: 10255 - RNA, 954 nt, unidentified
  source 1..954: mol_type = other RNA; note = synthetic construct
atgagtaccgctaaaggataccagctggatcagagccccttatataagctagagtctaagcgaaagctcgcaaagctcctgttctgggacctttcgaggttacaagctctcgccaatagaactgacaattaccgttcaaaaaagaccatgcatgcaaacaaggaaaggagcttagaggttccaaaacctgctctagaaaacgtgcaacgccggatataccagctgttggatcggattgagaagccagactacctgcacagcggacggaagcagcggtcatacatcactaacgcccaagtccatgccggtgccgtctggctgatcaaattggacatcaaaaagttctacgcagccgtgagctcagcgagggtgtaccgattttttcaggacgtgatgaggtgcagccccgatgtcgcctcccttttggccaaactgtgcacagcaaggggccacctggccatcgggtctagagtgtctcagctgctggctttctttagtgctaaacctatgtttgacgagctgcacgccagagccctggagtattccatcaaggacacttactatgtggacgatctgacctggtctggcacccgggcaacagctggctttctgtgggaagtaaagaagattgtacaccgccatggattcgagtatcatagagccaggctgtatgcgccaaataacccgaaacttgtcacaggggtgcagatcattggggatcggattgctgttcccccctatcgcgatagagaactctgggatgctatacgcacactgaagaagccttccgcctgtacgaccttgaaagttgcagagactcttttgtccaaagctgccgcgtatgcacaggtggaagaccgtttccagctccaagtccgccagctcagagcgctccgagcatccatgaaacttaccgccagtacggaccacattgatggccctcagggtgtgtga

SEQ ID NO: 10256 - RNA, 915 nt, unidentified
  source 1..915: mol_type = other RNA; note = synthetic construct
atgcccgcttcacgatcttacccgattaatgaaagccccctgtacaagatccgttctcggcggaggcttgctgcagtcctgttttccaatctgcctaagttggaggcccttgccaaccagacagataactacagacgctttgatgtggtttacgctggaaaaaaacgatcagtggaactccccaagccggccttagcccgcttgcatcggaggatattccagatcctgaattgcatcgaaaagcctgactacctgcacagtggctgcaaacagagaagctacatcaccaatgcacgcgtgcatgttggcttggtccccctcgtgaagctcgatatcaaaaagttttatgcctccgtgtccagtgcgcacgtctatcgcttctttaactccggtctacagtgctccccagacgtaagtggccttctggcaaggctctgtactgccaacgggcatctgcctatcggtagctctgctagccagctgctcgcttttttttctgccaagccaatgttcgacgaactccaccggcactcagtgcgccacgaggttagggacagctactatgtagacgatctgacttggtcaggggtaaatgcgacccctcggttcctttgggcagccaagcagattgttcacagacatggattccgttatcattcggatagagtgtataccgctagtcagcccaaaattgtcaccggcgtgctgatagctggagacaggatcgctgtgcagccaagacgggagctggagctgtggaacacgattaatacactatgtatgcaagatccagccaagaggttagagacaattaacagcttgattgggaaagccgtggccaacgcgcagatagacgagagattcctggcacgcgtccgtcaactccgagcatataagatcaaaatgcaattatga

SEQ ID NO: 10257 - RNA, 942 nt, unidentified
  source 1..942: mol_type = other RNA; note = synthetic construct
atgaaaagctatgcgctcaatcagtgccctctctttaagatggctagtaggcggaagcttgccagcctactgggatttgacgccggggtgcttcagactctagctaacaggaccaccaactacctgtgctttgacatcgcgcagggctccaaaaagagaagagtggaggttcccaagcgtgctttggagagagtacaccggcgcttgttcgccctcttggaacgcatagagaagcctgattatctgcactcgggaagaaagaagagaagctacattacaaacgcccaagtgcacaccggtctggccccactcgtgaaactcgacctaaagaagttctatccgtcagtggcctcctctaggatctatcggttcttcaacgaggtattactgtgctcctgtgacgttgcagctattctgactaaattgtgtaccgtggatggacatctccctactgggtcatgtatatcacagctgctggctttcttcgccgccaagccaatgtttgacgaacttcacgagtactcctttaaattaggcaatagggactcctgctacgttgacgatctgacatggagcggcagtaacgccacacccgccttcctttgggcagctaaacaaatcgttcatcgccatggctttaaataccataaagatctggtgtaccgggctgatcagcagaaggtggtcacaggagtgttaatctctgggggcgagctgacggtacaacgatctcgtgagcacgaactgtggcggagcatccacgcactgggtggtcaggatcccgccaagcgactcaaggcgattgactcacttattggcaaagtcatcgcaaatgggcagattgaaaatcgattcctcctgagggtgcaaggcctgagagcacgccgggtcatgctgatggggtctagggcagaagtcgtcagtagcttgcagcgcggatga

SEQ ID NO: 10258 - RNA, 969 nt, unidentified
  source 1..969: mol_type = other RNA; note = synthetic construct
atggccattagaaagaaatcctatgctattcatcagtgtcctctctttaagattgcgtctcgcaagaaacttgccgcactcttaggattcgacctctcggtgctggaggggctgtcaactgctaccaataacttccggaccttcgagatcaaacaaggcattaagttacggaaggtcgaggtcccaaagcgtcgacttgaacttgtgcaccggaaggtgtttagtctgttggaaagaatagagaaaccagaatacttgcactccggcattaaagggaggagctacatcacgaatgctaaggtgcatgttggccctgtacccctggtcaaactggacttgaaaaagttctacccctccatcgatggagcacgcgtgtaccgcttcttccagcaggccctgcagtgctccccagatgtgagcggtcttctcacaaagctgtgcaccattgacggccatgttccgactgggagctgtgtgtcacaactgctagcctatttcagcgcaaaacctatgtttgatgagctccacatgctcagttcacagtggggcctgagggacacatgctacgttgacgatttgacttggagcggagaaagggctacacccgcttttttatggaatgccaaaaaggtggtgtatcgacatggttttaagtaccacaaggaccacgtgtatacagcagacgagcagaaactggtcaccggggtcatgatcgacggagatcgtatagccgtactacccagtcgagagctgaagctatggaaagacatcaatgccctcggaatgtcagaacctgtggagaggctggccgcggttaactctctgatcggtagtgtagtcgcaaacggccaaatagagccgaggtttctgcagaggttgagaagactccgggatacccgcatctctctgatccgccagcttgaagtgaacttcagccggcagccctctctgctgccatccgatagatga

SEQ ID NO: 10259 - RNA, 933 nt, unidentified
  source 1..933: mol_type = other RNA; note = synthetic construct
atggctacccggaaaacatacgcgctggatcagtgccccctttataagatagcatcccgtaaacggctggctcaggatgtgttcaatgtagatctgccctttttggaacggcttgccgccaacgaggggaatttcagagtcttcaccattaagcagggtgacaaagataggcaggtggaagtgccaaaggtggtgctggagcgtatccaccggcgactttttaatctattagagcggatcgagaagcctgactatctgcactcaggagtgagaggccggtcctatatcagtaacgctaaagttcatgttggtgctgtcccactggtcaagctcgacctgaaaaaattttacccttcggttgacggcgcccgcgtatctcgcttctttacaggaacgatgaggtgcagccccgatgtcgccgccttgctcaccaggttatgtacttttgagaatcacgtgccgactggatcttgcgttagtcaactcctcgccttttttgcggcaaaacctcttttcgacgagctccatgctctggcggaaagcgcagggttgcgcgatagctgttacgttgacgacctgacctggtccggccatggggctacaccagcattcctctgggcagctaagcaggtggtccacagacacggcttcgcccatcacaaggacagatgtttcgcagccggcgaccgaaagctggtcactggcgtgatgctggaggggaaccgaattgccgtattgccttccaaggaattcgatctttggaagaacattcaggcgctgggaggattccagccccaagaacgtatagtggcagtgaactctctaatcgggtcagccgtggccgccggtcaaatcgagagcaggtttctgcgccgcctcttgaggttaaggagagtcagagctgcagccattgctgaagctgccctgacatga

SEQ ID NO: 10260 - RNA, 948 nt, unidentified
  source 1..948: mol_type = other RNA; note = synthetic construct
atgaagtcccggaaaacgtatccgatcgatcaatgtccactctacaggctccagtcccgtaagaaactcgctaaggacgtattcaatctcgagctcagccacctagagtccctggccaaaaacacgtctaactaccgcatttttaaaattccaagcggtgataaagagaggcaggtcgaggtgcctaagccaatactagagaggatccatagaaggctcttcgccctgctggaacggatccacaagcctccctaccttcaatcgggagtgaaggggaggagctacattactaatgctcagctgcacgtggggcttgcccctctggttaagttggacgtgaagaaattttacccctctatcgactcagcaagagtttaccgattcttcaacacaatactgctatgtagcccagatgtaagtggtctgttaacaaagctcaccacatgcgagggacacgtgcctaccggctcatgcgtctctcagttactggcgttttttgccgcaaaacccatgttcgacgagttggattatctggcaaccaagcagtctcttcgcttcagctgctatgtggatgatatgaccttctcgggcacacttgccacaccctcactgctgtgggctgccaagcaaattgtgcactcacatggctttggatatcataaggaccgttgttatactgccgaacaggacaaacttgtgaccggcgtcatggtcactagtgaccgcatcgcaatattgccgtccagagagttcgaattatggcgcaagactcaagatttgggaaccggcgacattgaacagcggatcgccgccgtgaattccctgattgggactgttgtcgcggcgtcccagatcgaagctcgactgttgagcagactgaagcggctgaaagggatcaaagcagcttttgaacaggaggctagtaccagcagtccctctcagagatga

SEQ ID NO: 10261 - RNA, 927 nt, unidentified
  source 1..927: mol_type = other RNA; note = synthetic construct
atgaaggtcaggaagacataccctctgcaccagagtccgctctacaggatgcagagcaggaagagactggccgccgaaattttcaacgcagacatcgacttattggagagaatcgctggccacggggataatttccgggtgttccacatcattcagggtgaaaagcgacgtcaggtggagactcctaaaccaatcctggagcggctccatcggcgactctttgtgcttttcgagcggattgagaagcctgcctacctacagagtggtgtcaaaggacgctcatatatcaccaatgcccaggagcacgttggcgctgtacccctcgtcaagctggatataaaaaaattttacccctccgtggacgccgcccgggtttataggttcttccatgaagtgatgcgctgctcacctgacgtttcagggcttctcacaaaactgtgcatttatgacagccatgtaccaacgggctcttgtgtttctcagctgctggcatactttgcgactcgccccatgtttgatgaattaagcgctctggctgagagccgaggcgtcaaatttaccctgtatgtagatgacatgaccttcagcgggaggtctgcaacccccgcttttttgtgggacgtgaagaaggttgtccactcccatggtttgcagtaccataaggataggatttatgctgcagattcccaaaaagtggtcacaggcgtgcttgtgagtgcccagggcatcgccgtgctgccatcaaaggaattcggaatctggctgcaatcgagaaacctcgggagtggagacttagctgagagacgcgccgcaatagagtccctgcttggaagcgtgatagcggccggccaaattgaaaaacgcttgctatccagagtgcggggactgagaatcctgcacgccgatgcgctccgttctgcagggtga

SEQ ID NO: 10262 - RNA, 1008 nt, unidentified
  source 1..1008: mol_type = other RNA; note = synthetic construct
atgaaacggccctatctctcaaatcaaagcccactctattgcctggaaagcagaaaaagattggcaggggagattttagggctgtcgctccctaagctcgaaggtctggctgcccgtgcgaacaactaccgcgagtgtacccgagttactggcggaaaacagcggaccgtgcacgtgccaatgccactgctcctcgcggtacataggagactggccgtcctgctgaacaggattgctgtcccccattatcttcagagcggacagacccatcgcagccacctcaccaatgccagagcccacgagacagcccggaatatcgccaagctggacatcagacacttttacccctccatcactaaggacagagtctggcacctgttcgtggatggcatgttgtgtagtcgtgatgtggcttcactcctggctagactgttcacacaccaggggtctgcccccataggctccccagtttcccaggttttggccttccacgtggtgcggccgatgcttgacgagctgcaagagcttgcaagccgacacaggctgaggttcacatgctacgtcgacgatctcactttctctggggatggggccgaccatggctttcttgctctggccggagatgtggcgcgcaggcatggttttctacctcatgcagaagcctgctacggccctggagaggacaagttagtgaccggagtaatgctgacacgcgacggtctgagggtacctgcaccccagttgcgacgcattgacgctgcccgccaggagctactcttagccgaaggcaacgaatctcggagggtcctattaagccgacttatcggccacctggctgccgctgcgagtgttgatgactcatttcgtccggagttgtctagtcggtgttttgctgctaggaagctggccgcagcattgcctgcacgcccatctccatcagattccaaagtggcaagtgtggtgccccggcttcggcctatgagactgtcctatggtgtcggaacgtga

SEQ ID NO: 10263 - RNA, 924 nt, unidentified
  source 1..924: mol_type = other RNA; note = synthetic construct
atgtcctatgcatttcaccagtctcccctgtacgtgatgcgttccaggcgtaggctggccgacgaaattttcggtataagcctgacagctttagagggcctggtggagaatggaaacaattacattgagtcacgccgcgtcacgggcggtaaagagcgacttgtgcgagcgcccaagcccctgttgaggcacatccaggagcgcctcgcgcagcttttgaatcgcatcgaggccccggattacttacatagcggacggaagcaaagaagccacatatctaacgctcttgcccatcaaggagcaactcgggtgctcaaactcgacattaggaaattctatccatctatcactagagcccgtgtgtggaactacttcgccggccagatgcgctgttcgccagatgtcgccgcattgctagccaagatttgctgctttgaaggtagtgcccctatcggctcccctgtgagtcaggtcctggctctccaggtcgtacggcccatgctggacgaagttgatgttttagcaagggcccatggcctgacctttacttgttatgttgatgacctgagcttttcaggggaaaaggcaacacccgcatttctctggcaaatcaagcagctgattcggaggcatgggtatcgctaccacggcggaaccgcttacgggccagatgctgagcgaagagtcacaggagtgctcctaaccgcgcaaggacctcgagtgccacctgctcacctgcagggcatacgagccgccagacacgcctttgaggctgcgaaggaggcttcagaccgggaagctaccctgtccgtactgatcgggagattggccgccgcagccgctatcgaaaaaagattcctcgcacagattggcgaccttcggcggaggcgcaggagattcagaccgcctagtttcggggggtga

SEQ ID NO: 10264 - RNA, 954 nt, unidentified
  source 1..954: mol_type = other RNA; note = synthetic construct
atgaccgaccacccgatccatcatagtccattacacggactgagatcctctgagaggttggccagaagggacgtcctcggcctttccctcgaaagactgagcgcgctggctggggatgcctctagttaccgggcgttcatccgagtaactagcggaaagaagagggcagtgacagagcccttaggcgacctcttagccgtccacgatcggctgtacgatctcctcgatcggatagagaagcctgactacctacacagtggcgtgcgtggtcggtcacacgtgaccaatgccggcgctcacctaggggataaggcaacagttaagctggacattcgccagttttattcctctattgatgtgcctagggtatcgagattcttcgggcgccagatggcatgttctgcgccagttacggatctcctcacccggctttgcacctttcgaggtcatgtgcctatcgggagccgtatgtcccaacacctggcctattttgctgctcggcccatgttggaggatctgaggagattgagcgagcgccagggcgtggtattcacttgttacgtggatgacctgagcttctcaggaactgccgccacacccagtttcctgtggcaggtgaagaggcttgtgcatcatcaccgttttggctatcataacggatgctgctatcgcgctggcgaatcacgaatcataacgggggtcgtggtgaccggagagaaactggctgttttgcgggaacaagctgagcgaattcgccaggacgtgcgggacatggacaaattgacagtcgacgaccaaagaagggccctgcagaggatgatcggtaggactgcagccgcagcaagcattgatctggaataccgaaaagtcatgaaacagctggttgccagaagagctcgccttaaatccgccccaccttcaccctgtatggtccgcccatttgacgaagtttga

SEQ ID NO: 10265 - RNA, 1014 nt, unidentified
  source 1..1014: mol_type = other RNA; note = synthetic construct
atggcccaaagcggtaatcagaccgagcttgaacagtcaccattgtttggaatctccgacccacgcgaactggcagagctcgtggcaacacctctgccttcactgtggaggatagcgagggcccgagacaactacacggccctgcagatggaaactgggggaaagctgagaactgtaaaccgtccctgtagagccttgggcgctgtccagcgcagaattcagcatctcctgagttttattcctctacccgattatctccacagtggagtgcctgggcggtccaacctgacaaatgcaaccgttcaccgtgacggcgcatggctgtgtcaaattgatttgaaggcgttcttcgtgcaggtgactgacgccaaagtctttcatttcttctggcagcgaatgcagtgcgagccagaaattgccacccttctgaccaggctaaataccacaaatggccatgttccgctgggcggccactgcagtctccagctagctttcttagtggcacagcctctgctggatgaccttgacagaaccgcccgagaggaggacatcagattttctacctacgttgatgacctctccttctctggtgccaaagcaactccatcctttctctgggccgtgaagcagataatccaccggcacggctttcgttatcatcacgatcgctgtcatcggccaggaggtagacggttagtcacaggggtgctgctgcacaagagctgcatggaggtccgcccccaacttgtacaacgaatctggacggactggagcgctatgttcaccgctcccagcgatgacgcgtcattgcggccgcttcaaggaaggttggctgtggcctcccagatcgagccaagataccgcgaggcccacgatagcatgaaagtcatgcggaagacactccgcgattcgcccgaacctgctctggctcccgcttctgtttcagcactcgccaacaggaaattagtgagggctaggctgagcacaagtgggtctgcccatttcgatacttga

SEQ ID NO: 10266 - RNA, 1059 nt, unidentified
  source 1..1059: mol_type = other RNA; note = synthetic construct
atggcccagaaaaattacgacatcaagtatgacatcacccaatcccctctgtacaaattacggtctaagaagaagctcatctcacttctgaatctcgggtccctctcggacctcaaaagtatcatgcggaccgattccccttaccgaaaattccccatcatgtctaagggaaaattgcggccagtggaagtgcctagcagagttttgttgcccatccataaccggctgttcaggctcctgaagaaaatccatctgccgtcttatctgcattctggagtgaaaggatgttcttacctatccaatgctcgagcacaccgcgaccgcaaggaagcatatactctcgacattaagaagttttacccctcagtgaccagagcgaaagtcgttaccttttttagagagacaatgaaatgcgagccagatatttccgcaattctggccaacattactacttgtgacgatcacattccaacgggcagcagcctgagccaggtgctggcttacctaagttgcaaggagatgtttgacgccctccatgatctgagtcaggaggccggtgtcaccttcacttgctatgtcgatgatctgacgttttccggggatcgaatctcaaagaagtggatttatgatcgggtgaagcccatgattaataaattcggcatgaggagccacaaggataagcacttcagggcgggccaagtaaaagagattacaggggtgattgtagacggctgtatagttaaggtgtgtaacagaatgcaccagtcaatccacaagctgacacttcaaatcgctgagacagaagaacctctactcattgacagcttgtacgacaagcttatcgggaaactgtgcgccgctggccagatagaggaaaggtttaaacttcagcgcgtcatggccactaaaacccgtcgtaaactgttaggtccgaagttcggaagcagtagaatcaagctgaacaatggtaaccaggagatcaggaagaaattaacaccaatacttccctctatatggcgcccagtcgatcatttggacgaatcgataccttgggactga

SEQ ID NO: 10267 - RNA, 903 nt, unidentified
  source 1..903: mol_type = other RNA; note = synthetic construct
atggtgctgaagagtaggtacgccctaaaccaatcacctcttttcaagttgcattcgaaaaagaagttggccagtcttttgcgtctggattccaaagagctcctggctctggctgcgaatcccaacaactttcataagttcaacgtggagaaaaacggtaagctgcgatccgtgcaggtgcccaagaaggatctggaggcggttcacctacggttattcaatctcttgcgccggctcgaaacccctccctacctacattctggaatcaaggggtgtagccatgtgaccaatgccctcgctcatgacggcgcagtgagcacagccaagctggacatcaaaaagtactacccgtctacaggcagagagtatgtctacaacttctttaagatttccctctgctgctctgctgatgtagctaaggtcctcagcgacctgagctgcgttgatggacacattccaactggaagcgctttaagccagctcctggcattttttgcaacccagcaaatgtttgacgaaatcgccgtccttgcgagtgactctgatatttgttttacactctatgtagacgacctgaccttctccggcacccgcgtgaatccaaacttcatatggcaggtgaagcaaatcatctcaaaatacggttacacatatcacaaagtggaatctgcccctccaaataaaacgaaaattgttactgggctggctctgactgcaaacggggccaaagttagaaattcacaccacgagaaaatccacgaactgtatgtccagtatctggatgacacgattgcaactaaagatcttgcacggcttataggcatgctgagttccgccagccaggtcaatcagagaatggccaataagctgaggaacttattggagtcaagggcctccaaatga

SEQ ID NO: 10268 - RNA, 972 nt, unidentified
  source 1..972: mol_type = other RNA; note = synthetic construct
atgatgaagcgcgtctctaaacataaatcctatcctctaaaccagagtgcccttttcaagatcaatagcccaacaaagttggcaaagatccttcttgttagtgacatgtcagtcctctttaagctgcagaacaaaggtgaagaaaactactatttcggcaccacagggagcgggcgggatatcgaggtgccactgagccagcttcggcgcatccataataggataaacaagctcttatctcacatcagcgttcccgactacctgaacagcggcgtaaaagagcggtctaacattaaaaatgcggccgctcacgtgaacgctaaaaaactgctgaagatcgacatcacgaagtattaccaatctataacagaggagcaagtacggaagtgctttaggaaaacttttcagtgttcccctgacgtttccagcctgttggccagtttgtgctgcgtgaggggacacctgccaactggatcaacaatttcccaatcactcagtttcgccgtaaatcgccccgtcttcgactcgattaacatttactcgaacagtaagggggtgaaattcacttgttacgtggatgatctcaccttttccggcgacgacattcctcccagcgagttttgcgattatattgtgggctatatcaagaagtctagaggttacaagtgtcataagatcaggcgttataattccgaaaccgataaaccggtgactggagttatcatttcaaatggccacctgaaagtgatgaacagacatgtgaaagtcatcaattccctgtacaagtccatgaataagatgacggcaagattctcttcaaccgacaaggaattgattcactactttcaggtcctgcagggtcacctgttcagcgcaggacagataaacccccgatataagagactagggtggcatgtggtcgatatacgaaaagagttatctgtgcctgctctcaatcagaataccatgtga

SEQ ID NO: 10269 - RNA, 966 nt, unidentified
  source 1..966: mol_type = other RNA; note = synthetic construct
atgatgtcacgtgtgaacaacaaatcctatccgctaaaccagagccctctcttcaaaatcaattcaccagccaggctcgctaaaattcttctcgtcagtgacgcttctgtgctgattaagctgaaagagaaaggggagaagaattattacttcggctctaccgataagggccgagagattgaagttcccttgtcccagctttctcgcattcatagccggatcaacaagctgttgagcaatattacccctcccgactacttgtattccggagtgaagaaaaggtccaacgtcaaaaatgccgccgttcacgcgggtaataagaaactgctgaagatagatatcgcaaagtattaccaatccataagcgaggagcaggtcttcagatgtttcaggaaggtgtttcagtgcgcccccgaagtggccagcctaatcgcctcactgtgttgtgttaaggggcatctgcctactgggtctaccatcagccagtctttatccttcgcagtgaatcggccagtgttcgataacatcaatatctactcacattccaagggcattaaatttacgtgctatgtcgacgacttaacattttcgggagatgaaattccaagtggtttttgcgactacattgtaggatacatcaaaaagaatcgcggctacaaatgccacaaaatacggcgatataacgcagagacagataaaagagtcacaggggtaatcatcagtgatggaaagttgaaggtgatgaacagacacgtgcgggaaataaactacctgtacaagaacgtgaacagtatgctgaagaagcacgcggctaccgacaaggaacttatccatttctttcagcgcctgcagggccacctttttagcgctggtcaagtaaacctccgctatagacgtctcggcgcatctgttgtccaaattaggaaatcaagtgccgtgcccgctctgaatcagaatactatgtga

SEQ ID NO: 10270 - RNA, 987 nt, unidentified
  source 1..987: mol_type = other RNA; note = synthetic construct
atgagatatgggtggagtctgcttgccaacaacaacaaaggcgtgaagcagtatccagtgcaccagtctcctctctttaagttacgtagccacagcaaacttgcagctgtgcttggaactaaacccaagactctgaaaacagttgtacgcagagcggacaaaaattacaagttcggcaccactgagagtggccgagccatcgagataccgaagtcacaaatcctacggtatcataaccgaataaacaagctgctatgccgtattagtcctcctgactatctgatgtccggcgtgaaagggaggtcttatgtcgataatgcagctaaacacagaggagagagggctgtcgcaaaacaagatatccagaaattctaccagagcacgaccagagatattgtgtatagagggctccgtaagagattgcactgcagttccgacatcgcccagacactggccgacctctgtacagtgaagggacatatacccaccggatcccccatctctcagagcctggcgttctttgtcaacttcggcgtttttgagcacattaatcagtacgccagctcacggggactgcgcttcactttgtatgtggacgacctgacgttttccggccagaaaattccaaagaatttcctcaggtacattagcggttatttggagaagaataggggctacaaagtgcataaaaatcggacctaccacgctaccactgaaaaggaagtcaccggggtaatcctgaagcagggggggatagatgtgaagaaccggcataggcagaagattgattctatgctgcggcgcctgtcctacttttctgacgagtcacaagaatccgatgcaaagacacgggactactttcagcgactcatcggccatttatactcagccggtcaagtctcgccaggttaccgcacaaggggtaaggaaatggttgagattcgcaaagccatcggcatcgaaggacaaaaccagaataataagtga

SEQ ID NO: 10271 - RNA, 960 nt, unidentified
  source 1..960: mol_type = other RNA; note = synthetic construct
atgaagaagaacaagagttataagatcaaccagtccccactgtacaagttatcaagccataagaagctggccgcatgtctgggccttgacaatgagaaaacactgagtaacattctgcagcacggggataataattactatgtgtccaccttgccgagtggccgggttattgaggtccccaagccccaattgaatagaattcaccggcgacttaacaaactgctaactcgcattgaggtccctgactatttaaattcaggagtgaaaggaaggagtaatgtgaagaatgcccaggatcacattggcgaactggccgtgcttaaactcgacatacagaacttctatcagtctgttacgcagcagcagatcgcgcgatgtttcgtgaaatccttcgcctgcccaaaagatgtcgccgaaaccctctctaaactgtgcgtgatccacggtcatattcctacaggatcttccatttctcaaagcctcgcttttatagtaaacaggcccgtttttgatcacatcaacatatacagcatctccaagggtattcggtttacctgttatgtagacgacctaacattctcggggcaaactatcccaaaaggcttttcatcctacatcacgtcttacctgaaaagaaatagaagctacaagtgccacaagatgcgcgtgtataaaacacttaccccaaaactcatcaccggcgcagtagttgtcggaaagctgctcaaggtcaagaacagacataggaaccagattcagaaactgttgcatagctacgattcaatggtgaaaagctacaagcctgacgataacaagctgatcaattacttccagactttgcaaggtcacctctacagcgcagctcaaatcaatcccaggtatcgccagatgggggacatcatagtgcagcgtcggtgccatcttggggtgcctgctctgaaccagaacactaagaaatga

SEQ ID NO: 10272 - RNA, 960 nt, unidentified
  source 1..960: mol_type = other RNA; note = synthetic construct
atgaagaaaaataagtcttacaagatccaccagtcccccctgtacaagctgcggagtcataaaaaactggcatcttgccttggacttgaaaaggaacagactttgaggcgactcattaaacaaggagacaagaactattacgtttccaaactgcctgatggccgcgtaatcgaggtccctaaaccgcagttgaaccgtgtgcacagaaggattaataagctactgactcggattgaagtcccagaatatctcaattcaggcgtcaaaggtcgtagcaatgttaagaacgcaagggagcacacgggagagctgagcgtgctgaagctggacatcaaaaagttttaccctagcgtcaccgaacaacagattgctagatgttttgtcaagagcttcggttgtactaaggacgtggctgagacattaagtaaactctgcgtggtcgatggccacttacccaccggctcctcaatctctcagagtctttcgtttaccgtgaaccgaccagttttcgatcacctgaatacatatgccaaagcccgaaagatcaaatttacctgttatgtggacgatctgacttttagcgggcaggcaattcccaaggagttctgcaaatatgtgacagcgtatctcaaaagatctagggggttcaagtgccacaagatacgggtgtacaaagctatcacgccaaaatcaattaccggtgccgtcgtggtgggcaacgttctcaaggtgaagaactgccatagaaaacgcatccagaagttgctgcatttatacaactacatggtgaaaaggtacaagcctgacgatgagaatttgatcaactacttccagagacttcaggggcatctatattccgctgcccaagttaatccacgctaccggcagatgggggacataatagtacagcggcgctgtaacctcggagtacccgccctgaatcaaaacacaaagaagtga

SEQ ID NO: 10273 - RNA, 984 nt, unidentified
  source 1..984: mol_type = other RNA; note = synthetic construct
atggaaaaacagtatcacctgaatcagagccctctctacaagctcagaagctttaaacggttagctaaaattctggactgcccccagaaatctctggagaagctcctcttacaaccgaacaataactattacacctctcacatcaaccaggaaaaaatcattaaaggctcaaagcagatcgtccagcgcaagattcaggtcccaaaaccacagcttaataggatccataagaaggtgcagaagttcctaagtaagattgagaagcccgggtatctgtttagcggagtcaaacgccgaagcaatgtgtcaaatgcactctaccatgtcgaaaccgattacatgcgtaagatggacattcaaaaatactacgagaaaacatcagccaagtatgtgtataaatgcttcgtaaataccttcagaatggctcccgatctcgccaaggtcatgacgaaattgtgcacatttaatagccacatacctactggctcctccctttcccaaaatctggcgtttttctgtaatcttcacctgttcaatcagattgagtctttctgcaaaaaaaggaagatctcattttccctgtacgtggacgatctgaccttctctgccaaacataagctgacaaaggatcttactaaccggatcgtgcacatctttaacaagaacagtgactatgttatccataaattccaggtgtacaacaaggagacgccaaagctggtgaccggcgttatcttgaagaataacataatgctggttcccaacaaattgcgagtaaagatgctgaaccacgacaaggagaaatccattataatcgataacttgagcaacgacagagatggagcaataaatttctatcagaggtttatcggtctagtgagttgtgctaaccaaatttcgcctaactacaagctgtggacaaaagaattatgtgaagagcggaagaagtacgggattcaagccgtgactggtaagaaggactga

SEQ ID NO: 10274 - RNA, 972 nt, unidentified
  source 1..972: mol_type = other RNA; note = synthetic construct
atggagctcaaaaagtatgacatcaatcagtcaccgttgtacaagctcaataactacaagcgcctgttgaagattctggacattaaagacaaatctctgaccaagctgctcgttgctggagataataatttctacacgtcagaaattggcggacgcaaggtgcaggtgcccaagccacagttatctcggttgcataagcgactgcagaaactgttcagtagaattcagacaagacccttcctgtattcaggtgtgaaaggcaggtctaacgttgataatgcccgcgtgcacgagaagagctcgcacctcctgaaggtggacatcgcaaaatattacgagagtacgaactttaagagagtgcttaagtgctacatcaacatattcaaggtttccccagatctggccgagatcctcgcacggctgtctacctattccggccatgtccctactggaagctccatcagccaatccctgacatacttctgtaacataaaggtctttgatcaagtgatgctatattgcaaaaagagaggggtgaccttcacattatacgttgacgacctgacattcagtagccgtgtgccattaggcaacgggtttttgggaggtatcaacctcattttttccaaaaacaccgactataagctccacaagattagggcttacaaccccactaccccaaaaaaagtaacaggggtcatattgaaagggacttctctggatgtacctaacgatatccggaaacggctgaatgaatttaaaatgaagcacaggcgagtcgtccttaactacgtgaataatagcactccgtccagttacgaaaacgctattgcgcatttccagaaatttattggccttgtatcgtgtgcctcacagatcagcccctattataagctatggaccgacagcctttgcaatgagcgtagggtgaataacatccctgccgtcaatcaaaacaatcctatgccctga

SEQ ID NO: 10275 - RNA, 942 nt, unidentified
  source 1..942: mol_type = other RNA; note = synthetic construct
atgataaagtcttacaatcttaaccagtccccgttgtatagaatcaactcccataaaaagctgtcctcagtgcttggagtgaagtcaagcagcgtgttgacaaaaatcgtgagcaagtccgataataactactacctctcaaaggtggatgacagagacattcaggtcccactgaatcagttgcgtcgcattcacaaacgaattgatagtctcctccgacggatcgaacagcccgattatctgtattctggcgtaaaagggcgctctaacgttctgaacgcccgtgtacacgacaataattacaacgtcctgaaactggacatcaaaagctactaccaaagtgtgtccaaggatcaggtcgcccggtgctttattagcgtctttaaatgctctcaagacgtggcgaagacgttatcagagatttgtacctataacaatcacatacccaccggatcaccagtgagtctctccctcagtatggctgtgaatcggcctgtcttcgaccatatccataagcattcgcattccaggaacattagattcagttgttatgtggatgatcttagcttttctggtaaagtaatcccattgagcttccgcgactacatcgtttactatctgaaaaagtcgcggggctacgaatgccacaagattagaagctacaatccttcaacacctaaaaagataactggcgttgtcttaactaaaaacggcctgaaggttatgaataggcacaggtccaccatcagttctttactcaatgaccggaaacgcatcctgaagaataacaagaaggatgacgagcttaccattaacttctatcaaaagctgatcggacacctgtttagcgcagggcagataaatggtagatataaacagctggggaggatcctagtgaacgagaggaaactatactctattcccgcttgtaacaagaagtga

SEQ ID NO: 10276 - RNA, 939 nt, unidentified
  source 1..939: mol_type = other RNA; note = synthetic construct
atgccctatgagatcgagaattctcctctcttcaaaatcacctctattcaccggcttagcgaggtgctgcagcttcgggtgggccgattgaggcgcctggagtatctgacaggccaatttaaagagggcacaactgagagaaatggtaagcagagaaagactgaaactcctattagaacgatgtgcagggtccataacagagtgcagaagctactcagccgtatccaaatgccgaactacctccattccgggaagaggaagagatcttatctgtccaatgctgtcgcccatagtggacttatacagtccttccaggttgatattgcaaaattttacccatcctgtacatggcaccacgtctatctgtgcttcatacgccagtttcagtgttcaagcgatatcgccggaataatggccaccatcctgacctaccgcggtcatattccaactggatctcctacctctagcctcttggcttttctgtcacacaaggagatgtttgacgccttatacgagttagctcagagtcacaacctgacgatgacagtttaccaagatgacatttcgtttagtgggtctagcatttccgaatccttcaggagcgaagtaagatgtatcatcaaaaggtgcaatctggtgcctaagcgcagcaagcagcgctattgccatggtgggaggagtcccaacattaccggggtagtgctcaccagtagaggacccaaagcaccacggagcaggcacttggcgctacggcagtctatagacgaattcgatgctgcagaatcagagatcgacctccgcatctcataccaccgaatgatgggccgtctgtcagagatcgaacgagttcaaggccggctgttcgaccttaaacccaagttgaagtcccggttccgttcgcgactgaaagccatgtcccagtgtccacaggtggaatga

SEQ ID NO: 10277 - RNA, 1056 nt, unidentified
  source 1..1056: mol_type = other RNA; note = synthetic construct
atgaagcagaaacgaaagaaatcagtgaagcgcgagcgtaaatcctacgacatctgccaatctgccctgtataataccagtacaaagagcaagctggcctccttatttagtatcggcttgcatgaactgagagaatgcataggggactaccggcagtttcagctgatacctgaacccgaccccttcaaagctgggaaactccctaaggcccgacaggttcaaaaaccttcagctagacttctggtcatccacgaacagatccttaaactactgcgctgtgtgagggtgcctgagtatatgcagttcgctttgaaagggaccagctacaagatcaacgccgagagccacctctctaagaatactgtcgctacgttggatattcggaactttttcggaagcacctccaaatccaaggtgtttaacttctttaaggaggatctgaaagcccctggagatgtagccaatttatacgctgatcttatcaccttcgagaactgcctgcccactggttcgccactttccccgttaatctctttctatgccaacaagaatctctatgaggacattaataacctggcaaaagctcataatctgaagttcacatgttacgtagacgatctcacttttagcggcgataagatctcaagcggattcatgtggcaaattgaagaggcaattgcaaaatatgggcacgtcgtggcgcgggacaagacaaagatatacaagaacggtagaccagcgcatataactggtgttattgtgcacgatggcgtcattagggtcccgaacgcccgccatcgtaaaatgcggctcatcaaggcggcaattgccagaggaaaaggaacacacgggttttctaagaaggagcttgagtacaagctcggcggcctgttgggcgaagcagcttatctggacccctcacacctacccgccgccatcgagttcaacaaaagcgttcagaggtacagtctggtggcaaccgagtataagtccaataggccagaaacgggctctgaacagccactcgacagtcccgtgaatctgccatgggactga

SEQ ID NO: 10278 - RNA, 1056 nt, unidentified
  source 1..1056: mol_type = other RNA; note = synthetic construct
atgaggcagaagagggagaaggtggttaaaagagagcgtaagtcttacgagatctgccaatccgccctgtacaatactagcaccaagagtaagctggcgagtctgttcagcatcggaatacaagaactgaaggagtgcataggagattacagacagtttcagcttaaatctgagccagacccgtttaaagcggggaaacctcccaaagtgcggcaggtccagaagcctagtcctaggctcttagtgatccatgaacgcattctgaaattactgcggtgtgtgagggtccctgagtacatgcagttcgccctgaaggggacttcctacaaaattaacgccgaggcacacctaggtaaaaactctgtcgctacacttgacattcgcaacttcttcggatcgacgtcaaagagcaaggtctttaattttttcaaggaggccctgaaagctcccggcgatgtggctaacctctacgccgacttgatcacatttgataattgtttgccaacaggctcccccttgtcccctctgatctctttctatgccaataaatcactcttcgacgatattgacaatatcgccaaggcacacaatctggtatttacatgctatgttgatgacctgaccttttctggagacaagataagcgatggcttcatgtggcaaatcgagcagaccatcgctgcacatggccacgtcgtggcctcagacaagaccaaggtgttcaaaaacgggcgacccgcacacataactggtgtgattgtgcacgatggcctgatcagagtacccaatgcacggcatcgaaaaatgcgcctcattaaggctgcaatcacatccgggaagggcacccatggcctcagcaagaaggaacttgagtataaattgggaggtcttctgggggaagcggcttatctagacccgtcattactcccagctgccatcgaattcaacaagtcctttcagaagagcaacaccaaaactattgaacataaggccgaccacacgaacaaaaatgacaaacagagtccagatagccccattgatgttccatgggaatga

SEQ ID NO: 10279 - RNA, 1053 nt, unidentified
  source 1..1053: mol_type = other RNA; note = synthetic construct
atgaggcagaaacgagaaaaagccgtgcgacgcgaacgtaagagctatgacattagtcagagcgcactgtataatacctcaaccaagctgaagctcgcttccctgttttctgtggagatcggagcactgaaggactgcattggcgactatagacagttcgaattgattccagaaccggatccctttaaagctggtaagccccctaaaagtcggttggtgcagaaacctgcacctcgcctgcttgctatacatgagcggatcctaaaactgctgagatgcgtgagggtcccagaatacatgcaattcgccctcaaaggaacgagctacaaaagaaacgccgaggagcatcttcacaaaaagtgtgtggctactctagacatcagaaactttttcggcagtacaagcaagtccaaggtatttaacctgttcaacaatgatctgaaggcgccaggagatgtcgcgaatatgtacgccgacctcgtcacagtggacaactgcctacccaccggaagtcccctttcgcccctgatgtctttttacgcgaacaagaacttgttcgatgatttgtctaagctggctcacgctcataaccttaccttcacctgttatgtagatgatctcacattctctggcgaaaagatctccgagtcatttctttggcaagttgagcgcgccatcgccgcgtatgggcacatcgttgcttccaataagaccaagttattccagaacggtaaaccagcccatataactggtgttgtcgtccacagcggcgctataagggtgcctaacgcccggtatcgtaaaattaggctgatcaaggccgctattgccactggcaaaaataattacgggttaactcggaaggagttggaatacaaactcgggggcctcctcggggaagcagcatacctggacccaagcaatctgcctgccgccattgagtttaataagtcatttaagcgctcctcttcacctctgccggagcacgtgcccgataatcccgcagcaacggagaaaacattcgacgacgcctccgacttaccatggaactga

SEQ ID NO: 10280 - RNA, 1116 nt, unidentified
  source 1..1116: mol_type = other RNA; note = synthetic construct
atgaaactgagaagggagaagaaacccaaaaaagagcgaaaatcctacgacattagccagagcgcactgtacaacacttctagcaaggcgaagctggctgcaatctttagtaccgacatccaggaggtaatccgctgtataggagactatcgccgttttgaactcatcccagaactggatccattcaagctaggtaaaccaccaaaagtgagacaagtccagaagcctgctccgaaacttctggcaattcacgagagaattttgcggcttctgcggtgcgttcaggtccccaagtatatgcagttcgctctcaaggggacatcttacaagaataatgccgagatgcacctcctcggtcgatgcgtggccactttggatattaggaatttcttcgggtccacatccaagtcaaaggtttttaacttcttcaacggaccgctcaaggcccctggagatgtggcgagtctgtacgccgaccttaccacttttgatgactgtctgcctaccggtagccccttatcaccactgttgagcttttacgccaacaaagccttatttgacgacctgaacataatcgccaccgagcacggcttaacatttacatgctacgtggatgatctaactttcagcggcgagtcaatttcccggagatacctctggcaaatcgagaataccatacgtcagtatggccatgtggtcgctagtaggaagacgcggctattcaaagacgggattcccaagcacattacaggcgtagttgtccacgagggctctattagggtgcccaatgtgagatatcgcaagatgaggttgatcaaagaagccatccatggatctggcaagaaccacggactcacccgcaaggaactggaatataagcttggcggtctgctgggagaagcggcctatttggacccttcaaatctgccggctgcaatcgagtttgggaagacctcgcacaagaacttcctcaaaaccataacgtccgtgcaggaatacctggaaccccccaaacctaatgctactgacgagaaattccatcctccttggcatgaacaagagcttatcacaatgctgctgccagaacatgcaaacgatgggaatgaggccgattga

SEQ ID NO: 10281 - RNA, 1056 nt, unidentified
  source 1..1056: mol_type = other RNA; note = synthetic construct
atgaccctgaagcgggagcgaaagacgaaaaaagagaggaagagctatgatctgtcacagtcggccctgtacctcacccgcaataaatctcgaatggccgccatccttgcaacaaccactcaaaacttaacagactgcattggcgattatcgcagatttgaaacagtgccagagaatgatcccttcaagttgggaaaccaaccaaaacctaggcaggtccagaagcctgccgccaaactcatggcaatccacgagcgcattcttaaactgctgaggtgcgtgaaggtgcctgaatacatgcagtttgcactgaaaggcacatcatacaaaaagaacgctgaagctcacatcagtggcaagtacgtggccactctcgacattcggaatttttttggctctacctcacagtccaaagtattcaactttttcaacggaccacttcgctctcccggagatatcgctaacatatatgcgcagctcacgaccattgataattgtctgcctactgggtccccactaagcccgctgctgagcttttacgcaaataaaaagctcttcgacgatttaaacgacatcgctaaagaacatgagctgactttcacctgttacgtcgatgacctcaccttcagcggcgagtgcataagtaacagattcctgtggagagtggaagaaagaatccggaagtccggccacattatcgcggctaacaagacaaggattttcagtgagacaatgccgaagcatataactggggtagttatccaggacggggggatccgtctgccatatgtgcgtcagcggaagattaggttaataaaagacgcaatctctggaaaagccaaaaatcatggttttaccaagaaggagctagagtataagttgggtgggctgctgggtgaggccgcctatttggaccctagaaatttgcccgctgccatcgagttttccaaaagcgttcggatgaattccttcaagttcttcaagctctttgactacgtcgaacttccaaagcccgcagcgcccgatgagaactttattcccccttggcaagaatga

SEQ ID NO: 10282 - RNA, 1062 nt, unidentified
  source 1..1062: mol_type = other RNA; note = synthetic construct
atgcggcttaagcgcgtaaagaagacgaagcaggaaaagaaatcatacgaattatcccaaagcgctctctataaaaccagttcgaaatgtaagctgtccgccatcttttctctgtctgctccagacatcctcaacagtatcggagattacaaacgcttcgagatgtcccccgtgcttgaccccttcaagatcgggaccccccctaagacacgatgggtgcagaaaccaaaggggaaactgttagcaattcatgaacgcatcctaaagctcctgagatgcgtggaagtgcctgagtatatgcagtttgcgcttaagggcactagctataaaaagaatgccgaggcgcacttggctggctccatggtagcgaccttggacatttcgaattttttcggctcaactactaagtctcaggtgttcaacttctttcgggacagactgaaatgtgccggagatattgccaagatatacgctgaattagtcacctgtgacgattgcatccctaccggctctcctctgtcacctcttctgagctactacagtaataaaccactgttcgacgagctgtcctgcctggccaaaaacgccaacctgcactttacctgctacgttgacgatctaacatttagcggggcttacattggtcgaggtttcctttggcaagtcgagaagacaattaagaagtacggtcacatcactgccagcaagaaaactagactgttcggactcggggttccgaagcatatcaccggaacagttatagcagatggggctctcaaagtccccaatgtgagattcaggaaaatacgtctgatcaaactggcaatcgagggcaggattagcaaatttggcttttccgatgtgcagttgaaatataagctgggagggttgctgggcgaggcagcctatcttgacaatgactttaagtcactcgccgacgaatataatcggaagattagggaactaaacctcgcctctctggaaggcggagagacatataggagcagtacgaaaccgttggagctcgcagatgataacttcatacccccatgggagatttga

SEQ ID NO: 10283 - RNA, 1080 nt, unidentified
  source 1..1080: mol_type = other RNA; note = synthetic construct
atgaaacccaagagagtgaagaaggcgaagcaggagaagaaatcttacgaaatctcacagagtgctctttataagactacttcacggagtaaactggccgctattctctccctctctatacatgacctcctatgttcgattggtgactataagagatttgagatgaccccaaagcccgacccgtttaaaatcggaaaaccaagcaaaaccaggtgggttcagaagccaaaaggtaagctactggcaatacacgaacgcatcctgaaactcctacggtgcgtgaaagtgccagaatatatgcagtctgctctcaaaggcacaagctacaaacgcaatgcagaacaacacctgtccgggtgcatggtggcaacccttgacatttctaacttcttccgtagcacaaagaagagccacgttttcaatttctttcgggataggttagaatgccccggggacattgccaatttttacgccgagctggtcacctgtgatgactgcatccctacaggctcacctctgtcaccattgttgtcattttatagcaacaaacccttattcgacgagctcagcgtccttgcgaaaaactccaatttgcagttcacatgttacgtggatgatctcactttttccggcagccatatcacgcatgacttcctctgggaagtacagaagattgtgaagaagcatggccacgtgacagccactaagaagacccgactgtttggggcagaagtacctaaacacattaccggaaccgtcgtcgctgaaggcgtgctgagggttccgaatgcccgttttcgaaagatccgcctgataaaactggccttggagggaaagcgggacagtttcggtctgacgaagacccaaatggagtacaaactttctggacttctgggcgaggccgcatatttggacaacgatttcaagtccctggccgatagatacaacacgactatcagggagatcaacttagctagtctgggggatggaaagtacagacccagcctgaaggctacagacctgattgatgataaattcatccctccttgggagactgagcagagttcctccaaatcttga

SEQ ID NO: 10284 - RNA, 1080 nt, unidentified
  source 1..1080: mol_type = other RNA; note = synthetic construct
atgaaacagaagcctgtagagtcccacataaagaattacaaatcttacgccctcaaccagtgtgctatgttcaacacctctagccgaaccaggctggccgcaatccttctaaagcccctgcatcttatcatggagtccatagggagttacagcaagttcaaaaaagatccaaagcctgacccgttctcgcataaaaagccaagacgccctcggagcgtgcagaaaccaaagggggagctcttacacattcacaataggatgttacgcctgctgaagagggtggtcgtccccgactacatgcaagcggccctggctggtacaagctatcgtaagaatgccgctatgcatgttggtgggccatgcgttgcaacgttggacattagaaattttttcgtggctactaacaagtcaaaggtcttcaactttttcgagactgatctgaggtgcacaggagatatcgcctcaatttacagcgagttggtgacttgtaatgactctcttcccaccggcagcccactgtctcccctcatgtccttctatgccaataagagactgttcgacgaattggatgtgttggcccgtaataacggatttatctttacctgctacatcgatgatctaacattcagcggcaataacatcagtggttcctttctgtgggatgtagaacgcatcgtccactgttatggccatgaagtgaccgcagggaagactagactgtttaaggctggacggcccaaacacgtgaccggcgtcgtgctgtttgacaacgaggtgagtgttcctaactcaaggtataagaaactgcgcaacattaatgccgctctcgaaggccgggcaagtatgcacgatttttccgaagtagagctgttaaacatgaaagcgggagttttgggcgagattgcctacctcgatcccaaaaaggggttccttgcgagacgggcaattgacgagcttaaactccgagacttgaagatcctgggcgacggtaaactgaaaatatctacgtcacctccagcctatctctcccctggagaagtgcccccgtggcaacctctcccactggctacacccgactga

SEQ ID NO: 10285 - RNA, 1002 nt, unidentified
  source 1..1002: mol_type = other RNA; note = synthetic construct
atgcccggcaatgctagcgccaaattgttggcccggaggtcccggagtaagagatacgatatcgatcagagccatctttttagagttggaagtcctgctcgcttatcaatggtgctgggtgtgagcctggacaaactgttggccctttcacgacgcactgataactataaattgttccagaaggaagacgtggatccctttgccagacatcataggcgccggcgcgatatacaggaaccaaaggcagccctgaagaagatacatgagcgggtggcaaagctgctgaaattcgttagagtcccaacctacctgcactccgctatcaaaggggtgtcctatcgtaccaacgcactggagcacgctgagaggggtgtgtcaattcttacgatggatatcgccgatttctatccatcaacgggggcgtcccgcgtatttaatttcttccgcgatgtcctcgaatgcgctcctgacgtgtctaaattaatggccaagctcctgacatggcgtggcgtgttagctacaggaagccctgcatctcctctcctgtcgtttcactgcaatagacccatgtttgacgagatggcggccgtggctgtcaagagcgagttcacttttacctgttatgtcgacgacgttactttctccggcgtcaacgtacgacgggggctagtttctgaaattgcttgtattgcccgccgtcacggtcaccggatcaaggaacacaaaacacgattttactctgccggccaagcagggattgttaccggggtcgtggtcgaggacggaagtgtgagtgtaccccatgagagacgactgaagggcaggaggattgagacagcaatcgatggagcgaccgacccggtagaaagactcgcgctgactgagaaacttatgggcctcgctggcgaagccgcatacctagacaaagccttcaggccatgggtggactccatcaggggaaagctcaaggtgctgagaaggagctacgcctctcggcggtga

SEQ ID NO: 10286 - RNA, 993 nt, unidentified
  source 1..993: mol_type = other RNA; note = synthetic construct
atgcccgagtcgacccccaaaaaagtggtgcggcgtagggacgggtccgacagatacgagattgaccaatgtgccctctataaaacaggatcattgcgccgcttggccaaaatcctgctcatcgagaaatcagatctcatcgccctttctaatagacgcgatctgtacagcgtctacgatctggaagatgacgacgagttttcagataaacggggtaaggtgcggaagatacaggatcctgttgaagagctcaagaagatccagagacgggtggctaagttattacactatgtcagggtccccagatacctgcatagcgcagtgaagggagtgagctatcgcagtaacgtgaaggcacacgcccacgcagggtccaatatactaactatggacgtagccagcttttatagtagtactcgggaaagtcaagtttttaggttcttccgtgaaaccctgctctgcgccccggatgtcgcacgtatgcttaccaggctgttgacgtggcatggagtccttccaaccgggggtccagcgtccccactgctaagcttccactgcaatcgcgagatgttcgatgagatagccagggaagccgagcgagctggggtagtgttcacatgttacgttgacgacattacgttttctggcacaaacgtcaagcgaggcttcgcttccctgattgatagaatcgtgcggcgctctggctatcgaattgcagcccagaaaacacgattttaccgccctaaccaggccgctctggttactggcgctgtgatccaggacggaaaggtgtccgtacctcatgctaggcggagaaaggcgaggagaattgagattgccgcgaggagcactaaggaccctgcaaggagactcgcactgaccgaaaaattgatgggactggctggcgaagcagcctacatcgaccccgcctatcgcggttgggcttacgcggttagaggccgacttgtggctctgcggaaatctgccgcctga

SEQ ID NO: 10287 - RNA, 1014 nt, unidentified
  source 1..1014: mol_type = other RNA; note = synthetic construct
atggccaaacgcggactctatgatataaatcagtgtgccctttacaaactggggtctaaagctcgcctggcccaaatcttgggcgtgcctaaggccagactgctcatactggttcgtcgatccgagaactacagggttttcacactaccccaggaaatttgcgaatttaccggaaaggtgcgcaaggaacggctcgtgcaagagcctaagcccgagctaaggcgggtccatgagcggattcagaggctgctgtcgcgcatccgacctcccgaatacggtcacgctgctgtgaagggacgctcctatagaactaatgcggaggcccatctcaacgggcccagaatcgccactttcgacgtgagacgtttttatccgagtacttctcggtccgcagtacggaacttcttcagcgagcaactgtgctgcgctcctgacgtcgcagatcttctggcccaattgtgttgctggcagaacgtgaaggaatccaatagttctagcgggctcccaacggggagtccgctttcaccaatcctctcactgtatgcgaataggccaatgtttgacgtgttaaacgactacgcaggccgccaccagctggtgttcacatgttacgtagatgatttgacctttagcggcgagatgctcccagcaggaatctctaagttcgtcgagaagatcgttacagccggtggccacaccctggctaccgaaaaaacaagattattccggagaaatcaggtgaaacacgtgactggggtcgtactaagcaactcccaggttaaggtcccccacgcaaggtttctgaaagctcgtgcgattgccagcgccattaccgcccatgaaacggccgatgcaaggtacagattgctgctgcagcgaaaactcgccggtcttttgggcgaggccgctttcctggacagcaggtttgctggctgggcgaatcgggcatatgctgacttacgagcagtgcaggccgaggtgcatatggctgagtcacttcacgtcgaatcatga

SEQ ID NO: 10288 - RNA, 1011 nt, unidentified
  source 1..1011: mol_type = other RNA; note = synthetic construct
atggctaaacgggagctgtatgacataaatcagtgcgctctgtataggttgggatccaagacacgcctgagtatcctcataggggtgcccaagagcaagctcctggcactggtgaactcactggaaaactatcgcgttttcccgttaccccaggaggtgtgccaatttactgggaaggtccgcaaagagcggttggtacaagagccaaagccggagcttcgaagggtgcacgagcgtattcataaactgctcagcagagttagaccccctgagtatggccatgcggcggttaggggcaggtcctaccgatccaacgccgaggcacatatcaatggccggcgggttgctacgtttgacgtaaggcgtttttacccctctacatcactgagcgccgtccgcaatttttttgccgatcagctctgttgtgcacctgacgtggcagacatcctggcacgtctgtgttgttaccgcaatgtgaaagaagcctcatccctcctcggtcttccaaccggctctcctctcagcccactgctttcgttgtatgccaataagcctctattcgatgccctctaccactacgctggacgccacaaactggtgttcacctgctacgtcgatgacctgactttctctggagcactgcttccacgaggattaagtcagttcgtgaccaagatggtggagtcttgcggccacacactggctcaggaaaaaactagatttttcaggtcaaaccaagtgaaacatgtgaccggtattgtcatcagcgacaacgagatcaaggtaccccacgcccggttcttgaaagcccgagccatcgccagtgccattgcgaagcacgccccagctgatgtccagcagcggttactgttgcagagaaagctagcggggcttctcggggaagcagctttcctggatggcagatatgctggttgggccaacaggtcctacgtcgatctaagagcaattcaggaagaagctagagctgccgaacttcatagccctgaatga

SEQ ID NO: 10289 - RNA, 1044 nt, unidentified
  source 1..1044: mol_type = other RNA; note = synthetic construct
atggcgaccagagggttttactcgattgaccagtgtgcactcttcaagcttggctccaagactagactcgccgaactgttacacgtccccaaatctcatttgacgaaacttgcggccggctccgacaactaccgcctgttcgagctaccacgagaggtgtgcgaatttacgggtaaagtcaccaaagccaggtgggtgcaggagcctaagaatgacctgcgccaagtgcacgaacgattacagaaattgctggccaggattaggcctccagagtacgggcatgctgctgtcaagggacggagttatcgtacaaatgccgctgcacatgtacacgccgctgtggctgcgacttttgacatacggcggttctacccatcaacacctcgtctggccgttagggatttctttctccatacactcagatgcgcctcagacgtagccgaactgttgacgaccctgtgttgctaccaggacagaactgaagaaggtgcacagtgcgggctccctacaggctcacccctttccccgatactcagcctgtatgctaaccgagccatgttcgataggctccaccggttcgctctgcaacacgagttgacctttacatgttatgtggacgatctaaccttcagcggtcccctgttaccgcgctctctgggacgctttgtacggaagactgtggacgcttatggccacagtctagcagttgagaaaaccaaagtgttcaggagggggcaagccaagcatgtgaccggagtcgtgatcgttaataacaagatcaaggtcccaaacgcccgctttaaaaaggcacgcgccatcgcagcggttattcagagaactgccagcgatgactatatgcgactgcttgccttgcagagaaagctgtctggcctccttggcgaggctgcattcctggatcccgcatttagtgattgggccagacgtagctaccgggatctgaagaaaatcaatgaagaggctgccacctctacatccggggtgggagcagcaaaggagggcactggagctgtggcgttcctgtga

SEQ ID NO: 10290 - RNA, 1023 nt, unidentified
  source 1..1023: mol_type = other RNA; note = synthetic construct
atgctgttcatgaaaaagcagaagagctatagtatcgaccagtgcgtgctctataaggttggaagtaaaaagcggctcgctgacatcttgaatatccctctgtcgtccttgttgaaactggctaagtccaagaacaactaccgagtcttcgagctcccttttgagcagtgtgaattcacaggaaagaccaaaaacgccagggttgtccaggagccgaagaagctgctaaaggccgtacatgctaggttacaaaaactgatctctcggattgaagctccaaagtacggccacgccgccataaagggacggagctatagatctaacgcctctgaacatatctcttcagtgtacctggcgactttagacgtgcgaaagttttatccctccacgaggcaaagcctggtgcgtaattttttcgccgatcagctccggtgcgcaccagatgtggcggacatcctgaccaagctctgttgtttttttggggcaagtaagacaggaggatccgttggcctccctacagggagccccctttcaccaatattaagcctttacgcaaacaagcctatgttcgataagctgcaggggtatagtaacgacaactcactcatcttcacgtgctatgtggacgacattactttttctggcgaggcccttcccaaggacattgtgagaaaggttggcgagattgtgtactcctacgggcacactattgccgtagaaaaaaccaagatctttcgcgagaaggatacaaaacacgtcaccggtgtcgcaattaaaaataataggatctctgtcccacattccagattcaaaaaagctcgtgcgattgagaggataataagcaatactccccaggaggaactagccaaaaaaagaaccctgcagcgcaagctggctggtctgcttggcgaagcaggctttttggattcaagatacaaaccgtgggccagccgctcctacgtggatctgaaaaaactggagtatgacttcaatcaacagtcgcgccaagtggatttcaaatga

SEQ ID NO: 10291 - RNA, 1005 nt, unidentified
  source 1..1005: mol_type = other RNA; note = synthetic construct
atgacaaaccctcctctccgtctggtcacaaagacccccaaaaagttttatccgattaatcagagtgcactatataagattggaagcaaaaagcggctcgccaagatcctggccacctcactggagaggatcttacttttatctacggccactgataactacaaaattttttgtctcccagaggaagtctgcgagttcaccaaaaaaaccaagaaatctagatgggtgcaggaacccaagcgtcccctgcggtcaattcacgaacgcatccaaaagcttttgaagtccattatctaccccgattatagccacgctgccgtgaaaggcaggtcttacagaaccaatgctgaaacacataaagatgccacccgagtggcaactttcgacctgcgaaagttctacccctccacctcaagctccagagttagggatttctgggcggagcagatgctttgcgcgcctgatgtggccgacttgcttgcgaaattgacatgtcacgaggggtgtctcccaactggttcgcctctctctcctctgctgtccctttatgctaaccgcccgatgttcgatgacctgaatgagctggccaacagccataacctcaagttcacatgctacatcgacgatctgaccttttcaggtccaataatcccaattgggctgccccggcttgtcagtaatatagtccatcgcagtggccacacactcagcgttgagaagactaaaatttttcggagcgaccagaggaagcacgtgacgggcgtggttgtgtacgggaattccttgcatgtaccttacagcagattttttaaggctagagccatccaaaatgcattcgacctggagaaaaactccatcgctaagctggctctagcacggaagctgagtggattgctaggagaagccgcctatctggacactaggtacgcagacttagctaaaaagtcttatgtagagctcaaacgaatcaacgaagaaataatgcgcgacaagctgccattctga

SEQ ID NO: 10292 - RNA, 960 nt, unidentified
  source 1..960: mol_type = other RNA; note = synthetic construct
tacactatcgaccaatgcgctctgtacaggctcggtagcaaagcccgcttatcggccgtacttggaatcacactggattggcttctacagctcgccgagtctgaaaagaattactgtttgttcaaccttcctgaagaggtgtgcccctttaccaggcgcgtgaagaaggctagagcggtacaggcacctaaaaatggcctccgtaccgtgcatgagaggattctgcacctattacggcccatcattctgcccacgtacgcccacgctgggatcaagggaaagtcctaccggtccaacgctgctgctcacaaagattcaccccgcctggctgcatttgacatcaggaaattctatccctccacgaccgccagccgagtttattacttcttcgccgacaagatgctttgctctcctgacgtcgccaggttactgaccgcactcacttgctataagaatggcctccctactggctcaccgctgtctccgctgctgtctctgcatgctaacatgccaatgtttgatagcttggaggccctggccttgagtaacgacctggtgtttacatgttacgtcgacgatctaacattcagcggggaaaaattgccaatcggcctgccaagactcgttaaagggatagtggaaaagtacggtcacaaagtctcagaggaaaagacccgcctctatagaagacgacaggggaagcacgtgaccggcactgttctgctggatggtcggattctggtgcctaatacacggttccataaggcacgcgcaattagtgcggcgcttgcatccgagagagatccagcactgcggctcgaactcggaaggaagcttagcggcttattgggagaggccgcctttattgacgaccgttatgccaaatgggcgagtgacagctatatatccctgcgaaaattgcaggctgattttgcctgtgaggaggcatcactggattga

SEQ ID NO: 10293 - RNA, 1005 nt, unidentified
  source 1..1005: mol_type = other RNA; note = synthetic construct
atgcagaagtctctgcccaacccacccccgactaaaaaaatcaagcggacatactccatcgaccagtccgctctctacaaaatcgcctcgatgaagcgtctggcctccctaataggcttgccccgcgggaaattactgaggattgccgggggtgcccataaatacaaaactttcgttcttcctgaggagaaatgtccctttaccggcaaggtccgcaagagccgaaaggtggaagagccaattaatgaactgcgctatatccacgagcggatccacgcacttctgtgtaaagtggatcatcctgagtacgcgcacggtgctgtcaagggacggagttatcgatctaatgcactagcccacgtggagtctcaaagtcttgccacctttgacatgcgtgaattttacccttctacgagcgagtcaagagtatatacattctgggtagagcagatgtgctgtgcaccagacctggcgaacgtgctcgctaagctgatctgctataaaggcagattggccacaggatctcctgtttcccctcttgtcagcctctatgccaataagcccatgtttgacgaactgtcaaggatagctttgagccggaacctgaagttcacctgctatatcgatgacattaccttcagtggtcagaatttgccgcgcaactttgaacagtggatagcttcaatcgtggggagatacggccatgcactgagtgagaaaaagacgaggttcttcaggagcgagcaggccaagcatattactggagccatcattaaagatgggctcgtcaccgcaccacacagcaggttccagaaaatgagactgattggaagcgctctccggcaggtgaaggattttaacctgagaaagtcgttactgagacgccaagccggcctcatcgcggaaatagcatacttagacaagtcattctccgctatggcagaatccgcgaatcaacagtttcgagatttgagggttaaggctgccacagacattgtggattga

SEQ ID NO: 10294 - RNA, 1047 nt, unidentified
  source 1..1047: mol_type = other RNA; note = synthetic construct
atgcccagagggctgtatgaggtgacccagtgcgcgctctataagatcaattccaaggcacgcctcgcaggactgctgcatgtcagcgtgcctgtgatgttaggtatggcgtcctcacgcaagtaccaggagttcacactgaaagagaaagtttgtccattcggaggcaaatcccgtaaggcacggatggtgcagactccaaccgaagcgctgcggcctctccacgaccgtattcatgacctacttagacgctgcgcccctccaaattacgctcacgccgccgtcaaaggcaggtcttacaggactaacgctgaggcccacaagggaagttgcgtggctgccacattcgatctggaaagcttttactcctcaacctcagagacgactgtattccgattcttcgttgatcaaatgaagtgtgcacccgatattgctagtttgctggcaagactcatctgcgtagaaagggacgatagttatccatgtctccccactgggagccccctttcgccattaatctccgtgtacgccaataaacctatgttcgacaagtttgcccatctggctgagacacacgccctgagctttacgtgttacgtcgacgatctaactttctctggcttggctatgccgaagggcttggagcggatggtcaccagcgtggccaaacgctatggccacacattagctacacacaagaccatgacctttggtccttctagcgccaaacatatcaccggggtggttatctttaacggtaagatcactgtgcctaatgccagatttcggaaagctcgaaaaatacaggcagcaattaacgctgaaaatgacccgattaaaaaaattagcctcatgcaaaagctgtcgggcctgcttggagaagccgcctatctggacaacaggtactctaatctggccaagaaggctcagcatagtatgtccgaattcaggttgaactctccagcaatcaccatgtctgcgatacccgtgacgcaggaggacgcctcaaaggcagggtttgttcttacaaacgatgtccccttttga

SEQ ID NO: 10295 - RNA, 1023 nt, unidentified
  source 1..1023: mol_type = other RNA; note = synthetic construct
atggccggctacgctcttaatcaatgtgccctgttcaaggtaggctccaaagccaaactcgcttccgtgcttttgctaaaacaaagagatctggtcgacctgagtgaagatggccagtatagacaattcaggctggaggcctcggtttgcgagtttacaggcaagcgcacgaaggcacgtgacgttgctgagccaaagaaggccctcaaacgggtccaccagcgtattggggatctgctcagccgcgtgctgctggtggaatatgcccacgccgcagtcaaaggtcggtcatacagaacgaatgctgctgctcaccagcatggcgatgagatcgccacatttgacatagaaaacttctacccctccaccacccacgcccatgtgtaccatttctttttccgagaaatgaaatgcgcagctgatgtggctcacctattggcccgacttctctgctttagagcaacccccgaagcattaggatgtctgccgaccggtagtccggcctcacctattatgtctgtgtatgctaacaagcctctgttcgacgctctccacaggctggcccaggagttgggacttgtgtttacttgctatgtggatgacctcacttttagcggaccccagatcccaccatcattaggcaggcgggttgactctatcgtcgccgcccatgcacagaggctgcatgcatccaagtctcgcgtgttccggaaagggaagccaaagcacgtaaccggagtggtcatcgcggacgggaagcttgctgtccccgatgcgagattcttcaaagcccgcagagttgagcagcggttggtggccgagacagatcctggggaacgcgcgaggttgagccgaattctgtgtggtctgctgggggaggctgcctacctggacaacaaatatgccaattgggcaaaggacagctaccggaagttagcagcggagactcgtctcgcggtagtgaccgctgcaggcacaatagcctttgctgcaacaagggccgaccctcccactggagcatga

SEQ ID NO: 10296 - RNA, 1113 nt, unidentified
  source 1..1113: mol_type = other RNA; note = synthetic construct
atgtcagagaaccagaaacctcccgccccagccaaaccacgaaagacttacgctttaaatcagtgtgctctgtacaaagtgggctccaagaagcggttagagaaaattctcggcgtcaacgttgccgaccttatccgcctcagtgcagacgaaggcaattttcaggtgtttgaattggaggcggaagtgtgtgagtttaccggtaagacacggaaggccaggtgggtacaaaatccggtcccagagctcaaggccatcctggctcgcattaccaagttgctgagccgggtacgggtgcccgattactgccatggtgctactccgggacgctcttataggtccaacgcacaggcccacgtgggagcacagtccgtggcaacattcgacctcaaagatttttttcccacaacgacgtctaaacaagtcttccagttcttctctaaggacctggaatgcgcgccagacgttgcgggactccttacagatctctgtacacatggccacgtgctacctaccggcgcaccgacttcacccattcttgcctattgggccaataggcggctgttcgaaaccattgaccgtaggggaaaagttttgaggctgaaactgagtgtgtatgtggatgacatcaccctatcaggggatgctatcccccgatccctggccgatcaaatagaggggattgtcaagtcccacgggcacaagctgagcggccataagactaagatctttggtcctagccggccaaagcacgtcaccggcgtcgtcataaccgggcagtcgctgagagtgcctcatgccagattccacaaggcccgcgctatcagaatcgccctgtatgctgagaaagacagccgtaaaagagttctgctggctgcgaaattatgcggacttctcggggaagctgccttcttggatcccgcatacaaaagaatggcaagtgacagcgtaaagctcctagcagcagccaaggctcaggtggcccccagactgtcaaggagtataggaggcccacgtcgcaagaggggtcgatctaaccctcgcaccgttgctacaatggggggcgtgcagcttagagagcaattggatctgagcgacgcccctactaactga

SEQ ID NO: 10297 - RNA, 984 nt, unidentified
  source 1..984: mol_type = other RNA; note = synthetic construct
atggccgctaaaaggctcaaatcataccctctcgaccagtgtgcactgtataaagttggtagcaagaaaagacttgcgaagattctggacgtagatctccccaagttggtgaggctgtctgcagaccagggtaattttcaggtctttgaaatcccagaagaggtgtgcgagttcacaggcgccaagaaaaaggcacgatgggttcagaaccctgtgccagacctgaaagcaatcctaaagcggatcgctgggctacttagccgcgtacaggtccctgattattgtcatggcgcgatgaaaggccggagctaccggtctaatgctgccgtgcacgtggaggaggaatcagccgccactttcgacctgaaagatttctttccttccaccacgagcgcacaggtgtttgctttcttccggcacaccctgcaatgtgcgccggacgtggcagggttgttaactgatctttgcacatacggcaaaatcttgcccaccggagctccgtccagtcccatcctggcttactgggccaaccggaagctgttcgacgttttggaggggcgtgggagggatctgtctctgaaactcagtgtgtatgtcgacgatgtgactttttccggagacgccattcccaggtcactccctgaacaggtggacggcatagtcagtaagcatggccagaagctgagcgcccataagacaaggatattcggaccagggaagccaaagcacatcaccggagttgtcgtggccggcggaaggttaggtgtaccccacgcacgtttccgaaaagccagagctattcgcgcggccttagccgcagccaaagatgacgagcaaagagagcttctggcctcgaagctttgcggactgctgggtgaagccgcctttctcgatccacgatatcgccgctgggctgaggattccgcacgccaactcgcggcaattaaggccgctagattgtctgctaagagagctgtcaagtga

SEQ ID NO: 10298 - RNA, 1002 nt, unidentified
  source 1..1002: mol_type = other RNA; note = synthetic construct
atgaaaaataaacgacccccgaagagcaaagataaaaaatacgagatcaaccagtgtgctctgtttaaagtcacgacgaaaaaacgcctcgcttccattttgggggttgacaccggcacactgtctaggctgagcatagacgaaagaaattataacgtgttcgagatcgccgaggagaagtgcgaattcaccggaaaaatcgtaaaggcacgattagtgcagaatccagttcccgagttaaaggatatacaccgtcggatccatgacttgctctcccgggtggtggcacccgattactgcttcggcggggcaaagggtcggagttacagatcaaatgccgcagcgcataccgactctgtggcagcggccacctttgacctgaagagcttctttcccagtacaaagtcagcccaaatttttggattcttcaaagacaagctgctgtgtgctccggacgtcgctgggattctcaccgatctgtgcacctacaagggtgcacttgccactggctcgcctgccagcccacagcttgctttctgggctaatctccctctgtttgaagtcctggagacaattgctcaccggtataacctaatcctatccgtttacgtggatgacatcacaatgtctggtcctagggtgccagctcagctgcagcaccaggtgaacgaggtggtacaaaagtatgggcacaagctgtcacctggaaaaactaagatttttcgcaggggcaatcccaagcacataacaggggttgtcgtccataacggcttcttgcgagtaccaaactccaggatgaaaaaggcaagagccatcagcgaagcccttactcgcaccagcgctactgatctgactcagcgggagcatctcgccagtaagctctccggcctgcttggagaagccgcccacatcgattctcgctatcgcccctgggcccaacgttcatacagagacttgaggttcttacagagactcgcgaacgtgcctccaattgccttttga

SEQ ID NO: 10299 - RNA, 1107 nt, unidentified
  source 1..1107: mol_type = other RNA; note = synthetic construct
atgaaggaagaattcaaatccaagaagaagcggaagctttactcgctggaccaatgtgcacttttcaaaattgggtccaagaaaagattggcggccattctgcgagtttcccaggatcggcttgaaccgctgggggtggacaagggtaactatttcgtgttcacactaaaagagcagatttgcccttttacaggtaaggtgaagggagcccggagggttcagaacccccttccagaactgaagctggtacagcggaggatcctgtccctcctcgcccgtgtggaaatgccagaattttgccatggagccaaacaagggagtagttacaggtcgaacgcaaaagctcatgtggatgcaaagaatgtcgcgacttttgacttaaaatcatttttccccagcacaagcgcttctcgcgttttcagtttctttagaaatacgctgcagtgcgcaccggacgtcgcaaggatcctgacaaagctctgcgtttgtcacggagctttagctaccggctcccctgtgagcccaatcctggcctactgggcgaattgtgagctctttagagtcctgaaccgcctggctgaggagaatcacctcttaatgaccgtatacatagacgatttcactatctctggcgacgtgttgcctcgcaatattgtgtggcaagtgaagtctatcgttgagaaatatggccactccctcagtctgtctaagactaaaatatttcgggagaacgaggctaaacatgtcaccggtctggtcatctacgaggggaatcttaccgtcccacacattagattcaagaaggcccgcgcaattgaaaaggcgatagctgtggctagcaacgacgaggaaaggttggatttgatgcgaaagatgggcggcctactcggagaagcagcttatgtggataaacgttataagagctgggccttcaaaatttacagcaaaatctcacaggcccagtcagtgctgcgaagaaaagaggcctctgccagtgagaaacgcaaatttgaggaggcctgtgtccctgatgtaatgcccgacaaggcctcatggtccgacatcagccccaaggcccaggataactccagctctatgaagtcatga

SEQ ID NO: 10300 - RNA, 990 nt, unidentified
  source 1..990: mol_type = other RNA; note = synthetic construct
atgcagcctaaaaaaaacacccgtaagaagaggaagccggataatcagctgcccatccaccagtgtttcctttacaaaattggctctccaaagcggctcgctgaccttctgaacgtttcagccgccgagctggaagacactctcagatctgagaacaactacaagctgttcaataagctcttaagccccaacccttttacaggaaaacttaggaagaaaagagcagtgcaagaaccaaaaagccggctgagaaagatgcatgagcgaattttggcgcttctgagaagggtgcaatacccatcctatgttcagggcggagtgaagcataggtcctaccagacaaatgcagcaactcacttgggagcccgtcagacagccaccttcgatctgaaaaatttttatggctcaactcgctactgcctcgtccacgatttttttcacaagtccctgtgctgtccgaccgatatagctggccgcctagcatccctcacaacctggaatggggtgatgccaaccgggagtcctttatctcctctcctaagtttctgggcagccaaagggttttttgacaagtgtgaaactctggccgccaagtatcggctgaactttacatgctacattgacgacctcacgttcagtggtgataaaatcagcggtaagttccaatcagaactggagatcatcgcgagccgctttggctatgaattagctaaagagaaaaccaaggtcttcaggttcggaatacccgcacacatcaccggcgtgatcagccataaggctaaactgtcggtcccccactctcgcttgaaaggtgctagaaagatccaggatgccatagagggccgaggggaggcctatgggttcactactgcccagttgaaacagaagctggctggaacaattaatgaggcagctacgattgacgccgtaaagtacgaaaagtgggcgacccatacgcggaaggccgctgaagacaacgagaaagagtga

SEQ ID NO: 10301 - RNA, 990 nt, unidentified
  source 1..990: mol_type = other RNA; note = synthetic construct
atgcagcccaagaagaacatacggaagaagaggaagccagacaacgaattgcctatccatcaatgtgcactgtacaaagtgggaagtcccaagcgcctggcagacctcctgaatatttccacaatcgagttagaagtcattcttcagtccgagagcaattacaagctgtttaataaggttctggcgccaaatccattcacgggaaagtcccgtaaaaatagagcagtgcaggagcccaaatctaggcttagaaagctccacgaacgaattttaagcatattgaggcgagtccagtatccgggctacgtgcaaggcggggttaagcaccgcagctaccagacaaacgccgctatacacttaggggcccggcagacagccacctttgacctgaagaatttttacggaagcactcgctattgcctggtgcatgatttcttccataacacaatgtgctgcccaactgatatcgccggacggttggcctctttgactacctggaacggtgttatgcccacgggctcacctctatccccgctgctgagtctatgggctgccaaaggacttttcgacaaatgtgaagtacttgctattaagtatggcctgaacttcacctgttatattgacgacctgactttctccggtgatcaaatctctggaaaattccagtcagagctcaaaatcatcgcatcgagatttgggtacgaactggccaaggagaaaacaaagatttttagatttggggtacctgcgcacatcaccggcgtgattagccacaaggcgaagctctcagtgcctcatgccaggctcaaaggggctcgtaaaatccaggatgctatagatgggaaaggcaaggcctatggtttcaccgaggcacagctcaaacagaagctggcaggcactattaacgaggctgccaccatcgacgctgtcaaatacgagaaatgggccatctatagtcggaaagatgctggcgacgaactctctcaatga

SEQ ID NO: 10302 - RNA, 987 nt, unidentified
  source 1..987: mol_type = other RNA; note = synthetic construct
atgcagctgaagaagtcaacccggaagaagagaaaacctgacaatgagctgccaattcaccaatgtgggttgtacaaagtaggaagtccccgcaggctagccgagctcttaaaaatcagcgagatagagcttaagaaattcctcgagtctcagaataactataagatcttcacgaaggtacttgctcctaacccgtttacaggcaaatttaggaaaaagcgagccgtgcaggaacccaaataccgcttaaggaagctgcacgagcgaattctctgtatgctgcggagagtccagtacccagactacgtgcaaggcggagtgaagcatagatcctaccagaccaacgccgctattcatttgggcgcgaggcagacagccacttttgatctgaaagacttttacgggtccaccaggtactgcctcgtccacgattttttcctggacgtcatgtgctgtcctacagacatcgcaggtcgtttagttagtctgacgacatggaacggagttatgcccaccggaagcccactttcccccctgctctctttctgggccgctaaggggctctttgacaagtgcgaagaactggcagtgaaatatggtctgaatttcacttgctatatcgacgaccttacatttagcggcgatcagatttctggagggttccaggcggagctaaagattttggcaagccgtttcggatacgaaatcgcaaaggagaaaactaagatctttcggttcggtgtgcctgctcatatcactggcgtcatctcacacaaagccaccctcagtgtgccacactcaagactgaaaggtgttcggaaaatacaagatgccattgatggccgcggcgctgcttatgggttcaccgcagtgcagctgaaacaaaagttggctggcgccatcagcgaagccgcgtcgattgacgccgtgaagtatgagaagtgggcattctattcccgcaaggatatagaaggggatctggtgtga

SEQ ID NO: 10303 - RNA, 996 nt, unidentified
  source 1..996: mol_type = other RNA; note = synthetic construct
atgcagcctaaaaagagtgaaaaacctaaacggaaacccgataacgaaattgccatcaatcagtgcaggttatataaggtcggcagcttccgcaagctgagtgacatcctgaaaacttcccctgccgaaattatggacctactcgtgtctgataaaaactacaagaaattcacggtttcgcagagcgctaatccgttcaccggtaagccacggaagcagagagaagtgcaagagcccaaaagtaagcttcgccgtgtgcacaacagagtgctggccctgctacgaagggtggggtacccggactacgtacagggcgcggtgcgatatcgttcgtaccagaccaatgctgctctgcacatcggttccagacaaaccgcgacttttgatatttccgacttttacggatcaaccaagcggcacttagttcatagttttttccatgacgtcatgaagtgtcccaccgacatcgcaggaaaactggccaggttgacaacttgcgatggcgtcatcccaactggctcacctctcagccccctcttgtccttttgggtagctaaggggctctttgatgagtgcgcagctgtggccaaggagtacgggatgaagtttagctgttatattgacgatctgacgttctcaggggatcggatccccagggagttgaagagccgcctgaagattatatgtcggcgctaccgctatagactgaagagcgaaaaaacaaaggtgttcaggttcggagagcctgcacacatcaccggcgtcattaaaatggacgctgttctgagcgtgccattcgcccggctgatggcagtccgaaagcttatggatgcaatagagggaagaggggactcatatggttatacagtggaggagcttaagagaaagctcgctggaacagtttctgaagccgcctctatagatggccaatttaaaaaatgggcacttcatgccaaacaggacgccaaatcctcttctaggccatccgcgtcttga

SEQ ID NO: 10304 - RNA, 978 nt, unidentified
  source 1..978: mol_type = other RNA; note = synthetic construct
atgcagcccggcaaatcaaaacgggtggagagaaagcctgataattcacttgagttagaccagtgccgactttacaaaattgggtccgaaaagagattagctgaaatattgggattgtctctgcaggaccttaggctcctgctgcggagcgaatcaaactacaagaagtttaccataagtcagagcgagaacccctttactaagaagccacgcaagaagagggctgtccaagtgccaatgaatagactaagacgggtgcatgctaagatcttttcatttctccgtcgtgtgaaataccctgattatgttcaaggtgctgtgaagggacgcagctatcagactaatgcagccttccatgctcggagcaggcagactgcaacgttcgacatttccaagttctatgagtcgaccaagtatcacctggtgcacgaattctttctgggtgcactgaagtgcccaactgatatagcgggcaaactcgccaggctagtaacctgtgacggggtcatgccaaccggaagtctgctgagccctttactctccttctgggtggccaaaggcatgttcgatgagtgtgcggcccttgcagaaacatacgacttgaaattcacatgctacattgatgacttgacattctctggcgaccggatcccccgagagctgaagtccaagctcaaaattatcgtttctcgctacggctataaactggccatcgagaaaacaaaagtcttccgctttggtgccccggctcacatcaccggggttgtcaaactcaatggagagctggtggtacccttcgcccgcctgatggctgccaggagaatctccgatgcactggatggcaagagtcctgactacgggtatacgaagaacgagctgaagcgaaagctcgcggggaccattgcagaagccgcaaccatcgacggaaacagattttctaaatgggctgcctttgcccagaaagaagccagggattga

SEQ ID NO: 10305 - RNA, 1005 nt, unidentified
  source 1..1005: mol_type = other RNA; note = synthetic construct
atgcgaatagagatgcaaccaaagaagaatgagaaaacgaaaagaaagcctgacaaccagatccccattaaccagtgcagattgtacaaagtcaccagcccaaagagacttgccgaaatactgaatctcgacatgacagggctcctggaactcctgaattgtagcaccaattatcgcttttttgacattcctctcagcattaaccccttcaccggcaagtcccgcaagaagcgatctgttcaagagcccaaacagaaactccgtagagtccacaaaaggatcctacttcttttacgtcgcatgtcctacccgaactacgtgcagggggccgtgaaacacaggagctaccagacaaatgcagaggtgcacaaggagagtagagaaaccgcaacgtttgatatccgggatttctatggttccactaagtatcacctggtgcatgactttttcctgcgggtaatgggatgtcctaccgacattgctggcaaattggctaacctgaccacatgtaatggagccatgcctacaggatcacccctatcacctctgctgtcattttggattgctaagaagatgtttgacgaatgccatgccttggccgagtcccacaaactgaagttcacttgctacgttgatgaccttactttcagtggaaaccacatcccacggatcctgaagtctaagatcaaaataattgcgtcacggtatgggtattccatagccaatcataaatcgaggcacttcaggttcggtcagccagcacatatcactggcgtgatctctttagataaaaagctccatgtgccctttagccgcttgatggcagtcaggaaggttactgatgccatcgatggtaacagtgacaccttcggctttactaaaacagagctgaagaagaagctggctggcatggtatccgaggctgcgaccattgataatcggttcgggaaatgggccatctacacgcagaacgaagtgagtgacagctctacaccgtctgattga

SEQ ID NO: 10306 - RNA, 972 nt, unidentified
  source 1..972: mol_type = other RNA; note = synthetic construct
atgcaacaaaagaaaaaggagaaaaacgagtgtaagactgcaaaaagctatcccatcgaccagtgtagcctctataaggtgggaagtgccaagcgattggcggctgtattggggatagagctggacaaactaaagaagctgttactgtccgattttaactacaaggtcttcgacatcgcgggcagcgttgatccattctcaggcaagatattcaagaccagacacgtgcaggaacccaaagatgacctacgcgctgtgcattcgcgaatccttcggctgttacagaacgtgtctattcccccttacgtgcatggggccattaaaggtcgttcataccagacaaatgccgccgcccacgttaaaggcaaacaggctgctacttttgacatccataatttctacgggagcaccaagtctaatctggttcacgatctgtttcatgacgtgctggcttgtccgtcagatgtggcgggaaagctcgccaggcttgtaacgtacaaggggatgatgcctactggctctcctctcagccctctgttgtcctattgggtggccaagccaatgttcgacgagtatgcttgcctggcaaggcagtatggtctggaatttacatgctacatcgacgatcttaccttcagtggggaccgcattccaagagatctcaggtaccgggtcggtattattgctaggcgctacggatatcgtatctccaagaagaagacacggttattcgtccaaggcaaagtgaaacacattaccggggttgcagtcgcagaaagcggactcatggtcccctttagtcgcctgaaagccgcaaggaaaatcatgggagcaatcgagggttctggcgagtcccacggcctgtccagtgaaaagttgagacagaaactcgccggccttataggcgaggctgccacaattgaacagagatttggaaaatgggcccggaaggcaagaaccgcctgctcatga

SEQ ID NO: 10307 - RNA, 1002 nt, unidentified
  source 1..1002: mol_type = other RNA; note = synthetic construct
atgcagcggaaacctacaaagaggaaacggaaactatttaagcgttacccagtcaatcagtgcgccctgtataaagtgggatccatcaagaagatctgccagctcataggaataaagaagtccaacttgaactcgatcttgaagaatccgcttcagtatagagagtttgtaaataaggagtcattcgatcacttttctcttaaaaccagcaaaacccggcagatccaggaacctactggcaacttgaaaaaaatccacgagagaatcctgtacctgctggagccagttgagcttcctaattattcacacgccgccgtgaaaaagcgatcttacaggagtaatgctgcatctcacgtgctgtctaagaagatagccacatttgacctggagaacttctacggaagtacgaagaaccatcttgtgtataacttcttcctcgataagctgaaactcccacatgacattgcaaagaagctgaccaagatcacgaccttcaataatagtatgcccactggtagccctctttcaccgttgctgagcctgcatgctgcaaaacccatgtttgatgaactcgaatccctggcgcaaaagtacaatctgatcttcacctgttatattgacgacctgaccttcagcgggtccactattcccaaatcattaaaccggcaaatcgttcatatcattaaccgctacggctataatctatccaaccataagacacgtatttttaacgagtctgaagtgaaacacgtcactgggataattattaataaggagaggctccgcgctccctatagccgatttatgaccgctagaaggattaaaaaagccatcgatgggaaggccccaatgcacaacttctccaagatcaaactgctggagaagcgcgctggtttgctcggcgaaacagcctacctcgaccccacatacaaaagagcagcgaaaaatgcccagattgaattaaagaacgcacgcaaccaaataaagaagagcactttatga

SEQ ID NO: 10308 - RNA, 981 nt, unidentified
  source 1..981: mol_type = other RNA; note = synthetic construct
atgctgcggaaacctacaaagagaaagttgaaatacctgaaacactatcccataaatcagtgcgcattgtacaagattgggagtataaagaagatctgcgacatcataggcatcgagaagaacgaacttaatctgatcttgaagagcccacccaagtaccgacagttcgttaataaagagtctttcaaccactttagccttaagaagtccaaggagcgacaggtgcaagagcccgtgggtgacctccgcaagattcacgaaaggatcctcgaccttctaaaaccagtagaacctccagactatagtcatgcagctgtcaagaaacgcagctatcggacgaatgctgcagcccatgtgttaagcaaaagaattgccacctttgacctaaagaatttttacggatccaccaaaaaccacctcgtgtataatttcttcctggatcagctgaaactcccccacgacatcgccacgaaactgacaaaactgaccaccttccataatagcatgcccaccggctctcctctgagtccactgctgtcacttcacgcggctaaaccgatgtttgatgagttagaatctcttgcccaaggatacaacctgatcttcacctgttatattgatgatctgacttttagcggctcaactattcctaagtcgctgtctaagcagatcgtccatatcataaagcgttacggctacaacctatccaaccataaaacaaggattttcaatgagtcagaggtgaaacacgttacagggatcattattaacgaagagcggttgagggccccttacagtaggtttatgactgcgagacggatcaagttggccatcgatggaaaggcatccactcacaactattccaaaattaagctcttagagaagcgcgccggtctgctcggcgaaactgcatatctggatccgacatacaaagggctcgcccagaaagctcagctggacctcaagaccgctagagggtga

SEQ ID NO: 10309 - RNA, 1041 nt, unidentified
  source 1..1041: mol_type = other RNA; note = synthetic construct
atgttaaagaagcctaccaaacggaagaggaagtgcctgaaacgctactccatagaccagtgttccctgtataaagtcagatcagctaagaggctctccgaaatcctgggtgtagagaaacagcggcttgatagtatcctgaagtcatcagccaagtatcgggaatttactatcgaagaaaccaccaatcctttctcttctaagtttatcaagtctcgccaagtacaggctccatccgacgaactgcgacggattcatgagcgaatactgtacctcttggagcccatcgaacttccaaactacgcccacgccgccgtgaaaggacgctcttacagaagcaatgcagccacacatgtgaactccgcaaggatggctacgttcgatctcaagaacttttatggctcaacccagaggtacctggtctatagcttcttccttgacaatctcaaatgctcacccgacatcgccgggaaattgacagaactgactacattccgtaacgctttgcccacaggctctccgctgagcccactgctgtccttgcacgcagcgaaaccgatgttagatgagctgagtaagctggctcaattacacgacctcattttcacttgttacatcgacgatctaactttcagtgggaaaaaaattcctagatcgctagaaagacgagtttctcggattgtcggaaagtacaatcatcaactcagcattcacaaaacgaagatctttgacgaggataagcctaagcacgtgaccggcgttgtgattaataagggtaagctggctgtgccccacagtcgtttccttacagcaagaaaattggagcttgcgatagccggcaagtttcctatgcatggaaacagcatgctaaaactgtgcgagaaactggccgggctcctgggagagacagcatgcattgacccaacctataaaaagtgggccgagaaggcgcaggaggatctccgcaaggccaggaccaaagacagcagcatagtggggcccgatagtactgattttggctcctgtcagcagatcgactga

SEQ ID NO: 10310 - RNA, 1083 nt, unidentified
  source 1..1083: mol_type = other RNA; note = synthetic construct
atgtggcccaaagggttaagtcaatacttaaacggcatcaaaactgaaatgaggccccagcagtcttcggccaagaagcgcaggagctttaagttatacaccatcaaccagtcagcgctatacaagataacaagcccgaagaaactgagcaacgcccttaatcgaagcgaactcgagattgatgtgctgctgggctccgacgaaaactacagggagttcaccctacttgaggaactgaaccctttctcccacaaaagaaaaaaggcccgcttggtgcagactccgaataaggatttgcgatctgtgcacgaaagaattctcaaactgctccagagaatcgagtaccctgagtatgcccatgctggtgtgaagaagcgatcctatcggtccaacgctcaggctcaccaaaagagtaaggaagtggcaacttttgacctgtccaattactacggctcggtcaaggcacaccatgtctatgacttttatctcaaacagctgcagtgtgtgcgtgacgtgtcaggaatactgacccggctgtctactcacagaaattgcattccaaccggatcacccctcagccctctgcttgcccttcacagcagccggacaatgttcgactctctggactgcctggccaaaaggtatggactagttttcacatgttatgtagacgatcttacttttagtggcgatgcaatcccaccatctttggagagggaggtcgttagtatcgtgcgccgtaatgggcattccattaacaaaaagaagacgcggatattcagagcacaccaggccaagcatgtcacggggaccgtgatcattaatggcaatattaccgttcctcatgctcgcctggtgacagttaggcggctggaggatgccatcaacggaaagatggacagttttgggttttccgaaacaaaattgatggagaaactcgctggtgtcctcaacgaggcaagctacctcgattccaaattccgctcaaaggcgttggctgctagatccaatctgtctagcccctctccttcaccctctcccagcccatcacctgcaccacaagtagccgatgccagtatctga

SEQ ID NO: 10311 - RNA, 1002 nt, unidentified
  source 1..1002: mol_type = other RNA; note = synthetic construct
atgaatggcattaaagccgagatgcgccaacccaagacttcagctgggtcccgtagaacttccaaactgtaccccatcaaccaatgcgccctttataagttgacctcgcccaaaaaattgtgtgaggctctcaagattgaaaagtccctgctgtctgacgtcttggagtctgatgaaaactacagagagtttacgctgctggaagaagtggatccttttagtcgaaagataaaaaagaagcggctcgtacagactccgaacaaaaaactacgaaatatccacgagcggattctacagctgctacagcgtatcgaatatcccgactatagccacgcaggtgtgaaaaaaaggtcttacagatcaaatgccttagtgcatgtcaattctaagaccattgcaacatttgacctgaaaggcttctacggggctgtgaagagttaccacgtcaatacattcttcagcgagcagctcaactgcgtgggagatgttgccggaattctgaccaaacttacaactttccggaactgtgtcccaacaggcagcccactgagcgctctcctcgcactgttcaccagcaagccaatgtttgatgacctggacgccttagccaagaagcacaaactgaagtttacttgctacgtggacgaccttacattttcgggtgacagcattcctagttcactggagagagatgtttccagcatcgtgaggaagcatgggcactctctgagtatcaacaaaaccaagatctacagggaaaatcagcctaaacatgtcacagggaccgtaatattaaataatcgcatccacgttcctcatacccgccttctggctgcccggaggttgcagtctgcgatcaacggcgagatagagtccttcggattcacggaagagaagctcattcagaagcttgccggcatgctcaacgaagcgtcatatctcgatgtgcgcttcaagtataaggctttgaccgcaaaagcaatgctgaagtccgccaagtga

SEQ ID NO: 10312 - RNA, 1008 nt, unidentified
  source 1..1008: mol_type = other RNA; note = synthetic construct
atgtgcgcacagaaaaccaaggtaggagcggttcgggcttctcaccagcggtaccccatctctcaatgttgcctttacaagatcggaagcagatcaaggctcgccgacttactctatatagagaaggtcgaccttgtgaccctgcccggtgagcggtcgtataaggttttcacgctcccggaaaaacgagatgaatttagcggcaagatcaagaagaaaaggatagtgcaggaccctaaacgcccactgcgtcgcgtgcacgatcggattttgtacctcctgaacaagattgaactgcccgagtatgtccatgcagctgttaaagggcgcagctatcggtccaatgccgcggctcacacaactgcggcccatgaagtgctcacgttagatatcaagtccttttaccccagtgtgagttacctgctcgtgagggaattcttcagatacaagatgaaatgtgcctctgatgtcgcgacaacattggccgatttgtgcacatacaagggcgctctgcctactgggagccctctgtcaccacttctatcctattttgcatgtggtgatatgttcgacgagctgaatagactcgccgtggagtgcggactgaaatttacatgctacgtcgacgatcttaccttctcaggggagaaaattcctggcgatctagagagtagagtcaagtcagttctaaggcgctatggccatcggttagcagtggacaagactatcagatacaggccgcactctccaaaatccgtaactggttgtatcttgcacaacggagctattcacgtgccacattcccgatttaggaaagcccgcatgttggccgccgccattgctaccacagacgaccccgctctgactcataagctttacgaaagacttgctgggctcctgggagaggcagcctatctggacggccgtttcaccagctggaaagaggacaccgcacgactgctgaagctggctacccagaagctgggcgcagccaaagaagccacctga

SEQ ID NO: 10313 - RNA, 939 nt, unidentified
  source 1..939: mol_type = other RNA; note = synthetic construct
atgaaaaagcggaaaaatctgcaactgaagaaggacatcccactggatcagtgtgccctgtataagatcaggagtaagcggcgactatgccagatactgaacatacccatctcctctctcaagggcttcatgaacgatgatcgaaattaccatacagtagacatcgaggaattcttcaacgaattaaccggtaaacgtaagaaagcgaggactgcctctgttcccaactactggctgaagaaactccattcgcgcgtgcataggcttcttagcagtatagctgccccattatatgcgcacggaagcattaagtcccggagttatatcactaacgccctggtacacgtcggctctaaggaagtccttactatggatcttagagacttttttcgctctgttaagcgccaccatgtgtacttcttctttaaagacaagctctgttgtagtcctgatgtggccggggtcctgagcaacctcttgacctatcagggtgcattgcctgtcggctcaccagcttctgcgattattgctatgtgggcctgccacaccatgttcgagaggttaaaccaactggcttcagagtaccgcctcaaattttcagtttttgtcgatgacctcacatttagcggcgaggtggtacccagcggatatcagtccttggtggagcgtatctgcgcacagagcggtctgtcggtgcgggaagacaaaaccgtgctgtataaacatggcacagccgcctcagttacaggggtgattatctacgccggagcaattaagccccctcactccaggtaccagaatctgagaaaactctctgctattctatcccaacagggggcacacgcaatcgtgaatggaaagcacgctaaatactccttccagggcgggagaaatgagacgatgctgttgagaaatattagcatcccgcacgtggactga

SEQ ID NO: 10314 - RNA, 948 nt, unidentified
  source 1..948: mol_type = other RNA; note = synthetic construct
atgaaaaagcgaaagtccagtccccccgacaagtcaataccactggatcaatgcgcattatttaaggttagatcaaagcggcgtttgtgcgaaattctgcgcgtccctttatctagccttaaagggttgatggatgacgaccagaattaccatgctgtggaaattgaggagttcgtgaatgagctgaccggaaagagaaagaaagctcgaatcgcgtcagtcccaaacttctggctcaaaaaactgcacctgagggtgcacgatcttctgtctgccatcaccacgcctatctatgcacatggcagtattaaaaagaggagctatatcacaaacgccctggtccacgtggaggcaaaagagtttctgactatggatctcagggatttcttcaggagcgtcaagcgtcaccatgtatacttcttctttaaggacaagatggcgtgctccagtgatgttgccggcgttttaagctatctgctcacctaccaaggcgcactcccggtgggaagtccagtaagcgccacactagcaatgtgggtgtgtcacgccatgtttgaacagcttaataaactcgcctcctcttatgccctgaaattttccacattcgtcgatgacctgacttttagcggggacgtggttcctagtaagttccagctgctagtggagcggatatgtcaacagtccggactttcaatccgggaagacaaaacattcctgtataagaacggaatggctgcttcggtcaccggtgtgattatacataatggttctatcaaacccccccatagccgctaccagaacctccgcaagctctcaactgtgttgtctcagcagggcagacacgctgtgattaatggcaagtacgcccgctactcctttcagggggggagaaacgaaaccagactgttgcggaggattaacaacgtacagtccaatgactctatctga

SEQ ID NO: 10315 - RNA, 948 nt, unidentified
  source 1..948: mol_type = other RNA; note = synthetic construct
atgaagaaacgcaaaaatcttcttcctaagaaaagcattcccctggaccagtgcgccctgtacaagattcggtccaaacgacgactctgtcaaatactcaatatcccgagtagttctttaaagacactgatggacgaggactctaactaccatctggtggagatcgaggaatttgtaaacgagttgaccggaaagagaaagaaagctagaactgcgagcgtacccaacttttggctgaaaagaattcattctcgtgtacattgtctcctgagtgcaattgtggtgcccgtctacgcccacggctctatcaagaaaaggtcctatatcactaacgcactggtacacgtgaatggcaaagaagttctgaccatggatctgcgggacttcttccgctcggtcaaaaagcaccacgtgtatttcttcttcaaggataaactatgctgctcccctgatgtcgccggcatcctgtccaaactgctaacataccagggagctctccctgttgggtcccctgtgagtgcgcttttagccatgtggacctgccactcaatgttcgatgggctcaataagctggcctcagaatacaagttgaaattctccactttcgtggatgatctcacattttctggggaactagtgccctccggctttccactgttggtggacagggtctgtatcaagtttggattgagcatcagggaggacaaaacggtgctttataaaaatggcgtcgctgcttcagttaccggtgttattgtgcatgagggtaacataaagccaccatatagccgctatcagaaccttcggaagctcagcgtggtgttgagccagcatggagcccacgccgttgtcaatggcaagtacgcaaagtactctttttgcggtgggctgaacgaagcaagactgttaaggaagtttaatgaggagaagtgtagcctcgtctcatga

SEQ ID NO: 10316 - RNA, 954 nt, unidentified
  source 1..954: mol_type = other RNA; note = synthetic construct
atgtcccagaagagaagaaaactgcttcacaaaaagcgctacccactgaaccagtgtgccctctacaagttgacatctaagaagaaactgtcagccattctcggtgtgtccctggcaaatattaagtctctgtgcgacaacgatagaaattaccacctggtcgagatcgaagaggaattcaacgagctgactggcaaacgcaaaaaggcacgccaggccaatgttcctaacttcttcttgaagaaagttcattcccgggtgcacaatctactatctaggatccagacacccggttatgcccacgggtccatcgttgcccgaagctatgtcaccaacgctcttgctcatgtcgagtcatgggagttccttacgatggacgtgcaagattttttccgaagcgtgaagagggagtttgtgtactacttcttcaaggatgctatgttttgctcgccagacgtcgctggaatactctcaaatctgctgacttataagggagcacttgcggtggggagccccgtatccagcctgttatctatgtggacctgcaaggaaatgtttgacaggttagactctctcgctattaagaataatctcaccttcagcacttttgtagacgatctgacgttttcagggctcaaaataccggcctccttccatgaagagatcgagagtacatgtagacggtatggcttgtcaatccggaaagataaaaccaagttttacaaaaacggcatgcctgcattgatcacaggggtgattgtggttagtggcggcatagaagccacttattcgcggtttcgttctattaggaaactcagtaccatcctgtccgaagaaggcgctcacgcggtcgtgaacggaaaatacgcaaagcgtagtctgaggggcggacttttagaggcccgcagaatcggacatattagcgatagccggctgcaaagtagcggtgggtga

SEQ ID NO: 10317 - RNA, 1053 nt, unidentified
  source 1..1053: mol_type = other RNA; note = synthetic construct
atgagacggaaactggtgcggtcctcaatcgaacgatacgacctggagcgaagtcctttcgcccagaggccaactcagcgcgacatcggcgatctactgggcacaactagaaatcacctacgctacttagtaacccacaaggagcatttcatcgtgaggagacaagaggagattgggaagaaaaagaagttgagagaactgaagttccccgtcgctgacttgaggggggtacacgaacggctgaagtatcatctgaataagattcgccagcccagctatttgtttagcccccgccgtcatcgaggccaacgggataacgcagcacttcatctggggcaaaaccagtaccttacgcttgacctgaagcagttctacccctcaaccaccgctaccatggtgagacgttggttccaagacgagatgggcatatatcctgacgttgctggcttactcacgcacttggcgaccattgatgatcacgtttcttttgggagccccctaacaccagtcctttgcaccctgattcaccgccctatgtttgataagattgcggacctctgcggtagccacggactgcgatactccctgtgggtggacgacctgacaatctccggccggtttgtgcatggagatattgtgtgtgagatcaggaagataatagcggacgctggtctgagaagtcacaaaatccggtttagaacaggttcgaggccggtgtatatcactggcatcggggtggtcggaagggagctcgttgctccgaactctttaaatctccggattaaagaattgtgggaggcactccacctggcagaaacactggatgagcgggatgattgcatccaggccctccttgcccagctgggtactcagcgccatatttgtggggcatcttccgccatcggaagaaaagctgccgatcagatgaacgccctcaggcagaaaaggcgtaaaatgcatctcgaggccgccgaaaaagctgctgccgacaggttgccacgcagtgcaactatagtccaggcccctgaagacgccccattcgatctgggatga

SEQ ID NO: 10318 - RNA, 1053 nt, unidentified
  source 1..1053: mol_type = other RNA; note = synthetic construct
atgaggagaaagctgttccgaccccccgtggaacggtatgacctggtgcgttccccgttcgcacaaaggcctacccagagggacttaggggatttgctgggaactacaagagatcatctaagatacctcgccacccataaagaacatttcgtggttaggaggcaggaggtgattggtaaaaagatgaagctgcgcgatctcaaataccccgtcgcggatcttcgaggagtgcatgagcggttgaagtttcacctcaataagatcaagcaaccaagttacctatttagtcctaggaggaaccgcggacagcgagataacgctgccctccacgtgggtcagcaccagtatttgaccctggacttaaagcagttctaccccagcactacagccgacatggtgcgtcgctggtttcgggatgagatggggatgtacagcgacgtcgctggcctgttgacacacctgtgtaccattgacgatcaagtctcttttgggagtccgctcaccccagtgctgtgcacgctcattcaccgccctatgttcgacaagattgcagacctatgcgagcgtcacggcctccgctgttccctgtgggttgatgacctgactatctctggtcagtttgtccacggaaatgtgataagagaggtgcggcagatcatcgctagcgccgggctgagatcccacaaaatccgcattagaacgggatcgcgacctgtttatattaccggcatcggcgttgtaggccgggaactggtcgctccaaatacattgaaccttcggatctccgatctttgggaaaattaccaccttgccgagactaccgaggaaagggatgcctcaatacaggcgttactggcacaactgggcactcagcggcatatatgcggcccttcatctgaccttgggcgcaaagctgccgaccagatgaacagcctgaggcagaaacgaagcaagatgtatagagagacagcggccagagctacagcagcacggctgtctagatcactggccctcccccatgccccagaagatgctccattcgacgtagtatga

SEQ ID NO: 10319 - RNA, 1053 nt, unidentified
  source 1..1053: mol_type = other RNA; note = synthetic construct
atgcggagaaagaccgcaaggccccctattgaaaagtacgaacttccccggtcgccattcgcacaacgccctacccagcgagacattggaaaactgttgggagcctcacgggatcatctcagattcctggccacacataaagaacattttattgttcgccgccaagaaaagatcggtaaaaagcaaaagctcagggacctgaaatatccagtcagtgacctgagaggtgttcacgagcgcctcaagttccatctgaataagatccggcagcccagctatcttttctctccaagaaggaaccgtggccagcgagacaacgcagctctccacttaggacagcatcagtacctgacgcttgatctgaagcagttttatccctcaacaaccgcagatatggtgaggagatggtttcgagacgaaatgggaatgtatccagatgtcgctgggctgctcacacacttatgtactatcgacgatcaagtgagtttcggctcccctctgacccccgtgctatgtaccctgatccatcgtcctatgttcgatcgaatagctgatctgtgcgaacgacacgggctgcgttacactctctgggtcgacgatctgactatctccggcgagtttgtgcacggcgatgtggtgcgggagatccgccagataattgccggggcaggcctgcgctcacacaaagtaaggttcagaacaggtaatagaccagtctttattaccggcatcggggtagtggggagagagcttgtggccccgaacgctatgaatttgcgcatcaaagaattgtgggaggtgtaccacctagcagagactgtcgacgagagggacgcttgcattcaggccctccttgcgcatttgggcacacagcggtacattagcggaccgtcttccgatctaggtaggaaggcctccgaccagatgaacagcttacggcagaagaggaataaaatgcacatagaggcgtctgccaaagctttggccgacagcctgatgcggagtctgacggagcaacactctgaccaggacgccccttttgatctcgtttga

SEQ ID NO: 10320 - RNA, 1050 nt, unidentified
  source 1..1050: mol_type = other RNA; note = synthetic construct
atgcccagaaaaagaaggccacctatcgagatatatgaactgccctcctctccattctctcaacggccaactcagagggatattgggtcactcgtcggttgtacccgagatcacctgagattcctagctacgcacaaagagtcctttatcgttcgacggcaagagataatcggcaagaagcagaagctgcgggacctgaagtatcctgtagcggaccttaggcgcgtgcatgaacgtctgaagtttcacctcaataagattgtccagccgtcctacttgttttccccccggcaaaaacggagtcagagagacaatgccgagatccacctaaatcagcagcaatacctgacccttgacctgaaacagttttatcccagcacctccgccgggatggtccatagatggctgcaggaaaaaatgggaatgtacgaggacgtggccggcttgctcactcacctgtgtactgtggacgggtttgttagttttggcagtcctctcaccccggtcctatgcacattggttcaccggaagatgttcgatgaaatcgctgatctgtgcgctaataacggcctgaactatagcgtttgggtggatgacctcacaatcagcggcaagttcgtgcatggagatatcgtatcggaaattcgcgacataatctcaagagcaggactcaagagccacaaaatcgcctacaggacaggaaaccgcccagtgttcctgaccgggatcggggtggtcggcagaaatctcatagcacctaatattctgcatttgcgtattaaggagctttgggcatcataccatacggccgagagctacgaggaaaagaacgcgtgcatccagtctcttttagctcagcttggtactcagcgctatatttgtggagcaaaatccgtgttgggtcgaaaggcctctgatcagatgaactctttacgccagaaacgcagtaaaatgaggcgtgaggccattgaacaatcaattagcaacagggcattaaggattacaaaggaggtgggcctgaaagaagacgcccccttcgatctggcttga

SEQ ID NO: 10321 - RNA, 909 nt, unidentified
  source 1..909: mol_type = other RNA; note = synthetic construct
atgcctcgtaaggctagagccaccttctctgaacggtatcctattgagaggtccccttttgctcagaggccgacccaaagggaggtggctgcccttctgggagagactagggacgacttgcgcttcctcgccactcataaagagcactttatagtaagaaggcaggccatccttggcaagcagaagaaagcgagggacctgcggtatccagtcagtcgattgagagccattcatgaaaggctgaaattccacctgaataagatcaaacaaccttcctacttgttcagtcccagaaaaaacagggggcagcgagataacgcggctctccacctgggacaacgccagtatctgacactggatatcaagcagttctaccccagcaccaccgcacaaatggtgagacgctggtttcgggatgaacttggcatgtacgacgacgtggcaggcttgctaacgcacctgtcgacaattgacgatgtcgtctcctttggcagcccccttacaccagttctatgtacgctcgtgcaccggcggatgttcgatgagatcgcagatctgtgcgagcagcgaaacctcagatactccgtctgggttgacgacctcaccatttctggagattttgtggtccgggactttgtgagagagctgcgggatatcatacgccgctatggtctgaagagccacaagattcagttccgcacagggaataaaccagtttacatcacaggcataggagttgatggggaccaggtgattgcccccaattctctcaacctccgaatcaagactttatggcatgaattaagccaggcaaagaccatcccggaacgtgacggtcttattcaaccattactggcccagctgggcactcagctgcatgtggtggggaattcatcaaaagtaggttga

SEQ ID NO: 10322 - RNA, 1053 nt, unidentified
  source 1..1053: mol_type = other RNA; note = synthetic construct
atgccaagacggccacgcagacccgtcttcgagaaatacgacataagtaaatccccatttgcccagaggcccacccagcgagatctcggagaactgctgggcgagaacagaaacaacctgaggctgttggtggactacaaggaacagttcgttgtgcgacggcaggaggtgattggcaagcatcagaaggtccgggatctgaaataccccgtcagccgtcttcgcgccgtacatgagcgtctgaagtttcacctcaacaagattaagcaaccctcttacctgttctcacctcgcaagaataggggccagagggacaatgcactcaggcacgtaaaccaagatcagtatttgacactagatctcaagcagttctatcctagcacaactgccactatggtccggagatggtttcaagatgaactcgggatgtatcctgatgtggccggtctgctgacccacttgagtaccatagacgacagagtctccttcgggtccccactgacgccggtcttatgcactcttattcaccgcgctatgttcgacgaaatcgccggggtgtgtgaacggaggggacttaggtgtacactatgggtggatgacctgactataagcggcaagtttattcccggcgaactggttaacgagatccgtgaaatcatccgcgcagcgggtctacggagtcacaaggtgaggtatagaaccgggaatagacccgtgtttatcaccggaattggcgtggttgggaccaaacttactgcgcctaatgcggtgcatttgaagatcaaatcactgtgggacgactaccatcaagcagagacattggaggagaaagaatcatgctctcagttactcctctcccagctcggttctctgaaacatattgtgggagccgctagcttagccggacggaaagcctctgaccagatgaataccatccgccagcaacgccgacgaatgcacgtagccgcaacggctgctgctgctgcaacacggctgagcagagcccttatgccgaaagagtcgccagaggatgttccttttgagatctcctga

SEQ ID NO: 10323 - RNA, 1032 nt, unidentified
  source 1..1032: mol_type = other RNA; note = synthetic construct
atgagacactcccgtaaaccgcacccctacgagatctatgggttagagcggtcccccttcgcccaacgcccaacacagagggaggtcgccgatctgctaggcgagacaaaggccgatctcataaggctagcgaattacaaggatcagttcatagtgaggagaagggagaatatcggcggaaaagatagagacttagcatatcctgtgtccagactgaggggcgtgcacgagaggctgaagtttcatctgaataaagtccagcagcccagctacttgtttagcccccgtaagaagcgcagccagagagataacgccgccttgcacctcgatcaggaccaatatctgaccatggacgtaaagcaattctacccttccaccacagaagaaatggtgtatcgctggttcgtggatgagctcggtctgtttgaagacgtcgctggcctcctgacaaggttatctaccatcgacggtaaggctagcttcgggagtccgcttactcctgttctgtgcacgctggtgcaccgaccacttttcgaccgcattagtgacatctgtgggcatcgcggcttgcggcactctctgtgggttgacgatctcacgatctcgggtaaatttgtcccaggacaggttgtgacttctattcgggaagttatccggcaacgaggcctgcgtagtcataaaattcgataccggacaggaaataggcctgtgatgatcaccggtattggagtggtaggccgagatcttcttgcacccaactcactgaacctgagaatcaagcaatactggcaggacctccatgacgcaatgaccgcagaagagcgcgcttcatgcgcccagcggctcttgtcccagttggggactgtgagacacattgtaggaactaaaagcaacgtcgggcagcgggcgagtgaccagatgaacatgctgaaacagaaaagagataagtggatatctgaagccagccaggaggcctcaaagaagtcagctgatgaagctgcacctatggaacatgaggacattccattttga

SEQ ID NO: 10324 - RNA, 1032 nt, unidentified
  source 1..1032: mol_type = other RNA; note = synthetic construct
atgcgccggaactctaagcccccacagtacgagaggtacgatcttgaaaggtcgccctttgcccagcagcctactcagcgagatgtggcagccctgcttggcgaaaccaaagccgatctgcagcggcttatcaactataaagacgagtttatcgtgcggaggcaggagaaaatcggtggcaaggtacgtgacttagcttatcccgtcagcagactaaggggtgcccacgagcgcctgaagtttcatcttaataaggtgcgccaaccgaattacctattctctccaagaaagaaacgctcacaaagggataatgctgaactgcatttggaccaggaccagtatttgactttagacctgaagcagttctatcctagcaccacagagactatggtctacagatggttcgttgatgaattggggatgtatgaggatgttgcgggcctgctcaccagactcagtacagtggacgggattgtgagctttggaagtcctctgaccccagtgctctgcacgctggtgcacaggccgatgttcgacaatatctccgatatctgcgatgcgcgagggctgcggcacagtttatgggtggacgacctgacagtgtctggaaagttcattcctggaaaggtcgtaacaagtattcgcgaggccgtccgggagagaggtttgcgttcccataaaataaactaccgatccggcaatcgaccagttattctaacaggaatcggcgtggtgggacgcaatctcctgtcccccaacagcctcaatctgcgtattaagcggtactggaaagacctgcacgaggctgaaaccaacgaagaaaaggtggcttgtgcccagctgttgatgtcccaactcgggaccgtcagacacatagtagggcaaaaatcagacgttggcatgagagcagctgatcagatgaacatgcttaggcaaaaacggaacaagtggctgcaggaaaccagcgtctctctccctgcaccagaagagactgagacggcatcagccgatactgagaacatccccttttga

SEQ ID NO: 10325 - RNA, 1023 nt, unidentified
  source 1..1023: mol_type = other RNA; note = synthetic construct
atgaggcgcaacaaaaagccagcctatgaaagatacgacctcgatagatctccatttgcacagaggcccacacaacgcgacgtggctgacctcttgggtgaaacaaaagctgatctagaacgccttatcaactacaaggaccagtttgttgtgcgtcgccaggagaggatcgccgggaaggatcgtgatctcgcctatcccaccgcgaggctgaggggaattcatgagcggctgaagtttcacctgaataaagtaagacagcctagctatctcttctctccccgtaagaagcgatcacagagggacaatgcagagctgcacttagaccaagaccagtatctgactctggatattaagcaattctacccatctacgaccgacgccatggtgttccgatggttcaaggacgaactgggcatgtacgacgatgtcgccggaatgctgacgcatttgtgcactattgacggcaaggccagttttggaagcccgctgacccctgtgctctgtacacttgttcaccgccctatgttcgattccatctccgatatctgtagcgcccgcgggcttagacattccctctgggtggatgacttgaccattagtggaagatttgttcccggcaaagtggtcacttcaatcaggacagtgatccaggattgcgggctgaggagccataagattagataccggtccgggaatagacctgtggtgataaccggtataggcgtggtcggacgggatctggttgccccaaatagtctgaacttacgcatacgacggtactgggatgatcttcacgaggctgtcaccgcggacgagaaagcggcctgcgcacagttgctgatgtcacagctaggcacagtgcggcacatcgtcggtgctaaatcggacgtaggccagcgagctgctgatcaaatgaacatgctcaaacagaaacgggcaaagtggttacgggaggctaacgcagtcactcccgccagacagcacgacgcatctgtagacgccgaagacatgccgttctga

SEQ ID NO: 10326 - RNA, 1032 nt, unidentified
  source 1..1032: mol_type = other RNA; note = synthetic construct
atgccccgtaataggcgtagtccagtctatgagcgctacgatctctccaggagcccttttgcacaaagaccgacccagcgcgacgtcgcccaattactcggcgaagctaaggccgacctgcaccgcctagttaattacaaagaacagttcatcgtgcgccggagagagatcattggtggaaaggtgcgggacctggcataccctgtgagccgcctgagaggagtgcatgagcggcttaaattccacttgaacaagattcgacaacctagctacctgttttcaccgcgaaagaaacgctcgcagagggacaacgccgctctgcatttggaccaggaacagtatctgacattagacctcaagcagttctacccatcaaccactgaggcgatggtcttcaggtggttcaaagatgagctgggcatgtacgaggatgttgccggtctgctgactcacctctgcaccatcgacgggaaagcctctttcggctcacccttgacacccgtcctgtgttccctcatccacagacctatgtttgacgagatttctgaaatatgtactaagcggtggctacgacattccgtctgggtggatgatttaacgatcagcggacggttcgtacccggacaggtggtggaggaaattaggagtgtaattaggtccgcaggactgcgttcccacaagattagatatcgatctgggaacagaccagtatttatcaccgggataggcgtggttggcggatgcctactcgccccaaacagccttaatctcaggatccagaaatattggcaagatttgcgggaagcgggcactgtggacgagaagatctcatgtgctgagcttttgctgagtcagctgggtaccgtgagacacattgttggggctaggtctgacgtcggccaacgggtggcagatcagatgaatatgcttaagcagaaacgcggtaagtggctgcatgaagcccttcatctgacgcagctcaaagagagaacagaacctacctttacaggggtttgcgatatacccttttga

SEQ ID NO: 10327 - RNA, 1041 nt, unidentified
  source 1..1041: mol_type = other RNA; note = synthetic construct
atgcgtcccaggaaagctcgggtgcgctttgagcggtatgagattgaacgttctccattctctcaaaagcctacccaaagagagatcgccaaactgctgggtgaatcaagggacggactcaggcgcctgatcgaggacaaggagaactacattatccggcgggaggcttttgtgggcaaaaagcagaaaaagcgcgacttgcgctacccaatccgacgtctgagggccgtccacgagagactgaaatttcacctcaacaaggtgaagctcccctcctatctgttcagtccacggaagaatagaagccagcgcgacaatgcggccctccatctagatcaggacgagtatctgacccttgaccttaagcagttctaccctagtaccactgctcagatggtaagggggtggtttcgcgatgagctgggcatgtacgacgacgttgctggaatgcttacacatttaagcacaatagatggtgctgtagccttcggctctccggttacacctgtgttgtgcgccctaattcataggcccatgtttgatagaatttcggagatttgcgatgaccacggattgcgatattcactgtgggtcgatgacctgaccatctctggtaagcaaattactggggaggtggtggaaaagattaggaaggtcataagagacgctggcttaaaatcccacaagatccggatcttccgcggaaaaaaacctgtgttcatcacaggagtcggggtggtgggggccaatctcgtagcacactccagcttacacctcaggcttggcgccgcatgggcggaatacgatagtgcagaaaccttggaagagcgagatcattgtactcaaacactgctttcactcctggggacgatccgacatatagttggcgcacagtccgaagctggccagaaagcagcgaaccagatgaacactctgagacagaagctggccaagagcagagccgaagctgcagttgccaatgtcaaacggcggatgttggcagtgcagaccacggaacacgccagagatgccccctggtga

SEQ ID NO: 10328 - RNA, 1044 nt, unidentified
  source 1..1044: mol_type = other RNA; note = synthetic construct
atgaggagaaagaaggtgcgtgatcgctttgagcggtatgaattggcccgctctccattttcacagaaaccgactcagcgagacatcgccaagctgttgggcgagagcagggacgatcttcgaaagttgattaactacaaggagcaattcgtggtcagacggaaagccataattggaaaaaaacagaaggagcgggatctgcggtatcctgtgtccaggttgcgcgccgtacatgagcgcctcaaattccacctgaataaggtgaagctaccctcatacttattctcccccaggagaaatcgcggacagagggataacgcggtgctccacctggatcaagacaggtacttaacgctggacctcaaacagttttatcccagtaccacagctcagatggtgtggaagtggtttagagacgacttaggtatgtacgacgacgtggctggcatgcttacacatcttagcaccatcgatgagaaggtcagtttcggctcccctctaaccccagtactgtgcgcgctgattcatcgacccatgttcgaccgcattgctgaaatctgtgacgaacacgagctccgttacagtctgtgggttgatgaccttactatctcggggcggcatattagcgtcgaaatccttaagaaaatccgggctgtcgtgcaggaggctggtctaaaaacccacaaaatacgttttcattctgggagaaagccaatctttatcacgggaatcggtgttgttggcgcccatttggtggccgccaacagcctgaacctgcgactgaagactgcatgggctgaatatcacggcgcgcagacaataaacgaaagagatcactgcacccaggttctcctggcccaactgggaaccctcaggcacattgtgggggccaagactgatgcagggcagaaagcagcaaatgaaatgaattccctgaggcagaagctcaagaagcacagagtccaggacgctaaactgcaggcagcaaaacggcaaatagccgcctctcaaacaattaccgaggctgcagatgcccctttctga

SEQ ID NO: 10329 - RNA, 1056 nt, unidentified
  source 1..1056: mol_type = other RNA; note = synthetic construct
atgagcggcaaaatagctcgaaaaaacttcgaaagatacgggatcgagaggtcgcctttttccctccggccaactaagcgcgacctggcagcgttgctgggggaatctgtaaaggatctgaagaccttggccattcctagctttaaggagcagtttgtggtgcgcaggcaggcagagacaggcaccaagaagaagaaaatccgggacctggtatatcctgagtcccgccttagagggatccacgaacgtctcaaattccacctcaataaagttaggcaaccaagctacctcttcagcccacggaaggaccgcagtcagagggacaacgcggctatgcatctggatcaggaaatgtacctgacattagatctcaagcagttttatccctctactacttcagcaatggtgagaaagtggttccagaatgagctcggcatgtttcccgacgtcgccagattgcttaccgatctgagtacaatcgacgaaaaagtctcctttggttcacccctgactccggtcctttgcacactggtgcacagagagatgttcaacgaaattgctgacgtgtgtgagctgcatgagcttaggtatacactatgggtcgatgacctaaccatatccggtcgaagcatccctgccatcgtgttagagcggatacgcgaaattatcaggaagcacggtctaaagagtcataagatacgattccacaaaggaagagatccggttttcatcaccggcattggcgttgtgggccggaagctgattgccccattctctctgaatctcaaaatcaagaaatgttgggcggagtaccacgccgccaccacgacatcagagagggatcaatgcattcagaccttgcttgctaatttaggaacggcaagattcatcgtcggggctaatactttggccggacaaaagctctccgacgaaatgaacgctctgcggcagaaaaaagccaaaatgtggcgtcaagacgtgaagcagtcactggcccgcaacatgcatctgtctggaattagcgatctggcacccgcaggagatgcccccttttga

SEQ ID NO: 10330 - RNA, 1056 nt, unidentified
  source 1..1056: mol_type = other RNA; note = synthetic construct
atgtccggcaaagtggcacgtaagaacatcgaacgatatgatatcaagagatcgccattctccctccaccccaccaagagagatctcgccgttcttttgggagagactgtcaacgatctgaagaccctgagcattccctcttttaaggaacagttcgtggttaggcgtcaggccgagacaggcaaaaagaaaaaaaagctcagggacctggtttatcccgaatctcggcttcggggtattcacgagcgcctgaaattccatctgaataaggtgaagcagccaagctacctgttttctccgcggaaaaatcggagccaaagggacaacgccgagacacatctagaccaagatgtatacctcacactggatctgaagcagttctatccttcaaccacagccgcaatggtcagaaaatggttccaggacgagctgggcatctacccagacgtggcgagactcttaacggacctgtcaactattgatgaaaaggtgtcctttggatcacccttgaccccagtcctttgtaccttagtacaccgcaagatgttcgacgaaatcgcagacgtctgcgatgcttacgagttgcggtatactctctgggtcgacgacctgaccattagtggccgctctattccggcagagatactggacaagatcaggcaaattattcggaaccacggactgaagagccataagatcagatttagtacagggcgacgccctgtgtttataactgggatcggtgtggtgggtagaaaactgatagccccttacaccttaaatctgaagatccaggaatgttgggccgattatcacgccgccaatacggtggccgaaagggaccagtgcatacagaccctattggctaatcttgggactgctaggtttatcgttggccccaaaacagctgcgggacaaaaactatccagtgaaatgaactcattgagacagaaaaaagctaaaatgtaccgcgaggatgcggctgagagtctcaagcgccgaactgaggcaaggtcccttatcgggagcagccagattgccgatgtgcctttctga

SEQ ID NO: 10331 - RNA, 1038 nt, unidentified
  source 1..1038: mol_type = other RNA; note = synthetic construct
atgctgcctcggagccagcagcgagagcggtacgaattagagcggtcacccctcgcacaaaaacctacccaacgcgacgtggcccagctcttgggagaaaccagggatgacctgagacgactaaggaactacaaagagcactttattgtgagaaggacagccatcattggcaaaaaggggaagatacgtgagttggcctatccagaaggaagactgagggccttgcacgagagactcaagtaccagctaaacaaggtgaaacagccgaactatcttttcagccctcgccttcgcaggtcccagcgtgacaacgcggcattacacctggagcaaaatcagtacctgacgctggacctgaagcagttttatccatctacgaacgagagtatggtacgctcctggatgcgggaccagctcggcatgtacgaagatgtgtcaggtctgctgacagatctctgtaccgttgacggcaaagtgagctttggcagccccttgactcccgtgctgtgttcgctgatccataagagtatgttcgatcagatcgctcgtatctgcgataatcgcggactcacttatagtgtttgggttgatgacctgacaatctcggggagatttatcccaggcgaagtcctcaacgagattaggtgggtcgtgcgggatgccggtttgaagtctcatgcggtgaagtaccgcaacgggaatagaccagtcttcatcaccggcatcggggtagtcggaaggaagcttatagccccctcatccctaaatcttaaaattcgagtcgcttggagtgagtaccacactgctctgtccgatgacgaaagagatgaaatatgccaacgcctgctgtcctatctgggcacactgaggcatatttctggttctacttcagaaaccgggcggaaaatttccgaccagatgaatagccttagacagaagaggtctgctcggcgattcgcaagcgaggcaactcggaatgaggtgaccaagagccctcccgctccgaaaatggccgacccattaggactcccttggtga

SEQ ID NO: 10332 - RNA, 1050 nt, unidentified
  source 1..1050: mol_type = other RNA; note = synthetic construct
atgaagagtcagaccctcaggaatcgtactcccactcatgagcggtacgacctgagcaggtccccctttttccagaaacccacacaacgcgaagtggctgaactgttgggggagactagggacgacctcaggagacttattaactacaaagaggagtttgttgtccgccggaccattgtgacggggaagaacgacaaagtccgggatctagcctacccagtgagtagatatcgggcgtgccacgagcgactgaagtttcatctcaacaaagtgcgccagccatcctatctgttttctccgcggaaacacaggtcccaaagagacaatgcagcgctgcatctcggcggcctgcagtacctgacactggacctcaagcaattttaccctagcacaaccgatacaatggtaagacgatggttcagggacgaacttggtctgtatgaagatgtagcagggctgctaacccacctgtgcactatagacggtaaggttagcttcggtagccctgtgacccccgtcctgtgttctttgattcatcgcgaaatgttcgatgaagttgctaggctttgtgaggttcgcggccttcacttttcggtgtgggtggatgaccttacaatcagcggcctgttcgtcccaggagaactcgtggaccagatacgggccatcgtgagggctgcaggattgaagtcccacgccatccggtacagaactggaaacagaccggtgttcatcaccggcatcggcatcgtcggttctaaattggtggcgtccaacgccctcaatctcaagctaaagcagggctgggcagactatcatgatgctgagacggatgatgagaaggatttcctgacacagcgcatgttaagtttattagggaccgtccggcagatttcaggagcaggaagcgacagagggcgaaaggccgccgatgaaatgaatagtctgcgccagaaaagaaatgagcgtcaacgaagggcccgtgcttcaaaatctgccctgcgacacgtgtcagacccagctgagttggtacctgccgatgcccctttctga

SEQ ID NO: 10333 - RNA, 1059 nt, unidentified
  source 1..1059: mol_type = other RNA; note = synthetic construct
atgccacggtcttcacagaaagacaaaaaatttgagaggtatgagctgtccagatctcctttcgcccaaaaacctactcaacgcgatgttgcgaaactgctcggagaaaaacgagatgacctccgacggctcgtaaattataaggagcagtttatcgtgagacggcaggccaaaaccggtaagaaagagaagttgcgcgatctggcttatcccgaaaaccgactcagggcagttcatgaaaggcttaagtttcacttaaacaagatcaagcagccaaattaccttttttccccaagacggaagcgagggcaacgcgataacgctgcccaccacttagatcaggaccagttcctcaccttggatctgaagcagttctacccaagtactacagacaaaatggtacgcaggtggtttagagatgagctggggatgatggacgacgtggccggactgcttatgcatttatgtaccatcgatgggagggtcagcttcggatccccgctgacacccgtgctttgcagccttatccaccggccgatgttcgataggattgccgaggtttgcgatacttatggcctgcagtactcagtgtgggtcgacgacctaacgataagtggcagatttgtgcccggtgacgtcctgaataagatacggcagattgtgcatgcggctggcctcaagatgcatgacatcaagtttaggagtggcaaccgtcccgtgttcatcaccgggattggagtggtcggtgctaatctggtcgctcctaattccctccatataaagatccgcgactgctggactgagtaccactcggcaattaccgccgatgaaaaggatgcagttagccaacagctgttgtcccacttgggaacactgagacacattacgggcagcagttcagaggccggccgcaaagcagcagaccagatgaactctctacggcaggagagagacgccaggcgcaaagccgaacaaaagtgtcgtcaggcggaacgtaacgcaagagctagcgtggagattttcgacctgtctgacgcccctttcgaaatgacactgtga

SEQ ID NO: 10334 - RNA, 1047 nt, unidentified
  source 1..1047: mol_type = other RNA; note = synthetic construct
atgccacggaaatcaacagcggccagccactacgaacgctatggcgttgaccgctctccatttgcccaaagacctactcagcgggacctggcgtcacttgtaggagaaacgcgagacgatctgcggcgattagccagctacaaagagcagttcattgtccggcgacaagtcgagacaggaaagaaggccaaactgcgcgacctcgcctatcccgagggtcgtcttcggggagtgcatgagcgcctgaagttccacctcaacaaggtgaaacagccctcatacctattttctccgcgtaaagggagaggccagcgtgataatgcgctccaccatctcgatcaggatcagtatctgactctggacctcagacagttctacccctccactagctcccaaatggtgagggagtggtttagggaccatctgggtatgtatgatgatgtggcaggactattgacgcacttatccaccattgatgacaaggtcagcttcggcagccctctcaccccagtactgtgcagcctcattcacaggccaatgtttgataggatagcagatatatgtgaggcacgggggttgcgatattcggtctgggtggatgacctgactatctccgggagattcgtgcctggagaagttttaaggcagatcagggaggtggtacagcaatttgggctgcagtcccataagattagttacaagaccggcaaccgcccggtgtttatcaccgggatcggagtggttggcagtcgcctggtggcacccaacagtctgaatctgaaagttaaggaagcctggacaggttatcacaatgccgtcacagacgacgaaaaagacgccatgtgccagcggctgctttcttaccttggcaccttgcgccagatcgtgggcggcaaaaccgaggctgggaggaaggccgctgatcaaatgaactcattgagacagaagagggacgcaagacggaaggccgctgcagaagcctacagaatcgaacgagagcagagacaggctgtgccctctgctgtcgctgctgacgctcctttctga

SEQ ID NO: 10335 - RNA, 1065 nt, unidentified
  source 1..1065: mol_type = other RNA; note = synthetic construct
atgcagaagcgtgccgataagcggaatggagaaagatatccattgaatcggtcccccctcgctcagaacccatcccagtcagacctggcaatgctggtgagggagacaaaggcggacctaaatacattagctacaccagagtttaaggaacagttcctggttagacgtaccattgagacgaacggaaagactcgcaacctcgtttaccccgagggtcgtctaagagcagtccacgagcgcctgaagtttcacctgtcaaaaattgtacagcccagctacctcatgagccctaggaaaaggcgctcccagcgggacaatgcagttgcacacctcgaggcaacccaatatttaacgctcgacctgaaacagttctatccttccactactagacaaatgatccggaacagtctggtagctcagttcggaatgcaggctgatgtcgccggcctgatcgcccatttagcgacagctgatgatcgggcatgctttggcagtcccttgactcctgtgcttgcctctattgtgcaccgaccaatgttcgatttgatcgccgggcgatgtaacgtcgatgggctgtcttacaccgtgtgggtggacgaccttaccattagcggccctcagattaccggtcagttcagaagcgacgtgcgcggcatcatcgctcagaacggcctgaggagccacaaactgcggagccaaaccgggaatcatccggtctttatcaccggcattggaatcgtgggtgccaatcttattgtgcccaagcgaatagaactgcgatccaaagagctgtgggctgaattcaaggcatctcaaacttttgaagagcttgattcttccgctaccagactgctctcgcatctcggcggggtaaaagccgttgtggggccgtcaacaatcagaggacagaaattgagctctgagatgaatagtgtccgccaaaagagggaaaaggccaggcgcttccatcaagcctttgtggccgagcagcggacaaggtcgagtcaggcctgctgtatacagaacggggacggagtgggcgaacaggcggaaatatcattctga

SEQ ID NO: 10336 - RNA, 1056 nt, unidentified
  source 1..1056: mol_type = other RNA; note = synthetic construct
atgcgaaaacggtatagattgaaatccggggaaaaatatcctttagaaagatctccgttcgcccagaagccatctcagcgcgatattgccgaattggtgagggaatcaaaggatgatcttaatcgtctcgctaccccacgctataaagaacagttccttgtgcgaagaaccattgagacgaacggcaagacccgggacttagtgtaccctgagggaaggctgcgatcggtgcacgaaagactgaaataccatctcagtaagattgcccaacctagctatcttatgtcaccccgtaagggacgagcacagcgggacaacgctgttgctcacctggaggcagcccagtttctcactctggatctgaagcagttctacccgagcactactcggcaaatgatcagaaactccctgatggagcagtttaagatggaggcggacgtggcaggtctgatcgcacatgtagcaactgccgatgacagggcatgctttgggtcaccactgaccccagtattggctagtcttgtgcaccggcctatgtttgatcggatcgcggaccgctgcgtggaagacgacctgtcttacacagtttgggtggatgaccttacaatatctggactgaggataacgggcaacttcagggccgatgttaggaagctcgtggcccagagcggcttgaaaagtcataaactgagaacccagaccgggaatagacccgtcttcgtcacagggattggtatcgtcggcgcaaacttgatcgtccccaagcgcctggaactccggagcaaagagctgtggacagaactaaaggccgctcagacacaggaggaaatggaggcctgttctgtccgcctcctgtcccacctgggtggaatccgcgccgttgtaggcgcctcatcccacaggggccaaaagttagctagcgagatgaacagtattcgccagaaactatccaaggctcgtcgggaaaataaggccagactcgctgaggagaaagcggccgctcaagagataagcagggtggaccccgacaatgagaaggagaatatccccttttga

SEQ ID NO: 10337 - RNA, 1068 nt, unidentified
  source 1..1068: mol_type = other RNA; note = synthetic construct
atggcagtgagaaaaaggcgggtccgtaaggcctatgaacgttatgaaattgaccgatcaccacttgcccagaggcccagtcagagagacattgcatcactgatcagcgagaataaaagcgacttaaacaggctggccactcctcagttcaaagaacagttcctcgttaggagaagtatcgagtctggaggaaagacacgggacctggtgtaccccgaaggaagactgcgagctgcccacgagcgactcaagttccacctgaataagatagtccagcccagctacctgatgtcgcctcgtaagaacaggagtcagagggacaacgccgctgcacatttggatgctgcgcagtacctgactctagatattaagcaattttacccaagtacgaccaggggaatgattcggaactctctggtggatttgtttggtatggaggccgatgtggccgggctgattgcccacgttgccactgcagacgaccgcgcatgttttggttccccactgacccctgtactggcatccctcgttcacagaccaatgttcgatgcaattgcggatctttgcgctagctacgacttagggcacacagtatgggtggacgatctcactataagtggtaatcaaatcccgggccgctttgtgtctcaagtgcgcgccatcgtcgcttctcatgggctgcgctcccataaattaaaatatagaaccgggaacaaggctgtgttcataacgggcattggcgtggtaggatccaatctggttgtcccccgctccgttgagcgacggagcaaagacctttggcgggatttccagaaggctgacaccgtggatgaaatcgacaccgcgggcagcagattgctctcccatttggggggcatccgacacgtcgtgggcaaatcaagcaaacggggccagaagatctcaagcgagatgaattcggtccggcaaaaaaggacaaaggcgcttcggataggttctgagaagtccgcctcaacctctaacctacgctatctcacagccgaagagcaggaggaacgcagagatgagatcgatgctatccctttttga

SEQ ID NO: 10338 - RNA, 1041 nt, unidentified
  source 1..1041: mol_type = other RNA; note = synthetic construct
atgtacgaaagatacgaacttgaacggagtccctttgcccagaaaccaacacagcgcgacatcgctgccctggtgcgagagaataaggaggacctgaacaagttaggcaccgacagatttaaagagcaattcctggtgcggcgaacaatcgaaacaagcggaaaagaaaggcggttagtgtatccagaggcaagactccgggccgtacatgagaggctgaaataccacttgaataaaatcatccagccgtcctatcttttcagtccaaggaagaataggtcccagcgcgataacgccgaggttcacctttctgcctttcagtatttgaccctggatataaagcagttctatcccagtacgacccgcaggatgataagaaactccctggctgtgcagtttggaatggcgggtgacgtcgccggcctgattgctcatgttgcgactgccgacgatcgtgcctgttttggctctccccttactcctgtcttggccagcctggtccacagacctatgtttgatgagatcagcgatctgtgcgtgtcatacggactcagccattccatttgggtagatgacctcactatttccgggcccaagatacctggcgcattcattgcagaaattcgtcggattatcgcttcatatggcttacgcagccacaagctgaaatactacactggtaataaagccgtgttcgtcaccggggtggggattgttgggtctaatctagtggctaagaagaaagtggagctgcgatctaaggaactctggcgtgcgctcaagaacgcagagacattggacgaaattgacacagcaaccacgcggctgctggctcaccttgggggaatcaagcagatcgtcggaaaatcgtcaaagcgcggtcaaaaactcagcaacgaaatgcattcaatcaggcaaaaaagagagaaggctttcaggaagaataccgagaggctgataaacgaagcctctggcttgcggcgactaagtccagaagagcaggaggctagacgcgaggagatcgatgcactccctttctga

SEQ ID NO: 10339 - RNA, 1002 nt, unidentified
  source 1..1002: mol_type = other RNA; note = synthetic construct
atgcctcgcattcagagacgtctcaaccaggtcgagcgttatgaactggctcgctctcccttatcgcagcggccaacccaacgtgatttagcagcgcttgtgggcgaaacgagggacgacctacgaaggctagtaaattacaaagagcaattcattgtgcggcggcagactgaaacaggtaagaagaagaagctgagaaacctggcttatcccagcggtcgactgagggctgtgcatgagcgcctcaaatttcacctgaacaaggttaagcagcccgactatttactgtcccccaggaagggtaaatcccaacgcgataacgccgcagcacatgtggggcaggatcagtatttgacgctcgacctgaaacaattttacccaagcaccacaggagggatggtgaaaaggtggctgcacgctcagctaaggatggaggaagatgtcgccggcctgctcgctcatctcgttaccgtcgatggcaaagtctctttcggctcaccgctcacacctgtgctgtgttccttggtgcacagacctatgttcgataaaatagcaagcttgtgccgacaccggggactgaattacaccgtctgggtagatgacctgactattagtggaagattcgttccatccgcccttcttgtccaggtgaggagaatcatccaggaccatggactcagaagccatgacatccgcttccgcagtgggaatcggccagtatttatcacaggaataggcgtgctggggcgaaacttggttgcccctcaggcgttgcacctgtccattcggtcatcatttgaagagtaccacgccgccatcaccgacgtcgagagggacagtgttgagcaaaagcttctgagccagctgggcactcttcgccacgtggtgggggtgtcaagcaaggcgggccagaatgccgccgaccagatgcactctatcagacagaagcgggataaactcagaaccgctgagcaatactctactacactggcagccggttga

SEQ ID NO: 10340 - RNA, 1047 nt, unidentified
  source 1..1047: mol_type = other RNA; note = synthetic construct
atgcccaggagagcacctgctaaaagcgagagatatcagctccaccgctcacctctagcacagcgacccacacaacgagatattgccaagctgcttggagagactcgggacgaccttcggcgcctcgtcaactacaaggaggaattcgtccagcgccgcaagatcgagtctgtgaaatcgggaaaaatccgcgaactggcttacccagttggtcgccttaggggggtgcatgagaggcttaagtttcacctcaacaaaatcaagcagccgagttatctgttctctccccgacggggctttggtcaaagagataatgcggcgtaccacatccggcaagaccaattcctcacgctggatctgaagcagttttatccaagcaccagcggggccattattaaacgttggctatgggaagacttgggcatgcctgaggacgtagctggcctgttaatgcacctggtcacagtggatgagaaggctagtctgggttcccctgtgactccggtgttgtgctcattaatccataggaaaatgttcgaccgaattgcggaaatttgtgacgcacgggggctcagatactccgtttgggtggatgacctcacaatcagtgggcggttcgtccccggagatgtattgatgcaggtcagagacataattcgcacctccggactgcggtcacacaagatcaagttcagaaccgggtcccgtcctgtgtttataactggcatcggcgtagtgggaccacatttggtggccccaaatacactgcatctgagaatccaagccggatgggccgattaccatgacgccgtgaccgacgatgagaaggacgccgcctgtcagactttgcttagctttctcggcacgttacgtcacatttctggtaggaagtctaaggccggccagaaagtggcagatcagatgaatgctctaaggatggaaagggaggttagacagaaatttgctatacagctggataaagagaaggcagaactgagggtccagaccaactattgcgccgttgaagacctgcccttcgatctgtga

SEQ ID NO: 10341 - RNA, 1029 nt, unidentified
  source 1..1029: mol_type = other RNA; note = synthetic construct
atgcccgtgaccaagaaagtgcaaagggccgagcgttatccaatcgcccggagcccattcagcatgcgacccacacagcgcgaagtagctcggctgctcggggaatcaagggacaatctccgccgcttggtgaattacaaggagcaattcgtgcaacggagggatcttgaaatcaacggaaaactgcgacacctggcttatcctgaatctcggctccggtccgcacatgaacggctgaagtttcaccttaacaaaattcagcaaccggcatacttgttttctcctcgccgcggaaagtcccagagagacaatgctgcactccacttagagcaggtccagtatctaactctggacctgaaacaattctacccttccacgactagtgccatggtgagaaggtggtttattaatgacctgggcatgtaccaggatgttgctggccttatgacccaccttgtgacgattgacgacaaagtgtctttcggttccccgctgacccctgtcctatgcactatggtgcatcgacgcatgttcgatcagatcgccgatatttgtagggccagaggacttaacatgagcctgtgggtcgacgatctcaccatctcgggacagtttgtaacaagagaggttctcagggaggtcaggacggtcgtgagggctttcggcctgaagacccacaaaattaagtaccgcactgggaaccgacccgtttttatcaccgggatcggcgtcgtgggcagtaatctggtggcgccagccaaaatgaatttaaagatcaaggccgcctgggaggcctatcatgcggctcagaccgatgcggagcgtgatgcttgcgctcagcacttactgacactcttgggtacagtgcggcatatagcaagacgagggtcacccttggccagaagagtagccgaccagatgaactcactgcggcagaagcgtgcagttctgactgttacaacaactaccagaagcgcacaggcgggtgccgctttgatagccaacgacgcagtcggcgatccattttga

SEQ ID NO: 10342 - RNA, 960 nt, unidentified
  source 1..960: mol_type = other RNA; note = synthetic construct
atgaccaagcgaacccacgagaggtacgccctgacacgttccccattggcgcagcgtctgacgcagaagaaactcgcaaaccttcttcggcggccgcttccccagttgaaaggcctgataaaatacaaaaagagcttcgttgtcgccgaagtgagagagatcgatggaaaagccaggcccctgtgctatcccagaggacctttaagaagtgtgaatgaggcactgaaatatcagctctcgaaaatcagactgcctgattacgtcgcatcaccaagacgcggaaggggtcaacgcgagaacgctgccgtccatgtggacgccaaacagattttgaccctggacctcaggaagttctacccaagcgtcagtagacggtacatcgctaggtttttcagggaagagttctccatgcaccctgacgttgccggcctgatcactgaactattaacctttgaagggcgtgtcctatacggggctccggctacgcctgtgctggtaatgcttgctcacaggaagatgtttgatcagattgacaacgcctgcctcgcttttgggacaaagatgtcattatgggtagataatctcacaatttctggcgctgaggtaccaggagctttgctcgttcaggtgcgggaaattatcgcgagtcatggctataagacccatgacatagcattcgtgactaccaaccgagatagcactgtgacaggtgtcgtggtgcgatgtggggaactgcaccccgccaattcttctaatctggcaattcgcgatctggaggccgcgctgagaaactccgttgaccccagcgagtatgaggccaaggcaaataggttgctgtcacggctcggcgggcaactgcacatccttggcactcagcgcgaatggggtcagaagatcgcccgccgaatgaacgtgataagacaaaagcgcgacaaacgggtgcggtccaattctaagtga

SEQ ID NO: 10343 - RNA, 987 nt, unidentified
  source 1..987: mol_type = other RNA; note = synthetic construct
atgacaataaagcggaaagagccatcccacagaagcgaccggtatgaactggaagccagtccactgtatcagaagcctactcaaaaacagtttgctgagttggttggactgtcaaagtctaaattacgaggccttatagatcacaaaaagcagtacattatccgtcgagacgcagaaatcaacggcaaaaaaagaaggctggtctaccctttcggtaaatttcggagtgtccacgagaagctcaagtttcacctgaacaaaattatccagcccgcatacctctacagcccccgaaagggaagaaaccaaagatccaatgccgtcttccatctgggacagacccagtatcttaagctcgacatcaagcagttctacccctctaccagttcggaacatgtttttaggtgggcaaaatacgacatgcgcatgtctgacgatgtggcagggctcctggtgcatattgcgaccattgatgatgtagtatccttcggcagccctcttacgccggtcctagctacccttgtgcataggcgcatgttcaatgccatagccgaagaatgttcagcccgtgggttacgaatcagcttgtgggtggatgatatagttatctctgggaagtttattcccggcccactggtatcccgcattagagacttgacgaggagcaatggtctaaagagccataaactggagtatttcacaggctataggcgcgtgactatcactggagttgtggtgaaaggggacgagattcactcccctcggaagctgcacacagagatctcaaacgcttatggactcgccatccaatctaactccaggattgaggctgaggccgccgtcgatcggttgctcagtactctgggccggtacagggtgatggtgggcaaggggtcaccaatgggtcgtagggcgtccagccggatgaatgctatccgccagaagagagtgcgctttgtgtcggagagatgctctaccacagactga

SEQ ID NO: 10344 - RNA, 1041 nt, unidentified
  source 1..1041: mol_type = other RNA; note = synthetic construct
atgacagtgaaacgccacaaacagaataagtatgaacgatacccattcgagaactctccatggactcaggacctgacccagcgggacttggccgagttgttagggtggaagaagcagcagttagaggcgttggttcgggacaaagaccgctatattaagagggggcccaagcttatcggaactaaaaccagggagctggccgtgcctacaggaaaactccgtaccatccacgagcggatcaagatacacttgaacaaaatcaagcagccggaataccttttctcaccacgcaagggccgcgctcagcgtgataatgccgaacatcacgttgggcagaatcaaatcctgtctctggacataaaacagttttatccctctacgacggacgaacatatttttagatgggcataccatgtggctggactgagggctgatgtggccggtctgttcaccaagctagtagctgttgacggcaagatgccttttggcagccctgtgagtcctgtcctgactactcttgtccatagacaaatgttcgatgccatcagtgatatttgcaaagagcaagatctcaagatgagtctatgggtggatgacctcgtgatttccggctccttcgtgagaggcaaggtcatggaggatgtcagggcggcaattcggcggtttggctttcaaacccacaaaattcaattccgctcaaccgcccgacctgtcccgatcacaggagtgcccgttaccaagacatcaattggcgcacccctgtcgctccataggcgaatacagagcgggtatgccgagctgagacagcgcttaacagacgcccagagaacccaggcgacagataaactgctcgctgccctgggtacctaccgttaccaccttggtgcttccagcgaacagggaagactggcagccaaccggatgaacgcactcaggatgaggcgagctcggctgaagcccagatatgtgacttacccagtagggagcactcctgacgagacgtccacagaaatcgatgacggaactcccccatgggaatga

SEQ ID NO: 10345 - RNA, 1041 nt, unidentified
  source 1..1041: mol_type = other RNA; note = synthetic construct
atgacgcggcgtaaacaacccccctacgagagataccactttgaccagtccccttgggtgcaggatctcactcagagagacttggccgccctgttaggctggaagaaacagcagctggaggctcttattagagacaaggaaaggttcatcaaacgggaagccaagctagtgggtacgaagatgcggaatctggctgtacctaccggcaaactgcgcaccatccacgagaggctcaagttccacctgaacaaaataaaacagcctggatacctcttcagtccccgaaagggtagagcccaaagggataacgcagagcatcatgctggccagactcaattcctgagcctagatatcaagcagttctatcccagcacaacagatgagcacatttttaggtgggctcatcacatggccggtttgagggccgatgttgccggcctgttcaccaagcttgtggcaatcgacgggcggatgccgtttggcagtcctgtctctccagtgcttactacccaagtgcatcgtacaatgtttgacgaaatccacgccatctgcgaggccaaccgacttcacatgtccctctgggtggacgatttaaccatctccggagtgtttgtccgcggggccattgccgaagaaattagggcagtaataagacgccatggattccagactcacaaggtcgcttttagaaatgcacatcggccggtggtggtcaccggagtgccaataaagaataagcgggtcgtagctccacgcagcctccataaacgcgtccaggcagggtatcaagcgttacgagagtcacgtacagacattgagcgggggattgcgatcgacagactgctgtcagcgctcggaacttatcgataccacctgggtgcctctaccgcagagggcaggacaacctctaacaggatgcagatgttgagagttcggcgcgctcgcctgaaaatgagcgcaattactgttccaacggtgggacctgcccaggcgacatcggttctggctggggctgaaggcttggacctgccctgggattga

SEQ ID NO: 10346 - RNA, 1032 nt, unidentified
  source 1..1032: mol_type = other RNA; note = synthetic construct
atgaagcagcataaacagagatacgagaggtatttgtttaaggattcgccctgggtccaggacttgactcaaagagacttagcggagctgctgggatggaaaaagcaccagctcgaggccctgattcgggacaaagagcggtgggtgaaaagagaaccaaaacagatcgggcttaaactgaggaatcttgccgtgcccactggaaaattacgtaccatacatgagcggctcaaatttcacctgaacaaaattaggcagcctgaatatttgtttagtcccaggaagggccgatcccaacgcgacaacgcggagcaccatgctcagcagacacagttcctgtctttggacatccagcagttctacccaagtaccaccgacgaacacattttccggtgggcatttcacgtagccggcctccgatccgatgtcgcagggctattcaccaagctggtggcaatcgataggaagatgcctttcgggtcaccagtgtccccggtgcttatcacacacatacatcgtgccatgtttgatgagatcttcgcgatctgccaggccaatgggctgcgcatgagcctgtgggtggatgacctgacgattagcggaaccttcgtccggggcgagcttgtcgaacagataaggggtataatccgccagagggggtttcaaacacataagatcgagttcaggagcgccgctagacgggttattgttacaggtgttccaattgaacgacgccgcgtgatggctcccagagcccttcaccaacgcattcaaaatggctacgccgctctccggggcgacttaacagacgtagaacgtggcaaggctatcgataagttgctgtctgcactgggaacttatagataccacctcggaccgtcagaacctggcggtcgaaaggccgccgatagaatggaggctctgcgcgtgcggagagcaaagctcgatatgactatggtgacgctacctgcagttgagaacgtcatcaccgcttcttccactctccccggtagcgagctgccttgggaatga

SEQ ID NO: 10347 - RNA, 1047 nt, unidentified
  source 1..1047: mol_type = other RNA; note = synthetic construct
atgaagcgcagaaaacaacaggaatacgagagataccccttcagtgattctccttggactcaagacctcacccagcgtgacctggccgagcttataggatggaagaaacaccagctagaggcacttgtgcgtgataaggaacgctatacgcggagaaaaacagagttaatcggcagcaagttgcgagatctcgctgtcccgacaggtaaactccggactgttcatgaaaggctgaagttccatctcaacaaaataaagcagcctacatatcttttctcacccagaaagggaagatcccaacgggacaatgcggaacaccatgtggaacaggtgcagttcctgagtttagatatcaagcagttttacccaagcacaagcgatgaacatatttttaggtgggcctattacgtcgccggtcttcggagtgacgtggcagggctgctggtcaagttgattgctatcgatgggaaaatgccctttggctccccagtctctcccgtgctgaccactcacgtgcacagaagcatgtttgacgagatctacgagctctgccggtcgcagggtctaaagatgtcactctgggttgatgacttgaccgtgtctggccagttcgttaggggggagttagtggaggccatccgcgtaattattcggcggcagggctttaagacacacaaaataaaattccggtccgttggacgcgcacagggaggaaggcctgtcgtggtgaccggggtcccagtacgcgctagacgagtagacgcgcctttttctctgcagaagcgagtgcaggatggttatgccaagctgcgtccggacctgactgacgtagagagagcccaggcaattgactccctgctcagcgctctgggcacctataggtaccacctggggcgcagctccccagaaggaaggaaaaccgccgaccgcatgcaggccttgcgacaacgaagggctaagctggatctgaccgttatcacccaaccctcaggccctatcaaaccctggggcactacaacgagggactcagatgtgccatgggagtga

SEQ ID NO: 10348 - RNA, 1047 nt, unidentified
  source 1..1047: mol_type = other RNA; note = synthetic construct
atgaagcgcagacggcaacagaaatacgagaggtatagtttccgggatagcccttggactcaggatctgactcagagagacttagcagaactcattgggtggaagaaacagcagctggaagctcttgtaagagataaagagcggtacacaaaacggaagcgcgagaaaatcgggagcaagatgagagacttggccgtccccgtcggaaagttgcggacagtgcacgaacgactgaagtttcacttcaacaagatcaagcagcccccatatctgttcagcccacgcaaaggccgatctcagagagacaatgccgaacaccacgccaagcaaatacagttcttatccctagacattaagcaattctaccccagtacaaccgacgagcatatatttcgatgggcttactacgtcgccggactacgatctgacgttgccgggctcctggtgaaactgatcgctatcgacggcaggatgccttttggttcaccggtgtcacccgtgctcaccactcatgtgcataggcatatgttcgatgagatttacgatctgtgttgccgaagggggcttaagatgtctttgtgggtggatgatctgacgatctccggacagttcgtgaggggcgagttggtggacgccgtaagagctgtgattcgccgtcagggtttcaagacccacaaaattaaatttcgctcggttggacgcgcccaagggggcaaacctgttgtcgtgacgggcgtgccacttagggcaggacgggttgacgcgccgtttagccttcagaaacgtgtccgggacggatatgctctgttgcgcacagatctgacagacgtcgagagggcaaaagccatcgattccctgctctctgccctgggtacctatagatatcacctgggccgtggctccccagaaggcagaaaggcggcagatcgcatgcaagcgctccggcagaggagagctaagctcgacgcaaagggctacgtaaccgggcctaaggcagaaggttcatttgaggacagggttaccactagtgatgtgccctgggattga

SEQ ID NO: 10349 - RNA, 954 nt, unidentified
  source 1..954: mol_type = other RNA; note = synthetic construct
atgaagaccacaaagggacgtctggagtggctcatcgagaataaagaacggtttaccaagcgggaagaccgacagattggcaggaagaccagaaacctgtgctaccctgttggtaagctcaggggcgtgcacgagttgttgaagttccatttcaacaaaattcgacagcccccttacctcttttcccctagaaagggccgttctcaacgagacaacgccgagcaccacgcagataaagtgcagtttctgagtttggacatcaagcagttttatccgtcaactaccatcgaacacgtttttagatgggcttatcatgaggccggtctgaaagccgatgtggccggcatgcttgcgcacctgatctgcattgacgggaagcttccatttggctctccagtcagccccatagccgctacacacatacatcgctctatgttcgatgcagtttacgatatctgtctagagaatgatctccagatgagcctctgggtagacgatctgacaatttcgggggccttcgtacgcggggaactgatcgaacagattcgcagtgtgcttcgtcggcacggattccaaacgcacaaaataaaattcagacaaagcgacaaaccagtgatcgttaccggcgtcccagtcaagaataggcgggtgatagcacctcggtctttacatcagagggtcgaagacgggtatgctgagctaaggggagcagagtcagataatgctactgtctccgcgattaaccagctgttgtccgccctgggcacaatgagataccactatggagctcagagtgtggaaggacgcaaagccgcggaccggatgcatgcactgagaaggcgcagagacgctatccagcaagccagcagcaggcagattccctcagacctgtccatccgcaagcaggatgaggccgtgactggggatggtcatttaccctgggtggctgactga

SEQ ID NO: 10350 - RNA, 1038 nt, unidentified
  source 1..1038: mol_type = other RNA; note = synthetic construct
atgcggcagaggaagccaaaaaggtacgagcgatatgcccttgaggattcaccatgggttcagaacctcactcagcgagacttagctgagctgctcggctacactaaaacccaactagaagccttaatcagggacaaggacaactggattggcaggagaactgagatgataggcagtaagctcaggaacttagctgttccccgaggaaagctgcgcgcggtccatgaaaggctcaaattccacctcaataagatcaagcaacccgattacttgttttccccacgcaaaggacgggcacagcgggacaatgccgagcaccacgtttcccaggggcagttcctgagtcttgatatcagacagttctatcctagcacaacatctgaacacatcttcagatgggctcatcacgagctggggctgagaacagatgtggccggtatgctggtccatctggtgtccgtggatggcagaatgccattcggatcaccaatcagccctgttctcacaactttggtgcaccggtcaatgtttgacgccatcaaactgatctgcgacgcccatgatctgaggatgtccctatgggtggacgaccttaccattagtgggcgggccattcctggtacgctgattgaggacgtgcgggctgaaatgcgacagcgctcgtttcagacccataagatacagtttaggagcggtaaccgtcccgtaatagtgactggcgtcccgattgatggggaccgtgtagctgctcctcggtccgtccacgagagagtgagaacaggctacgcagcccttcgagtccctctagcggatccggaccgcgctcaacaaattgataagctgctgtcagcccttgggaccctccggtatcacgtaggacgctccagccccgaaggaagacgtgccgcaaatcgcatggatgcattgaggcgccgccggagctctttgagtaaatctgtgacgaccctgcctacactgaccgacagagaagcatctgcggagctgcccgtgtctaccagcagcttgccctgggaatga

SEQ ID NO: 10351 - RNA, 1038 nt, unidentified
  source 1..1038: mol_type = other RNA; note = synthetic construct
atgaaacgtagaaaagtcagtaggtatgagcgctacgcatttgaagattccccttgggtgcagaagctcacacagaaggagctggcaacacttctggggtataccaaagatcagctcgaggctctcatcagggacaaagataagtggatcggacgccgggctgaagtgatcgctggcaagaaacgcaacctggcggttccttatggacggttgaggggcctgcacgagagacttaagtttcatctcaacaaaatccggcagccagattacctcttctcgccgagaaaggggaaggctcagagagacaacgctgcccaccacgtgggccagacacaattcctgacgctggacattaggcaattctatccaagtaccaccggggagcacatttttcggtgggcgcatcatgaagccggcttacgccccgatgtagcagggatgttggtgcaccttgttgcggtggatggcaagatgccttttggtagccccatttccccagttctgactgctttagttcatcggcctatgttcgatgccatctccgggctgtgcgccgagagagacttacacatgtctctgtgggtcgacgacctcaccataagcggacgagaggtgggcggtgacctaattgaccaggtaagggccatcatgaggaaggccggcttccagacgcacaaaatcagatttaagatgggtaacagacccgtggtcgtgacaggtgtacctattgatggctctcgagtgactgcaccccggtccgtcaatgaacgtgtccggatagggtacgcaaatctgcgtgtggctgccaatgataatgaacggcgacaagccatagacgccctgctgtcagcccttggaacctataggtaccatatgggccgcggaactgctgagggacgaaaagcagcgaacagaatggacgccttgaggaggcgccgctcagccttgagtaattcataccgaagcccggccgaagtggagctagactctgctagcgaggcagcagcttacgatggggaagccccaccctgggaatga

SEQ ID NO: 10352 - RNA, 981 nt, unidentified
  source 1..981: mol_type = other RNA; note = synthetic construct
atgtgggcgcagaatccaggtcaacgcgatattgcttcgctgattggcatgacaaagggccagcttggagctattgtgcgcgacaaagagaggtatattagaagggacaccatcgacattaatgggaagctgagaaatctgaccgtgccaaccggcaagcttaggatggtacacgagcgcctcaaatttcagctgaacaaaataaagcaaccaccctacctttgttcccctaggaagggggtaggacagcgggacaacgctgagatgcatgtggccggccaccagctgctgaagctggatattcggcagttctaccccaaaacgatgcaggaggatatttggcggtgggcccattactctttgggcataatggacgatgtggcaggcctatttgcaaaattagccgctatcgacgggagaatgccctttggtagtcccatcagccctgtgctcacctccctggttcacaggggaatgttcgacaaggtctacgcaatctgcggaagccatggcctgaagatgagtttgtgggttgacgatttaacgatcagcggagcagaagttcctggaggggccgtgactgatatccgtcaggccatccgagcaggcggcttccaaacacacaagattgaatatctgatgactgcacgccccaccgaaataactggagtgccgatcgccaaagggagagtcctggccccgcatgctatccaccgccgaattaaggagggctatgaagccctcaaggtcgccgcgagcgatacagaacggtctaacatcatcgataaactcttgtcagcactagggagttacagatatcacttgggttcctcaactccagagggtcggcttgccgctgatcgaatgcaatcactccgtcagaggagagctaaaatgaccatcgtcgcggagactcctcagacactctcctctatacaggccgtgaccttcggggctcctgacacactgccatgggactga

SEQ ID NO: 10353 - RNA, 1026 nt, unidentified
  source 1..1026: mol_type = other RNA; note = synthetic construct
atgaagcggccgagggatagaagatatgagcgctttgggttggacgcgtccctttgggcacaggaccccacacagcaggacgtggcacggctcctcggcatgactaaagaccagctcgaagccatcgtgcgggacaaggaacgttacacgtcccgccgaaccctggaaataaacggcaaactaagaaatttagccatccctacaggcagactgaggcggatccacgagaggttgaagttccagctgaacaaaatcaagcagccaccttatttatgcagccctaggaaaggcatagggcaacgcgataatgcggagcgccacgttgatggtgcccagctccttaaaatagacattagacaattctaccccagaactatgcaagaagatatttggagatgggcccaccatacaatgggcattcgtgacgacgtagccggactgatggcgaagctggtggccattgacggtcggatgccattcggatctcccgtgagccctgtactgacgacacttgtccaccgacccatgttcgatagaatctacgaggtgtgtggggtgcgcgctttagccatgagcctgtgggtggatgatctcactctgtctggaactgagatcaccgctaacaccattgtcgctgtcaggcagatcatcagggatggcggttttcagacccataaaatcgaacatttggccactgcacggccagttgacatcaccggagtgcccattgcagccggaagggttttggcccctctggcacttcaccgtcgaattcaggagggttttacagctctcagagctgccacaaccgatgcggaccgagcatcaataattgacaagctgctgagtgccctcggcacctaccggtatcatctggggacttccactctggaagggcgcagggccgctgataggatgcacgctctaaagcaacggcgagctcgcatggcaatcaccgctgtgaccgtcccggcaacaacgaccgtccatgaggctaagtcaagtgccgccctgccatgggagtga

SEQ ID NO: 10354 - RNA, 1152 nt, unidentified
  source 1..1152: mol_type = other RNA; note = synthetic construct
gataggaagagagctgatctcagaccgaggcgcccctctagatctagaagcaggcgcgcagcagatcatcacgtgtgtggcgccggactgtccgcagtacctaagaatcgactgcgacagcgggctgcaaaaaggccccgctatgaacgctacgaactggccgactccccttggacaaagaaactgactcagcgggatcttgccgtcctactcgggaccaccaaggaccggcttgaagccttggtgagggatcacgaaaactacgtccatcgacgcgatgaaaatatcaagggcaaactcagaaagctggctatcccaaggggcaaattacgagcagtgcacgagcggctgaagggtcaccttaacaaaattaagcaacctccctacctgtattcgccccgtaaaggacgcggacagcgggacaacgcctttttacatgcgagtagcgcacaggttctgaaagtggacattagccaattctacccgcagaccacagtcgaggacatctggcgttgggctcactatacggtagggatgcgcgaggacgttgccgggttgttcgctaagctcgtcgccatcgatcggaagatgcccttcgggtcaccaattagcccagtgttaacctccctgatccaccggccaatgtttgacagagtgtaccagctggtccgtgaggcgggatttgagatgtctctctatgtggacgatctaaccatatccggacagggaattactggtgagtttcttgctgccgtacgcagcgagatcagaagcggggggttcaacacgcacaaaattgaattcctggaagccgcccgccccgtcgttattactggtgtgcctatagccggcaaacgggtgttggcccctacagctctccatcaaaggctgagacgaagttacgcggacttgaagtcagctaggtccgataaggaaagagcagaggtgattgaccagatcctgatcgccctgggcacttatcgtcattttgtcggcgcaagtagtgacgagggccggaaggcggccaatagaatgcacgctctcaaacagaggaggcgaaatctgtctatagagcttgtgaccatgccgacagttgatttcgtgccaacagctactttgtcacccgctgcaccaggcgttccttgggcctga

SEQ ID NO: 10355 - RNA, 1065 nt, unidentified
  source 1..1065: mol_type = other RNA; note = synthetic construct
atggcaaagccaaccgataagaccataagcgaacgctatgccttcagtgaatcaccgctcgttgggctctccacccagagaaaactggcacaactgctgggctccagtaaatcgaggctgcacaaattggtggctgctgtggaatccgatccctctaactgctacaaaatcgaggatagacaggtgggagagaaactacgcaccttttctgtacccgtggggcagatgcgtaagattcatgagcgcatgaagattctgctgggaaggatctctctgccagagtatgtcatgagcccccgtcgaggtaaaaccatcgccactaatgccacagctcaccggcacgccgcggagttactgaaggtggatgtgaagtcctactatccgtccacgacagacgagctggtgttccgcctgttccatcatagatttgggatacctggcgatattgcaggcctgttaaccaagttattgactgtcaacggcagagtgcctattggaagccctgcatctccaattcttgctttctgggcttcaaaacccgcctttgacaaaatcgccagtgccgtccaatcacggggcctcaagcctactctgtgggtagacgaccttagcatttcaggccgccacgttccacgtgagatcgccgacgtcgtctcgtacgaactaggaaagctcgggtacatgggacacaaggtgaaatttcagtcccgacggcgaggcttttctatcacaggagttaggatcgacagcaggggacccggccccacaaatgctatcaacctcaagataagagatggcctgcggcggcttgagcgcaagagtaatacggacgaagaaacttcaaaattgctagctcagcttattggtttgaacgggcaccggctcggtacaatggctaaagatcacccagccgcacctagggcgaggaagctgcagcaacatttgcaccagagacggaggcgacatctcatgaccatgcaggagactctgtctagctccggtcaggcagacagcaaggggcttagcgcctctgccgcaagcagagccttcaggagtgcgtcctga

SEQ ID NO: 10356 - RNA, 918 nt, unidentified
  source 1..918: mol_type = other RNA; note = synthetic construct
atggccgagacaaacaccctgcctcttagccagtccgcactctacaaagtgcagagccgggcccgcctcgccaaaactttgcttatttccccccggcatttaaaatttctcgctcgcggcacccagtataagctgacatcgattctggacaagaatgtaaagccgagaatgctgcaagtgcctcagggcgatctgcggaaagtgcacgatagagtaaggtatctcttcgcccagctgaaggcgccagagtaccttcacagcggagtgaaaggtagaagtcccgtcacgaacgccaaaaagcaccgtagcggggccgctggaatgagggtggacgttcgaaagttttttccatcttgcagcaggctgagcctcgctaagttcttccatcatgacatgggtatggcaggagatgttgcgcatcagctatcactgttgtgtacatgcgatggcgcacttccaaccggcagtcccttgtccatgtcactcgctttttggatgcaccgacgagtgttcgaccggatagagcgtatggccagagagcgcggctacgtgttcactttattcgtcgacgatgcaaatttttccgccgatctaagtatccccagagaatttgaactggccgtcagatcagagctcaggcgagtccggttacgggctcaccctcgcaaaacgtctcgggttgcgcccggtacagctaggcaaattactggcgtgatcttgcctaattcagacgagatcagggtgccgaacgcacagagactgaagttcctgcgcgggctggaaaccataaagcagaattctgcacttaaagccgaaagggttaactccctgagaggactgctagcctggatgcgccaaatcgaaccaaccatcttccctcgtgctgggggggagttgactaggctgaactctaagtga

SEQ ID NO: 10357 - RNA, 1029 nt, unidentified
  source 1..1029: mol_type = other RNA; note = synthetic construct
atgccaatgaaaaatccttcacaccggcgtgaaaaggccttcgggcgtgccaggctgcgcaagaacaagtcggcccgatatcccattgaacgctcacccttctggcggctgtcctccatccatcagttggcagcattgctggacgtccctgtggaagacctggaggccacatgcatggccccgagctacaatcgctttgacgaccagccaaaacctggcaaggaggctcggcacatccaggagcccactgaggcaaccctaaaaatccattatcgcatcgcacggcacctagatagtatccagaggcccgattttctgcacagcgccaccaagtgcaggagccatgttactaacgccagagcccatttggcgtcaggaggcgcagtcgtggccatggacattcggaaattcttcgaatccacaacataccaccacgtcaaggcttttttttacaaggacctgggctgttcccatgatgtggcgaggctgttagccacggtgtgtaccgctgatggacacctgccaaccggcagctgcatatctcccctgctgagttatttcacccatcgacagttatttgcagaaattgagaaactttgtgtggtcacgaatgtgattatgaccctctatgtggacgacctgactctgagcggtatccacgccacaaaatccatgctttaccggataaaagcactcattgtacgccatgggctgcagactaaaagtacaaaggatgccgttttaagaccgggtaagtctgctatcatcaccggcgctatccgggcgggagatcaactccgactcagaaacaagcaccacggggcaatagttgaaattcaagaccagatgtcacttggccgcactccacctcttgaccagctccgaggcagaatagcttctgccagggcggtcgatcctcaagctgctgctaggctggaggccagactcgagaggattgtgagacgtggtcagctcgctaacggagagggagatttgtctgggattgtaagaaaaaagccagggatctga

SEQ ID NO: 10358 - RNA, 1002 nt, unidentified
  source 1..1002: mol_type = other RNA; note = synthetic construct
atgaaaaaccctctccataagagagagaaggccctaggccgggcacgacttaggcggaatcaatcagcccgctacccaatagagcgtagtcccttttggaggctctcgagcatccaccagctggccatgttactggacgttccagtccaggagataaaggctacgtgtatggagccgtcctacaacagattcgatgatcatcctaaacccggcaaggaggctcgccatattcaggaacccactgataggactttgaagattcactatcgcatcgcccgatatctggacagcattgaaagaccggaatttctgcactctgccaccaagaagcggtcccacgtgacaaatgctcgcgcacatcttccttccggtggggccgtcgtggcaatggacatcaggaaattctttgagagcaccacttaccaccatgtcaaggcattttttcaccgcgacttgggatgctcacacgatgtcgcgagattgctcgccaacgtgtgtaccgccgacgggcatctaccaaccggaagttgcatctctccattactgtcctatttcactcaccggctgatgttcgctcaaattgaacggctgtgcgttggtaaaggggttgtgatgaccttgtacgtagacgaccttacactgagtggcatgcatgccacgaaaagcatgctgtatcagattaagaacctcattgtgagacacggactgcagacaaaggccacaaaagacgctgtagtgaggcccggcaagagcgctattatcacaggggtgatgagggctggagagcagcttaggctccgtaataaacaccacggagccatcgtcgcgatccaggatcagatagccgctggcgaaaccgaatcattccatcagctgagaggtcggatcgcagccgccagagcagtggatcctcaagcagcgacacgcctggaggcgcgaatgaaacgtctcgcacacgccacttctggggatgtggctaccggcgaggacgctcgatcttga

SEQ ID NO: 10359 - RNA, 990 nt, unidentified
  source 1..990: mol_type = other RNA; note = synthetic construct
atgaaaaatcccagtgaccggcgtgacaaagcagctggacgggctaggctacgaaagaacgagactggacgctaccctgtcgaacgctctcctctgtggcgactctcatctatccacagattggccgttcttctcggggtgcctgtgcaggaacttgaggcggcctgtatggcgcctagctaccatcggttcgttgatccaccaaagaaaacgggcaaagaggcaaggcacatacaggagccaaccggcgccacactcggaattcactatcggatcctgcgccacctggattcgatccagaggccagactttctccatagtgcgaccaaaaatagaagccacgttacaaatgcgcggtcccatttagccagcggtggagctgtccttgggatggacatccgcagattctttgaatcaaccacatatcaccatgttaagaccttcttccacaaggacctggggtgctcacatgatgtggcccgactgttagccacagtgtgcactgccgatggccacttgcccaccggttcctgtatctcccctctgctgtcctattttactcataggcgtctgtttgcagagattgagggcctgtgcgtcgagaaacgggtgataatgaccctgtacgtggacgaccttactttgagtggcgtgcacgcaaccaagagcatgctccatcagataaaagcattgatcgccagacagggactgagaacaaagccctctaaggatgctgtagtgcgcccgggtaagccggccattattacgggtgtcgtccgggatggggaccagctgaggctgagaaacagccatcacgatgccattgtacaaatccaggacttaattgctcacgggaacgccccaagcctccacgagcaactaagaggccgagtggcatctgcacgtgctgtggaacccactgctgctgctcgccttgaagccaggctcatcaggctgatgtccggcgaaaggcccgccgatagtaagtga

SEQ ID NO: 10360 - RNA, 987 nt, unidentified
  source 1..987: mol_type = other RNA; note = synthetic construct
atgaccagagacgcacataaacgcgataagtctgcggggagggcaaggctgagaaaaaacaagtctgccaggtatcctatagaatcctcccccttgtggtccctgtctagtatccaccagctggccgtcctcattggtatcccggtcgatgaactggaggtgacctgcacctctcccacctatcataggtttgatgaggccgcgaaggagggtaaggaaccccgccatatccaagagcctaccggcgcgacactccgagctcactaccgactggtgaggcacttggattccatccagcgtccagactttttacactcagccaccaagaaacggagtcatgtcactaacgcacgtgcacatgctgaaagcggcggcgctgtggttgccatggacatccggaagtttttcgaatcaacaacttaccagcacgtcaaacgtttcttccataaagatcttgggtgttcacatgacatcgctcggcttctggccaatatctgtaccgtggatggccacttgccaacaggttcctgcgtgagccctcttctgagctattttacacacagacatctcttcgcagacattgaacgccgctgtgtggagagaggggtcactatgacgctgtacgtagatgacctgacattgagcggccctcacgccactaaaagcctgctattcgccatcaaggctatgatcaaacgatgcggactcaggactaaagatgccaaggacgctgtggttagacccggaaaagctgccattattacgggagtggttcgctcggatggcggggtacggttacggaataagcaccacggagccattgtggctatacaagacagtatagctactaccggagacaataacgacgacgtgcttagaggccgactcgccgctgccagagcagttgagccaaatgcagcgacacggctagaggagcggctgaagcgcattattgggaaccagcagaggaacgcatcagccaagtga

SEQ ID NO: 10361 - RNA, 987 nt, unidentified
  source 1..987: mol_type = other RNA; note = synthetic construct
atgaaatctctgcaacatagagtagacaaggcagcgggacgtaagcgactgcggaaaaataagagtgctaggtatccaatcgagcagagtcccttttggggcctggctagcattcacacgctcgcttcccttctcggggttccggtcaaggacttggaagccgtgtgcctgagccccgcatacaacaggtttgatgaacccccaaaacccggcgccaaacctggcaaagaacctcggcatatccaggagccggttgacgctactctaaggatccactatcgcatcgtgaaacatctggattcaattcagaggcctgactttctccattccgcgacaaagcagagatcacacgtgacgaatgctcgcgctcatgtagatgccgggggagcggttgtggccatggacatcagaaagttctacgaatccaccacataccatcacgtcaaggcgttctttcatagagacttaggatgcgccctagacgtggcacgcctcttggccactgtgtgtactgccgatggccacttaccaacaggtagctgtatttctcctcttttgagctatttcgcacaccgcaagatgttcgccgctgtggaggccctgtgcgtcgagaagcaggtcaccatgacattgtacgtggatgaccttacactctctggcgcccacgccaccaagactatgctgtatcaggtcaaggcacttatcaagcagcagggtcttagaacccaacctaccaaggatgccgtggtgcgaccagggaaagctgctatcataaccggcgccgtgcgtgatgggcaacagattcggctgcgcaataaacaccacaactcgattgtcactctgcaggataggatagcttccggagacgacgtttcattcaaccaactgaggggtcgagtcgcagccgctcagagtgttgagcccgtggcagccgcaagactcgtagcacggctggatcggatactgtctaacgacaaagcggcctga

SEQ ID NO: 10362 - RNA, 996 nt, unidentified
  source 1..996: mol_type = other RNA; note = synthetic construct
atgtcaaacgctacaaacaataagcaccgtcgccagcgcctggcactgaagagggagaaccgacggtccccaagtgaaaagtacccgcttgagagatccccggtcttcgagctaggaggtcccagggagcttgctacattgatgcagctgtccatcgagcagataagggcgatcgctgccaacccagagtatcacttttttgacgaagagcctaaacgcgaaggcaaggcagcgcgtcatatccaagaccctcggggcgacacgcagacgctgcattacagatttgccaaattcctcaataggattgaacgccccgcatttttacacagcgccacacgagggcggagccatatttctaatgccgcagtccatagaggcacttatcctgtggtgtgcgccgatatcgaaaaattctacgaaaacaccacccgggcccacgttaaaggattcctgttccgcgagctgcactggccaatggacctggcagctctcatggcggatgctttgaccgttaacggacacctccccactggctctgctgtttcccctatactctcatatttcactcaccggaggatgttcgcggagatcgaagccatgtgcattgcaaccgggtgtaccctgaccctctttgtggatgatataactgtctcgggtgcccgggctagtatgtcacttttgagacagatcaagcaaatcctgctggggcgaggcctacgagctaaggcaaataaagacaagagtgccccaacagggagcgccgtggtcattaccggagccgtacggcaaggggataggctgcgcattaggaatgagcataggaagggtatcgtggaattgcttgccagatacgaggccggcgagggtgctgttgaggaacagctcgtgagcaaaattgctgcagcaagatgtgtggacagcgccggagccgtgcccttagaaagaagatttacacagctgcgttctgtagctcgctcatccgcctctggcgtgtga

SEQ ID NO: 10363 - RNA, 978 nt, unidentified
  source 1..978: mol_type = other RNA; note = synthetic construct
atgaataaaaagcgatcagcgttaaagaggagactgcgagcaaatcagtcatgccgttacgagctgtctagatgtgccctgtacggcgttaggcagttgagcgtgcttacagaccttctgcagaccactaacaaggccttaaggcagtccgcacaagcccccgaatttgccacctgggtggatcgatcccgcccagagaaacccagagacatacaagatcctcgggggacaaccgaacggctacactaccggatttgcgagctgctggatcgcgtgattcgtcctgagttcttacacagtgccacccgcaagagatcatccatcactaatgctagccaacacgttagccacggaccgtgtgttacaacagacatgaaatcgttttatgaagctacttctaccaaacaggttgaggagttcttctcagatagtctgaacatggcccctaacctcgcacgcaagctcgcaaatctctgcacaacggatggacatctccctaccggatctcccctctcccccctgttgagctattgggctcatcaccagacctttgataagatccacgagcttgtagtcgagcgcggggtggtgatgaccgtctacgtcgacgacatggccttttctggcgcccatgctagtctggctcttttgaggcaggtgaaacataagctgcgcctccggggcctggaaacgcacaaagataaaagcttcggcagaggacagtttaaacacatcactggggcagctgtgaatgggagaggaatccatgtaccaaacaggaggctgaaacaaattgtcgacgaccagggcgtcctagccaagggtgaattcgacgcagaaactgtggcttccctccggattaagttgtccgggcgtatcgccagtgccagcgcaatatctcggaagactgcggcgtggctgaagaggcgggacgtgtataacccaaagggtagacgaggcgccatcacagctggttga

SEQ ID NO: 10364 - RNA, 963 nt, unidentified
  source 1..963: mol_type = other RNA; note = synthetic construct
atgaataagcgcagactggcactgaagaagagactgcgagcaaacaagcaggctaggtactcgctggagggctgcgcccttttcggcgtcaccgaaatgagcgttctcagcagactcctgcaggcagataataaaagtctccggctcacctgtaaagctccagagttcgccgtgtgggtcgataccactaaacctttaaagcctcgtaatatacaagacccgagaggtattacagagaggcttcactatcgcttatgcgaactgctagacagagtggtgaaaccagatttcttgcactctgcaacgaggaaacgcagcgctatcactaacgccgcacggcacatctcaaaggctccttgcgtgaccactgacatgaaatctttttatgaggtgacaaccacgcagcaggtcgcggcgtttttccgggaggacctccacatggcacccgatctggcactgaagctggcacagctgtgtaccgttaacgggcacctccccacaggcagtcccctatcacccttgctggcttactgggcccatcggcggacattcgggcagctgtatgagatgtcttggtcagcgggcattgtcatgactgtgtacgtcgacgatctggcctttagcggtgaacacgcttccctggcctttctccatattgtgaagcagatccttcggcgcagaggacttcatactcataaagacaaaagttttggggctggacaattcaaacatatcacaggggccgctgtgagctcaaagggattgcacgtgcctaatggtcgcctgaagaggatagttgacggcattgatgaattaaccgtagtatccgacccagcccagcaggccgatttgcgaaggcgtcttgtgggacgcattgcctccgcttccgcgatctctaggcaaatcggcaacgccttgaagcgacgtcacatccaaagcgccgaatccgccgttacagactga

SEQ ID NO: 10365 - RNA, 939 nt, unidentified
  source 1..939: mol_type = other RNA; note = synthetic construct
atgaatactccccgtgatccttacgccctcgaaagctctcctttctttcgattgacttccatccacgagttagcgaagctcctccgccttactgtaggccagctgcggcaagagtgtctgcaccctgccttcgcgcccatgagagtggtgagaaaaccgggtccacggagtaaaacaaggaatgtcagcccacctctgaaaaccacgctgctgctgcaccagaggttgctgcggttctttgatcgagtcaggcgccctccctaccttcattcagcaacacggagaaggtcacacgtaactaacgcagccgctcacagcgggcagaggcatctcgtcaaagcggatatccggaagttttacgagagcaccacatattcacatgtcgtggccttcttccaccatgagttgcagatggccggtgatctggcacgattattagcacggctttgcacccgcgaggggagattggcgatgggatccccactatccccgctgctcagcttttgggtgcacaagaagatgttcgaccgcctggacgccctgagtagacagcacaggcttcgctttaccgcttatttcgacgacttgactatttcaggcaaccgcataaccgagagctttttccagacaatccggaggagtgttgctattcaagggctggaactcaaagaacagcgtgcctccgttgtgagggtgagagccggagttgaagtcaccggggcttggttgtctagaggcgcactctttgtgccacagcccgcctatctgctcgcacgccaagcaatcgctgccgtgagttctgctgaggccgacgagctagctacggccatccggacagcagaaggccatgtgtctgcttcctcggctatacgaagaggagccggcaaggccctgaaccgtcttatggctagggccattcatgcaaagaagcccctgtga

SEQ ID NO: 10366 - RNA, 1026 nt, unidentified
  source 1..1026: mol_type = other RNA; note = synthetic construct
atgataggccactcccagataatgattctgagtaaaacccgcgccgatgaggatatcaagatatcgaagctatactttgttggcacgaagaagcgtcttgccaccgtgctgaaatctaacccttctgtcctgcgtcgccttgcaaagacaggcgacgccaattatcagcatatttttgtgaccagcaggggcaaaaaacgagccgttcagaatccaaatcctgagctgaaagagatccaagtacggattaatcagcttctgcagcgaatcaattacccggaatacatgatggctgggctgaaaggtctgtcttacgagaaaaatgctagtgcgcatcttgggttagagtccacaagggtgtgcactgtggatatcgaaaagttttatcccaactgccaacggggagcagtcattcggtctttggaaaagtggtttaaccagaagcacgacgttgccgtgcagctcgctgatctggtctgtttgaacggtcaccttccaaccggtgggccagcctccttactgttctcattctggtcaaatagggatgtattcgacgaaatcaagctggcggccgacgcgcacggactgaaaatgacagtgtacgtggacgacatgacattctcaggggaaaacgctggcctcaagttcctgcatgattgtgtcctccccgtcctcaagcgcgcaggactcagaggtcataagatcaagagctatcacaaaagttgccctcaagagatcactggcattattctgaacaagggaaagctgtgtctgccatataggaggtttaaagacatcgacaagaatattctagctttgaacgccgcaagaaagcccgttgcaagactcaagttgatcaacagcctggtgagcagattatactcagtgtccgccttctttcccaaatgcaaaaccaaggccaaagctatgggcaaaaagcagaaagcattgctaagcaagttcccttatctcaaacttagacaccggttcgggaaacaggctgcctccctcaagactggacgctga

SEQ ID NO: 10367 - RNA, 942 nt, unidentified
  source 1..942: mol_type = other RNA; note = synthetic construct
atgcctaagacacagcccgaggaaggttatcagctgaaagattccccctttttcaggctgcggagtcgcaagcagcttgcaaagctgctgagggtgtcagctgacacactggatgaaatttcccacaggcacgatttgtatgtgagacgatggaaacataaaaaacttaaggacgatgagaagggagcttggctcaaacaccccccaactccagagcaggctgagaattacagacctattgacattcctgacccacaactcaaggccatgcaggggagaatcggagatctgttaggcagagtgaaggcgcccgaattccttttctccccggtcaagggcaggagctacgttgagaatgccgcacaccacaaggaggccaaggcgttttggctgctggacgtggctgattattttccaagctgcagcgccaataacgttgcccggttcttccaccgggaactagaatgctctcgcgatgtaacggccgtgctggtccatgtggctactttgggcggatgtttaccgcaagggtcgccctgttcccctatacttgcctactatagtaatagccatatctggttggccgtcgaaaaactcgtgcgcgccaaaggttgcaaactcagcctgtacgcagacgacataacaatatcaggggatgttgtccctaaggccttgatctgggagatcaaaaagttaatctttggcaacgggctacggctcaagacctcaaaagaagtatctcttattaacgctccagctgacatcaccggagtgattgtcaaggacggtgcaactcatctgcccaatcgccagctcaagaggctggcagagctcaagcaggagagagcaaacaccacaaacccaaagctgcagcagcgtatcgacaatcaaattgccggccgactgtctcaacgtaaacaggtggagaaccctaaaacctga

SEQ ID NO: 10368 - RNA, 942 nt, unidentified
  source 1..942: mol_type = other RNA; note = synthetic construct
atgcctaagaaacagtccgatggcgggtatcacctgaaggacagccccttctttcgcctgagatccaggaaacagctggctgaactgcttcgcgtatctgcaaacacacttgacgaaataagtcacaggtcagacctctatgtgcgtcggtggaaacacaaaaagttgaaggaccacgagcgaggagcgtggctgaagcaaccgccacccccagaaaaagcagagtcctacagaccgattgatatccccgatgtgcagctgaaagccatgcagaaacgcattggagacttactgggcagggttaaggccccagaattcttgttttcacctgtgaaggggcgttcgtacgtggagaacgctgcccatcacaaggaatctaaggccttctggctgctagacgtggctgattatttcccttcctgctctgccaacaatgtggctcatttttttcatagagtcttggaatgctcaagagatgttaccgcagtactcgtccacctcgtcacactaaatgagtgtttgccccaggggagcccctgtagccctatactggcctattactctaacagtcatgtctggctggccgtggaagagctcgttaaagcgcgggactgcaagctgagcttatacgcagatgacataacaatctccggcgatgttgtgcctaaagctctgatctgggatattaagaagctcattttcggcaatgggcttcgattgaaagatagcaaggaggtaagccttatcaatgcaccagccgacatcactggtgtgattgtcaaagagggcggtacccatctgcccaacaggcaactcaagatgatcgccgagttaaagcagcttcgggctcggactacgaacccaaaactgaggggacggctcgacgagcaaatctcaggacgcctgagtcagagaaagcaggtggagaatcctaagacctga

SEQ ID NO: 10369 - RNA, 930 nt, unidentified
  source 1..930: mol_type = other RNA; note = synthetic construct
atgagaaaaacgcagttgaaggacgggtaccagttgagggactcccccttttttaggctggcaaatcggaagaaattatccacactgcttagggtgagcgaggaaacactgaaggcgctctcaaccagccaggatctctacacaaggcgatggaaacacaagacgaaaaaggacaaagaggtggacgcctggaaaaattatatccctgagaacgcagacgaatacaggccaatagacattccgattcctaaactgaaagccacccaaaatcgaatctctgatcttctgtcccgggtccaggctcccgacttcctattctcaccggtgaaaggaagatcgtacgtagagaatgcgagccatcatgttgagggaactgctttttggtctttagatgtggccgactactttccaaactgtaaggctaacaacgtagcccgcttcttccgccgtgatctggaatgcagccgggacgtcaccgccattctcgtggctctaaccactttgaacaaatgtttaccacaggggagtccttcaagccccattctcgcatattatggcaattcccatatgtggctgaaggtcgcagatctggttgcaagttactcctgcaagttcagtctctatgccgatgacattaccatctctggacctatcatcaagaaggagcttatatggaagattaagaagataatccacgccaacggttttcttctgaagccctctaaggaaatcagtctgatccacgcccccgctgatatcacaggggttatagtcaagcagggtaaaactcacctccctaatagacagctgaaaagattggccgagctgaagaaagaaagagcccacactaagaatccagctagccaggcggtgctggataaccagatttcaggccggctaggccaacgtcgccaagtggagcgcgtgtga

SEQ ID NO: 10370 - RNA, 927 nt, unidentified
  source 1..927: mol_type = other RNA; note = synthetic construct
atgccactgaagctcggctatcggctcgtggacagtccgttctataagttgaagtctaggtccaagttagctagactgcttagggtatcaaccgagacacttgatcaattgtcttccggacgcatgctgtacgcgcgaagatggaaacataaaaaactagagaagtggctgtgccagcctccttcagaagacgcagcagacatctaccggcccatcgatatcccggatccatgtttaaaggctgtccagtctagaatcgcttcgctgctctccaggatccaccccccagactttctcttcagccccgtaaaaggtagatcctatgtggagaatgcagcccgtcacgttggttcagaggcattttggttgctcgacattgccgactacttcccaagttgcgccgccaataaagttgctaggttcttccgcagcgatctggactgtagccccgatgttagcgccgtgctggtccggttgaccacccataatgagtgtcttcctcagggcagtccttgctctcccatactcgcctactattgtaatcggccaatgtggctggccattgaaaagattgtgactgatgctgggtgcaagctgtcgctgtacgccgacgacattacaatctccggcgatgtggtgagaaagagcatgatatgggaggtcaaaaagatcgtgcacggaaacgggttaaggctgaaagcgtccaaagaagtgagtttgatcaagtcagcagctgatattaccggagtgatcgtcaaacctgacgggactcatctgccaaaccgccaatttaagaagctagccgagcttaaggccctgcactctacaacggtcaaccctaaagataaagcgcgcattgaaaaccagataagcggccgtattgctcagtggcgacaggttgaaagctttcggatagcacccgactga

SEQ ID NO: 10371 - RNA, 936 nt, unidentified
  source 1..936: mol_type = other RNA; note = synthetic construct
atgcagaagacccctccccggcaagcctatcagatcaaagattccccattttacaagctctctagcagacgcaaattggcctcactgttgcgcacttctagcgatacgctagccgagctggctagtggaaaacctatgtatgtgagacgctggaagcataaaaagttggaccagtggttacgggaagcccccagtaccacggacgcagacgtatacaggcccattgatatcccggacccccgccttaaggcagtgcagtcccgtatagccgcacttctcgctcgaatcgagcccccagacttcctttttagtccagtgaaggggcgtagctacgtggaaaatgccgcaagacacgtgggttcaaaagctttttggctcctcgacgtggcagactattttcctagctgcacagcgaacaatgtggcccggttcttccaccgagatctgctctgttccgaggatgtcacagccgtcctcgtgaaactggttactctgagagaatgtctgcctcaaggatcgccctgctcacctattctggcttactattgcaacaggccaatgtggctggcgatcgagagctgcgtcaaagctagtgggtgtaagttgagcctgtacgcagacgatatcactatatccggcgacgtggttcggaaagagatgatctgggagattaaaaagatcgtccatggatctgggatgaggctgaaagcgtccaaggaagtctcactgatctctgccccggctgatattaccggtgttatagtgaagccaacaggcactcacctgccaaaccggcagctgaagaagctagccgaacttaggaagttacataccttaacaaccaatgctaaagataaggcccgaattgagaaccagatttccggccgcgtagctcaaaggagacaggttgaatctttccagcctagcaatgagtga

SEQ ID NO: 10372 - RNA, 936 nt, unidentified
  source 1..936: mol_type = other RNA; note = synthetic construct
atgcccttacgtcacagcgcaaccccatacacacttagagactcccccttcttcaggctccgcacccggaaaaaactggccaccttactgcgagtgagcgaagcagcactggctgatatatcagccagaaatgacctatacgtgaggtgttggaaacacaaaaaagacaaggacatatggctccgagagcagccagctcccgatatagccgctcattataggcctatcgacattccggatagtgggctgaaagccgtgcagagtcggatcgctggtttgctgagccgcattacaccgccagattggttgtttagccccgttaagggacggtcttacgtcgacaatgcggcatcccataagggggctcgggcctactggctcctggatattgcggattactttccttcatgctccgccaataacgtggcccatttctttaaccgcaaactggagtgctcccctgacgtgactgcaatccttgttcacctgacgacttggcaacagtgcctcccacaggggtcgccatgttcacctatcctcgcatatttttctaatctggatctgtggcaggaaattgagcagtcagtgatgcaagccggccttaagcatagtgtctatgctgacgatatcacaatctctggccaaatgattcgtaaagagctcatttgggaagtcaagcagagcgtacacaaacacggcatgaaaatcaaggcggacaaggagctttccttgattgatagccctgccgacataaccggagtaatcgtggttggtgatcgaactaagttgcccaaccggcagttaaagagactgttcgaactaagagccgagaggcaccgcgctagagacgcaatcaagaagcgcctgctggacaaccagatctctggaagggtggcccagaagaggcaggtcgaacaagcctataacgctaagtga

SEQ ID NO: 10373 - RNA, 924 nt, unidentified
  source 1..924: mol_type = other RNA; note = synthetic construct
atgccgacaagacatcgggctgttccatataccctgcgagatagtccctttttccggctgcgccggagaaaagatttggccaaactattacatgtgagcgagacaaccttggctactatcgcctccaggaatgacctttacgaaagatgctggaaacacaaaaagctgaagaataattggctggatgacgagccatctgccgatattgcacatctctaccgcccaatagacatccccgatggcgggctgaaggcaatccaatctaggatcgctaacctgctgggtcggattacccctcccgactggctgttctctccagtgaaaggaaggagctacgttggaaacgcggcgtgtcaccgcggctcaaaggcattttggctgctggacatcgccgactatttcccttcatgtactgcaaacaatgtggctcacttttttcaaagaaagttggaatgttcccctgatgtgaccgctattctggtgcatctcacaacgttgcagcaatgcctaccgcaggggagtccttgcagccctgtgcttgcctacttctccaaccttgacatgtggcgcgaaatcgagcagagtgttagcaaggcggctctcaaacactctatctatgccgacgacattaccatcagcgggccaattgtgcccaaaaaggtcatctgggagattaagcaggcaattcataagcacggcatgaagataaaagccgataaagagctgtcattaatagactcccccgccgaggtcactggagtaatagtggtcggagatcgtacaaagcttcccaaccgacagtttaagcgcctgttcgagttacgtggcgaaaggcaccgagagagatcgaagacgctcatgcggctcctcgatggccagatcgccggtagagtcgcccagaggaggcaggtagaacagttctga

SEQ ID NO: 10374 - RNA, 903 nt, unidentified
  source 1..903: mol_type = other RNA; note = synthetic construct
atgagctatgaattgagagactcccccttctttaggctaaagactagaaaaaagctggccgctacgctgaagattagcgaaatggccctgaacaccttaactgttaggactgatctctacgtccgaaaatggaagcacaagaaggaaaaggacaagtggctcgagacacctccaccacccggtgagtcacacctgtatagatccattgatataccagactctgacctgaaagccgttcagagccggatagctaaactgcttagtcgagtgacccctcccgactggctattttccccagttaaagggcgctcttacgtggataacgcagcacgccaccgtggatcaattgctttctggctcttggatattgcggactattttcccagttgcaccgctaacaatgtcgcccacttcttccggacacgcatggagtgttctcctgatgtgactgccatcctggtgcatgtcgccacatggcatcagtgtttacctcaggggagcccgtgctccccgatccttgcatacttttctaatctcggtctgtgggaagagatcgaatcggccgtcatcgaggcgggccttaagcatagcatttacgctgatgacattacgattagtggggccatcgtaaggaaaaaagtgatatgggaaattaagcgcagcatccataagcacggcttcaagatcaaggccgagaaagagctgtcacttatccataggcctgcagacataaccggagtgatcgtggctggagacgacacaaaactgcccaatcggcagctgaagagactctttgatctgcgggcagagcgtcacaaggcgaaaggcaaattgttgatctcacagatcgataacaagatttccggccacctcgcccaaaaaaggcaagtagagagaacctga

SEQ ID NO: 10375 - RNA, 942 nt, unidentified
  source 1..942: mol_type = other RNA; note = synthetic construct
atgctgccactccccaacgggagccagtatgccttaagagatactccttttttccggcttcggtcaagaaagaaactcgccgagattctcttggtcagtgacgcagccctgcagcgggtgctgaacgaggagaatttatatgagcgcagatggaagcacaagaaagaaaaggattcctggctcaacttcgaacctaaaccggaagtttctcatttctaccgtccaattgacatacccgataagggactcaagagcatccagagtcgcattgcgaagctgtttgctaaagtgacaccaccggattggttgttttccccagtgaaagggcgttcctacgtgaataatgcagcccgacatgtgggagcgagggctttctggctgcttgacatagctgactactttccttcgtgtactgataataatgtagcgcacctcttccatactcgccttgaatgctctcctgacgtcaccgctatcatagtcaagcttatcaccctgtgtggctgcttaccccaaggttctccatgcagccctatcatggcctattactccaaccacacaatgtggctgaagatctcagagattgtgacagactctggcctgacacatagcgtatacgcagacgacatcaccatcagtggcaacctgatcaaaaaggaagtgatctggaatattaaggccacggttcacaaacatggtctacggattaaagctgagaaagagctgtcaattattgattcacccgctgacataaccggcgttatcgtgaagggcggacgaaccatgttgcctaacagacagctaaagaggctgtttgagctcaggggagaacgccagagggcaaaggggagcctggccaaagcagccctggatagccagatcgccgggagattggcccaacagaggcaagtcgagcaccagtatcggcaccccccctcctga

SEQ ID NO: 10376 - RNA, 939 nt, unidentified
  source 1..939: mol_type = other RNA; note = synthetic construct
atgctgaaagaaacgactattaatacttactccttgcgggactcccccttctttaggcttaggtctaggaagaagctagcccagctcctgagagtcagccccaaaacactgtccgagatcagccaacgggaggacctctactccagatattggaaaagtaaaaaaggggacgtttggctgaagtctccccctgatgaggtagacgctgataaataccgacctatcgatattccggtccatcgcctcaagtcactgcaggctcgaatagccaagctgctgtcccgtattaccccaccagaatggctcttttccccggtgaagggaaggtcatacgttgataacgctgcttatcataagggagcaaaggcctattggcttttggacatcgagaacttcttccctagttgctcgggcaacaacgtggtgcatttttttagcagcaaactggagtgcagtcccgacgtcaccgccattttagtccacatcaccacaatcttggataccgacacagatcgcgtgggacttccacagggagccccctgtagtccaatcttggcgtatttctctaatctcgatatgtgggcagagattgaatcaattgtgaagcgcgcgagcctgaagcatggggtgtacgcagacgacataacaatctctggtggcatggtgcctaaagctgctatctgggaaatcaagaaggcaatacacaaacacggccacaagattaaagcagccaaagaagtgtctctgatccacgccccagccgatataactggcgttattgtggcagagggtaaaaccaagttacctaatcggcagtggaagaagctcaacgagcttagagccgcgcgttcagtcgctaagggcagcaaactaaaacagagactggacaatcagatcagcgggcggattgcccaaaagaatcaagtagaacagtcgtga

SEQ ID NO: 10377 - RNA, 933 nt, unidentified
  source 1..933: mol_type = other RNA; note = synthetic construct
atgcctcggaaagcctttccctttcacaagctcgaggctagcgcattgttcaatgtgaggacaaggaagaagctggcggacattctaatgtgcagccctgcccatctgaagtccgtggatgcaattgaaatccgatacaaaaagcgatggaaaccgaaagactctgacaccgccccttggttgaagcaaccccctccagctgagaaggctggcaactacagaccaatagacattcccgtggatccccttaaaaagttgcagaccagaatcgctaatctcctgtcacgcatagagcccccaagctacctgtgttcaccggtcaagggggtttcctatgtggacaatgccagaaggcacgtaaattcgaacgccttttggttattggatatcgccgattatttcccctcttgtacagctgaccgcgtggcatggttcttctctaccgttatgaagtgcgccccagatgttactgcggtgctcgtgtccctggtgaccgactctggaagactccctcagggtagtccttgcagcccgatcttagcctacttttcaaacaaaaagatgtgggacgacgtcgccgaagctgtggctagtgcggggtgtattctgtccgtctatgcagatgacattacactgtccggcactaccgtgccaggagcactcgtgtgggaggtaaaacaaatcatcgtgaaaaacggcttcaaactaaaacgggagaaggaagtcagtctggttgggagccccgccgatatcacgggcgttatcgtccgcaatggaacgcttaagctgccaaacaggcagctgaagaaacttgcagagactaagaaacttcacaaactggccactgataaggtcacattaataaagctcgaacatcaggtaaaaggtcggctggcacagcggcgtcagattgaagaggctctgaagccttga

SEQ ID NO: 10378 - RNA, 924 nt, unidentified
  source 1..924: mol_type = other RNA; note = synthetic construct
atgagacggaaggccttcgagttccacaatctcgaagccagcgcactgtttaatgtaagaactagaaagaggctggccgaggtgctgctatgtagccctgcccacctgaaggcagtgtgcgaaatagctattaggtacaaaaaacgctggaagccaaaagactccgatacagccccttggttaaaacagcccccccccgctgaacagacagcgaattatcgccccatcgacattccaattgacccactgaagaagcttcaggctaggatcgccaacctgctgagccgtattgagccgcctgaatttttgtgctcacccgttaagggtgtgagttacgtggacaacgctaagcggcatatcaacaacaacgctttctggctgctggatattgccgattattttccgtcttgttcctcgaatcgcgttgcatggttttttaatacggtcatgaaatgcgcgcctgatgtgaccgccgtacttgtctccctggtttccgagaatgactctcttcctcaaggctcaccttctagcccaatactcgcatacttcagtaataagaagatgtgggatgacgtggccctagccgtggcgaactcagggtgtactctgagtgtttatgccgacgatgtgaccttaagcggtaccacagtgcccggggctttggtctggcgagtcaagcagatcatcgtgaaaaacggcttcaaactaaaacgcgagaaagaagtgtcccttatcggctctccagcagacattaccggagtcatcgtaagagatggaaccctcaagctgccaaaccggcaactcaagaaaatcgctgagataaagaagctccatactaacgccacaaactcacggttggcaattaaactggagaatcagttgaaagggcgtctcgcacagcgaaggcagatcgaggaagcttga

SEQ ID NO: 10379 - RNA, 930 nt, unidentified
  source 1..930: mol_type = other RNA; note = synthetic construct
atgtcacaccgagccgttaaatctcatgacctgagagatagcgcattatttaatatcggcactcgtaagaagctcgctagcgtcctcctgtgcagcccagaccatctgaatctggtgcagaagctggaggtgaaatataagaaacggtggaagcccaaggattccgacactgctccctggcttacacagccacctgccccacacgaagctgactgtttccgccccattgatatccctgtggatcccctcaaaaaattgcagggcaggattgcagacctgctgtcgcgcgtaaaggcacctccgtatctgtgcagtcccgtgaggggtgtgagctatgttgacaacgcccgggctcacatcgaaggcagcgctttctggttattggatatcgccgattactttccctcctgtaccgcaaacagagtggcctggttttttaggaccgtaatgaagtgtgcccctgacgtgacggcaatcctcgtggccattgtaaccgacagtggacgactgcctcaaggctcaccatcctctccgatccttgcgtacttctccaacctgaaaatgtggggggaagtggctgcactcgtgcatcgcgccggctgtatactgtctgtctacgctgacgatattactatatctggaaaaaccgtccctggtgcccttgtctggaacgttaagcagactattgtgaaaaacggattcagactaaagagggagaaggaggtcagtttggtgtgctgtccagcggacattacaggggttatcgttcgcaatgggtccctgaagctaccaaatcgtcagttaaaaaaaatcgtcgagacgaagaagctgttgagggcatcaacagataaaatgacagccgataagctcaaaacccaaattgcggggcggcttgcccagcggagacagatagagtgcgctagttgctga

SEQ ID NO: 10380 - RNA, 927 nt, unidentified
  source 1..927: mol_type = other RNA; note = synthetic construct
atgcccaggaaaagttttcggttccataagatcgaggactccgccttgttcaacgtctccacccgcaaaaagctcgctaacgtcctcatgtgctctcttcctctgttaaaggcagtagaaggcctcgatgtgcggtacaagaagcgctggaagagaaaggactcagatacagccccttggttgactcaaccccctccaccagatcaggccactcaataccgacccatcgacattccagttgatcaactgaaaaagttacaggcacgcattgctgacctgctctcacgcatcgagacgccccctttcctctgcagtccggtcaaaggcgttagctatgttgataacgcgggtcggcatgtgaacaatcgtgccttttggctgctggacatagctgactatttcccttcttgctctgccgacagagtggcgtggttttttggcactataatgaaatgtgctccagatgttaccgctgtgctggtcagtctcacaactgatatgaatagactaccacagggaagcccttgtagccccatcctagcatactattccaatatgaaaatgtggcacgacgtggccaccttggtggcaggtgcagggtgtattctgagcgtatacgctgatgacattacaatcagcggaaaaacagtgccgggctctttaatttggcaggtcaagcaggtgatctttaggaacggcttcaagcttaaacacgagaaagagctgtcccttatggcttcacccgccgatatcaccggagtgatcgtgcgagacgggaagttgaaactgccaaataggcagcacaaaaagatcgtagacctgtccaagcagcaaaagatcgccacggataccaagcttctggccaaaattgaatcgcagattcgtgggcggctggcccagaggagacagatagaagaggcaatatga

SEQ ID NO: 10381 - RNA, 927 nt, unidentified
  source 1..927: mol_type = other RNA; note = synthetic construct
atgcctccaaagccgaggcaatttcataaactgaatgattcagccctgtaccaggtgtctaccaggaagaaactagccgaggtcctgatgtgttcaccccaagacttaaaagatgtccttgctctgtctgtgcggtacaagaatcgctggaaaagaaaagattccgacaccgctccatggctcacccacccacctgcacctgacgaggcctccaattaccggcccatcgatatccctgttcctccactgaagaagctgcagggacgcattgcggacctgcttagtagagtggaaccccccgaattcttgtgttcaccggttaagggtgtctcctacgtggacaacgcccgacgccacattaactctcatgctttttggctgctcgacattgccgattattttccaaattgtcgtgccgatagggtcgcatggttcttcaggacgaagatgaagtgcgccccagatgtgaccactattttagttgcgctaactacagataaggacaggctgccccaaggtagcccttgcagccccattctcgcttatttctccaacatgcgcatgtggcgggatattagcactctggtaacaaatgctggctgcgtactgagcgtttatgcagacgatatcaccatcagcggctcgaaagtgccgggggggttggtgtggcagattaaacagacgatacacaagaacgggtttaaactcaagagagacaaggagcttagtctgatcgcctctcccgcagatataacaggagtgatcgtgcagaatggccagctcaaactgcctaacagacagcggaaaaagcttgtggagttggtcagtcagcaaaaagcaacatcagacaagaagttgttagccaaactcgacaaccagatccagggaagaatcgctcagcgacgtcagatagaatccgtagactga

SEQ ID NO: 10382 - RNA, 930 nt, unidentified
  source 1..930: mol_type = other RNA; note = synthetic construct
atgccgccaaaacagcagcgtcacttctataaactccaggattcagccctatacaatgtgaccactaagaaaagactcgcggaagttctgctctgcagtcccgacgatcttaagaatgtcctggcaaccaaggtcaggtacaaaaatcgctggaagcccaaggattccgacactgctccctggcttacccagccaccaccccctgaagaggccgcaaattatcggcccattgatataccgatcccttccttaaaacgcctgcaggcccgaatcgcatatctgttaagtcgcatagagcccccttccttcctgttttctccagtgaaggggttaagctacgtggataatgcacggagacacgtggggtcgagagcgttctggctgctcgacgtagccgattactttccaagctgtagggcggacagggtcgcctggttcttccgcacagagatgaagtgcgctcctgacgttgccgctattctggtagcattgacaacagacaaagaacggctgccgcaagggagcccttgttctcccatcctggcttatttttgtaatatggtgatgtggaacgacatcgcaaccactgtcgagaacgccggctgcgtgctgtccgtctacgctgacgacatcacgatttcaggtgccaacgtacctggccagctaatatggcaggtgaagaaaacaatccataaaaacggatttcgattgaaaagggagaaggagctctctcttctggataggccagctgatattaccggtgtgattgttagaaacggccaactcaagttgcctaatagacagcttaagaaactggtggagctcgttgaaaagcataaaagcgaaacgaagaagaaggaattggccaagctgtttaaccagatccaaggacgtcttgctcagcggaaacaagtggagaacgccaactga

SEQ ID NO: 10383 - RNA, 927 nt, unidentified
  source 1..927: mol_type = other RNA; note = synthetic construct
atgcgccctggccaccgcatagttgactccgcgctttacaaggtgcgaaccagacggaggctggcggaactgctctttacagaagtgggtttcctggagagcctagaaaaaaatcagcccaagtacgttgtgaaatataagcctaagtacgatgacaaggctccctggttagctatgccacctccgccggagctggccgataactacaggccaataagcctgccacctactgccctgaaaaggctgcaggcccgtttagccaagttgctggggatgatcacggtaccaccttatgtctttagctcagtgaagggcgtgtcatacgtggacaacgcagccgtgcatgttggcgcacgcgccttctggctattggatatcgaggcctttctgccctcctgcaccgccgagagacttacttggttcttccgagacaaactccagtgtagtcccgacgtcgcggccatcctcgtggagattgttacattcgatggctgccttccccagggatctccttgttcgcctatattatcctatttttgcaatgctcgcatgtggagcgatatctaccagctcgctggggagtatggatgtaccctgagtatctatgcagatgatattactctgtctggagccgtagtgcccaagaaacttgtgtggcgtatcaaagaagtcctgaagaataatggtttcaggacaagtagatcaaaagaggtcagcctggtgaacgcaccagctgacattacaggggtcattgtccgggacaacaagttgtttctcccaaaccggcagtttaagaaactcagggtagagttggcaaagagaagagacgcaaaaacctccatcgaaaaacgaaaaattgacaatcggattgctggccggaaggctcaagcccgccaaatcgaaaagcactctaagtctgggaggtga

SEQ ID NO: 10384 - RNA, 918 nt, unidentified
  source 1..918: mol_type = other RNA; note = synthetic construct
atgaaggtggcttcccttcgcggtaatgccctctttaggatctcaaaccgtagattgctggccgagcggcttctcctgaagccagaggccctggccgcagctctcaacctggacctgccctatgtgcgaaggtggaaatctaaaaaaggagacgaatggcgatccgaagaaccagacgcagacgaagcaagggctttccgtcctatcgatattccccatccccacttaaagcaggtgcagcgccgaatcgggcggctgttatcttccgctcgccctccggattggttgttttcacctgtcaagggacgaagctacgttgataacgccgcccgtcatcttggcagcacggcgttttgcatgttggatattgcagattacttcccaagttgtactacctctgcggtcgcagggatgttcctgaatgagctccattgccctcccgacgtggccagtatactaaccagtctggtaacaaaagacggctctctaccacaagggagcccgtgtagcccagtcgtggccttttattccaaagtgggaatgtggaatgagatcgcgcgcttggtggatgaacgggggttaatccactcagtgtacgctgacgatctgactatttccggccccgtgattcctggagaagctgtatggggtgtcaagaagattgtgcacaaacacggcatgagacttaggcgggacaaggaggtcggactgttctgccggcccgcagacattacaggcgttatagttaccaacggtggactcaggctgcctaatcgccagttcaaaagactggccgagctcagagcccagagacaggcttcgcgcgaaaaggagagggagatgatcgatcggaagatcgccggcaggatagctcagagaagacaggttgaggggcacgacggccaaagcgcaccatga

SEQ ID NO: 10385 - RNA, 951 nt, unidentified
  source 1..951: mol_type = other RNA; note = synthetic construct
atggctagctcaagcaacgctactgaaaatgcctcgtctctctttggctgccagagaaagagggacttcgctaagattctaggaattactaggggccggcttcgctggttggcgaaccaaaagaatgagtaccccgagggcaagaccgccaattccctgtacacaagactgtggaaacccaaacgtggggaaggcaagtggctgagggtcgaaccactccccgaggtggcaagcaactaccggcctatcgatgagctaaaggtcctgcagcgacaccttcacgacgacctgtctaatatcgaggttccggcatggcttttcgctcctgccctgggaaagagctacgtggacaacgccgccgcacattcaggctccagtcattttcatctgttggatctggaggcttatttcccgtcctgtcggagccaccgcgtgtatgatttctttaggagaaagctccactgttcttccgacgtagcggagttactgacacatgtgtccacgttaggtggatctcttccccagggtagccccagctctccaatcttagcctacctgagcaatgtggatgtgtggaacaacatagccgatttgtgccggtcggaaggagtcaccctcagcgtttatgccgacgatattaccctgtcatcccacaaaagtatatctggggagctggtgtggaacatcaaatccgctttgtattccaaggggctgggcacaaaaaagagtaaggaagcgagtatggtacacaaagccgctgacattaccggggtcatcgttggaaagcagggtgtgaggcctccaaatcgacaggtcaaacgcctcaaagaactggaagaggtggcctcacagcgccctaacaatgaggttctcgtgagaaaaatccgggggagacgtgcacaactcaaccagattgcatcagcctctagtaatccagcagctaaaaagtga

SEQ ID NO: 10386 - RNA, 975 nt, unidentified
  source 1..975: mol_type = other RNA; note = synthetic construct
atgaacccaaatatgggctacacggagcgagagagtccgttcttcaggttaaactctaaaaacaagctcgccaaactgctgttcattggcctgccaaagctaaaggagcttgccgcaggcgcggatctgtattatagctttcagaaggtcaagaagtcaggaggtatgcggatgatttctgcacctcgcgatgacctcaaaaaagtccagaagcgcatctcggatctgctgcaacggattgccccccccgatttccttttcgctcccgtgaagggacggtcctacgtggataatgcagctgtgcatatcggggccactgcagtgcaccttctggatatcgaagattttttcccctcctgcactgctaacaaggtcatttggttttttaagaccagattcgagtgtagtccggacattgccgttatcctgaagaacattgcgacaaggaatggctccctccctcaggggagtccatgtagcccagctctggcctacttttgctacgtggacatgtggaaagaaatagaggcccacgtgaaacaaagagggtgcaaactatcagtgtatgctgacgacttaaccatatctggcgacgtagtgcctggcgagttggtctttgacatcaaagccacaatgttgcgccatggacaccaatatagcgcaaaaaaggaaaggagcaagatcatgaagcccgttgagatcaccggtgtaatcgtcgccaacaaccagctgcttattcctaatcggcagcatagatccatcgttattgctcaacgtaaactcgggaaagaaaagaaattgagggagaggctcaagatcacaaatgaactgaaggggcgtaatgcccagaaaaatcagataaagaaccaccctggtcagcccaccacagacgcgatacctactccaacgggatactaccagagcaccacacgctctacctctagctcagtgactagttcagacagacgatcctga

SEQ ID NO: 10387 - RNA, 927 nt, unidentified
  source 1..927: mol_type = other RNA; note = synthetic construct
atgagaaatccaaggcggcggaagaccacagatatggccgtgaaggggggctatcaggagagagactccccattcttcaggctaaaatcaaagactaagcttgccaccttcctgttcatcgggagccagaaactgaaagatctatcagacggacgagacttgtacagaagtttccaaaagctgaagggaaacggaaagacccgggaaatcaatgcaccgcgggacgatctcaagaaggtacagagacgcatagcagatctgttgcagcgcattcaaccccctgactacctgtttgctcccgtgaatggcaggtcgtatgtcgacaatgccgctgtacacgtcggcgccaacgccgttcatctgctcgatatcgaggacttttttccatcctgcacagccaacaaagtgatttggtttttcaaaacacggatggagtgctcagccgacgtgtctgtgatcttaaagaacattgtgactcgtaaaggttgccttccccaaggctctccctgttcccctattttagcctatctctgttacgcagatatgtggaacgagatagaagaggcagtgagaaggcatcactgtcagatatctgtgtatgcggacgatctgacgatctccgggaaggttgttccgcagcagctcgtgtgggaaattaaagctaccctcagaaagcatggacatgtcattagcgctcacaaggaacgaagccggtttaaacgtcctgttgaaattactggcgtcgtggtgacaaatgggaggatgagcgtacccaaccgccagttgaaacgaatcgtggagacgagggataagctggcgaatgaaaaaaaaccaaaggctgtcgagaaacttcaaaatgagctgaagggtcgcatcagtcaggtcacccagatcaagaaccaccctcgccagcctgcacactactga

SEQ ID NO: 10388 - RNA, 915 nt, unidentified
  source 1..915: mol_type = other RNA; note = synthetic construct
atgttgaggaaaaaacctgtcctgaagagtaaatcaaagaagtatcacaatgagcgcgatagcgctttctttcggcttcgctccaaaaacaatctggcccgactgcttttttcttcggaaaaaaagctctctgacattgcacgggaggatggactctacaaggacttcgagaagctaaaaaagaacggaaaggatactcgcacggtttccgctcccagagcggatctgaaggcggtgcagtcccggatcagtgacctgcttatgcgcatccgtccaccggactggctgttttctcccgtcaagggcagatcatatgtggacaatgcccgtccacacgctaacgcagcctccgtccgactcctggacattgaggacttctttccttcttgtaccggaaataaagtagtgtggttctttaaggaaagaatggagtgcagcccagacgttgtggctatattaaaggggatcgtgacaaaagacgatgctctccctcaggggagcccatgttcccccatattggcctatttgtgctacattgatatgtgggaagagattgagagcctggtgaataaggccgaatgcgatttgagcgtatacgcagatgacctgacaatcagtggtgagaaggtgcccgaaaagatgatttggggcattaaacagatcctaaaaagacatggccattcataccacgccggtaaggaaagaaagaaatggcataagcctgccgaagttaccggcgtgatagtcaggggagatgggctgctgttcgtcccgaacaggcagcaccaagccacagcaaaaatcaggaaaaaactcgcgagcaaatgtagtatcaaggagcgggccgctctgcaggcacaattactcggcagggagtcacagatgaagcagatcaccactcttaacgacttctga

SEQ ID NO: 10389 - RNA, 909 nt, unidentified
  source 1..909: mol_type = other RNA; note = synthetic construct
atgacagatagacgcaagtactccctgagggacagtccattttttcggctgcggagcaaggctaaactagctagcctcctctacgtcagtcgggagaaattgcaaactttgtccgagggtgaacagaggtatttcgagtttacaaaacccaaaaagtcaggcggagtgcgcaagatttcagcccctaatgcacccctgaaagccgtccagagtagaatagccgaccttctgcggagagtgaccccgcctgactatcttttcgccccagtgccagggcgatcttacgcggataacgcagccttccacgttggagccagatccgtgcgactgctggacattgaggacttcttccccagctgtaccgttaagaaagccatttggttttttcgtacaagaatggagtgctctgaggacgtggccgcgatactggccaacattgtaactttcaagggcgcactaccacagggaagtccctgctcgcctattctggcttatctttgttaccttgacatgtggggtgaaatcgctaaattagtggaagacggcggttgcaagctctcagtgtacgccgatgacttaactatcagcggagtatcagtccctgaggcccaaatctgggaaatcaagaaaaccctgtataggcatggccacaggtacgctcgctctaaggaacgatccgttagggataagagcgtggaggtaacgggggtggtgttgttgagggggtctgtggtcgcgcccaatagacagcacgccaagatcgccaaggttcgcgatgagctcacaaggaccgctagcgccgatcatcgcaaagcactggaatctcagctgagaggccgtctcgctcaagtcgggcagatcaaagctgcagatcagcggcggcgcgcttccgaagcagcaaagatctga

SEQ ID NO: 10390 - RNA, 912 nt, unidentified
  source 1..912: mol_type = other RNA; note = synthetic construct
atgaaaaaggtcgagtcacaaggatatgccctgagggactgtggattgtacaatatccagaccaaggctgtccttgctaaacgcttactggtgtccccttccaggctgaccagactcacgaataaacaagatagatatagatgctggacagaacccaaaaaatccggaggcaccagagagatcgaggcacccctcgacgatctgaaggacgtccagaaacgcatttcggagctgctcggcagggtgagagctccatcttatctaatggccccagtaaagggccgctcttacgtcgataacgccgccattcatgttggctcacaatgcttcaggctgctcgatattgaagacttttttcctagctgcacagagaagagggtgttctggttcttccgaaccgtgatgcgttgttctgtggacgtggctgccgttttggcacgcttgagcactcggaacggaaggctgccacaggggagtccttgtagcccgatcctcgctttctatgcgtactttgatatgtgggaaaccatcaacgccacagtggaatcccgaaagtgctacctgactgtatacgctgatgacatcacaatcagcggtgaaagtattcgcgaattcgacgtttggcgaataaaacagaccctatttaagtttggtcatcggtacaatcggagcaaagagcgggccataattaacagacccgccgacataactggggtgatcgtccggggggacatcctgttacttcccaaccgtcagcacaaggcactgacagaggtgatcaggaagcgttcttcagcaggcactagtctggagagaaatgccatcgatcggcagattcggggtcgaattgctcaggcaggccagatcacgcgccaccttgagaagataggggccaagattgcatccgcgtga

SEQ ID NO: 10391 - RNA, 903 nt, unidentified
  source 1..903: mol_type = other RNA; note = synthetic construct
atgtctaaaacaaagaagccttggcgcagaaaggcgaaaaaattttaccctctggaggcctctccattttacaaactgcagagcaagaagagactcgcaagtctactgttcacctcattaacagcccttagagggatggctgataaatcagtcccccactatgaatactgggaggaacagaaggctgatgggagcatgaggccgttatgccggccccatgaaggcctagacaagacgcagagccgcatcgcctacctgctcgcctgtgtgcaaactcccgactatgtgcatgccccggtacccgctaagacatatgtcactaacgctgcatcccaccaaggcgctcgcgccttttccttgctggatattgagtcgttctatcctagctgcaaagaggagaaagtactggcattcttccgccaccgaatgaagtgttccattgacgtttccactcttcttgccagactctgctgtgacaacggtagcttgccacagggcagttcttctagcccaatcctgtcctactgggcatacgcggaaatgtgggatgctatctatactataacaagcaacgcaggaaataatttcaccctgtacctcgatgacctcacgatctcaggagacagggttcttggaaataccctctggaggatccggcagcagatacataaacacggtctgcagatcaaggagagtaagagtcgaaggattatcgacaagcctgccgatgtcaccggggtgattgtgaccaaccaaggtctgcgtctgccaaatcggcagcatcagaaattggcgcacgccaagtcagacttttctaagcccggcgggaatcgtaaacggaaaggaaacgtgctgagaggcaggaatgcccaagctgtgcagattttgaaccacaactcctga

SEQ ID NO: 10392 - RNA, 939 nt, unidentified
  source 1..939: mol_type = other RNA; note = synthetic construct
atgacaaaaaagatcaagtcttaccctctcgatcagagtcccttttataagctcacaacaaagcgcaaacttgcggagctgctaaggctcccactcggacggctgaagaggatcgctttgctgagtccaaatatgtataatgagtggatacaggagaacgcaaagggcaagaaacgtcagattgaagatccggctcgcccacttaagctggcccaagggaggatagccaacatcttgtcttcaatctcggcacccaattatctgcactgcccggtcaagggcagaagctatatttctaacgccgctgagcacattggtgcaaaacatatccgcaatattgacatctccaactacttcccttccactaaaagcacccgtgtgtactggtttttcaacacgatcctgaaatgtacccccgacgtgtctggcattttgaccgcccttacgacttataaaggtcacctgccttgtggcagtcctgcatcctcaatcctagcctactttgcccattacgacatgtggcagagcatcgatcagatcgtgtcagagaacggctgtaagttgtcagtttacatggacgacataaccgtctcaggtgaaatggtgactgagcgggtaatcttccaagtgcggaggtgcatttttcgcgccggactgcagcccaagaaagaaaaggagcgatggtacagacatggaattgggatcgtgacaggaatagtagtccggccctctgggcttagtgcgcctaatagcgctcacctgaaacgattcaccctccggcgccagatagctagctcttgcaatgaatccgaaaagtccagtctgagacgatccctgaaagggattgagggccagcagagccaaattgataggtggaatagaagattacacaacagcaaatccaatgccaaggaacatgttaacttaaagccaaactga

SEQ ID NO: 10393 - RNA, 930 nt, unidentified
  source 1..930: mol_type = other RNA; note = synthetic construct
atgaagaccaagaagattaaaaactaccctctcgaccagagtccactctacaagcttactacgaagcgaaaattggctgaactcctatgtttacccctggccagactgaaaagaatcgccaccctgagtccgaatatgtataatgagtggactcaggagaaaaaaaacggagatctacggacaatcgaggatccggctcgaccccttaaaatggttcaatccagaattgccaagatcctctcgagcatcagcgcacccgagtatcttcattgcccagtgaagggcaaatcttatatatcaaacgcggctcagcacatcggctcaaaacacattcgtaacgtcgacatttccaattatttccccagcaccaaaagtagacgcgtctactggtttttccataacatcctgaagtgttcgccagatgtcgccggcctgctgacaacactgactacatacaagggtcatctgccttgcggctcaccttcctcctctatcttggcatactatgcccactacgacatgtggcaaaatatctatcagatagttagcgaaagtggttgtaaattgtccgtgtacatggacgacgtaactgtatctgggggcgtggtgacagaaagagttatgttccaggtgaggcggtgcatttataggtctggcctgcaaccaaagaaggaaaaggaacgttggtaccgccgggggattgggatcgtgactggtattgtggtccgatccggagggctctctgcacctaatgctgcccacctgaagaggtttaagctgcggaacaagctggcgaccagcagcaacgatgaggagcgcatcaccttacaaaaatctctcaggggaatagatggacagcagtcccagatagataaatggaatcgccggcttaatacgagcaccaagtcagtgagggcagacttgcagtga

SEQ ID NO: 10394 - RNA, 912 nt, unidentified
  source 1..912: mol_type = other RNA; note = synthetic construct
atgactacaaagaccaagtcctatccactcaaccaaagtcccttttacaagctgaccacgaagcggaaactggctgaacttcttcggctgactcctgccaaactcagaaaattgagtgccctgtctcaggacctctatcgcgaatggccccagacaaatctgaagggcaaaacaagactgatagaggaccctgcccctgctctgaaagaggtgcagcgcaggatttacaggttgctatcctgtatcactccaccatatttcttgcattgcccagtgagggggagactttacatttctaatgcagcgtaccacgtaggaagcaggcattttcgtaacattgatatctcggactactttcccagcactaaatctcgaagagtgaattggttcttccgtcggatcttgaaatgcgccccggatgtctccgggatcttaaccgaacttaccacttacaagggccacctgccttgtggatcaccggcgtcatcaatcctggcttactttgctcactgcgatatgtgggaacagatcgcacgcatagcctcagagaacgggtgcaaactctctgtgtatatggacgacctcacagtgagtggtgatgtggtgcccgaccgggtaatgttccaaattcgtcagcgaatttatcgcgccggactacagcctaagaaggagaaggaaaaatggtatagacggggcgtgggtgttgtcacaggagtcgtcgttcgaccctccggcttaagcgcaccaaatagcgctcacctgaagagatttaagttacgctgtcagctggccacggcaagctccgctgatgagagggccaccctccaaaactccctgaggggggttgagggccaacagtctcagatcgatcggtggaatagccatttcaccagttacaacgcagaggagtga

SEQ ID NO: 10395 - RNA, 942 nt, unidentified
  source 1..942: mol_type = other RNA; note = synthetic construct
atgctatccctggggaggaagttaatggccactctgcctcggacacaccccattaagcagtctccgcttcacaaactaggacatcacaagaggctggcctcactgttgaagatcgaggtggctcaactgcgagggcttgcaaaggccggcagtgcagcctactccgaatgggacgaggataaacctaatggcggcacaagacgcatcgaaaatccaaaaccaagactcaagaggctgcaaagcagactcgccactatattatcacttatagatcctccggcttttctttcttgtcccgtgaagggccgatcatatatttccaacgcccgggcacatctcggtagcaaagagttcgtcactctagatgtgaaatcctacttccctagtacgacctggaatcgcgtgtattggtactttaacaaaaggttgctgatgccaagggataccgcgtggaccctggcaagtgtggccaccattgacggtcgtctgccaacaggttctcccctctcgcccatcatggcataccttgctcacgaggatatgtggttgaaggtcgccaagttagcggaggacgtgggatgccggctgaccgtttatatggacgacatcacaatttctggagcccgtgtccccgaggctaccgtttggaagatcaaacaggaggttcataaagtgggcctgcgcctcaacgataagaaggaaagaagattcagcgacgtaggagtgatcacaggcgtagtcgttacgcctgatggggtgcgcctgcccaaaaggagccatctcaatctcagtattgcgcgaaaggccgctctggtagttgacggcgaagcaaaactgcgggctatgcgccgtgtgagaggactggaagcccagcaccggcaggtcttggctccaactgactttactgacaacttgagcgggagccaccgggggtcctcatga

SEQ ID NO: 10396 - RNA, 909 nt, unidentified
  source 1..909: mol_type = other RNA; note = synthetic construct
atgcagaagtcaaagtacgccagatatgagctcgatcagtcaccgttctattgcctcaaatcaaaggctaaactggccgagttgttacacatctcccaatcgaagctgaagtgcctcacatgcaccgaggacctctatgttgaacgcgatacgttcaatcctggacgccgcaagtctagacgaatagagcaacccaagttaccgctcaagctggttcagaaaaggatcgaagagctgctgaaacggatcaaattgcctaactacattcattcccccggtaaggggaggagttatatatctaacgcaaaagcccatgtaaatgcgaaggaactgagaatcttggacatagagaagtactttacttctactccagctaggcggatttactggttttttcacaagcagatgaaatgtagccctgatattgctggcattctgacaaaattgtccacattcaaagaccacctgcctacaggctcaccatctagcccaattctgagctactttagccacatcgatatgtgggaggagatcaaccgaatcgtggaacccaacaactgtatcctgaccgtctatatggacgacgtcactattagtggtgagcatgtgcccggggaacttatatggcaagtgaagaagcagttcaagaggtacgggcttcgttccaataaaaaaaaggagaagcactacatcggcaaaaagagttatgaggtgaccggagtcattactacgcagtccggagaactgcgagtgcccaatcggcaacatctacagatgagaaatatcaggcggcttattagtttagaaagcgaaccagagaaactcgccaaacttagacgctccctgaagggcctggaagcacagagcgagcagatccgtcgggcaaactctctcctaaccgaaacctga

SEQ ID NO: 10397 - RNA, 909 nt, unidentified
  source 1..909: mol_type = other RNA; note = synthetic construct
atgcggaagtccaaatacgccagatacgaactggatcaaagtcctttctactgtctaaaatccaaggcgaaattggcaaaactgctgagggtgagccagataaagctgaagttgctgaccaacactgagcacctctacgtggaatcagatatcttcgaccctgagcgaggtaaatcacgccggtttgagaagcctagacaggacctcaaatgtgtgcagacacggattgaggaactgctgaagcgtatcaaagtcccaaactacatccatgcgcccgccaaaggaagatcttatatctccaacgccaaggctcacgttaattcaaccgaggttcgaagtttggacattgaaaagtattttccgagcaccccagcaaggagaatagattggtttttcaggaagcagatgaagtgctcttcggatgtagctaatatcttggccaaactctctacgttcaaagaccacctcccaactgggagccctagctcccccattctttcctattttgctcacatcgacatgtggaaggcaattaatgaaattgtcgatctggccaattgcacactgactgtctatatcgatgacgtgaccatatctggcgaccgcgtgcccggagaattaatctggcaggtaaagaagcagttcaatcggtacgggcttcgaagtaacaagaagaaggagaagcattacattggcaaaaagagctatgaggttaccggcatcatagctacaaaggagggtgagcttaaaatccccaaccgccagcatctcaaaatgtataggtgccgtaaactactcaaactgggaattcggtacgagaagggcaaggacatgctgaaaaggttaagagggcttaaggcccagatgcaacaaatccgcaaagtgaacaatagctcaattgaaacatga

SEQ ID NO: 10398 - RNA, 906 nt, unidentified
  source 1..906: mol_type = other RNA; note = synthetic construct
atgccgagaattaagcaagccggctacgaattgaaccagagccctttttactgtctcaaaagcaagaaaaaccttgcaagcctgcttcagatcagtcagtctaagctgaacaatcttacaaggtcagaagaactctatatcgaggagaatcggtttgataaaaagcgaggtaaaattcggcacatcgaggagccaaaacctgacttgaaacgagtgcagaagagaatcaagaatctgctgacccggattcagttgccaaattacgtgcatgcacctgctcaaggacactcccatatcgggaacgccaaggctcacgtcggagctgttgtggtgagaagcttggatatagaaaagtatttcccatcaacccccgccaagagcatattttggttcttctataagcagatgaagtgctcctctgacgtggccggaatcctgaccaaactatccacattcaaggggtatctcccgacgggctcacccctgagtcccatcctttcttatttttcgcacatagatatgtgggagactatcggtgagatcgtcagaaatgcaagttgcactctgacattatacatggacgacgtgaccatttccggcaattctgtcagcggagaactaatttgggaagtaaaaaagcagttccaccactgcgggctcaggtccaacaaaaagaaggagaaatactactttaggaagaactcatacgagatcaccgggattattgtgacaaaggaaggcgaactcaaagttcccaatcgccaacatctgaaaactcatcagatacgtcaggagctccattgtgagacggagcctaagaaatgtaaaaaactgcgccagcgcttacaaggcctggaagcgcagattcagcaagttaagagggtaaactatcccctgccagagtga

SEQ ID NO: 10399 - RNA, 921 nt, unidentified
  source 1..921: mol_type = other RNA; note = synthetic construct
atgccggtgcttcgcattaaaaagattggatataaactcgaccagagtccattttattgcctgcaatccaaggccaagctagctactctgctcggggtgtcacgctcccgattgatccaacttgccagaagcgagtccctgtacatcgagaaagagattatccatcctagacggaagaaatcaagattggttgagaaaccaaagtatgagttaaagctgattcagaagcgaatcgaagggctattgaaacggatcgagataccaaagtatattcacgctcccaccaagggcaggagctatgtctccaatgcaaaagcccacctcaacagctacgtcatctctagccttgatatcgtgaaatacttcccttctacgaaaagtaagagagtttactggttcttccatacacgtatgaagtgcagtcctgatgtggcagcgatactgaccaagttatctacatacaaggaacatctgcccactgggtcacctctcagccccatcctctcatactttgcccatatcgacatgtgggaggaaattaacaatatcgtggaggatgcaggctgtatactgacagtgtatatggatgacgtaacaatttcgggagactacgtgagtaggaatctgatctggcagatcaagaagaagtttcacaggtacggcctgtctagcaataccaagaaggaaaagtactacataggtaaaaactcgcgcaaaataaccggtgttatcctcgacttcgagaagggcgtccttaagattcccaacaggcagcacaaaaaaatgtattccatccggaaacagatttctaaagaaactcacccagatacctatgcccatttgatgagcaaactgaagggactgaagtcccaggtacagcagattcacaaagctaacaatacccaaactaacgaaaattga

SEQ ID NO: 10400 - RNA, 921 nt, unidentified
  source 1..921: mol_type = other RNA; note = synthetic construct
atgcagcgctcacggtgcaaacagtatacactggaccaaagccccttctactgtttaaagagtaaggagaagcttgctaagctgttatatattactcagaggaagcttgaggtcctcgcacatacggaagagctgtacatcgaacgagataaattcaaccctaaaaaaggcaagactttccgagtggaagagccaaccccccctctaaaacgtgtacagaagcggattgacgagatcctgaaacgggtgaaaatgccaaactacatacatgccccgggcaagggtagaagttatattagcaacgctagagcccacatcaacgttgccgtggtacgctccctcgacatcaaacaatacttcccttcctcccagtcttggagagtgtatagtttctttgacaagcgcatgcggtgctcttcggatgtggcgggaattctgaccaagctctctacatttaagaagcacttgccgaccggatctccctcctcaccagtcctgtcatattttgcccacatagatatgtgggaggcaattaatgagttggttgaaggggcgggttgtaccctaaccgtctacatggacgatgtgacaatctcaggctccagcgttagcgacgaactcatcaggaaaattaagagagaatttgacaggtgtgggttgagggatagcagggacaaggagaaacattacgtcgggaataagcctcgtgagatcactggcgtgatcgtcaaagacggcgagcttaaactgcccaatagccagcataagaaaatgcacgactgccggcaagctatccagcttgagacagatccagccaagctcgctcacctgatgcagtctctgaaggggctggaaagtcaagcccagcagatacgcaaagcaaacgaaattagagtggataatggatgcaatgatctgtga

SEQ ID NO: 10401 - RNA, 912 nt, unidentified
  source 1..912: mol_type = other RNA; note = synthetic construct
atgaaaaaagacaaatgcaagcaatatccccttcaccagtctcctttttactatctaaagagtaaggacaagctcgcgaagctgcttcatatatcccaaaagaccctggagatactgacgagcaccgaacagctgtacattgagcaggatcgttttaatctcaagaagaagaagttcttcagggtggaagagcctaaaccattgctgaagcaggtgcagaaaaggatcggggagctgcttaagcggattgaagtgcctaattatatccatgccccggcaaaaggccggtcatacattagcaacgctaaagctcatatcaacggatttgttgtcagatccttggatatcgagaagtacttcccctcaactcagagccaaagagtctactggttcttccacaagcagatggagtgctcctctgacgtggccggcatcctcactaaactgagcacgtttaagaatcaccttccaacaggatcacctagttcgcccatgctcagctattttgcacacttggatatgtggaaagctattaacgaattagtggagtccgccggctgtgtgctgacagtatatatggatgacgttaccatcagcgggagtttcgtatctgggaaactgatctggctgattaagaaggagttttaccggtgcggtctacatgactctcgcaagaaggaaaaacactatgtcggtaataagccacgagagacaacaggaatcattattgacaatggccagctcatgctccccaactcccagtataagaaaatgcacgaatgtcgacaagcaatacgccaagagactgatgctgacaaaaggtacatattaatgcgcaccctgaaaggcttggagtcacaggcccagcagatcagaaaagccaacgaaacctacatcgatactgaatgttga

SEQ ID NO: 10402 - RNA, 924 nt, unidentified
  source 1..924: mol_type = other RNA; note = synthetic construct
atgcccactaagcgtctctaccagctgaatcagtcccccctgttcaagctgggaagtcggtctaagctcgctaaactactcggtatgacacctggggctctcagggctctggcagcaggagacggcctgtataaagagtttgaagtggagaaaaagtcaggtggcaagcgcggggtcgagaacccctgtagaccgctgaaactggcccaggcaaccttggcaaggctgctggggcggatacaacctccagatttcttgttttgtcctgtcaagcgaaggtgctacgtgactaacgcggcagctcatcgccacagccggatggtccagtgcttagacatcaaaaagttctttccatccgtgtctcagagacgcgtattttggtttttcgctaccgttatgaagtgtccacgtgatgttgccggtctgctggctcagctcgcctgctacaagggccatctcccaaccggctctcctctctcccctatcatggcctatttcgcctactacgatttatgggcggccatcgacgccctgtgcaaagcaagagggtacactttcaccgtgtatattgatgacgtgacgattagcgggactcatgtgcccaagagcgccatttgggaagtccaacagatgattcacggcgctgggctacggtatcacaaacagaaaacgttcgtggataagccagccgagatcacaggcataattcttaaggacggccagttattggccccctttaggcagcaccgaaagctgaaagataccagagctgctcttcgagcagccgaccccgtagacaggaaggcccttaaaagtcgcttgacaggtgtgacagcgcagatcggacaaatcgaacggcaaaatctgtgtgccccgcagcgcaaaggaggatcgaccaagatctatagactttcagaggtttga

SEQ ID NO: 10403 - RNA, 903 nt, unidentified
  source 1..903: mol_type = other RNA; note = synthetic construct
atgcgcactaacgccaagctgtataaacttgaccagagccccttgtacaagctacgcagtcgtgctaagctggcccggctccttggtgtttccgtagccgatttgcgacggctgaccaagaacgcagactcactctacaaggaattcgaaatacgcaagaagaacggcgagatgaggccagtgcaaaaccctgaaaggtatcttaaagtagttcagggacgccttgcaaaggtgctcgcgaggatcgctccaccggactatctctactgtcctgtcaaaggtaggtgctacgtgagtaatgccggccaacatcggggcaatcgcgatgtgagatgtctggatattcgacgatattttccttccaccccgtccaggagagtctattggttctttagatccgttatgggctgcgagaaagacatcgccgccacgctggctagattagccacatacaaagggtgtctgcccaccggttctagactcagccctatcatggcctattacagtcacatcgacacatgggacgctatcgcgtgcatctgcaaggaaaagggctacagactgactgtctacatcgatgacgtgacgatctctggacagtctgtcgatcctgacgatatttggcggatcaaacaggtcattcaccggtcggggctgagatatcataaggaaaaggcatacacagacaggccccccgagataactggggtgattgtggatggagagcgtttaattgtgccaaatcgccagattgctaaactggcaaagaccaggaaatctctctcatcaactaccgatccagaggagctgaaaaagctgcacgacaaaataagcgggctacggggacagatggcacaagtggctattaaagccttggagttgccccagctgagcaccacatga

SEQ ID NO: 10404 - RNA, 1005 nt, unidentified
  source 1..1005: mol_type = other RNA; note = synthetic construct
atgactctgccacggaaaagcgccaaccgttacgacgttagtagctctgcactgtacaggttacccacccttaaggccctggccagattcctagagtggaagggatcacctagcgcgctccgcgctttatgcaagcgccctgacaatttttccgagttctatcaggcccacccccggaccgggaaaatgcgactgattcaagctcctagcaaggtgatcaaacccctgcagaaaaggctgaatgttcttttaaaacaggtgcgcgtccctgattaccttcatagtggcattccgaagcggtcccacctgtctaacagcgagcagcacatgctagccgccggagcaactgtcactgtggacgtatccgatttttatccgtcaattactaggcagcgcgtgttccggctcttcaaaaacgtcttccagtgtcgaggtgacgtggccgacgctatggctgatctcgtttgttatcaaggcaagctggccacagggtcaccagcgtccgtgctcgtgtccttttgggcatgcagagacatgttcgactctatggcccagcgagtcgctactcaaggaggcacatttacattgtacgtggatgacgtagccataaccggcgatacgatcggacacggcgatatccaatggttggacagacttctcagaagatttggtttctcttctaaggttgaaaaagccaagctctttcgcaaaacccgagcaaaagtagtgaccggcagagccttccgtcatggcataagcagggctcccaatcgaaaacacaaggagatgcatgaggcacgcgctgaaatcgaatcaggacgggccacaatcaaggctaagcgggggttggtggggcagctggaaaacatcgggaatctggatcaggaacgcggtaccagtctgaaggcagaggcaaagaagttgaggagtacactgccccggccaagaaggaggcgtagagctacagcgaggccagtcaaaacccggtcggagattgcgacgtga

SEQ ID NO: 10405 - RNA, 1005 nt, unidentified
  source 1..1005: mol_type = other RNA; note = synthetic construct
atgtccttgcccaggaaatcagccaatcgatacgaggtaactagtagcgcctttttccggctgcctaccttgaaggcgcttgcacgactcctgcaatgggaagggagcccttctgctcttcgcgctctgtgcaaacgaccagataactttacggagttccccagaatccatccccgtaccaaaaaggagcgagtgattcaagcaccgtccgacgtggtgaaacctctgcagaagagattaaatgtgctgctgaagcaggtgagggtgcccgattaccttcattccggcatacctaagcggtcacacctgagcaactctgagagtcacatgtgggcagagggggctacagttacagtcgatgtgtcagatttttatccgtctatcactcgtcagagagtctttcgcctgttccggaacgtcttcgagtgtccaggggacgtagccgatgcgatggccgacttggtgtgttataaaggcaagctcgccactggatcccctgcaagcgtattaatctctttctgggcatgccgtgatatgtttgacatgattgctgatagggttgccaccctgggcgggacctttactttgtacgtggacgacgtcgccattaccggaaatacagtggggcatggagacattcagtggcttgacaggctcctacggaagttcggattctcaagcaaactggagaaggctaaactcttccgcaaggacagtgccaaagtcgttacgggccgggcatttcgccacggtatttcgagggctccaaacaagaagcacaaagaaatgcacgaagcgagaacagaagcaaaatccatcggtgctagtgtcaaggttaggcggggcctggtgggacagctcgagaatataggcaatctggatcatgaaaggggtacctctctaaaggccgaagccaagaaactcaggtccacattaccaccacccagacgccggagaagagccatcactcgccccaaccacatcagccctgaggccgctacctga

SEQ ID NO: 10406 - RNA, 1005 nt, unidentified
  source 1..1005: mol_type = other RNA; note = synthetic construct
atgacccttcctaggaagagtgccaatcggtatgacattacctccagcgctttctttcggcttcccaccctgaaagctctggctcgcgtattgcagtgggatggaaccccatctgcgctcagggctttatgtaagcgcccagacaacttctcagaattttaccaaacccataggagaacaggtaagaaacggctcatccaggcccccaatgcagtggtgaagcctctgcagaagcgattaaatgtcctactcaagcagatatgtgtaccagactatctgcactccggcatcccgaagaggagtcatttgacaaattccgaatgccacatgctggccgaaggggcaacggtcactgtcgacgtctccgatttctacccctctatcactcggcaacgagtgttcaaactgtttaggaacgtgttccagtgccctggggacattgcagatgccatggccgatctcgtttgttataacgggaaacttgccaccggaagccctgctagcgtgctgttgagtttctgggcctgcagagatatgtttgacctcattgccaagagagtggcggatcagggcggcacattttccctctacgtggacgacgtggcaatcactggcaatacaattggacacggggatgtaagatggctggaccgcgtgctgcgtaggtttggcttcgcctctaaggtggagaaagccaaggtgtttcgaaaagcaagcgcaaaggttgtcactggaagagcgttcagagacggcattagccgagcccccaaccggaaacacaaggagatgcatgagagtcgcaatctagtcaagggtacaagcgcgtcaacgaaagttaagcgcggtctggttgggcagctggaaaacatcggaaacttggatcaaaagcgcggcaaagcactgaaagctgaggctcagaaattacggtcaacccttccaccggctaggcggaggcgtagatcggctgctctgcccactgccatatctgccgccgaggaggcatga

SEQ ID NO: 10407 - RNA, 1011 nt, unidentified
  source 1..1011: mol_type = other RNA; note = synthetic construct
atgacgctgccacggagctctgcaaaccggtacgacgtgccttcctcagccctatttcgtcttccttccctcaaagctctggcaaaggttctgcagtggggcgggaacccctcagcactgagagccttatgtaagcgccccgataattttgaggagttctaccgcactcacccaaggaccaagaaaaaaagactgattcaagcccctagtgaccaggtcaagcctctgcaaaggagattaaatgtactcctgaagcagctgcgagtgcccgattatctgcagtcggggatacctaagaggtcacatctgtctaacagcgagcttcatatgagggctgaaggcgctaccgtaacagtggatgtcagtgacttctacccaagcatcaaaagaaagcggctgttccggctttttcgcaacgttttcgagtgccgccccgatgttgcggatgcccttgctgacctcgtgtgcttcaatggcaatctggcaacaggttccccagctagcgtcctgctttcattctgggcctgtcgggacatgtttgacatggtggccgaaagggcgctatctcaaggagggacattcacgttgtatgtcgacgacatcgccattaccggtaatgccatcggacacggtgatatccgttctctcgacagactgctcaataagttcggctttaatagtaaaaaggagaaggccaagttgtttaggaaggctgatgctaaactggtgaccgggagagcctttcgggatggagtgagtcgcgccccgaacaagaagcatcaggagttacacgagactcgaaaacagttgagagacactaccgcctctattcgcctcaaacggggcgcagttgggcagctcgaaaacataggaaacctggatgcacggaggggaagcagcttgaaggctgaagctaaaaaactgcgcacaactcttcccccaccccgtaggagacgacgatcctcctccgcgttgccgctcgaagcaggcatcctagaccctaaagcctga

SEQ ID NO: 10408 - RNA, 969 nt, unidentified
  source 1..969: mol_type = other RNA; note = synthetic construct
atgacattaacacggaaatctgcgaaccgctacgacgtgtctagttcagccctgtttaggctgcccagcctgaaagctctggcctcagcattgttgtggcctggcacgccgagtgctcttagggcactaagcaagaggcctaataacttccaggagtttaatcgagtccaccggagaactggtaaagccagaaagatccaggcaccatgtgaggaggtcaaaccacttcagaaaagactgaacctgctgctcaagcagctgagagtgcccgattatttgcaatcagggatcccggggcgctcccacctgtcaaatagcggcaaacatatgactgccgaaggcgctacagtgaccgttgacgtgagcgacttctatccatccatcacccgtaaacgggtcttccgcctctttaggaatgttttccagtgcgaacctgatgtggccgacgccctggcagatctagtgtgcttcaacggacatttggcaactgggtcgcccgcaagcgtgcttttaagcttctgggcctgtagagacatgtttgatgtcattgctgaacggacctccctgtctggtgctacttttacactctacgtcgacgacattgccattaccggggataaaatcgggcacagtgagatattgtttctaggacgcctgctgaaggattttggcttcagttccaaggaacaaaaagcaaagctgttccgaaagagggaggcgaaggtagtgacgggtcgcgctttccgggatggagtttctagggctcctaacaagaagcacaaagagcttcacgaatccatgagacagctccgcgaacataaggctaccgttaaggaacgacgggccgccgtaggccagcttgagaatgtgggactcctggacgagaagagaggcgcgctcctcaaggccgaggccaaaaaactgcgttctaccttacccccttcccgaaggcccaagcgtctcccatga

SEQ ID NO: 10409 - RNA, 936 nt, unidentified
  source 1..936: mol_type = other RNA; note = synthetic construct
atggcgaaaaaagagaggctgccacgttccctagagaattcagggctgtaccgacttaggaccatgggagccctggcccgacttttgcattggaagaagagcccctctgctctgagagcactctgctcaaggcaagacaattgggacgaatttgatcaagccaggccgggaaagaagccgagacgcattcaggctccaaaacccgccataaaggctctgcagcgcagattaaatgacctgctccagcgcattgatgcacccgagtatcttcactcagggacagtcgggagatcttacttgaccaacagtgccctccatagggatgcagagggagccaccgtgactgtggatatctccgatttttatccttctgtcacgcgaaaaaggctcttcgtgttatttcggaccgttttccagtgcagttccgatgttgcagacgcattagcgggtctactgagctgtggaggtagcttggccacaggcagccctgccagtgctctcgtggcgttttgggccgctaaggacatgttcgacggtattgccgaaagagctaaacgcctcgggggccggttctctctgtacgtggacgatataactctgactgcacgaaccgccggacgtggggatgtatcttttattgaaagacacgtcggccgctatggcttcagactcgcccgtaagaaatcacgcgtgtatcgggcgggccaacctcgagagatcacaggccgcgttcttaggaacgggcagagccgggctccaaacaagcagcatcggtacatgcacgaggccctgtccgctatgggccctgaaacacccccagctgaagtcaggtccgccatcggacggatccagcacgtgggcatcctggacgacgtacggtcgcaggagctgatggcaagcgctagacggctgagggagaagttggcaagttcctga

SEQ ID NO: 10410 - RNA, 957 nt, unidentified
  source 1..957: mol_type = other RNA; note = synthetic construct
atgattgccctggaccagagctcacgctatgagctggagttgtctcccctctaccggctaggcaggaccaaggacttggccgccctgcttagatggcgtggtaatccatcccaactgaaagccttctccaagagggatgatcacttcgacgagtatgaccaggtcgatcctaaaaccctgaagaagcggcacattgaggctcccaaagccggtttgaaacgcttacaaagacgactgaatgcactcttgcaacgaatccatgccccgccttacctccacagtgggatcagaggcagatcctaccttactcacgccgggacgcatactcaagcggaaggggcgacgttaaccgccgatatttcggactactatcctagcgtcagtacagagcgtctccagcagctgttccgcaaggactttcgctgtagtatcgatgtggcttggatactcgctcgcctgttgagctgccgcggccatcttgccacaggatcacccgcttccgctattgtggctttcatggcaaataggtctatctttgatgaattggccaaaagggcaaccaagcggggaatcgccttttctctgtacatggacgacctagcatttactggccgaggcgttaaccgctcagatgccgccgccgcaggagaactcctcatcagacacgggcttcgaatcaaagctaaaaaaacacgtctgttccacgctgaccagccaaagttagtgacaggagtggcatggaggaacggcataaagcgggcgccaaacgcccagcacaaactgatgcgggaagcactgcttgtactgcagagggcacccagagagccaggtcattatcggaccgctattggaagagtccagcatatagctatgctcgacgatgtgagggggcctcagcttcggaagaaggcgagagaactgagggttggcctgaaggcactggagagcccgcggtga

SEQ ID NO: 10411 - RNA, 957 nt, unidentified
  source 1..957: mol_type = other RNA; note = synthetic construct
atgaaccagcagacaacgaagcctgtctctaccaagcgacgcaccgaacgatacaggattgcgagctctcatctctatggcatcaggcggcacaccaaactggctgagatactttggtgggctgggactgctggccagctgcaaacttttacaagacagcctgacaactacacccgttatattgataccagcaagcccgggaaagaccgcttaattgaggcccctgccagacgcctgaaggggtttcagaggcggctgctagacctccttatccgaatagagctcccagattatctgcatagtgccaggccgggctactcctatctctctaatagcgccgcccactgcaaggcggatggaagtacagtcacaatggacattgattcattctaccagtccgtgaccctgcatcgtgttgcccagttctttgaacagaagttaaattgcgcacccgatgtgtcagaaacgctcgctcacttgttgtgctgtgatgggcaccttgctaccggatctccagctagcccactgctgtccttctgggcctaccataacttgttcgattcaattaacgaccgggtgaggtcccgaggtggtgtcttcactctctacatcgacgatatggccatcactggcaatggctttggacacactgacgcccggtgggtaggaagactgatccgccgcagcggacttcgcctgaaagactccaagacaagggtgtttagagcggatgctgcaaagctaatcaccggcagagcctgtagaaacggtgtgagtagagcccccaataaacagcacaggaaaatgagagaggcacaggcacaactggagcaaaatccccatgacctgacactccgcgcatcggtggctgggctgaaacgtcacttagccctgttggatgacgttaaaagggaccaacaccgggcagacgcaagccggatctcaaagcggcattga

SEQ ID NO: 10412 - RNA, 957 nt, unidentified
  source 1..957: mol_type = other RNA; note = synthetic construct
atgagccaacagacaactaagccagcctcaactaaaaagcgcacagagcgctacgggatcaccctcagccacctgtatggcatacgatcccatacccggctggccgaagttatttggtgggcaggaaccgctgggcagctgaggactttttctagacgggcgggtaattatagccggtacattgacaaatcaaagccaggcaaggaccgactcatagaggctcctgccgcttcgctgaaaggatttcaggcaaggctgctttgtctgctgtccagaatcgagctgcctgactatctgcattctgcccgccccggatactcatacttgtctaatagcgctgcccactgtaacgctcacgggagcactgtaacgatggatattgatagtttttaccagtccgtcaagctccacagggtcgcaaagtttttcgaaagcaaattgaattgtgcttccgatgtgtcagagacgctcgcacatctcctgtgctgcgatggccatctcgccactggctccccagcttctccgttagtgtccttctgggcctaccgcgacctattcgacagtgtggatgaaagggtacggagccgggggggcatcttcaccttatatattgacgatatgggaatgacaggcaacggtttcgggcacacagacgcccgttgggttggtcggctaatgcatagatccggacttcgcctgaaggacagtaaaaccagggtctttcgtgcagatgcacccaagctgatcaccggaagggcatgccgaaatggcgtgagtcgggcccctaacaaacaacacagaaaaatgagggaagcgaaagccaggctggagcagaaccccaacgaccccacacttagagcgtctgtggccgggcttaaacgtcacttagccttgttggacgtgaagaagagagatcagcacagagcggatgcttcacgaatctctaagggccgctga

SEQ ID NO: 10413 - RNA, 963 nt, unidentified
  source 1..963: mol_type = other RNA; note = synthetic construct
atgacactccagaccaaaaaaaaggccatacctctcaaaaggcgcactgaacgttacggcatttcctcttctcacctgcacgggattcggtcacactcacgattggccgaaatcctaagatggggagggactgccggccagctgagaacttacgccaggagagaggagaactataaccgctatatcgagaaggggaaacccggaaagaaggacaggcagatagaagctccagaacctaggctgaaggagtttcaaaagagactcctggacctcctcaatcggattgagcttcccgaatatctgcattcggctaggccagggtactcatatctttctaatagcgcagcgcattgcaatgccacaggctgtacactgacgatggatatcgacagcttctaccagtccgtgaaagtgcagcatgtagcacgcttttttgagaaggctttgggctgctctggcgatgttagcgagacaatggcccagctttgctgttgtgatgggcacctagccaccggaagccccttgtccccacttctgagtttctgggcgttcaaagaggttttcgacgcaattaatcatcgggtgaaaagcagaggcggtgtgtttaccctgtacatcgatgacatcggaatcacagggaagggtttcggacacacggacatcatttggaccactcggctgctgcgaaaatccggcctgactgtcaaagagagtaaaacccgtgtctttcacgccgatgcgccgaagttaattaccggtcgagcatgccgtaacaatgtcagtagagctcccaacaagcagcatcgcaaaatgagagacgcccaactcaagttggaatccaaccctaacgacccttcactgcgcgcaagcgtggctggcttaaagcgccacctgggactgctcgacgataagaatcgggatcagcaccggagtgaagccaggcaaatattaaaggctaggtga

SEQ ID NO: 10414 - RNA, 960 nt, unidentified
  source 1..960: mol_type = other RNA; note = synthetic construct
atgaatacacctagaaccaagaagaccacgcccacccaaaagcgtactgagcgatacgcgatagattcatcccctctgtatgggatgaccagccacactcggttagccgctatactccgctgggcagggactacaggccagttacgcgagttttgccggcggccaactaacttttccaggtacatcgacaggtccaaacctggcaaagaaaggcttatcgaggctccggcaaaatctgcgaagacatttcagacccgattcctggagctcctgagaagaattgaactccccgattatctgcacagtgctagatcaggccggtcttacctttcaaactctgccacacactgtgaagccgatgggtgcacaatcaccatggatatcgatagcttctatcagtctgccacacgggagagagtgatccacttcttcgaggtgcacctgaagcagccacgggacgtggctgaaaccctggcaagcttgttgtgttgcgacggccatttggctactggttcgcccgccagcccactggtttccttttgggcataccgcgaggtatttgacgctatcgatgaacgagtgaggtccagaggaggtgtgtttacgctctatattgacgacatgggcattactggtaaaggattcgggcatacagacgtcgggtggattagccgtcttctgaggaaggccggcctgacggttaaagaaaccaagacacgagtattccatgcagacgcaccaaaactcgtcactggcagagcctgtcgcaacggagtcagtagggctcccaacaagcagcaccgcaagatgagagccgcccagacccaattggagctcaatccgaatgaccctggtctgagggcaagtgtggcgggacagaagcggcatctggccctactagatgacgctaatcgcgatcgtcatcgggccgaagccgagaggcttaccaaaggacgctga

SEQ ID NO: 10415 - RNA, 969 nt, unidentified
  source 1..969: mol_type = other RNA; note = synthetic construct
atgagtacccctaatcctaaaaaacacccccggcctaagcgcaggaccgaatgttatgacgtcgctgactcacatctacacggcctcgagagccacagtcgactggccagcatcctttattgggccggaaccccctcgcagttaaagactttcagccggcgggaggacaactactcacgatacacagacaagtctaaggcaggaaaggaaagactgattgaagctccggcagagaggctcaaggtgttccaagctcgaatactggatctgctgtctcgcatcaagcttccagactatgtccacagtgggagaatcgggcgctcctacctgtccaactctgccgcacactgcagcgctgatgggtgcacgatcacaatggatattgaaggcttttaccaatcagtgactctgcagagggtcgcccgctttttcgaggtctggcttaaatgcagcccagacgtgtctctgactctggcacatctgttgtgttgtgactggcacctagctactggctctcccgcgagccctctcatgtccttttgggcatacagggaggttttcgatgcgatagacagtcgggtacgtgctagaggaggcgtgtttaccctgtatattgatgacatggggatcacaggcaaaggattcggccacaccgatgttcagtgggtttcccgattactgcgccggtacggtcttaagattaaggaagcaaagaccagggtatttcatgccgaccgtcccaaattagtgacaggacggggtatgagacacggggtgtccagagcgccaaataaacagcacatgaaaatgagacaggcccaggccctgctagaggccaatccgaacgatccaacgttgcgcgcttcagtcgctggtcatcgtcggcatttggccctcttggatgatgagaagagggcccatcatagggccgaggctgccagagtgtccaggctcaaactcaaagtgtga

SEQ ID NO: 10416 - RNA, 939 nt, unidentified
  source 1..939: mol_type = other RNA; note = synthetic construct
atggcaagcaagcaaacaaattccgctcagagatatggcgtgggcacttccccattgtacgggattcaaagcaagaggcgactggccgaagtgctcttctgggcaggccccacttctgctctggcttccttcgccagggatcccgataactatgcacggtacatcgatcggaggagaagtgaaaaaccgcgccttattgaggcccctcaggcaagactcaagggatttcagaaacgggtagaagatctgctcaagcgaaccgtcatgcctgactatctacactctggcatcccagggcgatcataccttacttgctcagcagcccaccgtgatgctgccggctgcacagtcacaatggacataagcgatttctacctgtccattagtcaggacagagttaccaggatgttcatcgtgctcttcgcctgtacccgagacgtagcagaggtgttggcccagctcttatgttgcgacggacacctggcgactggctctcctgcttcgcctctgctcagcttcctggcgaataaagagacgtttgatcagattgctgcacatgccggacgccggtctggtgcttttacactttacatcgacgatgtggcccttaccggaaagggcatcggtaccgctgaggtcaaatggattacaaggctgttgaaacgttcagactttacggtcaaaagaagcaagaccaagatctttcgtgccagtcgcgcgaggctgatcactggtcgcgttctgtatggagggcaatcaagggcccccagtcgccagcatcagaaaatgaaggcagctatagaggcttccaacgccttaccaaaggacaaggccctgaaagccagcgcaatagggcgggtgcggcatgttgcgctgctagacgacgtgagacgcgatgggatgcgggctaccgccaaaagattggccccacccaagtga

SEQ ID NO: 10417 - RNA, 981 nt, unidentified
  source 1..981: mol_type = other RNA; note = synthetic construct
atgaacccgaaagttaggacgaagaaagagcgtttggagaaacctctgaaacagtatgctcctgatcagtgtgcactatatggcataaagggggtaggtcagttgatgcgggtcctaagatggcggggaaccagggccgaactggaagccttcgatagagcccccgggagctaccgcttttgggcgaacgaacagggtcgtgagatacaggccgcaggggcagagatgcgcaagttacacgctagggtagccgtactgctgcggcgcattatgccacccgaataccggcaatcaggcgtgagaaaacgatcattcctgacaaacgcccagttccacacactggatgaaccaagcgtgaagctggacatcaagtccttttacccatctacgaccttcgcacatgtgcggcgatttttccagaacgacatgaagtgcgccggggatgttgcttttctcctcgcaaagatgtgctgcgtgaatcagaggcatctgccaaccggcggagtccactccgaggtgcttgcattttattgtcacaggaacgcattcgagcagctttaccaaagagccaaggcccgtggaggcgtcatgaccgtgtatgtggacgacatcatgatgactatgcccagagctagcctcaccgatcttgaatgggccagacgcctgttcgcgaatcacggcatcaagattcaccccggcaaaagtaaggtgctcgctaaagctaaaaggaagactattactggggtcgatatccatcgcggcaaaatttccgcccctaaggctcagcaccaactgatcctgcagcgacacgttgagctgaatgccgctgtcaatccgactcttgcagttaccgccgcgcggtctttgctcggacatctcgaccatgtggcccaaatcgagcctcgctttaggagtagagctgaaggaacacgagcctggttggccgcagtgttagcggagacagacgctcccggtgagtga

SEQ ID NO: 10418 - RNA, 963 nt, unidentified
  source 1..963: mol_type = other RNA; note = synthetic construct
atgaagatgcccgttcgaaaaaagaaacagcgtctcgaaaagcctcggaagcagtacagaatcgaccagtgcgccctctatggcctgaagggggtcggtcagctgatgagagctctgagatggacaggtacacgtgcagcactcgagggattcgaccaggccaagggttcttataaggcctgggctaatgagacagggcgagaaatccaagccgcaggcgccgacatgaggaagctgcaggccaggatcgcagtcttactgcgccgcgtgatgccaccagattatcggcaatccggtgtgagggaccggagtttcctgaccaacgccaagctacaccgagcggatgagccgagcatcaagctggatataaagtcattttacccatccaccacttttgcccatgtgcgcaggttcttccaccaggagatgaaatgtgccggcgacgtagcctttctgctggcaaaactatgttgctaccacaggaggcatctcccgaccggcggagtgcactcagaggtgctcgctttctactgccatcggagagctttcgagcagctgtacagacgagccaaagggcgcgggggggaaatgaccgtgtatgtcgacgatattatgatgacgatgcctggcgcctctttaacagacctggaatgggcccggcgtctttttgcaaaacagggcgttaagatccaccctggcaagagtactgtgcttacaaaggacaggccaaaaactattacgggagtaactatacacaggggaaaactccaggcccccaaagcgcagcaccatttgattcggcaaaaatttgaggatcttgctaaagctgaggatcccgcggcagctaccgctgctgcaagaagcttgatcggacatctggatcatgttgcgcaaattgaacctcaccttagagacagagcaaacggaactcgcgccttgttgcggcgcaccttagctccctga

SEQ ID NO: 10419 - RNA, 987 nt, unidentified
  source 1..987: mol_type = other RNA; note = synthetic construct
atgaccaccgtgcaaaagcgaaaaaaacctcctcgcctagagacaccaaagaaacagtatgctctgaccgactgcgccctctcaggcattagaggaatcggccaactgctccatgtgcttcggtgggagggctcccggcaggaattggaggacttacccgccgcccagggatcatataaggtctggcgcacggaccagggtcgagcaatccaggctgtgaatcttaaagaagcgaacggtagcaaactgagacagatacaggccaggatcgctgttttgctgaggagggtcctgcccccggaataccgacattcgggtgtcagggggcgttcttttataaccaatgctcaacagcacctccaggatgatccaagtatcaagcttgatattaagtccttctaccctagcactacattccaacatgtccggcgtttttttgtagaggcaatgagatgcagtggtgacgtagccttccttttagctaagctatgctgttaccagcagcgccacctgccaacaggcggagtccacagcgaagtggtggccttttactgtcacaagagatccttcgaccagttgtgggaacgcgtgaaagccagaagcgggaagatgtcagtttatgtggacgacattatgttgactatgcctaacgcctccttaactgacctggagtgggcccggcgtctgtttgcaaagcagcgggtaaaaattcatccaggcaagtctaaggtgctgagtaagaggagcattaaagtcatcacaggagtggagattcggggagggaaaaccggggctcccaaggagcagcacagactgatcaaacaaaggttcgacgaaatccgcgcagctgcatctgcagatgagctggccggggcagtgaagtctctcctcggccacctcgatcatgtggcccagatagatccccgcttcgttaatcgggcgagaggcacgagggcgcgactgaaagctgttatcgatcacaactga

SEQ ID NO: 10420 - RNA, 972 nt, unidentified
  source 1..972: mol_type = other RNA; note = synthetic construct
atgacaaaaacgatcaggaagagtaaacgccggagacagcctcgcttagaaaagcccaagaagcagtacgccctccatgactgtggattgtatggccttaaaggcctgggacagctggcaaaagctctgcagataactcaggatgagttggacgaactggcgaatctccgtggcggatatacagtctggaatcagaatgggagggccgttcaacaagcaaggccagcgctaagaaagatacacgccaggattgccacccttctgcgaagggtggcaagcccagactacagacactccggcgtccgtgacagaagctttatcagtaacgcagcgcagcatatcgctcctcacgccagcctcaagctcgacatctctaagttttacccttcgacctcagtccaccacgtgtggaaattcttcttcaggaaaatgcactgcgctcgagatatcgcagcaatcctggccgggctctgttgcttcgaacggcggcacctgccaaccggtggagttcattctgaggtgctggccttttactgtcacaaagacatgctggattcccttaacgagcgcgtggtgagtcgtggtggcgtaatgactgtgtatgtggacgacatagtggtcacaatgccaggggcctgcgagtcagacctacattgggctcagcggctgattgccagagccagattggctatgaatttacgcaagtcccgggtaataaacgccgataaggagaagcttattacaggagttctcattcgcaggggcaagatctctgcacccgcaggtcagcataagaaggtcaagctcttacatgaagccattggctccgcgaccgctggggatgatgtgactccgcaaatccggtcattgcagggtcacctggatcatatcgcccaaattgatcccaaatttctgagcagagctaaagggcaccgcgctaaaaaccgacttgctctgctgcctcccatttga

SEQ ID NO: 10421 - RNA, 960 nt, unidentified
  source 1..960: mol_type = other RNA; note = synthetic construct
atggcacggttggaacagctggatcgtcctaaatacgcaatgaccacaagccccctatacggaattcgctccaggaagcggctcgtcgaagtacttgattggcagggatccgtgaaagccctggacggcttcgtggaacaaccagataactacaactgtttcctgcatgaggaggatggcaaaaagcccagaccagtccaacagcccacacccaagcttgaggccctgcatcgccgagtagcccggctactcttaagaatcttgcccccagactatttacactcaggcctccgcaagaggtcgtttgtgaccaatgccgcccagcatgtgaatgggcaccctgcggtgaagctggacgtacacaagttttatccttcaaccctccatagccatgtctgtgggttcttcaagaaccagatggcttgcgcaccagacgttgccggtcttctggcctctctctgttgcgtgactgtgaatggagtccgccacttgccgactggatccccactcagccagattttggcgttttatagtcaccggcagatgtttgacgagttaagtgcctatgttgccgcccgaggcggcgtcatcaccgtttacgtggacgacattacagcctctatggagttcgcctccgtgggagatatcagggcgatggggaggatcatcacgcgccacgggctgatgtggcacaaggaaagatttttccctaggggtcattcaaaagctataacaggggcaattgctaaagtcgaccaccttgaggccccgaagaaacagcatctgaagtacgctaccgctcgtgaccgagtggatcaccctagcctgctggtggctgatcaaaaacaggcggcacggtctgctatcggcctgctgcaatgcattgcacagatcgatgaaaggcagataagagtggcaagaggtatggctcagaaactcactgctgttgcaggcctgtga

SEQ ID NO: 10422 - RNA, 933 nt, unidentified
  source 1..933: mol_type = other RNA; note = synthetic construct
atgaaaaagatcaagtccccatacgcaatcaaccagtctcctctgtataagatttattctctgaagaagctgtgcgaggttctcaagtttgatcgcaaggtcatcgccaaacttctcaaatcacaggataactataagaagttccatcagcatgatggtgctaaatcgagactgatcgaataccccaagccgaggttggaggccgtgcacaaaagagtcttcagcctgctgagcagaataacaactcctgaatacctacacagtggcgtgagcgggcgaagctacatcacgaatgcacaacagcattcctccgctctggccgggtttaagttggacattaaaagtttcttcctgagtaccaccaccgatcacatttacaagttgtttcggttctcctttggatgtagttttaaagttagccagacgcttgcatctcttctgtgcgtatccggccatctacccactggatcttgtgcctcccaggtcctcgcattcttcgctcataaaaaaatgttcgacaaactggccaagacagtgaatcagtttggcggtaaaatgaccttatacgtcgatgacttgtatgtgtcaatacagtacgtgaaacggtggcacatccggagactcgaccgaattattaggggaaacgggctgtttgcgcacaaaggccgtgtctatcagcgggttaaacccaagttgatcacaggcgtaatcctcattgatggtaagatgaagctgcctcacgcgaagcacagaaagataagggacactaggaatgccgcccggatttgctcatccaggtcacagaaaagcctcctcatgcgcagtcttgtggggcaacttacaaccggatcattactggacccatctttaaagagccgcgtgaagccagctcgttcttatctgcagcgcctggagaagcaacaccaagtgtga

SEQ ID NO: 10423 - RNA, 951 nt, unidentified
  source 1..951: mol_type = other RNA; note = synthetic construct
atgaagaagagaaaaaagcttaagatcagcacgaagaacaagtcttacggcgtgatggacagtccattctataagcttaagtcgaaaaagaagctggccggcctgctctgcatttcagtcaacgatctgtccattctcaaaaacgatgagggtaattacagcgttttcgaccaattatccaaaaaagggaaatcccggaagattcagaagccgctggacaaactggatatcgtgcatactcgtatcgctagcttactgtccaggatcgcattgcccgagtatctgcacagcggaaaaaagcggtgttcaaacgttactaacgccaaggcccaccttaatcacgaaaaaatgatgaccaccgacattaaggcattctttcctagtaccacgagaataatgatcttctcctttttcttctctgtgatgaagacttccagtgacgtcgctgacatcctgtcacacatttgcacctgtcatgatcgattgccaaccggatctaggatctcaatgcccctggcttattttgccaacagtcgcatgtttggtgagatgtacgaactatgccagaagctcaaagtgaaaatgacagtgtacgtagatgacctcacattctcgggcgccaacgtgaatcgactattttgtgcggtgataaggaaagtcattagcaagcacggacacataatgcatcccaccaagactaagctctacgccaaagataaacctaaattggtcaccgggatcatagtactgggcgatgcattaaaggtccgcaatgagcagcatagactgatggctcgcgacattgaatactggaaaatcattaaagacgctgaaaatgcaaaggagacaagcatcgccaagacactctttgggcggctgcattctatgggcgttatcgagcagaggtataagagcaaggtgttgactcttaaagtgaatacagcgtcttga

SEQ ID NO: 10424 - RNA, 951 nt, unidentified
  source 1..951: mol_type = other RNA; note = synthetic construct
atgaaaaaacggaaaaagctcaaagtaaacacgaagaacaagagttatgacatcatggacagccccttctacaagttaaaatctaaacggaagctagctaatctgctgtgcgtgtctttagaggagctatactcccttcggaaagatgaaggcaattattccgttttcgaacagctctcgaagaagggaaaagcgagaaagatccagaaacccttggaaaaactggaactggtccacacccgaattgcaagcctcttaagccgcatcgccctgcccgagtatctgcactcaggcaagaaaaaatgctccaatgtgaccaatgctaaagcccatctgaacaacgagaagatgatgaccaccgacatcaaggccttctttccttccaccactaggggcatgattttctcatttttcttcagtgtgatgaagatgagtagcgatgtcgcagatgtactctctcacatctgtacttgtcacgatcgtttgccaactgggagcagaatttcaatgccgctggcttactttgccaactcacgcatgtttggtgagatctaccaactttgccaaaagttgagggtgaacatgacagtttatgtcgacgacctcacgttttccgggggaaatgtgaacaggctgttttgtgctgtgatccgcaagattgtgaacaagcacggtcacgtgatacatccaaccaagacaaaactgtacgcccgtgataaacctaagctggttacaggagtgatcgtctttggcaatgctctcaaggtgcgaaacgagcagcatttcttgatggcgagggagatagattactggaagataattaaagacgcagaaaacgcccgggagacaattattgcaaagaagcttttcgggagactgcatagcatgggcgtcatcgaacagagatataagtctaaggttctgacacttaaagccaatactgccaattga

SEQ ID NO: 10425 - RNA, 951 nt, unidentified
  source 1..951: mol_type = other RNA; note = synthetic construct
atgaaaaagcggaagaagctaaagatctttacgaacaacaagagttacggggtgatggactccccgttttacaagttgaagtccaagaagaagctggcctgcttactgtgtgtagacaccaatgatctctatgcactcaagaaggacgagggcaattattctgtctttgagcagttgtctaaaaagggcaaaccccggaagatccaaaaacctgttgacaaattggatgttgttcatacaaggattgcgtcacttctatctcgaatcgctcttcctgaatatctccactcgggcaagaaaaaatgtagtaacgtcacgaacgccaaagcccacctcaaccatgaaaagatgatgacatccgatatcaaagcattttttccatcaaccacccgcagtatgatcttctccttcttttttagcgtgatgaagatgagcagtgacgtggcagatatactgtctcatatctgcacctgccacgagagattaccaactggatcacggatcagcatgcctctcgcgtacttcgctaattccaggatgttctgcgaaatagacgagctgtgcaggaaactgagaatcaagatgaccgtgtacgtcgacgacctgacattcagcggggccaatgtgaatcgcttgttctgtgctgtagtgagaaaggtgattagcaaacatggtcacaatatgcacccaactaagacaaagctctatgccaaagacaaacccaaacttgtcaccggggtcattgttttcggagattgtcttaaggtgaggaacgagcagcaccggctgatggctagagatatcgagtactggaagattattaaagatgccgaaaatgcccgtgatactcccattgcaaagactctgttcggacgcctgcattcaatgggtgtgattgaacagcgatacaaaagcaaagtgctgacactgaaagtaaacactgctatatga

SEQ ID NO: 10426 - RNA, 951 nt, unidentified
  source 1..951: mol_type = other RNA; note = synthetic construct
atgaagaaaagaatcaagctaaaggtgagtaccaaaaacaagtcataccccattacagatagccctttgtacaaactgaaatcgaagaaaaagcttgctaacctcttatgtgtgtcaattaatgatctcagtgctcttaaacgcgacgagggcaattacagcatctttgaacagctgagcaagaagaataagattcgcaagatccagaagcccctggaaaagctggatgttgtccataccagaattgcctctttactgctgagaatcgccatgcctgagtacttgcactctggaaagaagtcctgttccaacatcaccaacgcaaaagcacacctgaaccaccaaaaactgatgacgactgacatcaaatcattcttcccaagtacaactcgcgagatgatcttctctttcttcttcagcatcatgaagatgtccccagacgtggcggacattctgtcccacatctgcacatgtcatgaacgtctgcctaccggcagccggatatctatgcccctggcttattttgccaatagcaggatgtttgacgagatgaaccagctttgcgagaagttcagggtgaagatgaccgtctacgtcgatgatctgacattcagtggggacaatgtgaacaggttattttgctctgtgattcggaagataatcaataagcatggccacgtgatgcatccaactaaaactaagctttacgctggggataagccgaaactcgtcaccggggttatagtgtttggtgactcactcaaggtacgaaatgagcaacactatctaatggcacgggaaattgagttgtggaaaatcattaaagacgtcgagcaggccaaagatactaggacggccaaaaagctctttggtagactgtattccatgggagtaatagaaaaacggtatcgaagcaaagttctcacattgaaagccaacacctccgtgtga

SEQ ID NO: 10427 - RNA, 951 nt, unidentified
  source 1..951: mol_type = other RNA; note = synthetic construct
atgcagaaaccaaagaagttgaagatttcgacgaagaataaaagctacggaatgatggacagtccattttacaaactcaagtctaaacgcaagcttgccgaacttctgtgtgtgagcctgagtgacctgtccgcactgaagaaagacgaggggaattattgcatattcgagcaactctcaaagaagggaaagctgcggaaaatccagaaacccctggacaaactggatattgtccacaccaggatagcctccctcctgagccggattgccctgcctagctacctgcacagcggaaagaagggctgctctaatgtgaccaacgctaaagcgcacttaaacaacgataagatgatgacaacagacattaagtcgtttttcccttccacaactagggtcatggttttctcattcttttacagcgttatgaagacatcttctgacgtggctgatttcctctcacatatctgtacttgccatgggcagctaccgaccggatcaagaatctccatgcccttagcttatttcgcaaatagtcgaatgttcgacgaaatatatcagctatgtcaaaaactcaccgtgaagatgaccgtttatgtggacgatctgacctttagtggtgcaaacgtcaacaggcttttctgtgctgtcattgggaaaatcatcaataagcacggtcacgccgtgcatcccactaagaccaaaatgtacggcaaagagaagcctaaattggtaactggcgtgattgtactgggcgattcccttaaggtgcgcaacgaacagcatagattaatggccagagacatcgagtgctggaagatgatcaaggatatggaaaaagcgaaagagacatcctttgccaagactctctttggccggttgcactctatgggggttatcgatcagcgttacaaaagcaaagtcctgacgttgaaggtgaacacagcaaattga

SEQ ID NO: 10428 - RNA, 951 nt, unidentified
  source 1..951: mol_type = other RNA; note = synthetic construct
atgaaacggaggatcaagttgaagatcagcaccaagaacaagagctatgacattatcgactcgccattttacaagatgcggtccaaacgcaaactcgcatcgctgttgggagttgacgtaggagatttaagtactctcaagaaagacgaggggaactactctatattcgaacagctgtccaagaacggcaagcccagaaaaattcaaaagccgctggaaaagcttgacgtcgtccacactcggatcgcctccctcctgagcaggatcacgttacccgactatctgcactcaggaaagaaaggttgctctaacgttacaaatgccaaaattcatctgaacaatgagcgtttaatgacaaccgatatcagggcgttttttccatctacaacccgcgagatgatattcagtttcttcttctccgtaatgaaaatgagctctgacgtggctgacgtgctttcctacatctgcacctgttacggccggctgcctacagggtcaaggatttccatgcctctcgcttattttgctaattcaagaatgtttggcgaaatccatcagctttgtaataaactccatgtgaacatgtctgtgtatgttgatgatctcactttttctggccagaatgttaatcgcctgttctgcagtgtcatcaggaaaataataaacaaacacggtcatgtgatgcatgccgataaaaccaaaatttactcaagagagaagcccaagctggtcacaggagtgattgtgttgggcggttcccttaaggtgagaaataaacaacacttgctgatgagtcaggagattgaatactggaagatgattaaggatgctgcatgtgcacgagagactcacactgccaagaagctgttcgggcgcctgcacagcatgggggtcatcgaacagcgatatcgtagcaaggtgctaaccctgaaagccagcacggccctatga

SEQ ID NO: 10429 - RNA, 951 nt, unidentified
  source 1..951: mol_type = other RNA; note = synthetic construct
atgaagaagagaaagaaactcaaaatctcgacgaagaacaaaagctattccctcaatgattcccccttcttcatgttgaagtccaagaaaaaactggccaccctgttagggatcaccatttccgacctgtctctattgaagaaagacgacgagaattacagcatcttcgaacaactcagcaagaagggtaaacctcgtaagatccagaagcctctggatgcgctcgacattgtgcatacacgaatcgcctcactcctgtcgaggatcgcacttccggaatacctgcatagtggaaaaaaaggcaggagcaatataaccaacgcccatgcacacctcaacacctctaagactatgacgtctgacataaaggcttttttcccaagcaccactcggcacatgatttttagcttctacttctcagtaatgaagatgagttcagatgtggctgacgtgctgtcccatatctgcacttgttatgggcagttgcccacaggatctcggatctccatgccactggcatttttcgcgaatagtagaatgttcgacgaactcaacgccctttgcaatacgctgaaagtcaagatgactgtctatgtggacgatcttaccttttcaggggataatgtgaaccgactattttgttctgtagtgcgccgcattatttacaagcacggtcacattatgcaccccaccaaaacaaagttatatagcgagtatatgcctaagctggtgacaggcgtcatcgtcaccgccggatgcatgaaagtccggaacgagcagcacaggttaatggctcgggacatcgagtactggatgcttattaaagatgcagatcgcgccagagaaacttccgttgttaaaacactgtttggcagactgcatagtatgggcgtgatagagccaaggtacaaatctaaggttttgacactgaagatgaacactgctatatga

SEQ ID NO: 10430 - RNA, 951 nt, unidentified
  source 1..951: mol_type = other RNA; note = synthetic construct
atgcgtatcaagccgaaactcaaaatcattactcgcagcaaagaatataacttaacagactcccccttgtataagattaacagcaagcgcaagttagctaagatcatcaacgtggatttcaacaccctgaagtctctgaaggacgataagatgaactacagtatatttgaccaggtgtcgaagaaaggaaaggtaagaaaaatccaaaagcctgtgcagagactggatatagttcatacgaggattgccagtctactgtgcagaattgctacgccaagttacttgcactcaggcaagaaacaccattctaatatcacgaatgctgacgtccacaagaacgagttcaatctcctcacaactgacatcaaatctttctttccctccacaaaacggtcaatggttttctcctttttcctcaccgtcatgaaaacatcccctgatgtggccgacatcctgagtcatctgtgtacctgtcacaaccacattccaaccgggtcccggattagcatgcctctggccttttgggcaaacgtgaggatgtttgaggagctgaaaaggctttgcagcaatcttgacatcaccatgaccgtatacgtcgatgatatcacattcagcggggagaatgtgaatagactgttcgtgtcatgtgtaaagaagatcattgtgaagcatggccaccaaatgcatcccaccaaaactaagttttataactctacagcacccaaattggttactggcgtgattgtcgtttcaaactgcctgaaggtccggaatgagcagcaccagctctttgcaaatgagttcgaacagtggcgaataatcaaagaagaaccacacgcgataaacgccaacattaccaataagctgatcggaaggctttactctatgggtgtgattgagaaacgattcaaggaaaaagtgcgcactgtcaagaatagcactgccctatga

SEQ ID NO: 10431 - RNA, 951 nt, unidentified
  source 1..951: mol_type = other RNA; note = synthetic construct
atgaagtctaaaccaaaactaaagatcagcacgcgtgataaaagttataatttgatcgactcccccctgtacaaattgaagaacaagaagcggctggcccagttgctgaatatcaacctgtgcgattttcggaccctcacctcagatgacgaaaattattctgtgtttgaacagctgtcaaagaagggtaaagttaggaagatccagaagcccgtgcacaagcttgacgttgtccatacaagaatcgctagcctaatttgtagaatacaaactcccctctatctgcacagtggaaagaagacatgctcgaatatcagcaacgcatctgctcatatcaacgaattaaacttgctcaccacagacattaaatcattctttccttctaccacgcggaatatggttttcagcttcttctactcagtcatgaaaacttccagcgatattgcagacattctgagtcacatttgcacatgtcacggtcatattccgacagggtccaggatttcaatgccactggccttttggagcaacataaggatgtttaccgagctcgagaacctcagtctgtccctcaacgtcacaatgaccgtgtacgtagatgacatcactttctccggcgagaaagtcaatcgcctgtttatgtcctgtatgcgaaaaatagtggctaagcacggccatcaggtgcatccaaccaaaaccaaactgtacggcgcaaaattacctaagcttgtgactggggttatcgtgcactctaatgtgcttaagattcgcaatgagcaacacctgttactcagcagggagctggaacagtggcgcatcattaaggatgagccttacgccatcaacgccaatatcacttctaagcttgtgggacgactgtattccatgggggtaatagaacagagatacaaagagaaagtcagaactataaagagtaacacggcgttctga

SEQ ID NO: 10432 - RNA, 954 nt, unidentified
  source 1..954: mol_type = other RNA; note = synthetic construct
atgaatagaaagagcaagctacggatcaacactaagtgtaaatcctatcagctgcaggacagcagcttttataaactcacttcaaagaagcgactggcctcaatcttaaatttgtccctgcagaacatcaatagtctccgttgcgatttgggtaactacacagagttcgaggagctgggaaagagtgggaagccaagaaagattcagaagccatgtcatcggctagatgtagcccacacgaggatcgctagccttttgtgcaggatccagacccccacatacctgcactctggaaaaaagagccactccaacgtaactaacgcggcatcccacgttaattttcatcaattactggccaccgatgtgaaatctttcttcccttcgacaagcagaaagatggtgttctccttctttctgaccgtgctcaagtgttctcctgacattgcagacatcctggccgacatatgcacctgtcacaatcatattcccaccgggagccgaatttcaatgcctctggcttattgggcaaattgccgcatgtttgaggaattagagcgcgtctccgacaaacaccacgtgacgatgacagtctacgttgacgatctcaccttttctggcgaaaaagttaaccgccagttcaggtctttggtcaagaagattatctcgaagcatggccacactatgcacccaaaaaaaacaaagctttaccaggggtcacaaccgaaactcgttaccggtgtgatagtgtcagatggcgtgctcaaagtccggaacgaacagcatcttatgtatagttccgagctggctcaatgggatagtattaagaatctgcccctcgccagtgaaactaacctggtggcgaaacttataggcaggctgcattctatgggagtgattgacaccaaatacaaagccaaggtcaagagcatcaaaaatgctacatgctccgactga

SEQ ID NO: 10433 - RNA, 954 nt, unidentified
  source 1..954: mol_type = other RNA; note = synthetic construct
atgaatctgaagtcaaaactgaagatcaacacaaaacagaagtgctatcctctgaatgactcaccactgtacaagctgaagagcaagaaaaaactcgcaagtatcctgaaagtccaactgcccgaaattctggcgctgagatgcgatgacggcaactatgccgagttcactgagctcggaaagagtggtaagccacggtccattcagaagccgtgctacaagttggatgtgattcacacgaggattgcatcactattgtgccgaatcgagaacccacccttcctgcatagcggcaagaagtttcacagcaacgtgactaatgccgccacacacgccaattcgcatcaacttctagcaaccgatgttaagtcatttttccctagtacctctcggcccatggtgttctcctttttcctcactgtgttgaaatgtagtccggatgtagctgacattttggcagatatatgtacttgtcacaagcatctccctacaggaagcaggattagcatgcccttagcttactgggccaactgtaggatgtttgaggagctccagcgcatttcccttaaacacggggtcaccatgaccgtctatgtagacgatcttaccttttccggccaggctgtgaacagaagattcaagtctctcgttaagaaagtggtgtctaagcacggacacatcatccatcctacaaaaaccaaactgtataaagggacccagcccaaattaataactggggtcgttgtggtggacggcgtgcttaaagtccgtaatgaacaacacctgaagtacagcagcgaactcgcccagtgggactcgatcaaggacttaccagccgcttctgaaacgaaactggttgcgcagctgataggccgcttgcattctatgggtgtgatcgatatgaagtacaaagccaaagtaaagtccatcaagaatgctacatgctccgactga

SEQ ID NO: 10434 - RNA, 951 nt, unidentified
  source 1..951: mol_type = other RNA; note = synthetic construct
atgacacgtaactctaagctcaagctggaaactaagaataaatcgtatcccctgcaggactcaccattccataaactcacctccaaaaagcaattgagaaagctgctcgacattgattccgaaaaactgaagaagctccggcaggataagggtaactacagcgaattcgaggacgtgagcgtgagtggcaaggcccgcaagatccagaaacccacgagggagcttgacgtcgtccacaccaggattgcctcattactttgtcgcataagcacacccgattacctgcactctggaaaaaaacagcactccaacgtgaccaatgctcgacagcataagaatgagtatgctctcctcgcaactgatgtcaagagttttttcccttccacaacgtggaatatggttttcagcttcttctatggagttatgaagtgctctagcgacgtgtctgaaattctgtccgatctgtgcacatgccataagcacattccaaccgggagcaggatatctatgccacttgctttttgggccaacatccggatgttttcagagctggactgtttgagtaataaacatggggtaactatgactgtgtatgtggacgacctgacattttcaggaagagaagtgaacaacttattcagatccagcgtaaaaaaaatcatcaacaagcacggccatatcatgcacccgactaaaaccaagttgtacaaacctaatcagcctaaacttgtgaccggggtcgtggtcaacggcggtcacctgaaggttcgaaatgagcagcactttaagatgcaccaagagctacagatctggtgtaaaattaaagatactccttacgcactgtctagttccataacgagtcaactgctaggccggctgcatgcaatgggcacaatcgacgatcgctttaagcagaaggcgaggaccattaagttgtcaaccgccccctga

SEQ ID NO: 10435 - RNA, 951 nt, unidentified
  source 1..951: mol_type = other RNA; note = synthetic construct
atgacccgaaagagcaagttgaaacttgaaactaagaataagtcctacccactacaagacagcccatttcacaagttgacctctaagaaagtgctgcggaagctgctcgatgtagacgcagataaactcaaaaaactgcggcaagacaaaggcaattattccgagttcgatgatatcggggagtccggtaaagctagaaaaatacagaagcctgcgcgtgatctggatattgttcatactcgcattgccagcctgctgtgtaggattagcacgcctcagtatctgcattcaggcaagaagcagcatagtaacataacaaatgcccggcaacaccagaataaataccctttgttagcaacagatgtcaaatcattctttccaagcaccacctgggacatggtattttcgttcttttacggagtcatgaaatgtagctccgacgtcagcgaaatccttgccgacctgtgcacttgccataaacatatccccacaggctccaggattagtatgccccttgccttttgggccaacatccgcatgttctctgagctagaggctctttctacaaagcacaacgtgaccatgacggtgtatgtggacgacctgaccttttccggaatgcaggtgaataagctgttcagaagttctgccaagaagatcatcaccaagcacggtcacataatgcaccccactaaaactaagctctacaagtcaaaccaggcgaaactggttacaggggtggtggtcgaaggcgagagtattaaggtcaggaacgaacagcaccgaaaaatgcatgaggagttaggcgtgtggttcgaaatcaaggatatgccgtatgctatgagttcatctattacttctaagctcttggggagactccacgctatgggaacaatcgacgacaaattcaagcagaaagcaaaaaccgttaagaagtccacaacgtcatga

SEQ ID NO: 10436 - RNA, 951 nt, unidentified
  source 1..951: mol_type = other RNA; note = synthetic construct
atgagccggaagtctaagctcaagatcgacacaaagaacaagtcgtacagcattatcgactccccgttctacaagctcttctctaagaagaagctggcgaccctgctcaagtgtgacctgagtgagcttaaaaaattgcgggatgacgaggggaattacagtgaatttgaggacattggaaaatctggcaaacccagaaagatacaaaaacctagccgcaatctggacatcgtacatacccgaatagccagcttgctatccaggatttcgacaccaacttatctgcactcagggaagaaagagcactccaacgtgacaaatgccaaggcccacctggaaacctccgctttgatgaccacagatatccgttcctttttcccctccacttcacatcggatgatctttagtttcttctacggtgtgatgcagtgttcatctgatgtggctgaactgctcgctgatctgtgcacatgccataagcacctgccaactggctcaagaatttcaatgcctctcgcctattgggccaactgccgaatgtttgaggagcttaattccctctcctctaaacatggagtaacgatgacggtttacgtggatgatttgacgttttcaggctctaaagtgaataaacttttcactagcaccgttaacaagatcataagtaaacacggccataccatgcacccagcaaaaacaaagctgtattcctctcatgagcccaaactggtcaccggggtcgttgtcgacaagggcgtcttaagggtgcgcaacgagcagcacctgaagttattcgaagatattagcctatggagtttcatcaaagacgaaaagtatgcacttggttctagtatcactagcaaactgattggaagattacacgctatggggaccattgaacctcgctttaaaagcaaggcaaagagcgtgaggaacagcactgccatgtga

SEQ ID NO: 10437 - RNA, 945 nt, unidentified
  source 1..945: mol_type = other RNA; note = synthetic construct
atgtctcagaagttaactctcaacaataagaacaaggcctatcaactgacagattcccctttccataaactgagtagtaaaaagaagctggcaattttgctgcgaaccccattgtcccaaataagaagcctcagagccgatagtggaaactacagcgaatttgagtccattggcaaaagcggcaaaataagaaagatccagaaacccagccgtaatttggatgtggttcacaccaggattgcttctctgttaattcgcattatcactccagagtaccttcacagtggtaagaagggctactcaaatgtgactaatgccaacattcatctgaacacaaatgctctaatgaccagcgacatcaagtctttctatccttctacatcctggaatatgatattctccttcttttacagcgtgatgtcatgctctgcggacatcgcagaaattctggctgacctgtgcacttgtcacaagcaccttcccactggatcgcggatctcaatgccacttgcctactgggcaaatgtccgaatgttcaacgagcttgagaatatctgtcagaaacacgacgtgataatgaccgtatatgtggatgatttgacgttttccggaaagaatgttaacaggctgttcaagtcaaccgtcaagaagatcatcagccgctacgggcatgaaatgcatcccacaaaaactaagctgtatcctccgaacgggaccaagctggtaacaggggtcgtgattgacaggaacaatctcctggtgcggaacgaacagcattttaagctatttgaggaactctctatgtggaactcaatcaaaaataaccagtacgccatctcgatgtccatcacctccaaactcatcggccggctccacagtatgggtacgattgagcccaaatataagaccaaagccaaaagcgttcgcaaatctacagctatatga

SEQ ID NO: 10438 - RNA, 951 nt, unidentified
  source 1..951: mol_type = other RNA; note = synthetic construct
atgcctaaaacgaaaactaagctcaaaatcgacaccagaggcaaattttacgctctcaaggatagtccactttataaactgagaacaaaacgcagactggcggaggtgctgaaccactcgcttcagaccttacgcgccctgcgcactgatcaggggaattataaggaattcgaggacaacagtggcggtaaggcccggaagatacaacagccggcccgatccctagacatggtccacacaaggattgccagcttgctgtgccggatcgacactccagattatctgcactcaggcaaaaagggggtgagcaacgtaacaaatgcagaagcccatattgattcccataatgtgctgaccaccgatattcggtcattctttcccagtacaacacggagaatggtgttctctttcttttacggggtgatgaagtgcgcacccgacgtagctgacctgttggcagatctctgtaccatacactcccatatccccacgggatcccgcttatctatgcccctcgctttttgggcaaatcatactatgttcaatgagcttaacgagttgtccatcaaacataacgttaagatgactgtatacgtcgacgacctgacatttagcggaaaggaggtcaacaggctgttcagcagttgcgcgcgacggattatcagcaagtacgaccactgtatgcacccaaataagactaaactctactcggccacctcacctaagttaatcaccggagttgttgtgcagggcagcctgcttaaggtgcgtaaccagcagcaccaatatctgctctcagaaatgacacagtggctatctatcaaagatagccctagagccctccacttgaacattacgaataggatgctgggtcgtctgtactctatgtccgtcatagataaacgctatagggctaaggctcgaatggtgaggaattctaccgccctttga

SEQ ID NO: 10439 - RNA, 954 nt, unidentified
  source 1..954: mol_type = other RNA; note = synthetic construct
atgaagcagaggaagagtaagctaaagatacagacaaaaggaaagagctacagcctgcacgattcccctctttacaaacttaagactaaacgcaagctcgccagcattctccaacacagtctgccagacttgaaactgttatgctcggatgaagggaattatgctgtcttcgaagagacaaagaaaggtagcaagccgcgcgaaattcagaagcctaatcccaaactcgaggtagtccacaccaggatagcttcactgctgtgcagaatcgatacccctaattacctgcattcgggtaagaaaggccactctaatgtctcaaacgcctacgcgcatgtgaactccgacaacctcctgacgaccgatgtcaagagttttttccccgcaacctcaagacgacaggttttttcctacttttactccattatgcagtgtagcccagacgtggccgatatgttggcagacctgtgtacatacaatgcccatatcccaacaggatctagaatctccatgccccttgcctattgggccaacgtgtctatgttcaacgagctccaggccctgagcttgaagcactccgttaagatgactatttatgtcgacgatctcaccttcagtgggaaaaaagttaacaagttgtttaggctttgcgtgaagcgaattctagaaaattatgaccacgcaatgcaccccgcaaaaactatcctgtatcgcgctgcccaaccgaagctcgtgactggcgtaatcgtgaccgaggggcaaatgaaagtgcggaacgagcagcatcagcagctggccagcgagctggatatctggaaagctataaaagaccacccttacgcggcaggaatgaagccaacctctaaattattaggccggctgtattcaatggctgttatcgactctcggtataagtctaaagctgtgacggtgcgtaagtccactcatacatga

SEQ ID NO: 10440 - RNA, 951 nt, unidentified
  source 1..951: mol_type = other RNA; note = synthetic construct
atgaccaaaaagtcaaagcttaagatcgagctaaaaggtaagtcatacgacatccgggacagcccattttttcgtctgcgaagcaagaaaaagctctcctcattgttcaatttaactctgcctcaactgcaagaactcaagagtgatatagggaactacgctgagttcgaggatgtcggcaagactggcaaagcgcggaaaattcagaaaccaaatctggaactcgacaaggttcacactaagatcgcatcttacctctctaggataaaaacccctgattttttgcatagtggcaaaaagtatcacagcaacataaccaatgctaaagcccacctggactcaacaaatctcatggtgacagacattaaatcctttttcccctccacaaagaagaacatgatcttctcctttttctacagtgtcatggaatgtagctctgatgtcgctgatctgctggcacagttgtgcagtattcatggattcctgcctacaggtagccgcatcagcatgccgctggcctattgggctaattgccgcatgtttaatgaactggataccctttccagatctcatggcataacaatgacggtatacgtggacgacttaactttcagtggggagaatatcaacaggttgttcaaggccgttgttaacaaggtaatttcgaaacatggacacactatgcacccatcgaaaaccaaaatctatagcgccaaacagcccaagctggtgaccggggtgattgtgaaggataatgagctgaaggtgagaaacgaacagcaccaaaagttgtacgccgacctcgagttttggaaactgatcaaagactcacccctgaccaaaaacgccaaaatctcttcccagctcctaggcaggctttattccatgggatttattgagcagaagttcaagcagaaggcattaacgattaagtctgcgcttaacagctga

SEQ ID NO: 10441 - RNA, 954 nt, unidentified
  source 1..954: mol_type = other RNA; note = synthetic construct
atgacaaagaaatccaaactaaaaatcgtgacaagaaagaagtcgtatgagctctctgattcccccttttacaaattgaagtcaaagaagaagctcgcccatctactgaaagttaatgtgactaagctccagcagatgactaaagacagcaacaattacaacgagtttgagcacaacaaggacgacggaggaaaggtgcgcaagattcagcatcctatcggtgagctggatgtggtccacacccgaatcgcgagccttctttgtcggattaagactccagacttcctccactctggtaagaagcaccacagtaatgtgaccaacgcaaaagcccactgtaataagcaccctctgatgactaccgatgtctgcagtttcttcccctcaacttcccgggagatggtgttctcttttttctataccgtgatgaactgtgcccccgacgtcgctgacgttctgtcacgtatttgcacaatacatggccatctgccgaccgggtcacgcatcagcatgccacttgcatactgggctaactgcaggatgttcaaggaactggaagaattgacaaagaagcatcaggttaaaatgaccctgtatgtggatgaccttaccttttctggaaaaagtgttaacacactcttcaaatccatcacatgtcaaattatcgaaaggcacggccacaaaatgcatcctcgaaaaaccaaattatacgaagcgaaaagccccaaactggtcacaggcgtagtgattaaagacaaccaaattgaggtaaggaatgagcagcggaagaagctggtgtctgatatcgcttgctggaaaagtattaaggattttccaaatgccatctccatgcaggtcacgaatacgctgctggggcgcttacatgccttggggagcatagatagcaagtttaaggacagagctagaacgataaaggcagccactcagaaatga

SEQ ID NO: 10442 - RNA, 906 nt, unidentified
  source 1..906: mol_type = other RNA; note = synthetic construct
atgctctacagaattctgctgtcaatcaacctgtcccagaagaaaaagcttgcatctctgttgaaagtagatatgcagaccctgtttagaatgatgaatgatacggagaactacaacgagtttgaaaagaaagggaagaaagggaaagtgaggaagatccaacatcctgtaggagaattggatgtcgttcatacacgtattgcttctctgatatgtcggattgctactccgaattttttgcatagtggtaagaagcaacattcgaacgtctcaaacgcccacgtccactgtaataacttccccctgatgaccaccgacgtgtgttcattctttccatcaaccaaaaaatccatggttttctccttcttctacactgtgatggaatgttcgtctgacgtggctgatatactgagttgcatctgcacaattcatagccacttacccaccggcagccgcatttctatgcctctggcatattgggccaattgccgcatgttctccgaactagagcaacttgccataaagcacgacgttacaatgaccctgtatgtggacgacctcacttttagcggggcacaggtgaatagtctgtttaagagcatcattaggcaggtgatcgagcgacacggccaccagatgcacagcacaaaaacgaagctttactccggaaacaagcccaagctcgtgacaggtattgtgatcaagggcgagatggttagcgtgcggaacgagcagaggatgaaactcgtcagtgacatcacttgctggaaatctatcaaggatatgccaaatgccataaatatgccagtcacccacactcttttaggacggctctatgctctaagctccatcgaccctatgttcaaggatagagccaaaaccatcaaggcgaatacacagaaatga

SEQ ID NO: 10443 - RNA, 951 nt, unidentified
  source 1..951: mol_type = other RNA; note = synthetic construct
atgagaaagaagtcaaagctcaaactacaaaccaaggggaagtcttatcctctgtgcgattctccattttacaagctccggacaaagaagaagttggcggaattgattggattccccctcattgagctgcagaagcttcggtcccacattggacactacattgagttcgaagaggagggtaaaaagggcaagaagaggaaaatccagcagcccataaacgagatggacagggtacacactcggatagcatccctcatctgcaggattgacgtgcctaactatctgcacagcggtcgtaaaggcttttctaatgtgagcaacgctaaagcccatctggatagcagcaaactgatggctacagacgtcaaatcatttttcccctccaccactagaagaatgatattctccttcttctacagcgtcatgcaatgctctcctgacgtttcagatatcctggctgatatctgtaccatccacggacatttgcccactgggagtcgaatctctatgccaatcgcattttgggccagctgtcgactgttcgaggaattagacagtctatcaaagcaccacgacgtgaagatgacactgtacgtggacgacctcacattttcgggggcaaatgtgaaccgcctgttcaaaacgaccgttcgtaaaatcattgaacgccatgggcataccatgcatccgaccaagactaaactttatgatgagcaccagccaaagttgattaccggtgtcgtggtggataatggagttctccgggtaaggaatcagcaacgcaaacagctgatcacagactttgcctgttgggatcttgtgaaggacgtcgagaatgcttccctgttaccttgcactaacagtctgataggccgccttcagagtatgggcatgatcgatggcgcctttaaagaaagggccaaaacggtcagaggccagacacataaatga

SEQ ID NO: 10444 - RNA, 972 nt, unidentified
  source 1..972: mol_type = other RNA; note = synthetic construct
atgaagaagtcaaaactcaagataaagactaagggtaaggaatatggcattaaggattccccactttataatctccgcaccaaacggcacctagcgaatctgctgaactgcagcaacagtgacctcaaaaaatacgctaaggatgatggcaactatcatgaatttgaggagaagggggccaaccagaaagcgaggaagattcagcagcctatgcgaggacttgacaaggtgcatactcgaattgccagcttattgtgccgcatcaccacacccgactacctgcactcaggaaagaagaaacacagtaatgtctcgaacgcactcgctcataccgctaaagaaaattctagaacaccgctaatgaccactgacgtgaagtcattcttcccctccacatctcgtaagatgatcttctctttcttctacagcgtcatgaaatgttccgccgacgtatctgatatcttagccgacatctgtacggtgcaccattttctgcccacaggcagtagaatctccatgcctctggccttttgggcaaattgtaggatgtttagcgagctggagcaattgagtaagaaacacgataacctgatgactgtgtatgtcgacgacctgaccttctccggtgttaatgtgaaccccttgtttaaaaccacggtcaagaaaatcctgaaccgctacgggcacattatgcatccagataagactaaagtttacgactgcgatgacgcaaagctggtcaccggggtgattattaaaggcggcaccattatggtgaggaacgaacagagaaaacagctcgtgaacgatcttagctgctggtcagtgataaagaaccagcctgacgctatcaataatacattcacccagcggcttatcggacggctgcactctatgggggtagttgatgagacgtttaaaaagagggccatgacaataagaaatcaaactaatcgcacaccaatcagctga

SEQ ID NO: 10445 - RNA, 960 nt, unidentified
  source 1..960: mol_type = other RNA; note = synthetic construct
atgaaaaagagcaagcttaagattaagaccaacggaaaagagtactccctcaaagatagccctttctataacatcaagacaaagaaaaggctgagtatacttatagggtgcacattgtctgagctcaaggcattttccaaagatcaaggcaattaccacgagtttctggaaaaatcaaccggagggaagtcccgaaaaatccagcagcccgtgcggggtctagaccgaatccatacgcggatcgcaagcctcctgtgtagaatcgaaacccccgactatctgcactcagggaagaagaaccactcaaacgtgtccaatgcgaagactcacgccgagaaacacttcgataatgtgcctaccatgacgactgatattaagagcttctttccaagtactacacgtaagatgatcttttctttcttctattcggtgatgaagtgttctgctgacgtggcggacgtgctggccgatatctgcactattcataagtttctgccaacaggctccagaatttcaatgcccttagccttttgggccaatagtagaatgttcgaggagttagaagccttgagcatcaagcatgacattgtcatgaccgtgtatgttgatgacctaacatttagcggctgcaacgtcaataagctgttcaagactacggtcaaacgcgtaatagagcgccaccatcataccatgcatcctgataagacaaagatctaccgcaaagccgaaccaaagttggtcaccggagttgtcgtgcacaacggtgaaattagggttcggaatgagcagcacaaacagctggtaaccgaccttgcttgttggaactctataaaagcaattccggaagcaattcggatgccctacactaacaggctgatcggcagactccactctatgggcgttattgagagtgtgttcaaagacaaagctacagccatcaggaatcaaaccgctaaatga

SEQ ID NO: 10446 - RNA, 960 nt, unidentified
  source 1..960: mol_type = other RNA; note = synthetic construct
atgaggaagcctaagtttaagattaaaacgaagggcaagagctactccatcaaggactcccccctgtataatctgcgtactaaaaagcacctcgctaatctgctaaattgcaacacacaggatttcagcaccctgagcaaggacgacggaaactacaatgtatttgaaactaccggcaagaatggcaagaagaggaaaatccataaaccacagcctcaactggataaaatccacacccgaatcgcttctctgctatgccgcatcgacgcaccagactatctgcacagtggcagaaaaaataggtctaacattaccaacgcacaggcccatattaccaaccattcttcagagactgccatcctcgcgacagatataagagattttttcacatcaacccatcgaaagaacgtgtttaatttcttctacaccatcatgaagtgcagcaccgacgtcgccgatatattggcaaaattgagtactatccacgagcacgtccccaccggttcgcgcattagcatgcccattgctttctgggccaattatcacatgtttgaggaactccacgcgcttagttcaaaatacaacgtctgtatgacagtgtacgttgacgacttgactttttctgggaacaacgtcaaccctctttttcggactgtcgtggagaaaattgtatcacgctacgggcacaagatccatccaactaagacaaaactctatgctaaagccgcccccaaactggtgacaggtgtgatcgttaagaatcagtccttacaggttaggaatgagcagttcaagcagctcgtgaccgatttcacatgttggaaagccataagaaacacgcctcaagcaatattcgatccacacacgtatcggctgcttggacggttacattccatggggtccattgaaccggtgttccgtgaaaaagctcggaccgtgaagggagccacaaacagatga

SEQ ID NO: 10447 - RNA, 954 nt, unidentified
  source 1..954: mol_type = other RNA; note = synthetic construct
atgcagaagctcaaaatcaagacaaaagggaagagctacgctctgaaagattctcccttctacaatcttaggaccaagaagcgactgtccatcctgcttggatgcgatactaaagacttaccgctgctcgctaaagatgatgggaactacaatgtattctccatcattggcaaagcaggtaagcctagacagatccacaaaccaatcaacaagctggacaagattcatacaagaattgccagtctgatttgtaggataaatctccctagttacgtgcattctggacgaaagaagcattcaaacctgacaaacgccaaagcccacctatcagccgacggcttcgatactaaagtgctcaccacagacataaaggactttttcacttccacccggaaaaaacaggtgtttggattcttctactctgacctcaagtgcaccgcagatgtcgcaaacttgttagccgatatgtgcaccatccacggccacgtgccaaccggaagcaggttgagcatggtcttggcttactgggcaaactatcatctatttgaagagctgtcctcccttagcaagcaacactcggttactatgacggtctatgtcgacgatcttaccttttcagggactggcgtaaatgaattgtttaagactgtggtgcgcaaagtgctgagtcggtatggccacaccatgcaccccaccaagacaaagttatatgggaaggagagtcctaagctggttaccgggatcgtggtcaaagagggccagctccagatcagaaatcaacaatttaaggaactggtgacggactttgcctgttggcacgctattcgtcagactccccatgcgatattcgacccacatacatatcggctcctgggtcgcctgaatagcatgtctagcattgaccccgttttcaaagagaaagcgcagacggttaagggtaacacatgtcgctga

SEQ ID NO: 10448 - RNA, 957 nt, unidentified
  source 1..957: mol_type = other RNA; note = synthetic construct
atgaaccgtaagcggagcaagaagcttaagatccagactaatggcaagtcatacacgatcaaggacagtcctctgtataggctgagatccaagaaaaaactggcgaacattctcaaaagcgatctgaacaatctcaaaaaactgcgactggacgctgataattaccacgagtttgaggataagggaaaaggtgggaagccccgaaaaatccagtgtccctgtaatggactggagaagatacactctcgcatcgcatctcttctgtgcagaattaagacaccggactacctccaaagtggaaagaagggccatagcaacgttagtaatgctaacgtccacctggggagtagctgcttattagccactgacatcaagagtttctttcctagcaccaaacgctatatgttgttctcctttttcttccactccatggaatgtagcgccgacgtggcggacatactttcagacctttgcacaattaacgggcatatccctacaggttctcaaatatcaatgccactggcattttgggcaaacagccacatgtttgacgagctgtatctactatctgtcaagcatgccgtaaaaatgaccgtgtacgtggacgatttgacgttctccggcgacgccgtcaataagttgttcatgtccgtgacccagaggatcatcacaaagcacaaccaggttatgcatcccgataaaaccaagctctacaggggatatgagtcaaaattaattactggcgtggtggttaagggcgacaatttgctggtgcggaacgaacagcacaaaatgctctttagcgatgtagaatgctggaaagctatcaaagatattccatcagccattaactccaatattgccaaaaaggtgatagggagaatgcattctatgtcggtcattgattctaagttcaaggataaagtccgcaccctccggatctccactgctacctga

SEQ ID NO: 10449 - RNA, 906 nt, unidentified
  source 1..906: mol_type = other RNA; note = synthetic construct
atggattctcctctctacaaagtgaaaacaaaacggaaactggcttccctgctgaactctactatccccgatttaaatcgacttaagattgacgacggcaactacaatgagtttgacgacttgaagaagcccgagaagccgaggaaaatccagcagccagttaaaagcctggatgtagtccattcaaggttagccagcttgctgtgcagaatcagtgttccagaatatcttcacagcggaaggaaaggcaggagtcacgtcaccaacgcaaacgcccacgtagggaatcactcgatacttaccacagacatcaaggcattctttcagtccacaaagcgcgacatgatcttcacctttttctacaaaaagatgcaatgttcagccgacgttgctgacctactgagtgatctctgcacgtgtcatggacacatacccactggtagcagaatttccatgcctctggcctattgggcaaattctgatatgttcgatgaactgtatgccctcgctctgaagcatgataataacatgtcagtgtacgtcgatgacctgacgttttccggtgggaatatcaatgagttgttctgctccattgtgaaaaagattattatccgctacgggcagactcctcatcccaataaaacacgaatttacggcaagaacagtgtgaagatcgtgaccggcgtcgcagtccacggagacgaactgctagtgactaattaccagcactaccaacattatcagctctatagcgatgtggaggtgtggaaggctatcaaggacacagaaaacgcgatggagctcaacacctctaagcggctcataggccgccttaacagcttggctgtgattaaccgtaagtatagagataaagcccggactataaaggccgcgacctcaaaatga

SEQ ID NO: 10450 - RNA, 948 nt, unidentified
  source 1..948: mol_type = other RNA; note = synthetic construct
atgaaaccaaagatcaacacccttgggaagtcccaccccatcgagaactccgctttttacaaactaacctcaaaaaacgtgctttataagttactgggagtgccaaaggaggaagttattcgcttgctgggcgatccggatcggtacaatgaattccaagacctgacaaacattgacaaacctagggctatacagaagccgaaaaaagcattggacgtagttcagagccgcatcgcatctctcatatgcaggatcgaggtacctgaatatctggagagcggacggaaaggccattcacacgtgaccaatgccatcgcccacgtctcccccaataacacatccgtagcgtttctgacaacagacattcgctctttctttccaagtacgacggtggtgatggtctacgatttctttcgatctacactgcggtgttcacatgccgtgagtgagatattgagcaatctctgcacatgcagaggatttgtgcccactgggagtcgaatttcgatgcctatcgccttctgggcaaattaccctatgttcttagaactagagaagctgtgtatcaagcacaatatccggatgtccgtgtacgttgacgacctgacttttagcggcaataacataaacactctcttcctggcttgtgtccgtaagattatcattagacacggtcatgaaccccatcccgataaaaccaaactttatgccaggaatgatgttaagattgtcactggtgtggcagtggtcgacaacagcatcactgccaccaataagcagcacctgaaattgtaccaggagatcgaagcgtggaaggccattaaggatatcccagacgctcttgagactaacaccgtgaagagactcattgggagactcaactcactcaccctgatcgactataggttcaaggataaagcccgtagcattaagtctgctaccagttga

SEQ ID NO: 10451 - RNA, 930 nt, unidentified
  source 1..930: mol_type = other RNA; note = synthetic construct
atgaaagtcaaaaagcaaaagattaagaccaagggtaagtcataccccctgcaaggatgcattttctacaaactcagttcgaaaaagcgtctggagaagatattatttacaagcatcaaggagctgcagttcctgtccaatgacatcaattacgtgctcttctatgagaaatcagacattaacaagaagaggttgattgagaaacctaacgaaaagctcgacataattcatactcgcatcgcttctttgatctctcggatcacacagcctcagtatatgcactcaggccttattgataagagctatatctcaaacgcgaaacagcacttagggaaaaagccaactctgacgacagacataaaaagctttttcccgtctacgactcgccagaaggtttttaacttcttctacaagaagctgtgctgctccagcgacatagcagaccttctgagtctgctatgtacaattaacaaccacattcccaccggatctaggatcagtatgcccttggcatattgggctaatgccaacatgtttaataatctttacgccatctcctgtgccaacaatatcatcatgaccgtgtatgtggacgatattacattctccggggaaaaagtgaataaacagtttctctccagagttaaaaagatcattacctctgagagtcatataatgcaccctactaaaaccatcctttacagcggtaccgaaatcaagaagatcaccggcgtgataattagcaacgataagctgaaagtaccaaatagcctccataataaaatctacctggacattgaggaatggaaatccctggataataatgaaaacactgcagtgaagaaccggctattgggccgagtctacgccgctgccaacattgataacaggtttaaagataaggctagaaccatcaaaaagtatgtctga

SEQ ID NO: 10452 - RNA, 927 nt, unidentified
  source 1..927: mol_type = other RNA; note = synthetic construct
atgaaagctaaaaagcggaagataaagacaaaaggaaagagttactccctccaggagtgcgtgttttataaactcacctcaaaaaagaagctggaaaaaatcttgttctcctccattcaggaactcaaactactgagtgatgataggaattacatcctgttttacgagaagtcagacattaataagaagagactgatcgagaaacccaatgagaaactggatatcattcacacacgcattgcaagcctcatatcgcgaattattcagccacagtatatgcattctgggctgaaggacaaatcttatatctctaacgccagagctcaccttgggaagaagccagtcctaacgaccgacattaagagcttctttcccagcaccacccgccttaaggtgttcaacttcttctataagaaactgaggtgcagttctgacattgcagacttgcttagtcacctctgtactgttaacaatcacatccctaccggctcaaggatatctatgccgcttgcctactgggccaacgcggatatgtttaacaatctgtatgcaatctcccgggctaatggcaacaaaatgactgtttatgtcgacgacgtcacatttagcggagagaaggtgaactcaaagttcttaagcagtgctaaacgcatcatagcgtccgaatcccatattatgcatcctactaagactatcctgtacggtagcatccaaattaaaaagataaccggggtgatcattagctcagacgagttaaaggtacccaactctctgcacaataaaatctacatagatatggaagcctggaaacgttccaataacaaaaactacacaggtatcatcgatcgattgctgggcagggtgcatgcagccgccaatattgataacagatttaaggacaaggcccggacgatcaagaataaatga

SEQ ID NO: 10453 - RNA, 936 nt, unidentified
  source 1..936: mol_type = other RNA; note = synthetic construct
atgcgccggaaaaaaccgaagatcaacaccaaaaacaaatcttattccctgcaggattgcgccctctataagtgtattacgaagaagcgattagtcaagattctgaaaagtgacctcgggaaactgaagaatcttagcagggacattgacaactacactacattttacgagaagactgacatccagaaaaagcgcttgatcgagcgacccaatgaagagttggatgtgattcacaccaggatcgccagcctgctgtgcagagttacccaacccgattttatgcattctggactcaagctgcactcgcacgtttccaatgcaaaaaaacatattggtgttcaccctctgctgaccactgacttgaagtcatttttcagcagcacctcgaaagcgatagtgttcgacttcttctttaagaagctgctctgtagccccgatgtctccgaactattgtctaatttgtgtacctacaacaatcatatcccaaccggttccagaatcagcatgccacttgcatactgggctaattcaaagatgtttctggaactgaatgccctgagtaaagctctagggatttgcatgacggtgtatgtggatgacatcaccttcagcggacgctcagtgaacaaacttttcaagagtaaagtgaacaagatcatcgagtcacactctcatataatgcaccctgtgaagactatactttataaaccttaccagaacaagctcgtaactggcgtgattgtatctggcgataacttacgggtccgtaataagcagctgaaggacatccatgtgcaaatgaaagagtgggagaactccaacctgatcataagtagaaacattgtcaaggaaaggctcttaggccggcttaattctgcctccacaattgatatcagatttaaagacaaggctaggacactcaaaaagacaacatga

SEQ ID NO: 10454 - RNA, 933 nt, unidentified
  source 1..933: mol_type = other RNA; note = synthetic construct
atggcgaaaaaaaagggtagaattaacaccaaggggaaatcatactctatcaacgacagcgccctgttcaatatccagtccaaaaacaagctggccgaggttctcttgaccaatctggataatatcaagtccctgctgtcaaacgataactacatagtcttcgataatacgaacgaagacggtaagaagcgtactattcagactccgtcagacaaactaaatgtggtgcacaccaggatcgctagcctgctttgtcggatcactcaaccagagtacgtccactctgggattaaaaacaagagtaacgtttcaaacgccaggaaacacgttggcacacaccccgtattgacaagcgacataagaagttttttccctagtacctctaagcaccaggtatttaacttcttcaatcgcaagctgaaatgcgcagccgatgtgtctgatctcatggctgaactttgtacttacgctaatcatattccaaccggctcccgaatcagtatgcccttggccttttgggcgaattatgatatgttcaacgagatgaacacgatttcgaacaaactcaatataaccatgacagtctatgtggacgatatcacttttagcggaaatgcagtgaataggctgtttttacacaaatgcaagcgcatcgtcgagaagaatggacatgtgctgcatcccaaaaagacagccttatattctgcaaaggagcctaagaccatcaccggcgtgatcgtccatgaaaacgagattaaagtgcggaacctccactacaagaaaatttatttcgaccttgacgcctggaaaaaaacagatgacgctatcgaaaaggagaatctcaagaacaaggtgctagggcgaatgcattccctgtccacaataaatgaaaagtttaaggacaaggcaagaagcttccggagcattgactga

SEQ ID NO: 10455 - RNA, 951 nt, unidentified
  source 1..951: mol_type = other RNA; note = synthetic construct
atgtcccagaaaaagcggaggctcaagatcgatgttaggaataagaagtacccgatcgtagactcatgtctgtttagattacagtccaagcggaaactcagtgaattccttaataccgaattgtttgcgcttaagaaccttacagacgatcgaaattacaattgctatatcgacacctccggacacaaaccccgggagattgagcacccttgttttgagctggacaaaattcagacacgcattgcatctctgatttgcaggatcgctcaacccgattatatccattctggcgtgaaaggtcgaagtcacattacaaacgcgaagcaacacgtcggcagacataacgtcctaacttcggacattcagagcttctttcctagtaccacgcagaggatggtgttcaatttcttttacaaacgcttgcagtgctctagcgacgtagccgacttgctcgcaaacctgtgtacatgcaaaggccatattcccactggaagccgtatatcaatgccactggccttctgggccaacgaaccaatgtttaacctgttacacaaagtgtctctgtcacaggggataactttcactgtgttcgtggacgatatcgtcttttctggatccagcattgatgagcggtttgtctacaacatcaagaagttgatctcaaaccacgggcacacggcccatcctcgtaagaccaaactctacaaagctggcaacacaaaactggtgaccggggttgctgtggataccaatggtctgcacgttgccaaccgccatagaaagaatatctatcaggacatgagccagtggaaggtgagcaagcaagctggactgcaattcgatgatctgaataagagaatcataggcaggatgaacgcccagtccctagtcgactatcgcttcaaggataaggcaagaactctccggctttccataaagaaaaaaaattga

SEQ ID NO: 10456 - RNA, 948 nt, unidentified
  source 1..948: mol_type = other RNA; note = synthetic construct
atgaagattaaacactccaagcttaagatcataaggaaaggcaagagctatgcgctgaaggatagctcactttataagattacctccaagaagaaactgctgtctattctctcgcaggccagcgtgactatatctgatttgactaaggcaattggggattacagcatctttatcgacaacaaaaacccgttgaaacctagaacaattgagaaacccaacaaaaacctggacatctatcagagccgaatcgcctcactgctgtgtcggattgaaagtcctgatttcattcatagcggtaccaagcggagatcacacgtcaccaatgccaaaatccacttagctaacgagaatacatttaccacggatatcaagagtttttttcccagtacacctattgagaaagtgttctctttcttctacggggttatgaaatgcgagcccgacgtcgctgacctgttggccaagctatgcacctgtaatggacatatcccaactgggtcccgcatatctatgccaatgagcttctgggcaaatgagaaaatgttccgcgaactccaaaacctctcaatccaacataatgttacaatgaccctctacgtagatgacatcacgtttacaggcagtaatgtgaataagatcttcgtaaacactgttaagaagataatcactagacacggacacattatgcatcccaaaaagtccatactgtatccaaagggctccgtcaaagtgatcaccggtgtggtgattcggaacggaacagccctggcaaaaaacgaacagcacaagaacttataccaggacattgaacttctcaagggctttagcgggaagctttcccctccagaaaagctaatagacaggaccctgggcaggatcaattccttgtctgtgattgagtctcgttacaaagacaaggctcgatcactctggagtctgatcaaatga

SEQ ID NO: 10457 - RNA, 951 nt, unidentified
  source 1..951: mol_type = other RNA; note = synthetic construct
atgaacaatcccctcaaaataaacaccaaatccaagtcttactcacttcaggattcagctctctacaaaatcaagagcaaaagacgcctgctgtctctgctgaacttatcacatcaggaattgaagagcctcctgagcgatggcaactacaacatctatcaagacaatacccaagagaagccccggctcatcgaacacccacaaagacagctggagcggatccacacaaggatagcctcgcttctgtgcaggattaagcagcccgaatatattcattctgggatcaaaggaaagtcccacctaaccaacgctcgcactcatatcggacctgcaccgactctcacgacagacattaagtctttctaccaggccacacacatacacagtgtgttcgactttttcaaaaattccctggattgtagccctgacgtcgctaagttgctgagtgagttgtgcacttgtaatggccatatcccaacaggatctcgtataagcatgcctcttgcatactgggccaatgcccatatgtttaacgaactgtataggtattccagtgaacgggatattatcatgaccgtatttgttgacgatattacattcagcgggaataaggtgactcgaaccttcaaacagaacgttaagaagatcatagagaagcataaccacgtcatgcacccaactaaaaccgtgttacacaaagaaaatagccttaaagtgatcacgggcgcggtggtgggtagtaagaaactgcagatccgaaatctgcaccatgagtccatctatagtgagctctcacagtggatgttaattagagacgagaactctaaaaactcctccatttttaccgagcagattaaaaatcgcctattgggtaagatcaactcacaagggcagattgataatcggtttaaggacaaggcaagatccattaagaattacaggaaggtctga

SEQ ID NO: 10458 - RNA, 939 nt, unidentified
  source 1..939: mol_type = other RNA; note = synthetic construct
atgaaaaggaaaaagaacaacaagatcaacacaaatggcaagtcttatcctctccacgatagccctttttacaagctgcgctccaaaaaagttctcttttccctactgaaaaccgataaagagaagatagctcacctgaagagtgaccaagggtacaatactttcacccagaagtctaataagaaaacacgcgaaatcgagcatcccgtggacgcattagatatcgcacatacgaaaatcgcttcactgctgtgccgcgttactacacccacttacgttcatagcggggtgaagggccggacccacgtaaccaatgcaaaagaacacctcggaaaaaagagagtcctgaccactgacattaaatcattctacccctcgacgactaggcagcatgtgtttaagctgttcttcaacacattcaaatgttccccagatgtcgctgacatcctcgccgatatttgcacatttcaaggacatgtaccgaccggcagcaggctaagcatgccaattgccctgtgggccaatatcaacatgtttgacgaattgaacgtcgtctctcgaaagcacgatatcaccatgacggtgtacgttgatgacataaccttctctggtaatcttctgaacggcaggtttaagtcccttgtgaagaagattataagtcgttatgaccacgtgatgcaccccaagaaaacagtgctctataaggacgatgagattaaagtgatcactggtgtggtgttggaccaggacggaattaagataaagaacagtcagcacaagttgatttatcaggatatcgagcagtggaaattgttcaaaggcctggctgcgttaccacctgagagtctgaacagcagacttatggggcggctccatgccctgtccgtcatcaatcctagacttaaagacaaggcccggtcaattaagaattgtatgtga

SEQ ID NO: 10459 - RNA, 942 nt, unidentified
  source 1..942: mol_type = other RNA; note = synthetic construct
atgccgagaaaaaagtacaagataaacaccaacgacaaggcctatagctttgagtccagctctttctataagttgtccagtcccaatattttagccaatctgctgcacatcccactggccgacttaaaaaagctcaagaactcgaaagattcatataagcctttcgtcatcaaaaaagagggcaaaaaggaccggaccattgagtgcccaaaacgactcctagaaaaagtgcatacaaggatcgctagcttgttgtgtaggatcatcacaccagattttctgcactctgggataaagggtcggacttacattactaacgccaagtctcatttgggtaagcacaaggtgctcactagtgacctacgcagcttttatccctcaaccagcaagaagatgatcttcaagctgttccgatacaactttcactgctcagtggaggtcgcggaccttatcgcgagcgtggctacctacgaagagcatctgcctacaggatctagactgtccatgcccctggcactgtgggccaatattgagatgttcctggagatagaatcgctggccaaaaaacactccattaacatgacgatttacgttgatgatcttgttttctcagggaaaaatctgaacgagctctttagctccacagtcaataagatcgtgctgaaacacgggcatgaaatccattccggcaaaactgttctctacaaaagtgacgaaatcaagcttattaccggcgtaatcgtgcataacgacgagatcttcatacgcaactgtcaccaccagaatatgcacaacgacctcgaagagtggaaaacctataagaatggatttatggtacctgacgatcttaagtctaggcttctgggacggattaatgctttcgctcaaattgatcccagattaaaggataaggcacgtagtatcctcgcaattgaacattga

SEQ ID NO: 10460 - RNA, 993 nt, unidentified
  source 1..993: mol_type = other RNA; note = synthetic construct
atgtcccaacagcggagaaagtacaagatcaatactaacgggaaatcttatcagatccacgattccccgttttataagcttagttcgaaaaagaagctgttgtcagttctttgcattactaaagagcagctccaatccgtgctgtctaatgagttgaactataacgtctttagtcaagttggaaagacgggtaagcctcgaaaaattgagcatccaattaactcagtagataagatccatacaaggatcgcgagcctgctttgccgcatctcccagccagagtttatgcactctggcgtcaaagggtttagtcacgtgacgaatgctaaagcccatctcggctcccacaagacactcactaccgatattaaatcatttttccccagcaccaagaaaagcatggtatttcacttcttttacaagcggatgaaatgtagccccgatgtggcagacatcatggctcgtatcaccaccttcgaatcgcacatacccactggcagcagaattagtatgcctctagccttttgggctaatatggatatgttcttcgaactagagaagctcgctaaacttcacaatgccattatgacagtctacgtggacgatttgaccttctctggtaaagcggtgaacaatctcttcaaatcaatagtcaagaagatcatctccaaacatggacatattatgcaccccaaaaagacaatcctgtatcagcatgacgacgtgaaggtgattaccggcgtggtgctgaagaacgacagcattgccatcaaaaaccagcagcatgccaatatacacgcagacatgatattctggaagatcgttcgcgacgatttattcgtccctcagggattaaagaatagactgctggggcggctgaacagtctgtccgtaattgcaccaagcctgaaagacaaggcccgaagcatcaataactacaagaggaagtctaaaaagtcaagggtggaaaacaagaaacagatggtttcttga

SEQ ID NO: 10461 - RNA, 957 nt, unidentified
  source 1..957: mol_type = other RNA; note = synthetic construct
atgactagaaaaaagctccggctcaaaataaatacagctggaaagagctaccgactgcacgactcaccattctacaagctgattaaacagagcagactgctgtccattctttgcataacctcggaagaactatcgtaccttaggtactctcctgaacgctataacgtattcatccaaaagggaaacaacgagaaagagcgcgtgatcgaacatccccgtgaaaagttggagaaagtgcatactaggatcgccagtctcatgtgtcgtatcgagccgccaccgttcctccactctggcatgaagggactcagtcacatcaccaatgcccagtctcatagtaccaatagtaaggtacttactaccgatatcaagtccttttttcccagcactacacgcgagatgatttttcggttcttctataaaacgctgaaatgttcttccaatgtggcagacatcctggctgatatttgctctgtcaacggtcacctgccaaccgggagccgaattagcatgcctttggccttttgggtgaatgctgaaatgttctttgagttggagaaactgtccaacatgcatgatgtgtgcatgacagtgtatgttgatgacgtaacattttccggggtgaccataaacaagttattcaccaagacagtgaagtctattatctcccggcacggtcatctgatgcacccacggaaaacagtcctgtataagggggatgacacgaaagttatcactggcgtcgtgctatcaggctcaaagatcgcaattaagaaccaacagcacaaaaagatacacgaggacatcttgctgtggaaggtcgtcagagacaagtacgtgcctgcgagcttaaaaaatcgccttctcggcaggttaaactcactgagcgtggttgagcccaggctgaaagataaagccagatccattaagaattacaagcccaatcctcaggtttga

SEQ ID NO: 10462 - RNA, 963 nt, unidentified
  source 1..963: mol_type = other RNA; note = synthetic construct
atgaaaaagcagaaacgccctaaattcaagatcaagaccctcaacaaggcctacgagatttcagactctccactgtacaagttaaccaccaagaggaaactggctgcactgctgctgctggagccagtgacgctcaacgccctgattaagaataccgacaactataacgtgttcgaacaggtaaattcgaacgggaaaaaacggatcattgaacatccgaatttggagctggataaagtccatactagaatcgccagcctgctgtgtcgcatcaagatccctgactttgtccacagtggtcgagccaaacacagtcacatcactaatgctcggatccacatcggccaccacaaagttctaacgacagacatcagaagcttttttcctagtacttccagaactcacctcttcaactttttcaaccggaagatgaaatgctccagcgatgtctctgatattctttccaagatctgcacatataacgagcatctgcccacagggtctaggatttcaatgcccctggccctatgggcaaatatcggaatgtttttggagcttgagaagatagcagtgaagcatgatattaaaatgtccgtgtacgtagacgacataaccttcagcggtgataagctcaataagttgttcatatccacaatcaagaggatcgtggaacgccacggacatattattcatcctgtgaagaccgtcttatacgcgaaggatgacgccaaagtgataaccggcgtgattttgaaggacgggaagcaattcgttaaaaacgagcagcatcgtaatgtttaccaagacattgaacagtggaaaatactcaaagatactccatatatgcccgagacacttaaaaatcggctcctgggcagattaaactcactttctgctattgaacccaagtttaaagataaggctcgaagcatcaggaatcacaagaccccgacaccatattga

SEQ ID NO: 10463 - RNA, 984 nt, unidentified
  source 1..984: mol_type = other RNA; note = synthetic construct
atggccgagaaaaaactgcccaataataagcaacggcgccttaggctacagacccgcggcaagcagtattccgtgtgcgacagcccattttacaaactctgcagcaaaaccaaactcgccgagatgctgggatgcaccctacccgaactgaaaaacttatcttctgacgaagactacatcgtgtttaacgaagaaaagtctggaaaaaggcgagaggtacagcagcctaagcccaagctggataagatccacacaagaataggtagcttactcgctagaattaagactccagactacctgcattcaggagttaagggaaggactcatattacaaacgcaaaatgccacaattctaatagccgtatcttggtgactgatgtcaagtccttttaccaatccacaaccttcaaaatgatctatggcttcttcaaccatcgaatgcgctgtagtcccgacgtttcttggcttctcacgaaggtcagcacatataacaactctattcctaccggcagtcggctgagcatgcctttggcgttttggagttcaatagggatgtttgaaaagcttaaccagcttagtatttccgaatcagtagttatgactttgtacgtcgatgatttaacattctcgggggagaaaatcaataagctgttttgtcacaaggtgaagaaaatcgtgtcctcctatggtcatctctgtcacccaaaaaagacgaagatctataaccagaatcaggccaaggtcgtcaccggcgtggctttgctggaaaatgggccggcaatttccaacaagcagcacaagagcatttacgaggatatgctgcagtgggagataatcaagaatgaggctctcttcgagtcactgaataacagactgctcggcaaactgaatagccaagggcagattgacttccggtacaaggataaagccaggtcactgatgaacgagatcagacgtcggaaaccttatagtcaagtggtgtga

SEQ ID NO: 10464 - RNA, 960 nt, unidentified
  source 1..960: mol_type = other RNA; note = synthetic construct
atgcgcaactcaaggtccaagcttaagataaacagcaattccaagaaacactctatcaatcagagccccttttttaaactgaagaccaagaagaagcttatcgaactactggggttggcttcttcagaactctccatcgcaaaaaaggatatcggcaactatgtggttttcgaacagatgggcaataacggcaagtcacgcacgatccagcatcctaaagacaaacaaaatgaaatccacaaccggatcgcaaacctcttaaccagaatcgagcttcccgcctatctccatagtggaaggaaaaaacacagccatataacaaatgctactcagcacctgggtagcaaaaaagtgctcactactgacatcaagagttttttccaaagcacaacaaagaaaatggtgttcaacttcttcaaccgaaagctcctgtgtagtcccgacgtcagccatattctgtcatgcatttgcacattcaatggacacattccaaccggatctcaattgtccatgccactcgccttttgggccaatatagacatgtttgagcgtttagagaatttatcttcgagtcttaacgtggatatgaccgtttacgtcgatgatttgaccttttccggggagcaggtgaacagacggtttctgagcctgattaagaagattatcataagtagcggccaggtacctcacccactcaaaacaaagttgttcaagaaaaacgatctgaagattatcaccggggtcgccctaaaggaggacaagactctgatcacgaataaacagcatatgctgatttaccagtccttcgaatcctggaaaggctgtagagacgagccggtaatagctaattatgtgatgcctaaactgcttggaaggctgaatgcgttgtcaggtattgaccccaagctgaaggataaggcaaaatctctgattaactacaaacctacttctctactgtga

SEQ ID NO: 10465 - RNA, 963 nt, unidentified
  source 1..963: mol_type = other RNA; note = synthetic construct
atgcggaaccgatccaaactgaagataaatagcaactctaagaagtacagcttaaatcagagtccattctataagctgaagaccaaacgtaagctcatcgagctgttgtctctgtccatgcccgaattatcaatcgccaagaaagatatcgacaattaccaagtcttcgaccagatgggaaacaatggtaagccaaggaccattcaacacccgaaaaataagcaaaacgagatccacaacagaatagctaacctgctgacccggattgagctacccgactatctccattctggcaggaagaaacatagccatatcacaaatgccactcaacatctggggtcaaaaaaagttctcacaacggacattaagaaattttttcagagcacaacccgcgaaatggtgttcagattctttaataagactctgcactgctcctctgatgtctccgacatcctttcctacatctgtaccttcaatagtcatatcccaaccgggtcacagttgtctatgcccctggccttttggagcaacatagatatgttcgaacagttagacaacctctccgcatcacttgacgtgaaaatgactgtttacgtggatgatctgacgttcagtggagagcaggtgaataagcactttcagagcattgtaaagaagatcattatctcgaatggtcagacacctcaccctctgaaaacaaaactgttcaacaagaacgacctcaaaataattacgggagtcgtgattaaagacgataagactctgattaccaataagcagcacaagcttatctatcagagttttgaaagctggaaaggctgccgcgacgagccccttctcgagtcatatatcaagattaagcctaaactgctcgggaggttgaacgcactatctggcatcgatcctaagttgaaagataaagcgaagagtcttatgaactacaaatccgccgctgaaatttga

SEQ ID NO: 10466 - RNA, 969 nt, unidentified
  source 1..969: mol_type = other RNA; note = synthetic construct
atgcgcaacaagtctaagcataaactgaaaacctatgagatctgcgattcacccttatacaagctgagatctaagaagaaactcttgtctttactgtacatgtccaaagaggaaatcgggatcgccgtgcaagacacggacaattatgttgtcttcgaaactattaggaagaaaggcaagtctagaacaatccagcaccccaaagatcgacacaaggagattcactgccggttggccaatttactgatcaaaataaaagtcccgaactatcttcactccggacgcaaggagcactcctacgtgacaaatgccaatcaacaccttggggagaaaagggtcctcacaacagatatatcagcattcttccagtccacggcaagggataatgtgttctgctttttcctcaacataatgaaatgtagttcggatgtggccgacacgctgagccatatctgtacatacaacggccatattcctacaggtagtaagctgtctatgccactggcgttttggagcaatttgagaatgttcgaccagcttgaaaaactcagcatcaaacacaacgtgtgtatgagtgtttacgtggatgacattaccttttcaggcaactccattaatcggctgtttctaagcaccgttcgtaagatcattactagcaacggacatactcctcatccagaaaaaacaaagatcttcggaaaaaaggacatcaaggtaatcactggtgttgtcattaacggcgacgacaccctgatcactaacaagcagaacaagcttatattccagagttttgtggagtggaaggctagccgagatgaacctctcaccgagaggctcattacccagaagctgttggggcggctaaatgctctgtcaatgattgatcccaagctgaaggacaaagctaaaagcgtgacctcctacaagaagatcgtcattaaatatgtgactacccagcgcgtattttga

SEQ ID NO: 10467 - RNA, 975 nt, unidentified
  source 1..975: mol_type = other RNA; note = synthetic construct
atgcccaagaagtcaaaattaaagatcgaccatagccggaggaaacacaagctgtttgaaagttccctgtacaagttgaaaacgaaaagaaaactggccgagcttctgcaagtgacaataccagagctgaagctcgctagtgccgatgtggggaattatgtggtatttgaacaggagggcaagagtggcaaggctcgtactatacagcaccctaaagatagccagaagaaaatacattgcaggatcgcaaatctgctatgccgaatcgagtttccagagtatctgcactccggtagaaaggaacactcgcatattactaacgccaaggcccataccgggaataagaaggtcttgactacagacattaaaagctttttcccttctacaacgcggaagatggtgttcaacttcttctacaatacaatgaagtgttcctcggacgttgcagacttattggcatctatttgtacctataatggacatatccctaccggcagtcagctgagcatgcccctcgccttctgggctaacatccgcatgtttgaacaactgaataacctcgctaacaagcacgacgtgaaaatgaccgtctatgttgatgacctgaccttcagcggagattctatcaataggcagtttctttccgtcatcaagaagatcatcgtctctaatgggcacatctcacacccagataaaaccaagctcttcgagaagtctgacgtcaaggtgattactggcgttgccatcaaatgcaacgatgtaggcattaccaacaaacagcacaaactgatatacgagtccctcgagcagtggaaaggatgtcgcgacgaaccgcttattagctccttcgtgattccaaaactattgggtagacttcacgcgcatagcaatattgaacctaaactgaagcacaaagtgaactcaattctcaactacaagcccgtgaagaacccccattcaaaatctacagattga

SEQ ID NO: 10468 - RNA, 933 nt, unidentified
  source 1..933: mol_type = other RNA; note = synthetic construct
atgaaaaagacgaaaaagctcaagcttataagcaatcaaaagtgctaccatttggatcagagccctttctataagctgcagtccaaaaagaagctgttagcgctactctgtatcaacgaagccgaattgaaagattgtattacaagtccactgaactacaatgtgttcttaaacggcaccagagtaatagagacacccatcggcgtcctgaagaaagtgcattggcgtatcgcctccctcctgataagggtcaatgtgccagagtaccttcagtccggcaagaagaagcattctaacatctcaaatgctaaggtgcacattggtgacaccaatctgctgagcaccgacattaaatccttctatccctctactcttcgctacaaagtgttcaacttcttcctgaacatcatgaagtgctcagtctatgtggccgatatccttagtaagctcagcacctacaatgatcacatccccaccggttctcagctttcgatgccattggttttttggagcaactttcgaatgttttctcagttgaatggactcgctgagaagcataatgcaaaaatgactgtgtatgtggacgacattacattttcaggaaatagcgttaacaacctgtttctcagtgttgtcaagaagatcataattagcaacaatcacacaccgcaccctaataagactaaactgtacgcatccaaggagaacaaaattgtcaccggggtagtgattaaaggcagtaaaatactgatcatgaacaagcaccacaaagccatctatcaagatctgacagtgatcaacgcctgtaaactgtcaggaggggcaccttcttgctacgaaattacgaaaaagcggttattggggagggttaatgctctgaagctcattgacactagactacagcataaaatcgagtatttttccaacctgtga

SEQ ID NO: 10469 - RNA, 957 nt, unidentified
  source 1..957: mol_type = other RNA; note = synthetic construct
atgaccagaaaactgaagctggacatcgatcacagacggcgtaagtataccctgattgagtctcctctatataagttgaagacaaaacgcaagctcgccgagttactgctggtgcagactaatgaactaaaaaatctcacccaggaccagggcaattacagggtctttcagcagatagggaagtccggaaaaccccgcgccattcaacaccctaaggattccctcaagatcgtccattgtcggatagcttcactgctgggaagggtggagctgccagactacctccattccggtcgcaaggagcatagccacatcagcaacgctaaaaaacatcttgggcaacacaacgtcctcaccacagacattaaaagcttctttccatccaccactaggaagatggttttcgacttctacttcaacttgttaaagtgttcagcagacgtcgcggaccttttggcgtccatctctacgtataactgccacattcctacagggagtcagatttcaatgcccctggcattttggtctaacatccgaatgtttgaacagttgtatagcctcgccaaaaaacacgatagtgagatgacagtttacgtggacgatcttacgttttctggacatgcagtgaacaaacgatttgcctcggtagtaaaaaagattatacacactaacggccacattgcacatccggacaaaactagactctacgccaaggacgaggtgaaggtgatcactggcgtggctattaagggtaatgagacacggattaccaatgatcagcatatgaaaatctacgaaacactggagttctggaagggctgcagggatgaacccatcatcgctgaactgatcaagccaaaacttctgggccgtttaaatgcccacctgcaaatagataccagaatccgggataaggttaagagtatcaccagctataagcccaaattctcaatatga

SEQ ID NO: 10470 - RNA, 954 nt, unidentified
  source 1..954: mol_type = other RNA; note = synthetic construct
atgaacgttaagaagaaccaaaaatctaagctgaagatccagttgaagaataagtcctaccaggtgaaggattcccccttctacaaactggcaaccaaacgcaagctggcgaatctattaaacatcagcgtcagcgaactgcttactttgacaaaagatgccgtaaactataaggtgttctcccagtctaagggttatgggaaacagagagtaattcaaaagcctataggccgactggagtacgtccacacacgtatcgctagcctcctgtgtcgcgtgtctgtcccgagttttgtgcactctggacgaaaaggacatagtcacgtcaccaacgccaagcagcacctggggaacaatcgggtgctcacaactgacattaaaaatttcttcccttcgactactgaggaaatggtgttcaaacttttctttcacacctttaagatgaacggagacgttgccaagctcttggccaatctgtgctgcttctcaggccatgtccccacagggtccagggtgtcaatgccaatatctttttggagcaatagcaagatgtttgatgagctctcctctctatcaaccaaacatgacgtcgtgatgtcattatacgtagacgacttgacctttagcggagatggcatcaataggctgtttctttccaccgtgaggaaaattgtgcagaaacatggccacatcatgcaccccgataagacaaaagttcatacgaaaaacagtcggaaggttatcactggtgtggttgtccagggcgacaccctgaatattacgaataagcagaacctgatgatttatcgcgaactggctcaatggaaggtgattaaaaacctccctttcataccaaagagtctggagtcccggttactcgggagactttacgcaatgggtcagatcgacaagaagtataaagataaagctatgagtgtgagaaacagctcatga

SEQ ID NO: 10471 - RNA, 939 nt, unidentified
  source 1..939: mol_type = other RNA; note = synthetic construct
atgcgcaaaaaccactccaaactgaaaattaccacaaagcagaaggcctattctatcagcgactctcccttctacaagctcagtaataagaagaagctggccgagcttctcttcgtgaaggcctcggagtttaaaaatctgacatctgacgaaaactacaaagttttcaagcagctgaacagcaaaggcaagtcccggcagattgaacagccgctattgaatctggatcgcgtgcatacgagaatagcttctctcctgtgcagaatcgacctccccaactatttacattcaggccgtaaaggacggtcacatgtatcaaacgcaagagcacacgtcggtaataagaaggttttgactacagatatcaccaatttcttcccatctacgaccgagaaacagatcttcagccttttctacaacatctttaaaatgacaccagatgtcgctagggtgtttgccaagatttgctgttacaaacagcatgtacctaccgggagccggctgtccatggtcctcgctttctgggccaattataagatgttcgaggaactaaacagtttttctctgtttaggaatgtgaggatgaccgtctacgttgatgatctgactttttcgggcgaaaacattaaccgagaattctcatcccttatacggaaaatcattaagaagcacggacacttggctcataaggggaaaactcaccagaaacaaagtcacgaggtgaaggtgatcactggagtggtggtgaaggggaatgacattaaacctaagctgagtcagtttaaggagctccacaacgacatccaagcgtggaaattagtccgcgacaccggtctgcccctttccagcctgagggatcgaattagcggcagattgtatagcatgggccaaataaacaagcgctttaaagacaaagcaaagtccgttcgtaattactga

SEQ ID NO: 10472 - RNA, 939 nt, unidentified
  source 1..939: mol_type = other RNA; note = synthetic construct
atgaaacagaagagactgaagcctcggatcattaccaagaacaaaagctacccaattgaggattcagtgttctacaaacttagcagcaagaagcgtcttgcaaatttgctgtttagcacatctcaggagttgaaaagtctgggagagtcagataactacaggtgctttacccagaccaaaaacggtaaaccacgcttaatccaggagccgctgcctcgactcgacaagatccactcccgtgtagcaagcctcctgtgtaggatcgatacagtggacggcctccactccggaaaaaaaggtcgcagtaacatatctaacgctcacgctcacttggggcaggggaagaaggtcattacagcagatataaagagtttctttccagctaccactagacagaatgtgttcgactttttctacaccaccatgcaatgcgcggcagacgtggccgatctactctcgaagatccttacatacaatgatcacatccccaccgggagtcggatatctatgcctctggcttacttcgctaacaaacggatgtttgacgagatagaaagcgcagcctcagaattctccgcgaagatgacgatttatgttgacgacctgactttctcaggcgctatgcttcaaaagagctttattggcagactcgaggccactgccaagaagtatgggcataaaatccatccctccaagacgcgattctatgaggcctctgaagtgaaattaatcacaggagccgccatcaagggtgacgagattacacctagaaacaagcatctgaaacagctgaggggcgaattgtccgtttggctggacaatcccggcaatgacgaaaaactaactaataggatcctgggacgcatgacctttattggctccattgatccccgctataaggataaagccaaaacttttcggaagtctgtcttcaagtga

SEQ ID NO: 10473 - RNA, 939 nt, unidentified
  source 1..939: mol_type = other RNA; note = synthetic construct
atgaagcagaagagacgaaagccgaagataattaccaagcagaagtcctatcctctccaggactcagtgttctataaactgtcgaacaagaagcgactggcaaatctgctgtcaagtactccccaggaattgaagatgttagccgggaatgataactatcggtgttttactcaaaccaaaaacgggaagaaaaggctcatacaagagcccttgccacgcctggatattattcatacacgtgtcgcctccctcctgtgccgcatcgagacaatagatgggcttcatagcggaaagaaagggaaaagcaacatctccaatgcacgggctcacgtgggtcttggcaagaaagtcatcactgctgatatcaaatccttttttcccactactacccgcctcaatgtgtttgacttcttctataataccatgagatgcagtccagacatcgccgacctcctgtccaagatgctgacgtacgacgagcacgtacctacaggctctaggatcagcatgcccctagcgtacttcgctaacaaaaaaatgtttgacgaaatcgagagtgcagcgaacgattgcggcgccaccatgacaatcttcgttgatgatcttaccttttctggaaccacccttaagcggtcattcattggcagactcgagacgattgccaaaaagtacggacacaagattcatccaagcaagtctcggttctacggtgccaatgaagttaagctgatcacaggagctgccgtgaaaggtaatgatatatctcctaggaacaaacacttgaaattactacgcagcgaactgtcagagtggttgaaatgtgcacagaaagacgaaaagctgaccaaccgtgtgctgggcagaatgacttttattggcagcatcgacgcaaggtacaaggacaaggctagggccttcagaaagacagctttcaaatga

SEQ ID NO: 10474 - RNA, 939 nt, unidentified
  source 1..939: mol_type = other RNA; note = synthetic construct
atgaagaggcgcttgcccaagaatagaatcatcaccaaaaagaagagctatccgctccaggattcaccattctacaagctgtcaagtaaaacaagactggccagtttgctcggctcaacacctaaggagttgaaaagtctggttggcaatgataactaccactgtttcactcaaaccaaaaagggtaaaccacggctaatacaggagcccttacctcacctggataagattcacagtcgggtagccagcctgctgtgccgcatagagacggtcgacggcctccattctggaaaaaaggggagatccaatatttccaatgcgcgcgcacatcttggtcccggccgtaaagtgataactgccgacatcaaatctttttttccaagcacaacccgcctcatggtcttcgacttcttctataataccatgcagtgctcctctgatgtggctgatctgttatcccggattctgacctacgatgaacatatcccaacagggagcaggatttctatgcccctggcttacatcgccaataaacgaatgtttgatgaaatcgaggacgctgctatgagggtgggagccaaaatgaccatttacgttgacgacctgactttttccggagtgatgctgcacaaggactttgtgaagacgctggaaatgattgcaaagaagcatggccacaggatccacccctcgaagactcggttctattcagaaaacgccatcaagcttattacaggggcagcaatcggtgaggatcgtatcttccctcggaaccgccatttgaaagctctcaaagaggaccttcagatctggataaacagcccgcaaaaggacaggaagcttattaacaaaattctaggacgactcaccttcattgggagcatcgaccctagatataaggataaggccagaacttttcgaaacgtcgcgatcaaatga

SEQ ID NO: 10475 - RNA, 927 nt, unidentified
  source 1..927: mol_type = other RNA; note = synthetic construct
atgaatacgcagaagcaaaaaatcatcaccaagaacaagtattacccagcgaaagattccttgttctataaactgtctagtaaaggccgtctagcaaaactggtttctagcaccgtccaagagctgaagtcgttaaccaaaaacgatcagtaccactgttttacacagagtaagagaggcaagactaggcctattcaggaaccacttcccaagctcgataagattcactcccgcatcgcgtccctgctctgtcgcattgagacggccgacggccttcatagcggaaggaaagggcgcagtaacatatctaacgccagcgctcatattggagtgggcaagaaggtaataacactggacatcaaaaacttctttcctagcactaaacggtcatctgtgttcgactttttctacaatactatgtgctgtagccctgacatcgctgatttactgagccatatttgcacctacgacgatcacatacccaccggttcgcggctgtcaatgccgctggcatacttcgcaaataagagaatgtttgacgaaatggaacagacagctaatgagtgcaacgccaaaatgaccatatacgtggatgacctgacattctccggagaggagctctctaagaacttcattaccagaattgagcttatcgctaaaaaatatggtcacaagatcaattcctccaaaactcgattctatgcagaagatgccgtcaagctcgtcacaggggttgccgtgatcgataatcagctgaagcccagaaacaagcacctcgaagccttgtttaagaagacaaatgactggcaagtgaataagagcatgcagtcacggaactgcatcttgggctatatgacctatctagggagtattgactcacgatacaaagacagggctcggacttttaggcagaaagccatcttttga

SEQ ID NO: 10476 - RNA, 924 nt, unidentified
  source 1..924: mol_type = other RNA; note = synthetic construct
atgaaacagaagaaaaacaagatcattaccaagaacaagtgctaccccattaaggatagcgtgttttataaactgtcttctaaaggccggttggcaaatcttctttccagtacagtccaggaattgaagtctctgacgaagaatgaccagtatcactgcttcacccagttaaagagaggcaaaactcgcctcatccaggagcctctacccaagctggacaagatccacagcagaatcgcgtcactgctctgccgcattgagacagtcgatggtctgcactctgggtgtaagggaaggtccaatatcagtaacgcaaaagctcatgtgggcgtcggaaaaaaggtgatcacactcgacatcaaatcattcttcccatccaccaaacggtcctcagtgttctatttctttaacaacactatgtcctgcagccctgatattgcggatttactgtcgcaactgtgtacttatgaggggtacattccaactggttcccgactttctatgcaactggcctactttagtaacaaacgaatgtttgacgaaatggagcaggctgccagcgagtgtggcgcaattatgactatatatgtggatgacctcacattcagcggagccgaactgtcacgtaatttcatcaagcggttggaatttatagccaagaagtacgggcacaagatacagagctctaagacgaggttttacagcgaaaacgaggttaagctgatcaccggagttgctgtgatcggtgaacaactcaaaccgaggaataagcatctggccgctttgacccaggagattgagtactggagagtaaataaatcccagcagagtgccaataggatactagggtatatgacctaccttggctcaattgacagtcgctacaaagataaagccaaaacattccggcatcaaatggcatga

SEQ ID NO: 10477 - RNA, 933 nt, unidentified
  source 1..933: mol_type = other RNA; note = synthetic construct
atgactcaaaatagaagaaaaccccgtatccagacaaagaacaaaagttatcctctgcaggattcacccctctttaaacttacaaccaaacgaaagctggctaagatcatattcagcgagctggccgagctcaagcagctgtgcaacgataacaattattcctgcttcaccgaaattacgaagggcaagacacgatttattcaggctcctctgcggcgccttgatatggtgcatactcgtattgccagtttgctttgtaggatcgacgttccaaatgaactgcacagcgggacaaaaggccggtccattttttcgaacgctaaagcacatttaggcgtgggacgcagaaccgtaactgtggacatcaaatcctttttcaaaagcacctctcgatctcaagtcttcgacttcttcagtgataccatgaagtgtgcgccagatgtcgccgacttactaagcagactcctcacatttaacgatcacatcccgactgggtcaagggtttctatgcctatggcgtacttcgcaaaccagaagatgttttgcgacatgcaagctgtggccgatgcgcggggagctacaatgactatatacgtggacgacctcacgttctccggtaccaaattgaatcaccagtttgtggacaagatctcaaatatcaccgaaaagtacaagcatacactgcacccagataaaacccgcttctacggccctaaggcagccaagtgcattacgggcactgttattgtggggaatgagttgaggccccggaattgtcagtataaagccgtccacgaggacatgcagaattggctgagcatcaacaaacccgacgacgctctagccgcaaggctgctgggaaggatatctttcattggtaacttcgatgccaggtttaaggataaggcagtacgctttcggagagccctgtga

SEQ ID NO: 10478 - RNA, 963 nt, unidentified
  source 1..963: mol_type = other RNA; note = synthetic construct
atgatcaagaagaagaaatcaaagctgaaaatccggaccaatggcaaaatatacaggcttcaagacagccctttctacaagttgaccagcaaaaagcgattcgcatctttgctaaatctggagtacgaccagctaaagcagttactctctaattcagattctaagtttgagaagttcactcaggtcaaagagggtaaaaagcccagagctatccagaagcccatcaccagcttcgctccactgcactgtcgcattgcaagtcttctctgcagaattggtactccagagtacctgcacagtggaaaaaaagggcgctctaatctgagtaatgcccaatcccactcagggaagcacaagctgctcgctgtggacattgaatcattctttgaaagtaccagccatgagaaggtgtattcgtttttccggggccatcttaaatgctcttccgacatagctgacgcgttgtgtaaactgtgcctttgtgactcccacattcctacaggcagccaactgtctatgccgctggcctactgggccaactcaaacatgttcaacgaactggatatgttggccacaaagcatagggtgaagatgtccgtatatgtggacgatgttgtctttagtggagagcagctgaataagctctttttgtcgacggttaaaaaaatttgcgcccgctatggaatgacagtgcatcctgataagatcaggctttacaacaaggagcagcccaaagtggttactggggtggcgattataggaggcgagttaaaagtagatcacaagcagcataagctgctcgaaaacgacctgaaactgtggaacgcctgtaaagaagatcccatcgcatccgacctctccctcccacgaaaaatctccggccgtttatccgccatggggagcgtcgagaaggaatatctggatcgggcaagaagctttaggaaaaagaacagcatcagatga

SEQ ID NO: 10479 - RNA, 951 nt, unidentified
  source 1..951: mol_type = other RNA; note = synthetic construct
atgaatcagattaatctgaagccaaagctgatcaccaagaacaaatcatacaagatccagaactccgccctttatatgattaagaccaagaatcacctggcgcgagtgctattggtcgatattgaggagataaagaacatcgagaacatttgcacgcaatacaatgtgttccagattgagggtaaatcctcaaagctcagggaaatacagactcccatcaattttcttgagattgtacacaatcgcatcgctagtctgttatgtcggattgaaacaccaaactttctccatagcggaaagaagtctcactctaatataaccaacgccaaagcccacttggggtataatctgcaagtgctgaccatcgatatagaaaatttctatcctagcaccactgcccagaaaatctacaaatttttcttacacggcatgaaatgctcggagacaatctccaagatcctcactaaaatttgcacatacaatgaacatctgcctacaggctctagaatcagtatgccgctcgcatattttgctaacatgttgatgttccaagaaattgagaagctgagcatcaaacacgaaatcaagctcaccgtgtacgtagacgacataactttttcaggatttaaggtcagcaccctgttctacaagctgattcgcaacattatcttcagacatcagcacctggtgaacataaagaaaaccaggttttatctgaagaaccagcccaaactggttacaggcgtcatccttaaagagaattccatcttcattcgtaacaagcatcataaagagctctacgaactaaaggagttgtacgaaattacgaaaactaataaccccgagcagcttttctccatccggaataaattagtgggtaaactctatagctgtggggttatcaacagtaaatataagtctgaggcaaagatctacctgaacacaccttga

SEQ ID NO: 10480 - RNA, 951 nt, unidentified
  source 1..951: mol_type = other RNA; note = synthetic construct
atgatccaaaagaatagcaagcccaaactggtgaccaagaacaagtcttattccattcaggacagtgcactgtacatgatcaagactaagaaacacctagctagagtgctcctcattgacgtcgagaaactcaagaacatcaaggatatatgcactcaatacaacgtgttttctaccaacgggaagagtaacaaattgagagaaattcagaccccgatcaacgttctggagacaatacataatcgaatagcctcactcctgtgccgcatcaagacccctgactttcttcattccggtaaaaaaaaccacagcaacatttctaatgccaaggtccacctgggagagaatctgaagatccttactattgacatcgagaaattctttcccagcacggcaagcaaaaagatctatgagttcttcctttacggtatgaagtgcaataagacagtgtccaagattttaacccagctgtgtacttataacgaatgtctgcctaccggatcacggattagtatgcccttagcctattttagcaacatgttgatgtttcaggaaatggctctcctggcttccaagcatcagataaacatgactgtgtatgttgatgacattacattttcaggctccaatatttcaaccctgttctacaaactggtcaagaaaatcacaatccgtcaccagcacagtatcaatgatgataagactaggttctatacagagtaccaaccaaagttaataaccggagcgatcctcaaaggcaattccttgctaattaggaacaagcatcacaaagaactctatgagttcaaagaactttacagcttcacaaaggataataatccaacgcagttgtctgaagtgcggaataaactgatcgggaaactgtactcgtgtggcgtaatcaatgtgaagtacaaatctgaggccaaagtataccagaactacctgtga

SEQ ID NO: 10481 - RNA, 951 nt, unidentified
  source 1..951: mol_type = other RNA; note = synthetic construct
atgaactcgaaacttaaaattgtgactctcaagaagagttacaatattcaggacagcgccctttttaaggtgaggtccctgaagcaccttgctaaagttctcctcatcgatatcgagaaactgaacgacctgtccttcactaaggatcagtacaggatcttcacaatcactggaaagtctggtaaggaacgcgagatccaaaatcccacaggattgctcgcccagattcacagtagaattgctagcctcctatgccgtatcaaaactcccgattatcttcattccggtaagaaaggccgcagcaacgttacaaatgcaaagtatcacaccgggcataacctggaaattttgaccgtcgacctcgtagacttctaccctagcaccaccagtaacaagatattaaacttctttctctgcacgatgaagtgttcttataaggtggcctgtatattgactacactttgctcttacaatgagaaattaccaaccggatcacagatctcaatgccactggcgtattttgcaaactgcatgatgtttaaggagattgaagccctgtccaataaacacaacatcaaaatgtccatctacgtggatgacatcacgttttctggcgagaagatcacccggctgttctacagcctgataaaaaaaattgtcgtaagacacggccattctttgaagcatacaaaaacccggtactataagaagagctcagcgaagctgatcactggcgtggtcgtgaaggatgcaaatctgctgattaggaataagcaccaccaggagatctatcaaacaaaagagttgttaaccatcgctatacactcagacagcaaagaacagattggcagtctacgactgaagctgattgggaagctgcatgcctgtgggtccattgatcctaaagctaaatctgaagcctattactaccagagacaatccataaattga

SEQ ID NO: 10482 - RNA, 948 nt, unidentified
  source 1..948: mol_type = other RNA; note = synthetic construct
atgaaactgcccgctaaacattcccccaagcttcacatcaaatccaacaagaaaagctacctgccgagcgatagcgctctgtataacctgaccactaagaaacgcctcgaagcaatcattgggaaaaccatcgcagagatcgaggccgccgggattgacgagaactatagagttttcggactgaaaaaaggtggtaagactagggaaatacaggcccctaagtactcccttgatgtcatccatacccgaatcgcgagtctgttagtgcgtgtggccgtcccagattacctccattcgggaatcaaagggcgaagcaatatcacaaacgctaaggcacacattggtaatcatcctctgctcacaatggacattcagaagttctacccttccattagcaagaagtccatcttcaatttcttccatattaggatgaacgcctctcgcgacgtggccggaatcttggcagaggtctgttcatacaaagattgcctgcccaccggtagtcggataagtatgcccctaagtttttgggtgaactatgagatgtattctaaattggagtcattgtgcctgaataagggcatcattatgacagtattcgttgacgattttacattctctggcgatcaggtggacgaaaagtttaagaagcacgcaaagaagataatcaaggagtcaggcctggaggtgcacccacggaagactcggttatttgggaaaggattcccaagagtcgtgaccggagccctagttgacggcagcgggataaaggtaagaaataagcaccacaaatcaatctacacgctctttggcgaaattgaaaagtgttctgatgacaagaaacttgaaaagatgcagatgcaactcctgggcaaactttctgctgctggccagattgacaaatcctttaaaaataaggcggctcaatttaggaaagccatttgctga

SEQ ID NO: 10483 - RNA, 990 nt, unidentified
  source 1..990: mol_type = other RNA; note = synthetic construct
atgaagaagaagaaaaagctgatcacacacaataaggagtacactctggacaagtctcctcttttcaatattgaatacatcaagcgcctcgtcagtgttctgaatgcagatgaggagatcatcaccagcctcatcaaatacaaggctgaaaactacaactgcttctcacagggaaagaagaagcgggagatccagacaccaatcaatgagctgtacctcattcataacagaattgcctccctgttggctcggattaagctgcccaaatacttgtactctggcgtgaaaaaccgatcctatattgacaacgccaaagaacacctgaatagcaaggcgatcctgacaactgacgtgacggctttttttccatccactaccagaaccatgatattctggttcttcaaagacaaaatgcagtgtagcagccgcatggccaatatcttggccgacttatgcagtataaacgatcatttaccaactggctcccaaatctcaatgcctctggcatattgggtgaactcctctatgttcaaggagctgcataggctagcagaagatcacaagctcaaaatgacagtttacgtggatgatctgactttttcaggggaaaaagtccctaaaggttttaagtatcaggtagagcagatcattaagaaacacaagcaccaaattaagagtgaaaaaaccaccctctacaataaccaatcggttaaggaagtgacagggcttatactgaaagagggtaagctgcttcctcccaacaggcaactgaaaaaactccatcagcatcttaacctatgggaaaaattgatagagtctccccgtaatggaattaaaatcgagtggctctatcccaaggtgatcggcgtcttaaacaatattacctattttagaccggagtataagaacgtaatctttgctattcagaaggagtatcaccagtataaaaatacgcccagcaattacaagaatcagatagacgccaactga

SEQ ID NO: 10484 - RNA, 978 nt, unidentified
  source 1..978: mol_type = other RNA; note = synthetic construct
atgaaaaagaagaagttgataacccacaataagtcctatgcgatcgacaaaagccccctctataacattcaatacatcaaaaggctctcagatattctgcagatcaacgagaagacaatcttctccttgattgagaataagaccaagaattacaactgtttcctgcaggggaaaaaaaaaagagagatccagagccccattaacgaactgtaccttatccataatcgcatcgcctccctgctggcccgggtgaaactacctgaatatctgtattctggagtgaagaaccgttcttatatagacaatgctaaagctcacctgacatcaaaagaaatcattaccaccgatataacagccttttttccttctaccacaagaacgatgattttctggttcttcaagaacaagttaaagtgcagtcacaagattgcaaatattctcgccgatctgtgctccattaatgaacatttgcccaccggcagtcagatcagtatgccgctcgcgtatcttgttaacgcctctatgtttgacgagttaaacaatctagctgagaaaaacaagctgataatgacggtgtatgtggatgacgttaccttctcaggtgaaaaagtcccaaaaggattcaagtaccaagtggagcgcattattaagaaacacaagcacaacatcaaggcagaaaaaactactctgtataagaaccagtcggtaaaagaggtcactggtctgattcttaaggacaacacactgcttccacctaataggcagtttaaaaaactccaccagcatctcaccttatggaaaactctgatcgcaaaaccccgaaacggcatcaaaatagagtggctctaccataagatcgtaggcatcttgaataacataagctactttaagagcgggtacaagaatgtcgtgtttgctatccaaaaggagtaccatcagtacaagaatactccaacaaattacaagaaggccgattga

SEQ ID NO: 10485 - RNA, 969 nt, unidentified
  source 1..969: mol_type = other RNA; note = synthetic construct
atgaaaaagaagcttatcacacacgataaaagctaccagctggaaaacagcccactgttcaagattcaatacaccaaaaggctgtcacaggttatactgcagtcagaagagacaatttcatccgtgttcgagtctaaggcccagtactacaatatctttcagcagggtaatcgcctaatcgaggttccattacggacactctacgcaattcataacaggatcgcctccctcctggctcgaatcactccccctgattacctgtactctggcatcaagaacaaatcctatattacaaatgcccagcaacatctggactctgatgtcatactaacgacggatattaccgcctttttccctagcactactaaagagaagattttctggttcttcaaggacaagatgcaatgcagtaccaaaatagccaatcacctggctgaactgtgtactattgacggacacttgcctaccgggagtcagatctcaatgcctctggcctattgggtgaatgcaaacatgtttgacgaactcaatcgactcgctaaggagaacgagctgaaaatgacagtttatgtggacgacgtaaccttcagcggggcaaggattcccaaggaattcaaatttcttgtcgaacgcaccattaagaagtatagacactccatcaagttagagaagacaaaactctataagtctcaaagtgcgaaagaggtgaccgggctgatactcaaggatggaaagttattgccgtcgaaccggcagatcaaaaaactgcaccaataccttaacctctggggcgaattgttgagccagcccagacagggccggaagatcgagtggctgtacccaaagcttgtgggtgtagtcaacaatatcgcgtattttaaaccagagtaccgtaatgtcgtgtttgctatccatagagagtataaccagtacaaaaatactccctccaactataaaaaggaagtgtga

SEQ ID NO: 10486 - RNA, 951 nt, unidentified
  source 1..951: mol_type = other RNA; note = synthetic construct
atgaaataccccgtgaaatatagtaagccttcttacccactcagcaaaagccctttttatcgcctgtgctctatttcctacctaaagcggatcctcgaagtctgtgtttggtatgaagaggaactgttaaacgagatcgagcagttctactcctgttatgactctagtggccatcagaaaagatttccctatccaattgacgaactgtacgggattcataataaaatagcgtcctacttggcccgcatggagatgccagaatacattcattcaagcaaaaagggggcaagctatttaacaaatgctcaggtgcatcaaggcacaaaggagacgtttaaaaccgatatcagatctttcttccagtcaacaaccaaagccatggttttcaaattcttccggaagaagatgctctgctcgcgcgccgtgagtgagtatctggcccacctttgcacactggataacgctctgcccctgggtagccaggtgtcaatgcgactcgcttactttgctaatatggatatgtttgagcagctgtttctcttagcacaaagccacaaccttcgaatgtcagtatatgtcgatgacataaccttttccggggataagattcccaagggtttcaagggccaggtggcacagatagtccaccggcacggacacaagatcaagagaaataagaccaagtgctactcccagaataaaaaagagatcactggcattatgatcgacggagagactcttaaactgcctgataggaagctgctgcaaattcacaacgaattcaacaagttcaaggcactcctaaagacgaccgaaagggacaaagagaagatcttgtacaagactcgttatttgttcggcctgttgaatcatgcggcccaatttgacccgaagtaccagctgatcaggaaagagctcaaagccaaaatcaacgaaaagtgtggactttga

SEQ ID NO: 10487 - RNA, 1173 nt, unidentified
  source 1..1173: mol_type = other RNA; note = synthetic construct
atggccatccacaaacgccataccctccaaacgtccccactgtatggtctgaagcatctgcatcagttgcaacaccttctgtaccattcccgttacttcagaaataccaacattgacttggacaagcagtacaaactctcagagactgctcatcgagaggttttctatcccgatgatacgctatataattttcacagcgagctgaacaagttcctcagcaaaatagagaaacccgagtttatcaaatctggaaagaaaggcgaatcttacctgacacatgtgtcatcacacattaacaagaatcagtacttcagtttagacattaggagctactattcaaacattaatcgccttgacgtgttcaagttttttaggaataacctcggttgttctcacaagatcgccaactacctagcctatttttgcacttacaaggatcagctaccgctggggagtcctatgtccatgaacttggcgtattttataaatgagcccatgttctattgcctcaatgaaatcgctgtgaagaataatttgagcatgaccgtgtatgtcgacgacatcgctttttctggaagggtgatcacctccaaggttaagtatgacatcatcggcgtaattaataagcatggctactccataaacgaagacaaacttcggttctacaaaagtaaaaagacatatcgcgagacaagtggactcctgatctataaggggaaacttctgccaaacaaggaaaagctggataagctgcacaagatgctgtccgaatgggatgcacttctccgactcgacaaacctctcgagacaaaaaatcatttcattcggttgatcagcttcatttcctatttatgtcagattgataccaagtacatgcaactgaagtataaggtcatcaaagaatacaacaacaagaaagagggcgatttgttagccatttaccaggatagaattaccgagtggaacactctgctgtctaatcacgagactagttttcacgcattaaatgaaaaacacgccgaactgaacgaactgatcaaaaacctttcgaagctcaacaagaagcacctgatactgtacaaacagatcaaatacgagcacgagaagttcaaaaaacacaagagatcaagcatagggcggttttttagcgcattctctaaatacctggcttga

SEQ ID NO: 10488 - RNA, 933 nt, unidentified
  source 1..933: mol_type = other RNA; note = synthetic construct
atgatcctctgtacaactgacgagatcttttccatcattaacaacaagatcttctactacaacatgttcgagattgggggcagggtttgccacacgccctgttatgagttgaaggggcttcattccagactggcccaattccttgtgaggattaaaaagccccgctacttatattccggagttaaaggcctgtcttacgtggacaacgctcgcgtccattctgtctattatgaaacattcaagacggatatcagcgagttttattcagcgactacccaggctatcgtgttcaagtttttcaggaacaagatgcagtgtagccacaaggtagcaaatatattagctgaactctgcacacttgaggggaaactacctaccggctcgcagctgtctatgatcctggccttttgggccaattcagatatgttcgaacagttgaatcagctggcacaggagcaccatttggtgatgacagtgtacgttgacgacataaccttttcaggcgccaaaattcctgctggtttttgccagcaggtagcacaaattatgagcgaacatggacatgcaatgaataagaagaaaactcggctctaccaggcgaatagtcacaaagaaatcaccgggctgattattaaccgggtgggagacagcccgataccaccaaaccgtttttatctcaaactgcataacaaactggccgagttcaatcagatctacgccgaaattaaaaatggcaagagtaaaatggaggaggataccctgcgacaactaaccaaccacctgataggtctgctcaatcacgccagtcagttcgataagaagtacaagatggtgaagaagcacatccagaagcaacacgatgaccttattcaatatctgcagactacacacaaagtcggctccggaaagttgggtaaactctgcatcagatga

SEQ ID NO: 10489 - RNA, 987 nt, unidentified
  source 1..987: mol_type = other RNA; note = synthetic construct
atgaataaaatcagacgcaagagtctgaagattcctatcaggcagacaaaagaatatgatctcaaccaatcaccgttctttaaattggtatcaatcaagaagctgctgtctattttgcgagtgagtcaggaggaactgaaggacattctcgacaaccccacctctcattactctatcaggattgagaataaaagggacattcagagccccaaaaagtatcggatcttatatagaatccacaacagaattgcccatcacctccgagctattatcactccagattacctgttttccgataaaaaagggtgcagtatctatgacaacgcaatagtccattttggctgcaaaatgctcctgaatgttgatatctccaaatttttcccaagcaccaataggaacaagatttactctttcttcaagtactccatgcaatgttcctcagaaatatcggacatcatgtcctacttgtgttcaatcaataatcacatccctacaggttcgcagatttcaatgagactggcttaccttgtcaataagaagctttttgatgatctgtacaagtttgccaaagacaaaaacctcaagatgagtgtatgggtggatgacgtttcatttagtggcgacaaaattgattcctccgtgatttatgtcgtggaaaagataatcaagaagcacgggttcaatgtgagcaaaaataagactcagatacggcactccaccgaaaacaaaagcgtgacgggaattttcataagcggagacataatggaggcgagcaaggagctgtataaaaagcgtcgcatcaagcttcgggagtggaagaatttcatcaaaaacaaggagatttccctcgaagaattagagaaagttaaagactctctactaggcctgcttaactacttaaacctgttcgagcccagcagcagcaagtatattgccctgatcgagaacgatttcttgagttactctaacaagcgcatctctatctga

SEQ ID NO: 10490 - RNA, 981 nt, unidentified
  source 1..981: mol_type = other RNA; note = synthetic construct
atgaataagatccgcaaaaaatccctgaagatacctatcaaacaaaataaggagtacgagctgaatcagtcgccattctttaaattagtgtcacttaagcgactgctgtcaatcctgcgggtgagcgaggacgagttgaaggacatattggacaatccggcttcatactattccattcgtgtcgaaaacaatcgggagattcagtctcccaaaaaaacgaaaagtctctatcgcatccacaatagaattgcacatcatttgagggccattattaccccttgttacctgttcagcgataaggttgggtgcagcatctacgataacgcgtccgtacatatcgggtgcaaaatgctgctaaatgtggacatctctaagttttttcctagtacaaaccggaacaagatttacagtttcttcaagaaggatatggaatgcagcccccagatttccgaaattctctcctatgtgtgtagcataaacggccacatccccactggatcacaattatccatgagactggcttaccttgtcaacaagaagctctttgatcaccttttccattttgccgagagcaaaagtctaaaaatgagtgtatgggtggacgatatctctttctctggcgaaaagattaatagcaacttcctgaactcagtcgagaaaattatcgagagacacggtttcaacataagcaagcacaagaccaaactgaaacattccacagagtccaagtctatcaccggaatttttatctcaggtgaaaaaatggaagcctctaacgagtcttatcagaaaaggcgagtgctgctggaaaaatggaaggagtctataaagaacaaggagatcccaataaaagaactcgaaaagctgaaggattccttactcggcttgctcaattatctcaatcactttgagaactcgagtaagaagtatattttccagatcgagaaagactttatcgaataccttaagagggttagctga

SEQ ID NO: 10491 - RNA, 990 nt, unidentified
  source 1..990: mol_type = other RNA; note = synthetic construct
atgaaaaagaaattcaaaaagctgcacatcacccagactaaagagtatgaactgacacaaagtcctttcttcaaactctattccgtcgataagctgttaaacatccttaaagtggagagggaaatccttgaagacatcctgaattttcccggcaactactacacattcaaaactagcaatggacgtaatatccagacaccttcaaaggatctgtcactctaccttattcataattgtatcgcaaaccatctccgcgctatcataacacccgattatctctttagcgacaagaagaattgcaccgtctacgacaacgccagcgtgcatttaggctgtgatatcctgctgaacattgatatctctaagttcttcccttccacgacctatatcaaagtttttaagttcttccggtacaggctgttatgttcaacagagatagcagacattttggctcacctgtgcacgattaatgaccacattccaactggatcccagataagtatgcggctcgcctttctggtgaatcagggtttgtttaatgacctgtacaatcttgccatttcaaagaacattaagatgtctctgtgggtggacgatatctccttttcgggtgcggaagtcactccgaccttcaagtacaaggtatataagatcattgaggaatacgggtttaaagttagcgagcacaaaactaaactatcctataaaggccaaccaaaatctgtgaccggcatcttcatagatggggataaaagtattggggccaatgagcactataagaagagacgcgtgctatttaagaaatggaaagacgcatgcaagaaaaagacctttaacaagaagcagtttcagagaattaaggctctgcgaatacagatcttgggactcttgaactatctgaatcattttgagcccagctctaagaactacataaacattatcgagaacgacttcaaaaagatcaagaacaagttcctctacaaaatttga

SEQ ID NO: 10492 - RNA, 960 nt, unidentified
  source 1..960: mol_type = other RNA; note = synthetic construct
atgactaaactgaacactcgaaacaagtcttataatttggaggaatcccccctctataacatccagtacgaacagaagttgctcaagattctcaatattagtcagaatgacctgattttcgttcgggagaacttgaaggacttctatcattcattctccaaaaagcatagaatcatccagacccctaaaaatctgctgaaacaaatccactaccgcatcggagatcttctggctaggatagctatgcctgactatctgatgtcggggaagaagggtgccagtcacatagagaatgccaaattacatctgcaagaggacctccacgtattcactgccgacatagaaaaattttttccctcaacaaagcgccaggccatcttcaagtttttcaaaaacaagcttcagtgtagccacaacattgctaccatcttgtctgaactatgcacaacccacgagggcagattacctacaggcagtcaactttctatgcatctagctttttggacgaactttaacatgttcgaaaaaatcgcaaagttgtcaaatcagtatgacctgcgtttttctatcttcgtggacgatcttactttcagcggaaagactattccgcacaactttaagtaccagctgaagaagatcatcaccagctacgggtatcaaataaatacacagaagattctcctcttcaaaccatttaagatccggagagtcaccggcatttacattaaaaacggtgatacccacctgcccaatacctttctcagggagctacatacagcgttacagagctggaaggatattctgaaaacttccccagataaactggataaaaagaaactggagacgacctataataaactccttgggtccatcaactacgccgcactgctggacaaaaagtacaagcagatcaggaagaaagtgatagcagagaagcagaaaattacacagtaccaatga

SEQ ID NO: 10493 - RNA, 960 nt, unidentified
  source 1..960: mol_type = other RNA; note = synthetic construct
atgtcaaagaagaagctgaagattaagtcctccaaaaagtactctatcaaccagtgccgactgtacaaggttacctcactgaaaaagttgtgtgaaattctgggcatcaataatcgcgaactaaaattgatcatcgacaaatcgaagaacagggagttttataactgttacatcaatcagaaggggcgcctgatccaggagcccattaacttaatgtatcgggtacacaacaggatcgccaatctgctagccagggtggagacacctagttacattcattacagtaaaaggggctattcacacatcagcaatgcaaaggctcacctggattccaaacagcttattacattcgacatcaaatcctattaccaaagcatcgactatgaaacgctcagaagattctttcgggagaaactgaaatgtgaacaagatgtcgcctacattttatcaatgatatgctctttcgagggaagcctgcctactggtagtcagataagcgtctacctctgcaatctgaccaaccttgatatgttcgacgaaatgtaccttcagtctaaccgagttgaccaaaagtttactgtatacgcggatgacataacaatcagcggacgtaccgtgaataactcccattacaacgtgatgaagaagatcattgagcgctacggctacatcataaaagaacaaaagactaagcggtacactagcaatcagataccaattgtcaccggggtggctctcagaaatacagtggatgtgaagaatgagtattataaaggcctgcggaagttgtgcgagggtgttaactttaatattgataacgagccgtatgcccagttaaaagacagatatctctctttgaaaggaaagacgcagtatatcaagcagcttaacaaagaagtgccctatttcattctccaaacccagatgctcctggagaaaaagctcgaagggcagctgtga

SEQ ID NO: 10494 - RNA, 960 nt, unidentified
  source 1..960: mol_type = other RNA; note = synthetic construct
atgtctaggaagaagttaaaagttaaggcagacaaacgatacagcatagatcaatgccgcctttataagataaccagcctgaagaaactctgcgaaattctctctatcaacaacgaagagctgaaactcctgatagacaaatctcggaactcaaagttctataattgctacaccaatcagaaggggagactgattcaggagcccattaaccttatgtacagagtacataacagaatcgccaacttgttggccagggtggagacaccgtcgtacatcaattacagtaagaagggctgctcccatatcagcaatgctaaagcccacctctattctaagcagctaatcactttcgatatcaagagctactatcagtccatttgtaatgaggcgttgcgccgttttttccgggacaaattaaaatgtgagcaagacgtggcttatgtgctgtcaatcatctgttcctttgagggttccctccccacaggctcacagatctccgtctatctctgcaatctggcaaatatagacatgttccacgagatgtatctacaaagtaaccgctttcagcaagagttcactgtgtatgccgatgatattacaatcagcggagatattgttaacgactcccactacaacgtgatgaagaagatcatcgagcggtacgggtacataattaaggaagagaaaaccaaacggtatactagtaatcagacgccaattgtcaccggggtcgctctgaaagacacagtggatgtaaaaaacgtctactacaagggattgcgagaactgtgtgagtctatcaacctgaacgtggacaatgaaagttacgcacagctgaaggatgaatatctgtcactcaagggtaagattcagtacatcaaacagctgaatagggaagttccttgttttattctgcagacccagagccttttagagaagaaacttgaaggccaactgtga

SEQ ID NO: 10495 - RNA, 960 nt, unidentified
  source 1..960: mol_type = other RNA; note = synthetic construct
atgagcggcaagaagctcaaggtgaaaactgataaaaagtatagcatcgaccaatgtagactttaccgggtgaccagcctgaaaaagctctgtgagatcttggggattaataaccaggacttgaaagtcctgattgataagtcgaagaacagtgagttttatcactgctatgtcaaccagaaaggcaggctgattcaagaaccaattaatctgatgtaccgcgtgcacaatcgaattgctaatctgctgagcagagtggagacacctagttacatccattattccaagaagggatgttctcacatctccaatgctaaagcccatctccactctaagcagctcatcactttcgatatcaagtcatactaccaaaacattgggaatgagacaatccggaaatttttccgtgataaacttaagtgcgaacaggacgtggcatacattcttagcatcatctgttccttcgagggctctcttccaaccggatctcagatatccgtatacctgtgcaacctcgttaacttagacatgtttcaagaaatgtacctgcagagtcataaagcccagcagcagttcaccgtgtatgccgatgacatcacgatatcaggccagatcgtgaatgattcccactataatgtcatgaagaagatcatcgagcgctacggttatacagttaaagaggaaaagaccaagaggtacaattcaaaccaaattcctatagtaaccggaatagcgctaaaaaatactgtcgacgttaagaacgtgttctataaagaaagcaggaagttgtgcgagaacattaacatcaatattgacaacgaaccctacgcccagctgaaagacaagtatctatcattgaagggtaaggcacaatatatcaaacagctgaacaaggaagtcccctactttattctgcagacacagatgctgctcgagaaaaaattagaggggcagatatga

SEQ ID NO: 10496 - RNA, 960 nt, unidentified
  source 1..960: mol_type = other RNA; note = synthetic construct
atgtcgaaaaagaaactaaaggtcaaggccaacaaaacgtatcccttaaatcagtgtctgctgtacaaggtgccgagcctaaaaaagctctgtgttattctcaagatcaccaaggaggagttgctgactttaatggctgatagtgagagcaacgggctgtataattgctatgagaataaggagggcagacttatccaagaaccaagggacctcatgtacgtggtgcacaaccgaatagctaatctgctttctcgtgtaaaaacacctgactacatacactacagtaaaaaagggcattctcatatcagtaacgctgaagttcacctggacagcaaccagctcatgacctttgatattaagtcctactatccttctatctcctcagaattaatccgcaagttctttagacacaagctgaagtgcgaacaggacattgcatacctgctgtcaaaattgtgtaccattgatggctcactgcccacaggttcccaaatctcagtctatctatgtaatctcgtgaacctggacatgtttaacgagatgaagctgcagtgcgaccggtttaaccataaattcactgtctacgccgatgatataaccattagcggcgaatccgttaatgaaagtcactacaatgtgatgcgcaagatcctcgagagatatggatacgaaattaaggagtccaaaactaaaaggtacactagcaatcaaacgccaatagtgaccggtatcgccctgaccaaaaaccttgacgcgaagaatgatttttacaagcagctgaggcagctgtgcgatgacatcaacttcattattgacaacgccagctatgcacagctcaaagatgagtattactctttgaaagggaaagcccagtatttgaagcagcttcaacagaaggtacccgagttcgtgttcacaacacaggcacggttggagaagaagcttgaaggacagatctga

SEQ ID NO: 10497 - RNA, 954 nt, unidentified
  source 1..954: mol_type = other RNA; note = synthetic construct
atgtcaaaaaagaaggtgaaggcgaataagatttacagtctcaaccagtgccggctttacaaagtaacttccttgaaaaagctgtgtagcattcttaagatcaccgaagaggaactgtctctcctcgtcgagagttacgagaatagtgacttttacaactgttacatcaacaaagatggaaggcctatccaggagcccaaaaaattaatgtacagggttcacaatcgcatcgcaaatctgttatcccgcatcgagacacctgaatatgttcactattctaagaagggacatagccacatctccaacgccgaggtccacctgcattcaaaacaacttatgaccttcgacatcaagtcttactattcaaatatcagctcagagagcattagagtatttttccgacataaactgcaatgcgagcaggacatcgcttacctgttgagcaagctatgcactttaaacggctccctaccaaccgggtcccagataagtgtgtatctgtgcaatctggttaacttggatatgtttgacgaaatgaaactgcagtgtgaaatgttcgagcagaagttcaccgtgtatgcagacgatataacaatctctggcaaaagtgtgaataagagccattataacgtgatgtctaagattctcgagagacacggctatgaaatcaaagaatctaagacgaagcggtttacatcgaatgagattcccgtcgtgaccgggattgccctcaaaaaaacaagcgacgtgaaaaactccttctacatggagctgcgtcagctctgtgaaggtatagatattcacattgatgacgcctcatatgcccagcttaaggatgaatactattccctgaaggggaaagctcagtacgtcaagcaactgaaccagaagataccaaagttcgtgtttcagactcaagctaaactggaaaagaagctcgagggtcagttgtga

SEQ ID NO: 10498 - RNA, 966 nt, unidentified
  source 1..966: mol_type = other RNA; note = synthetic construct
atgaaagtgaaatctaacaagctcaaggtcaaaacagacaaatactatccactgaaccaatctgctttataccgtgtaaacagcaaaaaaaagcttgccgaggttctcttaatctcaggtactgaactggctacacttataagagatgatgacaagatcaagttctataactgctatctcaatgaaaaggacaggctgatccaacagcctcagggattgatgtataaactgcacaatcgcgtggcgaaccttctttctcgcatagaaacccccgaatacattcaatactccaagaaaggactgagccacatcactaatgcaagcattcatgcaaacagtaagcaggtcatcaccttcgacattaagagctattacctctccattaagagggagagtgtacaaaacttttttcgggaggaactggagtgcgagatcgatattgcattcattctttccaaactgtgcacactcgatgaggctttgcccaccggctctcagatctcaaattatctgtgtaatctggtgaacctagtgatgtttgacgagatgaattcattggcctctaggtttgggatgtcctttagtgtttatgcggatgatataacgatcagcggcgacaatctggattcatcgcatctcaatacaatgcgaaaaattatcgaacggtacgggtattgtataaaggacgagaagaccaaaatattcaagggcaatgagacggccgtggtgactggaatcgctctaaaagaaagtttggatatcaagaacgagttctacagcgatctgagaaagctgtgtgaactggtcaattcctacattgacaaagagtcctacgcccagctgaaaggcgactacttcaagctgaaggggaaaatccagtacattaagcagttgaaccagactattccgagactcgccctgaacaccaaggccctactcgagcggaagttagacggtcagatctga

SEQ ID NO: 10499 - RNA, 957 nt, unidentified
  source 1..957: mol_type = other RNA; note = synthetic construct
atgaaaaagaagagaaagctgaaggtgcgccatttcaacaaacaatatcccattcatcagtcgccactttaccgcttgtctagccttaaaaagttgtccgtcctcctggccatgcctcttaaggacatccgtaagctcaacggtaataatgactcccgatacaacgtatttactaacaaagacgacagggagatacaggagccctttaacgagatttacgtgattcacaataagctcgcaagtctgttatctaggattgatactcctacctatctccactctttcaaaaagcagtattcgcacatcaccaacagcaaaacccacctgggcagcgagcaagtgataaccttcgacataaaagctttttaccaaaacatcacccaggataaaatccgaatgttcttcaagaacgacctaaaatgcagcccagatattgcattcctgctgtcaaaaatctgcagctacgataatcatctccccacaggaagccaggtgtccatctaccttaactttctggttaataggacgatgtttgacgaaatgcactctctagcggagacactgaagatctgtttaacggtgtacgccgatgatgtgacaatttctggagaaaaggtcgatatgggaatgttgaataccatgagtaagatagtggagcggcacgggcatacaatcaataagcaaaagactcggaaatatagcaataatcaggttccggtcatcactgggatcgccttatgtaatggcaagacccagcctaccaatgaaaagtttaaggaactgcgccagaagagtaacttcttgctgagagtatccaacgacctggatttggactttctgaaaaaagagagtatgtcactcgatggtactctgaactatttctcccagctttcctcagaagttccaaaatcaacactcgaggcccgggacagactggctaaactactgggcatttga

SEQ ID NO: 10500 - RNA, 957 nt, unidentified
  source 1..957: mol_type = other RNA; note = synthetic construct
atgtctaataagaaacgcttgaagatcaagaatcacaatcagtacccctttcatcagagccccttgtataaacttaagagcaaaaagagactggctgatattttcaatgtggagctcagtgaactgaagtcatggtttaacacaattccaagcgaatataacgttttccttaacgagaaagacagagagattcaaactccactcaataacctgtacattatacacaataggcttgcgaatctgctgtcgagaatagagacgccttcctggctgcatagtttcaagaagaatttctcctacctaactaatgctaaaagtcatatcgattctcgccaggtgttaacgttcgaccttaagtctttttaccagtccacaactcaaaatgccgttcggaaatttttcaaggacactatgctgtgttccgaggatgtctcctttttcttgagcaagatttgctgctacaataaccacctgcccaccgggagccaagtcagtatatacttgtgttacctcgtgaacatcaaaatgtttgatgaaatgaggaggctggctgtcagccgaaatgccctcctgaccgtttatgcagatgacatcaccgtgtcaggtgacaagatcgactattcactgctgaacaccatgcggaagataatcgtgagacacggctataaactctcagaagataagacactccgcttcaaatataacgaaatacctgtgatcaccggcattgccttggtacagggagagctacgtcctacaaacaagtttatgtccgagcttaggagcaaagtatatttcttaaaccggaatgccgaagagctggacattgaactgctaaaaaaggagaaacagcggatcaacgggaagattaactacatcgagtctttaaaccgaccaattccctctcaggcaatcgacatcaacaagaaactcgataagctggtgccgatcaaatga

SEQ ID NO: 10501 - RNA, 960 nt, unidentified
  source 1..960: mol_type = other RNA; note = synthetic construct
atgaaatcaaccaagaggacaccttccctgcaaaggtttcccaaattgtacccattaaatcagtcccccttttttaagctgaaaactcgaacaaaactcctcgagatcataggactgagtcggagccaagcggacaaactgatgctcgacagcgcctacaaggagttcataaatgatgcagggagaagcatccaggaaccgatcgcccagcttaaggcagtccacaaaagaatcggtatactgttcagtcggatcgagctgccacaatatcttcattctgggcgcaagaaacactccactcttacaaacgcagagagtcaccgtcatgccacggagctgctcaagctggatatccacaaattttttccttcaacctctgctgcaaaggtgtataaggcattcgtcgagaagttcgagatgagccccgatgttgcctatgtgatgaccaatttggccaccttcgcaggcaaggttcccactggctccccaatttcgatggccattgctttctgggctaacaaagatatgttcgacgaactgagtaaccttgccacactgtcaaacttggtgtttacagcttacgtagacgatgtggccttttccggagccaaaatccctaagggctttgctagccaggcgaagaaatgcattcattctcacgggttaacttcaaaggacaaaaaggaacgcttctaccctgcatctgaagggaaactactcaccggaattgtgatccagaacggaaagctgaaggtgcggtgggctcataatgacagcattggcaaagaattcgccaccctagctgaggccaaagataatgccgcgaagatttctcatctggagaagctcgcaggcaagctgcacgctgccggtcagattgacttcagacaaaaggataaggcgaggtttttcacgcagcagttgaaggtcgctaaaaaacagagcgaacaggactcctga

SEQ ID NO: 10502 - RNA, 978 nt, unidentified
  source 1..978: mol_type = other RNA; note = synthetic construct
atgaaatcaacaaagcgcacgcctagcctccagagcccaccaaagatttatcccctgaaccagagtcccctgtttaaattgaaaaacaagcggaagtctctggagataattggtctatccaaaaaacaagccgacaaacttatgcttgatagcgcatacaaggagttcgtgaatgacgcagggcgtacaattcaggagccaatcgcgcagctcaaggctgttcataggaaaattggggtgctgctatccaggatcgagttgcctccgtatctgcatagcggtcggaaaaaacacagcacactgaccaacgtggagagccacaagttagccaccgagttgctcaagctcgatatacataagtttttcccgtcgacacgagctgctaaagtctacaaggccttcgtggaaaagtttgaaatgtcacccgatgtagcttacattatgactaatctgagtacctttgcaggcaaggtgcctactggcagtccaatctccatggcaatggccttctgggccaacaaagatatgtttgacgagctctctaatcttgcagcttctaacagcttggtcttcactgcctacgtggacgacgttgccttctccgggtccaagatccccaaaggattcgccgcgcaggccaagaaatgcatccgctcacacggccttacttctaaggacaagaaggagaggttttacccttcatccgaaggaaaactgttaacaggcatcgtaatacaggacggagaactgaaagttagatgggctcacaatgatagtattggaaaggagtttgccacgctcgcggaagcaaaggataatgccaccaagatcatccacctggaaaaactggctggcaagctgcatgccgccgggcaagtcgacttccggcagaaagacagagctagatttttctataccgcagctcagtctcacaagaaagccttacgcacccgatatctgaagcagcaagtggattga

SEQ ID NO: 10503 - RNA, 960 nt, unidentified
  source 1..960: mol_type = other RNA; note = synthetic construct
atgattagcactaagaggtcaagctctttgcactcaagtcccaaactgtatccattaaaccagagccccctgttcaagttgaaatccaagaaaaagctacttgagatcatcgggctcagcaaaaagcaagccgataagctgatgttagactcagcttacaaagagttcgaaaatgacgctggcagagcaattcaggaacccatcgcccagctcaaggccgtccacaagaggatcggcgcattgctgagtcgtattgagctccccccatacctgcattccggccgaaagaaacacagtaccctgactaacgcaaagtgccacaggcatgccacagagctgctgaagctcgacattcataaatttttcccatccactaaggccgccaaggtgtacaaagcatttgcggaaaagttcgagatgtcgccggatgttgcctatctgatgaccaacctggtcacatttgcgggaaaagtgcctacaggctctcctatttctatggctatggccttttgggcaaatcgcgacatgtttgataccctttcagaacttgcttcttctaataacctggttttcacggcttatgtggatgacgtggccttttctgggtccaagatacctaaaggattcgctgcccaggctaagaagtgtatcaaaagttacggtctaacctccaaagataagaaagagagattctatcagtccagcgaggggaagttactcaccggtattgtaatccaggatggagaactgaaggtgcggtgggcacacaataacagtatacgcaaagagtttgcagacttggcgaaggtgaaagacaatagcgccaagatcatacatctggagaagcttgcggggaaactccacgctgccggccaagtcgattttagacagaaggacaaggctcggttcttcacacagcaactcaaagccgcaaaaaaacagtcaacggaaagctcctga

SEQ ID NO: 10504 - RNA, 966 nt, unidentified
  source 1..966: mol_type = other RNA; note = synthetic construct
atgattagcaccaagaggagttcatctcttcacatttctccgaagctatatcctcttaaccagagccccctctttaagttacgatctaagaagaaactgcttgaaattatcggactctctaagaagcaggctgataaactgatgctggacagcagttacaaagagtttgagaacaatgcaggccggacaatccaagagcccattgctcagttgaaggctgtccacaagcgcataggagccctgctgagtcgagtggagctgccaccatatctgcactcaggcagaaagaaacactctacgttaactaatgcagagtgtcatagacaggctacagagctcctgaagctggatattcataagtttttccccagtaccaaagcggccaaggtttataaggcctttgttgaaaagttcgaaatgtctcctgatgtcgcctacgtgatgacaaatctcgctaccttcgccgggaaggtgcctactggctccccaatctcgatggcaatggctttctgggctaacaaagatatgttcgacgagctgagcgaactagccacgtcacataatctgatatttactgcatacgtcgacgacattaccttcagtggactcaaaatccccaaaggcttctccagccaaatcaaaaggtgcatccacagccatggcctggtgtcaaagcagaagaaggaaaaattctactcctcctcacaggggaagctgttgacaggtgtggtaatccgggatggtaaattgaaagtgagatgggcccacaactcctccatcaagaaagaatttaacgaattggcgaaggcaaaagacgacaccgaaaaaataattcaccttgagaaacttgccggacgtctccatgcggccgggcaaatagatgagaggatgaagaataaagcacgcttctttagcaaaaaactcaaggaggccaagcagtccttactgatccggagcactaagtga

SEQ ID NO: 10505 - RNA, 918 nt, unidentified
  source 1..918: mol_type = other RNA; note = synthetic construct
atgaaccagtcgcctttcttcaaactgaagacgaagaagaaacttctggagattatcggactgtccaaagcacagtcagataagttgatgcagaagtccgcttacaaggaattcgtgaatgacgccggcagaacaatacaagaacccattgcacagctcaaggccgctcaccggcgaataggggtcttacttggacgcattgaacttccgacatacctgcattcaggtaggaaaaagcactctacattgaccaacgcagagagccatatccaagcgaacgaactcctcaagctggacatccacaaattttttccctcaaccaccgccgcgaaggtccacaaagctttcgtagaaaagttccagatgagtcctgacgtggcatttctgatgacgaacctagttaccttctccggcaaagtgcccactggcagtccagtctcgatggctatggcatattgggccaataaggacatgttcgacgaattgagcgatttggccatctccaatagtctgatctttactgcttatgtggatgatgttgcgttttcaggtgtgaagataccaaagggatttagcagccgtgttaagaaatgcattcacagtcacgggctcgtgtccaagcagaaaaaggagactttttacgatagcacacaggggaaactcctgactggcgtagtcattcaagacgggaaactaaaggtgaggtgggctcataattcttctatcaagaaagagttcgatgagctggccaaagcagagtctgataccgacaaaatcattcaccttgagaagctggctggcagattacatgctgccggacaaatcgacgagcgcatgaaaaacaaggcccggttcttttctcagaaactcaaggaagccaaacagcatctggccgcccagagctccgagaagagctga

SEQ ID NO: 10506 - RNA, 960 nt, unidentified
  source 1..960: mol_type = other RNA; note = synthetic construct
atgaaatctactaagagaacacccagcctgcatagagcacccaaactgtacccgctgaatcagtctccgttttttaagctgaagaacaagaacaagttcttcgagataataggcctcagcaaacaccaggtcgagaagctgagtttcgaaacggcttacaaggtgttcataaatgaatctgggcggacaatccaggagcccattcctcagcttaaagccgtacataagcgcatcggcattctgttggggcgcattgagctgccaatctacctccattccggaaggaagaagcattcaacgttaacaaatgccgaaagccaccggtacgccaccgagctcctcaagcttgatattcacaagtttttccctagcacttctgccgcgaaggtgtataggacctttatcgacatctttaagatgtccccagatgtcgcctacctaatgactaacttggtgacctactcaggcaaagttccaaccgggtccccaatctccatggccgtggccttttgggccaataaggacatgttcgacgagctctcacggcttgcattctcgaatggcctgatcttcactgtgtatgtagatgacgtggcctttagcggagaaaaaatccctaaaggtttcgcagcacaggctaagaaatgcatccacgcgcatggtttagtcagcaagaaggagaaagaaaccttctatcctagttccaaagggaagctactgacaggcatagttattcaaaacggaaagctgaaagttagatgggctcacaacgcgagtatcaagaacgaattagataccctggctaaggctgagaatacacccgaaaaaattactcacttggagaaactggctggcaaacttcacgctgcaggacaaattgactataggttgaaagataaggcccgtttttttacacgacagctcaaaaaagcaaaaacccagtcagaacaagagaactga

SEQ ID NO: 10507 - RNA, 978 nt, unidentified
  source 1..978: mol_type = other RNA; note = synthetic construct
atgaaaaatactaaaaggacccctagcctgcacagcaaacctaagctgtatccactccaccagtcgccattatacaagctgaaggtaaagagcaagttattccaactgcttgggataacaaagtcacagcttgccaagctttctcaggataagagctacaacgtctttaccaacgagaatggcaggaccatccaggagcccattcctcagcttaaactggcacataagagaatcggcaagattttgtctcggatcgagatgccaagttatctgcatagtggacgcaaaaagcattctacactgactaacgcacgcgctcatatcaaagctaatgagttgctcaagcttgacattcaccactttttccccagcactacagcggcccgagtttacaacctgtttcacaggaagttcgacatgtctccggatgttgcctacctgattactaacttcgttacatactctggtcggatccccaccggctccccgatttcaatggccctcgccttttgggcaaactgggaaatgttcgacgaaattaacaagttggcaatctcccacgatttagtctttaccgtatatgtggacgatctggctttctcgggcgagaagatcccaaagggatttgcttcccaggtgaagagtatcataagttcaaatgggctgatctccaaacggaaaaaggaaattttctatccctcctccaaaggaaaactactgaccggggtggtgatccagaatggcgagctcaaggtgcgatgggcccataatgccagcatcaagaatgaatttgataacttgagcttggcctcacaggacgtccaactgagaataaagctcctggaacgcctcacggggaaactacacgccgctggtcaggtggattacaaactcaaagacaaagcacgtttcttcacgaaacaactaaaaatagcgagatgcacactcattcagcaacctcatctgtctcaccagtga

SEQ ID NO: 10508 - RNA, 957 nt, unidentified
  source 1..957: mol_type = other RNA; note = synthetic construct
atgaagaatactaaacggcccccaagtctgcattgtgccccgaaaacataccccctcaaccagtctcctttctataggctgaaggttaagaaaaagttgtaccagctgctcggtctaaccaaagcccaggtcgagcgacttagtcaagataatagctacaacgtcttcaccaacgaaaaagggagggtgatacaggaacccatctcccagttgaagttagcacataaacggatagggaagatgctggcccgcattgagctcccagatttcctgcattccggaagaaagacatactctaccctttccaatgccgaggcacacatcaatgctgacgagctgctgaagctcgacatacacaaatttttcccaagcacgaccgccgcgaaggtctacaaggtgtttaatgagaagtttgaaatgtcacctgatgtagcttacgtgatcaccaactttgtgacatttagcgggaaaatcccaaccggctcacctattagcatggccattgcctattgggcgaattgggaactcttcgacgagatcaataaggttagtattgcaaacagactagtgttcactgtgtatgttgacgatttggccttttctgggcgaaagatccctaaaggctttgcttcgcaaatcaaatccctgattgctagcaaaggtcttatcgcaaaaaagaacaaggaggtcttttatcccaaatccaagggcaaactcctgacaggcgtagtgattcagaatggaacgcttaaggtcaggtgggcccactcagcaagcattaaagacgaattcaagaacttagctatcatgtcacgtaacaaagaatctactgtgaagttgttagagaagctggcaggaaagctccacgctgcgggcagaattgattataagctgcgggataaggcccgcttcttcactaagcagctgaaaatagctaaatgcgtgctgatcgactga

SEQ ID NO: 10509 - RNA, 987 nt, unidentified
  source 1..987: mol_type = other RNA; note = synthetic construct
atgaaaaacgctacacggagttcctccagcttttcttccctaaagaattacccaattaaccagtctcccctgtttaaacttaccaccaagaagaagttgttagccctcttgggctttagcttaccacagattgaaaagcttagtaaggattcatcctatcgtgtgttcctcacgccctcagacagatgcgtacaggaaccgattctgcagctcaaaaaaatccataagaagatcggatcactccttaaccgcatcgagcagcctgactatatccattctggaagaaaaaaacggagcattattaccaacgcaaaagttcaccaaaattcataccaactcctcaaactggacatccacaagttttttccatctactagtggcagcaagatctacaggctgttcgtgaatgattttcagatgcagcctgacgtggcccatttgcttaccaatctggtgacctacaactattctgttcctacaggtagcccactatcgatggttcttgcttactgggcgaataaaagcatgttcgacgagctgtatcagctggccaacgagaacgatctggatttctcagtgtatgtagacgatgtcgctttctcgggagagaagatccccaagggcttctcccactgcgccaaatcctgtatttctaaacacgggatgaagtccaagtccaaaaaagagatgttctaccaggaaaatcaggcaaaactgctgacaggcgtgattataagtgacggtgtcttgaagactaggtggaaacacagccaaatgatcaagaaggggtttgaaacactggccctgcagaccagtgacggcgacagggtcatcgccctggagaagttaactggaagattgcacgcggcagggcaaatagatccccgaatcaagagcaaggccatccatttctctaaaatactgcgcgctgcaaaactcgacattatagccgctaagaatgaaaacgataagcctgatgtgagctga

SEQ ID NO: 10510 - RNA, 951 nt, unidentified
  source 1..951: mol_type = other RNA; note = synthetic construct
atgtcaaaaaataggtcgcctagctttaagtactatgagctcaatcagtcccccttgtataaactgcaatctaaaaacaagctgaacgccctgctcggaatcaataaaaatcaaatacccagccttctgtccgacgagctgtttaaccagttccttaataaagataaccgcctcatccagcatcctatcggcaagctcgagcttgtgcataaaaagatctactgtctcctcaacaaaattattaagccatcctaccttcactccggtaccaaaaaaaggagcacctcaaccaatgctgagattcacaaaaacaacaaggagatgttgaaaatcgacatcagtaagtttttcccgtctaattcagagcgaaaaatcagaaacctgttcctgtatcagtttgaaatgagcatagacgctgcatcttatctatcaaagctgatctgcattaatggaattctgcccacaggaagccaggtgagtatgcagattgcttacttcgccaataaggtgatgttcgatcgtttaaacactctggccaaagagaataatttgagcatgaccgcttacgtggacgatgtagccttttctggggaaaaaatccctacagggtttcttaagaaggttaagactattgtcaacgagagtggtctaaccatcaagaacaagaagattaagatctaccgggagaagcagccaaagatgattacgggcattatcataaagaataacatgttgaccgtccgcaataaaaacctgcggaagatcaagcaaacgttcttagaaattttcacaccaaatgcacacttatccctggaagaaaaagaagtcatatatacaaggctgaaaggccagttgcatgcggccgggcagatcaataaaagattcaagcagaaggcaaaacacataaacaagaaccagaagaagtacctgaaacagaaccaaactctctga

SEQ ID NO: 10511 - RNA, 903 nt, unidentified
  source 1..903: mol_type = other RNA; note = synthetic construct
atggagagtagccctccttgcgactatgccaaatatgtttatgaattggaactgctcagctctcctctttttcatatcacgagtaaaaagcgcctggctattctcctgcacagtagtgtaaaagagctaaacaatatcgtgcgtagcaaagatcagatgtaccagtatttcaacgagactcagactgacaattccggaaacatcattaaagtgaggcccattcagaatccgcacgatagattgaagcagatccactcgagaattgggaaatttctgggtaatctgaaggctcccgaatatctgcattctaagaggtccaaaagcgccatctcaaatgcaaaggcccacgttgggattaaaggccacacacttaacattgacatcaccgacttctaccccagcacttcccgcgccaaggtgcaagctttttttggatacacccttcagtatccaacagatattgccaagtacctgtcagaaatctgtaccgttaagaattgcttgccaaccggatcccccttatcttcagcactggcattttgggctaacaaatccatgttcgacgagatctaccgagtggccaaatcacgggctataacaatgaccgtgtatgtggacgatattagcttcacgggtagagcggtcaatcagaacttcctgaagaagataatccagatcgtcggcaaataccaacacaagatcaagcaggagaagattaagttctttccagagtactctgtcaagttcgtaacaggcgtggcgattctcaatgggcgactacagcctgcacatcgccattaccgggatataagggtgctccaaaagatcgataacgacttacaagccactctgcggctcatgggcaaaaacaactacataaagcagatcaccaaccaggtctga

SEQ ID NO: 10512 - RNA, 903 nt, unidentified
  source 1..903: mol_type = other RNA; note = synthetic construct
atgggaaacagtcagcccagtgaccatgctagatacgtttacgatctggaactcctgaactcccctctgttccacatcacctctaaaaaacggctagccatgttattgtgttccagcgtcaaggaattgaaccacattagcaggtctaagaatcagatgtatcagtgcttcaataagaaacagacagacaacaacggaaacgtaattaaggtgcggcccatacaggacccccatgagcgtttaaaacaaatccacagccggatcgggaaatttctcggtaatcttaaagcgccagattacctacacagtaagcgatcaaaatctgcaatttccaatgccaaagcacacgtggggctgaaaggcctcactctgaatatcgacattaccgatttctatccttcgacaagtaaggccaagatccaatcattctttggctacactctgcagtatccaacagacattgcgaaatacatcagcgagatttgtaccgtcaataattgcctgccgactggaagccccttgtcctcagctctggcattctgggccaacaaagctatgttcgacgagatttataggattgccaagagccgctccataaacatgacggtttatgttgatgatatctcatttacagggaaggccatcaaccagaagtttctgaaaaagatagtccagatcatcgaaaaataccagcacaagatcaaggaggagaagataaagttttttcctgaaaacggcgtgaagtttgtgaccggcgtggccattgtaaatggccatctccaaccagctcacagacacttcagagatatgaggcatcttcaaaagttcgacaatgacatccaggtggctctccgccttgcaggtaaaaacaactacattaagcagatcaccaatcattcttga

SEQ ID NO: 10513 - RNA, 915 nt, unidentified
  source 1..915: mol_type = other RNA; note = synthetic construct
atgaaaaaacttagctatgtgtcctttgactacgtagaacacatcaaagatctggctattttcaatatacagagcaagcggtacttggcatttgtgctgaagacccagctcccactgcttaaagatatcagccgaaatcccaataacttttacagattcaaggtgaaagagattgtcaagaatgagaagctgaaaatacgtcgcattgaggagccaaattctattctaaagcccatccacaagcaaattcacaacctgattagtcagctccccgcaccggactacctattttctaagaagaaatcatcctgcgtgctgaatgccaaggtccattccctcgctaaaggcaaaacactgaacatcgatatcgagaactttttcccttcaaccgccaagtggaaagttcagaacttcttcggctattaccttcaatataatagggatgttgccgctttttttgccgacatttgtacggtggacggacatattccaactgggagtcctttatcgttgatgcttgccttctgggcaaatcagcccatgttcaacgaactgaacaagctctcaaaaagtcgccaaatcaccatgacaatctatgttgacgacatcagcttcactggggaggctgtgtccgagaagtttaagaacaaagtgatagaaatcgtcaacaagcatcaccacactgtaaatgcggacaaggtcagatttttcggtaaggatctgaagttcattaatggtatagccatagtcaacaaccagttggaacctagcaacgaattatctggcaaggtgcggaatctcaaaaaaagcaaggagatccagtacattaaaaatctgaacggaaaaatcgggtacatcaagtatatcaagaaggtggattccctgaacagggacatcacaaccgaatgcaaatga

SEQ ID NO: 10514 - RNA, 912 nt, unidentified
  source 1..912: mol_type = other RNA; note = synthetic construct
atgtcttcacaactgaaagggaattacgagttaaaccagtgtgtgatttacaagctgaagtccaaacggaaattgaaaaaactcctgaatttgtccgaaaatagcaacctcaaaatctacttcaacgacgattatttctcttgctttgacctcatgcaggaagacggctcagccagaaatattcaaaccccaattaacgaactgcagcagattcacattcgcctggcaaatttcttcaagtatgtgaagactcctgattatcttcattccggtaagaaaaagcatagtatagtcaccaacgcgaaagcccacattgatagctcaaagcctaccctaacaatcgatattgccaagtttttcccatccaccaagcgggagaagatcttcaacttcttctacaagaagatgcaccagagcgcggacgtagcagacatattatctcgcttggtatgttacaataaccacgttcccactggtagttcgatctctatgctgatagctttttgggctaacaaagagatgtttgacgaactttacaaactgtgcgaggctaacaacatcattatgacggtgtatgtggatgacatcagttttacaggaaatggagtcgggaaactctttctaaagaaggttacagagatcatcgagcgatatggcctgaacatcaagaaagagaaggtcaagtttttcaaggccaatagccccaaaaccatcactggggtgatagtcaagaacaatagaatttacgccaggaacgaacactacaaaaaactgagggtgatggaaagcgcctataaaatcacaaaggttgaggatgtgattgagaaaggcatcatgcagaaggcatataatggacagctcgcttttctggtccagatccatccgcaacttcgtaataagatggtgttctga

SEQ ID NO: 10515 - RNA, 903 nt, unidentified
  source 1..903: mol_type = other RNA; note = synthetic construct
atgacaaaaatgacccctcgttgtagcgcaaactatgacattagccaatccatactctacaaactgcactccaagaagaaattgtctgagatccttggcctccccttatcagtcctcaagatctgcaaaaacgatagctattacagttgcttcgacctcgagcagaagaataagatcaggtcaatccaacagcccattgaccagctgtttataattcaccagcgcatcgcaagcttattaacgagaatttaccaccctgattatctgcatagtggaagaaaaaagcattcgattatcaccaacgcctcccagcatctgatttcggataaaaaaaccctgaccatagatattgagaaattctttcccagtaccacacaaaacaaagtgtttcacttctttcggacaatttttaagcagtctgtggacgttgccgatctgctcagccatctgttgaccttcaataaccacgtgccgactgggtcccctgtatcaatgagtctggcgttctgggcaaataaaaatctcttcgacgaactatctaggtttagcaaaaatcgaaacactatcatgacggtttacgtggatgaccttacatttactggctcaggggtcaactccaatttcctaaaaaacgcttctaagatcatcgaaaaacacaacctgaaggttaagaagtctaaggtattcttgtacaaggaaaaccaggccaagtttataactggaacagtggtccttaataacaagctggaggccgagttcaaacagtttaaagctttgcgcgtgagcgagttcctgtttctcaatgacccaaagaacgaagtgtatcggaatgcttacaatggtaggctggccttcctttcccagatcaagccaaacctgaagatcaagatgaatttcaagtga

SEQ ID NO: 10516 - RNA, 936 nt, unidentified
  source 1..936: mol_type = other RNA; note = synthetic construct
atgaatgtgcacaacggaatcaaaatcgaggacagttccctttacaggattaacagagagtgtctatttctgctgttaggtatcaagaataatgacgagctgaagactctcctttctaacaacaactataaggtttacactgttggaccaaaaaaccgcattatagaagagccagacaaaaaactcaagaacattcagacgaagtttaataagctgcttcagcaaatagaaacccccccctacgtcttcgctgggaggaagaaaatgaatcatatctcaaatgccaaggcacatattgattgtaatgacatgatctgcgctgatatcaaaaaattcttcccccacacaaaaatcaagtatctgcaggaattcctggagactaatctcaaatttagtccagacttggccctggacgtagccaacctgctgacaatcaacggccatttacccactggagccccatcatcccccctccttaccttctggtcttataaaatcgtgtttgacaagatctacgatttcgcgaccaatctgggtattaccatgactatatacatcgatgacatgacattttctagcaaaagcaaagtcagcaagaaactgattcctttcgtgggggcagaattgacacgggtaggcctggagttgcacccggagaagttaaagaactttaagtgctcgaagtacaaacatgtgaccggcgtctgtatcgatcggaaacacagactcgtggttaagaatgagcacagggacaacttgctaaagatcctcaacagcaaggatgatattacgcagctgtccaccgagcagattgaaacctgcataggcatgattaaatccatgcaacttattgaacctaagattttcgagcctacattgaagaagctgaaggaaatctataaactccgtcctaaacgaatagtgaagaagcgctga

SEQ ID NO: 10517 - RNA, 924 nt, unidentified
  source 1..924: mol_type = other RNA; note = synthetic construct
atgaccattaaagataacttcaaaagcttcgagtccctggataagaccctgaaactgttggacgtgagtctggaggagatgcaacaggcaatcaataagggttacaggcgctacaaaacatttaagaatggcaaatttcggtggatcgaggaacctaatgacgaattgaagattatccaacagaaaatcctgctttacctccagaataatctggaatgtccaacatattgcacggctggattcaaaggccagaacaatatcaaaaacgccgaaaagcatagaaataaacgggaagttctaacaatggatattagccactattttccaaacactcaagagaagtacgtgcgaaaaatattttctgagttcattggcgtagacgacaacgttcttaacttgctagtgaagataaccacctttaacgggtatttacccactggggcagcaacctccacaatattatcttgctttgtgcacaaggagatcttcgacaatattttcaagaagatgaagagcctggacattgacatgaccgtgtatgttgatgatatcacactctccacgcacaaacatatttcaaactgggtcatcagccatatcaacaactctcttcagtcacacggcctcttcctgaaaaagtcaaagataaagaggtatgggtacaagcacgccgtggtaactggagtgcatatcgctcagagcggaaagatgagtgcgcccttcaagattggtcacagtgctatctgtgccctgtgcgataaagacctgaaacagatgtctctcactgagctccgcaaaattatagtcaagatttcgtacatccagcagtttaaccctttgaagatgatcaaagtcaagaaacaagccatcaaacagcttaagaagctgcagaagatctccgccaataagaatgaaagaatttga

SEQ ID NO: 10518 - RNA, 954 nt, unidentified
  source 1..954: mol_type = other RNA; note = synthetic construct
atgaatacgctcatgaaaaagcgctacgacattacgcaatgctctttctacaagtgtcgatccaagagacggctaatgaatctcctgatgttgaatgaagaagagttcaagaacatcaagaagaagatttgctaccactcatttacccaggcaaaaaaggatggtgacaagagggtgataacagctccgaacgaggagttgaaacgtatacagaagcgcatactgaaactcttcagctatgtgaagcgtcccgaatggttaatctcaggagaaagagggaaatcctatatcgataatggccgatatcacattaacagcaactatttcctgaccatggatatccgcaagttctatgataattgcaaaagggagtacgtgtaccggttctttaatgacaacctggaaatgtctaaagatactgccgccatcttaacagacctggtgacatatgagggaaaagtgcctactggctgtccaactagccagataatcgcttattacgcctaccagaagatgttccattccatccacaaagtggcagaaatgcacgggtgtaagttttcactgtacgtagacgacatgaccttttcttcctcaagtccatttaatcccgattcgctacggaacgacattgacaaaattcttaggaagtatggtcaccgccctaagtactctaaagtcaagtactatagcaagaacaagttcaaactgatcactggggttaccatcagttctgatcataagctgttggtcagtaacacacttcggaaaaaaatttacgacggcgcgatgtcccaaattgagatggatagacagaagaaggtcaccattccaaaagagcttaggagactcaaaggaagaatccaggctgccagggtggttaatccccatatctttcctgaggtaaaccggtttgttgaggaaaaactgtatagcagtggcagctacaagtga

SEQ ID NO: 10519 - RNA, 966 nt, unidentified
  source 1..966: mol_type = other RNA; note = synthetic construct
atgacacaaatacgtaaaaagcacgaactggatcagtgcgccctctacaaatgcaaatccaaacgcaagctcgcttactatcttaagattgattacgagaagctgaagaccatcagcaacataaccctgtaccactcgttctcactgcagaaaaacgatggcgaccctcggcttattactgcccccaaagctgaacttaagaaactgcagaagcgcattttgagactgctcgagaaagtgaagcggccagactatctaatcagtggcgaaaaggggaagtcctacttgaacaatgcgctcactcaccaacattccgactactttttaaccattgatatccgcaagttctacgataattgtaaacgtgagtacgtgtacaacttcttcattaaaatgcttcagaccagtaaggacgtggcctgcattctgactgacattattacgttcgacaataaaatccccactggatgtcctacatctcagatgctggcctattacgcttattttgatatgttcactgagttgaaggagataagtcagcggtttaacagcatcttcaccctatatgttgatgacatgacgttttctagcaagacaagctttaatccaaaagcattggccaatgaagtggatatcgtactgaggaagtacggccacaggcctaagtacaagaaggtgaagtatttttccaaggaggactttaaactggtgacaggagtcgtcatcactaaagaacatgctctcaccgttcccaacagactgagagagaaaatttataccgggtctatggccgagaaggaaagattatatacatataacccccgagaaatttctaaacggatcaagaagctcaggagcatcaagggtcaggtccaggcagcaaagaatatccaaaaaacaatcttcccggagatcgataggctgatagacgacaaattactggacatctcatcacatacccgatga

SEQ ID NO: 10520 - RNA, 960 nt, unidentified
  source 1..960: mol_type = other RNA; note = synthetic construct
atgtctctgaagaaaaaacgctacgatctgaatcagtgtgccctctataagtgtagagggaagggacgattggcttacttactccatatgaataaggaggaatttgacaatctagagaaactgatcgaatattactctttcactaccgataagaatgacggcgataaaagactgataaccgctcctcgtaacaaccttaaaaaaatccagaagcggatcctgaagttgattacattcgtcaagcggcccgagtggctgataagtggcgaaaggggtaagaactatattgacaacggcaaattccaccagcagtcccattacttgctcacgatggatattaagaaattctatgagaactgcaagcgggaatttgtgtatcggtttttcaggtacacaatgtgcatgagcggggatatcgcggaaatcttgaccaacatcgtaaccctggaacaaaaaatcccaacaggctgtcccacttcacagcttatagcatactacgcatatcaggagatgtttgagaacattaagaagatcgccaacaaatacaattgcgtgttcactctttacgtggacgacatgacctttagcagcaaaaggccgttcaatccagacaagctgcgaaacgagatagatattgagctgaggaaatacggacaccgccccaagtatagcaaggtgcagtattattcccgcaactctaataagctggtgacaggagtagttatctccaaggatcacaatctcttagtggcaaacaagctgcaaaaaaagatctacgacaacgctatgaaactgaagaaagtcaacggcaacaaaaaagaagccaagattgcctaccaactcgaaagtgacctgagatccctaaagggtcagctccaggctgccagaaatgttaagaaagggatttttcctgagattaatcgcttagtcgagaattcgatgatcaatctttcaaagtga

SEQ ID NO: 10521 - RNA, 948 nt, unidentified
  source 1..948: mol_type = other RNA; note = synthetic construct
atggcccgcattgtaaagcgttaccggttggatcagtgtgccctttacaagctgaagtccaaaaaaaagctggcgcattatctgaatgtggactacgagactttcaaggaaaccggcgagcttatccactacagtgctttttccctcaaagcagagggaaagaaggaccggtccatcacagctcccaacagtaaactgaagagtctccagaagcgagttcacaagctattactcaagatcgaacgtcctgaatggcttattagcggtgaaagaggaaagtcctatatcgataatggcaagatgcatcagaaatgcaattatgcgctgtgcatggatatcagatccttctacactaacacgaaacgcgagtatgtgtttcggttcttcattgaggaaatgttaatgagcaaagatacggctaagattgttaccgacatcttgacatttaaggactctattccaacaggctcgcctgcatctcagctcattgcatattacgggtatcacaggatgttccaggagatagagtcaatctcaaccaataaatatggttgtgtgttctctctatacgtcgacgatatgaccttctctagcgagaagccttttcaaatgaaaggcttgagaaacgagatcgacataatcctccggaaatacgggcataaaccaagctataagaagaccaaatactactcaaggaataaagcaaaacccattaccggcactactgtgagtagcaagcacgagctgctgatcccgaactctctgcaattgaagatcattaggggggctgaactgatcctggagaaaccccaggaactgtccagggcccagctcgctagctttcgcggacaagtccaggccgccagaataattcagaaacgagcctttccagaattaaacaagctggccgaagagatgctgtcaaacccccttaagatacctacatga

SEQ ID NO: 10522 - RNA, 927 nt, unidentified
  source 1..927: mol_type = other RNA; note = synthetic construct
atggcacgcattgtgcagagatataaactcaaccagtgcgtgttctacaaactgaaatcaaagaagcaactagcttactttctcaaggtggattacgaaaccctccgggaaattaacgagctcatccattacaaatccttttctttgaggaccgaagggaaaaaggatagggatatcacagcccctaataaaaagctgaaggatctccaaaaacgcattcacaacctgcttctcagaatagaaagacccgactggttgataagcggcgagcggggcaaatcatatatcgacaatggaaagatgcatcagaactgcaattatgcactgtgtatggacatcaagtctttctataggaatactaagagagagtatgtgtttcgcttctttaccgaagagatgctaatgtcaaaggacactgctaaggttgtcacagacattctgacctttcagaattcaattccgacgggatctcctgcttctcagttgatagcctactacgcataccaccgtatgttccatgagatcaagtccattgcgacgaacaagcacagctgtatcttctccttatatgttgacgatatgacattcagttccgatactccattcgaagtgaacgtacttcgaaaggagatcgacatcttgctgcggaagtatgaccacaagcccagctactccaagaccaactactacagtaggaacaaagctaaaccagtgactggtacaacaataagcaagaaccacgaactgcttattcctaataccctgcagatgaaaatcaagcgagatagtgagatggtccttcagaaggggcgggaactgagcactaaacaaagagcctcgtttaatggccgcgtcaaagccgccaggattatcgagaaactggcgttccccgagttaaacaaactggccgagcgtatgctgaattga

SEQ ID NO: 10523 - RNA, 969 nt, unidentified
  source 1..969: mol_type = other RNA; note = synthetic construct
atgaaagcccccattaagaggtatcctctgcatcagtgcgcattgtacaagtgcagctctaaaaaaaaactcgaacttaggctcaagcttaatgccggcgacgcctccctcctggagaacatgatccaataccataagttcagtatcccaaagaaagacagcactaaacttcgtgacatcacagcccctgccgatgacctaaaaaaggtacagagaaggatcttacggttgctgcaaagaattgagcgtccgcagtggctgatttccggggaacgcggtaaaagctacgtggataacggacgggcacacataaattctatgtatcttctagccgctgacataaaaagcttctacgacaactgtcgcagggattacgtttaccgctttttcaccgagagactgaaaactgccccagacattgcgaagttgctcaccgatatcatcacgtacaagggagggatccctacagggtgccctacttcccagattattgcttattatgcttatgagcggatgttctcggaaatcgcacaggtggctgagcggcacggctgtatctttacactctacgtcgatgatatgaccttttcatctcagacgccctttgatcccaagcgactgaagagggagatagaaatgatactgctcaggtatggccatcgcctgaaggattcaaaggttaaatactatgcgagagacgacgccaaaccagtgacaggcactattatcactaaggagcaccgcctggctaccccgaaccaattacaaaaacggatagtgaccgaattccaggctttgaaggaacagatgaacggccaggccctgacccctgaggaaaagagtagatatgcgaccctgcagggtagaatttacgcagcccgaaatatcgaaccatgtatctttcccgagattcaccgacaggtgacagcagtcaagcactcccccgagaatgggaagggagtcgagtga

SEQ ID NO: 10524 - RNA, 930 nt, unidentified
  source 1..930: mol_type = other RNA; note = synthetic construct
atgaatagcgccatgcacaagtatgaaatcaaccagtgtgctctttacaagtgctcttcgaaaaagcgcctcgagcatctgttgttattgaaagagaacgaactgaagcagatcaagcagtatacaaggtattacaactttagcacccctaaaaaagacggatctccacgcaagataacagctccatgcgataaactcaagaagattcaacgccggattctgcggctgctgtcccccataaaacgtcccgattggctcatctccggtgagcgaggcaaaagctatattgataacgggaagagtcatattaacagcaaatacttcttgaccatggacatcaagaatttttacccgaattgccagagggagtatgtgtttagattcttcaccgatgttctgctaacagcccccgatatcgcaaagattctgactgacattataacctacaacaatggcatccctactggatgtcctactagtcagctgatcgcctattacgcctatgagaatatgtttaagagtatctacgagatctctttgaactatggctgtaaattcactctgtacgtcgacgacatgacattctcatccaattttccattcgatcccaaaaagctcgaacaggaaattgacatacagcttagaagatacaaccacaaaccaaagtactcaaaggtgaaatattacccggcgaatacatataaactagttacggggacgactgtatcacctgacaataagctcctggtgaccaataacctgcgacaaaagatagtggagaattttaagatcctcaaaaactaccagaagctgtccaacgacgaacggaagaagaaaatcgattctcttaaaggtcagattcaagcagctaggaatgtcaacaaaaccattttccccgagatcaataggttaaccaacgaccttaagtga

SEQ ID NO: 10525 - RNA, 936 nt, unidentified
  source 1..936: mol_type = other RNA; note = synthetic construct
atgagggagaagagccacaaatacgacatcacgcaatgcgcattatacaaaatcaaaggcagtaagcagcttaagaaagtgttgtgtataacggaggaggagtataaggatatcctgtccatcgttcactatcattcctttcagatcgacaagaaagatagtaccgaaaaacggaatattacagcacccgataagagaatcaaggaaatccagacccggatactgaagctgctgcagaatgtcgaaagacctatctggttgattagtggtgaaaaaggcaagtgctatattgataacggaaaatcccatctcaactctaattacttccttaccatggacatcaagaaattctatgataactgctctagagaatacgtctttttgttcttcaagaaccgcctcatgatggctggcgacctcgctggcctgtgtacagacatagtgacttacgacggcgggattcctacaggctgtccaacctcgcagatcatcgcctactacgcctacgaatctatgttcaacgagatatatagcgtagcttgtaaatacggatgcgaatacactgtgtacgttgatgacatgaccttttcagccaaggagccatttgacattaacaggatgaaaaatgaggtagattgcattctacgcaaatatgggcacaaacccaagtataaaaaggtcaagtattacagcaagggaaagtccgtgcctatcaccgggacaatagtgactggtcaacatgagctgaaggtgcccaatcgactgcagaagcgcgtttatgacgattttcaggagctgaagtatttaggagggaaggagctctcagacattgagattcgaaagctaaacagcctgaaaggtaggattctcgcgagccgtaatatcgaagaaggaaaatttccggagatcaaccggcttactaatttcatttcatga

SEQ ID NO: 10526 - RNA, 936 nt, unidentified
  source 1..936: mol_type = other RNA; note = synthetic construct
atggcgaagcagtataagaggtatgacatcacccagtgtgccctctataagtgcatctcaccgtataacttgaaacgagtgctcaagataaccgatgaagaatacaaagacatcgtgaaaatcgtcagataccacacattccagatcgacaagaaggacggggtcgaaaagcggaatatcactgcccccgatcggaggatcaaagagatccagacacgcatactgcaactgcttcagaaagtcgagaggcctgaatggcttatttcaggcgagaaaggcaaatgctatattgataacggcaaaaagcatatacactcgaattactttctgaccatggacataaagaaattttacgacaattgcgaacgggagtatgtgttccgatttttcagagataggctgctcatggccggggacctagcaggtctgtgtacggatatcgtcacctacgaaggagggattccaactggctgccccactagccagctgcttgcattctatgcttacgagaacatgtttaacgagatttctgaggttgcttacaagtacggttgtatttattccgtatacgtggatgacatgacctttagtagcgaggtggctttcgatgtgaaaaaaatgcgttccgaaatcgaccaaaagctccgcaagtacggccataagccaaagtatcgcaaagtgaagtattactctcacggacagtacgttccaattacgggtacaattgtgaccggaaaccatgaattgaaggtacctaatcggttacagaagagagtttacgatgacttccaagagatcaagagcttcgaaggccgtaaagtcacttccgaggagcaaaaaaagattaacagtctgaaaggacgcatccaggcctctgaaaatatcgagcccggaaaatttcctgagattaagagactgacaaagttaattgggtga

SEQ ID NO: 10527 - RNA, 936 nt, unidentified
  source 1..936: mol_type = other RNA; note = synthetic construct
atggagaataagtggaaaaagtatgatatcacccaatgcgccttttataagtgtaattcacccaagaacctcaaacgaatactccagataaaggatgaagagtacaatgacattttctccattgtcaagtatcatggcttcagcattgataagaaagacggcattgaaaaacggaacatcaccgcacctgataaaagaatcaaggccattcagggcagaatcttacgtctttttcagaaagtggagcggcccgagtggctgattagtggtgagaaaggaaaatgctacattgataatggcaagcagcacgtcttctctaactacttcctaacaatcgacatcaagaagttctatgacaattgtaagagggaatacgtgttccgcttttttaaggatcgcatgctgatgacaggagacttggccggactgtgtaccgatatagttacttacgaaggtgggatcccgacagggtgcccaacttcccagcttatcgcgtactatgcctatgaaaatatgtttaaggagatctacgaggtagctacggaatactcatgcatctttaccgtttacgtcgacgacatgacttttagcagcgagaaagcattcgatgtgaataaaatggttaacaaggtggactgtaccctgaggaaatacggtcacaagcccaaatacaagaaggtaaagtactattcccaggggcaatatgtgcctatcacggggaccatagtgacaggaaaacatgaaattaaggtcccaaaccaattgcagaaaaaagtgtatgacgagttccaggaaatcaaaactctgaacaccgaaaacctgacagacaaggagcaaaagaaaatcaacagtctcaagggccggatacaggcttctagaaatattgaggatggcaagttccctgagattcgaaggctggtgaacaaaatcgggtga

SEQ ID NO: 10528 - RNA, 936 nt, unidentified
  source 1..936: mol_type = other RNA; note = synthetic construct
atgtccaaggtgatcaagaagtatgacatcacacagtgtgccctttataagtgtaggtccccaaggatcctgaaaaagcgtctcgtcatcaaggatgaagagtacaaagacataaccgccatcgttaaataccacggttttcagatcgataagaaggatagcactgagaaacgaaacatcactgcccctaacaaaagaattaaggaaatccagactagaatgctgcaactactgcaaaaggtgatgcggccagagtggttaattagtggcgagaagggcaaatgttacatagacaatggtctgaaacacatccatagcaactattttctgaccatggacatcaaaaagttctacgacaattgcaagcgcgaatatgtttttttgttcttcaagaatcgcctgtgcatggcaggggatatcgcagggatttgtacggacatagtaacctataaaaagggaattcccactgggtgccccacatcgcaattgttagcattttatgcctacgaaaacatgtttacggagatttacgaagtggctcagtcccatgggtgcatgtttaccctttacgtcgatgacatgaccttctcatctccaaaggctttcaacgtgaaagagatgattcgcgagatcgattgcattctcagaaaatatggccacaaaccgaagtataagaaggtaaaatactacagtcacggaaggttcgttcctatcacaggaacaattgtgacagcgaatcatgatataaaagtgcccaataggcttcagaagaaggtgtacgatgacttccaggagctgaaagacctgtcaggcaaaaaattgtctgtcgaacagcagaagaagatcaatagcctcaaaggacggatacaagccgctcgaaacattgagaagaataagttccctgaaattaaccggctcacccaggctattggctga

SEQ ID NO: 10529 - RNA, 933 nt, unidentified
  source 1..933: mol_type = other RNA; note = synthetic construct
atgcggaaggagacgaaacgatataacatcacacagtctgcactctacaaatgtcgctcgcccaagaaaatcaagaccttgctgcggctggaggacacggaatataagaaaattaccgaaatcgtgggataccacgagtttcaaatcgataagaaagatgggattgagaagagagatataaccgcccctaaccgccggattaagcagattcagtctcgagtcctagaactgattcagaaggtggagaggccgcagtggcttatctcaggtgaaaaaggaaaatgctacatagacaatggaaaggcacatatcagcagcaattatttccttactatcgacatcaagaagttttatgacaactgcaaaagagagtacgtatatcagttcttcaagaataagctgcagatgagtggagacattgcaggcatttgtaccgacatcgtgacttttaaccagggcatacccacaggctgcccaacttcccaactcatcgcttactacgcctacgaacagatgtttgatgaaatctatcgcctggctgtcgagcatggttgtatcttcaccttatacgttgacgatatgacattctcatccatcaaggcttttgacgttaacaggttggtaaaagagatcgactttaaactcaggaaatacgggcataaacccaagtataagaaggttaagtactattcccacggcaaacctgtcccaataactggcgccattattaatgcgaaacacgaaataaaggtgcctaatagcctgcagcagaaggtgttcgagggtttccaggaggtgaagaaactgcaagggcaggaactgagcggcaacgatcaaaaaaagcttgatagactcaaagggcagattcaggccagtagaaacattgagacaaataaattcccagagattaagcgtttagtgaatcaaatctga

SEQ ID NO: 10530 - RNA, 945 nt, unidentified
  source 1..945: mol_type = other RNA; note = synthetic construct
atgaagaaccccaagtatcggtacgagatcaatcagtgcgcactgtacaagtgtcagagtaaaaagaagatttgctcactcctggatataagcgacagcgaattcaatactttgcgcgacagtgtgaaataccactgcttcgagatctataagaaggacaattcagacaaaaggaaaataaccgcgccaaatcagcgactgaaaattgttcagaaaaggctcctacaactgattcaatacgtgaaacggccagattggctgatatccggagagaaaggaaaatgctacattgataacgggaaggcgcatatcatgtcccactacgtgcttacgatggatatcaagaacttctatgacaactgtaaccgtgaatatgtctttcgattctttaaggacaagatgctgatggccggtgacatcgccgggttttgcaccgacctggtgtgtcttgagggcgggatccctacaggctgtcccacttcccagctgatcgccttctacgcatatgaagccatgttttttgagctctatgaagttgcctgtgaaaacaagtgcatcttcactgtctatgtagatgacttgacctttagcgctgagaatcccttcaatgtcaatctcttgaaaagggaggccgacatcagactacggaaatatggccatcgccctaaatacaagaaggtgaaatactatggcaaagacattccggcacctattaccggtacaatcctgatgcctgataacaaactgaaagtgcccaacaaccttcaaaagaaaatttacgacaacttccaggatattaagaatctctgtgatgttgaggctatcgataaggtggatttaaagaagatctacacattacagggccagattcaggcagctcgctcgattgaaccagaaaagtacaaggagataggaagaatctcttctgctaaggtacaaagatga

SEQ ID NO: 10531 - RNA, 930 nt, unidentified
  source 1..930: mol_type = other RNA; note = synthetic construct
atggttaagaaatactcgatagagcaatcagcactgtacaagtgtagatctctgagacggctgaacacattactcttcttggatacggatagcaaacagatcgccgacatcaagaagtactactctttcgagataaataagaaggacggcattgccaaaaggaagataactgccccaacaaaaaagctgaaaacagtccagaaaagggttctgtatctacttcagaggatcgaacgcccaaattggctgatctcaggcgagaaggggaagagttacattgataacggaaaagcccacatttatagcaactactttttggccatggacattaagtctttttatgacaactgcaatcgggaatacgtgtttcgctttttcaaggattatctgcaggtgtccggtgatatagctggaattctgaccgacattgtcacttatgataacggcatccccacggggtgccctacctctcaactcatcgcgtattatgcttacggcaaaatgtttcgggagataagtgaaattgctcagaagtacgagtgcatcttcactctctacgtggacgacatgacctttagcagccaggaacacttcgacgacaatagcatgaaaaaggagatcgattgtacactgcgtaagtacggccataaacccaagtactccaagatgaaatattattcccacgggaaggatgtactcattaccggtaccgtagtgaacagaaatcatgagcttaagatccctaacaaacttcaaaagaagatctatgatggattccagaatgtgaaggacgtcgacatcaaagaaatggactgcaacaaaaaaaaggaaatcgcttcattgcgagggaaattacaggcagcaaagagtattgagtgtaacaaattctccgatatcaataagatcgtgggaaatattgagaaacagtga

SEQ ID NO: 10532 - RNA, 1035 nt, unidentified
  source 1..1035: mol_type = other RNA; note = synthetic construct
atgcgtggcctcatgaaaaataagtcttatcccatcaaccagtgcgccctgtttaaatgcaatagcaagaaacgactagaacatctgctgactattgagcagggcgatctaaagctcgttcaatctatcataaagtacagcaacttcgaaattgataagaagaactccacagagaaacggaagataaccgcaccacaaaagactctgaaacagatccagagacgcattctttacttattacagtccattgagcaccctgaatggctgatctccggaacaaagggaaagtcttacatcgacaatggcaaataccactgtaagtcaagttacgtgctcacgatggacattgagaaattttacgataactgtacccgggaaaatgtgtatagcttcttcaagaacaagatgtgcacaagcagtgacgtcgcagagatcttgactaacatagtgacattcaataacgggatcccaacagggtgtcctacaagtcagatcattgccttctacgcatatgaagagatgttctccaatatcaagaaaatagccgacaagtatggttgtatattctcggtatacgtggatgacctgacgttttcaagcgataaagcctttgacgctgaaaaattgaagcgggatgtggatatcgaacttaggcgatataagcacaaacccaagaacaagaagatcaagtattacagcaagtatgaagctaagccgataactgggacaatcgttaccaaagaacatgagttggccacccctaatagtctccaacataagatttatacggattttcaggacatcaaaaacgactgcctgtcctcagacgaggagctgtacaaaaagatccaggtcctggagggtagaatccaggcttctaaaaacattgagattggagccaacaaatttccagagatttctagacttaccaataggattaaagagaatacccccattcccacccaacctaccgtcactaggaaaaataccaacaagaaggctaaaatccgcattaaaaattcaactcaggcgtga

SEQ ID NO: 10533 - RNA, 1011 nt, unidentified
  source 1..1011: mol_type = other RNA; note = synthetic construct
atgaaggcaaaaaagtaccctttgaaccagtgtgcgctttacaaatgcaactctaagaggagactagagaaaacgctcactattgaacagggacaattgaagttgatcgattccgtaatcaaatactctcacttcgaaatcgataaaaaggatagtaccgagaagagacaaattacagccccaaagtataccctgaaacagattcagaggcgaatcctgcggctgatccagtttattgagcggcccgaatgggtcattgctgggacaaaggagaagagttatatcgataacggggaattccacctgaaatcaaactatgctcttatggtggatataaagaagttctatgacaattgcaagcgcgagtatgtctacaggttttttagggacaaaatgctaaattctcccgacgttgccgaaatactgaccgatatagtgacgtatgagggcggtgtgcccacagggtgtcccacatcacagctcatcgcctactacgcctatgaggacatgttcgcgaacattaaacgaatagcagataactacggttgcttattttcactgtatgttgatgacatgaccttttcgtccgaaaagccatttaataaagacgtgctcaaacgcgaaatcgacattgagctgcggagataccagcataagcctaaatacaagaaggtgaaatactacagcaagaacgacccaaaacctatcaccggaactatcgtgactaaggataatacacttgtagcccccaataaactgcaggagaaagtttataagggcttccaggacataaagaacctggacatcgacgataattccgaagagactattaagaagatcgctgcactccagggaagaattcaagcctcccgtaatattgaaaagaataagaagttcccggagatcgagcgcattactaaacaaatcagcaccgagcatagcggcagtgtccctgctaacccgcctaaaaagagccgcaaacgtccacggaagataaggattatcaaatga

SEQ ID NO: 10534 - RNA, 1029 nt, unidentified
  source 1..1029: mol_type = other RNA; note = synthetic construct
atgaaagccaacaaacaaaaataccctctggaccagtgcgcgctatataaatgtcgaagccgtaaaaagttggaatccattctggcaatagaacagggcgatttgcggaacatccagtctgccatcaagtacagttcatttgagatagacaagaaggattcgagcgaaaagagaaccatcacagctccaaaaaggacaattaaggctgtccaggcccgcatcctgactctgattcagcgaatcgaacggccagaatggcttatatccggggagaagggaaaatgttatatcgacaatggcaaggcgcatattgggagtgcctacgtgctgactatggacattaagaagttctatgacaactgccggcgcgaatatgtgtataggtttttccttgacaagatgcagacggcaccggatgttgctaaaatcctgaccgatattgtcacgtacaagggcggaatacctacaggttgtcccacatctcaactcatcgcctactacgcatacgaagacatgttcaaacagattcaggcttgcgccgagtcctatggatgcatctttactttatacgtggatgatatgaccttctcctcaaaagaccctttcccccaggagaagctgagccgggagatagacattatcctccgtcgctacggtcataaacccaagtacaaaaaggtggttttcttcgcaaaggagaaacccaagccaatcaccggcactatcgtcaccagcgatcacgagttagaggtgcccaacagactccaggagaagatctataacggatttcaggggatcaagcaactctctgagcaaaatgacttcaaacagattgatcacgctgcacaaattcttctggggcaggtacaagccgctaagtcaatcgacaataaaaagtttccggaaattgaacgcttgaccaaggagatcaggaatattcaggagcctcagagggattttaaaccaaagccaccccatagaaggaaagccaaaggcaagatacacattcctaagcctagaacaaattga

SEQ ID NO: 10535 - RNA, 1035 nt, unidentified
  source 1..1035: mol_type = other RNA; note = synthetic construct
atgaaaaataaagtccctatcaagaagtacgatatcacccagtgcgccctttataaatgtaggaccaggaaacgactcgagtatctcttgcgtctcgaccctggcggactgaagattattgatggcatcatcgggtaccataagttcgagattgataaaaagcacagtgatgagaaaagagagatcactgctcccgataaaaccctgaaggccatacaacgcaggatcctgtacctgctgcagcgggtgatacggccagagtggcttatttcaggcgaaaagcagaaatgctacatagataacgggaaggcacacctgaatggcaaatatgtgttaaccatcgacattaagaagttttatgacaactgcacgagagaacctgtttatcaatttttcgtgcagaagctggagactagcccagacgtggccgaaattttaacaaacatcatcacctacaacgggggaatcccaacaggttgccccacaagccagattatggctttctacgcgtactcagatatgtttagcgaaatttttgacttggccaagcaacacggatgtaagtttacgctgtatgtcgatgacatgaccttctcaagcaaggagcctttctccccacatcagctatctcagatgattgacagagttcttcgcaaatacggtcataagcctaaatacccgaaagtaaagtactatggcccctcggactacaagccaataactggcacagtcgtcacaccggagcactctttggctgtgcccaacgggctccagaagaccatatatgatgctttccaaactgtgaagcccctcatcggggtggaaacatgttctgaagaggacgcccggcaaatcctgagcctgaagggtcagattcaggccgcatgtaatattgaagacggaaagtttccagagatacgaagactaactaatcagatcaaagtacccgactcccagtccgtttccaccaggaaacgccagcatcaccgtcggagtaaaaagatccacatcaaacagcaggcacctattaaatga

SEQ ID NO: 10536 - RNA, 1011 nt, unidentified
  source 1..1011: mol_type = other RNA; note = synthetic construct
atgaaaaacaagactcctctgaagaagtacgacataacacaatgtgcgctctataagtgtaggaccaaaaagagactggagtatctgctgcggctcgaatcaggctcactaaagatgatcgactccataatcgaataccataagtttgagacggataaaaaacatagcactgagaagcgcaagataacggcccccaataaagccttaaagactgtgcagaagcgcatcctttacttattgcagcaggtgctgcgacccgactggctcatttcgggcgagaagcggaagtgctatattgacaacggtaaagcgcatttggatgggagatatgtgctgaccatcgatattaaaaagttctacgatcactgcacaagagaaccagtataccacttcttcgtgcagaaactaaagacaagcccggatgtggccgagatcttgaccaatattatcacctacgatggctcaatcccaacaggttgtcccacctcccagattatggccttttacgcttactttgatatgttctcagaggtctatgacatcgcccagaaatgcgggtgcaagtttactctgtatgttgacgacatgaccttttctagtaaagaaccatttagcccacaccaactgcgacaaatggtagaccgtgtgctgcgcaagtacgggcaccgtcctaaataccccaaagttaagtattacggaccctccgattacaaaccaattaccggcacaatcgttactcctagacagtccctggcagtccccaacggactgcaaaagaccatctataatgcattccagagtgtgaaaccgttcatcgacgcagaaagccacagtgaagaggacgtcaaacagattctctccctcaagggccagattcaggctgctcggaacattgaggaaggaaagttccctgagatcaggaggcttatcaaccagataaggattcctgataatcagacagcttctaaacaaaagtcttatgcccggcttcatagcaaaaagtctgagtga

SEQ ID NO: 10537 - RNA, 984 nt, unidentified
  source 1..984: mol_type = other RNA; note = synthetic construct
atggagaaccccagcttaaaaaagtatgatattacccagtgcgccttctataaatgtcggaccaagaagaggctggcctttctattgtgtcttagtctgaaagagctcgagcacatttctggaatcatcgagtaccatagcttcgagattgacaagaagaatagtgaagagaaaaggaagatcactgcaccatccaaagagctcaagaccatccaaaggagaattctggcactcttacagcgcgtgattcgacccgattggctgatctctggcgaaaaagggaagtgctatattgacaacggaaaagcccacataaatggaagatatatactgacgatggatatacggaagttctatgaccattgtgttcgtgaagcagtctaccaattcttcattcagaagatgaagacaactcctgacgttgccaaactgcttaccgatatctcaacctacaacctcggcattccaacaggttgccctactagccagctcattgcgttttacgcctatattgacatgttttcagaaatcgcggccatcgctcgggagtatgggtgcgtgtttaccttgtatgtagatgacatgacattttctagctccaaacctatccaggtgaacaatttgattcggaagatcgactgtatcctacgcaaattcaaacacaaacccaaatactccaagatcaagtaccatcacccgtcagattacaagcctgtgacgggcactgtcatatcgccaaatcagacactgcttacaccaaattctcttcagcacaagatttacatcggcttcatcaagttgaagcccaagctgtttgaaaataacgaggccctcagtaatgaagagggcaaagagctgcaatccctgaacgggaggatacaggctgctagaaacatagaagagggaaagtaccccgaactgaaacgcatcatccataatagccaggcagctatcagatacaacggtaagcgaaagaaaatttga

SEQ ID NO: 10538 - RNA, 924 nt, unidentified
  source 1..924: mol_type = other RNA; note = synthetic construct
atgcaagacaaatttagacgatacgacatcaatcaatgtgcgttgtacaagtgcaagagcaaaaaaaagctcgaaaagcttttgaatctgcagatcggtgaacttaaatacattaacgtgatcaccacttactatcacttcgagattgcgaaaagttctagtcacgagaaaagagctgtcagtgcaccttcaagcaagttgaaatccatccagagcaggatactaagcctcatccagtatattaaccgtccagggtggttgatatcaggcgagaaaggaaagtcatatataaacaattcccagtgccatatcagcgccaactatctgctcgccatggacattaagaacttctataacaactgcaagcggaatcccgtttacctgttcttccttaatgagcttaaaacttctcctgatgtggctaacgtgctgaccaatattgtgacctacgaaaatctgatccccaccggtgctccaacctcccagctcatcgcctttcatgcttatactaacatgtttacggaaatcaaccaaatggccctgaattttgggtgtatctttacgctgtatgtcgatgatatgacatttagttcgtctgttcccttcaatcacatgagcctgtcttgtaatatcgacaagattctgagaaaacatggccataggccaaagtacaaaaagctaaagtactactccaagaacgaatctaaacctatcacaggcgccattctcacccctacacacactatcaaggtacccaataagctccgctacaagattcacaacacattccagaagataaagaataactccaacttcagcgatgaggccaaatcagagctgctgacattaaaaggacgcttacaggcagcaaaatcgattgagaagaacattttcccggagatttcccggataatcaattcttga

SEQ ID NO: 10539 - RNA, 969 nt, unidentified
  source 1..969: mol_type = other RNA; note = synthetic construct
atgatcaacaaaaacaagctctataggtatgacatctcacagtccgcactgtacaagtgtagaagcaaaaataagttgagcgagttcctaaaaatctcgattaaagatgtggacaagatcattaagtactacaccttcaacatacctaaaaaagatacctccaaaaccaggcaaatctctgctcctcagaaaaaactcaagactcttcagaaacggttgctgtatttaattaagcgcattaagcggccaccctggttgttcagcggggaaatgggcaaatgctatctggacaatggtaaatatcacctgaataatccttacgttctgactatcgacattaagagtttttacgaacattgcacacgaaacgctgtgtacttgttttttcttgagaaaatgcagacctctccagacgtagcaaaaatcctcacagatatcactacactggataaaaagctgcctactggaaccccaacatctcaactgatcgcctttcatgcctatgaggacatgttcaatgagattaacaacctcgcaaagtcgtacaactgtatcttttctctttatgtggatgacatgacgtttagtagctcctaccccttctcccccaagaatctgacttacaaaatcaagaccatacttcacaagtacaaacaccatctgagttccgaaaaggtcaaatactatagcaaagacatggcgaaggatattaccggactgatactcaccaaagacaaccagatagccatcccaaatagactccagaagaagatttatgacaacttctccaagattaaggattatgaaaagatgacagtgtacgataaggagattatcaagagcattaatacgctgaaaggccaattacaggctgccaagaacattaattataatgtcttccccgagatcactcgcatagtttactcaatcaattgcaagacaaacaagaagccgctagggaactcatga

SEQ ID NO: 10540 - RNA, 912 nt, unidentified
  source 1..912: mol_type = other RNA; note = synthetic construct
atgatgatgatcaaaaagtatgacatctgtcaatccccgctgtacaaactgaaaaataaaaggcgcctggaaaagattctcgggttggaaaaatacgagctgaataagctcaagttctggaacaaatacaaatcgggaaaaattcctaaggacgatggagactttcgcgagataaatatccccaatttcaagctcaagaaggtacagaagaaactgcagatcctgttaagcaagattcaacgaccagaatggctgattagtggggagaagaataagtgttatattaacaacgcacagtaccacataaagagcaagtatgtgattaccgccgacatcaaaaaattctatgacaattgctctcgtgagagggtgtatctctctctggtgaataagtttaaagtctcatccgacgtggctggcgcgatcacagatattgtcacatataacaagaggattcctacgggtgcctccacctctcagcttattgcttactactcatatgaagacatgttcaacgagatcaatactatctcacacaagtatggatgcaaatttagcttatacgttgacgatatgactttttccagtatcaacccaataaacgttcagtctctaaagagacaaatcgacatcatcctgagaaaatatgggcatcggttgaaaagtaacaagttcaagtactacagcaaagatgaagataaactgatcacaggcgtgacccttaagtcaaataacagtctcgccgtgagcaatcggttgagatacaacataatcaaggatttcaagggcatcaagtaccgaaaagattctaacattaagctacagagcctgaagggtcggataaccgcagccaaaatgatagagaaatccatttttccccagattaataactacgtctccaaccttaattga

SEQ ID NO: 10541 - RNA, 939 nt, unidentified
  source 1..939: mol_type = other RNA; note = synthetic construct
atgcgaaaacagcctccgaaattctataacattaatcagtctgctctctacaagtgtcgttctaaaaggaaactcgcagaactactgaagtgcgatctcaagacaatccagcagatggctaaggatattaagctgtattacgacagcttctcaatgtccaagaaagattcagaaaaggttcgcaaagtagatgccccaaatgagcaactcaaaagaacgcagaaaaacattcttaaactcctacagcggattgaaaaacccgactacgtgatgagtggaacgctgggcaaatcccatattgataacgcccagtaccacataaaggggtcctactttttaaagaccgacatcaaacaattctacaataactgctctagggatcgggtgtacagattttatgtggacaagatgaaaactagtcccgatgtcgccaatatcctgactgacttgacaacatacaacaacatcattccaaccggttcgcccagcagccagatcatagcatatttcgcgtatgaggacatgtttaacaatatgtacatcaaggcaaaggagaatggctttctgatgagcctgtatgtcgatgacttagtcttttctcggactgactatatagactataagtcattcttgagagagattgaggttgaagctttgaagttcaatcatagtctgaaaaagtccaaaaccatgtattacagccctaacaggtctgcccttgtgactggggtgattatcaaaaacaagaagatgaagatcccaaatcgcctgcgcaataacaccatccttcaatacaagaacataaagaaggacaagaacaaggatgagaaaaccgaactgagtctgattggcagcatcaactccgcccgaatgatcgagcctaatcactttaatggagtgttctcattctacaaacagatcaagaaaacacccaagtga

SEQ ID NO: 10542 - RNA, 927 nt, unidentified
  source 1..927: mol_type = other RNA; note = synthetic construct
atgaagaagaagaaactgaagttttacaacatcaaccaatcattactgtacaaatgtcgctccaaaaaaaaactcgctcagtatcttcattacgatctgaaatccttgaagaagatcatttctgagattgactctcattataacttcttttccaaggacaagaagaatagcgataaaaagcgggaaatcgaagcaccaagcgacgagctgaagaaaatccagaagaacattttgaagtacctgaagaaaatccagaaacctaattatgtgatgtccggtacactggggaagtcgtatattgacaatgccaagtatcacattaacgagaagtatttcctcaaaaccgatatcaaacagttctacaagaattgctctagggaccgcgtatacaggttttttcttgacaagatgtacacgagtcctgatgtggctgagatcctaactaatctgactacatatcggaatactatacctaccggagcacccagttcacagctcatcgcttatttcgcctatgaagacatgtttaacaacatgtacagaaaggcaaagaacaacgggtttaaaatgtccctttacgtcgatgatctcgtttttagcagaaacgattacattgacttcaagagtttcctgcgagagatagagattgaagctctcaagtacaatcacagcctgaaaaagagcaaaaccatgtactattcaccaaaaaaagcggccctcgtcaccggcgttataatcaataagggcgagcttaaaattcccaacagactgcgtaataacgccgtgcatcaataccgggacattaaaaacaatttcatcgatgacaaggtgttactaagcttcatcggaaatatcaactctgccaggctgatagaaccgaatcactttaatggcttgctgtcattctataaaaagacacccaaatga

SEQ ID NO: 10543 - RNA, 933 nt, unidentified
  source 1..933: mol_type = other RNA; note = synthetic construct
atgcccagaaaaaaaaccaacgtaaatctgtatgagctgaaccagtgtgtgttctacaagtgttattccaaaaagaagctcgccgagatccttaagattactctccgggaacttaagaatacttcatggaacgcaaatacctcttactatcagtttagccagaaaaagaagggaaccgacgagctgaggaagatcaccgcacctgataaggagctcaagaaagtgcaatctacaatttactctttccttcggcgcattaaaaagcccgagtgggtcatatcttccacactgaagaaatcatatctaagtaacgccttgtaccacaagaaaagcaattacttttacaagaccgacatcaaaaagttttacgataattgccaccgcgaccgcgtgtatcgtttcttcaaagacaagatgaaaacatccagcgacgtggctaagattttgaccgatctgacaactaacgaaaacatccccacaggctgcccgagctcacagctgatagcttactttgcctacgaggacatgtttaataacatcaagatcattgcggacaaatacaagtgcattatgacgctatatgtggatgatatagttttcagtaacgccgacaagttcaattatagggccttaatccgagaagtggaaaatgaggtaagacatttcgatcacagtctcaagaagtccaaaaccaaatattacacgggggaaaaaggagcaccaatcactggtgttatcgtcaaaaataacttactgtacgtccctaacagcaatagaaaatcgatactggatagctttagtctcgctaaaggcattaataagatttccgagaaagagttcaagtctttgagggggaaggtgaatgctgcccggctgatcgaaaagaaccattttaacggcatcaactcatatctgaaaaagaacaatccatga

SEQ ID NO: 10544 - RNA, 924 nt, unidentified
  source 1..924: mol_type = other RNA; note = synthetic construct
atgaacacactcacaaattggcgcaaaaatgacctcaagcagtttaagaagtatcctattcatcagtgcgccttctataagtgcaaaagtaagaagaagttggcctcgcttcttaagaccgacctgaaaaacttgaatcggctgagtaagtcaatcgaacaggagtactacacctttaacaaaaaaagacagatcaccgcacctaaaaaagaactaaaggcaattcagaaacgggtcctcaatctcctgaataaaattgaaaagccggattgggtaataagctccactaaagaaaaatcctacctggacaatgctcactatcacataggagctcaatatgtgtgtacaactgacattcgctcattctataacaattgtagcagggatcgagtgtatcagtttttcgccaaaaaactgatgaccagccccgacgtcgccaagctgctttcagatattacgacacttaaatacatccccacgggctctccctccagccagatcctcgcatactttgcctacgaggagatgttcatcaacatgtttaatatctcccaaaagttcaactgcaaaatgaccctgtatgtggatgatctaacctttagcaaggactctagcttcaattatcagaacctgatcaatcacatcgatatcgaagctagaaaattcaaccattctctgaagtacaagaaaactaactacaagtctgttaagaagggcgctaagataactggtgtgatactgaagaactacgagctcaagatcccaaactcattacgtatcagtattttgaaggacttcgagaacattaagaataaccaggagttgaagcaccaagttatgtctctgaagggaaaaattaatgccgcgaggctgattgagccaaaccattttaatgggaccaacagttacgtgaaatccttatga

SEQ ID NO: 10545 - RNA, 921 nt, unidentified
  source 1..921: mol_type = other RNA; note = synthetic construct
atgaagcaccagaagtaccacagcataaaaaatagccccttttttcggctgaaatccatcgacaaattagccgagtacctgaataccaagagcaaacggttgatttacttggagaatatgccactgacggaaaggtatcggtgctttccacaaggaactcgcgatattcagcagcctatcggcttcaataggtttatccacaaccgcctgcatacccttctttcaaggatcctgagccccgattttgtgttttccggaaaaaaggggttctctcatgtcgataacgccctggcacacctcaatagcaagtatgcagctcttatggacattgaaggcttttatcgcaatagtaagagagagtacgtgtttcgattctttctcaaaaaactggagatggcctcagatatagcgaacatcctaacaaacatcgtatgtttcaatgacttcatccctacaggtagcccgctgtcacagctgatcgcttactgggcctattccgacatgttcgaggagattgaaacagtcgcctcttcaaacaatttcattttcagcttgttcgtggatgacctcactttcagttctcaggacagaatacggcacgacttccatctcgagatcaacgctattttaaagtcgtatcgtctcaacatcaaaaggaagaagctacagtaccgtagtaagaaccaaaccaagattataactggttgcgccataacccccgataataagatcaaagttagaaacaagcaccgagtgaagtacatcaataacctgcagctcttactggggtcgcatcagaacagaaaggatgagaaactgattgactccgctctcggcttgattagttccctgcaagcaatcgaacctcaaattttcatggaatctaaacgcatccttaaacagaagatttccttttcttga

SEQ ID NO: 10546 - RNA, 915 nt, unidentified
  source 1..915: mol_type = other RNA; note = synthetic construct
atgaggaaggtaaacaaaatctacgatatcacattctctccgctttatgggattaagaataagaggaaattgcgcgaactacttgatatcggtactaatgaggagctcattcatctgcctctaacaaattcatatcggattttctccatcaacggccgcgaaatccaggagcctattgggctgctgcggaagatccacgatagattattccgctacctgtccagaatcgatacccccacgtatctttatagcggcaagcgtggcctgtcctacgttgacaatgccaaaagacacataaacagtagctacttcttgaaaatggacatcaagggtttctacaaaaacgcaaaccgagaatacgtgtttagattctatagatatcggctgaaccagtcagacgacatcgcgcatattttagccaatatctcgtgctacggaaaaatcattcctaccggaagcccaatctcccaacttattgcttattggagctacaaacagatgtttgacgagattgccatcctgaacaaagataagatatttacactctacgtcgacgacctcaccatatcatctgtggaactgagcttggccaaaaatctccacctgcaggtgcaggcaattgtcaagaagtaccgtctggatctgaaaaggaagaagattcgctactataacaagagggagaacaagcacatcaccggatgtgttattactagcgaccacaagtttagggtgccaaacaaacatcgaaagaagctcattagtatcatgcggaaatatccctcattgaatactataccagagggggagctcatgaaattaaccggcctgatttcttcctctcagcaaatcgaacccgatatatttatcaatacgaagaagcggctgagtcaaataatcaaaaagcagctcgcttga

SEQ ID NO: 10547 - RNA, 930 nt, unidentified
  source 1..930: mol_type = other RNA; note = synthetic construct
atgcacacagtccatggaaatttcttctatactctgtcgaacaagaaacgcctggccaagtacttaagggtgtcattgaaggaattactcacgctgcaggatgactcaaactataaagtatggtttgaggaaggcgagaatgggaaactgagggagattcaggaacctagttacaagcttaagtctgttcactctattatccagaaaagtcttgcttccatcgtagcacctgaattcctattttccggcgttaaaggtaaaagcaatatcagcaatgccagctatcacaaggatagcaactatatcgtgacggctgacattcgttccttctacatcaattgcaacaaggagtacattttccgctttttcaaatacaccctgcacaccagtgatgatatagccaggatccttactgagttgtgttgctacaaaacattcctcccaacaggcagcccggtgtctcagatcctggcataccacagctatgccagaatttttaatcggatagacgcctttagtaaagcgaatgggatcacattctccctctatgtggacgatattactctgtcgtctgaaaagagtattcatccatacatcctgaagaaaataagcaagctgctcgagtcagtgaatttatcattgaaacgagagaagaccaagttttactccaagaactcttataagatcgtcaccggttgtgctataagccctgaccatattcttctccggcccaacaagataatgagaaagatcaacaacaagttgtgcaaacatgaaaaggacctgtcaaaactgacttccaaagagattgagtctgtcctcggacaggtgatttacctgcggtccatcacccccaacagctattctcaactgtttaaatcactatccctcatgaaggcagaggaaaagatcaagcaaagacccctgtga

SEQ ID NO: 10548 - RNA, 927 nt, unidentified
  source 1..927: mol_type = other RNA; note = synthetic construct
atgaagacattgaaataccccattaataagtcctcactgtacaacctgcagaacaagaaaaaactgaaacagctgctctacatcgataattctgagttcaattacttcgccaaacaggtcaatatagacaatgaataccacccttttgttaacaaaaaggggagaggcattgacaatcctagtaaacggcttaagaaacttcattctcgtatccagaagctgctaagccgaattacttacccaaagtatttatattccgccgccaagcgctctaacatcaagaatgtgctgaagcacaaaaaccataagtacatgttcaagacagacattaacaagtttttcccaagtagcaagaaggagtatatattcagggcgttcaaatacaactttcagatgtcagaagatatcgcatggtacttagccaatcttgtgtgctacaatgaccacctcgctaccggaagccccgtgtcaactattctgtccttttgggggtacaagggcgtatttgattccatttatgcactcgctaaaaggagaggcatcaccatgagcctgtttgtggatgacatggcattttcgtctaacaagtatatcccaatctccttcaagtctaagatagagaagtatctgaaaaacgttgatctaatcctctcactgaagcccagcaaaaatattttctataagtccaacgaggagaaaaaacttacaggtgctatcataaccactgacaaaaagctgaaaatcttgcctgaaaccgagttgacgattaaggatctgctcaacaatatcgaaaacctcaaccatcaaaaactcaaaagtttgctgggaatgttgcaatatcagaagcaggtggagaaaaataacccgaatattacagaacacatcagcttagtcaaggccaagatcaagaacctgattagtaaatga

SEQ ID NO: 10549 - RNA, 903 nt, unidentified
  source 1..903: mol_type = other RNA; note = synthetic construct
atgagtaataagcaatacaacatccaccagtctccactgtacaagttaaactctaagtccaagctgtcgtccatcctgcacatcgataacctggccaatcttctgcgggacggtcactacaacaggtttgagatgaatgggaggcagattgaatccccctgcaaagaactcaagagagtccataagcgggtgcttaaactgctctcaaggatcaacacccctgattacctgattagtggtaagaaaggcttaagctatgtggataatgcaaaagttcatacccgcagatgcaatttggttaagatggacattaagaagttctatcccagcagcaaaaaagaatacgtattccgattgttccactacaaattccgcatggccgaggacgttgcttggattcttactgagctccttacatgcgacggccatattccaacagggtcacctgtgtcacagatcttggctttcatgatctttgccgacacattcgaagagatcaacaatctagcaatcacccacggctgttgttttaccctctacgtcgatgatattactatatccagcaccggcaacatccccagaaaactgatctatgccatacgcaacgagctcaaaaaggtaaacttaaacctgtctggaaaaaagacgcggttttatagcctgaacaaaaccaaatgtgtcacgggatgcgtgataacacctgatggcgaactgcgtattccaaataagctccaccaaaagatccatgagaaatctactatgctgaataaggagggactgtcaccgcatgaccaccaggtgctctttgggctattgaatgccgcacaacagattcagaagagcacttttcccagtctgtatagggaggctaagcgaaatttcaagatatccgtggcgcagtga

SEQ ID NO: 10550 - RNA, 912 nt, unidentified
  source 1..912: mol_type = other RNA; note = synthetic construct
atgaaaaattacagcctcgaaaagtctccgctcttcgggattcctagcaaagcaaagctggccgacctgctgaacgttgggaggtccgatttgttagctatgtctcggaaccccacttactctttctttaaaattcggaaaggagagaagtttagggacatagaggacccaaaccctgacctaaagaagctgcagaaaagattgaaccgactcctgtcccggattcaggtccccgaatatgttaaatcaagcagaaagggaatcagctatgtagacaatgcgaagtttcatcttggattcaattgtaccgccaagttcgacattgataagttcttccgaagcacaaaaagagagtacgttttcaggtgctttcactacacatttggcatgcccggcgatctcgcgtggcttctcacggatttagtcactctcgatgggcacttaccaaccggcgcacccacatccccactcctggcttattgggcatacgccgacgtgttctcccgcatgcatagcctggccgaaagtcggggcgccgtgatgtcgctgtatgtggacgatgtcgcagtaagtggaaatcaaccattgaaaagtgagtttcgtgataagctgtcaagtatagctggcgattacgagctgaaacttaagaaggacaagacccactattatttggaaggtgagacgcgcctgataactggctgcgccctaaacaccgtgggtcaggccattgtgcctaataagctgcgcaggaaaatctcaatcatgattcagcaaagagatatctctgacatgacagaaaaggagatccgcagactgtacgggcttctgaactccgctaggcagatcgagccggacttttctcccggtttgttcggacgggctaaatcacgtatcgaaacccttcctgtgtga

SEQ ID NO: 10551 - RNA, 990 nt, unidentified
  source 1..990: mol_type = other RNA; note = synthetic construct
atgtcccagatgaaaatatatcctttggagaattcacccctatatcaactgtgcaacaaaagcaaactcgaggaacttttgggcctacctaagggctatatcaataactttacctattctagggagaattaccactgttggcatcagctcaagaaaaacaaaatagacacacgccccgtggaagatccttgcggtatcttaaaaaaggctcagagtaagctgaacaaactgctctcacgcatttacaccacagactacctgatgagcgggaaaaagcactccaattacatcaagaacgccaagtaccatcagaataatccatatgttttctgtttcgacctctccgccttctttcagacagcaactcgacactatgtcttttctgcgttcaagaacgagttcttaatgtcagaagacgtagcttggatgctgaccgatcttgtcactatcccaaacatcgaaaacacagatggatatatcccgacgggctcgccgagtagccagaatgtgatttactgggcttacaaaaaggcctttgataccctctttagagtggctgagtcgaaaaagctgaaattctccctttatgttgacgacatgacgttcagtagctccaggcccataagtaacaaatttccacagttgatccaaaagctgtgtagcaaagtgggtttgaaaatcaatagcaaaaagaccaggtacttctctaagaacgatttcaaggatattactgggaacgtcatttcacctaaaaaagaacttaaggtgcccaaccgtagacggaaggagattctggacattctggcattcaaaaacatcaaggacatgaatgtgaaggagattcggagcttttacggaaagctgtgctctatgcgccagatagagcccaatatctttccagcactctataatgaagccagatctcagtactacaagctgggagcccaatacaatcagtccaagcaatttatgaaggggcgacggaagtga

SEQ ID NO: 10552 - RNA, 990 nt, unidentified
  source 1..990: mol_type = other RNA; note = synthetic construct
atgaagcagattaaaacctaccccattaataatagccctctgtacagactgtcaaataaatccaaactggcggagttgctgggcgtgtcaaagaaatacctggaacatttcaactatagtcgggacaattataagtgctggaagcaaaaaaagaagaacaaaaagggagcacgaccagtagaagacccaacactcattctcaaaaaagcccagtcaaaactgaataagctcctcagcagggtcattacaaccgactacttaatgtccggcaagaaacactcttgttatattaacaacgcacagtatcaccttaacaatccgtatgtcttttgctttgacctgcacacatttttccagaccgcctcgaggaagtacatcttcaaggctttcaaaaatgagtttcagatgcccgcacatatagcttggttgatcactgatcttgtgactattccaaagctcgataacagcgatgggtacatccccaccggcagtcctagctcccagaacgttatctactgggcttataaaaagacgttcgacaagttactggagatagctgaggcgaaggcccttaccttttctctatatgtcgatgacatgacgttctcatctcaaagacccatcagcgccactttcccgaaactcatccagaaaatgtgcgcccgcgtgggtctggagattaacgaaactaagacacagtacttctccgccaaggactataaagatgtgaccgggtgtatcatatctcctaaaaatgagctgaaggttccaaaccgacgtagaaacgaacttattaacatcgtgaagaacaagcctatcgaggaaatggatattcctgaaatacgcagtctatatggtaaattgaacagcatgcggcaggtggagcccaatatctttccacagctgtacaatcaagccaggaagcgctactacgagctgggagcacagtacaataccaagtccaagcaaaagatccggaaaaagaaatga

SEQ ID NO: 10553 - RNA, 987 nt, unidentified
  source 1..987: mol_type = other RNA; note = synthetic construct
atgctgaccattgaacaatcatggttctaccgtctcgggagaaagcgcgacctagctgcactcttgaatcttagtctctctgagctgaaggctcttactaatgacaaaaacttcgagccctgggaaaagacgtttccagacgggaaaaaaaggttgatagaggagccgcagccccagctgaaaaaggccctgaccgaggtgcaaaagatcctgtctcatatccagacccctccttggctcatgagtggtaagaagaagatccaaccgcgagacaacgcaatcgcccacattaaaaacgcctacatgatcagcgtggacatagccaaattctatcaaaacagcaagagagaattcgtttatacactgttcagggacgattttaaacagactaccgatattgcctccctacttgccgatttagtcacctacaacggacatattcccacaggagctcccagcagccagctcctagccttttggacatatcggaaaacattagagaagattcatgcagaagcatccagacagcacataactatgactgtatgggttgatgacatcaccttttcatctcggaaacctttgccaaagaactggctgacatttgtcaaaaggagtctggataagaccgacttgcacctgaagaaggagaagataaagttccatggtcagaaggatcacaaaatcactaccggctccgcgatctcacctaaaggcgtgctgaaggtgaagaatcagaagcggctggaaattctctccttgattaagagcaagaaaatcgaacaactgacactgaaggaggcccgctcattactgggcaagctgactgcgcagcgacagaatgagccagatttctttagtagcacgtacattaggtgcaagaaacacctccggaatcttgaaaagatgaaacagaaagagtcgtatcacaagaaacccaaacgcatcaaatcccttaaacagaaaccagctgctcagtctagatga

SEQ ID NO: 10554 - RNA, 1032 nt, unidentified
  source 1..1032: mol_type = other RNA; note = synthetic construct
atgagtaaatgttatccgattgagtcaagcccactttatagactgagaaacaggcgccgactggccaagctattatatctgcccaagaactatttccaggaggagcatacgtactgctacaatgagttctcacggcctaaacccaatggcgatggcaagagacatttcaccgtgcctccggacgacctgaaggacatacaaaagcacatctgtattctgctcaaacgcatcataacccctgaatgggtgatgtccggaaaaaaaagctgttcctacattacaaatgccgagatacatctcaagcaccggtttgtccgcactatggatatctcgaaattttacgatagcgctcagcgaagcaggatttacaatatgttctcccagacctttaagatggcaagtgatatcgcttggattatgaccgagctggtaacctataatggcatgttgccaacaggctccccctcatctcaattagtcgtttactggacgtacttcaacatgtttcagagaatcaacgaactcagcgagaagtatgattgtcgattctctttgtatgttgacgacatgacattttctagtgacttccccattaaacgtcagctgcgcgacgaagtcagtgtggtcctgaggaaaaatggtctgctagcgaagtctaagaaagaccactactatcaggccaacgattttaaagtaatcactggggtggggatcaggcaaggaaaaaagatcgtgccaaataacaaacgcaaacagattatcgaactttacgttcagtgcaagaaatcaggtaacatctacgacatcgaaaagctcaacggaattctgtgctccctcaggcagatcgaacccaatatttttcctgagatatatgggtacgtccactgctatgaaaaggagctgaagaaacttagcagagatcggttctaccggacaaagaggaagaaaaagccatatcggactaagcagatgtacaacgtggtgaataacatgaacttggtggagcaacgtaaggaaggcaagcagtgctga

SEQ ID NO: 10555 - RNA, 1011 nt, unidentified
  source 1..1011: mol_type = other RNA; note = synthetic construct
atgaataagtgctaccctattgagaattcccctctgtaccggctccgtaaccgaagaagattagccgagtttcttaatctccctaagaactacttcaaagaggagcacacatattgttataatgaattctctcggccaaagcccaacggagatggagagcgccatttcaccgtacccccagaagacctgaaagacattcagaaacatatctgtaaactcttcaagagaatcatcactcccgaatgggtgatttctggcaagaagagctgttcctatattacgaatgctgaagtgcacttgaaacacaggtttgtcaaaaccatggatataagtaagttctacgactcagcccagaggtctaggatataccaaatgttttctcaaaccttcaacatggcaagtgacatcgcgtggatcatgacagagctggtaacttataatgggaagctacccaccggcagcccaagcagtcaactgattatctactggacttattgcggtatgtttcagaggattaatgagctggcagaagagtataactgctacttctcactgtacgtggatgatatgacattcagcagtgactttccgatcaaggccatactcagagatggtgtctctgacgttctgcggaagaacggcttgctggctaagtccaaaaaagatcactattaccaggtgaacgatttcaaagtcgtgacgggggtggggattaaacagggaaagaaattggtgcttaactccaagcgtaagcagattatcgaactttacgccaaatgtaagaaaagctccaacatctaccagatagagaaactcaatggcaccctgtgctcactgcgccagatagaacctgacatttttccagagatctatcgctatgttcacagctacgagcaagaactgaagaagctatcgagagacaggttttatcgatccaagcgggagaaaggacgctacttatcaaagcatatccataacgttggcatcaatacagaacaggggtttgactga

SEQ ID NO: 10556 - RNA, 1014 nt, unidentified
  source 1..1014: mol_type = other RNA; note = synthetic construct
atgatgtctagcaaatgttatcttttagagcagtcgcctctattcagactcagaaacaggcgcaagcttgccactctgctgaaactagatgagaagtacttctcgaatgagcgtgcttatacgtacaggtcattctccaggcccaagcccaacggtatcggcatccgaaagttcaccgtgccctctgacgaactcaagatcatacagaagcagatctgcaaattgttgtcccggattgagactcccgaatgggttatgagcggcaaaaagagctgttcctatatcacaaatgccaaagtccacctggagtatccatttgtgaagactatggatatttccgaattttacgattcagcacagaggagcaagatctacaacatgtttttcaacctctttcaaatggaacatgatattgcttggttgatgaccgaattagtgacatataacggtgggctgcctaccgggagtccttcatcccagctgattgtgtactgggcctacagcgacatgttcaacgagatacagctgctgtctacaaaatacaactgcaccttcagcctctacgtagacgatatgacattttcatctgatgagtctatcagtggaaaactgagggaagacgtcagcgcacttctccgtaaaaataatctgaacgccaaggtcaagaaggaccactactatcagatgaaggactttaagatgattaccggagtcgggatttataagggaaatatggtggttccaaacagtcggcgcaaggctgccatctccctttactcagaatgccgcaaacatggcaatataaaagacatcgagaaattgaacggcatactgtgtagtatgagacaaattgagccaaatatcttcccggagatcgctatgtatgtgaaacactatgagaaagagctgaaagaatacagtcgaaagcggttttatatggcccggcgcaaggcataccaaaaaaagagaaattcctgttctgtagcggtgagcaatgaagttaagatttgctga

SEQ ID NO: 10557 - RNA, 996 nt, unidentified
  source 1..996: mol_type = other RNA; note = synthetic construct
atgtctaagatgtatgctctcgaacagagtcctctgtaccggatgagaaataaaaagaaattggcgaccttactgaggatctcgactaattaccttatgcaggagcatgggcaagactattataagttctcacgtcctaaacctaacggggatggtacgcggaactttaccgtgcccagtgatgaactaaagtacgcacagaaaaagctctgtaggctgctgtccaggatccagaccccggactgggtgattagcggaaagaagaatcattcctatattacaaacgccgagaaacacatcgaaaatactttcgtgaaaacgatggacatctctaaattctacgacagtgctgaacggaagtatgtgtatcgcatgtttaaagagacttttaagatggcagaggatatcgcatggctaatgacagagttagtcatgtatgagaacatgcttcccaccggcagcccatcatctcagctgatagtgtactgggcctattgcgacatgtttaatgaaatcaaccaaatcgccaacgagcgggcctgcattttcacactgtatgtagacgatatgacattctccagcaagactcccattaccaaggaactgagacaggaagtatgtaatcagctgaagaaatacggcctcatagccaagtcaaaaaaagatcattactaccagggaaacacagttaaggtcataaccggtgtggggataaacgatggacaaaaagttgtcctcaataataagaggaaacgaattttggaacagtttgagaagtgtaaaaccagcaacaaaatctacgacattgagaagctgaacggcatgctgtgcgccctccgacagattgagccagagattttcccagagatctacaattacatcaagcactatgactccgaacttaaattgatggctaggaatcgctttttcaagcaccgaagaaagcgcagaaagatcgagaagcaacgccagtacattaaccagaacaatatctga

SEQ ID NO: 10558 - RNA, 978 nt, unidentified
  source 1..978: mol_type = other RNA; note = synthetic construct
atgtcgaaactttatccaattgaacggagccctctttataaaatgtgtaatagacggaccttagccaacttgctgtgtctgccaaccaagtacttctcctacgagcatgagtaccagtacaatgaattcagtaagccgaaacccaatggcaatggcagaagggacttcactgtgccctccgacgaactgaaggccatccaaaaacgaatctgtagactgctcagcaggattgtgactcccgagtgggtcatgtccggtaagaagcattgctcttatatcaccaatgccgaacaccacgtggataagaaattcgtaaggacaatggatgtatcaaagttttatgatagcgtccagagaaactacatcttcaagatgttcaaaaacacctttcagatggctgaggacatagcctggttgatgactgatatcgtcacttataagggggtgctcccaaccggatcaccatcatctcagctgatcgtgtactggacatacgcagaaatgttcgacgccattaaacgcaaagcggatgaaaacgactgcgattttacactctacgttgacgacatgacatttagcgcagatcatcctatttctacggaattccggaacgaaatcgccatacagctgaagaaaaatggcctgcttgcaaaggctcagaaagaccactactaccaacccggaagttttaaggtcgttaccggggtgggtatagaaaacggggagaagaaggtgttgaataacaaacgtcagaagattctgttccagtatgagaaatgcaagaaaacgtgcaacctgtatgatattgagaaactcaacggcatgttatgttccatgaggcaaatcgagcctgacatctttcctgagctaggaaattacattaagcactatgaggccgagctaaaagagatggcgcgcaaacgattttacgctaacaagcgcaagaaagcaaaggttaaggagaagaattatgcttga

SEQ ID NO: 10559 - RNA, 987 nt, unidentified
  source 1..987: mol_type = other RNA; note = synthetic construct
atgagcaaaacctactccattgaattctcacctctgtataggatgagaaaccggcgcaaactggcccgcgtactgaaattagatgagaagtacttcaagcagaaccacacctacaagtataatcatttctcagagcctaaaccaaatgggacaggcacacggaactttacggtcccagaaaaagaactaaagtcaatacagaaacgcatttgcaagctcatgagcagaatcgagacacccgagtgggtgatctcggggaaaaagaagcatagttatatttccaacgctagaaatcactgtcgaaactataatgtgaagaccatggatatttctcagttctatgacagcgcgaaaagaaagtacgtgtacagtatgttcaaagagaagtttcttatggccgatgacatcgcctggatcatgaccgacctcgtgatgtgcggcggaacattgcctactggatctccgacttcccaattagtcgtatactggtcttattctgatatgttcgaaaacatctacgagattgcacgaaagtacaagtgtgaatttacgctgtatgtcgacgatatgactttttcctccaatatcggcattagcaagcagcttagaaaggacgtggaggaactactgaacagttattgcctgcacgccaaagcaaagaaagatcattattaccagaacaacgcctttaagaaggttaccggtgtggggatcaaaaaaggaaaactcctcgttcccaatcagaagcgttacgagatcataggtatgtacaagacttgtctgaagaataaggacataatagagatcgaaaagcttcggggcctgctcatcagcgctcgacaaattgaaccagacattttccccgagatctataggttcgtcgagaagtacaaagatgacttgaatctgttggctaggaatcgttattacaggaacatgcggaaacggaaaaaagtgcagaggcgcgaggacgtggcatttgtttga

SEQ ID NO: 10560 - RNA, 972 nt, unidentified
  source 1..972: mol_type = other RNA; note = synthetic construct
atgagaaagagcaagacttaccctctcgagaagagcccacttttcaggctaagaaaccgccgcaagttggccttgctgctgggcttagacgtagattatttcaaaaccgcacacgaatactcctataaggagtttgagaaacctaaggcctcaggtgatggggtgcgaaaattcgctgagccgaaaggcgaaatttgtgaaattcagaagcacatcctgaagtacctgaagaggattgagactcccgaatggctaaagagtggaaagaaatccgaaagctacatcacgaactgcaagatgcataaggacgcgctttatattcgtaccatggatatatgccatttctatgacgcggtcagttatgctcaaatcgagaaatccttttgtcaggtgtttaagatggcccccgatatcgcccggctgatggcaaaactggtcacaaatcgcaaaactattccaacaggttccccttcatcacagctggtggtgtattgggtttacagagacatgtttgacgagattaattcgatcgcagctacctttggctgtaaattctctctgtatgttgacgacatgacattctcatctgaaaagcagatcagtcaccagctccgggatgctgtggtcaaaaaattaaatgagtacggattgcacgcaaaacgatctaaagatcattactacgaggcccaagactataaggtcgtgaccgggtgcggcatcaaagatggcaagacggatgtgcccaataagctgcggtacaaaatcgttcagcagtacaggctctgccaacttaccgatacaatagccgagatagaaaaactcaacgggatgatgtgcagcgcccgtcagatggatgaaaacattttcgacagcgtaagcaattacctgtgtaagaacagggagaggctcaagggatatgtgcggtccagaaagtctaagcgccagtacgaagacaacgactttgagttctga

SEQ ID NO: 10561 - RNA, 930 nt, unidentified
  source 1..930: mol_type = other RNA; note = synthetic construct
atgaataaagacatcaatcaatatgagctggaagatagtctgctgtatcggctgcgaaatcgcggtaaactggctgaaatgttcaacctaccccataactactttcgcactcagtataagctggacattgagtataaaagcaaacacatccagacaggacgaaacaagaaagataggttggtggagaatccttcgaagaagctcaaaaatatccagagagagattctcaagtacttatcccggatccaaacgcctgattggattatctccggaaaaaaggggaagtcatacattgataatagcaagtttcacaaggacaattcatacgttatcacaagcgacataatgaacttttacccctcctgcaaaaaggattacgtgtacagaatgttccgttatacctttaggatgagttccgaccttgcgacgatccttaccactcttgtcacttacaatggtgggatcccgacaggcgcaccaacatcacagatgattgcctattgggcttataaggacgccttcattagaatcaatgagatcgcattaaagtacaacgccaaattttcactgtacgtcgatgacatggtattcagctctaagtctaccatttctaagaggatgattctcgagataaagaaagagctgcagaaatataacttgagcctcaaggacaacaaaacccggaaatacggctccaaggattataagttgataactggagttgtgtacgacaagaatggggagcttaaaattcccaacaggctcagaaaagatatcatcgacggctacaacgaaataaagaaaaagaaggacaactgcaacgaaaccgataaaaagagcctgctgggcaaaatttattctgcccgccagatcgaaccagatgctttcagtcagctactgcataacgtgaagaaaatagaatgtaagtga

SEQ ID NO: 10562 - RNA, 924 nt, unidentified
  source 1..924: mol_type = other RNA; note = synthetic construct
atgaaaaagatagtggagcgccatcacaaaaaacagtcgtttttttactgtctcgcaaacaaatcactgttagccactcaattcggtctacctcagaattttttccggagtaaatataaggagcagctgatctattctttcttcgagattagcaaaaaggatggatcaagccgtgagatcaataatcccaagtatgacctcaaggtgctgcagaggaagattttgaactacatgaaccgaatttacaagcctgattggcttatgagtggccggaagactatcagttacattgacaacggtagaaagcaccttgggtctaactatgtgattaccatcgacattaagaagatctacagcaactgcaaacgcaacaatgtttacaacatgttcaaggatgtgttcaagatgaccccagatatagcctccatcatggccgatttgacgaccttcgaaggggcagtacccacaggggctccgactagtcaagtcattgcattctggacatatcaggacgcttttgaaaagataaacgagatcgcccagcagtatgactgtatattcagcctgtacgttgatgacatgacattttcaagcctgggcgaaatcccaacacaattactgctcgaagttgacaaagagctcaaattggtgggcctgagcatcaaatggaaaaaggtgaagagatttggaatcaaccattgcaagcttatcaccggagtagtcctggacgaagctaagcagatgcgaattccaaatgcgcttagattgtctatcatccagggcgtcaagaaactgtccaataaagaactgtcacaagaggagcgcctccggctgattaagtccctaaaaggcaagatcaattccgccaggaatattgagcctgaaatatttcccgagattcacaggaaaatctcttccatttga

SEQ ID NO: 10563 - RNA, 927 nt, unidentified
  source 1..927: mol_type = other RNA; note = synthetic construct
atgcgtccctccattccgctcaatcagtgcatgttttacaaatgccgttcaaagaaagctctggccagatgcctgctactcgatttacaccagttgcagcggcgcagcgaatggatccagtatcgagtgcatgcagagcaaaaggctagcggtggactgcgcgtcatttatgcccctgcagatgaactcaagagtgtgcaaaaggtgatcaaatcgcgcctgcacagaattgaagtcccctcttgggtttacagtggcgtgaaaggaagatgtcatatcgacaacgctaaacaccatgcggggtcccggtattttgtgctgtctgatatatcatccttctacgaaaactgcactagggacgccgtgtatcgattcttcagagacgatctgctgtgttctcctgatgttgcctccctcctcgctgacttgacaaccgtacgcaatgccgagggcaagaccgtaaaccccaccggaagcccctgctctcaattgatcgcctactttagctaccggagtatgttccacgagattgcgtctattgctgaccggtatggctgtaaattttccctttacgtggacgatctgactataagctcagagagtcctatctcgaacccacgaaaccttatgaaacaggttgccaagtcccttagagcatacggccatagggtgaagtgggagaagacagggtatttcggtaaaaatcagtttaagctggtcaccggcgtggcgattgatcagcaaggcgagctgaatatcccaaatcaccttggggaggctgtcattactgggttaaaggagacgttgtcaggggacaggagcgagatagccccaacactaggtagaatcaacgcagcccggcagatcgacggacgcgtcttcagcgaagcaaggaggctggttgaaaatgcacagaggtgtttttga

SEQ ID NO: 10564 - RNA, 921 nt, unidentified
  source 1..921: mol_type = other RNA; note = synthetic construct
atgcggcccgaaatcacaatcgatcagtgtcagctgtacaagtgcaggtccaaaaagcgcctggccgagatattatacatcgagagggcagactttaacgatattcctacctgggcaacatacaggattagccacttggaaaagggagacggtgggacccgaactatctattcaccttccaaacggctcaagaaggtccagaaacgcatcaaacgcctgctagagaggattcacaaacctagctgggtttttagtggcaccaagggaaagtgtcacgtcgacaatgccatgcaccatgcgggtaacacctactttgtgctctcagatattgccgagttctatgagtcatgcactcgtgataccgtgtataagttcttcctgaacgaaatgaaaacttcccctgacgtcgctgaactgctcgccgacattacgacactggaaactaacggcaaaaccatcatcccaacgggatctcccagcgggcagctcttggccttctttagctacagagaaatgttcgatgagcttgaagagttgaccactagacatggatgccgcttgagtctgtacgttgacgacctgacaatctcgtctaatacaccgatagccaatcccaagtccctgcaaaaacagcttgctagaattatggcctcatatggccacagtataaaatggagcaagactagatacgtgaagccgtctgagtttaaggtggtaacgggggtggctattggtccagacgggaccccccatattccaaacaatctaggccgagcaatcataggtggactccaggatgcgttaggcggggactgcctttcccaagctagcacactgggccgtatcaatgctgcacggcagatcgttgaaggctctttcccagaggtggagagggtactttgtgattatcggcatctgtga

SEQ ID NO: 10565 - RNA, 921 nt, unidentified
  source 1..921: mol_type = other RNA; note = synthetic construct
atgacccatccaatcgaccaaagccgcttctataagctgagatcgaagagaaaattggccgaggtactctgtaccaatcctcaggagttaaaacgtacactgagaaacgccagctaccgcatttctcagactcccaaagcggacggtaccttccgaactatatacaatcctaatccatcccttaaacgggttcagcacaggataggaaatcttttgagtcggattgagatgccaccctgggctttctttgccagaaagggcgtctgctacgtggacaacgccaggtatcacgagggtgctagatatctagtgaagtccgacctgtcttctttttacgaccattgtgacagggaacacgtgtaccgcttcttcaagaacaccatgaagtgttctcctgatatcgccgaagccctgtgcgacctcacgacatatacccttcaggatggatcaactatcatcccgacggggagccccagcgcacagatagttgcatttctggcatatcgggagatgttcgatgagatcaaggccgtggcggatctgtacaaatgcaaattttcactgtacgttgatgatctaacctttagctcacgctccgggattagtaaccctagcaatctcgaaaggagtatctcccacatcgctcggcagtatggccattgcatcaaggccgagaagactgtctacctggatgcatccacaagtaagattattactggagtggctttaaccccctccggcgagccaaaagcaccgaacgccttgcgtgaagccacagtgtctgacctgacacagatcagctcaggggacctgtcaaagattgtctcttgtctgggccggataaatgcagcgcaaatgattgaacgaaacctctttgctgatagtaaaaggcaggtagaacaaatcctcgcttccgcttga

SEQ ID NO: 10566 - RNA, 927 nt, unidentified
  source 1..927: mol_type = other RNA; note = synthetic construct
atgaaaaagacggtgcggcagtatcccctacaacggtcacccatttaccggctcggaagacgccgagatctggaagagctgctctatatgcagaagggagatagccgtcgggttaaatgcttttctgaatacaacatcttcgacaaagagaaatccagtgggggctcaagaacgatcgaggccccatgtagcaagatgaagaaatggcagagaagggtttgggacctgatggctagaatcgagaagcctgattgggtgattagcgctactaagggaaagagctacaaagataatgcttccaaacatcgcagcaatggctacgtcatgaccatggatattagttctttttacccgtcatgcgtgagggagtacgtgtacagactgtttagggaacggttggaatgttctccagacgtagcccagtgtttaaccgatatatgcacctatcaggggggtatccccacaggtagtcctgcgtctcaagcagtggcctatttcgcatacgccaagatgttcgaggagattgaggatctcgccaggacttatgggtgtaccttcactttgtacgtcgacgatatgacattctctagccaggacaactttagctggaaaaagctggcgtacgaggtggacggagttctgcacaagtatggccaccgcgcaaagggctccaaaacaaagtataggctgcctggcgactttaagatagtcactggggtctgccttgcacccgacggtgctctcgtagcaccaaataaacttcgatcaaagattgtgggcaacacacgctccctgaaagccagtggggacctgtccttactttcgagaatccagggtcagatccaagccgctgactatgtggagggacgacgcaccttccctggcataaggtccgaactagaacgtatcgctgaagccgccttgtga

SEQ ID NO: 10567 - RNA, 924 nt, unidentified
  source 1..924: mol_type = other RNA; note = synthetic construct
atgggggctaacagaaagaagtatgcaatagagcagtgtgcattatataacctgaccaccaaacgacgcctcgaagagaagcttctgctgcaatccggtgaacttaaaggtgtgatgcgaggagtgacttatcgggattttcagattccaaaaaagtcagggtctttccggcaggtcagcgaaccaaacaagcgcctcaaactggtccagaagcgcgtgctatggctgctgagtgcggtggagaagcctgactgggttatgagcgctacaccgggaaagtgtcacaaggacaatgccgtgtttcatagatctaatgcctacatggttaccatggatatagagagcttctacgacaagtgcgaaagagagagggtctatcagtttttcaagaggaagctgagacagcctggggatgtggcaaaagcacttaccgacctgtcgacatacaggcaaagcatccccacaggcgctcccaccagtcaaattgtggcctatttcgcttacgaatctatgtttgccgaaattaaccaggtcgctaaatcccatggatgcatcttcactttgtacgtggacgacatgacattctcatccggtgagcctttttcccccgacaagcttgcaagcgaggttgatgcggtactccggaaatatgggcacaaatccaagatgagtaaaacgcggtactacccaaaaggcacttgcaagctcactacgggggccgccatctcacgtcagttgctgttagtagcacccaacgatctgaggaaacgcgttttggagaattacgataagctaaggaaaaccggagataaatctctggtggccgtcattctcggacagatcggcgctgctgaattcatcgagggccgggacatgtttcctggcatcaagcaagccgtgcgtgccttcggcaatgcctcatga

SEQ ID NO: 10568 - RNA, 903 nt, unidentified
  source 1..903: mol_type = other RNA; note = synthetic construct
atgaagagagcaagtaaaaagtacgatttagatcaatgtgccttgtacaaatgtaagtccaagaaaaagcttgccgagctgcttctcattgaccttcgatatatcaagaatagcaagaacttcatcgattatcattctttcgaactgacaggcaaaaataataaaacccgtctgattaatgccccacagcccattcttaaaaagatccaaaagagactcttggccctgttgaggcctatcaatcggccagcttgggtgatgtttggcgagaaagggaaaagctacatccaaaacgctatcgtgcatcagtataacccttattgcatcaccatggacatcaagggattttatgatcactgtcggagggacgccgtttatcggttttgcaaagacaagttgcaggtgtctcccgacgctgctactatcattacagactttaccacgtgggaacagcgcatacccactggctccccagtttcacagatcctagcttaccacgcctacgaagatatgttctgcaagattaacgaatacgcgaaaagtattggtgccaagttcacactgtatgtcgatgatataacgatatcgagtaaaaacgccattgaccctaagaagctcgcatcaaaggtccgaaagatcctgcatgtgtacggtcacacaatctctaagaacaagaccaaatactacagcaaaaatgacttcaaactcataaccggggtaattatctctcccaaccatcagctgctggtccctaataagctgagccacaaaattaacaatgagctcgagcacctgtattccattatgcaggagtcaactgatgtgcaaggagcgatattaaggctaaacgggctgctgcaggcagcaagactcatccagccgaactaccgctccgacatttga

SEQ ID NO: 10569 - RNA, 930 nt, unidentified
  source 1..930: mol_type = other RNA; note = synthetic construct
atgaagaaaaagtatccacttagccaatcttatctcttcaaatgccacagcaagaagaaacttgccgattccttaggaatgagcttgaagaagctgaaatacatctcaaacaatccccgctattatagttttactaagagaacaggcactaaaaatcgagagatcgacgtgccttccgatgccgaactcaagaaggctcagaagaacatatacaattacctgaagtacaccaaccggccgaattacctgatggcaggggagattgggaaaaatatcctctcaaacgctaccttccacaaagatagtgactattggctgaaatttgacattagcaacttcttccccaactgtaaacgggagtacatttaccgtttctttcagtctagtatgcagtgttctccagacgtcgccagtatcttgacaaacattactgtgtatagaggtgggctggttcagggtatttccacatctatgttactctccttcttcgcgttcacccctatgtttgacgaactaagtcttctggccactaagaacaatctaaagttttctacgtacgtcgacgatttcacattcagctcgtcatcccctatcaacacaaattttatcaaactgcgcgtgaacaagatcgttagggcttatggacataccataaagaacaggaaggtgaaatattacagcaccaatgattcaaaacgggtgtcgggcgtgatagtcactaaaacccaccatctgaaagtacccaacaagaatcgtaagaagattatttctctcgcaaaatccatgcgagagaacatcaatacaggcaattaccaagaggcagaaaaaataagattgtcactgcgcggatgcatcaatagcgccaggcagattgagcccgaaatctttccagaaatctccaagtttacgaaaaccaagtttaagagctga

SEQ ID NO: 10570 - RNA, 933 nt, unidentified
  source 1..933: mol_type = other RNA; note = synthetic construct
atgacttaccctatcaaccagtgttatctgtataaaatccacagcaagaaacgactctctaaaatttttggcctcgacctgaagaaaatgatggatatatccaacacccccatctataagaacttctacatcttgaagaagaacaagaaggattataggaagattgagtatgccagtgacaccctgaatggaatccagaggaagattcataaatacctggctaacatcaataagccaaaattcctgactgggggagtaaaaagtaagagtattctcaccaatggcaagattcacaagaataacaactactggatcaagttcgacatctcaaatttttacgtgaattgcaaccgggactacatctataaattcttcctgaatgatctcaagtgcagcccagatatatcagagatccttacaaatctgacgacttttgaaggccacctcatacaaggttcctcttcaagtgtggaccttagctactttgcctactccaaaatgttcaagcagctaaacgatctcgcgttgttgaatgacttaacattctctacctatatcgacgactttacatttagctcgaacattcccataaacattgactacatttcaaagaacgtgcttaagatcctgagattgtatgggcataaagccaaacgcaacaaagttaagtactacaacatcaacagcaataaactgatcacaggtattgtcgtgaataagaacaacgagattagagttcctaattacaatcgcgagatgattatcaatctaaggcggaaaatcgaagataatgattcttgtgacctgagagatattctgtccttaatcggcatgattaattccgctcgtcagatagaaaacggggtcttctccaactcttataactacgcacaaaatatactgaagcgacttcggaaaaataaaagctattga

SEQ ID NO: 10571 - RNA, 933 nt, unidentified
  source 1..933: mol_type = other RNA; note = synthetic construct
atgaggaaggggaaatacgccctgaatcagagcgccctctataagtgtggaagtaaaaaaagactggccgagattcttgggatcccactgggtaccttgaaggaaaatgccgaaaacccgcaatatcacatagtgtacaaacccaagaagaacagtaccgagaaacggaaaattaatgcacctcggaagacactgaaacggatccagggcaaaatctacaagaagcttcaatacgtgaagcgccctaaatgggtgatggcgggcgaaaagggcaaaaactggccagataacgctgaattccacaaggactcctgttacgtgctcaagtttgatatagccaatttcttccccaattgcggtagggagtatgtctacaggttctttctgaatagactaaagtgcgctccagatattgccgaaattcttacaaatctgactacgtatcatggctgcatagtgcagggaagccccgtttcaatggtcttagccttctacgcttacgaaaaaatgtttgacgagctcgcaaacttggctgacgagaactccctgctgttttcgacctatgtggatgatctaacattctcctctaaaaaacagatccagaaagacaaactcatcaagattgttaacaagaagctgcacgcatatgaccataaatctaagtctaagaaggagatgtactacgggaagactaaatacaagaagataaccggagtcatcctgtatcccgatcatgttagcaaagtgcctaaccgaatccgtctcaagattaaacgctccctggtggcggccaaagaggctgagaaggaaggcaacgtaaaacaggccaatgactttaagaaggagttggtcggaactatttatagcgctagacaaatcgaaaagaacatctttcctgaggcattaaattatgcaaagcagcaggtatcatga

SEQ ID NO: 10572 - RNA, 954 nt, unidentified
  source 1..954: mol_type = other RNA; note = synthetic construct
atgaagccgagcgagtctcggaaacggtataacctgaatcagtgtgccctctattgctgccgtagcaaaagcaagctctttaagctgctgggcaccaatgcaagggaaatccgggacctgactaaaaacatgaatgagcagtacagtatcttcgacttggaaaaaaagggaggcgggactagaacggtccatggcccatcacccttacttaagaggatccagaagaccttatataaatacttgagaaaggtcgagcgcccctcttggctgattagtggtgagctggggaagtctgttatagacaacgtacggcctcaccagttcgccggcgacatgattaagctcgatatctccggcttctttgataattgtaaacgagaacctgtattccagttttttcacactatacttcgccaacccggtgatgtggcttccatctgcaccgagctttgtatgcttaatggagccatagtgcaaggaagtcccacatcaatggtgattgcgttttacgcgaaccgcaaaatgctcgaagagctgcagcagttagcatcggatttcggtttggtctttacagtttatgtggacgatattgctttctcctgtgctgccagcttcaatgaagacgcactgctgtctcgagcttgccagatcgtgcgcgcctacggatttagggtgaagacgaagaaggtcagagagtaccctttggagaaacctaaactgctaacagggatcgtcatctccaagaagaataccctgtccgttccaaacagggtgcgtcgaacaatactcgactccatgaccagttacagaaaaatggatgactcaaacgagaaggaaaaactgcgccaaagcatgctcgggatgattgcatcagcccagcagatcgaaccagggattttcaacagcattcggggccagctcctaagcgataggagaaaacaactggtgtcttga

SEQ ID NO: 10573 - RNA, 948 nt, unidentified
  source 1..948: mol_type = other RNA; note = synthetic construct
atgacaactaaggtaacaaaacgatatctgctgaaccagagcgctctataccattgtaccagcaagcggaagctggcccgggtcttacaaatcgatttaaagcgccttgtagggattgtgggggatataccaaaccaatactccaccattacacggccgaagaaagattcaggagagaggatcgtgcataatgcacacttcgaactcaagagggttcagagacggttgtttaccctgctcagaagggtgaaacggccaaattggctcatctcaggcgagataggtaaaagcattacagacaacgttaggcctcacctgggcggcactcagcttttgaaaattgacatctctggcttttttgacaattgctcacgcgaaagtgtctaccagttctttcatgttcaaatggcccagcccagtgatgttgctaagatttgcactgacttgtgtaccctggaaaatgctgtggtccaaggggcctccaccagtatgttgattgccttttacgcgaatcagagcatgctccaggagctgcacgagctggccgaggacaactccctaatatttaccgtgtatgtcgacgacatcgctttcagctctagtcactctttccaggcatccgatattcttgaccaagcgacaagaatcgtgtctgcctatggtttcagagtgaagaataagaaggtccgcgcatataacgatagccgacccaaacttctcactggagtgatcattacgacaacctccaagatggctgtgcctaattgcaaacgaaggaagatcctggacgatatgactcagtacaggcgctccaccaaccccgcagagcgtagatctatgcgttcaaagatactgggccagatctcggccgcccagcagatcgaacctgatttcttcacgggagtgaaaaaccagctgaaatacgaaatgcgcatggatgaggactga

SEQ ID NO: 10574 - RNA, 936 nt, unidentified
  source 1..936: mol_type = other RNA; note = synthetic construct
atgaagaaaaatatcaggcgttaccccctgaatcagtcccagctgtataagtgccactctcgtcggaggctcgcccgaatgttagataccgacctgaagactctcgaagagatcgccaaaaaccccagatattatagctttacacggccgaaaaaaaatagcaacgagagacggattatcgatgcccctaatcaaaggctcaaaaaaatacagaccagcgtgtacgcttacctgaggaaagtgaaacgcccagactgggtgatggcaggcgaggtaggcaagaactggacagagaacgctgagactcacgcagacgactcatactttgtcaaggccgatatctccaagtttttcgataattgtgagagagagtacgtttaccaatttttcttgaccaagctggaacagtccccagatgtggccgacatctgtaccagtcttgtgatgttcgaagggaagatagttcaaggagcacccaccagcatggtaattgctttctatgcgtatcagaagatgttcgaagaactggcttgcgtcgccaaacaattccactgcattttcaccatttatgtggatgatgtcacatactccagcctcgatccaatagactctgccgccctggaggcaagaatcagtcagattatggcggcttatggccataaggttaagcgacagaaagtgagaacatacggatctcagcgggctaagcgcgtgactggggtcatcttatcgacggaccatcaaatgcttactcctaattcactgcgccaggaaatttacgctgactttcagcagtaccttgcgcagaaaaaagcagacaaggatgaccctaacctagaccaccagagggcctcattgctgggtaagatcaatagtgcccgccagataaaccccgggatttttcctgagatgcatcggatcttgaagaacggttga

SEQ ID NO: 10575 - RNA, 951 nt, unidentified
  source 1..951: mol_type = other RNA; note = synthetic construct
atgaaaaacatcaccctgtcgaataatccactgtataacttgaagagcaagaataagttgaagaagttactgtacgtggataatttcgacaacataatcaaccagtatgatgtcttcattgcaaaacccgcacggctggttgaaaaaccaagtaaccagctgaaaataatccacacccgcatctttaaattcctgaagaagatagagatccctgactatctcttctcaagcaagaaagggaaatgttacatcgacaatgccaggctacaccagaataacagttttgtagtcactcttgatctgtcaaaattttttcctaagtccaacgcatcccatatctataacctcttcgagaagaagtttaatatgagtaaggatgtggcctacattatgacccaaatttgctccattgatacaagcaaaatcaccctgaaagatagtgtgaaaagatggtaccagaatgcgaataacaaactcaagtaccctattccaattagccatgtgcccaccggatcttgtacatcacagataatcgctttcttatctttcattgacatgttcgaagagatgaatagcatcgcctgctgcaacaatattactttttccgtgtttgtcgacgacatcatcatctcctctaatcagcccataaaaaggcacatcattaacaagttcaagtatatcgctacgaaatacggccatgagatcaacaaaagcaagattaagtactacgggattaactataacaagcgcatcacaggcgtaattataactaaggatcaccgtcttaagtctccgtccaagaatcactttcaatcttttaaagacgcccagcagtataagatcaatcccagcattaaatcaaagcaacgaacaattggtagaatccaggctgttcggaacattgaaaagcaaaagttcatacagctcatcaaagacattaaacaggtgtga

SEQ ID NO: 10576 - RNA, 942 nt, unidentified
  source 1..942: mol_type = other RNA; note = synthetic construct
atggagaacgcgttattcaatctgaagtcaaagaagaagctagcaaagctgttgttctatgacaaaattgggtacctcgataaggacctcagcttcatcaacaactattccgtttttatcgtagagacatcaaatggtggaaccattaaaagcagaatcgtggagacgccaagagggatgctgaaagtgatccacgaccgtgtgtttaaattccttaaccaggttgatttgccggactatttgatttccaaaaggggctcttcctatgttcagaaccacatttcccacaagaataatagtaacgtggtgagcatagatatacagaaattctacccaatgtgcagcttcggcaatgtctacaagttcttccataacactatgaatatgagtcctgatgtcgcttacattatcagtgagatcctgacaatcaactacgagaacatcaaaatcaatgacaaagtggacgaatatctggagcagcaggaagtgaagaataaagtcaaatttcccaccaaacatatccctaccggttccagcgtgtctaacatactgtcatttctgtcttaccgagaaatgtttgaggaaatcgctcagcttagcaagcgctacaatattgaaatgacagtctatgtggacgatataaccttttcgtctaacgaacaatttcccaagactttcattggaaaggtaaagaagattctcatcaagaatgggcataagtacaacaaaaggaaatctaagaagctggacaagaaccacaataagaacatcactggagtgattgtcaacaagtacaagcagacaaaaatacccaataaactccaccttaagtacaaatatgccaaacgggatctgttaaaggatccttcacaactcaacaatcagaaactaaatggcattaaagaggccatgaagcaaatcgacaccgttagtaaaaagtga

SEQ ID NO: 10577 - RNA, 921 nt, unidentified
  source 1..921: mol_type = other RNA; note = synthetic construct
atgttgaaaagactgcttcatatcgaagacaacaaattcctgaaacaagactatattgcaagtatggtcacaccctatatcgacaagaaaggaaaagcccgtctcatcgagccccctcgagaggagctgaaaactatacagaagaggatcaaaatgatgctaggccagatagtggtcccttctaatgtgttctccggaatccgggggcgctcatacgccgaaaacgcagtgatgcattccagtgagaaattacggaacctcttcaagattgatctgacggcttttttcccgagcatttcgcgtgaaacagtgtaccgcttcttttatgaagacctgtgttgttcacccgatgttgccgaaacactgacaaatttgaccaccatcgatctcgagaagagccaggcccactgccttgatgagatttacagcttcctgaactacaagggggttacatgcaaaaatcacctgatcagcggggcaccaacttcccagattatgtcctaccttgtcaaccatcggatgtttgaagaaatgcagaaggtggccgatgataataatgccgtaatgaccgtgtatgtagacgacgtcactttttctaccgaggatcatatctcaagacactttaagaaccgggtgattgacattgttaggaagtatggctatcagattagtaaggcgaaggtgaaaaactacaccaagctatacccaaaactggtgacgggtgtcataatcgactcacacggtaagccaatcatcaagaattctatgagagagaagattatcaaggagtatgagctgttgagggatcaccctgagagcgcagaatctaaacaacgattaaagggcctcctcaccgctgctaggcaggttgaccaccgcgcttttcccactatatacagattcgcgttcgacaaggagtga

SEQ ID NO: 10578 - RNA, 921 nt, unidentified
  source 1..921: mol_type = other RNA; note = synthetic construct
atgctaaagcggctgttacgaatagaggatagcaaattcctgaaacaggactacgtggcatcgatggtgagcccttacatagacaaaaaaggtaagcctagacttattgaacccccacgggaagagctaaagatcatccaaaagcgtatcaaacagatgctggggcagattattgtgcctagtaatgtctttagcggaattaaaggcaggtcatacgccgacaatgcagtgatgcacaccggggaatcccgccgcaacctcttcaaaatcgacctcactgccttttttccgagtatcagcagggaaaccgtttatcacttcttctacgaagatctgtgctgtagcccagacattgctgagatactgactaactttaccacgatcgatctggacaaatcccaggcaaactgtttagacgacatctatagttttctggactctaagggcgtactttgcaaaaatcatttgatctcaggcgctcccacttcacagatcatgtcctatctcgtgaaccaccaaatgttcgatgagatgcagaaggtagccgacgagaatggagctgtcatgacagtctacgtggatgacgtgaccttctccgccgagaatcgaatttccaagaacttcagagatcggattattgccatcgtcaggaagtatggctatcagatctctaagtcaaaagtgaagaaatacacaaagctgtaccctaagttggtcacaggtgttgttatagattctgaagggaagccagttattaagaacagcatgcgtgagaagattatcaaagagcacgattacctccgggagcaccccgatgatgcaaagtctagacaaagactgaggggattgcttacggcggctcgccaggtgaataatcatgcctttcccaccatctataaattcgcgcataacaagacatga

SEQ ID NO: 10579 - RNA, 927 nt, unidentified
  source 1..927: mol_type = other RNA; note = synthetic construct
atgctcctgctacatataaaggactcccgctacattaaacaggactacatcgcagatatggtatctccttacattgacaagaaggggaagccgagattaatagaacctccctgcgaggagctgaagacgatccagaagaaaatcaagaacatgttgggacagatagtggtccctaataatgtattttccggggtaaaaggaaagtcttatgctgataatgctattatgcacgtggacaataaaaggcgcaatttgttcaaaatagacatgactgccttcttcccaagcatctctagggagactgtttatcgctttttctgcaaagatctgtgttgttcaccagatgtcgccgagattctgacaaactttacaaccatcgacctgaaaaagagccacgcacggtacctagatgagatctacgcgtttctggacagtaaacacgtcaaatgcaagaaccaccttatttccggcgctcccaccagtcaaatcatgtcatatctcgttaaccaccgaatgttcgacgaaatgcaaaaactttctgacgagaacaacgcagtgatgacagtctacgtggatgacgtgaccttcagcagcgaaaattggctgtcgggtagttttcgaaacaaaatcgtggatattgtggggaaatatggctaccagatcagcaagaacaaggttaagaagtatacaaagttgtaccccaagttagttactggtgtggtgatcgccctcaatggcaagcctactattaaaaactcaatccggatgaagattgtgctggaacatgcccaccttcgggatcatcccgaggatgccgattcccgtcagaggctcagaggactgctcaccgcagcgagacaggtcgacgctcatgcctttccaaccatttataaatatgcctacgaactggacacgaagaacaattga

SEQ ID NO: 10580 - RNA, 939 nt, unidentified
  source 1..939: mol_type = other RNA; note = synthetic construct
atgcttaaacgactcctacacattgaggatagtaagctgacaaaacaggactacatcgcctctcttataagtccttacattgacaaaacaggcaagccacggctgattgaaccccccagagaggaactgaagacagtccagaaaagactcaagaagctgctgggcgaaatagtagtgcctgacaatgttttctctggcatcaagggcaggtcttatgccgacaacgccaagatgcacattgggtccgggagacgtaatctatttaagatcgacctgacggcatttttccccagtattgaccgcgacacagtgtaccacttcttttcaaaagacttaaactgttccagtgacgtagcgcagatcctcactaatttgactaccgttgatctcgagaaggctcatattaccaataggaacgatgtgtatctgttcctgagcagcaaaaaagtctcctgccggaaccacttgatctccggagccccaacgtctcaaattatgagctacctggtcaatcatcacatgtttgatgagatgcagaccatagccgatcgcaacaacatctcaatgacagtctatgttgatgatgtgactttctcaagcgagggtagaatatcccatgattttaccgagcagatctacgcaattatcaagaaatatcgttaccaggtgagccggagcaaggtgaggaagtatactaagttatacccgaagcttgttaccggagtcgtgatcgacgctgatggtaaagcagtgattaaaaatgctatgcgactcaagatcatcaatgaatataaccacttgctccaaaacccaaacgaccctatctgtcggcaacgcttgagggggcttctgactgcagcgcgccaagtggatcagcatgctttccccaccatatacaaatatgcctttgaaggatcgctgaaatgccagcagaattga

SEQ ID NO: 10581 - RNA, 930 nt, unidentified
  source 1..930: mol_type = other RNA; note = synthetic construct
atgctcaagcgacttttgcatatcgaggattcgaaatttactaaacaggactacatcgcagccttagtgtccccctatatcgacaagaccggaaagccaagactgatcgagccaccacataaagatctgaagacaatacaaaagcggctgaaaaatctcctcggaaccatcgtggtcccaaataatgtgttcagtggcattaagggccgctcatatgccgacaacgctaagatgcatgccggaagtcactcaagaaatctgttcaaaattgacctgactgcattcttcccctctattagtagggaaaccgtttacaacttcttttaccatgacatgacttgcagcagcgatgtcgctgagattctgactaacctaacaacaatcgacttggagaaggctaggattcatgagcgaaatgaagtactgctttttcttgagtctaaaaaggtgtcttgccataaccacctgataagcggtgcacctacatcacaaatcatgagctatctggtcaatcaccacatgtttgacgaaatgcagattgtagccgacaacaatcacgctataatgaccgtttacgtggatgatgtgacatttagttctgagtatcggctctcccacaagtttaaggaacagattcttagcatcgtcagaaaatacgggtatcagatctcaagacctaaggtgaagtactacacgaaactgtatccgaaactggtgacgggtgtcgttatcgatagcagcggctcccctatcattaagaacgcgatgagggaaaagataattaacgagcacaggcacctccgcgaattccctgacgacaaatcctctcggcagcgcctatgtgggttgttaaccgcagcccgtcaggtggatccccacacctttcccactatctacaaattcgccttctcctccccggatcatgagtga

SEQ ID NO: 10582 - RNA, 981 nt, unidentified
  source 1..981: mol_type = other RNA; note = synthetic construct
atgccgctcatatacactgattgccccctttacggacttaagtccaaaaaacttctgaagagactgttacgtatcaataacaatcagatgatgaggcaaactcatattgctagcctggtgtcgccatatatagacaagagtggcaagcccaggctcattgaaccacctcacgaggagttaaaaataatccagaagcggattaagaactgcctggggagaattactgtacctgataacgtattttctggcatcaaaggcaggtcatacgcagacaacgccagattccacgttggtaataatagacggaatctgtacaaaatcgacctgacagccttctttccctccattacccgagacacagtttataggttctttgctgaggacctgttgtgtagtcctgacgtcgcgcagctgctgaccgacctgacgacaattgatctcgaaacatccaatacgaaaaacatcgatgagattcggttgtttctcaaagagaagggagtttccacctataaccatctaatatcaggagcccccacatcacagatccttagttacttagtcaaccaccaaatgttcgacgagatgcagaaaatcgccgatgataacaatattaccatgaccgtctatgtggatgatgtcaccttcagctctgaaaaccgcatctctaaagactttcgtgataagataatcgcaatcatccggaagtacaattaccagatcagcaagaagaaggtgaagcgatataccaaactctatccaaagctggtgaccggggtgattatcgatgcaactgggaagatcgtgctgaaaaacagcatgcgccaaaagatcatcattgcgtataatgaactcaaaaacgaccctgacaacgcagatatacgcatgaggttgaaaggtttgctaattgccgctcgccaggtgaataaagacgccttcccaactatttacaagttcgcttttcagacagaagagaataagtga

SEQ ID NO: 10583 - RNA, 930 nt, unidentified
  source 1..930: mol_type = other RNA; note = synthetic construct
atgctgaagtacgtcctccacattaaaaatggcgaccttctgaaacaggactatgtcgtaagcatgattggcccttacatagacaagaccaagaagccccggcttatcgagccaccccaagccgagctcaaaactgtgcaaaagcgcatgaaaactctactggggaaaattcaggtccccgataatgtgttctcagggatcaagggacgctcttactcggataatgcctgcttgcatctgggcaaatccaaaaggaacctgtacaagatcgacctgacagccttttttccctccatcagccgcgagactgtctattgtttcttttttgaggatctgtgctgttccccggatgtggccgaaatacttaccaatctcaccacggtggacctgaagaaactaaaccagtctagtctgctcgaagtgtacgacttcctggctaataagggggtgaagtgctataaccatttgatcagcggcgccccaacgtcccaaatcctgtcatatcttgtgaaccacaagatgtttgacgaacttcagtctctcagtgacaagagcaacgtaacaatgacaatttacgtggatgatgtcgtgttttcgagcgaacacaagatttctagcgagttcagacagagtgtattgtctctgatcaaaaagtacaactaccaggtcagtaggaagaaagttaaaggctattccaagacataccctaagttggtgactggtgtgatcattaattcagaaggaagagctaccatcaaaaatgctctgagaaagaagataatggttgagtatgagcatttacggaacaatccagacgacataaaaagccgacagcgtctcaggggattagttaccgcagcacgacaggttgataagtcagcttatcctaacattcggaaattcgcattcgataaccctgcgaaatcctga

SEQ ID NO: 10584 - RNA, 927 nt, unidentified
  source 1..927: mol_type = other RNA; note = synthetic construct
atgctgaaatacgtccttcagatcaagaatgacgatatgctaaagcagtctaacatcacgagtaagattcacccttatatcgataagaccaagaaaccccgactgattgaggccccacaggccgagctcaagattgtgcagcgaaggattaaaaccttgctgggtaaaattcaaacaccggataatgtctttagcgggattaaagggaaatcctaccccgagaacgccagaatgcatatcgggggcagaaaacgtaatctgtataagactgatcttacagcatttttccctagtatcagcagagaggacgtttatcaattcttcaacaatgagctctgttgttcacctgatgtttccgaagtactcacgaatttgactaccgtgagcttagagcgcttccccaaagaagaactgacagaagtttatgatttcctaggacagaaaggagtgcactgctataatcacttgatcagtggcgcgccaactagtcagatcctgtcatacctggtgaaccacaagatgtttgacgaattacacacactgtctgcaaagaatgacatggtaatgaccgtttatgtggatgacatggtcttttcgtccgaacataagatatcttcccattttcggaactccgtgaagtccatcatcaaaaagtaccgctacaagctctcacacaacaaggtgaagggctacagcaaaggatacccaaaactggtcactggcgtcgtgatcgactgcaatgagaatatgatagtgaagaacagcctccagcataaaattatccttgagttcgaacatctgcggaaaaaccccatggaccaagagagccggcagaggctgaggggtcttgtgacctcagctcaacagatagacaagtctatattcccaaacattaagcgctttgctttcgagaacccttctaagtga

SEQ ID NO: 10585 - RNA, 924 nt, unidentified
  source 1..924: mol_type = other RNA; note = synthetic construct
atgctgtgtcacatgcttaacatcagagatacaaatctccttaaacaggattatgtgtccaaactggtagagccctatatagataaaaccgggaagccacgcctgattgaaccgcctcgggcggagttgaagctgattcagaagagaattaagaacatgttggggatgattgaagttcctgaaaacgtctttagtggaatcaaaggaaggtcctatgcggataatgcctcttttcatatcggggacagccccagatacttatttaagatcgaccttaccgctttctttccctcaatctctcgagacaaggtttacgctttcttcctgagcgacatgcactgctcgcctgatgtagccgccatcctgactaactacacgactatcgacctctcccgggcagccattcaggataggcaatccatctatacattcctgagtgagaaaaacgtgagttgctataaccacctcattagcggtgcccccacctcccagatactgtcatacttggtcaactaccacatgttcgatgagatccaaatgctagcagacaagcattcagtttctatgacaatatatgtcgatgacctcactttcagttgtgaacatcgtatcccgcgacatttcaaagagaatgtgctttcagtcattacaaaatacggctacgtgattagcgccggcaagaccaagagctacactaagaggtatccaaaactcgtgacgggcgtgatcatagactctaatggacagctcgctctgaagaatagcctgcagttaaagatctctctggagcacgcccatctgcgcgaccaccctgaagataccaagtcccgccagagattgcggggtctaataaccgctgcaaggcaagtgaaaaaagacgcatttccaacaattcaccagttcgcttttcaggccaatccatga

SEQ ID NO: 10586 - RNA, 975 nt, unidentified
  source 1..975: mol_type = other RNA; note = synthetic construct
atgaagtatgacaattgccccctctatgaactgaagagtaagaaaatcctaaagtacttgctgggcataaaaaactccaatctgctgaaccaacagtatgtagcatcgctcgtgactccttacattgacaccacgaggaaaccaagactcatcgaaccccctcactctgagctgaaagccatccagaagaaaatcaagaccttactgggtaaaattgaagtgcccaacaacgtgttttccggaattaaaggaagatcctatattgacaatgctctgatccacaaaggcaacggacttcgtcacttgtttaagattgatctcacgaccttcttcccgtccatttctcgagaaacagtttacgggttcttctacaaagatctcaggtgcgctcctgatgtggcacagatactggcgaatctgaccaccatcgacttaattaagtctaatagtcgggacatcgagacaatctatcaatttctggagatgaagaaggtgcgttgtcggaatcaccttatttccggggctccaactagtcagatcctgtcataccttgtcaaccatcgcatgttcgatgagatgcaggctttggccgacaaaaaccgcgttacaatgagcatctacgtggatgacgttactttttcatcagactaccggattccacagaggttcaaaaatctagtcttcactattgtacgaaagtacaactaccagatatcaggcattaaggtcaagagctacagcaagctttatccaaagttagtgacaggtgtcatcatcgatacaactggggatctcaccataaaaaatagcctgcgcaagaagatcattgatgagcatcgaaacctcagaaatgaccctggcaacagagagtctcgccagcggctgagaggcttgatcaccgccgccaggcaaatcgacaagagcgcatatcccaacatacatcggtttgccttcgaaaaatttacaataaggtga

SEQ ID NO: 10587 - RNA, 966 nt, unidentified
  source 1..966: mol_type = other RNA; note = synthetic construct
atgaattacaactattgccccttgtatggtcttaagtcaaagaaacgactgaagtaccttctgaagattaagaatagcaaaatgctcagccaggctcacattgccaaacatgtagagccctatattgatatccaaggtcgccctaggcttatcgaaccaccatccgtcgaactgaaagcaattcagaaacgaataaagaacctcctgtcgaagataattgttccggataacgtgttttccggcattaagggccggtcttatgttgataacgcaagaatgcatagtaatgggctccggtatctcttcaaagtcgacctgaccgcttttttcccctctattacaagggaaactgtctacaccttttttcgcgaggacttgcactgtagcagcgacgtggccgaggccctgactaacctaactacaatcgatatccagaaatccaaagctaagaacattaatgagatctattgcttcctggacgccaaacaggtgaatgttatcaatcacctgatcagtggagcaccaacatctcaaatcttatcataccttgtgaaccacaagatgttcgacgagctccagctattgtctgacaaaaacaagattacgatgagcgtgtacgtagacgatattaccttttccagtgaattcaggataagccatatgtttagagagaaagtgtaccagataatcaagaagtacaactacaagatctcaaagaagaaagtgaaagggtattccaagctgtatcctaagctcatcacaggcgtcatcatcgatgccaatgggaatctggtgatcaaaaacaccctgcggcgcaagataattctggagtttagaaagctgatggaggaccccgctgacgatgaatcaaggcagagattgcggggattagcaaccgccgcccgtcagattaataaagcggcgtaccctttcatctacaaattcgctttcgataacaagcaatga

SEQ ID NO: 10588 - RNA, 972 nt, unidentified
  source 1..972: mol_type = other RNA; note = synthetic construct
atgatatacacaaactgcaagttatacaagctgaattctaagaaagtgctgaaatacctccttgcagtatctgacaacaacttcttcgaacagaagtacgttgctagtcagattgagccctacatcgataccctcaaaaaaccaaggctgattgaaaaaccttccgaacaactgaaagccattcaatccaagattaagggattgctgtatgctattcaagtccctgataacgtcttttccggtatcaaagggagaagttattctcagaacgcacagtggcacaagggaaccaagcatgtgtataagattgatctgacagcgttctttccaagcattactcgtgaaaaggtctacagcttctttaaagatgacctggagactagttcagatgtcgcagagatcatcactaacatcaccactgtggatattgacttgacgaatctccagaacgtggagcaggttaatgagtttttaatcagcaagaacgtcaaaaccagaaaccacttgatctccggggctcccacatctcagattctaagctatatggccaatcacaagatgtttgacgaaatccaaagtctggccaatcataacggcattgttatgaccatctacgtggacgacataacattctcctcagagaactacatcagcaataagtttaagaacaaggtgcagtccatcattaagaagtatggatatcagataagcgctcgcaaagtgaagtcatatagcaaatgctatcctaaactagttaccggtgcgataatagacaaaaacggctgtctgactgtaaagaattcacttcggtacaagatcatgtctacgctcaatgagctgaaggaaaacccgaataataagacagcccgcaggaaactccggggccttgtgatcgctgcccgacagatcgagcccaatgcctacccatcggtgcataaactggcattcgacaaaaaatacaaggtgaattga

SEQ ID NO: 10589 - RNA, 951 nt, unidentified
  source 1..951: mol_type = other RNA; note = synthetic construct
atgtaccagctgaagtgcaagaaggtgttgaaatatctcttgaagataagtgacaacagcgtatttaaccagtggtatgtggcctctttgatcgagccctatattgatatttctagagggaaacctagactgattgaaccacccagtcttatgcttaaatctatgcagacacgactcaaaaatatgctggggactattgacgtccctatcaatgtgttctctggtatcaaaggacgttcctacgcacagaatgcccagtggcacaagggtaacaagtttgtttataagattgacctgacggcctttttcccgagcatctcaagggaacgagtctattcctttttcaaggagaaactccgcacaagccctgacatcgctgaattcctaaccaacataacaaccgtgaacttagacttgagcaatattaaatccatggaggagatcaacatctttctggagtcgaagaacattaccaccaggaatcatttaatcagtggagcgccaacatcgcaaatcctaagctatctggcaaaccaggatatgtttaacgagatacagaaactgagtgatcacaacaacattacgatgactatatacgtggatgatctgaccttctcttctaccgaccatatctccaataacttcaagcaggaaattttctccgtgatccggaagtatggctaccacatttcaaataagaaagtcaagggctactcaaaattctaccccaaactgatcacaggggtaatcatctccaaggacggcaatatagctgttaagaattcacttagactcaagaccatcaatgagctcaatactcttaaacaagcccctcaaaacaccactagcaggaaacgcctgcggggactggttacagccactcggcaagtcgaacccaatgcatacccaagcattcatcagttcgcttttgataagaaatacaaggtgtga

SEQ ID NO: 10590 - RNA, 975 nt, unidentified
  source 1..975: mol_type = other RNA; note = synthetic construct
atgatcaacccaatccatagtaatctgtacaaacttaccagtaagaagtacttacttagtcttctccacatccataataggcagtttttgaagcagtcttacgtgtccaagcagattagcccgtatatacagaccgatccaaaacccagactaattgaagtaccttcggaagagctgaagactatccaacgtcatataaagaacgagctcaacaagattatcgtgccagcgaatatcttctccggaattaagggaaagagctatattggtaatgcaaagctgcattccgggaataagtatgtcttcaaaatcgatctctgcgcattttttccctgcattacaaggaacacagtctacaatttctttatagagtcccttaagactagccccgatatagccaacatactgaccaatctgctgactgtggatttaagcaaatgtagcatagagaatgttgagagtgtgaacgctttcctgatctctaaaaaaatcaagacccctaaccacctgattagcggctcaccggcatctcaaatcttgagctatctcgtgaatcacaaaatgtttgactcactacagaacttttgtgacaagaataacatcacaatgtcagtttacgttgacgacgtgacgttctcttcccaacacattattagtcacacacagaaacaggtgatctacaagattatctccaagaacttataccgactgtccagaaacaaggtaaagtactatacgaagaagtatcctaaactgatcaccggcgtcgtcatctcatcgaatgggaatctgaaaatcaaaaattccttgtctctcaacgtgattagcgaatggaaatatttctctcagaacccaaaaaacctccagtctaaagcccggttgcagggcctgctgattgctgcccgccaaagcgaacccgccaaattccagaatatctacaacctcattcgggaggcttcaatccctttctcatga

SEQ ID NO: 10591 - RNA, 975 nt, unidentified
  source 1..975: mol_type = other RNA; note = synthetic construct
atgataaaccctattaactccaatctgtacaagcaaaccagcaaaaagtatctcctaaatctgctgcacattcacgacaaacgtttccttcagcagaggtatgtatctaaacacatctccccctatatccagactaaccctaaacctcgcttgatagaggtgccatcagaagagctgaagatcatccagcgccatatcaagaatgagctcaataagatcatcgtcccagaaaatattttcagcggcgtcaagggtaagtcctacattgaaaacgccaagttgcatagtgggaataagtatgtgttcaagatcgacctcagctctttttttccgtgcatctctaggaacactgtgtataacttctttactgagtcgttgaaaacaagtcccgacattgcgtgtatcctgaccaatctcttaaccgtggatctcagcaaatgtaatattgaagacgctgacagtgtaaacgagttcctgatctccaaaaagattaagacgtccaatcatctgatctctgggagcccagcttctcagatactgagctatcttgtcaatcacaagatgtttgatacactgcaagagttctgcgataagaactcactgattatgtccgtgtatgttgacgatatcacattttcaagccagcacgttatttcacatagtcagaaggaggtcatttacaaggtgattagcaaaaacctatacagacttagtcggaacaaagtgaaatactacaccaagaattaccccaaactgatcacaggagctatcatttcaagcaacggaaatcttaagatccggaactcgttatcactcaacatcatcaaagagtggaaacatttcaaatacaaccagcaggatgcccaatccaaagcccgattgcaaggcctgataatagcagcacaccagagtgaacccaataagttccagtccatttacaagatagttagagacgcctcttttgatgtgtcttga

SEQ ID NO: 10592 - RNA, 972 nt, unidentified
  source 1..972: mol_type = other RNA; note = synthetic construct
atgattgatccagtgaagtccaatctgtttaagctaagctccaaaaagtacctcatgacccttttaaacgttcctacaaaagagtatctgaatcagaacttcactgcaaaacaaatcaaaccttacatacaggccaatcccaaacctaggctcattgaggtgccctctgattccctcaaaaagatccagaagaatatcaagtgcgagttgaataagattgaggtaccgtcaaatgtgttttcaggtatcaaaggcaaaagctatgttgacaatgctgtaattcatcagaactgcaacttcttattcaaaatcgacctcaccgcgtttttcccatgcattacccgagaaacagtgtacaagttttttaaggttgacctgaaaacatcgtcggatattgcaaacatcttgaccaatttcgtcactatagacctcactctttgtgacatacaggaacctgaaccgattgaacagttcttgctgagtaaggggattaaaacaacaaaccacctgatatctggcagtcccgccagccagatcctttcctatctggcaaatcataacatgtttgacgagctgcagaacttctgtgataagaatgacatcatcatgagtatctacgtcgatgacatcactttttcaagccagcacgagatttctcacaaacacaaggagatcatctacaacatcatattcaagtacctgtatcgcctgagcagatctaaggtgaagtattatacctcaatctaccccaagtccgtgaccggggctatcattagccccaatggaaacctgtccattccaaacagtctatcttacaaggtcattaacgagttgcggaattacaaaaacaaccctaatgatgaacactctcaaaagaggcttcaaggactgatcgtggtggctcagcaaacggaaccaactaagttcagcaacatttataaccatgtccgtaatgccacgataaaagcctga

SEQ ID NO: 10593 - RNA, 963 nt, unidentified
  source 1..963: mol_type = other RNA; note = synthetic construct
atgatcaatgccacaaactctaagctatacaatctgcaatccaagaagaaccttatctaccttctgaaaatccacgataaggacttttttaatcaggattatgtggctgcccatatacatccctatatcgataaacggggaaaacctaggcttatcgagagtccatctttgcagttgaaaaagatccagaggaatctgaagaatgagctcgctaagatcgaagtgccatataacgtgttctctggcattaaaggaaaatcctacgtggagaacgctgaaatgcaccgtaagtccaactacatttttaagatcgacttaacggccttttttccatgtattccccgggaatccgtctatacattctttcgcaagcagttaaagactagtcctgatatcgcccaaattctgaccaacttgacaaccgttgacctcactagatgcaatatcaaaaaactggaaagcattgagaagttcattctggacaagcacatagtgaccacaaatcacctcatcagtggcagtcctacctcacaggccctgagctatcttgtaaatactaaaatgttcgacgagctgcaatacctgtgcgacaaaaataaggtgattatgagcatttacgtcgacgatataaccttcagcagcaatcacaaaatctcacataagttcaaagagattgtctacactatcatttctaagtacatgttcaagctgtcacataacaagatcaagtactataccaaagactatccaaagctggttacggggcccgtaatctctaacgggaaactcataatccgaaattcactccgcttcaagataattagcgaatttaagagcctcaaaaagaaccctaacaaggcgtcgtatgatagactgaaaggtctaattgttgcagcaaaacagatcgatttgaaccagtacccgaacatatccaagtacattaaagagaaccccatccactga

SEQ ID NO: 10594 - RNA, 909 nt, unidentified
  source 1..909: mol_type = other RNA; note = synthetic construct
atgctgcggcacttcctccaggtgcaaagcaatcagctgttcaatcagaccttcatccttgacaaaatccatccttatatcgacactgtgggtaaaagtagactgatagaagtccccgacaaggccctgcgcacgatccagaagaaaatcaaaaacatgctcggaaagttagtgttacctgattacgttttctctggtgtgaagggaaagtcatatgtggataatgcgacacaccactctgggactaaattcacatacaaggtggatgtgactgcattttttccatcaatcagtagggagaaagtctatctgttttttagggagaagttgaagaccagtcccgatgtggccgaggcactcaccaacctgacaacagttgacttgcatcttattgagaacattcaggaagtacacgagttccttaaacgtaagaacatcaagacttggaaccatttgatttcgggcgccccaaccagccctatactctcatacctcgttaattctgacatgtttgacgctctgtattcactgagcaaggaaaatgagattgtgatgaccgtttacattgacgacatcgtcttcagttcctcctaccggatctcttacaaaattagaaccaagatcttgagcattatcaagcaatacggcttacaggtcaacaagaaaaaactaaagctgtatacccggaaataccccaagaagataacaggcgtcataatcgataaaaatggaaactccgaagtgccaaattccctgcgcaaaaagattattacagagctgcacactctgaaatccaatccgaataacctctcctctagacagaggcttcaggggctagtaaccagcgctcgacagattaacaaggaaacgtttcaaaacatctgcagctatgcctataaaaaggattga

SEQ ID NO: 10595 - RNA, 960 nt, unidentified
  source 1..960: mol_type = other RNA; note = synthetic construct
atggaaatacagaaaagccctttatacaagctatctaacaagaactaccttaagtacctcttaaaaatccccgacaaaaagttcttcaagcaatcctatatcacacagcttataacaccatacatagataacaagaacggcaaaaaacgattaatagaagttcctgacctcgagctgaaaaagattcaatctagactgaagaacatcctgtccttgctgcagatgcccaattatgtgtttagcggagtcaaagggcgctcctattacgataatgcatatctccacaaaggaaataagtatgtgtgcaagatcgatttggagtctttttttccgaacatttcacgggaaaaggtctatctcttctttctgacctactttaaatgttcctcagatatcgcgtacattctaacgaatctgactaccgtagatcttactcgtacaaagatcaagaacaataagaagctggagaagtttctggagtacaaaaatatcttctgcaaaaaccacctcatttccggcagtccagccagtcagttgctgtcttatctggtcaataaggacatgttcgacgaaatctataacttggccaacaagaattctataaacgtgagcatctatgttgacgacattatctttagcagcttcaacaagattagttacgacttcatcaaacagatcaaacgcatcatcaataagtacaactacaatatctcgaactcaaagttcaaaaggtatcttaatgggtatcccaaaaggattaccggtgtgatcatagacaaaaatggccagctgagcatccccaattcgcttaggctcaagattattaaggaattcgagtacctgaaatcccatcctaacgatagtaagagcaaaattagattgcggggtctgattctctcatctagacagattgagccaaatgctttcgtgggaatttacaagtacctgaaaaagttttga

SEQ ID NO: 10596 - RNA, 954 nt, unidentified
  source 1..954: mol_type = other RNA; note = synthetic construct
atgaataagaagtgcccactgcacggactgaagagcaaggcgcagttgtactccatgctcggagtgaatgataaaaagctgtttaggaatggtatccaggataaggtgaaaatatacattgcaaaggaccctaaagagagactcatcgaggctccagattacatcacaaaaaaagcccaaaagcaggtgaaaaactacttgatgaagtgtgatttcccaccctacgtcttttctgggatcaaaggcaaatcctattttaataacgcagagatgcatctgtcgagcaagtatatgtataagaccgacataagcaaattctttccgaatatctcacgagacaaggtgtatctatttttcctgaacgacctcaatacgtctcctgacgtcgcaaacatattgacaaacatctgtaccatcaacataagcgattccattgagactaatcctcaagtagctgaattcgtgagcaagaataagatcaggatgtttaatcatctgtgcaccggttcaccagccagtcccctgctgagctatctcgtaaatcggaagatgttcgatgaactcaacaatattgctgagaacaatggaatgtcctttagtgtttatatcgatgacgttttcttcggctcaaaaaaaccgattccctacggcgtgagacagcagattcttaaaacactgactaaacacggctacaacatcagtttcaagaaagttatctactacaaggacaaggaaaacaaaaaagtcaccggggtcattattagccccaacaacaagctagagattcctaacaagttaaagcttaagatcgtgtctgggttttctaaaggcaacttaaaggattcacgtgccaagattaatggaatgcttatagcctcctctattatcgacaaaaatagtttcaacgggatccgcgagtatatgaagcagctggaaaaagactccgaggaatga

SEQ ID NO: 10597 - RNA, 948 nt, unidentified
  source 1..948: mol_type = other RNA; note = synthetic construct
atgcataaacattgcctcctgcacggtttaaagagtaagaagcaattgatcagcatgctggatattacagataacaaagttatgaagggcaaagcccaggacaaaatcaaaatttatatcgctaccgaaccaaagaaaagattgatagaagccccagaatataagattaagaaggtgcagaacaagatcaagaactatctcctaaagtgtgacttacccagctacgtattcagtggaattaaggggaaatcctacttttgcaatgccgccttgcatagagactgtaagttcctgtacaagaccgatatatctgcattttttccttccataagcaggaatactgcttacaagtttttcaagaacgatctcgagacaagctccgacgtggccaaaattcttacggacatttgtactgtcgatattcgcgatacccttgagaaagactcctctgtggcgggattcgtgaaggacaaaaagatcaagatgtataaccacctttgcactggctcccctgccagtcccatcctgtcctatctggttaataaggcaatgttcgacgagatgtacgctatcgcggagaacaacaatctgaagttctcaatctatatggacgatgtattctttagctctagtaaatcgatctctaacaatgtgcgggagcacattctccgcattctcacaaagtatggctacaatgtctcatttaagaaagtcatctactacacatcacagcagaataaaaaagttaccggggtgattataaccccccaaaataagctttctatcccgaataaactgcgtcgaaagataattgcatctttttccaaaggcaacctgaagaccggtgaacagaacctgcgggggatgctggtggctagcaacatcatcgagaaaaattcattcagcggaatcaaaaggtacctaaacgaactgagcaaaatccagtga

SEQ ID NO: 10598 - RNA, 954 nt, unidentified
  source 1..954: mol_type = other RNA; note = synthetic construct
atgtacaaatcttgccctctgtacgccctgcaaagcaagaaaatgcttatgaaggtgctgggcatacaggataaaaagtggaccaagaatatctacgtccagcagaatatttcccctttcatcgattgtatggtgaagcccaggttagtggaggccccaaagcaggagttgaaagtgatccaaaaacggattaagaacggactgatgaaatgcaggttccccaactatattttttccggagtgaaagggaaaagctatattgacaatgccaaaatgcatgcaggcataaagtacctttacaagatcgatattagcgctttttttccgaatacatcacgagagaaagtctacatgttctttaagaacgagctgaagacttcaagtgatgtggctgagatcgtcaccaatctgtgtacctatgatatctccattgacctagtagaaaagaaagagattgacacattcattcgcatgaaaaagataaagcacatcaaccacctctgtacaggagccagccctagtccattactgagttatctcgttaacaaatcgatgttcgacgaaatgtactctctctgcctgaaatacaatgtgaacatgtcagtatatgtggatgacgttgtgttcagctgtgacaagcccatacagccagaatttcggggtagaatattgaagattgttctgaagaacgggtataacatctccaagaataaggtgaaatactatgggtcttccgacgtcaaaaaagtaaccggcgtgatcattaaacctgatggcacgcttgacgttcccaataaactcaagttcaaggtcactaagagatttaaggacactcaaaaaggttcagaactaaacaagttgtacggctgcgtcatcgcggcaaagcagatcaaaaagaatatctatccaagcatctctgagtacatcatgaaccagaagaaaaaggaaaagtga

SEQ ID NO: 10599 - RNA, 1023 nt, unidentified
  source 1..1023: mol_type = other RNA; note = synthetic construct
atgcagtcatgggataagcataaccagtttaagtataatgaggtgtatcctcttgagtatagaaagtgttacttgtatggactcaaaagcaaaaagaagctcctggagcttctgcacattgacaggaagatatactgcaaaagctcgtttctgaattgtaaaatcaagccctacatcgaaattaacaagaacaagaagaagcggcttattgaagcaccagatgaggacgtgaaaaatatccagtccattatcctgagggctctgcagttgattgacgtcccaaattacgcttttagtgggatcaaaggtaagtgctatattgacaatgcgaaagcacacagcgataagaaatacctgttcaagatcgacatcagcaaatttttcccaaatattggccgcaataaaatctacaacttctacctgaacaagctcaaaacatctcccgacgttgccaacatactaaccaacctgtctactattaatctggatctgaagaaccagaacaataagaccatgttgaagattaatgagttcatcaacgatgcccatataaaagaaagaaaccatctcatcacggggagtccgctatcctcaatcatgagctatttcgctaatgtggacatgtttgagaaaattaacgaaatagccctgaagtataacattacaatgactgtctatgtggatgatgtagtattctcctccgacaataaaattccctacttcttccgcaaaaacgtgctgaacattatcaaccaaaattcttacgacgtttccgtcaaaaaatgcaagtggtataataaacctgagaataagaaggtgaccggtgtgatactcgataaaaaaggaaagatgcagatccctaacaaattaatgcttaagacccacaactacataaatgagatcaataaaggcgacaagacaaacatcgataagttacaggggtgtctcgttgtcgccaactcaatcaatggcaagtttaaagaataccgaggacaattgaagaagatgaagcgtaagttttga

SEQ ID NO: 10600 - RNA, 987 nt, unidentified
  source 1..987: mol_type = other RNA; note = synthetic construct
atgacctataaactttgccggctgtatggccttaaaagcaaaaaaacactgcgcgagtggctggaaatcgacgattctagctttttccactctaaaaacattgctaagaactaccacccctacatagacaataaagctaacaagaagaggttaatcgaggtcagtagccctaaactgaaatttgtccaaaccaagattctgggaatgctgaagaatctggactatccggaatacctattctcatctgtaaagggagtttccttcattgataatgcaaagcagcactccggtaagtattacactttcaagatcgacattagcaaatttttccccaacacctctagaaacaaggtgtacaatttcttcaagaaagacctgaacaccagttctgatgtggcgaccattctcacagattgcacaactgtggacctgaggaattacaattcggacaaacatcacaacgagatcgtcaactttctggaggaatacaaaataaagcaaatcgcccacttgagtactggggcccccacatccatgctcctatcgtttctggccaatcgtccaatgttcgaggagctcaattcattttgtgaacagagaggctatatctttaccgtctatgccgatgatgttactatgtcctccataaatcctattagttactctgatcgatccgcaatcattcggatagctgagaaatacggacatttcgtttcaaaaagaaaggtgaagtactataacgccaatcagagcaagaagataacaggggtggtaattaataaaaacggcgaaatctgtacgccaaacaagttactcaacaagacgcacaacaaaattcttaagtacaagtccaagaacatcgacgagcatgaaatcaatagcttgaagggttgcatcaatgtggcatatcagatcgacaaacgctatcctcatctcaggaaggtgttgaacaaaaattcaaattacagcaaggagaagaacgggtga

SEQ ID NO: 10601 - RNA, 972 nt, unidentified
  source 1..972: mol_type = other RNA; note = synthetic construct
atgacatataagctgtgtagattatacggattgaagtcaaagaaaaccctgagggaatggctggggatcaatgacagcggcttcttttgtagccagaatatagcgaaaaattaccacccgtatattgggagtaaagacaataagataaggctgattgaggattcatcttttaagctgaagcacgtgcagaagaaaattctgaaaatgctcaagaagctggattatccaaagtacctgttttccggggtgaaaggcctgagctatatcgataacgctaaacaacacctcggaaaattctatacctacaagatcgatgtaagcaaattctttcctaacaccagtcggaacaaggtgtactcattctttaaggacttccttaatacttctcccgatgttgcaaagatcctgacagactgcactactgtagacctgcggaattattctaactccaagcactacaacaaaattatgcgattcgttgccatagccggcatcagacagattgcccatctttccacaggcgcatccacgagtatgctactttccttttgcgtgaatcagagcatgttcgaggaactaaacgagttttgcaagcaacgggactatatctttaccgtctatgtggacgatgttactatctcttccacaaaacccatcacgtacaaagatcgcctcaaaatcatccgtatcgtcgaaaagtacggtcatagtattagcaggaacaaaatcaagtactacaccttgtctaagactaagaagatcacaggtgtggtcataaacaagaacggagaggcccgcacccctaacaaattactctcgaaaacccattgtaaaatcctcaagttcaagagaggtaatattggcgacgctgagattaactcattaaagggatgcattaatgtggcttaccagatagatgggaaattcattcaccttaagaagttgttgaacctcaaagacaatctgaaatga

SEQ ID NO: 10602 - RNA, 915 nt, unidentified
  source 1..915: mol_type = other RNA; note = synthetic construct
atggatctgaccacatgcaaactgtacggtgtgcaaagaaaacgggatttatccaatatcctgaagatcaactgcaaggaaatcaataagattgtgaactcctacaaaccgtacatagcgaataagtcgaagaaaagacttatcgagcccgtgagctcagtagagctgaaaaaagtgcagaaacggatacagaatcttttgaaggagataaagtacgactctaatgtcttctcaggcatttctgggcgaagctatattgacaacggaaggctgcatctcgggtgtgaatatgttgtggctcttgatatttccaaattctttccaaacacctcccgagaaaaagtctacaagttcttcaagcacgatatgaaaaatagtagcgatatcgctgaaatcttaactaatctctgtacaatcgacttgtctaacatcgccgacatagacgaggaggttatcaagtatatctccgagaataggatcaggtacaaaaagcacatacctactggtagtagcatcagttgtattctgtcttacctggtgaattacaaaatgtttgacgagatcgtcaagttgggcgttgaataccggtgcaagaccagtatttatgtggatgatgtcgtcataagctcaaccgagaaaattaataaacagctgattgaccgtatcatgggaattattaaaagccgcggctattctatacagaaaactaagctcaagttctacgacaaaaatgagtttaagagagtgacgggaaacatcatttccaaggacggcacaaagctggtgattcccaacaaaatccgctataagatgatcaagctaaagaagaacaaggaaattcagaaggataaaaaggaagccaagctcaacgggtataaccaagtaattaaccagatcaacatggaggcattttga

SEQ ID NO: 10603 - RNA, 963 nt, unidentified
  source 1..963: mol_type = other RNA; note = synthetic construct
atgaacttcaagaactgcgaattgtataagatcaaacgaaaacgggacctgttcattttactgcatatagacgagaataagctcaatgaggagctgtataaatataaggtctgcatcaaagacaagaagagactgctggaaaagccttccgaagaactcaaaaagattcaacgaaacatactgtacaagctttaccagcttgattttccacagtacgttttttctggcatcaaaggtcggtctgcatttgggaatgccatttaccatatcaattgtaagtacatgctgaaactcgatatgtcaaaattctttcccaatactcacagaaacaacatttacgagttcttcaaggataaactcaagatgagcagtgacgtgagtagcatatgcacagatatagtgacagttaactacgagaaagaggatgttgaaatcgattacgaggtgtatgacttcttaaagaggaaaaagatcaagaacacgaatcatttgccctccggaacccctacgagccaaattctgtcttatctagcgaatatcgatatgttcgacaagattatagagtacaccaagaagcacaaactgcagtgttctatttatgtagatgacatcaccatctcatcctcaaacagatacatcactaaaaaagaggagagcgaaattaaacgcatcattaaaaagcacaagcacaatctgtcgaaagagaaaaccattcgttatagcgtgaacgaatttaaaaaggtgactgggtttgtcattgacccaaacaatcgccttgtgattcccaacaaaatcaagagtaagatcaaaaaccagacaaagttcattaggaagaaggaactcgacgagcagcggaaaaactcaatcataggcctaaccaactttgctaatatcagcgtcgaaggaagttataagggcctgagggccacattgaagaatatctccacctccaatactgtatga

SEQ ID NO: 10604 - RNA, 918 nt, unidentified
  source 1..918: mol_type = other RNA; note = synthetic construct
atgaacaagtataaatgcaccctgtttaattgcaaatccatcaaaaaactccagaaatacctgttcatccagaacaagaacaactttaagaagatttccaacgagttgaaaaacaatccccttaacttctacgtgtcctttaagaataacacagggcgagagctgttctcatgtaatgagcagatcaaaaagatccacaaaagattgcagaaactcttcaacgtggaaaaaagcgactacctgaaaagtggagtcaaaaaagaatctcatatcaccaatgtgaagttccataagaacagcaatttctttctactgctggacattaagaatttttacccgtctataacgaagcaaaagatcaaaaaacagctgatcactacatacaatcaatctagtgatgtagccgagattattagcaatatggtgaccgtcccacaagaaaaggcgttaggcaagcgcgccctggtgacaggctcagtgctaagccagttcttcgcatacatgataaacaagaagatgtttgacgagcttgataagatctccaaagaagagaatattcggttcagcctgtatgttgatgacctcacttttagcagtaacgttcctgtttcctatttgttttataccaaggtgtacaacatcattcggaaaaacgggtacattattcactcaggtaagatctatcgtggtaagattggcaataaatctaagatcactggagtacatatcacaaaatatggattcaggctgctcgatagacacaagattaagatcagggaaatcataaagaacaaggactatcttgagaacaataaaccccttctcgggttactgaattatgctttgcaggtcaatccgaaatacagtaagtacatgtacctgataaagaagaagctcatatcggattccaatatttga

SEQ ID NO: 10605 - RNA, 978 nt, unidentified
  source 1..978: mol_type = other RNA; note = synthetic construct
atgaacgcatatcaatgcaccctttacggcgtgaagagcctgaacaaattgcaacaatttctgcagatcaaggccaaacaagaatttaaggccctgtcaagttctgtgaaatctacacccctgaaatattatagcccctttaaggatgagaataaacgggagctcttcaactgtagctctcacatcaccttcctgcacaaaaaggtaatgcgattatttaatctcgagcagtctacctatctgaaatcaggtgtgaagaaagagtcacacataacaaatgctaaagaacatcagaacagtaacttctttctgctgatcgacatcaagggcttctatcctagcataacgaagtctaagattaaaactcaactgattcagacctacaaacagtccaaagatgtggctgagttcctgtctaacttattgacagtgcctcaggagaaatcgctcgggaaaagagcacttgtcactgggagccccctttcccagtggtttgcgtatgtcattaacaagaagatgttcgatgaactttacaatgtgtccaaggaagaaaacataatcttcagtgtttacgtagatgacatcaccttcagctccaaatcgattatttcctacaagttctacacgaaaatctacaacatcatcaataagtacgagtatcgtattcaccagggaaagatgtataggggaaagctgtgtaacaaaactaaggtgaccgggattcagttcactaaatatggttttcgcttattggacaaacacaaagaaaagataaggaagatcgttaagtccaaagactgctccaatcagattaagtcactactcggcctcgttaattttgccatccaggtcaatccaagatacagtaagtacaagtacttgattgagaagagcctactcctgaagcatagcaatacaaaaaacaagaaccagtaccataagtcaccaaccaattccaaggccctgaagtatagttga

SEQ ID NO: 10606 - RNA, 903 nt, unidentified
  source 1..903: mol_type = other RNA; note = synthetic construct
atgaatccttacagttgcaccctgtataactgcaaaagcttgaacaagctcaagtcctacttgaatattgaggacgataagtacttcaaatctctgaatgctaacctgagcgcgaatcccttcaaatttttccgtaagttcgagaaaaacgagagagaactgtttcgctgtaataaaagaatcacacagatacaccaacgattcatcaaactgtttaagatcgaggagagtgagtacttaaaatctggcattaagaaggaatcacacattaccaatgccctggctcataaagacagcaacttctttctattggtagatatcaagggcttctatccctctactacaaaggccaaaatcaagaaacagctgatcatgacatatcagcagtccagcaacgtggcagagtttatatcaaatgctgtgacagtcccgcaggagaaggccaacaataaacgcgccctcgttactggcagtgtgctatcccagtacttcgcatatgtcatcaacaagaaaatgtttgacgaactttacaagctgtcaaaacacaatgatgttatcttcacggtgtacgtggatgatatctccttctcgtctaagaaagtcctgacctataagtttcaccagcaagtctacaacataattaagaagtacgggtatactgtgcataacggaaaggtgtatagggggaagatcaataacaagtcaaaaattaccggtgtacaaattaccaagtacggctttaggcttctcaccaaacataaggacaaaattaaggaactgaagaacaaaatcgacataaaatccaaacggagcctcctcggaatgttaaattatgccattcaggttaatccaaagtataggcggtacaagaacctgtttaagaactacgaagaacttaattga

SEQ ID NO: 10607 - RNA, 906 nt, unidentified
  source 1..906: mol_type = other RNA; note = synthetic construct
atgtttacctgcactctgtacaattgtaagtcactgaacagtctccagaagtatttactgatcaagaccaaggagttcaaaagcttgtctattgaactgaaggaaatccctcacaagttctttaaaagctttaccgatgataagggaagagagctgttcaggtgcaatggacaagtcacgaagttacataagagattgatgaagcttttcaacgttgagattcctatctatcttaagagcggcgttaaaaaacagtcccacatcactaacgtcaaataccatgagagttctaattttttcctcctgattgacgtgaaacggttttatccaagcatcaccaagagtaagattaagaaacagctgattacaacctacaaacaaagtagcaatgtggccgagtttatatcaaacctggtgacggtgccccaaaaaaagtccaacaataagcgagctctcgtgacaggctctccactctcccagtacttcgcattcattatcaacaagaaaatgttcgacgagctgaacaaaatatcgatcgaagaggacgtaaagttctcagtatatgtcgatgatatgacattttcatccaaacaggtgatctcctacaagtttcatcaaaaagtcttctctatcctgactaagtacgggtttgttacacacttgattggcaataagaaaacttataggggcaaagtcggggcgaaatctaagataaccggcgtgcatattacaaaatacggtctgcgcctcttgcagaaacacaaggacagcatccagcacattataaaacagaatctgcacgaagaaaaggggaaaactcttcttggactagtgtactatgccatccaggtgaatcccaagtacgacaagtataaacggttactagagaagtacaacaagctctga

SEQ ID NO: 10608 - RNA, 957 nt, unidentified
  source 1..957: mol_type = other RNA; note = synthetic construct
atgattaagtacaaccttgacattttcaagaactttacctcaatagagaagacgtgtgaatttctctgcgtgaataaagtgctgaagtacaacatcatcaacaacaacatcaaagagtgttatatcaccgaaataaacgataatgggagggaaattcataagcccattttcttcctgaaaaagactcagaagaagctgctcaaatgcttacttcccaaagttctacctaagtacctgtttgcgcctagcatcaagaacacaaataagaacaacatcgagaatgcaaggtaccacctgggcaaaaaatactttctgaccatggatatcagctcattttataacagcatcaagggaaacactatttacgacctctttttcaacaagttcaaattgaactctgacattgctttgtttatcaccaaactcaccgtatacgataatggaaaggaaacgttcctgtccacaggttctccgagttcccagatcttggcttatctctgttactcggacgtctttgacaacatttacaacttgtgccttaaaaaaggcattagattctccctgtatgtggacgacatgaccttcagcagtgatataaagtttacaaacaagcttcccaacaagataattgacattttcgagaagaacaacctgaagataaaaccagagaaaactaagcgatataacaaaggctatgccaaaataacaggggtcatcctcaagaacaataagctgtacatcaagaattccaaacggaaagatattatcgaaaacctgaaactcctaaacaagtctaacgatatcattaagaaggagatcgagaacaacaacatcgagataatcaagacaattagcaagttaaacggtctgctgaattatactaaacaaatcgaagaggatcacttcctggccaatagaaatcgcatccggaagttgtataaacttattccaaaatga

SEQ ID NO: 10609 - RNA, 954 nt, unidentified
  source 1..954: mol_type = other RNA; note = synthetic construct
atgcaatacaataattgcatactttacagcctgaactctaaaaagaaactcgtgaagattctcattgtgaacaagaacatcaacaagaagaaactcgttaaaatcttctctaaggaggaacaactgaagatcttgattgaaaaaagcaagaaggtacaactgaccgacaagaaaacacgcaataaaattctgaacagtactaacatcacgtttaatgagaacatacaccgtcaatttacatatgcccagaaaaagtcagactataagatgatccttaagaaactgtctaagattctgagcatatgggtcgaaaaaaacaacctgaactacttatactccattatcaaaaacgtcgattacgtcaaaaacgcttatttccataaggagaacaactactttctgaagatcgacttcaagaactactttaacaacatctcatccctccagatctttaatttcttcaagtacaagctgaacactagtatagacattgccaggatattgacagttttgagtgtggcagatatcaataataccaatcttaaacagggcctcgaaactagccctattctgtccttcttagtgaatatcgagattttcgaagagatataccagtactgtatcgagaaaaagtttaagatgtccctgtatgtggacgatttagttatctcaagcaaaaatcccatcaacaaaaaggagattcagtttgtattcaacatcctaatcaagaacaagctaaagatcaatcgacggaaaatcaaataccagaacctgtacaataacatcgtgattataaccggaattcagattctgaagaatcacaatctcaaaccaatcaacaaaacctgcaagaagttgagaattgagaaaaagatctctaagaaccagaatgtgattaatgggcttatttcgaacctcaaatacatccagcagataaatgataagaacaaatga

SEQ ID NO: 10610 - RNA, 1002 nt, unidentified
  source 1..1002: mol_type = other RNA; note = synthetic construct
atgaattacaaagagtgctctatctacaagataacaaagaagagtgacgtaaattacctcctggacaacgccgacaaagccacaaacatcaataagtaccaccagtatattactacctacgtggtccttgatcctaatgggaaaccaaaaaggctgatcgaatgcattgaggaaaagtataggcacactaacaaagtcctattcaacttactcaagagcatcgaaacccctgaatggcatttctctaaaaaggctgttagctacctggacaacgccttttatcacctcgataatcggtacatgttaaccttggacattaagaagtttttccccaatacttctcaagattccgtatatcgcttctttctgaacaaattcgagttgacacccgacatcgcaagttacctcgccaagttgtgcaccgtgaacattgatctttgtaaatatgatagcgtcgagatgaagaataacgtgaacacatatatggagatcaagaagataagacagcggaaccatctgatcacgggtgctagtacttcatgtctcctaagtttcctggtgcaccaggaaatgtttgaggaaatcagaggccttctgaaaaagcacgaaaagatgtccgtgtacgtcgatgatattactataagctcaaattgccccattgacaagaaactcgtgaagcagatatccgcgattctgtaccgatatggccatcggttgtccaagaacaagacaaagtactatacaaaagactcctacaaaagaaccaccggggtgattcttactccatcaaagcaggcccgaattccgaactctaaaaggaatgagatctttagcctgttcggcatctataaagaaaccggatatacctgtgagaaaacgaaggaccgtctgcgcggactgctgaattacgcacgctccatcgagcctaacgcttttccaagaatctatgaggcagttgttagccagtctaaatcgtactcaaaacaaaatcccaccaggtga

SEQ ID NO: 10611 - RNA, 1251 nt, unidentified
  source 1..1251: mol_type = other RNA; note = synthetic construct
atgaatttaaacgaattgattgagcagcagatacaaaaatgtcggctgtacgggctgactaaaccactcatcattaaggagattctgaatattcccgattacgtggatattaagcacctggataaatcaattgactccttttacgacaccttttacataaagaagaactgggccaaggagagccagacaaaagaagaacggtataaagagattctgaacattgagaagaacatttccgagaggttcaccagtatccccgacggagaagacaaaacaaaataccggaagatagtcaccatcaatacagactggctcaagaaatctcagaagaagtttaacaagatcctcatgtccattctcttggacaagaaagtgagaggaatcaagcagaagtcaatcatcccttaccttcacagtgccgtgaaacagcgtagctatcatacaaatgctcaagcgcatgtcggagataaatacgtctttgccatcgatctgaaagatttctatcctagcgtaaccaagtataagctgtaccttttcttcaaaaacgagttcaatctgtcttcagatattgccatgttctatgcagttctcagtacctgcatctctgacgatggcacttaccgcttaggtcaaggcctctcacagtccagcactttagcttatctggttaactattcccttttcaactatctgtacgagctaagcaaggtcgaagacattgatatgtctatttatgtggatgacgttgtgttctctagcaaaaacaaaatctcgcaggactttatagataaactgttcggcatcataaagtccaacaatatgcagatcaagcgacaaaaggtacattattacaagaaggaatcggtaaagaagatcacgggtgtgtatgtgaatggcaataagaccagggtggcaaatcacaagcactatgagtttcatacgcagtacaaatacttgaagaaccatatccttaacgtgaaaaccatcgaagactattacaagatctataacttgtacctcaagttttacgggaatttccaacacattaaaatggttgaaagcagagtgcacgataggtacgaaaagttcatcaaagactttgacgagttttttccaaaagggataaacaaaaagcagaagagtatcaactaccagaaagacaacattaagaatgtgactgaccgcgagaaactaaataaatgctatcagaagctgctgaataaaaataagatcatagagtctgtcctgtga

SEQ ID NO: 10612 - RNA, 1251 nt, unidentified
  source 1..1251: mol_type = other RNA; note = synthetic construct
atgaatctcgacaacttactggaggagaaaattcgcgagtcgagactgtacggagtgaccaaaccgatgattataaaggagatgttgaatatccctgaagacatcgacatcaagaaccttgataagaacattgacagcttctacgatacgttctatataaaaaagacctgggttcagggtagtaaaacaaaggaggagaaaatcaaggagattctcaacatagaaaagaccacttctgaaagatacaaaagcattccagatggagaggagaaaacgaaataccggaagatcgtcacaattaatagcgactggcttaagaaatcccagaagaagttcaacaaaatcctgatgaacatcctgctggataaaaagatcaggggcgtgaagcagaatagcataattccctacttacattcagccgttaaacaaagatcttatcacacaaacgcccaggtgcacgtgggggacaagtacgtgttcgcaatagatcttaaagacttttatccctccgtgactaaatacaagctcttcctgttctttaaggataagtttaacctgtctagtgatattgctatgttttacagtgtcctctcgacatgcttagcagacgacggttcttatcgattgggccaagggttgtcccaatctagtaccctggcgtatctcgtgaattattccctgtttaactatctgtacaacctcgccaaaaatgacgacatcgaaatgtccatttatgttgatgacgtgatcttttccagcaaaaatgagatttctcaggtctttatcgataaactattcggaatcatcaagggcaatgacatgaggattaaacgccaaaaggtacacagttataagaaagagagcgtaaaaaaggtcaccggcgtcttcatcaatggtaataagactcgggttgctaatcacaagcattacgaatttcatatgcagtataagtacctcaagaaacacataatcgatatcaagtccatcgaacagtacttcaagatttataacctgtaccttaagttctacggcaattttcagcatatcaaaatggtggaagggcgggtacacgatcgttacattaagttcatcaaggaatatgacgacttctttcctaaaggaatcaacaagaaacagaagaatgtcaactataggaaagggaacattaagaacatatcagattcagagaagctgaaatcaagctacaaacgactgctaaagattaataaggtgtcaaaaagcgtgttgtga

SEQ ID NO: 10613 - RNA, 1266 nt, unidentified
  source 1..1266: mol_type = other RNA; note = synthetic construct
atggacctcaataaactgattgaggagaatatctccaaaaacaggattactggcttgaccaaaccgaagattatcaaggagatgttatctataccagagaacatcaacctcaaaaaactggatcagatcataaatagctgctacagcactttctatattaagaagaattggtcgaagcatcaggaaacagaagaggaaaagtacatcagataccttaatattcaccaggaactgtctgaacgtattcaacagctgcctgaaaatgccgacaaaaccaaatacaggaaaatccttgtgattaatgagccatggctcaaagtgtcacaaaaaaaactgaataagctgctgacatccattctgttgacaaaaaaggagaaagcgaagaaaagagaatcaattgtaccttatctgcactcaagcgtaaaacagaggtcatacactacgaacgcacaggcccatattggggataagtatgttttcgctatcgatctcaaggatttttaccctagtgtcacgaaggttaagattttcaacttcttcaagaagcactttaagcttccctccgatatcgctatgatctatgccgtgcttagtacatacaaatctgacaatggagagtattgcctggggcagggattatcccagagctccaccttggcatttctggtcaattaccgactgtttaactatttatacctggaggctcagaagctcggtattgaaatgactatctatgtcgacgacgtgatatttagcagtagcagtcctattccacagaagtttataaaccgcctattcggcatcattaaggagaacaaaatgtccataaagcggcggaaggtgtattactatggcaagaaacaaacaaagaagatcaccgggatatacattaagaaaaacaaaaccagcgtggcctacgagaaacataaagaaatcagaatccagtacaactatctcaaagaaaagatcaaggagataaagactttctctgactacctatgtatctacaacctttacctgaaattctacggaaactaccaccatatcttgaatgtggagaagaagatcaataacaagatcctgaacttcgtggataagtatgatgagttttttcccaaaggtatacacaaaaaacagaagcagccctattctgtccaaaatatcaagaccatcaatgacgtccaacgcttgaataagtgttatcagaagctcaagaacaaaaacctaaacgaagtgattctggactatcccaacgttaatctctga

SEQ ID NO: 10614 - RNA, 1227 nt, unidentified
  source 1..1227: mol_type = other RNA; note = synthetic construct
atgaaaaagaattttgacggtctaaaacggctgaacaaaaagaagaccatttactcactgttcgagtttcctaaagcagcatccaacaaggactacgactttagcaataattatgagttccgctacctggcaaagaagaaggatgacataaatagaaaggagcgaaaactcgaaagacttacagggtatatccagctgcaagatagcgataaagatgctcttatgcgctccaggcccaaagactacgacaaaaattcctatcggaccatagtgaactattctaactcctccgattggttaaagaaagcccagaagaagatccataaatatatcgtgaaggagctaggagaagtcgaatacctgcacagtaccatcaaatcaaagagctatgccactaatgcctttcagcacaggggagaaaactacactttggccatcgacctgaagaatttcttcacgtatgtttcgagggagaagctgcagtataccctgaaggatttcctacagatcgattctgacgtagctttcctgtacagttccatgttgactagtcccgtggatgagccgccgcatcatggagggaagtataacttgggccagggcctgccatcatctcctatcctggcttatttgtgtcacgcgagtctgttcgagtatatctacaataactcactcaaggaagagatcaccatgacagtgtatgtggatgatgtcgtgtttagtagcgttaaacccatcccacagcacttcattgacagactgtttggattatttaagcggaatggcctcgagattaacaaggataaaatacgcctttacatgaatggctctaccaagaaaataacagggacatacgtgagccctcagaagcttagcatcccaaatcgaaaacacgaagaacttcataacctctaccaaactctgaaggaaaagaaagaaaagattgagacgatggacgactacttgttcctctacaatatttacctcaaattctctggcaattaccaatacctcattcaggtagaatgcaggggtgaggacgggaaaatttctgtcaacccacggtacaagaaatttgagaagttaaacaacgagctgaacattctgtttcccagaggcctcaaaaagaagaagaagaaaaccccttatagcaaagaaaacatgtacttcgaggaatataagcaactcgaggagaaatataaactttccgtttcacgtctgaaatga

SEQ ID NO: 10615 - RNA, 978 nt, unidentified
  source 1..978: mol_type = other RNA; note = synthetic construct
atgaaaattctcgaaaactgcaagctctttaaactgaacaagatcaagaccatatacaagaaattgaacatccccatagaggcacagcagaagaattttgacttcgattctctatacgacttcaaatacctgaagaaggactctaaagataacaacaagattagcaaagaggaacgctttgagaaatatgtgaatattgagaagtccataccgcagctgattgatgagcgaccaggggacttcaataagagcaaatatcgggttattatcaacatcaatcaggagtggctgaaaaagagccagaaaaagttccacaagatcatagccaaggaactcaacaatatcccctatcttcattctaccatcaaacacaaaagttttgcgacgaatgcccataagcacattggtgaaaaattcaccttgactattgacctgaaaaacttcttcacatgcatttcgagagagactctagctaataaactgaaaacgcttcttgaaatcgattctgacatcgccatctattacagccgtttgtttacaagtccttctgataaacccccctacaataacgggcaatataacctgggacaaggactcccttcaagtccaatcctggcatttctctgtaactacactcttttcgaatatatcaacgatctcgctaagttatacaatacctccatgaccatttacgtggacgacatcaccttttcaagcgacttacctatttcccaggagtttatagacaagctgtttggtttgtttaagcagaatggcatgaggatcaatccaagtaagatccacctgtcaaaaaacaattccttcaagaagatcacaggcgtaaatattattgatggcaagccaaagatacctagcaggaaacatgaagagattatgatccaattcaagaccattaagacactgatgactatcaagtccttttcagattatttcgacgataaccaggtcatattctga

SEQ ID NO: 10616 - RNA, 1260 nt, unidentified
  source 1..1260: mol_type = other RNA; note = synthetic construct
atggatagggtcaaagaatgtcttaaaaattgcagactgtacaagttcaacaatagaaagggtataaagcaactcttgaagatcccagacaatctgaacctgaacgacatacgcggcgaactgtctagctattacaacttcttctacctaaagaagccggataaaatcaagtcaaagatgagcaaagaagagattaggaataagtacctctcaattgaagagaatttggagatctacgatgagaggccggccgattacaccaaagacaaatatcgaatgcttatcaacatcagagagaaatggctgaagcagacccttaaacggattaataaactgctgagtcagagtctaatcaagaagaacaaaaagaacgtggaatatcctatcccctatctgcacagctctctcaaaaagcgatcctataatactaacgtgaaagctcacaagaaccataaatacatattggcgatagatctcaaagcattctaccccagcgtttcgtatgagaagatcattaacttctttcggcatgatttaaagctggagaaggacatagcagagatatatacagccctgtgcacttgtccattggatgatccacagcagggcaatatccaatacggcatcggccagggactggctacctctcccgtgttagcctttctgacgaattaccgtatgttcgagtatatttacagtatcgcccaaaaaagcgggatcgaaatgactgtgtatgttgacgacattgtcttttctagttccaaacctattgagcagacatttatcaattccctgtttggcattgtgaagaaaaataacctgaagatcaacaagaacaaggtaaaactctatggaccaaaacaggtgaaaaagatcaccggattatgcattattaaggggggttcaatcaaagtgcctaattccaagcactttgagacaaaaatacagtttgagtacctagtgaacaaaattctggtgattagcaatatcgacgactatctttctttctacaacttgttcctcaagtttaagggaaatgttcagtttatcgaacttgtcgaagacaaaattcccaaaaagtatagcgacttcattaaagagtacaaggattatttcctctacggggtccctaaaatcaagaagtccaagatttacacacaatcaaacgtatccaatgacgattacaagaacttcgtcattatgtatgaacgcctcaagaaaaagatagacaaggtgaagaacaataagatcatcatgtga

SEQ ID NO: 10617 - RNA, 1242 nt, unidentified
  source 1..1242: mol_type = other RNA; note = synthetic construct
atggacaatgttaaagagtgcttgaagaaatgccgcctgtattgctttaacagccgcaacggcatcaaaaatctgcttaatatacccaaagacttcgacctggagaatgtccgagacggcctgctgccctattacaattttttctacctcaaaaagcccgacaaaagcaaaaccaaggaaactccagaagagaggaagatgaaatatctctcaatcgaagaatcgtcagatatatatgacactaggccagatgattattccaaagacaagtaccggatgttaattaatatcaacgagaaatggctcaagaagaccttaaagaagattaacaagctactgagcttgtcccttatcaagaagaacaaaaaggaagtcaactacccgattccttatcttcactcatccttgaaaaagcggagttacaaaacaaatgtggaggctcataattcaaacaaatacctgctggcgatcgatattcagaacttttacccaagcatatcctgtgaaaagatcttcaatttcttcaagtacgaccttaatttggatgacgatattgccggaatttatacttccctgtgtacctgtcccttagacgatcctgtcgtgggaaaatttgaatatggaattggtcaagggctggccacgagccctgtgttggcatttctgtctaattatcggatgttcgagtacatcaatgatttcgccacaaagaacaatatcgaaatgactgtctacgtggacgatgtagttttttctagcaacaaaccaatcaagcaagagttcatcaacagtctgtttggcataataaaacgcaatggtctgcgaataaaaaagtccaaggttaagatctatggtcccaatcaggacaaaaagattacgggcctctgcattacaaagggggggaaagtgagagtgcctagatctaaacacgaggagctgaaaattcagtatgactacctctctaaggaggtgctgaacatcaagaacatcaacaactatttcaacttctacaacctctttctgaaatttaaggggaatgtgcagtttgtactacttgtcgaggaacgtgctacaaccaagcatttcaagtttatcgaagagtacaaggatttctttctatacggcatcagaaagaacaaaaagggaaacaagtataccaaagacaacatttctgaagaggattacaagaaattcatcctcaaatacgagaatctgaggaagaagattgatagtctcaagtga

SEQ ID NO: 10618 - RNA, 1017 nt, unidentified
  source 1..1017: mol_type = other RNA; note = synthetic construct
atgcagttcaacaattccaagctctatggcctgagcaataagaaacttttggccgacattctgagtgttgacaaaaagtcacttaagaatgtttccctcgaattcctcccctacaaactgccacaacatctatccacaattaacggcaagcaaagagatatatacaaccctaatgacgaacacaagaaggctctgcggaaactcgtccgcttacttatgcaggttgagctgccttcctatgtcttcgggggaatcaaggagaagagccacattcagaatgccagtatccataaggctaataactacctgatgctcattgacatccagaatttcttcccatcgacgttagatagctatgtgtatgatctctttaagggaaagtttcagatggccgacgatatagcaaaaattctcaccgatttcgtaaccatcccttgcgagaaaaaagacggtaggtatctgccccagggctatccaactagtccgattctatcatatttggcatatgtcggtatgtataatgaattggccactgtggccgtggaaaatgagatgattttttcctgctactacgatgatctgacattttcaagcaataagttcatcaacaagagcttgaaacgtaagtgttaccagatcatcgaaaagcaccaactgaaagtgcatcccatcaaatctaagctgatagtaaagaaaggggtggaagtgaccggggtttttctggatgacctcggagaggcaaaggcgcccaaaaagctgcttaagaagctgcaggagtcatacgagaaggtgaaaaatatggataggaacccttctgagtttaccaaaatgaactttgtcgacgagttaaacaaactgcagggccttatctctgctgtcaaatctatcgagaaaaaccggaagattgacctgtttttgaacgaactgaagttcatacgcaagaaatacaacgtgccatacagaaagaacgacgtgaaaaaatacttcaacacagaatacgctagcattatccgatga

SEQ ID NO: 10619 - RNA, 1017 nt, unidentified
  source 1..1017: mol_type = other RNA; note = synthetic construct
atgcagttcaacaacagtaagctgtttggcctgtcaaataagaagctcctggccgacaccctgaatgtcgagaagaaatctctaaagaacgtggcaattgaattcgtgccttataagttgcccccccagctctctaatataaacggaaaacagcgggatttatacaatccaaatgaggagcacaaaaaggccctgcgcaaactcgtcaagctgttgatgcaggtcgaactgccctcatatgtttttggaggcattaaggaaaaatcccacattcagaacgcgtttgttcataagcaaaacaaatacctgatgctgatcgatatccagaatttcttcccttctaccatggatagctacgtgtatgaccttttcaagagaaaattccaaatggaagaggatctggctaagatcttgacagactttgtgacaattcagtgtgaacgaaaagaaggcaggtaccttccacaagggtatcctaccagcccaattctaagctacttggcctatgtagatatgtataatgagcttgaagcactggcagtggaaaatggtatgtctttttcctgctactacgacgacctgacattttcgagcaacaagtttataaacaagagcctcaagagaaagtgctcccagatcatagagaagtaccaattcaaaatccaccccaccaaatccaagctgattgtgaaagagggcgtggaagttactggggtgttcctcgatgatctagggaacctgaaggccccaaagaaactgctcaagaaactgcagaaatcatatgacaaagtcaaggagatgaatgagaatccgagtggatttactaaaaaaaacttcgttgacgagcttaacaggctccagggtcttgtggctgccgtccgcagtatcgagaacaatcgtaaggtaaacttattcctcaatgagttgaagtacatcagaaggaaatataacgtgccttaccggaagaaagacatcaaaaagtactttaagacggagcatgctttactgattcagtga

SEQ ID NO: 10620 - RNA, 1017 nt, unidentified
  source 1..1017: mol_type = other RNA; note = synthetic construct
atgaattttaacaatagtaaactctacggcctgagcaataagaaaatcctggccgatctcttgaaggtggataagaagcggttaaaaaatgtcatcgaagagtttgttccgtataaacttccaaccgagctttctaccattaacggaaaaaagagagacttgtacaaccctaaaaacgagcacaagaaagctctgaaaaagctggtagggctgctaatgcaggtgggtattccatcctacgtgtacggtggaatcaaggaacgcagtcacatccaaaacgcatcaatccaccggactaaaaagtacctgatgttgatagacattcagaatttcttcccttcgactagcgattcctatatctataacctgttcaaagatcgcttcggaatggccaatgacctggcaaaaatccttacagatttcgtgactgttcaatgcgagaaccgtgaagggcgatatctgccacaggggtatcccacatcccccgtcctgagttacctctcttatgccgccatgtatcaagaactcctgcatctggccgtcgaaaacggcatgcagttttcctgctactatgacgacctcacattttccagcgacaaattcatctctaagtcactaaagaggaaatgttctcagataatagagaggtaccatttcaaaattcaccccaccaagagtaagctcatggtgaagaagggcgtcgaggtgaccggtgtgttcttaggggatagcggcgaggttaaggcccccaaaaaactgttgaagaaggtgcagaattcatacgaaaaggtgaaggagatggacaaaaaccctaatgcttttacgaagattgattttgtggacgaacttaatagctttcagggactcattgctgcagttaaaagcatagaaaatgatcggaaggtcgacttatatttgaacgagctgaagcacattagaaagaaatacgacgtaccttacaggaagggctcagcgaaggagcattttagatctgagaacgctaaattcatcctttga

SEQ ID NO: 10621 - RNA, 1017 nt, unidentified
  source 1..1017: mol_type = other RNA; note = synthetic construct
atgaatttcaacaactctcgtttatacgcccttagcaataagaaggtgttggctgacatcctcggcatcgacaagaaacggctgaagaatgtgatccaggaattcgtgccctatcggctgccacctgaattgagcacagtgaatggcaagcaaaggaatctgtacaatccaaatgatgaacataagagagctctgcgaaaactcgtcagactgctgatgcaactcgaaattccgccttacgtgtatggcgggatcaaggagaaatctcatattcagaacgcatcaatacacaagaaaggaaaatacctgatgcttatcgatatacagaacttctttccctctacatcggatagctacgtgtacgacctgtttaagaacaaattcggcatggctaacgacattgccaaaatcctcactaatttcgtaaccgtcccctgcgaaaattccgatgggcggtatttaccacaggggtacccgacttcccctattctgtcatacttgagttatctcgatatgtacgaggagctgctttacctagcagtagaaaacggtatgaagttcagttgctattatgatgatctgacgttctcttccgacatatttattagcaagagccttaagcgcaagtgtagtcagatcatcggaaagtaccactttaaaattcaccccaccaagtcaaagttgattatgaagaagggagttgaggttaccggcatatttttgaacgaccttggggagatcaaggtgcccaagaaactgctgaagaaactacagtccagttatgagaaagttaaagaaatgggtgagaacccatcaacctatataaaatccgacttcgtcgatgaactaaacagactgcagggactgattgccgccgtgaagtctatcgaggtgaatcgcaaggtcgacctctacttaaacgagctcaaatatatcaggaagaaatacgacgtcccttataggaagagctccatccataaacactttaaaacagagagcgcgaaatttattatgtga

SEQ ID NO: 10622 - RNA, 1014 nt, unidentified
  source 1..1014: mol_type = other RNA; note = synthetic construct
atggatttctccgcttccaaattgtttgggattagcaacaagaaatacgttgccgagctgctgaatgtggagaaggcaaaactgaagaatgtgtcgtctgaatttgtgccctataaatttgaacagagtgtcaagggcaaaaaacggatcctctataacccaaacgatatccataaggccatcctgaagaagattacaaagatgatcagccagctggacatcccggattacacatttgggggaattaaaggccgcaattatatagacaatgctaatgtgcatcgggacaacagctatttactgctggtcgatatcaagaacttctttccctccaccagagactcttacatctacggtttgttcaagaataagttcgagatgccatccgatatagctaaaatcttcacagatctggtgaccgtaccttgcgaaaatggagaggggcgatacctccctcaggggtaccctacaagccccatcttatccttctttgcatacttggacatgtatgaggaaattttcgaagtggtgcgcgccaacaacatgggcttttcttgttattatgacgatctgactctcagctctaataagttcattgcgaaaagtgtcaaaagaagggtcacccggattatcaggaagtacggattcgaagttcaccccactaagagtaggcttgtgatcaaaaagtacacgaaagtaaccggtgtcattcttaaagaggatgagatcgttgcccctaaggctctactgcgaaagttgcacgacactcataacctcatgaggcttatggataaggactgtgttaagcacaccaaagaggacttcattgatgtgtgcaataaggtacaaggcctcatatcagccatcaaatcaattaacgaccagaaaaagctagacatatacattaacacgctgacacacatcagaaagaagtacaacgtgccatatcgcaaagccaacatcgcaaccagttttaatactgactatggccgtcttataggagtgtcaatttga

SEQ ID NO: 10623 - RNA, 1026 nt, unidentified
  source 1..1026: mol_type = other RNA; note = synthetic construct
atggacttttcaacaagcaaacttttcgggatttctaataagaagtacgtcgcagagctgttaaacgtagagaaggtcaagcttaagaatgtgagttcggagtttgtgccataccggtttgagcagagtgtgaagggaaagaaaagagttctgtacaaccccaatgatgcccataaggcaatcctcaaaaaaatcgttagaatgatctcacagctgtacttgcctggatatacctttggcggcattaagggccgcaattatattgacaatgctaatgtgcatcgaaacaactcctacttgcttctcgtggacatcaaaaattttttcccaagtacaagggacagttacatctatgacctgttcaagaacaaattcgagatgccccccgatatcgccaagatattcacagatttggtgaccgtaccttgtgaaagcggtgaaggcaggtatttgcctcaggggtacccgacctccccgattctgtcatttttttcttacctggacatgtatgaagaaatcctcaaagtgacgctggagaataatatgctgttctcctgctattatgatgacctaactttgtcttccaacaagttcattgctaaatccgtgaaacgaagggtgacccgcatcattcaaaagtacggcttcgaagttcaccctaccaagagccggctggtgatcaaaagacacactaaagttaccggtgtcatattaaaagagaatgatattgccgctcccaaagcgttactaaaaaaactgcacgacacttacaacctgctgctgtctctcgataaaaactgcacgaaatatactaaggaagagtttgtcgatgtctgtaacaagcttcaggggctcattagcgccatcaagagcattaacgacaagaagaaactcgaaatgtaccacaacacactttctcatatccggaagaagtataatgtaccatacaagcgcgcaaacatatccacctcattcgagacagattatggaaagctcataggaactctgccacgtcacatcagctga

SEQ ID NO: 10624 - RNA, 1209 nt, unidentified
  source 1..1209: mol_type = other RNA; note = synthetic construct
atgaaacacgcaaagcacaggaagaagcagtgcctgaatgactattatcaggccttaaaagagattacgatcgtgaaaaacctggtgtacgtggtgaaagctatccaatatctgacgatccttaagatcatcatcgccattattttcttcacccttcaagtcatcgtgaaaatcatctcatgggtcattccatatctggagattatctacaacttcctgtcccaggtaacaagtctcttttgctgctttcaaaggggtaatgtcaaaatgtactggaagtcatgtaggctctacggcgtgaagagcaaacgggaactgtcctatctgttgaaggttcctctggagtcactcaaaaacatcgacgaaaactatatcagcgagaatttcgtatacgatgggcgggagctgactaaccccagtgacaagcttaagaaggtgctagaaagaattctaggctatctcttcatgctccgcattccaccctacgagtacggaggcatcaagggaagaaacgccattcagaatgtgcagagacacgtgggccatgggtttatcctgagaacagatatacggcattttttccccaatactaagtatgacaatgtgttcgatctcttccgtaataaattgaacatgtccatcgattgtgccacaatactgaccctgctgactaccaatgtcgctgttaacgcatcttataggagcttggcgcagggctacccaacatcgccggttttgtctctcctgtcctaccttgacttgtttaacgagatttccgactatgcagatgaacacaagttcacttttaccgcttactacgacgatttaacactgtcctctgaaacctttattaacaaatcgcacctgcgaatgattgagcacattataaagaagtacggatttgacgcccatcctcaaaagactaaacttgtgaaggttagcaaggtccatagcaagataaagataaccggcgtgctgttgcagaaagatggtttatacgtccctaaaaaactctataaggggctttacgaatacgtacagcgcctccggagtgtcttaagcggagacgtttcaatcagtaatgaagagaaaaagacactgatacagcaggtacgcggttgtatcgctgccatccaggtgatatctgatgatgaaagcttccaggggtatgaggacatggcgcgatctctagagaaaaccattatttga

SEQ ID NO: 10625 - RNA, 999 nt, unidentified
  source 1..999: mol_type = other RNA; note = synthetic construct
atgatcttcttccttaagttgcaccttttttttgtcgctttcaaggaggtgcgaaaggtgtattggaaatcttgcccattgtatcgcgtcaagtccaaaagaaagctctcatacctgttaaaagtaccagttgagtccttcaaaaacgtcgatgaaaactacataagcgagaactttgagaaggacggtaggaatctgaccaaccctagtgataaactgaaggtggttcttgagaggatcctcgactatctgtttatgctgaagatcccgccatacgaatacggagggatcaagggcagaaatgccattcagaatgtacaaagacacgtgggacatgggtttattctgagaaccgatattcggcatttttttcccaacaccaagtataataacgtgttcgacttcttccgcaataagctggacatgtctatagattgcgcaacaattctgtctttactgacaaccaacattgcacgcaatagcgatcatcgttctctcgcccaggggtatcctactagccctgtgttgagccttctggcctatttgaatttgttcaacgaaatttcctcctacgcaaatgagaagggatttactttcacagcttactacgacgacctgacgctgtcaagcaacgacatcatctcccactcacacctacgaatggtgaaacatatcatcgaaaaatatggcttcgaggcccacccccggaaaaccaaactcgttaacgtcagcaagtttcaatccaaaatcaagatcacaggagtgctgctccagaaagacggcctttacgtacccaagaagctatacaagggcctacacgagtctgtcaatcagctgaacctggctctcaatagtaggcaggggataagtaacaaagagaagaaaaagctcgtggaacaggttaggggttgtattgctgccatacattcaatcaatgacgatactgtgttccagggctacgaagatatggcgcggcacttagaaaaatcgattgtgtga

SEQ ID NO: 10626 - RNA, 966 nt, unidentified
  source 1..966: mol_type = other RNA; note = synthetic construct
atgtattggaaatcctgccctctgtacggcgtggaatcgaagcgaaagctgagctatttacttaaggtgtctttaaactccctcagagatgtcgatctaaattatccctccgagaattttgaggagaagggaagaaatctgaccaacccctcaccaaagctcaagacagttctcgaaactatcctgaactacctgtttaaattacgtattccccagtacgagttcgggggaataaaaggcaggaatgccgtgcaaaatgtgcagtgtcatgtcggtcatgggtatatcctgcggactgacatccggcactttttcccaaacaccaattataataacgtgtacgacttctttcggaacaagatgaagatgagcatcgactgcgctaccatcatatctctgctgacaaccaacatagctgctggagcgcagcacaggtcacttgctcagggctacccaacgagtcccgtcctatctctgcttgtgtacctgaacctgttcgacgagatcgattactacgccagagcacatgattttaccttcacagcctactacgatgatctcacactgagctcaacttctattatcaataagcagcacctgcgcaaagttaaacacattattcgaaagtatgggttcgaggcacaccctaagaaaactaagcttgtaattgtcaccgaaatccatagtaaaatcaagattacgggcgtgctcttgcagaaaaatgggttgtatattccgaagaagctgtacaagaaactccacgaagccgtcagcttgatcgatcctgtgttgaacggaaacctcaaatatagcgacgatgacaaaaagaagctagtagagcaagttaggggctgtattgccgccatagaagcgattagtttggaaaacgactttcagggttaccgcgaccaggcacgccatctggaaaaaacaatcgactatgagcaactttccgagaataaatga

SEQ ID NO: 10627 - RNA, 945 nt, unidentified
  source 1..945: mol_type = other RNA; note = synthetic construct
atgcagttcacgacctgcaagctgtacgggattcagagcaaacggaagctgagttatatactaaagacatccctcgcttcgctcaaaaatgtcgacctctccttccagtctaaaaatttctaccagcagaacagactgctgacaaacccgagtgaggagcttaaagttattctgcaacggatcaccaagtacttatttacaatcggaatccctgaatacgagtttggaggtatcaaagaccgttcctttgtaactaatgtagagatgcatgttggccatgggtttgtgctcaggaccgatattcgccacttttttccaaacacccactacggcgatgtttacgtgttctttcacgaaataatgaacatgtcagtcgactgcgctaccattatggcgaaacttacaacttataggtgcaatcaaaactatcgctccctgccccagggctaccctacgtctccaatcctgagcttgttctcataccttaatatgttcgaggaaatcaatacctatgctgtgaaaaatgggttcacttttactgcctactatgacgatattacaatctcaagcaagagattcatcggacgaagccacctacgcgtgattattcatatactgaagaagtacggattccaagcacatccccagaaaacaaagttggtcaagatcagtaagaactctagcaggatcaaaattactggcttactgctccagaaagacgaaaccttggtgcccaaaaagctttataagaagttgcacgtggccatgaaaaacatcgattcagcactcaaacaatctaactcccgactgaacaaggctgatgccaagaagatagtgcagcaagcacgggggtgtatcgccgccattaacaccatcggcagtaatgatgaattccagggttatagcgaccagattagacagctggagaagaggtgttactattga

SEQ ID NO: 10628 - RNA, 1263 nt, unidentified
  source 1..1263: mol_type = other RNA; note = synthetic construct
atgattaaaaagcataagattgtgcaggtaaagcagtggctcaaggagaagacttgcaaagatggaaagattaacttcacaaaaacctgcacctttctggccgcaattcaggtttgcctttggctgatagaaatcatttgtatgctgtgtggatttatcatcagtacgtttgtcgagattgcaccattccttgaggccttttttaaaatcctggaaaacctcgccagtactcttagttacaacctcaggcggtcattctttgtggacttttacaactctaagctatatggggttagcaacaaaaagtatctttccgagctcctgcacctggagaagtcaaccctaaagaagatcgacaaattctacgaagtgaaaccctttctgaagaaagtgaataagaaggagagactcttatataatccttctatgcagcacaaaatcgcacttaaacggatagtgaaaatgttgtcattcatcggatttcctgactacctgtgtggcggtgtgcccgaggtgtcctacgtgaccaacgccagcagacatctggagaagaataacctgcttctcttggatattactaacttcttcccatccactaaggatagctacgtctatgatttcttcctgaacacactaaatcagagtaccgatatcgcgaaaatcatggtcaatttgacaaccgccaaatcggaggacggtgattataggtttctcccccaagggtactcaacatcccctatgttgagcttctttgcctaccataagatgtatgaacgtttaaatgctttcgctgagaaaaatgacctgaccttcagcgcatactatgatgatttcaccttctcttctaaggactttatccctaagtacttaatgaaggaggctatcaaaattatctctgactatggcctctccgttaacgaaaaaaaaacaaagctcgtaaaggtgaatcacactaaaataaccggcgtcgtggtacataaagataagatgagcgtcccgaaagggctgttcaagaaaacgtatgagcactacctgactttgctggacatggacgaaaatacagagaattatacccaggataactttatcgacacgtgtaatcgaatgcagggctgcctggcggctattcaatccgttgagcccgaacgcaacctggaacactacaagaacatgatacgctatattaggaataagtacgacgtgccagtcgaaagaaaaaagaaggacaagtacttcaagaagaaagaagtgcggcaaacatga

SEQ ID NO: 10629 - RNA, 1227 nt, unidentified
  source 1..1227: mol_type = other RNA; note = synthetic construct
atgatcaataaacataaaatcgtgcaggtgaagcagtggttaaaagagaaaacctgcaaggacgggaagctggacttcactaaaactattgcttttctcgcagcaatccaagtttgcgtatggttgttcaagatcatttgtaggatctgcggtttctctattagtatttttatcgagatcgcaccttttctggaggctttcttcaaatttctcgaaaatctggctagtacccttagctatataaaggagggcgtcttcttttacggattctataacacaaagctttacggtgtctccaacaaaaaatacctgtcggaattgctacacctagagaaaagtaccttgaaaaaggtggataccttttacgaagtaaagcctttcctgaagaacattaatgggaaagaacgacttctctacaatccatccagccagcataaaatcgccctgaagagaacagtcaagatgttatccttcattggcttccctgactacctgtgtggcggcattcctgaggtgtcatacgtgacaaatgcctctcggcacttggagaagaagaatctcttgcttctggatatcaccaactttttcccaagcaccaaagactcttacgtgtatgacttttttaagaacacgctgaatcagtccactgatgttgcgaagattatggtgaatcttacaaccgcgactaataactctggaaattcaagattcctcccccaggggtattccacttcgcccatgctgtcattcttcgcttatcataagatgtatgacaggctaaacacgtttgccgagaagaacaacctgacattttctgcctactacgacgatttcacttttagcagcaacgagtttatcccgaaatattgcatgaaggaagccattaagatcattaatgattacgggttatccgtcaacgagaacaaaaccaagctggttaagctcaatcacacgaaaataactggcataatagtgcatgaggataaaatgagcgtccccaagggactgtttaaaaaaaccttcgaacactatctgaccctcctggacatggataagtatcccgaaaagtacagccaatacaatttcatagacacatgtaatcgcatgcagggatgtctcgcagccatccagtcagtggagccagaacgcaatctggatcactacaagaacacaatccggtatgttaggagtaagtataacgtgccagtaaacaagaaaaacaaatga

SEQ ID NO: 10630 - RNA, 972 nt, unidentified
  source 1..972: mol_type = other RNA; note = synthetic construct
atggattttagcaatacaaagcttcacggtgtatccaacaaaaagtacttatcagagctgatccacttagaactgcacacactcaagaaggttgaccaattctatactgtcacccccttcgtcaaaaacatcaatgataaggagaggattttgtacaaccctagtttaccacataaaatcgccctcaagcggattgtgaagatgcttgggtacatcgggtttccggactacctgtgcggaggaatacctaatgtgtcctacgtctcaaatgcatctagacatctgatgcagaagaatcttctgctcctggacattacaaacttctttcccagtactagcgattcctacgtttacgatttcttcaaaaacactctcaatcagtcgaccgatattgctaaaattatggtgaacctgaccacagcgaagaacgagtctaacaacgttcgctttttgccccaggggtattccaccagtccaatcctttcattcctatcttactttcgtatgtatgaacagctcaatgatttcgccttgaacaataacctggtcttcagcgcttactatgacgactttacttttagctccaataaattcatccctaagtactacctcaaggaaacaacgaagattatcaacaagtatggtctaaacgtgaatgagcgaaaaagcaagatcgtgaagataaatcacaccaaagtgacgggcgtaattatccatgacgaaaagatcaaggccgccaaaggcctgtttaggaaaatgtatgagtgttatctgactctgctggacgtggacgtcaataacaatttctatagcaaggacgacttgattaacacctgtaataaaatgcagggctgcctggctgcaatacagtccattgaaagagatcgcaacctcgagcactaccaaaacatgatcaggtatatcagacggaaatatgatgtgccagtgtcaaaaaaatctataaatcggtga

SEQ ID NO: 10631 - RNA, 993 nt, unidentified
  source 1..993: mol_type = other RNA; note = synthetic construct
atggacttcgctaagtccaggttgtacggcgttagtaataagaaatacctgtcagaactgctgcagctggaactgaaaacgttaaaggatgtcgattctaattacgaggtggaaccattctttaaagaagtcaatgggaaaatcagagaactctacaacccctctgatgcccataagcgtgctctgaaaaatatcgttaagcgcctgtcgtatattgggtttccacactatatttacggcggaattcccctggtaggatacgtggataacgcttcacggcatctcgaaaaagagtaccttctccttttggacataactaacttctttccgtctactaaagactcttacgtctatgacttctttcacaatactatgtcccagcccgccgatatagccaaaattttaaccaacctcactacaatcaagaaggacgaagagcgatttctacctcagggtttcagcacaagtcccatgctgtcctttcttagctatcaccagatgtatgaggagctggacgtgttctcaaaacggaataactttacattcagcgcatactatgatgatttcacctttagctccgacaagtttatacatacgagcaagaggagagaggccatcgcgatcatagagaaatatggattgcaagtcaacaaaaagaagacacggctaacaatctgcaatcatacccgcgtgactggtgtgattatccacggcgacaccaagaaggcacctaagaagctgcacaagaaaatgtatgactactacaggctgttactcgacatggacaaagatccaacaaagtacacccaggatgagttcattgatacctgcaatagattgcaggggtgtattgccgcaattcaaagtatcgagaaggagcgaaaccttgaacattataaaaacaccctccgctacatcaggaccaagttcgacgtgcctgtagagaagaagaagaaacacctgtatttcaaaaacgtgcagatcaataactga

SEQ ID NO: 10632 - RNA, 999 nt, unidentified
  source 1..999: mol_type = other RNA; note = synthetic construct
atggaattcactaaaagcaagttgtttgggattagcaacaagaagtacctatccgagttactgaacgttgagcttaagaccatcaaggatgtcgactcaaattacaaagtggagcccttcttcaaagaggtgaatggaaagaaccgggaactgtacaatccaagtgaagtgcacaaaaaggtcctcaaaaagatcgtgaaactgctctcttgcattgagtatcccgagtacgtgtatggcggtattccaaacgtaggctatgtggacaatgcatccagacatttggaaaaggagtatctgctgttgcttgacataaccaacttttttccaagtaccaaagatagctacgtatacaacttcttctacaatactatgtgccagtcgtccgatatcgcgaaaatactcaccaatctcacgactgtgaagattgagaacggtgacgagaggtttctacctcaaggcttttcaacgtctcctattctgtcatttctcgcttaccatgaaatgtatgagaagctggagggcttcgcaaagaacaataaatttacattctccgcctattacgacgattttaccttcagctctaataaattcatccatgccaacaaaaggcgagaggctatagccatcatcgaaaaatacggactgcaggttaataacaaaaagacccggttaacaatctgcaattatacacgcattacaggggttatcattaatgggaatattaagaaggcccctaaaaagctgcacaagaagatgtacgattgttatcgcctgctgttgaacatggacaagtgcccggagaaatttactcagaacgaattcatcgacacatgtaataggttccagggatgtatcgccgctatccaaagcatagaaactgaacgtaaccttgaacactataagaacacactcagatatattcggaccaaatttgacgtccccatcgagaaaaagaagaagcacctttacttcaataacatcctgattgcagattga

SEQ ID NO: 10633 - RNA, 969 nt, unidentified
  source 1..969: mol_type = other RNA; note = synthetic construct
atggagttcaaggaaaagttcaaacagaagatagtgcaaatcaaacagtggctggactctctggaggctaaggcagataattatatatggctccagttcattctcatcattgtccggttatgtgatttcatcaaagtcatcagcatcatagccctggttatcaagtgttttctccggttgagttacatccttttgccctaccttattgagtttatcgagtttatcgagactctagcatccaccttctcatacaaacgcagatctttctttatggactttacgcaatcagtcctgtatggagtgtctaataaaaagtacctaagcgagcttctgcatctggaactgaagaccttgaagaacgttgataagtactatacggtgtatccatttgaaaagaaaactaacggcaaaacacgggaactgtacaatcccagcaatgagcataaacgtgcgcttaaaaggatgaccggtatgctcaacaagattaagttccctagctatctgtgcggagggattcagaacgtgagttatgtcgacaatgcctctcgacacctcaacaaggattatatgttactgctcgatattgccaacttttttccatccaccagagactcctacatttacgatttcttctacaatagcatgtcccagccttctgatatagctaagattttagtgaacctcgtgaccgccaaagttaacaaccacaggcatctgcctcagggctacagtactagtcccgtactgtcatttctgtcctatcacaggatgtaccaggaactttatgaatacagcttgcataattgcttcacattcagcgcttattatgacgacttcacattttcgtctaataatttcatccacccaaaccgccgaagagacatcatcaagatcattgagaaatacgactttaaggtgaactccaaaaagacaaaactggtaattgggaatcacgtgtcatccccgtga

SEQ ID NO: 10634 - RNA, 948 nt, unidentified
  source 1..948: mol_type = other RNA; note = synthetic construct
atggattttaagagatctatcctcttcggagtgtcgaataaaaagtggctggcagacctgcttaaaattgagaaatacaagctcaccaacatctcttccaacttcataggtaaatctttctttcgggaagtaaacggaaaaaccagagagctctataatgcaggtctgatccataaaagggtcctgcgtcttatcgtgaaatacctgcagaaaatcgatgttcccgcatatctacacggagggatacccgggagaagttatgtcaccaatgttgagatgcattgcgaaaataacttcgccatcattgtggatataagtgacttcttcccttccacaagcgcccagaaggtgtttgatttctttaggtacgacatgaatcagagtccagacatcgctaaaatcttgaccgatttgacaaccgtaactaagtatgagaagtcatttttgccgcagggctacccaacttctcccattctgtcctactttgcctattataacatgtacgaaacgcttatgaggtacgcccaagctaatgactttattttcagcgcctactatgatgacctgacttttagctcaaagaagcctatacctaaacgatgtatgaaccgaattatcaagattatcgagtcccacaagctgaagattaacaaaagcaagtcaaagatccggaggattaacaatgtgaaagttacagggtgcattattgtgaacggcgagttaaaggcgccacgcaagctccagaaggagacatacgacctgtatatgatcataaagaatgacgtgctgagcacgaacgacttatcacggatgcttaagaagttcatcggcaaaatttccgctattcaaatgatcgagaagaaccgcaaattccccaattacatgaagctaatcaaagataagcaggccgaactggaagaactccgcgtcgagaaagcgaaagcttga

SEQ ID NO: 10635 - RNA, 951 nt, unidentified
  source 1..951: mol_type = other RNA; note = synthetic construct
atggatttctcaaagtctatcctctacgaaattagtaacaagaaatggttagccgaacttctcaagatcgagaagaacatgctgtcaaatgtaggcgacaatttcgtcggcaaatcctttatgaaagacgttaatgggaaaacaagagaactgtataatgcaggtaccattcataaacgctccctaaagttgatcgtgaaatacttgcaaaagattaacttccccacctatctgcacggaggaatcccggggcgtagctacgttactaatgtcgagagccattctaagaataaattcgcggtgatcgtggacattagcaacttttttccatccacaaacgcccagaaagtgttcaactttttcagatacgatatgaatcaggctcccgacatcgccaagattctaactgacttgacaactgtgtctaaagatgagcactcattcttaccacaggggtatcccacgtcccccattctgagttttttagcctattatcacatgtacgagaaccttatgaaatatgcccagaacaacggcttgacattttcagcatattatgacgatctgaccttcagtagcaagaaacctatccctaagatatgtctgaaagagatcgtgaatatcattgaaagctttaacctcaaggtcaataaagagaagtcgaaagttagcaaacttgattacaccaagattaccggatgcgtgatcgtaaagggtgaactgaaggctccaaggaagctgcagaaggaaacctacgacctgtacaggtacctcaagaattctaatctctccgacgaggaactgctgagcctgctcaagaagtttgcaggcaaaatcagtgctatacagtctatagagaaggagcggcaattccctaactacttcaagcttattgagaacatgaaatcggagctggaagaacgacggatatccgagctcgattggctgtga

SEQ ID NO: 10636 - RNA, 936 nt, unidentified
  source 1..936: mol_type = other RNA; note = synthetic construct
atggactttacccgcactattctctacggtgtcagtaacaaaaaatggctcagcgaactgttaaagatagagaaaagcaagctgaagaacatccgaaacaacttcaacacggtgcccttcgtgaaaaaagttaacgggaagaatagggagctttataatgccggcaaaatgcacaagctcgtcttaaagaggatcgtcaagtatcttcagtctattgatatcccaaactacatacatggaggcatcactggaaaatcatatgtcaccaacgttgaatcccacaagaagaatcggtacggcgtgattattgacatcagtaacttttttccctcaacggacgcacagaatgtatacaatttctttcgctttgacatgaatcagtccaccgatatcgcaaaaatcatgacagatctgaccactgtgtctaaagggaataaatccttcttgccgcaaggtttcccaaccagccctatattgtcctttctggcctatcataagatgtacgagctacttaataactatgcgaaggtgagagacttgacatttagtgcttactacgatgacttgactttctcttcccgtaaacgcatttcaaagcggtgccttagggagattgtgagcatcatcgaatcgaacagcttggagattaatctcatcaagagtaaggtaagcaaactgaattacaccaagattacaggctgtgtgatagttggcaacgagctaaaagctcctaataaactgcaaaaggagacacacgacctgttcctcaagatcaagaatggaaacttatcagagacagaactgtctatcctcctgaagagattcctggggaaaatctccgccattcagatgatagaaaaaaaccgaaagttccccaactatctgaaactgattgaggataagaagcgggaactgatgtctaggagaaatgattga

SEQ ID NO: 10637 - RNA, 975 nt, unidentified
  source 1..975: mol_type = other RNA; note = synthetic construct
atgtatattcaaggaggaatcttcctttttcgggagagcttcttatatgagctgtctaacaagaagttcctctccgagattattcaggtcgacctctccgtattaaagaacctggaagatctgctcgaaacggagaagtggaaaccttacaagttggagaataaaaaacgcgatctgtacaaccccacagtgcaacataagcgagcacttaaaagactggttcgttccctttactccatcacttaccccacatacttgtatggcggtattaaaaacaaatcttacatcgacaacgccgccattcacaagaataacaagtatttcctcatcgccgacatcgagaagtttttcccatcaactcacgagagctatgtatacgacttctttaggaataagatgcagatgagtatagatatctcgcggatcctgactcttctagtgacgtatcaacatgaagaggactcttatcgatatcttccgcaggggttcccaacctcacccctcttgagctttctggcttacagcgacatgtttaaagaactggagcagtttgctgagacaaataatctggtgttcagtgcgtactatgacgatctgaccttttcatccgccagtttcatatccaagcacctgaaaagagaactggctctaatcttacggaggtacggcttcaatctgagcacagagaaaacccgttttcagaagaggaaggccaacaatataaccggtgtgatagttaccaaggatggcctcaaatctccttacaagctaaccaagaaactgatgcgcttgtctagtgatctggataacaacttgaaaaatagcagcctgactaaggaagaaatcattgtccagctcaggcgcattcgggggtgcatcattgcaatccagtcagtggacccttcgagaaatctccaggtgtacgaaaagcagattaacgaggtcaaaagagttcatgacgtgacattttcttga

SEQ ID NO: 10638 - RNA, 1158 nt, unidentified
  source 1..1158: mol_type = other RNA; note = synthetic construct
atgaaaactcgcaacgaggtcaagaagacaagagggaaacacagaaaacagttggcacagtttaccttatgcaacatagtcgtgaactttttgatggactttaaagatgtgctcgaatctcttagagccgtattccgcttggtgagtttcgtagtggacagccttcagtattggatcgatctcctgtacagtctgctgttctacttctgtgaagtctacaagatgaactattcaacaagtccactatttgaagtgagctccaagaagcgactctcgtatctgctcaaaaccgatatttccaagctcaaacaagccgacatctccttttctgcgccttacttctcaaagatgaaaggaaggaaaactcgacagttttttaatccaactgacacacagcggattactataaacgctatcaagaattgccttgagcaaattgagatccccaattatatctacggcggaatcaagaatcgttcctacatcgcaaatgcccgtgttcacgagaatgctaagagtctgatcctgatcgacctcaaaaacttcttcccgagtacaagcgactcctacgtctacgatttcttcaagaacaaactaaatcagcctgccgacgtggccagaatacttacaattatcacaaccgagtctggcgaccatggccggtttataccccagggatatagcacctcacctctgatgagctttctggcctacgaatctatgtaccagcagctgaataatctggctaatcaacaacagctccacttctcagcatatttcgacgatatcaccttcagcagctctaaatacatcaacaaggctgtggaacgcagcgcgaagaaaattgtcaggtcatttggtctgcagattaatcaggagaaatccaggactttatttaacaacgcttccaaactgaccggggttgttattaccccaacgcaaatacaggcatctggtaagctccataagcagatgatcgataacttcgacttactgttgaactcgttgtattccaacagtaagcccagcaagaaggatcttctgaatctatgcaacaagacccaggggtgtattaattctattaaggccatcgaagagaacagggatctgtcatattatacgaataaggtgaaagaggtgcggcggctgattaaatga

SEQ ID NO: 10639 - RNA, 948 nt, unidentified
  source 1..948: mol_type = other RNA; note = synthetic construct
atgattctcctcaaatataccaatagctcactatatggcattactaccaagaaacatcttagctacatcttgaaaatgaacctgggatcactctccaacattgaacccttattttgcgccaatagcttctccaagaaaaagaacaacaaatctcgggaattttacaatccgaccctggaacagcgggcagtattaaaccgaataaatgtggctctgtgtcaaatcggggctccaaattacgcctacggagggatcaagggtcgttcctatatcgacaatgcaaaagtgcacagcggtcagaaggcgttgtttcttatcgacatttcgaatttcttccctagtaccagggataaatacgtgtacaagttcttcaagaacaagctcgcaatgtccacggacgttgcgactattctcacactggtggtaacggagaagctgttcgattccgacaaacgctttctgccacagggctatcccacaagccctctgctatcactgtttgcctacattgagatgtttgaaagcatcaacaagatcgccatcaacaatgatctcaagtatacatgctactatgacgacttaactctctcttcaagcagttacatagacaaaaagatccttagacaagtgaaaaaagagatttcgagttatgacctgaaggtgaacgatttcaaaacccgcgctctttttaataaagcctctaagctgacaggcgttgtcgtgtctcctgagaagatagttgccccagggaagctgcagctgcagatgatcgacaatttctccaagttgatggatgctatttactctggcaaaatgaccactaagatcgagatcaacgaattgtgtaacaaggtccagggatgcctggcatccattaagagtatagagcccgatagggatcttacctattacgtcaacaagctgaaaattatcagacagatgttgtga

SEQ ID NO: 10640 - RNA, 957 nt, unidentified
  source 1..957: mol_type = other RNA; note = synthetic construct
atgaactataaaaatagcaatctctactccgtgcagtcaaaggcaaaactggcccggctgctgaatattgacgcaaataagctcagagcggttagagaaaacttttccgtcgatgcatttgtggtcgagatcaacggcaagaaaagactgcttcataacccgtcatactgctacaaacagatcctcaaacgtatgcttttattgctctaccccattggcgccggagattatgtttttggtggcattaagaacagggactacattatgaacgctaaagtgcacaaaaacaatacatacttctgtctaatcgacatcaaagacttttttccctcgaccaactctgattttgtctatcgcttcttcaggtataagatgaatatgtccattgatgtggccaagatttgcacacttctgacgacagtttcaaattctgagacaagcaggccagacaatttaccacaagggtttcctaccagtccttatctatcctacttatcctatctggaactgttcgagcagttgaataacatctcgatatcaaagaacatgaacttttcttgctactacgatgacctgactttcagcagcccccgcttcataagtaaggggaccaagcgagacattatcaaactgataaacagctatcagctgcaggtaaacagttccaagacgcgactcctcaaaaactctaacggagtgaaagtaaccggtgccgtcatccgggacaaccagctgttgacccctaattctctgttccttaagctgtacaaggaatacgataatctcctgagcgagttctatttgaatagcttcgaccagaagaaaatccttaatatgtgtgaggtggtcgatgggatcctggcttccgtgactcggatcgaattgactgaaaatgccgagtatattaagaacaaggtgcaaatcatacgcgagacttctaatgctaccattagttga

SEQ ID NO: 10641 - RNA, 957 nt, unidentified
  source 1..957: mol_type = other RNA; note = synthetic construct
atgaatttcgagaagtccatactttataacgtgcagagcaaaaagcacctggctaacctcctgaggattgatgctaggaagctcaaagccgtacgagaatacttctctgttgagcccttcgttgctgaaatcaacggtaagaaaagactcttgtacaatcctagctactttcacaagcagctgctgaagagaatgctgctactgctgtaccccattggggcagcgaattacgtgtttggcgggataaagaatcgcgattatattatgaacgccgaattccacaaaaacaacaaatgcttttgtctgatcgacattaaggacttcttcccttctacatcttcggacttcgtgtatagattcttccggtacaaaatgaatatgagtatcgatgttgccaaaatttgtaccctactcaccactgcatcatcgcgcgagacaaacaaactcgactacctgccgcaaggatatccaacaagtccatatcttagttacttgtgctatctcgagttctttgaacagttgaataacatcagcgtatctaagaacattaccttcagttgctattatgatgatcttacgttttccagccaacattttatatccaaaggtaccaagcgcgacattattaaattgatcgagtcctaccagtttcaggtcaataaagataaatctcggcttctgaagaactcaaatggcgtgaaggtcactggcgctgtgattagggatcataagctcctgatccccaatagcatgcatttaaagctgtataagacttacgacaagctgttaaatgatttttacctgtcctcatttgaccagaccaacatcgtgaatatgtgtgacgccgtcgacggaatattagcctcaatcagccgagtggagagcatcgaaaacatcaaacacatcaagaacaaggtccgtatcatccgggagatatccaatgcaattacatcttga

SEQ ID NO: 10642 - RNA, 1041 nt, unidentified
  source 1..1041: mol_type = other RNA; note = synthetic construct
atgagccttcagatctcacttgcgctcgctttcattatcctcttactggagaaagaaatagaaaactacatgaacttccagaactcgattttgtacgggatcaaaactaagaaggaattggcaaaactcttagacattaacaagaagcttctcaatgacgtgaattatcacttttctacgaaaccattcgaagccaatatcaacggcaaaaagcgaatgctgtacaatcccaatgatatacacaaggagattctgaagaaactgatcgagctgctgtcaccaatcaaggctaaggaatacgtatttggtggaatcaagaaccggagctatataatgaatgccaccctccataaagattctacctttttctgcctcatagacattaaggacttttttccttccaccaaagagaagttcgtctataacttcttttacaacaacctgaagatgtctagcgatgtcgccaaggtatgcacgttactaacaactgaatatgatattcagcagagaaatcgtcatctgccccaaggctatcctagtagtccttatctctcctacttgtgctactttaaattgttcgaggaactgaatgcaatttcaatctccaagaatctaatcttctcctgttattacgatgacttcaccttttccagtaagcagagcatttctattaagaccaaacgcgagattatgaagtgcatcaagaaatataacctgactgtgaataccgataaaacgaaattggtgaagaacaaaaacggcatcaaaattacaggtgtggtgatcaggaataatgatgttatacccccgaataagaatctgcacaaactgtacattggatttaaggagcttaagataaagttcgagaacgatttctttgagaaagacgaagttctgaaactttgtgagaaggtgaaagggctgtacgaggccgtgcaaaaaatcaagtttaataacgacctgacgtatatggtcagctacatcaaggacattaagatcttctacgagaagaacaaatcaatcaaaaacaagagcgactga

SEQ ID NO: 10643 - RNA, 954 nt, unidentified
  source 1..954: mol_type = other RNA; note = synthetic construct
atggtagattttaaactctcaaagctgtacggcatcaataacaagaaatacctatctgagcttctgaaagtggagctcagcaaacttaaagacattgagactcacttttctaccacccccttttatcagaagaatcagaaggggaagaggagaagactatataaccctcatcctgactataaaaaagtgttacagagactgaacatccacctctcacggatcgttgcccccgactatgtgctgggcggcattaaaaagcgatcttatgtcatgaatgcgaacttgcataaagagaatgattatttcctcctgctggacctgaaagattttttcccgtccacaagagataatcatgtgtactacttcttccggaacaagttaaagatgtcccaggacatcgcaaagatatgtacattgctgactaccgagccaagcgaagataggacctttaggcaccttcctcagggttattcaaccagcccttacctgtccttccttagctatttcgatatgtacaacggaattaagaacattagtgacaaccagaacattatcttcagttgttattacgatgacttgacattctccagtaagaagcgcatctctttcaaatttaaggagacgattagcaacattgtcgcagactaccacctgaccattaataaggacaaaactcgcttttacactaagaaacgcaaggtgatcaagatcacaggagccataattaataaggggcaactgttaaaagcccccaattcgttgcaaaagaagatgtacatctacttcaaagagctgactcagaaaacacagcagaggccagttgaaaaagaacacataatcaagctctgcaacaaggtgatcggttgcctgacggctattcaacacatagaacccaagcgtgaatttccacatatccgaaaaaaggtcaaggagatccggaaagctctccggtga

SEQ ID NO: 10644 - RNA, 948 nt, unidentified
  source 1..948: mol_type = other RNA; note = synthetic construct
atgaattattcgactagtaaactgtttggtgtaacgaataagaagtatttgagcgagttgctgtccatcgatataaacgaactcaagaacattgaggagttctataacacaagccccttcaccaaaataatcaaagggaaagagagaaccctctacaatccacctttcaagtataagaaggtgcttaacaagataaacatctacttacagcagatcacacctccgagttttgtgttcggaggaatcaaaggcagatcatatgttatgaacgcgactctccacaaagatcatagcaacttcctgctgctggaccttaaggattttttcccctctacacgggacttctacgtctacaatttctttaagaacaagcttaggatggctacagacattgctaagatttgtaccctgcttactactgtgaagctcggtctaaatacccaggagaggaatctgccacaaggatttgcaacctcaccttacttatcttttctgtgctattacgacatgtacaacagcatctacaagatatcaaaccacaaacagattgtgttcagctgctactatgacgatctgacgttttcctcttccagttatatcagcaaggggttcaaacgcaatattgtcaaagtgataaaggagtacggcttggttgtgaatgacaaaaagacccgactattgtttaataagcacggcatcaaaatcactggcgccatcgtcaaagataactctttgctgtcaccaaacaacacacagctgaaaatgtactcccattttgaaaagctgatggtcctctactccaccgaccccactaaacagcaagaaattcttgagctctgtaacaaggtgaatgggctgttaatcgccctgaaaattgtagaaacaaatcgcgatctcgggtatattaagaataaggttaaggaaatccggaaaaccattaatggctga

SEQ ID NO: 10645 - RNA, 951 nt, unidentified
  source 1..951: mol_type = other RNA; note = synthetic construct
atgctgaatatccaactgtgcaagctgaagaatctgaagtccaaaaaaatgctgagcttgtacctacgcatcgagctgtacaagctcaaagacattaccaaacactacagcactgccccatttgagaaagagttcgataatggtaagaaacggatgctgtacaacccaaacaaggactataaacaggtgctgaagaggatcaatttaattctgcagcagatccccatccccaattatgtctttggagggatacgggagagagactacgttcaaaatgccacggtccacaaagacaacaatttctatcttctgatggacctcaaaaatttcttcccctctacctccgattcgtacgtttacgacttcttcaagaacaagttaggcatgagtatggataatgctaagatcgtcactcttctagtgacagtgcctaacgaagggaattcagggatcaggagcctccctcagggcttttctacatcacctgtgcttagctacctcagttattcagacatgttcgaaaagatccatgatctggcagtctctcagggcataaagttcagctgctattatgatgatttgaccttttccagcagtaacatgatcggcaaatcttttaaaaaccgcgtgattgagatcgtggaacagtttaacctgaaggtgaataacaagaagacacatcttacacgaaatataaacggaactcggattaccggaaccatagtaaaaaataacacgttgtttgctccaaacaagctccaacgcaaactcactgaaaagttcaacgagctcgagaaaatggaacaggttgacattttaaacaagagggaggtgattcagctgctgtgtaacacagttcagggttgttgctccgcgattatgtccgtagagcgaaccagaaagtttccgcacatcttgagaagggtcagagaaattcggcgttcagtgtga

SEQ ID NO: 10646 - RNA, 945 nt, unidentified
  source 1..945: mol_type = other RNA; note = synthetic construct
atgatagactatacagtgtgtacgctgtatggtgtcaagaacaaaaagtacctctcagaactgctcaagattgagctctttaaacttaaggagatcgaaaagtactacattactctcccattctccaagaaaatgggaaacaacaaaattaggctactgtataatccctccaaagagtacaaggacattttaaagagacttaactacttcctgcagaaaattgtgttgcctgactatgtttttggggggatcaaaaaacgggattacatacagaatgctagcaaacacaaagacaacaagttctttcttatcatagacttgaaggatttcttcccaagtacgtctgacacctatgtgtacaacttttttaagaacaagctgaacatgtcaatcgatgtcgccaagatatgtaccctgctggtgactgaacagagtgagatcaatacccgttatctgccgcaaggatatagcacatcacctattctttcctatctgtgctacttcgagatgttcaatagtattaatagcctgagcatcaacaacaatatcacctactcttgttactatgatgacaataccttctcatccaaaaacatcatcatcaaggatttcaagaacaagatagttgagatcatcaaatcttacaacctgcaggtaaatcccaaaaaaactatcctgctgaagaatacaaagggcgttaggattaccggcacaattgtcaataacaatatattgagcgcacctaatcccttacaaggcaagatgtacatcaattttaacaagctcgtgaattctgatctaactgacatgaatgaagcgaagaacatcatcaaattatgcaacattgtgcagggttgcagtagcgccattaagtcgatcgaacgccagcgaaaatttccccacattctcaagaaagtaaaggagattagatccttgatcaaatga

SEQ ID NO: 10647 - RNA, 954 nt, unidentified
  source 1..954: mol_type = other RNA; note = synthetic construct
atggagtatcagaaatgcaagctgtatggaatctccaacaagaagtatctctctgagttgctgcacatcgatgcattcaaactgaaggacatagatagacatttctcgactgacttttacatctctaaaagccgaaataaagagcggcacatttacccccccaaaccctactataagaaggtactgaaacgacttaattggtacctcagcagaattgccgtgcctgattttgtgaacggcggcattaaaaataagtcctacatcatgaacggtctgtatcacatcaacagcaatcattttctgctccttgacatcaaaaatttctacccatcaacaagcgattatttcgtgtacaggttctttaagaacaggctcaacatgagtaccgatatagccaagatttgcactctgctggtgacagagccccacccaatgcacgacaactaccgccatctgccgcaaggctatcctacttcatccctgctgtccttcttggcctattctgacatgtacatacacttatacaactacgcgatgttgaacaacattaccttcacatgttttgttgatgaccttacgtttagctcagatgactacattagtaagagtttcaagcggaacatcaataaaattgtccgccagtataatctggaaatcaactctgggaagacaatgcatagacggatcaataaagggatcaacatcaccggtacctacataaaagagaataagctattcgctcctaatcgtcttcaaaaggacatgagcatagccttttccgaattatgtgcagcttatgaggccaacccaaaggacattaatcagctgaagctcctatgcaatcagttgcagggatacatcgtgaacgtcaaactcattgaagaagcaaggtcattagattacatgcagaatatgatcaccaaagttagacgctatattaagaataaggcttga

SEQ ID NO: 10648 - RNA, 960 nt, unidentified
  source 1..960: mol_type = other RNA; note = synthetic construct
atggatatcaataactgtaagctgcagaacatcagcaataagaagtacttctcagagctaattcgaataccactcagccatctcaaaaatgtccgtaagtattacaccaccgtcccatttacccagatgacgcagaaaaataaacctcgaaccctgtataacccctctaccgaacacaagcgcatcctcaagtccatcaataggcacctgcagaagatcattattcctgaatatgtgattggcggagttaaaggtaagagctacatcaacaatggagaaatccacaacggccaaagttttttttgccttatagacttcaccgacttttttccatcgacaaatgagaaatacgtctacaacttcttccggtacaaattaaataactccgtggacatcgcgaaaatcctgactctgcttgtgacagagacttcacccagtactggggtggatattctgcctcagggctatccaacatctcccatcctaagctatttaagctatcacgggatgttcagtaaactcaaaatactggcagatgccaacaattacaaattttcctgctactacgacgatgttaccttttcatccaacacattcattaacaagaacttcaagaagcaagtaatcagagtcactagcgattatgggttgaaagtgcatcctcagaaaagtggcatatacatactcaagaatggaattcggatcacagggacgattgttagaaaagagggtctttatgccccgaacaagttgcaactgaagatgattaaccagttcaaggagctggaacagaaggctaaggtgtctgcagaccatgatgagattataagcctgattaatagggtacagggcactgtgtccgctatcaaatcaatcgaaaaagacagatccttcccccatattacacggcgcttgaaggagatcaggcactcttctaagattaacaatatcgccaagtga

SEQ ID NO: 10649 - RNA, 930 nt, unidentified
  source 1..930: mol_type = other RNA; note = synthetic construct
atggattactcgagttgtaagctatacaaaatcgagacaaagaaatccctgtcgtatattcttcagactcccaagagttcactcaaaaacgtaaacctgtgctactacccaaaggtgaatatcttcaacaaaaacactagttcaggcaaagtgaggacgttctacaatcccaccggtgaacataagaaagctctgcgcaatatcaatcgatccttatcagtacttccgataccgccatatgttattggggggattaagaaacagtcaattatttccaatgcctctaagcatatgagtagcagattctttctgagcatggacatcaaagacttttttaatcacgtgcctcagaagtacatctacagctttttcaagaatgatctcaagatgtcaatcgatagcgcaaagatttgcacgacattggtcacctacgagatcgataaccactctatattgccacagggatatcccacttcccccatcctctcttacctgaccaataaaaagatgtttgacaagatctctcagcttagcagccagaacaacattattttctctctgtatgtcgacgacctaacatttagctcccccaaccctatctctaaaaaattcgaaaacgaggtcagaaagatactcaatttctatagctacaaggtgaattccagtaaaaccaaacgtcagtatatcactaagccagttctgatcaccggagtgattatcaacaatggcgagctgttacctcaaattaagcatacaaagcaaatgatcgactacatacacaacataaagagcagggatttgcacgaggtgaatattgattcctgggggaagaaaattcggggatattattactaccaccaagccttcgaatcctattctggtataaaattccctcagatcaagaactttctgggcaactataaaaagtga

SEQ ID NO: 10650 - RNA, 1029 nt, unidentified
  source 1..1029: mol_type = other RNA; note = synthetic construct
atgttcatcgacgagaagaacagcctagccaacttgcagaaaaagaccaagttggccaagattttaaattgcgatgtggaatacctgaagaactttagcgattattcagaggtgaaatcctttgataagcgcgtaggtcccaagacaagacgacttttcaacgcagatcctaatcacaagaagattctccgcaaaattaacaaactgctgctcagcatgaatatccccgattacgtttacggaggaaggccgaacagggactatctttcgaacgcgtttctgcataagaaaaatccctatatccagacagctgacattagatcttttttcccatctacccatgaatcctacgtctacggcttcttcaagaataaacttctcatgtctgaagatgtaagtaagattctaaccgatctgactacctattcaagctccgaaagtcctcactaccccgagaaatcattgccacaagggttccctacgtccactatcatgtcttaccttgcttacttcgatatgttcaatggcatctataagcagtgtcgtgacaggaatattcatttttcactctttgtggacgatatgacttttagttccgacgtcaaaataccaaaatcttttatcaggcacatcaacaacattgtgacccaatatgacctgagcctgcatcccaataaaatccggcgcttttctgttgatcagccaaaactggtgaccggtgtcatcattgaccccaagacaaataattttcacataccgaacaagctgcataagaagatttacacaaacatccagaacttccacagcttgaacgtcaacacatacactgactacgtgaatttaaagcggatcatactgagcctcaaaggccaactcgcctcctgctcccggattgaccaggagaaaactttcaatcacatcatcaaggtcatacaggacgtggagatacactttatcgttccttcagtgaaaggggccacgcaccgacagctgtatgaagagtatattagtttcgtgagtttcagatga

SEQ ID NO: 10651 - RNA, 1017 nt, unidentified
  source 1..1017: mol_type = other RNA; note = synthetic construct
atgctgatctcccagccacacagcctttttgaattacacaacaaacggagactggcatctctgctaaagacggacgtagagaatttcaatcgtatcgaagagagatatacagtctatccttttaagaagaaggtcggtaagaaagtgaggactctctttaataccgatcagcactacaagtcccttctgcgtcgcttgaacaagatgctttgcaagacgaatatccccgattatgtgtacgccggcatccccaagagggacttcttggacaatgcgctgattcatcgccagaagccttatattcaaacagccgacatccagaatttttttccatcgactagagattcttacgtgtacgggctgctgctccataagttccacaccagccctgatgtcgctaaaatcattacacagctgaccacctacccactcgattcaaagactgcattgcgacacatccctcaagggttccccacatcaactatactgtctttcttatcctacttcgacctatttaacggaatttataacctctgcaaacagaacgatatccattttacgttgttcgtcgatgatatgacttttagtagtcacaaaaggattcctaagtcattccttcggcatattaatagcattgtgaagaagtacgacctgcaattacacccgtctaaaattcataggatgaacccctacaattacaaaaccgttactggtgtcgtgatagacccatgtacaggacttctgaaggctccaaataagctgcagcggaagatgttcaacaactttaaagccatacacaactacagcattaacacattcaatgactatatccagttcaaacagctggttctgaaactcgagggccaactcaaaagcataaatcggatcgaaccgaacagacagatgccctatataaccaccgtagttaaagacatcaaacgcaactttatcacccattccgtgaaaggctcatcccgagacgtgctcaagagtgagtatgagttctttgtgaaatga

SEQ ID NO: 10652 - RNA, 1266 nt, unidentified
  source 1..1266: mol_type = other RNA; note = synthetic construct
atggatgacaagtccattggtagggacagaaatcattacctggaaaccaggccctcacgcaaggagaaacacggaagaaagaaaactaagctgagaagcgtactgatagacgtgttcatccggaccctcctgtcacgtctgtttaccgaagtcttcaacattgtgagcaggtttgtcttacgaattattgacatgatctcgaacctgctgtaccagaaaaataaagtgatattcatgcggatccctgaaaaccacgcgttctaccagcttaagagtaaaaaacggcttgctgctatcctcggcattgattcaccagctttcttcaaacacctcgacctgcatttcacctgtacagaatttagtctgacgaagaacaataagacacggaccctattaaatccgtctaagcagtacaaacgtatactccgaaaaattaatcagctcttgcaggggattaatttccccacatacctgcatagcggtgttaagcagaaaaacgccctgtctaatgcatgttatcacaatagccatagtcacatatgcacgatggatattaaaaacttcttcccttcaacttctgaggcctttgtgtataagttcttcaaagacaagttcaagatgtctgaggacgtcgccaaaattatgacattgctggtgacgtataagaacgagaacgaagtcgcccgcttaccacaaggatttccaacttcctccatcttgtcatatttggtgtacttcgatttctttaacggcgtgaatgccctggcccatagcaggaatatgaagttctccatatacgtggatgatcttaccttttcctctaacagagcatttactcccagttttctgaaccgcatcgtcactatcgcacaacagtatgagctaacaatccatcccgacaaaacacagttttataaccgacatgcgcacaagaagattactggagtgatcttgaagcaggagactgttagagctcctctctttatccacaaacagatcaatcagcactaccttgacatcctggactgcgatctgctaaccttttccaacttcattaagttcaagcaaaaggtgatcaagaccctggggcaaatccagtacgtacgctccatcgaggggacccacaaatatattagcatcgagaggaatctcaacgatttcaaagaacacttttctgttctcagcgttaaggataagtaccggatacagcttaaacaggagtataagcattttcaaggcatgtttacacacagtattatcttttga

SEQ ID NO: 10653 - RNA, 1053 nt, unidentified
  source 1..1053: mol_type = other RNA; note = synthetic construct
atgttgaatcaggggtaccctaagcttaatttatacacaaagaagcagctggcagacgctattcgggggaaagatctttctttcgattctgccatgaaactgatcgatgactgcctgatcaacaaagacaagtattggagcgacaacagtgaggaaagcaagtccaacgagaataagtgggtcagaaatgcctcaggtacccccctcggcaagctgcaaaagcggatagaccaaaaggtactagccctacacgacagcgaactccccatttttatttacggcggcgtggggaaaaaaggaatcaaaaatgccgttatcgcactccagggcaagagaaataagagaactctgctgaagctggacatgagccattttttcgagcacatatcttatggggacgtaatcaaaatcctggtgtgccattgtgggtgtggcaaagatgtggcccacattatagcagaaatcgcgtgcattcagagcggaaaaaagtcaagtaataacaccaacgagaaagtccttgctaggggcttctcaaccagctctcggctcgcagtgtggcgcaacttatctctttttcgttccttattctactgtatggctaagcgccttaataagcacgatccacgcatcgctgtctatatggacgatatcggtatcaccgcctcgcggatagatccagtgtcgctgagcagtttgtataaggatattacgaagctgattgagaattcctccaagctggtcgtgaacaaaaacaagactaagatcatcgattacctccagcatgaatatgacgttacagacggacatctgctcgaggacaagatagcgcagtttgaatttctgggtattggaatcggccgaaaccgactgtaccctggagtgaagattaggtccaaaatggctaaattgatcaaaaagagtcacctgtccgatgaggagctgagaacattgaaagggcagaaaaggtacgttaagttcattactggcaaaaaactaggtctgcccccgaacgatgcctcattgaacaggaagggactcctctggcaaaattga

SEQ ID NO: 10654 - RNA, 996 nt, unidentified
  source 1..996: mol_type = other RNA; note = synthetic construct
atgatcaaccagggttatcctaaacttaacttgtatacccggaaacagttagccaacgctattcgagacaaagatctgtcctttgatgccgccatgaagctcatcgatgattgcctgataaataaggacaagtactggtcagacaatcctaaggagtccaagcaggatgatgacaagtgggtgcggaacgcttccgggactcccctaggaaaattgcagaaacgcataaatcaaaaggttctggccccccacgacagtgaattgccaatttttatctatggtggagtggggaaaaaaggaatcaaaaatgccgctatcgcactccaggggaaaaacaataagcgaactctgttgaaagtagacatgagaaggtttttcgaacacatcacctatgaggatattgtgcgtacactggtctgtcattgcaactgcggcaaggacgtagcgcagataattgcagagatcgcttgtgtgagaatggggaagaagtctctcgataatacgaacgagaaggtgcttgcgcggggcttctcaacttcaagcagactggctgtgtggtgcaatctgatcctgttcaggaaactcttttactgtatttcgaagagactgaagggccatgatcctcgtattgcagtctacatggacgatattgggatcaccgcaagcagggttgatccggccatgctgagtagcttatacaaggacattgtcaacctgattgaaaacacctctaaacttgaggtcaacaaaaacaaaacccgcatcatagactatctacaacgggagtatgacatcatcgacggtcacctgctcgaggataaaacggcccagttcgaattcctgggcataggaattggaaggtctagattatacccaggcgtgaaaacacgctccaagatggccaagcttatcaagaaacccaatagtagcgacgaagagcgcaggacactcaagggccaaaagcagtacgttaagtacatcacatctaagaattga

SEQ ID NO: 10655 - RNA, 1002 nt, unidentified
  source 1..1002: mol_type = other RNA; note = synthetic construct
atgaacatgatcaattatcccaacttcaacataagatcaaagaatgagatcgccaaacgcatcagtagccgaaagcttccccagtccgaggcgctggctctaattaacgactgcctggtggacttcgatagtctgtgggtcgataacttgaagatgtccgagcctggaaaaaagaagtgggtccgcgacgccagccgcactaagcttggcaatctcttgagtcttattgacaaacggatttttgccccatacgataccaagctgcctagctttatacatggcggagtggccgggaaaggagtgaagtcagctgcatctagcttgctggggaaacgcaggaagcgtatgttactgaaagttgacatgagtcggttctttgaacatgtatcctccgagaggctcaaatatgctctcatccacaaactgggcttctcaagagaagctgccttaattatatgcaaactgtgctgtgtggatgcagggccgaagaatgggttggaaaaaggtaagaccatcgctcggggattcgcgactagcaaccgcctcgcaatatggtgtaaccttgagttattttaccggattaagtggctcaccgaaaagaggctaggtagatatgacgccaggctggcaatttatgtagacgatatcggtatcacagcttctcgaatcccacctaaaactatggcaaacttttactccggattgatcgtgctggttaacaaatacggtaatggacttgagatcaatcacggcaagaccaggattatcaattacctgggcaaccagttctctgtcaatggggaacccgccgttgataacggaggctcgccagtcaaggggagctatgaggtgctgggcatccgtatggaaaggaatagagtgacagccggccggcgaacaattgggaagattcaatcactgaaatctagaaagagcctcacgatcccccagaagaagtccctcaagggcctggagaaatacaaaagatacattggctcttga

SEQ ID NO: 10656 - RNA, 1005 nt, unidentified
  source 1..1005: mol_type = other RNA; note = synthetic construct
atgaaaaaaaaagacaacccactcattccaatcaacataaggtccaagaatgaacttgctaagcgcatcagcaacaagtacctgtccgttaaagatgccctgaccctgattaacgaggtgaaaaacaactttgatgacctttggaaagacaatctgaaagacagtaagccggaggaaaataagtgggtaagaaatgccaagggcaccaagttggggaccttgcttagcctaatcaataagagactgttcgcaccttatgataactatctgccctgtaacatattcggtggtgtcagtggaaagaatacgaagtcagctactctccacctgctgggaaataaacggaaaaggacgctgctgaagatggatctgcatcgtttctttgaacagaatgactatgagaaggtgttggatttcttccataaaaaagccggttgtagcttaagaatgagccacttttttgccaccatttgctgcgtccctcttggacaaaaggggactttaggaactaagcgggttattgcccgtggtttctccacttctcccaggttggcaatttggtgtaacctccagattttcaagcagatagaccgcaaatcacggtctatgctgaaagggttcgaccccagggtatcattttacgtggatgatatcggcatcacagcttcaagagtgaacttgaagaagatgacagacgtcttccactgtgtgaaatctctactggacggcagtgggaattatcgacttgagctcaataccaaaaaatgctttatcgtggattacctcaacaatacttacgacacaaatggcgaatatatcgggaaaggccactttgagcacctcggcaacgaactgatgcggaactatgtgacacctggaatcaagacaatgtccaagctcaggtccgatgaggcgaagttaaaagctctgagcggccagaagtacaagcgctgcctaaactcgattcgagcacgcaagagatacgttcattacaccaagtcttga

SEQ ID NO: 10657 - RNA, 1005 nt, unidentified
  source 1..1005: mol_type = other RNA; note = synthetic construct
atggccctcaaaccaaacaactatcctgcaatacgcatcaggagtaagaacgaattagccaagcagatttcctctatcaagaggaacccgtccagcagtttgaagctgattaacgatgtcgtgggaaattatgataactattggaaagaccatcccaagcttagccaacccgagaaaggtaagtgggtccgagactcatcacggactaacctcgggaaactccttagagatatcgacaaacatgtactgcgcccacacgacaatttagtgcccaaatttattttcgggggtctgaccgggctgaaccacaaggccgcagtgcttcacttactgggccggaggcgaaataggaccatcctaaagctcgacatcactaagttcttcgaacagatatcccaggaaagagtctatcacttgttttactcgaagtgcgagtgcagtaaggtggcctctaatctgctagcctcactctgttgcgtgccttatggcccgaaggagaagcctgaggattacaataccattgcaagaggatacccaacgtcacccaggctggccgtttggtgtaaccttgatacgtttattaagatcgagagagtggtgactcgggagctgaaagggaaagacccacgtatcgctatttacgtggacgacatcgctattacagcttctaatgtttccattgaggatatgatgaaactctaccccaagataaaggatatcttggagaatggcgataagaaccagaaactgcctctgaaccacgctaaaacaaagatcgtaaagcattccggcgaaacctacgatatagaaggcgaatatcagggaaaatgggcgtttgaacatctcggtttgcaaatgaataggaacagcgttactctgggaacaaaaacacgacggaaactgcgcaataccaatcaggacttcaagaagtctggcagaaaggaccgcattatccgccgtaaacggaaaagcttgctgctgtacaaaagctacatcgagaagtga

SEQ ID NO: 10658 - RNA, 1002 nt, unidentified
  source 1..1002: mol_type = other RNA; note = synthetic construct
atgaaaaacaatcagcgcaattatccgaaaatcgccatccgctcaaagcgagagctcgcgaaacgcttgtctgacaagcgggactcagttgaggacatggccagacttataagcgatgtcaagactaattacgacaactattggaccgatcacccaactcagtctcaacctgaaaaaggaaaatgggttagagatgcaagtcggacagaccttggaaaactgctgaagctgattaacgtgaaggtgcttgctccccatgacagtctgattcccacatttgtcttcggcggagtctcagggcgaaaccacaaggtggccgtaacccatctcctcggggtaaaacgtaagaggattatcctgaaactggatgtctccaggttctttgaacagataaaatatgagcgcgtgtacagcttcttcttagccaaaggaagatgtggccagcggggcgcccgcttattagcagacctatgttgcgtgcccattggtgcaaaggataatcctggcacgtacaagacaatcgcccgaggcttttctaccagttctaggctggctgtgtggtgcaatctcgatactttcctgagattggagcggttggtgaagaaggaattgcaggggaaggacccaagaatcgcaatctacgttgacgatatagccatcaccgcttccgggatcactaaagaggatatgatgaagctgtacccaaagattaagacaatcctggagagcgacaaaaaccaaaagctccctctcaacgatgcgaaaaccaagatcatttaccactccggggacgagtatgatatagacggcatttatcagggtaagcggggatttgaacacctgggtctgcagatgaaccgtaacagcctaaccctgggcaccaagactagatggaagcttgctaatctgacgcatagatacaaggaatcgaggaggaggaataccacaattcgtaaaaagaggaaatccacactccgctataaagagtacgtggaacggtga

SEQ ID NO: 10659 - RNA, 978 nt, unidentified
  source 1..978: mol_type = other RNA; note = synthetic construct
atgactgtaaggaggtatccgaaactcaatattcggtcgaagaatgagcttgctaagcacttgagcactaagaaaatctctaaagagagtcgcctggcccttatcaacgatgtgttaacgaactttgatacatactggaaggacaatctgcatgaaagtaaaccccaagaacgaaagtatgtgcgcaatgccaagcacacccatctggacaagctgctgcgtgcaataaatgaacaggttctgtctccacacgacaatcttttgccagagttcatatttggcgggatcaaaggcaagaaccatatcaaagccgccggccacctcctaggtgagaaacggaataggacattaataaagctggacatccaaacattcttcgaaaaaatcgatgacaagcgcgtgtactacttcttcaagaacaagtgtgggtgttccagtaaggcaagcaggattttagccaatctgtgctgtatcccagagggacctaaggataagcctggtaccaaaaaagttctagcacgggggtttgccacttcaagccgtcttgcgatttggtgcaacctggatacttttctgaagcttgactggatgataaaaaaagagctgaaggggtacgattctagaatcgcgatttatgtggacgatatcggcattaccgcttcaagagtcggaaaacagaaaatcttgaacctcgaacagaagattgagatgattctgtgcagcgataaaaacgctgagctccccctgaacaaggagaaaacccgcgtcatcccccatcaggaaggaatggaacacctcggaatcattttgagaaggaacaagctcagcctgggcaagaagaccagatcaaagctcgaggaaacaaaaaaacggatatctcgggctaaagacaaggacaaagtgaagaagattaaaacccagaagcgatccttgatgtcctataagagatccgtggagacgtacaagcctgcaaaatga

SEQ ID NO: 10660 - RNA, 972 nt, unidentified
  source 1..972: mol_type = other RNA; note = synthetic construct
atgaagcacgaggacggctaccccaaactgtgtatcaggtcaaaaaatgagctggcaaagcacatctcccataaaggctttctgccagatgaagcactggccctgattaacaacgtcaagtccaatttcaacgattactggaaagactctaaaaaggcgtccaaaccacagaatgataagtatgtccggaacgctaagggctcacccctagggaaacttcttcgaaaaatcgatcggctcgtcctcacaccacacgacagcttacttcctaattttatttttggcggagtgaaggggaaaaatcatgctatggccgcctacaatttactggggaataagagaagaaggcggttgcttaagatcgacatcagcaggttttacgaacgtgtggaactgcaccgcgttattaacttctttcagtataagtgtgggtgccagtatcgggcggcaaaactcctggctgagttctgctcggtacccttcggcgccaaagacagtaagaatcccaggattaccatcgcccgaggattcgctacatctagccggttggccatttggtgcaatctgggagtgtttaagaaaatggagcgcctcgttatgcgaagactgaagggtcacgatccgagaatctctgtgtatgtggacgacataggtattaccagctctggagtaacgaaggaacagatggaaaacctccgcgatgaggtgatccaattattgcagactcacgacaagaaccagcctctgcctgtcaacaagaagaagacagcaatccaaagtcatgaggaaggtctgtacatactggggattaaactcaatcgcaacaacctaactatcggcagaaaaacccactcccgcattcataatttcaagcataagctcaaagtgagtaaagccaaaaaggagagggataagctgaaacagttgataaggggaatatcacgttacaagaactatgttgagaacatgtga

SEQ ID NO: 10661 - RNA, 987 nt, unidentified
  source 1..987: mol_type = other RNA; note = synthetic construct
atgctcaataaaacgtaccccaagataaacattaggagcaagtgtgaacttagtaaaaggatctcacataagaagctgcctcggcaggacgctcttaccctgatcaacgatgttaaaaacaacttcgaaaagtactggaaagacaacattagcaaatctaagccagagaagaataaatatgtgcgtaatgccaaaagaacacctctcggaaagctgctgaagatcattaattctaagattctcgccccccatgacaacattgttcccaactttatttttggcgggccaaaaggacgagatcacgtaaaagcagcctattccctcttaggcacctacaagaaacgcaccctgttgaaggccgaccttcagggattctttgagcagatagacgaaaagaacgtgatagacttctttctgaaatgcgattgcgattacaaaactgcaaagttcctcggctatatatgttgcgttttcgacggtcaaaaagggagcaattccaagaagcgagtgctggcgcggggcttctcaacatcttccagactagctgtctggtgtaatctggatgtgtttatcgagctcgatcgcttagtaaaaaaaaggctcaaaggctatgatccaagactggcaatttttgtggatgacatcggtataactgcttccagggtccctatcgatctgatggacaacttatacaaggaaatcaaagaactgttcgaggggaaaaaacaaaagcagccgttgatccttaacgacaagaaaaaagacattaagcagcacttcgagggaatggaaatcctgggtagctttttgtatcggaataagctgaagcttgggaagaaaagtttcagtaacaagcagaagattaagtcactactgaaagagaagaatgtcacaaacatgaagaagatcaagaacaagtatcgctcgatcaaacagtacgagaagtacgtggagatgcaaggcaaacagaagaataagatcttgtga

SEQ ID NO: 10662 - RNA, 963 nt, unidentified
  source 1..963: mol_type = other RNA; note = synthetic construct
atgcagaacaggagatatcccaaaattttcattcggtccaaaagcgaatttgctaaacacatctctcacaagaatttcacaaaggaggatgccctgaagctgattaacgacgtgaagatcaattttgaaaagtattggaaggactctaagcggagcgaccctaagaaagaaaaatacgttcgtaacgccaaaggtactcctttaggcatgcttctaaaaaagatcaacagtctcattctggctccccacgataagattctgcccaattttattttcggcggacttaaggatctgaatcatgcgaaagctgccaaacacctgttgggcaataaacgcaagaggaccctgctcaaattggacattaagcattttttcgagcagattggcctgggacgcgtgttcatttttttccagaacaaatgcggttgttcaaagaaggcctctaagcttttgagttccctttgctgcgtgagcctaggaccaaagggatccaataaccctataaaaacaatagcacgcgggttcgctacgagctctcgattagcagtatggtgtaatctcgatatctttatcgccctaaacaaactgatccagaaaagactgaagggtcacgatccgaggattgcaatctatgtcgacgatatagggatcacagccagtaggataaataaggagactatggagaagctgtacatcgagatcaagaaactcttttactcattcgacaaaaaccaattgctgccactgcatgatataaaggacaaaggcgggatcattactcataacgaaaatatgcagatcctgggcctccaactcaatcgaaatacccttagtatagggagcaagacccggtcaaaaaagaacaagctcatgaacaagttgaaaatctccaccgacaagaaaattctgaagaacaagtacatgtcgctcatcagatacaaaaactatatcgagtccttatga

SEQ ID NO: 10663 - RNA, 927 nt, unidentified
  source 1..927: mol_type = other RNA; note = synthetic construct
atgcagacttccagatacccaaagctgtatatccggagtaagaacgaactggtcaagcacttatcccactcaaaatttcccaaaaaggaggtgttggccctcatcaatgatgtcctaaataacttcacccgctattggagagataatgaatatcggtcagagccagaaaaagagaagtacgtacggtcagcaaaaaggacacctctgggcagattgctggacaacatcaataaagctgttcttgcgccgcatgacaaaatgattcccgatttcatattcggcggggtgaaaaacatgaaccatgcgaaggctgctaaatatctcttaggaaagaagagaaagcgcacaagcctgaaactcgacatcaccaggtttttcgagcagattagcgaggaacgcgtgtatcacttctttcgggataagtgtgcctgctccaaaaaggccgccgctctgctggctagtttttgctgtgtccccgagggtcctaagggcaatgcatcagagcgcaagacaattgcccgagggtttgccactagtagccgcctcgcagtgtggtgcaaccttgatacattcataaagttagaccggctgattaaaaagaggctcaaaggaaacgaccccagagtagccatctacgttgacgacatcggtattacggcatctagggtgtctaaggaggagatgggcaaacttagcttggaagtggagagccttctgctaaacactgacagaaatcaaaagctgcctattaacaaacgaaagaccaaaatctcctcccacgaggaaggcatcgagcacttgggactgcgcctctacaggaataggctgtctataggggccaagaccaaatcgaagattgatcggatccgtaatcgttctgaacgaaaaccactgatacgttacaagcattacatcgaaaagatttga

SEQ ID NO: 10664 - RNA, 966 nt, unidentified
  source 1..966: mol_type = other RNA; note = synthetic construct
atgcagtcacggagataccctaagctgtttattaggtccaaaaatgaactggctaaacacatctcccatgaaaattttcccaaggagaaggctttagtacttattaacgacgtcattgccaatttcgatttctattggaaggactctgtgcacagtgatcctctgaaagagaagttcatccgaaacgcaaagcataccaaactggggctcctgttgaggaagcttaacacgctggttctggcaccccacgacaaattgttgcccaaatttatatatggaggagtcaaggagatgtctcatgccaaggccgcgaaaaacctgttaggcagcaaacgaaagcgcattttgctcaaaatggatctgaagaaattctttgaacaggtcagcagtgagcgggtagcctattttttccagaataagtgtgagtgctccaaaaaaacatcggaaatgctatcatgtctttgttgcgtgcccattgggccaaagaataacggggcctccaaaaaagccatcgcgaggggctttagtactagcccaagactcgcagcctggtgcaatcttgacatattcattaagctggaacgcctgatccagaaacggctctctggtcacgaccctaagatctcagtgtacgttgatgacatcggtatcactgctagccgtctcccaagggaggttatggagaagctccgtgacgaggtgagctcattcctcctgacagctgacagcaagcagcagctggagattaaccaagataagaccatcataacttctcatgaggaaggaatggagtatgtgggcgctagattataccggaacaagcttggcctgggcaagaaagcaaagtccaaaagagatcaaaccaagaacaagctgaaaaagaactctgatccgaaagtgagggaatccctacgccgcaagttgaatgggatgaatcaccacaaaaagtacatcgaaacaacctga

SEQ ID NO: 10665 - RNA, 969 nt, unidentified
  source 1..969: mol_type = other RNA; note = synthetic construct
atgtccaatcggtatccccagttaggcctccggagtaagaatgaaattgctaagaggatttgctctaaaaagctgagccaaaacgaggccctcgagctgatcaatgatgtgattaaaaacttcgacgactactggaaggactccaaagagtcagagccacggaaacagaaatatataaggagcgctgccgggaaccccttgaataaactcctaaaggctatagacgccaagatcttacagccacacgaccacttggttccgaacttcatatttggcggacttaagggcacatcacatattgatgcagcctattctctcatcggaagacagaacgcaaggaccatcttgaagatggacatcaagagattctataagcaaatcactcgggagagagtcttttttctgttttatcgcaagtgtggatgttcagtgaaagccgcgaatctgctcgcagatctgagttgcgtgccagtcggtaagaaaggctctgggagtacaaaaaagaccatcgccaggggtttccccaccagctcccgtctggccatttggactaacctcgatacctttctccggctgcagtgggaagtgtccagattgctgcgaaagcatgaccctaaggtggtagtgtttgtggacgatatcggggtgtcagcgtctcgcgtctccggtaaactgttcaaacacgtcaagcacgttgctcagacgattcttgctgcctacgatgagaaccagcccctacctgtgaacaaacgcaaaactcaagtcatccctttcagtgatggagcggaacatctggggttactgctgggccgcaataagatttcgatagggcgaaaaacaaagtctaagatggccagagtaaaaaataagattgcatccgctgttggccttgaaaggaaaagcctgcttaaaaagcgtagcagctactacagctacaagaagcagatcaagaaagcatacgacaattga

SEQ ID NO: 10666 - RNA, 966 nt, unidentified
  source 1..966: mol_type = other RNA; note = synthetic construct
atggcgaatatctacccgcagatcagcattcgctcgaagaacgagctagcaaagcaaataagctcagtgaagttgccctttgagggtgccctgagcttgataaacaacgttattgagaattacgacacctattggaaggattccaaaaaaagcgagccccaaaagcgaaagtacgtaaggacagcagtgggaacccccttagacacactgctgaaagccatcgacaagaagctgttacagacgcacgacaaactgattcctggctttatttttggcggggttaaaggcaaatcccacatcgccgcagcataccatcttgtcggaaatcgcaataagcggattctgctcaaaatggatatctctcggttcttcgagaagatcactcgcgagcgggtcttctatttctttaacaagaagtgcaactgctcagtgaaggccagtaatctcctcgcggacctctgttgtgtgccaaagggaaaaaagggcagtactgatcctaccaagacaatcgctcgggggttccccaccagttctaggctcgctatctggactaatctggaaacctttcttaaacttcgtcatacagtgacaaaaaagcttaaaaaccacgacccacagacggtaatcttcgtcgatgatattggtatttcagcttccaggactagtaaagagtccctggacgagattcgtaagagcgttcagaaaattctgttgtcccacgatagaaaccagcctctccctgctaacaaaggaaaaaccaagatcataccattttctgaaggcgctgaacatctgggcttgctgctagggagaaataagatctctatcggtcgcaagaccaagagccgaatggccaccataaggtccctggtggggaaatcaagaggagaaactaaaaagagcctgataaaaagagaagcctcttactataggtataagaagcagatcgaggaaacaatcatttga

SEQ ID NO: 10667 - RNA, 981 nt, unidentified
  source 1..981: mol_type = other RNA; note = synthetic construct
atgcagacaaattctaggtaccctattatcaatatcgggtctaagaacgaactggcgaagcgattatcttccaagaacttcagtaaggataaatctctcgagctgattaacaatgtgctggctaatttcgataagtattggtacgactcaaaaaagtctgacccagaaaagcaaaaattttttagaagcagcgtcggtacccccctgcataaactgctgaagctgatcaacgccaagattctcaaagtatacgacaaatccttgcctgagttcattttcggcggggtgtcggaccggaatcacatccttgccgcgagggaactcatcgggaataaaaacgacagaacgctacttaagattgacgtgagccgttttttcgagcagattactatgcagcgcatagttagattcttccaccagaaatgtaattgctcactgcgcgcatcctatctcttagcttccctctgttgcgttcccggcggccaaaaggattcctcggccaatatgcagaagtatctggcccggggttttccgacttcaagcagactcgctgtctggaccaatcttgatacatttttgcgccttaaatgggagacaaataaaaggctgaagaaccatgaccctaagatagtcatctttgtagatgatatcggcgtgagtgcttcacgagtggacatcaagaccatcaattgcttgaaggaaagcctgataggcctgctagagagttacgatattaaccagcccttaccagttaaccacaaaaaaactgagatcattgcattcaagaacggtgcagagcatcttggaatgcggctaggaaagaacaagatatccattgggaggaagaccatctctaataagagcaagctgaacaactccataaaaacaagtgatggattgggaaagagcttgctgctcaaaaaaaaagcagcctactaccagtatctgaaacagatcgaacaagtgaacgacatggcctga

SEQ ID NO: 10668 - RNA, 972 nt, unidentified
  source 1..972: mol_type = other RNA; note = synthetic construct
atgaaaaagaacaattacccgcagttcggcattcgttcaaaaaatgaactggcaaagaggatcagctccaagtctctgcctgccaacgaggcactgatcctgatcaacgatgtcctcgaaaatcacgaaggctattggaaggatagcaagatgtccgagcccgagaaagggaaatacgtgagaagttgtgttggtacccctctacataggttactcaacctgatcgacaaacgaattctaaggccatatgacaaactggcaccccattttatcttcggtggcttgtcaaaaaagaatcacattcaggcagcccattatttgattgggagcaagaagagacggtccctcataaaattagacattaagcgtttctacgagcagataacacaggaacggatcttttactttttctataagaaggccggctgcagtgtgcgcgcttctagactgctggcctacatctgctgtgtaacacaaggcgctaaaggcaatccaggtgtccagagagtgttggcccgcggattttccacttcttcaaggctcgcggtctgggccaacctcgacacgttcctgaaattacggtggaagctgcaggccgagcttgggaaaaatgacccaaaaattgctgtttatgtggatgatatcggaatttctgtggcagacgtgtcacagactaagctggaagagatagcccttatgatggcggaaatcttggagagtagcgatgccaatcaacccctgcctattaataacgagaagctggacattatgtcctttgagaaaaacgcggaacaccttggactccgcctgggacgcaaagctatcttcatggggaacaagataatgagcaagatccgaaagatcaaaaacgactaccagagagctgagaacaacaccaaatttaagctcatgtcgaagaggattgcttaccggctttatcagaagcaaatcgataagcagaatgaacaatga

SEQ ID NO: 10669 - RNA, 972 nt, unidentified
  source 1..972: mol_type = other RNA; note = synthetic construct
atgtttgagcaacttcgctatccaaaaataggtattcggtctacctgcgagctggccaagcggattagcgactcctacttaccttacgataaggctttgcttctgattaataacgtgattctgcacttcgatgagtattggcacgactccaaatcttctcaacccaaaaaggaaaagtacgttagaagcgccgtaggtaatcagctgggagaactgctacgtcggatagacaggaagatcctggctccacatgacgggaagctgcccgaattcatcttcggcggcctcagcgggagagatcatatccaggcaggaaagcgccttctcggcaaaaagaggaaacgagtcttactcggactcgatataactcgcttctttgaacagatcaaggagtctcgcatctcctatttctttcacaaaaaatgtggctgctcactcgaggctagtaccttgttagccaggatttgttgcgtgccactgggaccgaagggggggtctagtactaaccgagtcctggctcgggggtttgcaacgtccacccgtttggccgtgtggtgcaatctggatacatttctgagaatgagctggaaagcgaaaaggttgttgagacatcacgatcctaaagtaatgacctttgtggacgacattggcatcacagcgtctcgggtgagtcatgaggagatgaaggagatcgaaaaaaaggtcatcagcattctgagccacttcgacaaaaaccagcctctgcccattaaccctacaaagactaagatctgttccttcagtaatggtgctcaaatactagggctcggaatgggcaagcgactctcagttggtgccagatcacgcagcagaatctccaagacccggctcgccctaaagctggcaacatcgccccttgaaaagaggtatctgcttcagaaaaaacgtggccaggattcgtaccgaaggcaggtggcacaggcctcagactga

SEQ ID NO: 10670 - RNA, 978 nt, unidentified
  source 1..978: mol_type = other RNA; note = synthetic construct
atgttttccagaccgcgatatccacgcctaagaattggtagcaaaaatgaactggccaagaccatatccgatagcgctctcccctacccacaggccctgaccttaatcaacgacgtgatccgtaactttgattattactggcgggataacagtgaaaactctcagcctaacagaggaaaattcgtgcgatctgctgcacggacacccttgggagtgctgttggagagaatcgacaaaaaggtgctggccccccatgataggctagtgcccaattacattttcgggggcatgactggaaggtcgcacatccaagccgctcgttcacttctcggccaagagagaggccggatcctggcctctctggacatcacacatttctttgagcagattagagaacagagggtctttttcttcttttataggaaatgcggttgttcacctcgcgccagcaggctgctggcttccttgtgctgtgttccagtagggcagaaggggagcatgagcacagaaaagaccctcgctagagggttcgcgaccagcacacgactggctgtttggtgcaacctcgacactttcatccacctggaccgggaggtaaaaaagctgcttaaaaagtatgaccctcgcgtcgccatcttcatagacgatatcggcattagtgcaagtagggtgagtcaggaaaaaatctcagccgtggtgaaaatagtcgagaagattttgtccgattttgacaataatcagcgcctgccagttaacccggcaaagaccaagattcgcacttatgccagcggtgcagagcacctcgggcttaagctcggcaggaataagctggccatgggatccaagtcccgctctaggagagattcagtcataaatctccttaagaaacgcggagcgtactctcctacgcgggcacgtcggttactgttaaaaaagcaagcgtaccagcgataccaaggccagattcggtcggcttga

SEQ ID NO: 10671 - RNA, 987 nt, unidentified
  source 1..987: mol_type = other RNA; note = synthetic construct
atgcagaacaacggccgttatccgagaataaatcttcggtctaaaaatgagcttgccaaacgcatctccgataaatctttctcctttcaaagctctctcaaactgattaacgatgtgctcaaaaattacaacgactattggtacgactctagacaatcacagcccgagaaagggaagtttgttcgctcttccgtgggaaaacccttagggaagctacttaaacgaatcaatcggaaagtcctgattccttatgacaagctcgtcccaaactttatcttcggagggatttcgaagaaggatcacattcaagctgcttacagcctgttgggcaaacagaagaacagaatgctgttgggactggacattagcacctttttcgagcagattaggaaggagagggtgttctacttctttcatgccaagtgtgggtgctccgcacgggtgtcacggatactggccagcgtttgttgcgtgcctgcagggaaaaaaggatcaggttcaaaggtcgaggtgctcgcacgtggcttctccacctcgtcaaggttaagtgtctggaccaatttggatacttttcttagactgaagtgggttacagatcgaaatttaaggaaccatgatagcaaaatcgttatcttcgtggacgacataggcatttccgctagtagggtcacgaagaataacctcgaaatcctatccagaaagattcaggccatcctgagcgactttgatcgcaatcagaagctgcccatcaacaataagaaaacaaaaatccggtctttcactgaaggtgtggaacacctgggactgcgactgggtcgcaataagatcactgcgggctacaagacaaagaaaaaactcgacaagatcaagaccgaaataaaatccagcagtggcctgaacaagaaagacttgattaacaaggtgaaggcctactatgtatataagaagcagatcaagaacgtatacagtaacagcagtaatgtgtga

SEQ ID NO: 10672 - RNA, 990 nt, unidentified
  source 1..990: mol_type = other RNA; note = synthetic construct
atgccactggaaaagagatatccgactattaatttgcgctctaagaatgaaatcgccaaaaggatcacagataataagctacccttcaaagagagtattaagctcctgaacagagtgatcaataatcattccgaactttggcacgatgtgatctctttcagtgagccaagcaaaggaaagtatgtccgtagtgccaagaatacacctctggggaaactgctttccttgttcgacaagaaaatcttaaggcctcacgataagctgattccaaagttcatatttggcggcgtttcaggcggcagccatgtacaagccagctatcatctccttggtatctgcaaaaaacgaaccaaattgggcctggacatcaccaagttttttgagcacaatagcgagcagcgggtgttttatttcttccacaagaagtgtaactgctccgtccaggcaagtaaaatactctcgaagctctgttgcgtgcccttaggggccaaaggatcaaataacagcaaaacactagcgcggggattcgcaacctctacgcgcttggctgtgtggtgcaacctggatctgtttctgcgcatttactgggaagcaaaaaaaaccctgaagtacaaagatgtcaagatcgctgtgtttatagatgatattgggatctccgcttcccgagttgataagagaacaatggaggacctcagcctgaagattagggacatcttggagaactacgataaaaaccaatgtctccctcttaacaacaagaaaactgaggtaaagtcatatctggacggagagattgaacacctggggctcatcctgggcaataagaagctgtcattcggtaggaaaaccagaaaaaaactatccgaccttaaaaaagacctcgacaacaagcagattaagggtaagcagcggaagtctttatatactgccaagaaatcttactacagctacaagaagtacattaagaaccccatagacgacaagaaatga

SEQ ID NO: 10673 - RNA, 981 nt, unidentified
  source 1..981: mol_type = other RNA; note = synthetic construct
atgcgaaaagaggcccgataccccaaaattaatattctgagcaagaacgagctggcaaaacacatctcgggctcaaagctgaggttctccgatgcgttgaagctgatcaataacgcagccgacaacttcaataatcagtggtatgactcagagcattctgaacctgaaaaggagaaattcgttagatcagcggtggggacctgtcttgggaaactactcgagctgatcgacaagaaagtgctggccccacacgataatttggtacctgactttatttttggcggcgtgtccagtaaaaaccatatccaagctgctcatcaccttttggggaataaacgagagcgcgttctgttacggcttgatataaagcggtttttcgagcagatccacgaggacagggtgtttaattttttctatgccaagtgtcgctgcagtgccagagctagtcgcctgatcgccaggttatgttgcgtcccactggggcctaagggacagggctctgccactaaatcactggcaagaggcttcgctacatctccccgcctcagtttatggtgcaacctcgacctattcctgcggctgagctggatggtaaaaaaggagcttagaggtcacgatcccaagatagcaatctacgttgatgacattggagtgaccgctagccgtgtgtccctagagcggatggaagagatctccagaattgcagaaaacatactcgaaaactttgacagcaaccagaagctgcccatcaacccgtctaagaaggaaatactgtctaatgtcgatggaatggaacatttgggcctccgctttggacggaataaactttctttcggtgggaaaacgaggttcaacctgaacaagatctactccaagctcaaatcgccactcagcaagagcgaaaagctgaggctcctgaatcaattgaggtcctatcagcgttacaaacagcagattgtcaagacaagcaacgccatttga

SEQ ID NO: 10674 - RNA, 972 nt, unidentified
  source 1..972: mol_type = other RNA; note = synthetic construct
atgctaaaggaccggagatatcccgtgatagccctccgcagtaagaacgagctggctaagcgaatcagtggcaaggaccttccatatccagacgcacttgccctgataaacgacgtgttgcagaattttgatgcttattggtatgatagcgatcgcagtgagccaaaaaaagagaaatacgtaagaagcgcaatcggcaaacctctcgggaagctcttgaagctaatagataggaagattctggcccctcatgattctaaggtccccggattcattttcgggggcctctctggtaaaaatcacatccaggctgcataccacctgttgggagaaaagcgaaaaagaacgcttttgcggctggatatcaaaggcttcttcgagcagatacatgaagagagggtgttccatttgttcaacaaaaaattcggttgttccgtcgaagcggctcaactgattgcccgattatgttgcgtcgctgtgggtccgaagaattcaggatctactaaaaaaacactggcacgtgggtttgccacatcacctaggctggcgctgtggtgcaatctggacctgtttcttaggttacagtggaagatgaaaagggttctgagacaccacgatcctcggatcaccatctttgttgacgacatcggggtgacagcgagccgcatcgaggaggatcagatgcgtaagttctccaccgaattagagaatattctggcccaccacgaccccaaccagtcactccggattaacccacaaaagaaagaaattctcaccgccggcatgcacaaggagcatctcggccttcagctgggacggaaccgcctctcgatcggaaagaaaactcgctttaagaggaacgaaatcgccaaggctctgaagcaaccccagagcgaggccgacaagaaggcacttctgaaaaaaagacattcctactttgcctaccaagaacagattaagaatatttcctga

SEQ ID NO: 10675 - RNA, 978 nt, unidentified
  source 1..978: mol_type = other RNA; note = synthetic construct
atgagcgatctgcgctacccgcagattaatttagagagcaaaaacgaactggctaaacgcatttccgatcgttatcttccttattcagaatctctcaagctcataaacgactgtctggaaaatctagaccactactggtacgacagcagagccagtgagcccgagaaggagaagttcgttaggtctgcgaggggtaagcccttggccgagctgcttaagaggatcaaccttgccgtactggccccttacgaccggctggtaccagattttattttcgggggcctgtcctatagaaatcatgtgcaggctgcagccaatttattgggcttccagaaaaagcggactttgctgaaactggatatttcccgattttttgaaaggataggcgatgggcgaatattccacttctttaataagaagtgtggctgcagtgtgcgtgcgtcgcgcctgttatccaaaatctgctgcgtcccaaaagggcctaagggatctggcgaggtcagtaagacactggcccgaggtttcgctacaagtccacggctagcagtgtgggcaaacttggacatttttctgaaaattgacctgactgtccacaagatgcttaggggacatgatcctagattggtggtgtttgtggacgatatcggaatcagcgcttcaagagttgaaatgagcaagatgcaagaggtgaaggaaaaggtcatcgatattctccagaactacgaccccaaccagaccctccccgtcaatcaagacaaaaccaaggtgatccctttccagaagatcccagagcatctggggatcaagctcggccggaacaaactttccccgggtaaaaagacgcaactcaggatgaagaatgttagcctgctcctcggagaagcaaaatcaaaaaaggagcgcgaccgcctgatgataaagaaacaggcctacagacagtataaacggcagttgtcatctgtgaacatccccaaatga

SEQ ID NO: 10676 - RNA, 1005 nt, unidentified
  source 1..1005: mol_type = other RNA; note = synthetic construct
atgggtaaacagtacacccataaacacccaaagctaaatctccggactgaaaaagacctgctcagatttttgaacgccgccaagactgtaaaaactaagaacaagacactgaagaagcaagtgacctctaaggacttacacttcctgagcgagaacgcacatctcgagtggagcgatcaccccactgagtccaatcccatcaagaagaaatatgtgcggtttgttaagccgggcagttcattaaatattaccaataggcgcctcaatgcagccctgaaactgacacttgacaagaaggttcctggcatcttttatggttcggtgagtaaaaagtcacacattcaggccgctgaggttttatgtaacggcaagaataccaccataatatctttggacatcacccgattctttgaatccatcagcccaagtcgagtcgctagattcttcgggaaggcaggatgctcacctgaaataattaaggtcctggtggatatcacgtgcgtccccctcggatctaaaaacgagcccttgagcgattatagccttgctaggggttttccaacatctcctcgtctggccctgtgggccacatacgaaatcttcgtgaagcttaacagggtgctgctcaaaaacttcccacacctctcacctaaaatggtgattttcgtagatgatgtcgggatctccattaaaaatgctaccattatcgacgtggaggcgatcaaggaaaccgctttcagtataatcgaaaacgacaaaaacgggatcaacttggaggtgcataaaaaacctccaaagctgaaagtgcggcatatttcccagacagcggagcacctaggcctggtcattggaaaaaaatccctggcccccggatttaagactcgggttaagattggggacgtgaagactaaacttagcgataagtctctgtccaagacggaacgcgagacagcacttcagcataaacgcggcctgatgaattacaagaggagcgtaagaccgtga

SEQ ID NO: 10677 - RNA, 1008 nt, unidentified
  source 1..1008: mol_type = other RNA; note = synthetic construct
atgcggaaacagtttgcacataaacaccccaagcttaacctgagaaccgaaaaagaccttctcagatttctgaacgcatcgaaggagattaagaccaaacgagggactcttaaacgtcctgtgctctttaaggacctcacctacttgtatgaagagccacggttggattggtccgaccaccccactgaaagcgattctacaaaggagaagtacgtccggtctatcaagcccggatccatactcaacacagccaatcgcaggttaaatgaggccttaaggcgcacacttgatgaacaagcgtcccaaatattctacggcagcgtgtctaaaaaaagtcacatacaggccgctggatcgctgtgcaatgggaagaataccactatcgtttcacttgatatcacgcgtttctttgagagcatcagctccgaccgagttgctcgcttcttctgcaaggcaggctgtagtccagagatcgcgaagaaactcgttgctgtaacatgtgttcctgtgggcccgaaggaaaaacccgaagagaagtactccctggctaggggattccccacgagtccgaggctggcactatggagcaccttcgaaattttcgtgaagctgaatagggtcctgcagaaaaagttcgctcacctgagtcctaagatcgtggtctttgtggacgacataggtatctcactgaagaacgccacaggcgaagatattcaggccgtcaaagagatcgcctttagcgtaattgagtctgatactaaggacttatcactcaaagtgcacaaaaatcctcctaaactgaagattcagcatatctcagagaacccagagcatttgggtctggtcatcggcaagaagaatctgtctctcgggtttaagacccgaagcaaaattggggacgtgaaagtgcggttgtccgacagaaccctatcccaggaggatagatataaagccctgcagaacaagagaggactgatgaactataagcggtctattactcgcccatga

SEQ ID NO: 10678 - RNA, 1008 nt, unidentified
  source 1..1008: mol_type = other RNA; note = synthetic construct
atgaggaaacactacactcacaagcatccaaagctgaacctgcgaacagagaaggatctcctgcacttcctcaatgctcggaaaacagttaaattgaaaggaaagaccgtgagaaggcaggtggctacgaaggacctctcctatctcgataagaattcgagatcagactggaatgaccatccttcagaatccaagcccgaaaacggcaagtacgtgcggtacattaaacagggcagcacccttgatatctcaaataggaggttgaatgccgccctcaaacaaacgcttgacaaaaaggtgcctagcatcttttacggaagtgtcagcaagaagagccatattcaggcctctcgagcattgtgcaacggcaagagtaccgtgatcatatctctggacgtcacccgcttctttgagtccgttagtttagcccggattttccgtttcttccgcaaggctggttgctcgaccgagatagcagatattctggtagaattgacatgtgtgcccctcggcgctaaggagcacccacaatctggattttctattgccagaggattccccacttctccgagacttgccttatgggcgacttttgaaatcttcgtgaagctgaacagaattctccagaaaaggtatggtcatttatcccctaagctggtggtatttgtggatgacgtcgggatctcactgaagaatagtactcctgaggagatcgaagaaatcaaggcactgtccttcgagacaatagaatcagacaaaaacgggattcaccttgttgtgcacaaagaggctccaaaactgaaggtacagagcatcgaccagaacgcagaacatctaggcctggtcatagggaaaaattccctgtctcccagctttgagactcgccacaagatcggttatgttaaagcgcaactgagcaaacagacactaagtaccgagaaccgtgatcgcgcccggaaaaataagcgaggcctgatgaactataaacggtccgtcagcaacgggtga

SEQ ID NO: 10679 - RNA, 1032 nt, unidentified
  source 1..1032: mol_type = other RNA; note = synthetic construct
atgaaaaaaaactatacccacacgcatccgaagatcaacctccggacagagaaggacctgctcctgttccttaatgcgaaggccacaaaagatcggagatacaaaatacctaggaagctggtgagtcaaaaggatgtggcttacattaggcagaatgttcaccttgactggaaggattatgcatatgggggagactccctgaaattcgaaagcgccgctgagaagggcaaaatgactcgctcaatcaagcagaatagttgtttagacgtcgttaatagacgtctgaacgcaagttttcgacgggttctcgacaaacacgtgcctgatgttttttacggcagtgtgagcggacggacccatatcttagctgccaaggagctgacaaacgggaagaagactgtgttcctgtcgttcgacattcagaagtttttcgagtcaatttcctctaaccgtgtgcaacgattcttcgttaaagccgggtgcaccaaggaaattgctgattttttggtgagcattacctgcgtgcccctgggtgtgaagggattgcaaaaggacaaactatcactggcacgaggttttccaacgagcccaagactggccctttggtgtacttttgaaatattctctaagctcaaccgcatcttacagaaatccttctcccacctctttccaaaaatcgtcctgtatgtggacgacatcggcatatctctaaaaaatccctccgaggatgagatcgtccagatcagggacttggtattcgagctgatcgagtctgataaaaacgggctttctctcactgtgcaccgcgatccccctaaatttagagtgcagaaggtagaaggtcgcgccgaacatcttggcgtagcaattggcaagagcaagatagccgtcggaagcaagacagtcaggaatattgcgatcgtgaaaaatcagttgctgtcaaccaatgacaaggatgaaagaggacgcgtcttgcagaaaaaaaggggcctgatgaactaccggaagaccgtcacaaagaacaacctctga

SEQ ID NO: 10680 - RNA, 960 nt, unidentified
  source 1..960: mol_type = other RNA; note = synthetic construct
atgtgtaaactgaatatctactccctgaaaactctctcagaacgatcctggattagtcgcgacttcctgctctcctgctctgacggtagcgggcggtttaggaaaaagttcttttccgaccataaaaactctaagatcaccgatgatatcacaacatgtaagtacataagagtggtcaagtatggctctcaaatgcaaaagttccataagtggataaactgggagctcaaaaggtttgacagcaaactcccattgactatttacggctgggtagaggagaaatccactattgatgccattagcatacacattaggggagtcccgtttgtttttataaagagtgatctgtccagattctttgaatctatccccaaagaacagatcttctcgctgttttgcggcaagtttaactgtgataagatcgttgctgaggtgatctctaattcaattacgtttcctcagtggcccctaggttcgaaaggggagcttttcctggcacggtggttgcacgttagttcacgtatcgcagtgtggagtgccctgaactttttcaaagatctgtgctacttcttccagaaaaaatacaagaagtacaagcctaagatctcatattacgtggacgatattggaattagcctcgtgacgacagatcagattattatcgacgaattcatggcggaccttgtctggttcgtgtggcagatccataagaactccgacttcctgaacttgcacccagacaaaaccaattgcaccattatcaaggataacaatgacttcgtagagtatctttgggggaagatctatatgaatcgcaaggacataagcaataaaactaccgaaaaaaccaagcagttatatttcctgtacaagaaagctaagacaatcgaggagaagaatttttatgccaagcggctaacccccttacgcagctataaaaagagaatgcgaagctcttga

SEQ ID NO: 10681 - RNA, 909 nt, unidentified
  source 1..909: mol_type = other RNA; note = synthetic construct
atgaccaaacagcacaagatcggtcttgtgaaggtccttgaaatagtgacaaccattcttgccttcattaatgagagctggacatttgtggaaaaggtacttagtctgttcaacatcgtgcccaattacatgaattcatccatgaagcctgcctcagattggctgcataagttcgagatcaaggagaatcgctgggttttcattcccaatgaagacactctgaccctcggcagaaaaattcacaagtacatcaaaagcaagtggaagtttccactgtacatgtttcatttgcgggatggcggtcatgtcgccgcagcgaattatcacatagagaacacatatttctgcttgatagacatttccgattttttcggggcaacttctcagagccgtattacaagggaactgaacaaatttataccatacgaccgagccagagagatcgctaaattaagcacggtgaagaacctgaatagtaacgggctgaagaaagtactcccgtacggatacccccagtctcctatactcgcaagcttttgcttcaggcaaagctattgtggaaaggtgatccacactctcagtaaaagcggcaacatctccatctccgtttatatggacgatatcctactgagctctgatgacatcgagcaactggtttatgcattcaactccattaagaccgccttgaagaaatctggatacactgtgaacgaagctaagacgcagtcacctagtacctccgtgaatgtctttaacttggtcctgtcaaagaacctactcaaggtgtcgtctatccggattgtcgagttcctgcaagcctacatctcatctcagaacccagctgagaaaaaaggcattgcttcctatgttgggagtgtgaataaaacccaggcgaaattatttcagtga

SEQ ID NO: 10682 - RNA, 909 nt, unidentified
  source 1..909: mol_type = other RNA; note = synthetic construct
atgaccaagcagcacaaaattggactggtgaaggttctggagacaactaccgtggtattggcctttatcaacgagagttggaccttcgtcgaaaaagtcctgtcccttttcaatatagtccccaattacatgacattgagcatgtcgactccaagtgattggcttcacaaatttgagatcaagaccgagaggtgggtgttcgtacctagtaagaagacgttagaaagaggaagacagatccacgcctacatcaagcagaagtggaagtatccacgatatatgtttcatctaagaaacgggggtcatgtggctgccgcaaacttccatctgaagtctaactatttctctctgatcgacgtgtccgacttctatggcgctacttcccaaagccgggtgaccagggagctgggtaggctagtgccatacgtgaaggcccggcagatcgcacgattgagcactgtggccaatcccaaccgcaatggcttcaaacacgttattccctacgggtaccctcagagtcctattttagcgagcctctgtttccaccattctttttgcggcggcgtcatttcctctatatccaaatcggagcgcgtctttgtgagcgtatatatggatgatatcctgctgagctctgacgacatgaacctcctggttgaagcgtttgatacagttagacaagcactgaggaagtccggatacaaggtcaacgagaataaaacgcagtctccttcacccaagattcaagtgtttaatctcgaactggggcacaatcatctccgggtcacaccgaaacggattgttgagttccttaaggtgtttatatcaagcgctaatgaacacgaacgtaaagggatcgcctcatacgtgggctccattaacaaatcacaggctaaactcttccgctga

SEQ ID NO: 10683 - RNA, 930 nt, unidentified
  source 1..930: mol_type = other RNA; note = synthetic construct
atgaaaaagtttaaactgggcctggtgaaagtgttatggggagtctatgcactctaccactttcttaaggacttcgtgcccttccttaacgaatctatctctttgttcgagaagttgctcagctactttaacattgcccttaactacttattcctgaggcgcttttttctgatggtgaaatgggaatctaagttcgaaatcaagaaggaccgctgggtgtatgtcccaaccgatgaagtccggctttatggggagaaactgcataattaccttcggaaaagatgggtccccccactgtacttctatcatctgcgtgatggaggtcacgttgcttgcgccaaaaaacatctggccaatgaatatttcgctctgatagatatcaagaacttttttgagagcaccggccagtcgagagttacgcgggagatcaagaattactttaagtacaacgatgcacgcgagattgccaagttatccactgtaaggaatccactccctgtgggacctaaatacataattccttatgggtttcctcagagtccgattctgtcaacattgtgcctgcacaagagctattgtgggggactattcaaaaagatagattccagctttgggatcgacatcagtatctacatggatgacattattatctccggtaatgacctggagctatgtaacctcaattataaactgttgtgcgacggcctcattagaagcggctatgaggtaaacgaaaataaaagtcaggcaccctccaagtcaatcagggctttcaacctcgaattgaagaaggacagtctgcgagtcctatcctctcgagtgatagagttcctcgtggcctacatcaagagcgacaacccccacgtgaggaagggtattgcctcatacgttggctcaatcaatgctgagcaagcgaaactgttcagatga

SEQ ID NO: 10684 - RNA, 939 nt, unidentified
  source 1..939: mol_type = other RNA; note = synthetic construct
atgaggaagggcgcattaagaagaattccacggggatttaccgcaatcccggccaagtggaggtggggcagattccacctagcccccatcgtgatctttttggagaacatgcgaaacgtagcccgctccttccttaaggatggcactcggtacttcgtgctgactaagagctacgccggatggcgtacctttagtgagggcggtagagctgcttatgacggggaggaggaatggcggctgctcaaagaacgtgtcttttcgcattggcagccaaatgccgcttttaccgcattcgcgaagagggctcatgttgccgccttgcgccctcacctggttaataagtgctttgctgtgatagacctgaaaggcttcttcgaccatgtaaccaggacgaaagtgtgtcgggcactcgaagcaatcgggctggcgagatcttcagctttcaaaatagccggtgagtccacaattcggcaaggggataagtgcaccttgccccgcggatttcgccagagcagccttctcgctacattagtgttagagaagtcactcttcggtagtgccttgacgggaaacagatttgagtctaaagttactgtctatagcgacgacataatcttcagttctaatgatttcgagacacttgccgacgaacactcacaggctatcgcactcctgcgccgctctcacttcgccattaaccctacaaagacacagaccgcgcgggctgaagtcgacatttttaatctgaggatgagccaccgtactctgaggtttaccgatgagcgaatgtggaagtttctggagcaagccgcctccttcgtgaaaggggaggatgcagaacataaactgcacctgtacgaaaaactcttcggcgattatattaggtccatcaaccctgaacaggagaagagacttcgaacttccctggggctaccctga

SEQ ID NO: 10685 - RNA, 933 nt, unidentified
  source 1..933: mol_type = other RNA; note = synthetic construct
atgcctaaagggctgaacttccaaagaaagtccgatatagtaaagaggttgggaatcgaacctaaggtgctggaggagatcctgtacgacaaggagaaattgttttacgtggaggaggaaatcatcaaggggaagacccgggactttcacaaatgtaggggttccctatacggctttctcccccagctgaacaaagccataatgtcactcgacgctctcccccctgaactgtgcggtggcgttcgaggtaagagcatctttaaaagcgcctctcagcaccaaaaaaaaaagttcgtcctgaagcttgacctcaaggatttcttccattccgtgaagccctatcaggtgcaggctgtgtttgaaagactgggctgtacaccgagcatgtctaagttattgacatatacatgcactgcgaataatcacctccctcagggcttcagtaccagcccaattttagctgcgcatgtgctcgcaccattcgtggaagatatgcgagcacttctgcgcccacatcacctgtcatttaccatttgggtagacgatatcacaatttccgggtacacaaatcccgtgcggctgctcccaaccattagatctatctgcaaaaaacacaaagtccaccttaacgagaagaaacgtaaactgttaagggccggaaagcagactcaggaagttactggcgtccggatttcgtatgataagttgagtactggagccactttctttcgtgacacggagaggatggtgtatgtgcttaaaaaatttgggtggcatgaggttaagaaaaagttcgccttcaacgttaccgacaagcgcaaggtcatccaaaaaataaagggacgcattaaccatattcggcaggctaatgctcaccaagcaggcaagctagacacggccctgagagataccctggaggtccaggcacactga

SEQ ID NO: 10686 - RNA, 960 nt, unidentified
  source 1..960: mol_type = other RNA; note = synthetic construct
atgaacgacaccagactgaacctcaggtctgagaatgatgtcgtcaatagacttcacctgcgcgacaagaagtttttgcaaacactgtgtgagaatcgcgaccggtactttcagaaaaggatgctaaacactgggacaaaagaacgtgaaatatgtattccgcatgacccattaggccactttcttagaaagtttaatgcggtgctccgtacgctgcctgttccaccagaatgttacgggggagtccccggaagatccgtcaaggacaacgccagcaagcacaccaacaagcgcttcgtgatgaacttggacatccagaattttttcccgagcgtgaccgccaaccaagtgttcgaggtacttcggaggcacggctgctatagagagacgtccgaactccttactaaactggtaatgatagataatcgcctgccccagggattcaacacttcacctctgctgagcatccaggtgttaacacccataatcgaggagctgaggcccctcttaagtgaacaggatgccacattcaccgtctggatcgatgatattgcaatctctagtgacaaatcacctgaaccactggtgaagcgaatcgctgagaaatgccgacgccacgggttccggctgaacactgacaagtaccattgcggcgaaaggggtgtgagcgtccaagaggtaaccggcgtggttattaatggtgatgaactaagacctgccggtgggtttatcaaacagacagaaaagatgatccatgtgctcgttaagtatggcctggaggatctgaatgcagcattcgatcgggagtttctcgacaccgctaaagcccaggctcacattgagggacgaattgtgtggattgacgagttcgactccgccaaagctgataagctgaaacaacagctccataagttggtggtgcccgcgtctttccggtcggttttggttactgcacagtga

SEQ ID NO: 10687 - RNA, 906 nt, unidentified
  source 1..906: mol_type = other RNA; note = synthetic construct
atgagaaatgccctgaattttcagtttcccaatcagatcgcccggcggctgaagataaagtcttctatgcttcagaacgcactccacaatatgactgatctctattgtcaccaagagcgcgacattgacgggaaggtccgggatatttacatgccctatcctccccttaagaccgtgcagaggaaactgcacctgacacttaggaagatccctttcccagctgaatttatcgggggaatgccaaagcacagtatatttgataacgctcgacggcacgtgggtaggaattttgtactgaaccttgacctgaagaacttttaccctagcatcaagccctcgcaagtggagtcagtctttctgagattggggtgtaacaaaggtatgagtcgcctgctcacctacttgacaacagccgacggccatctgccacaggggttccctacctccactatgttatcagcactggttttagtcccactcgccgatgatctgagagctctgttacagcctaagttcgtgttctccttctgggtggacgatctcactatttccggagactctgatcctacaccactcattcccgctgtgcgcaagctatgcagaaaacatggcttcaggcttaaagaggagaaaaaacatctaggagttcgggggaaagttccgcaagaagtaactggcattatcataagcggaaaggacttcagtccggccaacggttttttgccccatacaaagaatatgttgcgagcgctgaataaggagggatgggaatatctcaacaccattgaacgttggggctgcaccagcaagagagaggtgacgtcacgcctgaaaggccgtatccgattcatcggccagttcgacaaaagcagggcagaaaaactgtacgactccttgaacatgtga

SEQ ID NO: 10688 - RNA, 963 nt, unidentified
  source 1..963: mol_type = other RNA; note = synthetic construct
atgccacggtgcaagatcatggtcacaaagagtgccaacaagaccataatctccactaggcggctatgcgtggaaatcctccaaatccacaaggacgaactgctgtcactcgtggcagacacagacagttactatagaccttacgtgcaaaaaaagaagagagccgatggcaccgctaaggagaggcgcattgaaccatcctacggatatttgaaaactgcccagagactggtaaataaacgcatcctgaagcccgccatggcagacttaccaattgagattatgggaggccggcccggcgtaagtgtcgttaataacgcaaaccatcatgctcagagcaaaagtctcatgaaatatgacgtgaaaaacttcttccccagcattaagtacgggcacgtctatcacatctttaggtaccgtcttggcttctgcgaagaagcagctaacattcttaccaaactaactacctatccgtccacaggagatgtccatgtgcctcaaggcgcccctaccagcactagcctggccatgttcgcgctggagcctatgtgtgatagactcaaggtttactgtgacgataacgatttacgctcctctatctggatagacgacattacaatatctggggacccaaaagccctgagacagcatcgaccccggattaatcacatcgtcaatggtacgccctttcagatccaccctgataaggatacaggcgtgttggtgaaagggggtaaggcgggccatgagaaggggagaaagattactggggttgtgatcgataataacaataggctgacgataggtcgacagaaactgcgaagcctccgttctaaagtgcggaggtccaaagtggtttcagacaagttggagggatcacttcagtttctgaggcacgtaaatccgacccagggaaacaagctgcttcgcgagtaccgctctaagcacaaacggtcggcttga

SEQ ID NO: 10689 - RNA, 918 nt, unidentified
  source 1..918: mol_type = other RNA; note = synthetic construct
atggtcaaccagaaatgcatcaccaccaccaaattgtgtagagacattcttaagataccgaaagaggagctactggctctgctggctgacaggcagtcatactatgtgccattcgaaaaaaagaagattacagccggaggacgggtaaaaatccgtaccattgaacctcctcacggatatctgaagcgggtcttgaagaaaattaacattactgtgctccagccccagatggaacggctcccatacggggtgatgggggggagaaagggctactcggtggtggataatgcaaaataccatgcatctgctcccgcgctgatgaagtatgacataaaggactttttccccagtatcaagtatgcagatgtctttcacatctttcgctaccagctcaattactgtgaagaggcagccaacattcttgcccacctgacaacgttcgagaactcccagcatggtgttcacgtgcctcagggcagtcctacatctatgagcattgccatcttcgctgtcgaaaagatgagctgtgccgtggacgactattgccgtgagaatggtttaaagttttccatctgggttgacgatattacaatcagcggcccctatgataaattatgccgccacaggagcactataaaccacatcctcaattccactcattacagaatcaacccagacaaagattctgggatcgttaagaagggccaaaaaggccgatccgtcacgggtgtaattatcagcaatgatgggagactgactgttggacattcaaaactgtctaggctccgacgccaggtgaagagatcaacccgcccaagtgataagctacgaggccggctgcaattcctgttgcaagtgaacaaacaccaggcccggaggcttatacatgagtacgcggagaagcacaggaagaattga

SEQ ID NO: 10690 - RNA, 918 nt, unidentified
  source 1..918: mol_type = other RNA; note = synthetic construct
atgaatacctcctccaagaaagtgtgcctttggggcagtgtggaggccttggccaaaacgcttaaggtgcccgttgatgatctgtttgcttggtgcggcagaaagaaaagattcgttacagaagaggaacgtctcatcggtgccaaatataggcagctgaaagtccctcatggcgaattcaaggaactgctacgcaagatcgaccagcagctgaagaggtgtcccattcccaactacttttatggctctcggaaaggagtgagcgccatagactgtgcccttgtccatttacatagcccctatattctcaagctcgatttgaaggattttttcccatctactgattaccggagagtaagtaactccttgagccaggtgtgcgacaaggaagcggtgctcaaactgcttaccgagctatgtaccttccagcaccacctaccacaggggttcccgacttccaccaccatcgcagagctgacgctgattcctctggctcagagactcttcggaatgtgtaatcagtacgggctccaattatcaatctacgttgacgacatatgtattagtggtagcccagtccttctgcggctggaggcacgcatcttacgaatgtttcaggaaatgcactttaggttgaacctgaagaaaaaggagctgcgctctaagcaagagggaatcgccgtgactggtgtatttatgcagaatggcttctgcaccacaaaacctaaatttgacgagaaactcttgaagaagatatgggcatatgagctggctcagatgatttgcgactctactctcgctgaggatttgctgggctcaatcaggggacaacttctgtggacacgacaactggacgaatcgaagtacctgtgcttcctcagcgaactgcggcaagggcagatgatgtcagggacatga

SEQ ID NO: 10691 - RNA, 927 nt, unidentified
  source 1..927: mol_type = other RNA; note = synthetic construct
atgaagaaaagacagcttctgaacatcaatacgctaaatgaactggcgctccagctagagatcccctacgatttcttaattaaaatggctgatcgaatggacaacaactactataccttcgataagaaactgatcaagaagaatgggaaaatcaagatcaggaaattcttcgagggcaataacaatctgaagattattcaccggaaaatcaatcagttgcttgaccatatcaattatcccgattcgattcaaggaggcattgtggggaagtccatagtaacaaatgcctctattcacgccagtagaaaatacgtcgcaaactttgatattagcaactttttcccttcaatcgactatcgcgtagtgtatcgggtttatcgatttttgaaatgttcaccggacgtggctcggattttgactaagtttaccactgcagacgcacatctcccacagggtttcggtactagcccaaaagtgtccggactggtgttgtttgaagtcgacatgcgtttaaacaagctcctgtctcgctatgggctcaaacattcattctggatcgatgacctcacaatttctggcgatcacagcataaagaagttcaagaacatcatttgcaagatctttcagcaaagtggatttaagcttaaccacgacaagacggagtttactaatagtaagcaaaagcaggtgtgtacaggcctgacaatcaattaccagcctaatgctgacaaagccatcagagacaaagttaggaaagagctgtttctttgcaagaagtttggcgtcgagaacttcctcaacgaacacggatactccatagataaggataagtacctgaggtccatggccgggaaaatcagcttcctgtatagcataaaccccaagtacctgacctacaaaaaaaccttccaggaaataaccacctga

SEQ ID NO: 10692 - RNA, 918 nt, unidentified
  source 1..918: mol_type = other RNA; note = synthetic construct
atgaagaaacgacagttcttgaagataaatacagtaaaggagctttcctatcagctggggctgccagaggcttttctgattagctcagcaaataagatcgacaattgctaccgaaaattcacagataaggacaagaagggcaaagaaagaactttttatgtggctaacgagaatctgaagaaggttcatcagaaaattaacaaactcctcgatactctggactatcccatcaacatccaagggggcattgctggcaggtcaattgtgacgaatgcgagcgtccatgtggggaagaaatacgttgcaaactacgacatcaaaaactttttcccctcggtgaattataaaattgtctatcggagcttcgagaaacagaagtgtatgcctgaggtttgcagaatgctcactaggtttaccaccgccgacggatgtcttcctcagggcttcgccacctccccaaaagtgtctggtcttgtcttgtactcaagtaacttcagaattgagacgctattaaaaccttatgacctgatccacaccttctggatcgacgacctgactgtatccggaaataggccgatcaagaagtttcagaagctgttttacaagatattcaagcaggaaggcttttccctgcatgatgaccccaaaaaagcccgcatcaccgatagtcaacaccggcagacatgcacagggctaatcataaatcaggaactcaatcccgaaaaaggtctgaaagataaggtgcgtaaggaattatttctctgtaagaagttcggagtcaacaattttttgaaagagcacaacagcccattcgataaagatcgctacctgcggaagctcgccggaaacatttcttttttgtgctctgtgaacaagaaaaacttcatctacaaggagcaactgaagcttataaagtga

SEQ ID NO: 10693 - RNA, 951 nt, unidentified
  source 1..951: mol_type = other RNA; note = synthetic construct
atgaagcggaagaagtacttcaagttctattcgatcaaatccttagctaaacacttaggggttagcgaaggctttttgattgatctggcaaacaaacaggacggaaactataaattctgtcagggtgttatgatcaagaataagtcccgggacctgtataaagcaaacacctccctgaaaatcgtgctcaacctaatcgacaagaagatactgaactattacgatttccccaaaaccttccaaggcggaatccgtgggagggcactcagagataatgctcagttccataccggaaagaagtacattcttaagattgacatcgccgattttttccccagtatcagccctgagaagatctttaagactctgaagcagcttcaaattgccgataaacctgctagcctgcttacgactttggttacagtgaaaaatccccacccacacctacctcagggcttttgtacatccccaaagatcgccagtctcgtgttgctcaatttggaaaagaggtttcataacctgtttaaggagaaaaaatgcgactactccttttgggtggatgacatcacgttttcttctgacatgcccatcggaaagttcaagaacctgatactcaagattctcaaagatgaagggttctcagtgaaccagaagaaaatagagctgctgaccaataaagaaagaatggtagtaacaggggtcgtggtcaattcatttcctaccctctctaatgatcgcaaaaaggaaattgagaaaccactttattgcctggtgaaattcggtattgtcgactacttcaagaagaacaaaatcgagatttctgaggcgagcataactaaaattcgaagcagtctgttgggcaaaatcaactttgccaagtcaataaatccggagctgggcatcaaatacaagaaggacttcctgaagattacatgggagttaaagaaatga

SEQ ID NO: 10694 - RNA, 1152 nt, unidentified
  source 1..1152: mol_type = other RNA; note = synthetic construct
atgaatgctctttgtaaagcgctggatctgaccctcgatgagatctctgaggccttatcactgacggctgcagatagatacaaggagaggtcagtccccaaaccaaatggctccattaggattgtacacaacccgcatcacctgatccgcaagattcaaagacgaataaatcggcggatcttttctaacccagatatcatcctctggcctgaccacgttttcggaagtattcccaacgaagagttttcggatagccccgccgccgagaaggactacgttaactgcgcgcggcagcattgcagagctaaatctgtcctgtctgtagacatcaaagatttcttcgacaacatccaccgagatagggtgcatcagatattctccgacttcctgaagtgcgaagaggaagtgagtgacgtcctggccaacatttgttgtaggggagataatttagtccaaggtgcactgaccagcagttacatcgccaccctgtgcctctattccaatgagggactcgttgtggagagattgcggaacaagggtgtggcatatactaggctagtggatgacatcacaatatcttccaaaattgctgactatgactttagcttcgccatgcgccagatagagaggatgctcgacgaatttggcctgcccctgaacacaaataagactaagcttcagaatgcggggatgcaacctctcatcgtccacgggctacgggtggacttcgatcagcctagattacctccagacgagccacggagaattagagcagctgtgaagaacttggagctcctcgccagcacacccgggtacagagcatcccgcgcttatcgtaaagatttcaataggtgtctgggacgcgtgaacaaactggatcgtgtggggcacaagcagcataaggttcttttggcaaggttgcgatccgtaattcctctaccatcacatatggacatcgaacgggccgagcagcaggtgactcgattgcaaaatgacagtgccaaagccggctacaaggaaacctactggttttatcgcaggtggtatgtggccagccagcgtattggcatacttaaacgctcatttccgggcaaggctagcgaactgcgcgaacggcttaatcagctgcgacccatcaagaactacgaatga

SEQ ID NO: 10695 - RNA, 1209 nt, unidentified
  source 1..1209: mol_type = other RNA; note = synthetic construct
atgcattccccaataagactccagccgatcaaagtggctagaggttcggtccccaccttagccgccttgtgctccgccctcgacatccaacgggctgagctcgatgccgcccttgctcttacggcagccgaaagataccaggtcagaaccgtgccgaaggccgatggaagcgaacgcattgttcacaatccccaccatctgatcaggaaaattcagcggcgtctgaatcgaagattttttgccaaccctgacgtcatcaagtggcccgatcatgtgtttggctctatacccaacgacgacttgagcacaagcccggcagcggataaagattacgtgaactgtgcgcggcagcactgcggagcgaagtctattctgagcgtagacattaagaatttcttcgacaacatccaccgcgataaggtcagggacgtgtttaccctattctttaagtatcctacagacgtggccgaagccttagcagacgtgtgttgcaaggaagaccatgtagtgcaaggggctctgactagctcctacatagctacgctgtgcctctacgatgtcgaagggcttgtggttagtaagttaagacacaaaggactggtgtatactcgtctggtagatgatattacagtgagttcacgcgtgactggctatgatttttcttatgcattgaggctcattgagagtatggtggattctgccgggttgccactcaatacacgaaagaccaggattcagagcgtcggcatgaggcctcttctcgtgcacgggctgcgagtggacttcgctgaaccacgcctgcctcctgaggaaccaaggaagatccgggcgtcagtaaaacaggttgagctgctggccgcatcacccggttatcgcgcttctagggcctaccggagggatttcaaccgatgtttgggcagagtcaataagttggcacgcgttaagcatacccaacacctgcctctgctgaagcggctacagaaaatagttcccctgccatcccacaaggacatcgagcgcgcagagaaacagatcacccggctggagagggactccctcaagcctggctacaaggatacatactggttctataagcgatggcatgttgcatccgagagactgactatcctcaaacggagtttcccaaaaactgcttcagacatgcgtgaccgccttagaaaactacaccccaaaaaagcttacgagtga

SEQ ID NO: 10696 - RNA, 1209 nt, unidentified
  source 1..1209: mol_type = other RNA; note = synthetic construct
atgacttatactgccaaacttcacccggagaaagtcgccctctccagcatctccaatattgataacttgtgtgatgctctcgacatcagcgtggccgagttgacagctgcgatgaagttgtccccagaacagcgttacacctccggagttgtgcccaaaaaggatggttccgaccggattataaataatcctcaccacctgatccgtaagatccagaggaggatcaacaagcggatttttagcgaccaggacgtgattagttggccagatcacgttttcggaagcattcctaatgacgatctctctatttccccagcgtctgacaaggactatgtgaactgcgccagacaacattgttgtgcaaagagtgtgctgagtgtcgatatcaaggatttctttgacaacatccactacgaagcagtcgtgagcatattcgagtcgttcctgaaataccctgcagatgtggctgatgctctggctaacgtttgctgtaagggggaacatgttgtccagggtgcattaacatctagctacattgctacactctgcctgcatgccgttgagggcgatctggtaaaacgccttaggcacaagggcctggtgtataccagactggtggacgatataacgatctcctcaaagctcgctaattacgacttcggattctctctcaaacaagtcgaaaagatgctgcatggcgctgacctgcctcttaacgatggtaagacccgaattcagcatgcatctatgcagcctctcatcgtgcacgggctgcgagtagacttcagtcagccgcgattgcccccatcagaaccccgaaatataagagcagcagtgaagaaccttgaactaatggccaatagccccgggtatagagcgagcagggcctaccggcgggactttaaccgctgcatgggcagagtcaacaaactgggcagggtgaaacacaatcaacactcagagctgctagcccgcgtacggcgtgtcttgcccttaccctcacataaggatatcgagagggccgagcgccaggtagacagacttgaggttgactttctgaagcctaactaccggagtacctactggttttataaaaggtattacgtggccatggaaaggttagggattctcaaacggtcttttccaaagaaagccgccgagttgcgcgcgagactgatcgtgatgcgcccatcaggaaaatatgagtga

SEQ ID NO: 10697 - RNA, 1209 nt, unidentified
  source 1..1209: mol_type = other RNA; note = synthetic construct
atggcccatactccccggtttcatcccgtcaaggagagcgccggctcaattgccgatgttgcctccctgtgcgtggctctagacgttgcactgtccgagctctctagcgccagaaacttaccagcagaccagcgctattttcgcagggaggtccgtaagaaggatggctcaatccgggttgtctacaacccacattacttgatacggaagatccagcgcagaattaaccgtcggatttttagtaatagctccgtggtgtcatggcctgaccacatcttcggaagcattcccaatgatgacttctctgagtcagatgcaagtgaaaaggactacgtgaattgtgccaggcagcactgtggagcaaaatctgtgctgagcctcgatatcagagattttttcgacaacatccaccgtgaaatcgtgcgcggcattttctctagattcttcaattacccagacgatgtgagtgacgctcttgcggacgtgtgttgcatgggggaccacgtagtacagggtgctctaaccagcagctacatcgcgaccttgtgcctgtgggatgtagaggggcaggttgttcggaaactcgggtacaaaggtctggtgtatacacggttcgtcgacgacatcaatatttcctctaaagtcgctcgctatgacttttcttacgccttgcggctggtggaggagatggtgtccgaagctggactgccactcaacgggaagaagacaaaaatacaatatgcgagcattaagccgctgattgtccacggacttagggtagatttcgaccaaccccgattaccacctgaagaacctagaaacatcagagcagccgtgaagaaccttgagctgctagccgcatctcccggctatagggctagtcgatcctatcggaaggattttaaccgatgcctgggacgcgtcaataagctcgccagagtggggcatcagttacacgaatttctgatgcagagactgaggaagatcctccccctcccttcgaatatggatatcgaacgcgccgaaaaaatgatttcaagacttgagagggatgctgtgaaatccggctataccgaaacttactggttcaaaaaaaggtacttcgctgcctcggagaggataggtatattgaaacgatcctttccgaacaaggcaaaggagctgagggagaagctgaaaaatatcggccctagtacgtaccgagagtga

SEQ ID NO: 10698 - RNA, 1206 nt, unidentified
  source 1..1206: mol_type = other RNA; note = synthetic construct
atggagacgcccaaatttaatccagtaaaggaagcgcccgggtctatctcaagtatcgctgggctgtgctctgctttggatatcagccagtccgaattggatgaggctcttgccctgcccgtggaagagcgatacaagaagggagaggtgcccaaaaaagacggcagtatgaggatagtcaacaatcctcattacctcgtccggaagatccagcgcagaattaacaagcgcatcttttcagattccaatgtgatttcttggcctgaccatatattcggatctattccaaacgatgacctcagtgacagcgtagcagcagataaagactacgtgaattgtgcacgacagcattgcggcgcaaaaagtgttctcaccctcgacattcgcgattttttcgataacatacacagagacagggtgtttgggatcttcttcaagtttctcaagtatagcgaagacgttagcaatgtgctagctgacatttgttgtaagggcggggccatagctcaaggcgctcttacttccagctacatagctaccttatgcctgcacgagacagagggtgacctggtcaggagacttcggtataagaacctgacttacacccggtttgtcgatgatatcacaatttctagccgtgtggcgaattacgactttaagtacgccctcggtctgactgaatcaatgctgtccgaggccggcctgccaattaacggacagaagacaaagatccagtatacatcaatgaaacctctgattgttcacggtttacgagttgatttcgaccaacctagattgcctccagaagagcctagaaaaatcagggccgcggtaaagaatttagagctgttggccgcaggcccaggttatcgtgcaagccatgcttatcggaaagacttcaacagatgcatgggacgggtgaacaaactaggaagagtgggccactcacagcacagcattctccttaacaggctgcggaaaatcctgccgcttccctcccacatggatatcgagcgagtggaacgtctgatcgcccggctggagaaggatgtcgccaaaccgaattattctgaaacctattggttccgcaaaaggtactacgccgccagtgagcgcatcgggatcctgaagagatccttcccaaagaaagccgaggagttcagggggaagttgagggaaattcgcccctcctcgcagtacgaatga

SEQ ID NO: 10699 - RNA, 1209 nt, unidentified
  source 1..1209: mol_type = other RNA; note = synthetic construct
atgacccagcctcaaagatttgacccgatcaaagtgtcagctgagagcatagccacaattgattctttgtgcggggccttagggattggagcggccgaactcgctcaagcacgaggtctggccccatccgagagatatatccaaaaggagctcccaaaaaaggatggctctactaggatcgtgcataatcctcattacttagtccgtcggattcaaagacggatcaaccggcgcatttttagcaaccctagtgttatttcttggcctgatcacatcttcggttctatccccaatgatgatacttatgagagcctggtttatgagaaagactacgtaaattgcgcgcgccaacactgtggcgccaaatccattctttccatcgacatcaaggatttcttcgacaatatccacagagatcaggtgtccaggatattcaaaaacttcctccactactcagacgtggtggctgaagccttgaccgacatctgctgcaaggatgcctcgatcgtccagggagcactcacctcttcttacctcgctacactgtgtctgtttcgagaagagggcgcactagttaagaggttagggtacaagggcctagtctataccaggcttgtcgacgacattacgataagtagcaagatcagcaactatgacttcagctatgccctgggacaggctgtccagatgctgagtgaggccgatctgccactcaatgctaagaaaacacggatacagtacgcatccatgaagcccctgatggttcacggtctgagagtagactttcagcagcctagacttccaccggaggaagccaagagaattagggcggccgtgaagaacctggagctgctcgctgctagtcctggctatcgagccagtcgcgcctaccggaaagacttcaaccgctgtatgggacgcgtgaataaactgcggagggtggaacataatcagcatccagtgctaatcgctaggctccgtaaaattctgccccttccctcacatagcgatattgtgcgtgcagaacagataatccagcgactgaagaaggacatgtcccgccccaactaccaggggtcattctggtttcacaaaaggtgtcacgtagcagcagaaagacttggcatcttgggacggtcctttcccaaaaaggcgaaggagctgcgggaacagttgaaattgattcgcccatcaactgggtacgagtga

SEQ ID NO: 10700 - RNA, 1206 nt, unidentified
  source 1..1206: mol_type = other RNA; note = synthetic construct
atgccccagttccagaagctacacccgattaaggaaagctccggttctattgcgaatattgatgccctctgccgagccctggacatctcatccaccgaacttgcccaagttcgggctcttagcagcagccagagatacgagaaaaaggaggtcccaaaaaaagacggatccactcgtacagtccacaaccctcattacgcactgcgtaaaattcaacgccgaattaatcggagaatatttgcaaacccagatgttgtgtcctggcctgactacatttttggttcaatacccaatgatgaaagtgctgaggatcctatagatcgggattatgtgaactgtgcacgacagcactgcggagcaaagagcatattgagtgtggatatcaaagacttcttcaataacatccacaggcatcaggtgatcggcatcttcaaaaacttcctcaagtattctgaggaggttagcgtgatcctcgctgatatttgctgtgacgatgaacacgtggttcaaggcgctctgacatcgtcatatattgcctcgctctgtttgttcgaaaccgagggcgacctggccaagaaacttgggtacaagggactggtctacacacgatttgtggacgacatcactatcagttcaaaaatcgctaagtacgagtttagttacgcactgacgctcactgagcaaatgttaaatgacgccggtctaccactgaactctggcaaaaccaaggtgcagaacgcctctatgaagcccttaatagtacacggcttgagggtagacttcgaacagcctaggctgcccccggatgaggctcgtaggattagagcgtcagtgaagaatctcgagttgctggcggccagtccagggtatcgcgcaagcaggtcctaccggaaagatttcaataggtccatggggagagtgaataaactggcccgggtcggccatagccagcactctatcctgctttctaggctgcggcgcatccttccattaccctcccacgccgacattggaaaagcagaagaattgatccagcgcctgcagaaggacttttggcgccccaactatcagacctcctattggtttcataagagatatcatgtcgccatcgagaggctggggattctaaagcgctcttttcctaagaaggctgaagagctcaaccggatcctgaagctcatcagacctgctagcagaaacgactga

SEQ ID NO: 10701 - RNA, 1206 nt, unidentified
  source 1..1206: mol_type = other RNA; note = synthetic construct
atggaggctagacagatcgacatatataacccaaagaagataagccttgaaagtatcggatctctggccaagctcgcctcgtgcctggatgtgaccctcgaggaaattcaagaagcccaagagctaagcgctagcgagcggtacaagatcaaagagacacctaagagagatggatcattacgtaaggtctattccccccactttttgattcggaaaatacagcgaaggattaacgcacgtatcctgagtaactcagacgtaattgcttggcctgaccacatttttggctccgtgcccaatcagcattgcggcgaaagcctagtcgtagagagggactacatttcgtgcgctcgaagacactgtggcgccaaatccgtgctcactctcgacatccgcaatttcttcgataacattcaccaatcctacgttgagaatatctttacggagttccttaaatatgacgttgaggtgtccaaagtgttgagcgatttgtgttgcttagacgggcatgtggtccagggggctctcacctctagctacatcgcatctctctgtctgtgggacgtcgaaggagagttggtcgtgaaactcggccacaagaatcttgtgtatacacgctatgtggatgacatgaatgtgtcttctgtgatcagcgattacgatttcacctacgcagtgagagccatagaagttatgctggacaagaaaggtcttccgctgaaccccaataaaactaagatccagcatatttcaacggaacccctaaccgttcatggtctgagaattggtttcaaggagcctaggctgccaagttccgaagtccgaaacataagagccgcagtgaagaacatcgagatcctcgcgtcagagcatcgttaccggacatcccacgcattccgcaaagactttaacaggtgtatgggccgggtaaacaagcttggccgcatcgggcataaccagcaccagaagctggtcctgaggctgaaaaaagttatcccattgccaagcaaaaaagatattgtacgcgcgaagaagattgtggaaaggttagagaaggattactccgccaataaatctactttctggtatatgaagcgcttttacctggctcacgaaagactgaatatcctgcagcggacttatttcaagaccagtgccgaactgaggggacggctgaagtcaatcagtcctacatacgggttttga

SEQ ID NO: 10702 - RNA, 1188 nt, unidentified
  source 1..1188: mol_type = other RNA; note = synthetic construct
atgacgcaatataaccccgaaaagaaagcatccgggtcaattgccggtctggacaatctgtgcagtgctctggatatacatagaagcgagctggacgaggccctggcgctgtctagctctgctcgctacactgctcggtcgatccataagaaagacggctcactgcgcgtcgtacacaatccacactacctgattagaaagattcagcggcgcattaacagaaggatttttagcaatgcgagcttgattagatggcccgaccacatcttcggatctatcccaaaccagagttctgacgacggtgtgcctatcgcaaaagattatatgagttgcgcctctagacactgtgaggccaagagtgtgttaaccctggacattaagaatttcttcgacaatatccatgcgaccctcgtgaggagcgtattcctagatttttttaagtactgccctgaagtgagcgatgcactttccgacatctgttgcctggactcccaccttgtgcaaggggctcttacttcgagctatatagcttgcctctgtatgcatgacatagaaggcagcgtggttgagaagctgaatcgaaaaggcctcgtttacacaaggctagtcgatgatatcaacatctcatcccgtatctcccaatacgacttttattacgccatttccatggttgacaacatgctcttagagaagggcttgcagctcaaccttgacaaaaaacgggtccagtacatatcaaccgagcccttgaccgtccacgggctgaggatcgcttttaaggaaccaaggcttcccgcagatgaggttcgacggatccgtgccgccgtgaggaatatagaaacaattgcctcagagcgggattaccgcacgacacacgcctatagaaaggatttcaataggtgtatggggcgggtgaacaagttatctcgcgtgggacacaaccagcataaactcctagtgggaagactgaagcgagtgttcccactgccttctaaaaaggacatcgatcgcgtcaccactattgtaactaaactcgaagctgatagtggccagaagaaaggaacatactggtactggcggcgtttctatctcgcacatgagagattgaccatcctgaacaggtcctttcctcacgccgcacaggatttgcgccagcgactgaaactgttgaagccgctctatgaatga

SEQ ID NO: 10703 - RNA, 1203 nt, unidentified
  source 1..1203: mol_type = other RNA; note = synthetic construct
atgatccctgtctcttctacaacccgcctgtaccccgttaagactgctacccacgccatcactacaatccaaggcctgtgcgaggctttggacatagtggtggaggagcttgacgatgtgctgctgatcccgccaaaagataagtattctagccaggaaaggcggaagaaagatggttccgtgcgggtcgtccacaatcctcaccatcgactaagggtgattcaacggcgtattaacaagaggctgttcagcaaccagaatttcgtatcctggcccgatcacatattcggctccattccaaatcagaaattcgagggcagtaaacaccccaaagactacgtggcatgcgccaaagtccattgtggagctaaaagcatcttgaccttggatatagagaacttctttgggaacatccatgtctcccaagtgatcaaggtattcactcagcttctcaagttttcacctgaggtcgccgaagtagtttctaagatttgttgccacgaggactacctcatccagggagccttaacatcatcatacattgcaggactgatcctgtttgatgtggagggcatggtcgtcgaaaggctcctgcgaaagaatttacgctatacgcggctggtggatgacatcaacgtttccagcgtggtgagtgactataacttttcgtacgcaaagacaatcattgaagacatgcttatagggaaggacctacccgtcaaccattctaagactaagattcagtacagcagcactgttccccttaccgtgcacggactcagagtggggtttaaggaaccaagactgccctccgacgaagttagaaaaatcagggccgctgttcattcaatagagctcatggccaaggagccaaactacaaaacaacccacagctatcgccgtgattttaaccgttgcatgggccgagtgaacaagttgtgtcgggtggggcataatcaatatgacaaactgcttctgcggctccagaaaaattacccactccctagtaaaaaggatatcgagcgcgctatcaaaattgttacgaagctggaagtggattatcctaccaagcagggtaatttctggttcgccaaaagattttatctggcacacgaacgcttaaatattctacagaggagttttccgaatgtggcgtacgacttgagattcagactgaaggcgattaaaaccgtatacgagtga

SEQ ID NO: 10704 - RNA, 1194 nt, unidentified
  source 1..1194: mol_type = other RNA; note = synthetic construct
atggtgagggtcccgcaattatttccgaagaaaaccgccgtaggctcgatcgcaactattgaccagctgtgtaacgctctgtccatcaccgaagacgagctgagagaggtcattctgcttcccgatatccttcggtattcctccaggccaatccctaagaaggatggctctctccgattcgtgcataatcctcacttccgattgcgccgcattcagcggagaatcaataatcgccttctgtccaatcagagctttctgtcttggccagatcatatctttggctctatccctaaccagcaattcgacgatggcatccatgccaaggattacatcgcctgtgcgcgggtgcattgtgaaagtaagtcaatactgacgatcgacatagctaactttttcgacaatgtgcacatcagccatgtcctgcaaatatttcgggatttgctgaagtgctcagagattgtttctgaggtgttagcagacatatgctgccacaatgacgctctaattcaaggagcactgacctccagttacattgccgggctagcactctacgacgttgagggtcgcgtggtcgagagactggcgcgtaaagggctgcgatacacacgcctggtcgacgacatcaatgtgtcgagcaaaaacagcgagtataactttgattacgctaaaaagatcgtggaggacatgttgttcagcaaagacctccccgttaataccagcaagacaaaagtacagttctcctcaacactgcccctcgctgtccacgggttgagagtgggctttaaggaaccacggcttcccggggaagaagtgtctaggatccgggccgcggtccattccattgagatgatggcaagggaaccaaactatagaacatctcacgcttatcgcagagatttcaaccggtgcatgggtcgtgttaacaagctaagtagagtaggtcacaaacagcacggaggacttgttcaccgcctccaccagattatgcctctcccctcacagaaggatgtgcagcgtgccattaaaattgtggagaaacttgaagccgatttcagcttaaagcggcatacttattggtacgccaaaaggttctacttggcccacgagaggctgaacatcctcaagaggagttttcctggaataactgatatgctgaggctgcgactcaagccaattaaagccagatatgaatga

SEQ ID NO: 10705 - RNA, 1197 nt, unidentified
  source 1..1197: mol_type = other RNA; note = synthetic construct
atgcccaccgtccctcagctgaatcccgtcaaagtatcaacagagagcatcataacggttgagaacctctgcagcgcactgtctatcactctggaagagttgaacgaagtgcgttccataccaaatggggagcgctacattgcctcccagatcccaaagaaggacggaactatgcgcgtcgttcacaatcctcattttcggctgagacggatccaaaggcgaattaacaaacgaatactgtcacggcagagcgtggtttcatggccagatcatatctttggatctatccccaatcagctggatagtgaacggattgaacacgagaaggactatgtggcctgtgcaagagtccactgcgaggcgaagagcattttatcgattgacatagctaacttcttcgacaacattcacatcaccaagatttccaaaatcttttgtgagttcttcaagtattccacagaggtgagtaatattcttgcagaaatctgctgtcacaacgacaatctgattcagggcgcattgactagttcatacttggcgacccttagcttgtatgaggtcgagggcaaagtggtggaaaggctgttaaagaaaaacctgaggtacacacggctggtcgacgatatcaccgttagttcaagactggccggctacaacttcgattacgctaaagccctcatcgaggaaatgcttattgatatggacttgcctatgaactcctctaagacaaggatccagtacaacagcacagtgccgctgaccgtgcacggcctacgagtagcctttaaagaacccagactgcccggggatgaggttcgaaagatacgtgctgccgtccattctattgagcttatggcttccgagcccaattacagaactacgcatccttatcgcagggactttaataggtgcatgggtcgggtgaataaactaagccgcgtggggcaccagcaacattctgtgttagtaaacaggcttcggaaggtgatgcctctccctagtccaaaggatatcgagagaaccattaagatcatcacacgcctggaacgggactatccaactaagcgtggaaccttctggttttcgaagagatattacctcgcccacgagaggctcaatatcctgaaaagatctttcccgggtataagcaaagaactacgaaaacgcctcaaaccactccgctccaagtatgaatga

SEQ ID NO: 10706 - RNA, 1191 nt, unidentified
  source 1..1191: mol_type = other RNA; note = synthetic construct
atgattatactgaggccctacaagaaaattccctcgagcatcgctaacatagacaacctgtgtagcgcgttagacattagcacaactgagctggacgaggccatcagtctggctgaaacagacaggtaccaggtccgagagatcgccaaaaaagacggtagccctcggcgcatctataatcctcactatttgatccgcaagattcagagacgcataaaccaccgcatattcacggatcaaaattttctcgggtggccagattatatcttcggaaccattcccaaccagaaaaagtcggacggaagaattgtgcagcgagactacatttcttgtgctaagatccattgtaaatccaaatccatagcgtctatcgacatccaggatttcttcgataatattcacatcgatcacgtggagaacatcttctccaaattctttaagtacccagacgaagtgtcagaggtcttggctaatatctgctgcctgaattcccatgtgatccagggggccctcacatcttcctatattgcttctctttgcctgttcgatgttgagggcgatgccgtggaacgcctcattcggaagaatctgcgatatactagactggtagatgatatcacaataagctccactgtctctaactataactttgactacgcactaagtatcatacgtaagatgttggagagtaaggaccttcccatcaacgagaataaaacgaagatccaatacgcctcaaccgtgccgttaaccgtgcacggtcttcgggtcgccttttctgagccaagatttccatcagacgaggttcgtaggctcagagccgcagtgaagaacattgaaactctgtcccaggaaaaaaattaccggacatcacacgcatatagacatgattttaacaggtgcatgggccgcgtgaataaactcagccggatcggccacaaacagcacgcagcactagttaagaggttacaaaaggtaatgcctctgccgagtcagaaggatattgaaagggccttcatgattattgaaaggctcgagaaagattattctacccataatagctcctactggtacagtcggcgctactatttggctcatgagcgactgaacgtcctccaacggacctacaccagaatcgcctcagacctgaggagcaagcttagatatctgcgtcctagctacgaaaagtga

SEQ ID NO: 10707 - RNA, 1197 nt, unidentified
  source 1..1197: mol_type = other RNA; note = synthetic construct
atggaaaagcagcctcagctgaatccagtgaaaactgccgtggacagcatcgcctctgttgcaaatttgtgccacacgctgaacgtgacacaggaggaattggacgccgccctcaccttagaccccgaagagaagtacgaacgcagagctattcccaaaaaggacggaagcgaccgtcttgttttctcccccgatcgccgtctccggaaaattcagcgaagaataaataaacggatcttcgcggcccaaagtgttgtcagttggccggatcatctttttggctcaatcccaaatcaaaacggccccgaaaacattaaaatagagaaggactatgtggcttgcgccagacggcactgtcagagtaaatccatcctcaagattgacatcaagaactttttcgacaacatctcggaattccacgtgaaggatatcttcgttaacttcttcaagtacagcgacgacgttgctaacgtcctcgccaacctgtgttgccttaacggacatgtcattcagggtgcattgacctcatcttatatcgccgggctctgtttatatgatgtagagggagatgtggtacgaaggttggctaggaaaggactggtgtacactcgtctagtagacgatattaccgtgtccagcaagtccgcagattttgatttcggtttcgccaaaagcatcattgagcagatgctcgtggggaaggacctgcctataaatgagtctaagaccgcagtacactacgtgtccacaacccctcttacagtgcatggtctgcgggtcggctttaaagagcctcgactgccctctgatgaggtgcgcagaatccggagcgctgttaaaaacatagaaacgcttgccaaggaggactcttatcgcattacccatggctacaggcacgattttaatagagctatggggagggtgaataagctgggccgcgtcaagcacaaacagcacgagccattggtgagacgcatgaggaaggtcctgccgctgccaagcaaaaaggatatcgaaagggcaactcgcattatcgacaggctgcaggcagatcatgcggggaagcatgacacttactggtactggaagcggttttatctggctcacgagcggctgaatgtcctacaaaggtcatttcctgaagtgtcaaagaaactgcgaacaaaactcagattactgagaagttcctatgagtga

SEQ ID NO: 10708 - RNA, 1197 nt, unidentified
  source 1..1197: mol_type = other RNA; note = synthetic construct
atggcccacattccactactcaatcccctgaagacagcactcggctctatttcctcaattgactcactctgcgaggcgttgaatatcactcgggaagatcttgaggaggcacttcagctcgaccctagtgagaagtacgttcgcttgaccactcctaaaaaagacggatcggacagagtaattttcaagccagattatagactgcgaaaaatacaacgaagaataaacaagcggattttttctaaccagaacgtcgtcacgtggcctagccacctgtttgggagtattccaaatcagttcgatgcggataagacaaaaatcgaaaaggattacgttgcttgtgctcgtagtcactgcgaatctaagtctatcctgaagatagacatcaagaactttttcgacaacatacatcagcactatgtggaggacatctttttgaatttcttcaagtacccggaagacgtatctagtaccctagccgagatttgctgtcacgagagccatgtcgtccagggagccctcacctcaagctacatcgcatccctgtgtctgtatgacgtggaaggagagactgtgcggagactcacccggaagggcctgacctacacccggttagtggatgatattaccgtgtcctcaaagatcgctgattacaactttgactacactaaaaacgtcatcgaaaccatgcttgtagggaaggaactgcctattaactcctcaaaaaccatcactcagtacatcagcactacagcactcaccgtgcacggtttgcgcgttgggtttaaagagccccggctaccgtccgacgaagtgaggagaatacgctccgccgtcaagaatgtggagacactggccaaagaggacagctacaggacatcccatggttatcgccgagatttcaatagggtcatgggcagggtgaataaattaagccgggtgaagcataaacaacatgccagcctcgtgaaacgaatgaggattgttctgccccttcccagtaaaaaggatatcgataggacgacaaggatcgtggaacgtctgttaactgattatgctagcagacatgacacgtattggtattggagacgctttttcttggcccacgaaaggctgaatgttctgcagcgctcgttcccagaggtgtctaagcacctgcgtaagaaacttaagctgatcaaacccacatacgagtga

SEQ ID NO: 10709 - RNA, 1191 nt, unidentified
  source 1..1191: mol_type = other RNA; note = synthetic construct
atggccgccattctcaacccaatcaaagtggcaacaggttcaatttctagcatcgacaacctgtgcgcagctcttgacatcacacgggcagaacttgatgctgcccttgaactggatattctgacgaggtatcaacgtgatgaaaccccaaagaaagatggatcaatgagagtcgtgtacaagcccgactacagaatacgaaggatccagcgcagaattaacagacgtatcttcagtagggctgacgtaattctgtggcctgaccacctcttcggctcgatcccaaaccaagagtcagacgatggcgatgagattcagaaggactacgtggcttgtgcaaggcttcattgcgaggccaagtccattgtcagtatagacatccagaacttctttgacaacattcatagcgatctggtcctggatatctttgaaaagttcctgcagtacccgagcgatgtcgcccggacgttgaccgatatttgctgtaggggcgaccatatagtgcaaggagcgttaacttcctcctatattgccagcctctgtttgtatgacatcgaaggaaaaaccgtggagagattgagcaagaagggcctcacatatactcgcctggtggatgacattactgttagctctaagatcgccaattacaaatttgactacgccatgtccgttatagaggacatgctgacctctaaggatctgcccattaacacctctaagactaaaatccagtacgtgagcacaacaggtctattggtgcacgggctgcgggtaagtttccagcagccccgactcccttccgatgaggttcggcgcatccgagctgctgtccagaatatcgagacactcgccgctgaaaaggggtatagacagacccacgcatacaggcaggactttaatcgatgcatgggccgtgtgaacaaattatcacgcgtggagcacaatcaacatgctaattttctccggcgcttacagaagatcctcccacttccttctaaaaaagacatcaaccgcgccaccaagataatcgaaaatttggagcgggatttcgaaaagaaaagtgggacttactggtacgcaaaacgcttttatctggcgcacgagaggctgaatgttctgaaccggtccttccccgccataaccaaaaggctgagagcgagactaaagcctctaaaacagaattatgagtga

SEQ ID NO: 10710 - RNA, 1191 nt, unidentified
  source 1..1191: mol_type = other RNA; note = synthetic construct
atggccctgctcaatccaagaaaggtgtcaaccggatccataagttctattgaaaatctctgcagcgccctgtccgtgagcttagaggagatctatgcagctctgtcactgcctgacgaggagaaatatgccgtctcccaagtgttcaagtcagatgggagtgtcagactggtccacaacccccacttcttgttgagaaagatccagcggcggattaataagagaattttcagcaggctttcaatcatcgaatggccagatcacctttttggtagcgttccaaaccagcgagaacaggacaccaaacgcctaattaataaggactacgtgagttgcgcagcaaagcactgtggcgccaaatctctgctgaaagtggatgtgaaagacttctttgataacattcacaaggacctggttctggatatcttcagtaactttatgaagtttgaccgtgaggtatccgagttgctcgctgagatatgttgtttccgctcccatgtaatccagggggcccttacatcttcataccttgcctccctctgcttgcatgatattgaaggcgcagtggtccacaggctgagccggaaaggactcgtgtataccagactggtcgatgacatcactgtttctagtaagatctcgaactacgatttttcttttgctctcgacatcattagggctatgctaacctccaaggacctgccgctgaacatagttaaaactaggagcatttacgtgtcttcggaaccactcacagtccatggattacgcgtcgcgttcccccaaccgaggttacccagcggcgaaatcgcccggattagagctgccgtgcgcaatattgagaaccttgcgagtgagcgtggctatcggactacccatgcctatcggcatgacttcaataggtgcatgggccgcgtaaataagttggttagagtgggtcacgaccggtacgatagcttgctcgctcgccttaagcagatattccctctgccttctaagaaagacatagaaagggcaagagcgatgctggatcggctagcccgcgattgtgctacaaaacgatccacgtactggtatgccaaacgatattacaagctgcaggagcgactcatcatcctgaagcgtagctttcctgcagtgacaaaagaaatcaggaagtcactgaaggggttaaaacccgactacgagtga

SEQ ID NO: 10711 - RNA, 1191 nt, unidentified
  source 1..1191: mol_type = other RNA; note = synthetic construct
atggtgctgctcaatcccaaaaaaattagcgcaggttccataagtagcatagagaacctatgctccgcactagatatcacgttggaagaaatttatggcgccctgagcctcagcgaggaagataagtacgccgttacagagatttccaaaagcgacgggggcatccggctcgtacataacccaaattatttgctgcgtaagattcaaaggcgggtaaacaagaggatattctctaggccgtctgtcattcaatggcccgaccatctttacgggtccgtgcctaaccagagaaataggcagaacagtgagatgttaaacaaggattacgtctcatgtgccgccaagcactgcggcgcaaaatccctgctgaagatcgatgttaaagatttctttgacaacatccaccagaatctcgtgctcgacatctttaacaactttatgaagttcgatggtgaggtaagtggactgcttgccgagatctgctgctttaaaagccacgtcattcagggcgctctcacttcttcataccttgccagcttatgtctctatgacgtggaggggagtgtcgtggagcggctgatgaggaagggcctgatctataccagactggtggacgacattaccgtttctagcaaggtttccaattatgatttcgggtatgcgcttgatatcatacgcactatgctgacctctaaagacttgcccgtgaatctagctaagacacgcgcgatatatgtgtcgtccgaaccactcaccgtccacgggctgagagtgggattttcacagccccgtcttccatcaggagaagtggccaggattcgctcagctgttcgaaatatcgaaagtctggcctccgaaagaggttaccgaaccacacatgcttaccgtcatgatttcaatcgctgtatgggccgggtcaacaagctggtaagggtgggccacgatcgctacgaatctttgctgaaaaggctgcggaaggtgttccctcttccttcgaagaaggacatcgagcgagcgcacgcaatgctcgcccgactgaatcgggactatagcgacaaacggggaacttactggtatgctaagagatactacaaattgcaggagagattgatcgtgctgaaacgctcttttcctgctgtcacaaaagagattagaaaggcaatcaagggattacagccagactacgagtga

SEQ ID NO: 10712 - RNA, 1194 nt, unidentified
  source 1..1194: mol_type = other RNA; note = synthetic construct
atggccacacaattggcccctaagaaggtaagtaaacgttcaattgcatcgatcgagaatctttgcagcgcactcgatatctcactgtccgagatttactccgcgctgagcctcagcgatgaggaaaaatataaggtcagtacgagagccaaatccgatgggaccgataggatcgtccacaacccgcacttcctactgcggaaaatacagcggcgcataaacaagcgcattttctccaagccttccgtgatcaagtggcctgatcacttgtttggctcagtgcccaaccagctcgatcagagtatgacccatatcatcaacaaggactatgtctcatgtgctgcaaagcattgcggcgctaaatctatactgaaggtggatatcaaggacttttttgacaacatccatgaggatctcgtgctggacattttccgcaacttcctcaaatttgatcaggaggtcagtgagacgttgactaatatttgctgttttcatagcagacctgtgcaaggcgcactgacttcttcttacctggcatctctgtgtctatacgacgtggagggctccgtggtggaaaaattgtcccgcaaaggccttacttatacacggctggttgacgacatcacagtgagcagcaaatctaacaactacgactttagttacgcccttgatattatcaaaggtatgttaacagccaaagaactgccacttaatgttgcgaagactaagtccatatacattagctcagaaccgctgagcgttcacgggcttagagtcagtttccctcagcccaggcttccctctggagaggtttcacgtatcagggctgccgtaaaaaatattgaaagcttagcctctgagaggggttatcgcaccacccacgcttatcggcacgacttcaataggtgcatgggacgggtgaataagctcgtaagagtggggcataatcgccaccagcccttgctcgacaggctcagaaaggtcttcccactgcccagcaagaaagacatagaccgtgccagagccatgctgaagagactgatgcgggacaaggattccaaaagggacacctactggtacgcgaaacgatattataagctacaggaacgattaatcgtgctggagcgatcgttcccagcctcagctaaggaaattcgagcttctctgaagggactgaagccatcctacgattga

SEQ ID NO: 10713 - RNA, 1188 nt, unidentified
  source 1..1188: mol_type = other RNA; note = synthetic construct
atggccgctgtgaaccctaaaaaggtgacttccgaatcaattgctaatatagataggctatgcgctgccctggatataactgccgaggagctctgtcaggtccagaatcttcatgaggatgctaagtatcaggccagcaccgtggaaaaatcggatggaagtttccggaaaatttacaacccagactttcgattgcgaaaaatccagaggaggatcaacaagagaattttttccaactcgaaggttatagcctggcccgaccatctgtacggctcagtcccaaatcagatcaatgacgacttcgacctgatcaacaaggattacgtttcttgcgctgcaaaacattgtggggctaaaagcatcctgaagctggacattaaggacttttttgacaatatccacaagatcattgtgcacgacatcttcctgaatttcctgaagtatccacaagacgtcagctctgccctggcttcaatctgttgcctcaacgatcacgtagtgcagggcgcattgactagcagttacctggcttctttaagtctgtacgatgtggaggggtatgtggtggagaaactgcaccgcaagaacctagtgtataccagactggtcgatgatataacagtgagctctaaaacctcaaactatgacttctcttacgcgattaacctcattgaaggaatgctgacagaaaaggaactccctttgaacaagaagaaaacaaaggtccaatacaccagtagcgagcctctcactgtccacggccttagagtggccttcaaacagcccagactcccgtccgatgaggttgcacgcatcaggacagcagtgaagaacattgagacattggcaaaagaggtgggttataggaccaccctctcttaccggcaagactttaatcggtgtatgggacgcgtaaataagttatcccgcgtaaatcatgagaagcacttgggtcttgtaaagcggctggttaaggtctatcctcttccctcaaagaaagatatatcccgtgcggaggcaatcgttgcccgtcttgaaaaagattacgcctccaaacactccacgtactggtatagcaaacgcttccacacggcgcatgaaagactaaatatcttaaagcggagttttccctgcgccgaaaaggccctgagaaaaaggctcaaaagcctgcgaccaatttacgactga

SEQ ID NO: 10714 - RNA, 1200 nt, unidentified
  source 1..1200: mol_type = other RNA; note = synthetic construct
atgacccggaatgtgaccgcccgtagctttaagatctctacccgatccatctcgaatttggagaatctgtcttctacgctgtccatccccttgaaaactctccagaaaacactggtgttacccaagccagacagatatcggagagacgaactgcccaagagtgacggaggcatcaggatcatatacaacccttcccaaatgattagacttgtgcagcggaggattaattcacggatattatcaaacaaccagattctcgcctggccgccttttctgtttggctccatcccaaaatccaaagacgcgcttggtaatgagatcacgagggactatattacttgcgcagcccagcattgtggggccaagtccttactcaagctggatgtgaaggactttttcgacaatgtacacgcagatctggtctatggggtctttagccaacttctgaagtttccccacctggtttcagcatctctcacgaatatctgcaccttcgaatcccatttaatacagggtgccctcaccagcagttttttggcaaacctgtgtctccacgatgtggaggctttcgttgtcgatagactggctaagaaaaatctcacctatacacggtttgtggatgatattactatctctagcaaaacctcaaagtatgatttcagctacgcgctgtcaattgtggaagagatgctgacatctaaagacctacctctcaatcgccaaaagacaaaggtgtacttcagcagctctaccccgcttactgtacacggcttgaggatatgtttcgccgagcctcgacttcccagtgacgaggttagaaggattcgcgctagtgtcaagaacctggaaacaatcgctaacgagcgctcctaccgaatgactcacgcctacagacacgactataacaggtgcatgggaaaggttaacaagctcgcccgcctaaagcataaccagcatattccactgctagatcgactgcgcaaaatccccccattgcctagtaaaaaagacattagccgtgcaatacagattgtgagcaggcttgaacgcgatttcttcctgaaaaaaaacacttactggtactaccggcggttctacatcgcttatgagaggcttaacgtcctgaagatctcgtatcctcgtatgacaaaactgttgaagattagactgaagaaactcaaaccaatctacgaaaagtga

SEQ ID NO: 10715 - RNA, 1197 nt, unidentified
  source 1..1197: mol_type = other RNA; note = synthetic construct
atgaccagaaccgtagctgcacgtagctttaaagtgagtaacagttccattgctgacctgcagaatttagcaaccgcgctttctgtcccgctgctgacactgcagaagacactgaccctgccgaaatcggaaaggtacagacgggatgagcttccaaaatctgatggagggttgcggataatatacaatccctcccacgaaatcagacttgtgcagaggagagttaatactagaatcttctccaatagtcacatcctggcctggcctcctttcctcttcggttctattcctaagagcagggacgccctcggaaacgaggtgactagggactacatcacgtgtgcggctcagcattgcggcgcgaagtctatcctgaagctggacgtgaaagacttttttgacaacgtgcactcagatcttgtatatggagtgttcaataagctgctcaaattccctcacctcgtcgcagcctctctgactaatatctgcacattggattcccacctgattcaaggtgcactgacctcaagcttcctggctaacctttgcctgcatgatgtagaggcctttgtggtcgaccgacttgccaaaaagaacctggtttacacacggtttgttgacgacattacgatctcctccaaagtggccaagtatgatttcagttacgctcaggctattatcgaggagatgttaatcagcaaggatttacccctaaactcccagaagacaaaggtgtctcacgccagcagtactccactgacagtccacgggttgagagttagcttctcaaagccccgcctaccctcagacgaagttggccgtattagggctgccgtgcgcaacattgaaaaaatcgccgacgaacggagctatcgaatgactcatgcctacagacacgattttaatcgatgtatgggccgcgtcaacaagttggcacgtgtcgaacataatcaacatcgcccactgctcaaaaggttgttgaagctcccccctctcccatcgaaaaaagatatttcccgagcaattcagatagtgagccggctcgagcgcgatttctatctcaagaaaaacacctactggtattcacggcgcttttacatagcctacgagcggctcaacgtcttgaaaatctcttatccaaggatgaccaagctgctaaagctgaggcttaagaaattaaagcccgtgtatgagtga

SEQ ID NO: 10716 - RNA, 1197 nt, unidentified
  source 1..1197: mol_type = other RNA; note = synthetic construct
atggccgggatcgcggaagtacagcgctataaagctagcgtgcattcaatcagctcgattgaaaaccttgcctccgccctgggagttagcctgtcctttctgcaggaagtgttgcagattccagatgaacataggtataagaaatctgagttgccaaaaagtgacggtggtatccggactgtgtattcacccgactaccggattcggctgatccagagacgtataaataagagaatcttctcaaactcccgcgtgattacctggccggactttctattcggatccatccccaaccacaaagataaatgcggccaggaggtcactaaagatcacatcgcatgtgctgctagtcattgcggcgcaaagagcttactcaagctggatgtgaagaactttttcgataacgtgcacagcgacatagtttacggcgtgtttcgcgatcttcttaaatatcctgatgaggtcagtcgcgccttaacgaatatatgcacattcaagtctcaccttgttcaaggggctctgacatcgtcctatttggctagcttatgcctccatgatgtggaggcgtatgtcgtggacaggctttcaagaaaagggattgtgtacactaggtttgtagacgacattaccctatcctcaaagatctcttccttcgactttggattcgcccggggggtcgtggagcaaatgctgacagccaaggacctgccgctcaactccggtaagtctaggacgcagtacctctctagtgagcctttgatggtccacggcctgcgaatctgtttcaacgagccacggctacccgccgacgaggttaggagaatcagagcatctgtgaagaatattgaggttatcgctaatgaacgtggatatcgcctgacccacgcctaccgccacgacttcaatagatgtatgggcaaagtaaacaagctggcacggctgggccatacccaacataccgcgctggtggccaggctggttaaggtctaccctctccccagtaagcgagatatcagccgagccattcagataattatgaggctcgagagagatgtcagcgcaaaagcttctacttactggtacgccaagcgattttacatggcacacgaaaggctgaatatccttaaacgcagctatcctagaattacattgctcctccgaaatcggctgcggaagctgcgtccaaattacgaatga

SEQ ID NO: 10717 - RNA, 1200 nt, unidentified
  source 1..1200: mol_type = other RNA; note = synthetic construct
atggccatggacgcctcagccgctggtggattcaaagtgagcaaaaactctattggtagcgttgacaatttgatccagattctggctgtttcacttaaggattttgagagcgtactgatgatgccgtctgaacttaggtatataaagaccgaaatcccaaaatccgacgggggggtaagaaggattcacaaccctcacttcctcatccgactccttcagaggcggatcaacacacgcatcctctctaatcccagagtcatcggctggccatctcacctgttcgggtctatccctaaccagagagacgaaaagaataatatagacagccgtgactacattgcctgcgcgaaagcacattgcggcgccaagtctctgctcaagctggatgtcaaggattttttcgataacgtgagcgaggatctggtatatggagtctttcacgatttgctcaagtactcagaagatgtttcttctgtgttaactgacatttgtacctacaattcacatttagtgcaaggggccttgaccagcagttatctagcatccctttgtctgcacgacgtggaggcccatgtggtggacagattgaggaagaaaaaccttgtgtacacgcggttcgtggatgacataaccatctcctcgcgaaccagtaattatgatttcgccttcgcacgaagcgtcgttgagcagatgctgatctcaaaggacctgccactcaattccggcaagtcccgggttttttacacgagcagtgagccgctgacagtccatggactcagagttagtttttccgagcccagattgccttccgatgaggtgcggcgcattcgggctgctgtacgcaacgtggagacaatcagtagtgaaagggcatatagactgacccatgcctatcgccacgactttaatagatgcatgggccgtgtcaacaaactggccagggtgggccacaaccagcacaagcccctgaagaaccggttactggctgtctatcctttgccctccaaaagagacatttcccggagcatccaaatcgtgtcaaggctagagcgggatgtggcggaaaaacgagcaacttactggtactcgaggcgtttctacattgctcatgaacgcctcaatattctaaagcgcacttacccaaggatgacaaagatactgcgcgcgcgactgaaaaaactgactcccacctacttttga

SEQ ID NO: 10718 - RNA, 1197 nt, unidentified
  source 1..1197: mol_type = other RNA; note = synthetic construct
atgatcaaagacaaggcgcatcggatcttcaaggcaagcacaagctccatctcctcactggagtccctagcaagtgcattggacctgcaagttgatgacttcgagcgggtttgggcgaaggaagaatcatctaggtacacgagaaaggaaatacctaaatctggtggtggcgtgagagtggtctttaacccttgtgttgaggtgagaaagatccagcgccgcgtgaacacacggattttctccaacccacacgtggtcaaatggccaggctatctctacggaagcatcccaaaatcgctgaactcagaagatgagttggccagcagagattatatttcctgcgctaaacagcattgcgaggcaaaatctctcctgaaaatggacatcaagaacttcttcgataacgtccatgatgacctggtctatggggttttcaaagatgttctaaaataccccgaagtagtctcaaatgtgcttactcgaatttgcacctatcgcagttctctcgtgcaaggcgccctcacctccagctacctcgctatgctcagtctctataaggaagagaacgacgtagtatctaagctaaagagaaaaggactcgtctacaccaggtttgtcgacgacatatctatctcttcaaaagtgagtggatacgacttttcctacgccagaagcctggtggagaagatgcttttgaatgccgggctgccccttaatagcaataagacaaaggtgctgtacgccacagccactcctctgacccttcacggcctgaggatatgttttaaggacccaaggctgccgccggaagaggtgagacgcattcgagctgccgtgaaggagattgaaattgtagctggggagagtaactatcggaacacttacgcatatagacgcaatttcaaccggtgtttagggagggtgaataaactttcacgagttaagcataagcagcacagtaatttagtgcgccggctgtccaaggttctgcctctgccctcgcagaaggaagtcaattatgtgcagcacgccctggtgaaattggaaggcttgtttcagagcaggggagatacgtactggtaccgtaagcacttttaccagttgggtgatcgtctcaatttagtcgctcggagctatccccgcctggctgaggagatccgacgtaggctgagggaggtgaaacccacctatgagtga

SEQ ID NO: 10719 - RNA, 1197 nt, unidentified
  source 1..1197: mol_type = other RNA; note = synthetic construct
atgcggcggagctcagctcaccgagcttttaaggtggcatccggttccatcagcaatgtggaaaacctggcggccgcgctcggacttactaccctgcactttgaaaagctgtgggaaatcccggaggagttgagatacagctcgaaaacgatacctaaattatccggggaattgcgagaagtacacaatccttgcagagaattgcgcattatccagaggaggattaacactcgcatttttagtaatccagatgtggtcaagtggccatcttacttgtatggctccatcccaaaaggagacaatcccgaggacgagttcaattctcgggactacgtggcctgcgcaaagcttcattgtagggccaagtccatcctgaaactggacattaaagatttcttcagcaacgtgcacgacgatttagtgatgggggtgttctcagaagtgctcaagtatcctgatgtagtgtcacaggtcctcactcgcgtatgtacatacaagagttcgcttgtgcagggagccttaacaagctcctatctggctatgctgagtctgtatggggccgaggacgatctggtgcatcgattgagaaagaagaacctcatctatacccgctttgtggacgatatcaccatttcttccaaagtggccaattacgatttctcatacgcagcaagactggtagagcaaatgctcgttgaaaagggtcttcccctgaataccaaaaagaccataacacagtacgcttcacttgctccactaactgtgcacggactgcgggtctgctttgccgagcctagactccccgcggacgaagttcgtaggatcagggcagccgtccaaagcattgagattgtcgctaaggagaaaaattaccgccagacctacccttatcggaaggactttaaccgttgtatgggccgggttaacaagctggctcgggtcggccataaccagcactctaagttcatcagccgcctgcataaaatactgccgcttccatctgccagggaggttgagtatgttaaagcagccacactcaaactagagtctctatacgccacgaaacgtgagagcttctggtataagaagctctactacagagtcggcgatagactgaacctggtgggcagaagtttccccaacctggcaaaaagtttgcgagaaaggctcagggaggttaagcccgcttatgaatga

SEQ ID NO: 10720 - RNA, 1197 nt, unidentified
  source 1..1197: mol_type = other RNA; note = synthetic construct
atgaaaaaagattttgcacaccgagcttttaaggcctccagtggaagcatcgccagcgtcgagaacctcgcaagtgcactgtccctagaagtgtcagattttgaacggctgtgggagattcctgaggagaagaggtacaaacttaaagaactgcctaagtcctcgggcggtttccgtacagtatacaacccatgcgtggctctccgagtcattcaaagacggataaacaccaggatctttagtaacccctatatattccagtggcccgtgcatctgtatgggtcaattccaaagtccccaaacgccgacgacgaatataggtccagagactacgttgcttgtgctaaacagcattgcggagcccggagcctgctgaagctggatatcaaggacttctttgacaacatacacgaggacgtggtcttgtcaattttccgcaaggtgctgaagtatcccgaggacgtctccctagtacttacaaggatatgtacgcataatagcaaagtggtgcaaggggcgctgactagttcttacatcgctatgttgtctttacatcaggaggaacagggcgtggtggatcgcctacgtagaaaaggcctggtttataccagattcgtcgatgatatcacagtcagctctaagtgcaccaactacgattttagctatgctcagtctatcatcgagcagatgctcaataatgcggacctccctgtcaacacaaaaaaaaccgaggttcagtacgccactgcagcgccgctgatggttcacggccttaggatctcattcaacgaaccccgattaccatcgaacgaagtcaagaaaattcgggccgctgtgcagggactggagatcgttgccaaggagaataattaccgccagacgtatccatatcgaaaggacttcaacagatgcatggggcgcgttaataaacttggtcgggtgaagcacaatcagcaccaaaagctcgtgcggaggttagtgaaaattctcccgttgccttccgcaaaggaggtggcctacgtaaaaactgcagtagaacgtctggaggccacatatgaaaccaagaagtcttctttctggtacaaaaaacactactaccgcgtgaatgatagacttaatctggtgaagaggagctacaagaccttggccgtcactctcagaaagcgcttgcaatgtattccccctctgtatgaatga

SEQ ID NO: 10721 - RNA, 1197 nt, unidentified
  source 1..1197: mol_type = other RNA; note = synthetic construct
atgaagcggacattggcacaccgagagtttaaagccgccagtggatctatatcaagtatttccaacttggctaaggcgctgaatctgcaggtcagtgatttcgaacgactgtgggaaattccagaggaaagtaggtacaagagcttagaaaagccaaaaaccagcggaggtatgcgagtggtatacaatccttgtccccaactgcgtttaattcaacgtaggattaatacccgcattttttctaacccgtatgtcatacgctggccgtcctacctgtacggctctatcccatctagccctaataagtccgacatcaatcactcaagagattatgtggcgtgtgccagactgcattgcgaagccaagtcgatcctgaagctggacattcagaactttttcgataacatccatgagaaacttgtgatcgagatcttctcagatattttgcgctatcccgaggatgtgagtgagatcctcgctaggatctgcacttataaaagcagactggtccagggggccctgacttcatcttatctggctatgctgtccctttacaaagaggaaccagaaattgtggcaaagctaaagaggaaagatctcgtgtacacaaggttcgtggacgacatcactgtttcaagtaagatcgctaactacgactttagctacgcacagaagataattgaggacatgctcagcaacgccgaatttcccgtgaactccaagaaaacgcagacccagtacgcatctgcctcccctctcaccgtgcacgggcttagagtatgttacaaagagcccagactcccctcgcgcgaaatcagcaatatccgggcagctatccgaagcctggagatagcctccaagcatggcaattatcggcaaacctatgcgtaccgtaaggatcacaaccggtgcctgggcagggccaacaaattagcccgggtgaagcaccctcagcattcaaaattcgttgctcggttgtcaagaatcctccctttgccatctcagaaagaggtcaattacgtaaagagcagcgttgagatacttgagcgggattatcttcataaaaaggactccttccgctataagcgccactactacagaacaaatgacaggctcaacgtggtccagcgatcctatccttctctggttagggacctaagaaaacggctacgccccattaaaccaacatatgaatga

SEQ ID NO: 10722 - RNA, 1164 nt, unidentified
  source 1..1164: mol_type = other RNA; note = synthetic construct
atgacaacccgccacacctttaaggtcgccacaggcagcattgctaccctggataacctcagtctggcgctgggagtttctcattgcgagctggaaaacgctctctctatgcctcaagacgagaggtacactcgactcgaaagacacaaagctgatgggagcgttcgctcggtgtacaaaccccattatttaattcggctcctgcagcgccggatcaaccataggatattggctaatcctgatgtcattgcctggccttcctatctatttggcagcattccctcattcaagaatgaagacggtgaatgggtggctaaggactacgttgcctctgccagattacactgcggcgcaaagagtctcctgaaaatggacattaaggactttttcgacaacatccacagttccgtggtggaggacatattccttgggctcctgaattacccgggggaggtggcaaaagccctgacgaacatttgtacatacaacagccacctagcccagggcgcgttgacatcatcctatatcgccaatatgtgtcttcatgggctcgaggatgaggtttttaccaagctgtcccgcaagaacctcaggtattcacgcttcgtggatgatattactgtatcaagtgtggtgaataggtacgacttttcctatgtgaaatcgatcatcgaaggcatgttgttggaaaggggtctaccagtcaatagcagaaaaacaaaagtccagtactccaccaccgaggcactgactgtacatggtctgagggtatgcttccccgagcccaggctgccatctgacgaagtgcgtcggatcagagcagccgtcaagaatgtggagatgctggctcaagagaacggataccggatgactcatgcgtaccgccgcgactttaataaatgtatgggaagagtcaacaagttgagcagggtcagtcacaaacagcacggcaatcttgtgcgtcgactggttaaggtatatccacttccttcaaagaaggatatctctcgagctcggtctatggtggcccggctggaacgggattatctggagaagagagatacgtactggtattccagaagattctacatcgcccacgaacgattaaacatactgaaacgaagctataaggcaagcgcaatcgagcttcgtggagcctcctga

SEQ ID NO: 10723 - RNA, 1191 nt, unidentified
  source 1..1191: mol_type = other RNA; note = synthetic construct
atgaagaaaaacaactatctcaaaatcagcaagtcctcaatctcttctgtggaaaacctctgcctcgccctggacctcactcttgatgactttctcaatctaaagatgatgagtggctgcgataggtatgtgctgaacgaaaaaccaaaacctggcggaggcattcgaaagacttacaaccccaataatctggtcagggtcttccagcggcgtattaataatcgcatcttcagcaacccacacatcataaaatggccagatcatatttatggcagcataccgaatgatatgaactccgatggggggattaggaggcgggactttgtcgcgtgtgcctctgttcactgtggtgcaaaatctatactgaaggttgacgtcaaagatttctttgacaatatctccaaggacatcgtgtacgatatctttaacggtttcctgaagtttaacagcgaggtgagcgaggcattaaccgatatttgtacatatgatcgttcgcatctggtacaaggggcccttacctctagttacttagcgaccctggccttgttcaacatcgagggacgcattgtgcagcggttggcccttaaaaaattgaagtatactcggttcgtagacgatatcacgatttcctccgttaactcacgctacgatttcgattttgctaaaagcatcgtgatcaatatgttgcacgagaaggacctgcccgtgaacctctccaagacaaaagtgtactattcaggttcagaacctctgacggtccacggacttcgggtgtcctttaatcaggtgagattgccaagtgatgaagtccgcaaaattagagcagccgtgaagaacatcgagattattgctaacgacaccagctacagaaaaacaggcagttatcggaaagactttaataaatgcatggggcgcgttaataagctgtctagagttgggcacaaacagcatgagagcctagtcgcccgtcttaacaaggtgtatcctctaccttcattcacagacatcaagaagaccaaggacctgatagaaaaaatacgaagtaagtacgacgacggcaagaactacttctactatcataagatgtactacgctgcaatggagaagttaaatctcgtaaagagatcgttccccaatactgctaagaatctgcgactgaggctgagaggactgaggcccgagtacgactga

SEQ ID NO: 10724 - RNA, 1224 nt, unidentified
  source 1..1224: mol_type = other RNA; note = synthetic construct
atgtctctgccaattagacacacaaagaaaaagacagttagctcaatcaactccatttcctcactgtgttcgacattgagcatcacgcgcgccgaactggaaaccgccctgagcacccccgataaagagcgttacaccccctctgaggtggagaagtcagatggcacgatccgcaacatctacaatcctaagagtttaatccgtaaaatccaacggaggatcaatcgtcggatcttcaatatttatactcctaagggacgcgagaaaaagaaccccccgataatctgggcgagttacctgtttggaagtatacctaatcaattccttgatgaagacatagagcagaaagattatatagcttgtgccagggtccactgccagagtaagagcttgctgaaagtggacatcaagaactttttcgataacgtccaggctattcatgtggagagcatcttttccaaatttttcttcttctccgacgacgtttctcaggccctcaccaatatctgttgctacgaagggcacctcgtccagggcgcattgacatcatcttacctgtcgtgcctgtgcctccatgatgtggagtggaagattgtcgatagactgagccggaagaatctcagatatactagactagtggacgacattaccgtgagctctacggtcagtaattatgatttttcctacgccaaggatatcattatcaacatgctccacgaaaaagacctgcctgtgaacttcaagaaaactcagcaatactatacctccaccacaccacttacagttcatgggctgcgagtaagcttcagtgagccccgcttaccctctgacgaagcaaagcgaattagagcatcagtacggaacatagagtctcttgcagctgagcgaaattacagaactacacacgcgtacaggaaggatttcaatagatgtatgggccgcgtgaacaaattgaaacgcgtgaatcactcacagtatgagtccctcgtgaatcggctgttcaagctatttccgctgccaagcaagaaagacctcgatagggtatttatttccattgctaacttagaagacgactttcataagggtaaacacgacacttattggtactggaaacgatatcatagggttcacgagcggatcaacatacttcagaggactttcgtgagggaagccaccatctttcggaacaagaccaaaaacattaagccatcctacattcagtga

SEQ ID NO: 10725 - RNA, 1224 nt, unidentified
  source 1..1224: mol_type = other RNA; note = synthetic construct
atgagcttccagattaggcacacaaaaaagaatactgtgagtgccataaattccatccagggcttgtgtaacgctttagacattagcttgcacgactttaacatcgcactgagtacccccgattctgagagatatacccctagtgagatcgaaaagtccgatgggagctttcgtaaaatctacaatccgaagtcgttcctgcggaagattcagagacgcattaatcggaggatttttaacctgtataccaaaaaggggagagagatcaagaacccaccaataacatgggctagctacctgtttggctctattccaaaccaatttctggatgagaacatcgagcagaaagattatattgcttgcgcccgcgtgcattgccagtcaaagagcctcctgaaggtcgacatcaagaatttctttgacaatgtgcaggatgttcacatcgaggacgtttttagaaacttcttcctatttgacgaagaagtatcacgtgccctaactaatatatgctgctttgaaggtcatctggtccagggggcactgacctccagttacttgtcttgcctgtgtctgtacgatatcgaaggaaaaatcgttgataggctcgctcgcaagaatttacggtataccaggctggtggatgatattacggtcagttccgtggtgtctaactatgacttcagctacgccaaagacataatcatcaacatgcttcacgagaaggatctgcccgtgaactctaagaaaacccagtgttactacacgagcacttcacccctcacagtccatggactgagagtaagcttctctgaacctcgactgccctccgacgaggccaaaaggatcagagccagcgtacgcaacatcgagtcactctcctcagaaacaaattaccgcacaacccacgcatatcggaaggactttaatcgctgtatgggcagagtcaacaagctgaaaagggttaaccactcccagtatgaatcattgttcaataggctcttcattcttcttcctctgccttcgaagaaagacatcgagagggtgagtgtgtctctcctacgactcgagaatgactacaagttgggtaaacacgatacatattggtactggaaaagataccatcgcattcatgaacgacttaacattttacaacgtactttcacccgggaggcgtccgtgttccggattcgactccggcttgtgaagactacttatatacaatga

SEQ ID NO: 10726 - RNA, 1224 nt, unidentified
  source 1..1224: mol_type = other RNA; note = synthetic construct
atgagttaccacattcgacacacctctaaacgcaatattacagctattaactccatagaagccctctgcaaagccctgtcaatatccaaggaagaattagagaacgccctcgctactcccgaccattttcgctacaccccgagcaccgccattaaaagcgatggatcaccaagaaaagtttacaaccccaaaccgatgattaggatgatccaaaggaggatcaatcgccgcatttttaattcctacaataataaagggcgggaaaagaaaaatcccccaataatctgggcgtcctacatttttggctccattcctaaccagtactacgatttggatctggaaaacaaggactatattagctgtgccgcaatccactgcggggcaaaaagcctgctaaaggtcgatgtgaaaaatttcttcgacaatattcacgacatctacgtgaagaacgtgttcgaaaatttctttcacttcagcaacgaagtctctgaggctttaacaaatatctgctgttatcagggccatctggtacagggagcacttacgtcatcctatcttgcttgtctgtgtctctacgacgtggagggcgatatagtgcaacggctcgcgagaaagaacctgaagtatacgagattgatcgatgatataacaatcagctctgaaatctcgaattatgatttcagctatgcaaagagtatcgttatagacatgctccataagaaagacctccctatcaacaatgaaaagaccaaagccagttacattagttctgagcctctgatggttcacggactgagagtggcctttaaggagcctagattgcccagcgatgaagtccgccgcatcagggcttccgtgcggaacatcgagtgtctggcctcagagacaaattaccgaactactcatccatatagaaaagacttcaacaggtgcatcggtcgggtaaataagctgaagcgggtcaaccacacccagtacgacaatctcgtcgcaagactgctgcggatccttccactgccctcgaagaaggatatagagcgaatttcagagcagatcgacaggttggagaacgagtattctaacaatctgcacggtagttattggtattggaggcgtctaaacaaggtgcatgagcgtattaccatccttaaccggacatttaaatctgaggctaaaacttatagggaccgcttaaagaagattaaccattgctacatccagtga

SEQ ID NO: 10727 - RNA, 1182 nt, unidentified
  source 1..1182: mol_type = other RNA; note = synthetic construct
atggcagtcctgaagagagtggcaaaaaaaagcatatcatcactgacgaacctttgtgatgctctcagtattaccatccacgagcttaacggagctcttgcgctgtcagatgaccagaaatatcttagatcaaccactcctaagcccgacggctcccttcggatagtgcacaatccacaccggttgttaagaaaagtgcagaggaggttgaatagccggattttttctaattccgccgtggtgacatggccagattatgtatacggatccattcctaatcagattgatgtaggcggggccattgtggaaaaagactacatcgcctgcgctcgcgtgcattgtggtgctaagagtatgctgaagatggacatcaaagacttctttaacaatgtccacgaggaggccgttcgagacatcttcctcagattcttcaagtacagcaaagaagtttctgacgccttaacttcgatctgcacatttgagggggggctggttcagggagcactgacaagctcttacattgccaatctctgtctctttgatgttgaggactccgccgtggagaggctcaggagaaagaagctgagatatacccgtctggtggacgacatcactgtaacgagcactatcgcaaactacgatttcagttttgccaaggacgttattacaaccactctggtcgataaggatctccccgtcaacgaacggaagacccgggttctttatatttcatccgagcctttgacagtccatggattacgtgtcaactacaaagaaccacgactgcctgccaaggaagtggcacgaatcaggtctgcggtaaggaacgtggagctactggcttctgaaggcagctacagaaccagtcattcctatcgtcacgatttcaatcggtgcatgggccgagtgaacaagttgaaacggataggtcatcgccaacacatggtgctgatcaaacgcctgctgaagatcctcccgctaccggccaagagggacatcgagcgcgcggaaaagctcttgatacgcatcaagaaggactggctgtccaatccagattcttatggctacgctaaacgcttttatattctccatgagcgcctgaacgtgctagctcggagtttccccgcagtcagcgccgtcatgagaaaagaaatgagggggctgcgacccgtgtacgattga

SEQ ID NO: 10728 - RNA, 1203 nt, unidentified
  source 1..1203: mol_type = other RNA; note = synthetic construct
atggcacgcgactccatgagctttcgtgggaccagcggtcccatcgctagcgtggagaaattggcttctgccctacgactgcccgagagcctccttctggaagtttccgaacgccctatctggcgaaattacaaacccgctagcgccccgaataggagaggcggacgaccacggctagtctttagtccatcccgggatgttcggctgattcagaataggattgtgcggacattcttcaaaaacccaaaagttatcaactggcttccctttatatacggcggcattcacaaggatgcactgaaatctggcgacagtagagatcatgttgcgtgtgccagacggcactgcggtgccaagagtattcttaagctggatatcgaagacttctttggcaacgtatcattcgatttagtggaagatgtgttcgtcggtctgctcggttggagtaaggacgccgggtcattagctgccaaactttgcacgagagacggcgtgctgccgcaaggagggataactagttcgtatttggctctgctctgtctgcacgatatcgagcctaaattggtccgccagctttcctataagaaactgacctacactcgctatgtcgatgacatcacaattagctctggctcctttacccaggaattcagcgggccaatgagaatggtggagcaacagctggcgtctaagggcctaggaatcaattccgccaaagtggaatcactcactgtgggcctggaggctatgtcagtccatggactgaacgtagcctatagggaccctgtgctgccaaagtctgaggtcaagagaattaggagcgtttgcaggcagacaatacttgacgcccgggaggtgggacggagaagcatcaattacaggcgaagatacaatcgagccatggggttggtaaacaaactgtcccgcgtgaactcttctagtcataagaagttggtgcagtcgctcaggctcgtgtcacctctgccctcacaggcagactttgagtatgctaccaagatcgcatacgatatgagggacgactatgataagaagaaactgggatactggtactggaggcgtttcaaccgtctcatggcgcgcttgacactcattggcgtcgataatcccggatgggcagggaacctccgcaaatatatgaagtcccactttttacctgggttcaaggacgataaggacaagtga

SEQ ID NO: 10729 - RNA, 1194 nt, unidentified
  source 1..1194: mol_type = other RNA; note = synthetic construct
atgggaaaagactcaatgtcattccggggaacatctgggccaattgcaagtgtggaaaaactggcagacagcctaaggctcccaatcagcctgctgaaagatgtcgctgcccgccctgaatggaaaaagtataagccggccaaagcacccgataaaagaggtggccgcccaagactggtgttttccccctctaaggatgtaagattgatccagcatcggctagtcagaactttctttaagaatccgaaggtggtgaattggctccctttcctctacggtggcattcataaagatgccctggctgcaggggacagtcgtgaccacgtcgcttgcgcgcgtagacactgcgaagcaaaatcgatccttaagcttgatatcgaggactttttcgggaacgtaagtttcgatcatgttgagggcatctttgtgcggttgctgggttggtctagggaagccggccatctcgccgctctgctgtgtaccagagacggagtactgccccagggggggattaccagcagctaccttgccctgttatgtttgtacgacatggaaccagcgttggttagacaactggcctacaagaaactggtttacacaaggtacgtggatgatattacaatctctagctcatcattcaaccaggactttaatggcattaagagattagtggagcagcagctcggcgctaaaggattcaccatcaatagttctaaggtcgaggatttaacggttggcctagaggccctgaaagtgcacggactgaatgtggcttatgctaaccctgttcttcccaagtctgaggtgaggcgcatccggagtgtctgcaaacaaactataatggacgctagggaggtgggacgccgcagcataaactatcgacgacgctacaacagggccatgggccttgtaaacaagctcgcccgagtgaagtcttcctcccacgcggcgttggtgtccaagctgcgtgcagtctccccacttcctagccacgccgatttctcctatgctactgagatatcctacaacatgcgggaggggtatgacaaaaagaagtattcgttttggtacaggaggcgctttaatcggctcatggcacgactctcactgattaagtccgacaatcccgtctgggccgccaatctccggaactacatgaccagccacttcctgcctgaatataaggaagagtga

SEQ ID NO: 10730 - RNA, 1182 nt, unidentified
  source 1..1182: mol_type = other RNA; note = synthetic construct
atgaccctgaggggatctgccgggccgattagatctaattgcgccttggccagagctctcggttgcactgaaaaatttctatctgacgtgatcgcgagggacacctctagcaaatataggctggtggaggccccagctaagctggatgggaccagacgggaggtctatagtccgtctcgagacgtacgtctgatccagcgccgcatcgttaaccgattcttcaaaaatccacgggtcataaagtggccaccttttatatatgggggcattcacagagacgccttggcacccggagagagtcgtgatcacgtggcatgtgctcaaaaacattgcggagctcgatcaatggtgaaattggacattaggagcttttttgacaacgtcacacacgatatggtggtggaaaccatggtaatgcagcttggctggtccaggggacccgccattcttctcgccgatctctgtacgcgcgacggcagccttccacaagggggaatcacttcctcctatctggccctgttaagcatttatgatgtggaatcgaagatcttcaacatagttggttacaagaagttggtctacacacggtacgtcgacgacatcactatctcttccaggaattctggctatgatttctcacccatcgtgaagatggtggatcagttcctcctttcgaagggactgagtattaatgatgcgaagacaagtgtctccgttagcggtttagaacctctcgtcgtgcatggcctgaacgtagctaataaacaccccgtactgcctaaggcagaggtgaagaggataaaaagtgtttcacgccagaccattaacgacgcttccgaggaagggagacggacgcatggcttcagacgacgatactaccggtcaatgggcctgattaacaagctgtcacgcgttagaagctccagccacaagagctcattgagtaaactgaaaagcgtgtcccccctccctaattttgcggactacgacatcgcaacagtggtggcatacagactgcgtgatctgtacggcgccaaaaagggcggtcgctggtattggagaaaatttaacgttcttatggcccggctagatctcatcgctgtggagaatcccgggtgggcaaagactttacggaggtacatgcgccggcattaccggccagattataggcgccctgagtga

SEQ ID NO: 10731 - RNA, 1104 nt, unidentified
  source 1..1104: mol_type = other RNA; note = synthetic construct
atgcgggatgttgcctctcgggcctcaacgacaaactatagatcagtcgacgcgcccatcaaaagcgacggcctcccaaggcgggtgtataaccctgccagggacgtgcgcctggttcagtctagaatcgccaatcgcttctttaaaaaccctgcagtcatcaagtggcccgcccacatttttgggggtatccacaagaaggccctgcctgctggagatagtcgagatcatgttgcctgcgctgcaaagcactgtggcgctcattcccttctgaaactcgacataaggaactttttcgacaacgttactcacgagatcatagtggagactatgacacgccaacttgcatggtctaggagccccgctgtcctgttggctgatttgtgcacccgcgaaggtgtgctgcctcagggtggcattacctcctcatacctcgcactaatctccatatacgacattgagagcaagctcgtgaggaatctggaatacaagggattggcttacactaggtacgtggatgatattacaatcagtagtaaggtggccagctttgactatgcaccaatcgtgcgcatggtagataatctgctcctgtccaaggggttatcaatcaacgaggccaaaaccagtgctagaataagtgggctggaaccattagtggtgcacggattgaacgtcgcaaatcgcagccccgtattacctaaagcagaggtggctagaattaagcgagtgggccggcaaaccatcctggacgcccaggaggaagggaggcgatctcatggatttcggagacgatattatcgttccatgggccttattaataaactgtcgcgcgtaggctctgcgtctcatgccagctcacttgagaagctcaaggccgtcagcccactgccaagcttcgacgactacaaaatttccaccaatgtcgcacataaacttagagccgattacgatattaagaaatccggggtctggtattggcggaaattcaacgttctaatggctcgtctcgacctgatcggagcggaaaatccgagatgggcgaagacactgagacggtatatgaggcagcactaccggcccgagttcaagcgtccgaaatga

SEQ ID NO: 10732 - RNA, 1110 nt, unidentified
  source 1..1110: mol_type = other RNA; note = synthetic construct
atgaatctccttcttgacgtagccgagcgtagcgcagaagagaattataggcctgtgtctgcacattcaaagcttgatggcactgaaagacgtgtattctcaccctcccgggatgtgagactcatacaaaggcggctggtgaataggtttttccggaaacctcaggttgtgagctggcctccgttcctgttcggtgggatcccaaatgacgcattaccccaacgcgatgcccctagggattacgtcgcttgcgcggctcagcactccatcgccaggtctgctttgaagctcgacgtgaggtcgttttttgacaatgtccacagcgacgtggtggagcctatctttagtggcctgctgagatgggatgaggaaccggccgtgttggcaacacgagtgtgtacccgattagactcactgcctcagggcggaattacctccagttaccttgctctgctgtgcctgttcagagaggaagggaacgttgcaaggaccctgcgcaggaaagggctgacttacacccgttatgttgacgatattacgatctcaagcacatctgtgctgcaagaattcgatttcgcgcatgccctggtggagcggatgctcatgaatcacggcttgttcatcaactccagtaaggtcaacctgcagaaggccggatccagccccctcgaggtccacaatctcagagtgggctgcggtccaccacgattaccacagagagaggtgaagcgaatcaaacaggtttgtcggcagactgagctagacgccagcgaaggacgcagatcttactcttaccgccggcgctattttcgcgctgttggcttggtgaacaagctggcgcgagtaggaaacaaccagcataggcacttgatcacgagacttagcacaattcgccccctccccagtcagaaagattacgaactagccacaaatgtcgcccatgacctgagggaacggtacgtcctggggcacgaccggtattggtatagacggcgttttcatatactcatggagcgccttaacctgattggtgtagaggacccagcttgggccgccaacctaagaatttacatgaaagctcactatgctcccacctccgtcgatgcatga

SEQ ID NO: 10733 - RNA, 1203 nt, unidentified
  source 1..1203: mol_type = other RNA; note = synthetic construct
atgaaaagcaagccttattcctcaatgcgaggtagtaacggcccaattcgtaatttagatcatctgtgcaccattttggacgttgagcgcagggtcctagacagagtcctggccatgcccggaagccaaaggtatgccctggctcgctctcgggccgctaaatccgacggcagtgcacgcgaagtatttaacccctgccgggaggtacggcggatacagctcaaaattgtgaagcggattctgaaggtgccaggcgctgtcaggtggcacgactttctgtacggatccatgcccaatcagatcgacgcccacggcaatgagttgaaaaaggattacgtgacatgcgctgcacagcactgtgacgcgagaagtgttctgaagatcgacataaaggatttcttcgggaacatccattctgacacaatcatgagaatctggactgagctatttgggtatccgggagatgttgcatttgtgctcactaacctctgtttaaaagatgataaccttcctcaaggcggaatcacgtcttcctacctcgcaatgctttgcttgttcgatctggaagccaagacagtggctacgcttaggcttaaggggctccgatatactaggtatgtggatgacattaccatcagctctcctctgtcaaactacgatttcgagttggcgctggcgctcgttagagcgatgctcatttcacgtgctctccctataaacgagtccaaggtgaagagggtcagtctgagcaccgaagccatcaccgtccacggtctgcgggtcaatttcgaaactccgcgcctacccgctgctgaagtcggaaggatccgggcatctgtgaaaacaattgaactgcttgccgccgatacatcttttagcagcacccccgggttccgcaaaagcttcaataagtgtatggggagagtgaataaattgaaaagagtgggccatagccagcactccaaactgttgaagagattacaggctgtgcgcccactcccatcacgcagagacatcaaaaaagcagtagcctcgattcgaactctgtcagccgagttccatagtaggggcaatacctttggttacaggaagcgatattacattctgatggagcggcttaacctgatcgccagatcgcacaaggagctggcagccatgctgcgtgcccatgtgaagcgaataaagccatcctacgttgactga

SEQ ID NO: 10734 - RNA, 1122 nt, unidentified
  source 1..1122: mol_type = other RNA; note = synthetic construct
atggccattacacaggacgagttgttccaggccctgaggttgacggatgatgtcaggtttcagcctattccagagaaacggaagccagatggtacaatccgcgaaatatataatccccacccactcatcaggaagattcaacgcagacttgttacaagactgcttagtgggtctgcggcttttcagtggcctgaccacctgtatggcagcatccctaacgtttcaagccccgatggagaggtccagagtaaggattatgtggcctgcgcaaggcggcattgcggagctaagtccttgctcaagctcgacatcaagaatttctttgggaatgtgcatcatgacaccgtataccggattttccgcgaactcctcggctatggttccagggtcagtaaagtgctcgcctgtctgtgtactcacaaaggatctcttcctcaaggcggtcttacttcttcatacttggccatgctaagccttcatgacttagaaggctacgtggtggaacgcctgagattaaagtccttagtgtacacgagatacgtagacgacattaccattagctcaaaagtactcaactacgacttcggctatgctcttaagattgtggataacatgctggtggagagagggctgcccctgaacctaaagaaaaaccggatagagcgcatctccaccagcccgctgatagtgcacggtctgaggatcgccttcgacaagccccgattgccggcagatgaagtgggaagaatccgtgcctcagttaggtacactgaactgatctacctcgaggcaaattttcggtttacctcttcttacagaaaggcttttaaccgatgcctagggcgagtcaataaactgaaaagagtcggacactcgcagcatggggttctgttaaggcggctgctgagagtccgtccactcgcaagcaaaaaagatcttatccgtgcccacgtgaccgcaagtcgcttggctaatgagtatggccgctataaggagacatatggctaccaccgaaggttctatctgttgcaggaacggctgaacctcattcaacggacttaccccaagatagcgaaatccctgcgcctgaagctgaatatcatccgacctgagttcaactga

SEQ ID NO: 10735 - RNA, 1119 nt, unidentified
  source 1..1119: mol_type = other RNA; note = synthetic construct
atggacgtccccattagtgacttcagagcagctctgttgctaagcgaggaagagaggtttcgcctcctccctgataagaagaaagccgacggcactgacagaatcgtgtacaatcctgatccactcatacgcaaaatccagcgaaggttccttactcgcatcctttctagaccttccgcggtcaagtggcccgaatttcttttcgggtcaattcccaaccacagttttaatgggatcgacgtgagcagggactatgtggcctgtgccgctcgacattgcggctctaagtccctgctgaaactcgacatcaagtcctttttcgaaaacgtacactcagacttggtgctcgagattttccgaggggtcttctcctatggagatctggtcagtcgggttctcacaagaatctgcacccacaagggcggattaccgcagggaggtattgtgtcaagctatctggcgatgctttgcttacatgacgttgaggcccgggtggtggagagactgagacagaagagattgacatatacccgctacgtggatgatataaccgtttctagtaagagctctaaccaggacttcgatttctcgaaaaggattattgaagagatgctgctcagcaagaatctgccactgaactacaaaaaggtgttggtgtcccgggtcagtacaaccgccctgacggttcatggtctgcgggtcgggtttaaggaaccaaggctgccggcagatgaggtcaagcggatccgagcatctgtaaaatatctcgagattctttacgttgatggggactacaaatataccagcagctaccgtaagaacttcaataaatgtatgggccgcgtgaataaactgaagcgcgtaggccattcacaacacggtcagctgaaatcaagaatcatccggttaatgcctaaagcttctcggtccgacttggccagggtgtttaaaatatccaaacgtctgcaaagcgattacctcgaaaagaaggatacgtttggattctacaagcgttttcacatccttgccgagaggctgaacctagtggctcgcactcaccccggcatcgcaaggctgattcgaagacggctaagggagataaagccaacatttgaatga

SEQ ID NO: 10736 - RNA, 1056 nt, unidentified
  source 1..1056: mol_type = other RNA; note = synthetic construct
atgagacagcccaagctgaatggcagcgacaggatcgtaaacaaccctcattatttaattcggaagatacagagacggctcaataagcgtttctttgcaaatcccgattttattaggtggccacgacacatctttggctgtatcccaaattacgtggacgatgacggcgagttagtcactacagattacgtctcctgcgccagtaaacactgccaatcgaaatccatcctcaaaatggacatttctgatttcttcggaaacgtacatcaggaccacgtctataaggtgtttctcaaccttttgtcatttccagaagatgtgagcaagatcttgacagatctttgtacccttcgcggatcccttcctcaagggggcctgacaagctcttatttggcttcactttgtctgcatgataaggaagggagtgtggtgaggcgactggagaacaagggcctggtgtacacacggctggtcgacgatattaccgtgtcttcccacgtggcgaactataacttctcttatgccaagaaaatcatcacggatatgctaatagagaaagatctccccatcaatgaagacaaaactattgttcagcgtctgagcaccgagcccctgactgttcatggtctgagagtgggattcaaggaacctagactgccggccggtgaggtaaaacgcattcgggccagcgttcagagtatggagcagttggcaagagagcccaattacagagtcagccatgcatatagaagggactacaacaggtgcatggggcgggtcaataaactatccagagtcggacacaagcagcacagtattctggtgaggcgtctgaagtcaatcaggccactgccttcacgagctgacctcgaccgactagaggttatggtttctcgcttagaaaaggaccatgccgaaaagcgggctaccttctggtactggaaaaggtaccaccgcgcgcacgagcgcttgaatgtgctccaactcatctacatagctaaagccaaaaagtttcgcgaacggctgaagaaggtgaaaccgctgtatgactcctga

SEQ ID NO: 10737 - RNA, 1200 nt, unidentified
  source 1..1200: mol_type = other RNA; note = synthetic construct
atggatgattttctgtttcataaagtcagtaccgccagcatttcaaacgtgaaaaacctgtgtaccgccctggatataactgaaacagatctggaaaaggctctaagcctcgagcccagtgcgagatacgaagaagtgcaggtaaataagagtgacggaagcctgaggacagcctttaagcctcattatctgatcaggcgcatccagagaagaattaacaaaaggatctttgcacctcagaaaaacgaaccgaatactatccaatggccaaattacatcttcggcagtatcccaaatcagatcatagatggagaggagatccagaaagattacatttcctgcgcgagacggcattgtaaagctaaatctcttctcaagatagacatcaagtctttctttgacaacatccatagcgacctggtgtacgatgtctttaacgagtttttcaagtatcctaagtcagtctgcgaggttttaaccgatatatgttgccatgagaatagggttccacaaggcgggctgacctcctcatacctggccagcctcgtgttgcacgacattgaacccactgtcgtgaaacgattgcttagaaaaggtctgcattacactcgactcgtcgacgatatcaccgtatcctctaagatccacgactatgacttctccttcgccaaaaaaattatcaccgacatgctttatgagaaggacttccctattaacgagcagaagacccgaatagagcgggaggcaagcactcccctctgtgttcacggcctgcgcatttgtttcaacgagccccggcttgcttcccacgaggtgaagaatatccgcgctgccgtgaagaatattgagattgtggccatggaacggcactatagaacaactcacccgtaccgtaaggattacaaccggtgcctgggtagggtaaacaaattagctcgggtgggacataatcagcatgcaaagctcgtgtcgcgcttgaagaaagtggaaccactgccctctgagagagacattaaaaggtgcacgacaatggtcacaaatttagaaatggatcactccacgaaggggagccgttattggtattggaggcgttaccacaaggcccaccagcgcctcaatattttgcaacgaacattcgttcacaccgcaaacgacctacgcgcacggctgaaggtgatcaggccttcatacgaatcttga

SEQ ID NO: 10738 - RNA, 1194 nt, unidentified
  source 1..1194: mol_type = other RNA; note = synthetic construct
atggggcagtttcagcctacgaagaatccaaaaggcagtattgccaccatcgatgccctctgtgctgccctgtctatctccattgacgagttgaatcaggcacttgctatgcccatcgacgaaaggtataccctccccaagaaagaactctttaagagcgacggatccccgcgagtcgcatacaaaccccatcatctgatacgaaagatacagcggcggatcaataaacgtatcctgggacaagaaggctacattgattggcctaatcacatcttcggatctgttccgaacaagaaggtgcctgatggcgaggatatagtcaaagactacattaactgcgccagacagcactgccttgcgaaatcgatgctgaaaatggacgtgaaggacttcttcgacaatattcacgtcgacctcgtgttcagcatcttcaactcatttctctccttctcagatgtggtgagtaataccctggccaatatctgctgtcggggcgaatttgtagtacagggcgggctgacttcctcctatttagcatgcctctgtttatttgatgtggaagccgacgtggtggtgcgacttaagaacaagggactaatctatacaaggctaatcgacgacatcacagtgagcagtaaaagatccggttatgattttagcttcgctcgacaaatcatagaggacatgctgttctctagaaatctgcctgtaaacagcaaaaaaaccgctattcactatcatttcagtgcaccactgatggttcatgggcttcgcgtgagctttaacgaaccccggctgcccgcctctgaggtgaagaagattagggctgccgtcaaggatattgaggttttggcaaaggatcacttatacaggattactcatgcctatagacatgacttcaaccgcgttatggggcgggtcaacaagttgtcaaggatcggtcacacacagcacgagaacctgaagaatagactgctgaagtgctaccctttgccatcattcaaggatattactcgcgcgcgtctggctgtcgagcgtgttgaacgggattacgaggagaaatgtgccacatactggtacaagaaacggttttatagagcacacgagcgcctgaaccttctcaaacgctcttttccagacaccgcttctgagctaagggacagattgcgcgatctcaggccagaatacgattga

SEQ ID NO: 10739 - RNA, 1200 nt, unidentified
  source 1..1200: mol_type = other RNA; note = synthetic construct
atgtctacaaacaacaacctgtatttccagaaaaacgcatctaattccatcggctctattagcaatctcgccaatgctctgaacttgaccgtaaatgagattgtcagggccgtgaatcttcccaacgaggtgaaatacacagctaatccgcaacagaaagccgatggatctcagcgaatggcttacaatcctcaccgttatctgaggaaggtgcaaaggcggattaacaaacgcatcttcgcagatcctagcgtagtgtcgtggccagattacatcttcggctctgttcctaacaccactcttagccttagcgaagtgatcaagaaggattacgtgtcctgcgccgctcggcattgtcttgccaaatccctcctgcgcttggacatcaaggattttttcccaaatattggcgaacatttagtccgggcagtttttgaagatttttatcactttccgcctgatgtgagtgagatcctagtttcgttgtgtacgaaggatggcggggtcccacagggtgccttgacctctggatacctggcgtgtctctgcctgtttgacgttgagcctgaagtcgtcagaagaatcgaaatgaaggggctgacctatactagatatgtggacgacatagtcgtcagtagcaaggtccacgaccacaactttagtttacaggagaagctaatcagctcaatgctggaagataaagacctccccgtaaacgacactaagacattaattcagcgatccagtactgcccccctgatcgtccatggcctcagggtgtcatttaaagagccacggctgccatccgacgaggtgagaagaatacggtccgccgtgcgaaatctcgagaaacaggcctctgagcccaacttcagaacaacgcgcgtattccggtcagcacataaccgctgcgtgggaaaagttaataagctgaagcgggtggggcacaagcagcattccgaatacctcaggcgcttgaacctgattaagcccctagctcgacgttcagacgttgaaagagtggtgagtatgattcgtcgcctggagaatgaccacggtagcatatcagacacctatgcataccacaagaggtatttcagggcgcacgagaggcttaacatcatccaacgcaattacgagaacatagctttcaaactgcggcagagactgaagtccattcccagcaattacgtgaaatga

SEQ ID NO: 10740 - RNA, 1188 nt, unidentified
  source 1..1188: mol_type = other RNA; note = synthetic construct
atgatcatcatgaacaactacaagattaagggcagtgtcatcgcttcaccacagaacctggcgaaggcacttaatctaaccctggaggagataaacgcagccaacgccttaagcaccgaaaagagatacaaagagaagaatctcccaaaggcagacgggaacttcagaaaaatctacaaacccaaccacaggatccgtacgatacagcggcggttgaataaacggatcttctcttccagcaatgtaatcgaatggcccagttatctctacggttctattccgaacacaattggagatgacgaaatcgagatgaagaaggactatgttacctgcgcctccattcactgccaggctaaaagcgtgttgaaaatcgacgtgaaagatttcttcgataacatccatagcgacctcatttttaacatcttcatcaagctcttcaagtatcctcaggaggtagcagagctcctgactgatctgtgcacatataagaataagctcccacaagggggcttaaccagcagttaccttgcttgtctgtctctgtttgacgtcgagcccgacgttgtgaaacggctggaaaataaagacgtgaagtatacaaggttcgtggatgatattaccatttctagccagcatcccaactatgacttctctttcgcgaagaaattggtctttgatatgcttcactccaaggatctcccaatcaacgaagctaagacaactgtccagaggctgtcctcagcccctattctagtgcatggactgcgtatttcctttaaggaaccaagattgccccccgaggaagcccgacaaatacgggccgcggttcgcaatattgagaaactgtcgaagcaccctgattaccggacttcaaacgcatacaagaaggactacaataaatgtattggcagggtcaataaactggcccgagtgaaacacattcagcacaagaaacttatctcacgcttaagaaaagtgaaacctctgccaaatcgccaggctgtgattagggctaggagtatgatccgccagctggagcatatataccctactcacctgcacgactattggtacaagaagaagtactttcaagcccatgagcgccttaatatcatccaacgatcctttccgaatatagccaaaaccctgagatttaaattgaagacgataagacctcagtatgaatga

SEQ ID NO: 10741 - RNA, 1236 nt, unidentified
  source 1..1236: mol_type = other RNA; note = synthetic construct
atgtcctgggttgggagagcaacattcatctctaatggcctggtgatcctgctgactaaccccatcaaacattctaagaacagcatttctaaccgtgagaatctgtgcaaagccctccgcgtgagtgacgactttctcggctccgtgctggcattgtctcagtcagagcggtacacaaaaaaagatcacgtcaaaaaggctggaggagggtcccggccaatctataatccccatcgattccttagaaagatacagaatcggatcaacattgccttctttagtaactactacgttattagatggccccactttatatacggaagcgtgcctaaccagaagaacggcgacgggtatgactcaaaagattatgtcagttgcgcgggtcgccactgtggagctaagtccctccttaaggtagacgtctcatcatttttcgacaatatccatcaggatgttgtgttcgcaatatttaacgacttcctcaaatacgatgcagaagtcagctcgattctgaccgatttgtgttgtcaccattcacacttggtgcaaggcgggctgactagcagctacatcgcaagcctatgcctgtacgacgtggagggagcggtggtggacagactcaatcgcaagggcctcacctacacaaggttggtcgatgacattacagtatcttctaaatcccttaacacggacttcacctacgctctgaagattattagcgacatgttaaccggcaaggatctcccaatcaatgagagcaaaacccgagtttttcggacttcgactgaacctctcactgtgcatggtttaagggtcagtttcgacaccccaagactgcctgctgatgaagtgggtaggattcgagccgccgtgcgcaacgtcgaatccctggctgcccagcccgggtatcgcatcagtcacgattataggcatgattataaccggtgcatgggccgtgtgaataagcttctgcgggtcaagcacacacaacacaaggtcttactgcgcaggcttaatgccgtgaagccgctgcctagccgtagggacgtgaatagagccaaggatatggtagcccgattggagatggattttgactccaagaagcacacgcattggtataaatctagatatcaccgggtaatggagcgcctaatcgttctgaatcggatatacgataaaacctcagttcagctgaggtccaaactaagacgactgaggccagtggtggaaaactga

SEQ ID NO: 10742 - RNA, 1194 nt, unidentified
  source 1..1194: mol_type = other RNA; note = synthetic construct
atgctgctgaaccctattaaggtgtctaaaaactctgtctcttctcgagaaaacttgtgcaaactgttgcgcgttagcgatgaatttcttacctcagtactggctttgagccaggaggagcgttacacaaagaaggaccacgtcaagaaggctggcggattgagtcggccgatctttaatccacacaggttcctgcggcgaattcagaaacggatcaacatcgccatcttttccaacaattacgttatcaggtggcctcactacatctacggatcaattcccaaccaaaaaaacggcgacggttatgattccaaggactacgtaagctgcgcgggccgacattgtcaggccaagagccttctaaagattgatgtgagtagcttctttgataacatccatgcagatatagtgttctccatcttcaatgattttctgaagtatgatcgcgaagtttcggtgatcctgacagatctctgttgccacaattctcatctagtgcaggggggtctgaccagttcatatatagcttccctctgtctgtatgacgtggagggtgacatagttgagagactgaatcgcaaaggattcacatacacccggcttgtagacgacattacgattagctcgaagagcctcggaaccgattttacttatcctctgaagatcgtgggggacatgctcgtcgctaaagatctccccatcaatgaggggaagactaggatttatcggacctctactgaacccttgacagtccacggattacgtgtgtccttcgactcaccacgacttccggcagacgaagtgggcaggattagggccgccgtcagaaatatagaaagtctggccgcggagccaggctatagaacaacgcacaactacaggcatgactacaatagatgcatgggccgggtaaacaagctgcaccgggtggggcataaccaacatgggccactgctggacagactggacgcagtgaggcccctaccttcccgtcgcgatgtgaatagagccaaagacatggtcgccagactcgagaaagatcacaaaggtaagggccatactcactggtacaaagcaagatactatcgactcatggagcgcttagtggtccttgatagggtgtatgacaagacctgttaccagattcgcctcaaattaaagactctgcggcccgaacgcgaggttgagaaatga

SEQ ID NO: 10743 - RNA, 1206 nt, unidentified
  source 1..1206: mol_type = other RNA; note = synthetic construct
atgctagccaatcccctcaaaatctcgaaaaatagcgtttccagccgggagaatctgtgtaagttactccgcgtcaccgacgaatttttggctagcgtaatgaccctgtcacaagaggatagatacacaaagaaggagcacgttaagaaagccggagggattagtcgcccaatctacaatccccataggtttctccggaaactccagaaaagaatcaatatcgcaatcttcagcaaccactacgtaattcgatggccgcactttatttatggctctgtcccaaatcagaagaacaacgatgcgtacgatagtaaggactatgtctcttgtgctggtaggcactgcggcgcaaaaagtctgctgaaggttgatgtgagctccttctttgataacattcatcaggacatcgtgttctcaattttctctaactttctgaagtacgatgaggaagtgtccaggatcttaacaaatctgtgttgccataactcgcatttggttcaggggggcctcactagcagttacatcgcctccctgtgcctttatgatgtcgaaggtgacgtagtggaacgcctgaacaggaaggggttcatctatacgagactggttgatgatattactgtgtcctccaaatcacttaataccgactttacctacgctctgaaaataattagcgacatgctgaccgcaaaggacctcccaatcaacgaatccaaaaccagggtgtttcgcactagcactgagcccttgaccgtgcacggactgagagtctccttcaacacaccgcgactacccgctgatgaggtggggagaatacgggccgcagtcaggaatctcgagtcactagccgaccagcctggctaccgtacaactcacggatatagacacgactataacaggtgcatgggacgggtgaacaagctgctgcgcgtgggccacaatcaacacaaacctctgcttgccagacttaacagtattaagccattgccttctcgtagggacgtgaatcgcgcgaaggacatggtcgctcgattagaaaaagacttcgatgccaaacgccacacacattggtataagtctcgattccatagagtgatggagcggctcatcgtgctgaaccgggtgtacgatataacgtctaagcagctgcgttctaagcttaagcggttgcggcctgaatcagaggacataattgacaaacatgtatga

SEQ ID NO: 10744 - RNA, 1185 nt, unidentified
  source 1..1185: mol_type = other RNA; note = synthetic construct
atgctgaccaatcctttgaagttcacaaagaactcaatatcatcaagggagaacctttgcaaagcgctgagaatcccagacgactttcttgcaactgtgttggctctgccccccgacgaccgttacaccaagaaggaccacgtgaagaaagctggggggatttctaggcccatatacaatccacatagatttctgagacgtatccagaagaagatcaacattgctatcttcagtaataactacgtcatccggtggccacatttcatctatggctccgtgccaaatcagaccaacaacgatggctacgacagaaaagactacgtgtcatgcgccggtcggcactgtggagccaaatccctgctcaaggttgacgtttcttcgttcttcgataacattcaccaggacatcgtttttagcatctttaaagacttcctgaactacgagaaggaagtcagcgagatcttaacgaacctgtgttgccataattcccacctggtgcagggagggttgacatcctcctatattgccagtttatgtctctgggatattgaaggcaaagtcgtggaaagactgaataggaaaggcctgacttatacccgacttgtagatgatatcactgtctcaagcaagtccctggaaacagattttacgtacgctctcaagattattagcgatatgctgacaacgaaggacttacctataaatgagtctaagacacgcatctaccgcacctctaccgagcccctaaccgttcatggtctgcgcgtaagttttagcactcccagactccctagcgatgaagtgggccgcattagagccagtgtgaggaacctagaaagcctggcggcagagccgtcgtacaggacatctcatggatatcggcacgattataaccgatgcatggggcgggtgaataagctgcatagggtcgagcacaatcaacacaagcctctcctgatgcgcttgagggccatacgaccattgccttcccgacgggatgtgaatagggccaaggacatggtagcacggctcgagaaagattatgacacccaaagccacactcattggtataagtctcggttccaccgcgtcacagaacgccttatcgtgcttgatagaatttacaccaaaactagtactctactccggtccaaactcaaaaaactgcgtccggtgggagagtga

SEQ ID NO: 10745 - RNA, 1209 nt, unidentified
  source 1..1209: mol_type = other RNA; note = synthetic construct
atggtgagactctttccgcagaaagtgtccaccgcaagcatagctaatgtcgactccttgtgccaagccctttctatcccccggtcagtacttgatcaggttctggctctggggctggatgaacgctacaaagaggtaatgcacattaagaaggccgatggaactaaccggcctatctacaatcctcaccatcttctgcgccgcattcagaagaagatcaatgagaggatttttagcgatactaagatcataaagtggccggggttcttatacgggtctattcctaatcagaccggctcctcaggacaggatgtctctaaagactacgtggcctgcgcagctgtccactgtggtgcgaagagccttctgaagattgatgtcgaaagtttcttcgacaacatccaacgggacattgtgctcaacatctttagcaagttcttaaagtaccccgaggatgtggctgacgtgctgaccaacatttgttgctataaaggtcggctggttcagggggccctgactagttcttatatcgcaagcctctgtttgtgggatgttgaagggaacgtcgtgaggcgacttaatctgaaaggcctaaggtataccagactggtagacgacataacagtgagctcagtgggactggctacagacttcagttacgcgaagaagttggtcgaagatatgctcagcgacagggacctccccatcaaagcatcaaagactaaagtctataggatgagtagtgagcccctaacagttcattccctgcgagtgaacttctctagcccccgattacctgccgacgaagtgggccgcattagagccgctgttaaacacgtggaacgcctcgcgtcagagccaaattacatcacgacgcactcctaccgtaaagtttataacagatgcgtgggaagggtgaataagctgtccagagtaggccacaatcaacataaaatcctgctcgcccgcctgaacaaaatcaaaccactcccatcgtttagtgatatacgaagagccaaagccatgctagcacggctgaagtccgactttggctccaagggccatacccattggtaccggtctaggtattacagactggaccagcgtttgaggattttgtcaagacggtatgagcgcaccagcgatcagattcgtgaggagatccgaggtatcaagccatttaagaaacactcttcggagacacactga

SEQ ID NO: 10746 - RNA, 1095 nt, unidentified
  source 1..1095: mol_type = other RNA; note = synthetic construct
atgctctcccttcctgacaatattctttacactgagaaggaaatcccgaaagccgggggcaaagttcgcgtggtctacaatccccaccggctgcttagacgcgtgcagaggaagataaacacccagattttctcctcaagcaacatcatcgagtggcctacctacctgtacggatctatacccaatcaggagtacgaggctgagctgaagcatctaaataacaaggattacgtctcctgcgcagctcgtcattgcggtggtagaagcgtcctgaagttagatgtggagtcattttttgacaacgtccatgaagatgtagtccgatccatctttgctgacttcctcaaatgcagtccagaagtgagcgatgtgctgacaagcttgtgttgcaaaggggaacatattgtccaaggagccctgacctcctcttatctggccagtctgtgtttgtacgacgtagagggcacagtagcagaacggctccggaggaagggcttcgtgtatactcgcctggtggacgacatcacggtttcttcaaagaagctcggggttgacttttcatacgccaagagcttaatcgttgatatgttgaaagagaaggacctaccagtaaatgaaggtaagacgaaagtgtatagagcctctaccgctccactgactgttcatggactccgtatcggattcagcaccccccggttgccctctgatgaagtgaggcgaattcgggcggccgtcagaaacgtggagctgttggcgaaggaaaacaattataggacatcgcacgcctatcgccacgactttaatagatgtatgggccgggtgaacaaactcgaaagggtgaaacacaaccaacaccagagtctggtgcgcaggcttaaggatattaagcctctaccaagtattcgtgatataggcagagctaaaaaaatgctggagaggctgcgcaaggactacaaacttcggtcccacacctattggtatcgagcaagatattttaaagtgctcgagagactcaacgtcctgcagcgaacttacgagcacgttgcattcgatttcagggtggagctgaaggggttaaagcctacacagaattga

SEQ ID NO: 10747 - RNA, 1203 nt, unidentified
  source 1..1203: mol_type = other RNA; note = synthetic construct
atgaacctcgttggcaataatctagacattcccagaaaaattagcaccggggccatcgcctccctcaattccttgtacaatactcttggctgcaccgaaagcgagatcacgagcgtcctgaatatcccccccgaccaactctacactgagatacgcatctcaaaagcgggcggcaaacagcgggtggtgtacaacccacaccgacttctgcgacgtctccagaagaagataaacgagcagatcttctcaaactcggacgttattagctggccttgctatctctacggatccatcccgaatcagaattatgaagatgggctggagatctattctaggaaagactacgtctcatgtgccgccaggcattgcggggcaagatctctgttgaagctggacgttgaaaacttcttcgataacatccattacgatgtggtgtacgcagtgttttctgactttttaaagtgctcatcagacgtatctgatattttatctcggctgtgctgtaagggggaacacctggtgcagggagctttgacctctagttatctggctagcctgtgtctgtacgacctggaaggagccgtggcagagagattgcgccggaaaggtttcgtgtacacacgtctggttgatgatgtcaccgtgtcctccaaaaagctgaacgtcgactttacctttgctcggaacaccgtggtcagtatgcttgaaggcaaggatcttcctgtgaacgaatcgaaaactaaagtccaccgcgtctctactgtaccactcagcgtacatggcttgcgaattggattttcaactccaagactgcccgcggatgaggtacgccgtattcgcgctgccgtccggaatatagagagtctggcaacagagagcaactacaggacaacacatgcctatcggcacgagtttaaccggtgtatgggaagagtgaataagcttctaagggttgagcattcccagcatcccagccttgctagtaggttagaaaggattaggcctctaccatccttccgcgacatcgcccgagctaagggtatgattgacagattgcgaagtgatcacacatcccgcgcacacacacactggtataagaccagataccacaaggttctggaaagactcatcgtgctccaacggacgtataaacacgtgagctatgagttcagggtggagctcaagggtctgaagcctatatga

SEQ ID NO: 10748 - RNA, 1215 nt, unidentified
  source 1..1215: mol_type = other RNA; note = synthetic construct
atgatcgacgcgcggtttgtgaacccaatcaaactttcagctgattctatatcctccgtgagttccctctgcgacgtcctggatatctcccagaaagaattgggggaggtactggctctaagcggcgaggagcgatattctagtaaggaaatcagtaaggccgggggcaagtccaggatcgtccataacccccataagctggtgagaaagatccagagacggattaataaccgcatattcaccgccgagaactacatacaatggcctagctatctttacggctccgtttcaaatcaggagtacgatgtggaggacgatcagacatacctgaacggtaaggattatgtcagttgtgctgctagacactgccaggccagctcgattctgaaactggacgtgcaggatttctttgataacatccacatcgggctagtggaacaggtcttcaaggattttttgtgttttccggagcctgtggctaaagtcctcgccaatttgtgctctcgaaatgaacatctgttacagggagcactgacgagctcttatctcgcctcactgtgcctatgggacgtggaaggcaaggtagcggaaaggctggggagaaagggattagtttacacaagactcgtcgacgacattactgtctcaagcaaatccattaaaaccgatttcacatatgcaaagaacattatcatcggtatgcttgagagtaaagacctgccagtcaatgaagcaaagacacaggtgcacagagctagcactaaaccgctgaccgtccatggtcttcgggttggcttttctactccacgcttgcctgctgatgaagtgaggcgtattcgggccgcagttcgcaacgtggagtcattggcagaggaacccaattatagggtgaagcacgcatacagaaaagactttaatgtatgtatgggaagggtgaataaacttcaaagggtgggacattcgcagtacgacgccctcgtgtctcgcttagagaaggttcaacccctcccatccaaacgcgatattggaagggtaagaagcatgatagaacgactccgcagcgactaccccaaacgagcccacacctattggtacagggtgcgtttctataaggttcacgagcgtctgaacatcctgaagcggacctaccggcacgaggccctggacttccggattgagctcaaggccctgaaacctcccaagtctggccaatga

SEQ ID NO: 10749 - RNA, 1191 nt, unidentified
  source 1..1191: mol_type = other RNA; note = synthetic construct
atggccgtcttggttccttacaaaaaaactaacacatccatagggtcgatagagagcctctgtggcaccctgggcataacccaggaggagctagcccgtgctatcgctatgcccctggtgatgagatacactacagtagaagcgcaacccaaagctgacgggtccgtccgcagcgtttcaaaccctcatttccttattaggaagatccagagacgtctgaacaaacgcatattcagcaacggtgcactgattggctggcccgattacatttttggatcaatcccgaatcaattcgacgctctcggggtggaggccgacaaggattatattgcctgtgcagcccgccattgcggcgctaaaagtatcctccacctggacgtccagagcttctttgataatatccatcgcactcaggtacttgcaattttcgaagattttctgaagtactccgaggccgtctctgatcagctggcggacatctgctgtaatggagagaacctcgtccaaggtgctctaaccagttcatacttggcaactctgtgcctttgggatgtcgaaggtgaaatggtgaaccggctgaaccggaagtcgttgacatacacgcggtttgtcgacgatatcacaatttcctccaaggtggccagttatgactttagctatgcccagggaatcgtgcaggacatgctcgcctcaaaagacctccccatcaattctggaaagacgagagtgcggaggatctcttctgaagccctgaccgtgcacggccttcgcgtgaattttagccagccaagattaccaagtgatgaggtgagaaggattaggtctagtgttcaaaatgtggaaaagttggcagtagaatccaactatcgccagtctcattcctataggaaggacttcaatcggtgcatgggccgagttaataaattaaaacgagtgggacacaaacagcacgctgaccttctgaagcgcctccgagagatcttaccactgcctagcttcaaggacattgagcgtgcacacctcatggttgcgaggctgaaggattcataccaggctaagggggattctttttggtaccggcgaagattctatgcaacccacgaaaggttgaccattctggatagatccttccatgccatagccgtgaagctgcggggggagcttaggctgatcagacctagctatgactga

SEQ ID NO: 10750 - RNA, 1227 nt, unidentified
  source 1..1227: mol_type = other RNA; note = synthetic construct
atgtcatacaaatatgatttcggcaaacgctcgaaaaggtccattggctctattgcaaagctaatcgccgtactggatattactcaaaaggagttggatatcgtgaacctcctgaccgaaacacagaaatacaagaagaaagaaactgtgaagagcgacggtaccgtcagagtggtgtacaacccggacaagactctccggaagattcagcgccggattaacaaacgaatctttaaccagcgcggaaataagggagggcttatatcctggcccaactatatctacgggtccatcccaaatacgccacaatacaactctaatcagaaaaacctggatttctctaaggactacgtggcctgcgcggccaatcattgcggctctaagtctttgctgaagatggatatatcagacttcttcgacaatatacacagtgtccatgtgaagtccgtctttacagacctcttaaagatccccgacgacgtcagtgacttgttgaccgctctgtgttgcttgaaaggaaacgttgtgcagggggcgcttaccagctcgtatatcgctagtgcagtgctgtttgatgtggagggtgacgttgtgcgtcggctccacttcaaaggccttacatatacacggttagtggatgatatcacggtatcttcccagaagcttaattatgagtttacatttgcccaaaacctgatagccgacatgctgtcaaaaaaggatctccctatcaacctgaataaaaccatcattagcaactgtagcactgaagagctgatcgttcacggtctgagagttaatttcaaggagccacgactcccctcttccgaggtcagtaggattcgagcaagcgtgaagcacctcgagctgctaagccaggactcaatttaccgtgtaagtagggattataggaagtcctatgatagatgcttgggcagggtcaataaactggggagattaggccacaaacagcatgccactttactgaccagggttctgagaatctggcctcttcctaacaagaaagatattaatctcgcaagcaacctgataaagaagctcgagggatggcacctgaccaccaaagctgacgaatactggtactaccgcctgtgtaataaggcccattcagaactaaatatcctccagcggagctatagcaaaacagctctttccctgcggaagagacttaaaaacattactcccaatcgcgaagactacctgtga

SEQ ID NO: 10751 - RNA, 1014 nt, unidentified
  source 1..1014: mol_type = other RNA; note = synthetic construct
atgagttataaatacgattttgggaagcgctcaaagagaagtatcggctcaatcgcaaagctactcgacgtcctggatattaagcaagaagaactcgatctggttaactcactgacggaagaccagaagtacaaaaaaaacgaaatccccaaaagcgatggtactgttagggtggtgtacaacccacataagacccttcgaaaggtccaacgccggattaataagaggatctttaatcagcggcacaataaaggaggcctgatctcttggcctagctacctatacggaagtatccccaatactccacagcagaacagcacaacaaaaactttcgatctcagcaaggactatgtggcttgtgccgcaaatcactgcggttcgaaatctctgttgaaaatggacatcagcaatttcttcgacaacattcacgaaacccatgtaaagaacatcttctccaatttgctcaagtttcctgaggacgtgagtaatacccttacttccctgtgttgcctgaaaggcaatgtcgttcagggagccctgacatccagctatatagccagcgccgtgctctttgatgtagaggcgcaagtggtcaggcgactacacttcaagtccttaacttacacccgtttagtcgatgatattaccgtgtcctctcagaaacttaactacgactttacattcgctcagcggcttatagcagacatgctgcagtccaaggacctgcccatcaacctctccaaaaccattatatttacgtgttctaccgaggagttaattgtgcatgggcttagagttaactatagtgagccacggttgccttcttctgaggtcgccagaatcagagctagcgtgaagcacctggagctgttggctcaagattcagtgtacagggtatcacgcgactataggaagtcgtatgaccgttgcctcggccgcgtgaacaaactgggcagactggggcataaacagcactccattctgttggagcggacagtgaagataaagccgtga

SEQ ID NO: 10752 - RNA, 1203 nt, unidentified
  source 1..1203: mol_type = other RNA; note = synthetic construct
atggcctttagatacgatttcataaagcggaatcgtaatagcatatcctccatcccaaatctgctggatgctctgggaattgagcaagtgcagttcgaacagttccaaaacttacgcgacctggataaatacaaagccagtagcgtgccgaagtccgatgggaagatccgcacagtttataatcctgcccagctgattcggttgtttcagagacgaatcaacacaaggatatttcaccctaaacattctcaggggggtcttattacctggcccagttatctatttgggtccatcccaaataacccccaatcacccgagtctagtagccgtaactatatcacctgcgctggaatgcattgcggcgcaaaatctatcctgaagatggacatctctgacttctttgacaatatccaccatagagaggtcatcaacattttcgaaaagttgctgaagttcccaaacgatgtcagccgcacgctggcggacatctgttgccacaagggtaacgtagtgcaaggtgctttaacatcctcatacatagcgtctgccgtattgtttgacgtggagccaaatgtggtacggcggatgcacgagaaacacttggtctatactcgccttgttgacgatattaccatttcatcgaagatctacgattatgatttcagctacgccaagaacattgtcattgatatgctcaggaaaaaggggctccctaccaacgaaaataaaaccattgtgatcaactcttccacaaaggaaggcttagtgcacggcctccgtgtgtgttttaaagagcctcggcttcctgctgatgaagtgggaaaaatcagggcatcagtccagcacgtcgaacgcttcgcaagggacgccgagtacaggactagtagggagtatcgaaggatctataacagatgcctgggccgagttaatcgcctcaaacagctgggccataatcagtatcagaacctcaaggacagacttataaagattgaaccgaagccctgtaaggctgacatcaaaaaagccagaaacctggtgagaaaggtgaagactctccataaagactacggatccggctaccgatatcgccggctgtactacaaggcccaatacgagctgaatattctacagcggactttcagcgttacggcagacagcctgcggaaacagctcagaagggtgaagcccacctacgagcagtga

SEQ ID NO: 10753 - RNA, 1227 nt, unidentified
  source 1..1227: mol_type = other RNA; note = synthetic construct
atggagaatacactcaactatcgaaagcggtatacgagcagtatcgggagcgttagcaacctcctctcatgccttgacatcacgcagcaagagtacgacgctttttgcgctctggcttcagaggagaagtacaaatcttttaaactgcccaaacctgacggaacaagcagagaagtgcatgctccacacaaattggtgcgcaagattcagcggcggattgtccgacgaatattcggctccccgaacagaaatcagtgggataagaagaggcctaaagggggagccatcatctggccggagtatatctatggttccgtacccaacgattactataacaacaccccaatctccaaagattatgtggcttgtgcctctaatcattgcggatgcaagtcaatattaaagatggacctgaaggatttcttcgataacatcacccctgatctagtcttcaatgtgttcaacaatctcctgaaatatcctcgcccagtcagcaatgccttagtgaaaatctgttgtcacaacggcaagctgattcagggcgccctgacatctagttacatagctagtgcagtcctgtttgacgccgagcctaaactggttaagcgtttgaaatcgaagaatctgatttacactcggcttgtagatgatattaccgtgagcagccttaaccaagattacgacttctcttatgcaaccgagttgattcgtcaggtgctgtacgaaaagaatctaccactgaacgagtctaaaacaattgttttgagggtcagcacttccgacatcctcattcacggccttagggtgagtttttccaaaccacgcctgcccgccgatgaagtatcgcgtatccgcgcgtccgttaagaatttagaatcccttgcaaagattgccgactacagggtgtcccgcgactacagaagaagtttcaatcgatgcctgggtagggtgaataaattgaagagacttggccacaaccaatacaaagcactccagcgcagggtgatcaaaatcctgcccatgcccagcagaatggacataactcggttggactcttttgtctacaagctggaagggtggtatcagaatcactctgattcatactggtacaagaggctgtatcatcgggcatactatgatctcaatattctcaacaggacctttaaggcgtcagccgaaaagctaaaggcccggctcagactgatcaagcccaactgtgacgactga

SEQ ID NO: 10754 - RNA, 1227 nt, unidentified
  source 1..1227: mol_type = other RNA; note = synthetic construct
atggagaataccttgaattataggcgtagatacaagaactccatttccaccgtgtcaaatcttctgtcttgcctggatgtatcgagttcagagtacgaggactttaaagctctggcccacagcgatcgatacaaggaattctatgttcctaaagcagacgggacttccagacatgtccatgccccgcacaagttagtgcgaaagatccagcgcaggatcgtccgccggatttttggtagcccaaaacggaatccttgggataagcatcgcaagaagggcggcgcaatcatatggccagaatatatctacggcagcgtgccaaacgattgctacaacaatacaatgatctccaaagactatgtcgcttgtgctagcaagcactgtggatcccagtccgtgcttaaaatcgacataaaggactttttcgacaatatcactccagagctggtattcaacgtttttaacaagctgctgaagtaccctagagcagtggctaatgcactagttgacatctgctgtcataataacatgctgatccagggggccctaacttcctcatatattgcgtctgccgtcctgttcgacgttgagccggccatcgtgcaaaggctgaagtctaaagggcttagctacacaaggttggtggatgatattaccattagcagtagaaaccccgaatacgatttttctttctctctggagcttgtgcgccagatgttatatggcaaaaatttgcccctgaacgaaaccaagacaaacattattcggagctccacaattgatatactcatacatggcctgagagtgagttttaaggagccccgcctccctagtgacgaagtgtcccgaattcgagctagtgtcaaaaacctcgagtcgctggccaaaatcgccgactatcgcgtctcaagggattacagacgttcattcaataggtgcctcggtagggtaaacaaattgaagcgtctaggacataaacagtatatctcactccagacccgggtgctgaacattctgcccttacccagcaaaatggacatcacgcgcctcgactcttttatccacaaacttgaaggatggtacgccaaccacaaggaggaatattggtatcggcggctctaccaccaagcgcactacgatctgaatatattgaacaggacgttcgagcacagttctcggcggttcagaagcagactcaatgatattaagcctatgtgtgacgattga

SEQ ID NO: 10755 - RNA, 1224 nt, unidentified
  source 1..1224: mol_type = other RNA; note = synthetic construct
atgacatccaaatacgagtaccacgtcaggaaaagaaccaaccggtccatcccatccataaagagtctgaagcgcgctctgtcaatctctgatacagagatcgacagtttttacgagctcattaaagaaggcaaagcctataagagggtcctgggacatttgaagtcttctggggatgagcgtctcgtctatgatccccacccactcgtccgcaagatccagagattgatcaattcacgagtgttcaatcctcgtaaacctaaggagggcctaatagtgtggcccccttacctctacggcagtgttcccaataccgtgaaagtaattaaaggaaaggtggaagttacgtctcgagactacattagctgtgctaagaaccattgcctgaccaaatcgatccttaaaatcgacattaaggacttctacgagaacattcacaagagcgacgtgttcgacatttttagcaaggtgctaaaatacccagatgacgtttcaacacttttggcagacttttgcacttataaggataaaattccccaggggggtctgactagttcctttatcgcaagtgctgtgctgcacgatgttgaacctaagctggtacagcggctccacaaaaagaagttgatctatactcggttagccgatgatatcaccgtgtcctcatttacaaacaactacgacttcaatctttgcatctcattgatcaaagagatgctcattagcaaggacctcccaataaacgaagataagcttgtcataagcaatcactccaattctgcgactttagtgcacggtctgcgggtaaatttcaaggagcctcgactgccggaagacgaaatctccaaaatccgggctagcgtgaggtctttggaaaagctggcccaggacagtaagtaccgcacctcaagagattataggaggagccactctatttgtatggggcgcgtgaacagaatgcaatcgataggacataacaaagcaagacaactgatggttagggtcctgaagatcttacccctcccgtcctaccaggatattattacgagccataaactcgtgtataagcttgaaaaatccttcaaaaaggacaagtgtgagtacttttataagcggctgtataacctggcccagtatgagctgaatattctgcagaggagcttctctcgcgaggcccatgagctacgcaacagactgaagagagtgaaaccaaatgaagtctga

SEQ ID NO: 10756 - RNA, 1224 nt, unidentified
  source 1..1224: mol_type = other RNA; note = synthetic construct
atgaagacccacttccaataccacataaagaaacggactaataggtcaataccctccatcggtgttctcaagcgcactctttcaattaccgatgaggagttcgattctttttacaccttgatagcgaacgacgacgcgtataagaaagtgagtggtcattttaaatcgtctggggacgagcggttggtgtataacccccaccccttggtgcgcaagatccaacgaatgatcaattcacgtattttcaaccccaaaaaacctaaggaaggcgtcgtgatctggccaaaatacttgtacggctctgttccgaatactcttaaatgggtggacggaaagctggaagtgttccatagagactatatatcttgcgcaaaaaatcattgtctgacgaagagcatcctgaaggtcgacatttctgacttttacgagaacattcattggcaggatgtatacgagattttcaataaggtcttcaagtatgcagatgatgtctcaaaggccctggcagatttttgtacatacgataataaggtacctcaaggagggctcacaagcagctttatcgccagcgctgttctacacgatgtggagcctaaacttgtccagcgcctccataagaaaaagctcatctacacaaggttagttgatgacatcaccgtcagtagttataccaagaactacgattttactctggccgtaggactgatcaaggagatgctgctgtccaaagatctgccgattaacgaagagaaactggtgattagcaaccactccaacagttcaaccctggtccacggcctgcgggtgaacttcaaacagccacggctcccagaggacgaagtgtccaagatccgcgctagtgtgagaagcttggagaatctcgctaaagactccaagtatcgcacctctcgggactatagaaagtcccatgccatgtgcatgggcagagtgaaccgaatgcagtccatcgggcataaccaggccaagcagttacttaacagggttttaaagattctgcccctcccatcctaccaggacataattacggctcacaagctggtatataggctggagaaaaactttgaaaatgacaaaggcacatactcgtacaaaaggatctataatcttgcccactatgaactaaatctgcttcagcgttctttcagcagccacgccaaaggactcaggctaagactgaaggaagtgcgacctaatgaagtgtga

SEQ ID NO: 10757 - RNA, 1161 nt, unidentified
  source 1..1161: mol_type = other RNA; note = synthetic construct
atgaagcacttagaaaaagtgccatctgccaaatctataggctctctgaacaagctctcccacgctcttggaatcgaaaaaagcattctgatcgatgtcgcagagtccatcggaggataccggaagtcggagcgcacaaaagataatgggaaaattagagtggtctactcaccatctagaatagtacggaagatccaaagcgccattaatgaacggatttttacagatcccaggatcatttcctggggcgagtatctgtacggtagtattccgaatgatgagtatgtcacccgcgactatatctcatgcgcggcccggcacggcatgtgcaaaagcattttgaagatggacattagcgactattttgataacatccatgaagacgctgtgttcgatgtgtttaacggcttcctcaaatatcccaatgacgtgagcaccatcctcgctggcatatgtacccacgagggcagggttcctcagggaggactgacgagtagttacctagccaacttagtcctctacgacgtggaggagatcgtgatcaacaagttagagaagaagaagcttacctacacgaggtatgtggatgatatcacagtctcatccctgtcttacgggtatgacttcacttacgcccaggaccttattaagaacatgctgcatgggaaaggttttccagtaaatgaagaaaagtgtgtcatcgaaagaagcgggactattggactgagtgtgcatgggctgcgcgttggttacgaccgccctagactgccaagggaggagatgagaagaattcgtgccaacgtgcagaaagtggagatcatctctaaagagcctgggtaccgaacaacccattcctataggcgagactttaatcggtgtatgggcagagttaataagttggttcggctcaagcacgatcagggcgctaaattcataaagcggttgaacgcaattaagcccttgccttccatcaaagacatcaatcgttgccgcaagatggtatggttcctcgcaaaagattacgagaacaaaaagaggcgtctgtcgtatgaacgacgattttacatatgccacgaacgcctgaacatactgaagaggtcattctatcaggaggaacaatacctacgctccaatcttaggactattagacccgtgagctga

SEQ ID NO: 10758 - RNA, 1269 nt, unidentified
  source 1..1269: mol_type = other RNA; note = synthetic construct
atggataaggtcttccttgacagcagctatagtatgggccgcccctcgttgttggtcaggtcagaaaacatggaactcatcgattactatgacaaggacagcgggaactcaatcagctctataaagaacctctgtctagccttggacatcaatgagtctgagttagatgagatttctcagctgggagatgaccggtacgtgaaatccgaggttccaaagtcctcaggaggagtgcggatagtgtataaccctcacagaaccctgcggaaagtacaaaggcgtatcaacaacagaattttcaacccgaaaagtggggcgatcattcgctggccaagttttatctatggttccatcccaaaccagcaccttttgcatggagagctcgagcacaaagattatgtggcttgcgtgaaaaatcactgtctgaggtcttctattctcaaggttgatgtgcaagacttcttcaataacatccatatagaccacgtcgtggaaatttttacatcgttcttcaagtaccccgatgatgtaagcaactgcctggcagagctctgttgttataaggactttgtggtccagggggccctgacctcctcctacatcgcatctctgtgcttgttcgacgtggagccagatgtggtccgtagagtgaagaggaagggcctggtgtacaccagactcgtggacgatatcaccatttcatccatggatagggactacgactttagctatgttaaatccctggtcatagatatgctgcatgaaaaagaccttcctgtgaacgttgagaagacaaacgtatttagagtcagtgaaggccctcttctggttcatggtctgcggattagctttcaggagcctcgtctgcccgccgatgagataagtcgcattagagcaagcgtcaaaaatgttgaacgactagcttcagaacccaagttccgcacgactcacgcttaccgacaggactacaacagatgcatgggccgagtaaataagctaaaacgcgtgggccacaatcagcacaaaaagctcacagaacgcctgctcaaagtccatcccaagccctcaaagaaagacctgaaacggattaaggtgatgatctctactttagaacgagattatgagaagaagggggacaattattggttttacaaacggttctatcgcgcccaggagaggcttaatctgatcgccaagagctacccaaattacgtgaataaactgaggcctcggttaaagaaggtttttccgaattacgacaaatcctga

SEQ ID NO: 10759 - RNA, 1200 nt, unidentified
  source 1..1200: mol_type = other RNA; note = synthetic construct
atggaggttatcgactacttcgcgaaagacagcgacaacagcatttctagcatcaagaatttgtgccgtgccctagatctgaccgaatcagaaatcaacgaagttcgcgccctgggcagtgactcttatatacagagtgagattcccaaatccagtgggggcctgagacgcgtctataaccctcactacaaacttcgaaaggtgcagcgccgtataaacaacagaattttcaaccccaaatccggagccattgtccactggcccagtttcatctatggaagcatacctaatcagaatctgcttgatggggacattgatcataaagactacgtggcttgcgtctcaaatcattgtctgagcagaagcttgctgaagattgacgtgcaggacttttttaacaatatccacattgaccatgtgaccgacatctttaagaatttcttcaagtacagcgatgacgtttcggaatgcctcgcagagatctgctgttataacggatttgtggtgcagggggctctgacttcatcctacatcgcttctctgtgcctattcgacatagaaccagaggttgtcaaaagggttagaagaaagggcctgcgctacacgcgcttggtggatgacataacagtctcttccttggaaagggactataactacagctatgtgaagaacttgatcattgatatgctccatcagaaagacctgcctatcaacgaggagaaaacaaatgtgttcagggtgtcagaaggtccgctacttgtgcacggtcttcgagtctcattccgcgagcccagactcccatctgatgaggtgagtcggatccgggcgtctgtgcggaatctcgaaaagctcgcatccgagcctaagtttagaacaacccacgcctaccggaaggattttaaccggtgtatggggagagtaaataagttaaaacgagtcggccacaatcaacacaggaagctgatcactcgcctgctgaaggtatcccccaagccatccaaaaaggatcttaagaggattgaggtaatgctcgagaggctggagcgtgattatgataaaaaggccggcaattattggttctataagcgattttaccgggcccaagaaaggctcaacctgattgcaaaatcgtacccgaacttagctaaaaatttaaggctgcggctcaaatgtgtatttccaatctacgataagcattga

SEQ ID NO: 10760 - RNA, 1200 nt, unidentified
  source 1..1200: mol_type = other RNA; note = synthetic construct
atggccacagatgtactgttcaagaaagtttctgctccaatagtgtcgattgagaagctatgcttggcactggacatctcaaaggaggagttgaatgatgcactcaagttaactagctctgagagatacacgaaatcagaagtcccaaagcccaacggaaaggtgcggatcgtccacaatcctcataagctgatccgtaagatacagcggcgaatcaacacaaggttgtttaacccaaagcctacagggaggggtgtggtggaatggccttactatatctttgggagcgtgccgaacgtgaaagatcctattaaacccattgagcgcgattatatcgcctgtgcccggcagcactgtctgtcacagtccatcttgaagattgacatcaccgatttctttgacaacattcacatcgatcacgtctactatatcttcagacatcttcttgactacagtgacgaagtatgcaatgttatctccgatatttgcagcctgaatggagccctgctgcagggcgctctgactagctcctacctggcctgcctctgcctcttcgacgtggaacctaatgttgtgattcggctccagcgtaagggccttcgctacacccgacttgtggacgacataactgttagcagtattaaagacgggtatgacttcaccctggcgaaaaacataattgtcgagatgctggagtccaaagatcttcccgtcaatgatgcaaagactcagattatacacaaatcttccgtgccactcgtagtgcatggcttgagagtaaacttcaaggaaccgaggctgccctcaagcgaagtctctaaaattcgcgcaagtgttaagaatatcgagcaactagctaaagagaggcattacatcacgacacatgcctatagaaaggatttcaatcgatgtatgggccgcgtcaacaaattaaagcgtattggtcacaatcagcaccaatcgctcgtggaaagactcaggaagatactgcccctgccttctaagaaagacattgaacgctgtaaagagatggtgagtggcctcgagagcgattttccaaacaagaagggacatttttggtaccacagacggttctatcgcgcgaacgagaggatcaccatcctagaccggacctttaaatccatcgctaaagaactgaggttaaagatgaaggatatcagacccctgtataaagactga

SEQ ID NO: 10761 - RNA, 1200 nt, unidentified
  source 1..1200: mol_type = other RNA; note = synthetic construct
atgttcgacaggtttacctttagcgcagccaaggcgccaatcaccagcatcgacaagctttgtgagactctttccgtctcccgggaagaactttacgatacattggaccttcccgacgaactgaagtatacagaaacccaaatcccgaaatcttttggcaaagttcgaaaagtccataacccacacaaaaagctgaggaaactccaacgccgaatcaatagacgattatttaaccctaagggcaagagtgatagcgttataaactggccggtctatatttacgggtccgtgcccaatcaagagatcgagggagtcacatacaatcgcgactatgtcgcttgcgccaggcagcactgcggaagtcgttctattctgaagctggatatttctgacttcttcgacaacgtccacgaggatcacgttaaaaatgtgttcgctaacctactcaagtacgaggaggaggtggctgaagtcttgacccagctctgttgttttaacggtagtctcgtgcagggcgccctgactagcagcttcctggcatgcctgtgcctctacgacatcgagccaaagctagtgaagaaactctcccgcaagaacctgcggtatacgagacttgtagacgatataacgatcagctcaactcagccacacttcgacttttccatggtaaaagacatagtgctgcggcagctgtacgaaaaggatctccctgtgaacaaggataagatcgtagagttgtattctggcacttcacctatgcttgttcacgggctgagagtgaactacagcgaacctcggctcccatctgaggaagtgtcacggattagggcagcggttaaaagaattgaactgcaggctatcgagcccaattataggacatcccatacatttcgcaaggatttcaaccgtaccttaggaagagtgaacaagctcgcccgtatgggtcataatcagcataagaagttgagtgcacgcctgtcgaatgtgcgacccttaccctcaaaaaaagacatcgagagatgttggtccatgctggccagactgcagcgcgattacaattcacagaagaattcttactggtacaaacggaggtatcacagactgagtgagaggttgattatactgaaaaggaccttccataagactgaagcccggattcgcgaggccctaaagaaaattaaacctgggttcgtggattga

SEQ ID NO: 10762 - RNA, 1278 nt, unidentified
  source 1..1278: mol_type = other RNA; note = synthetic construct
atggcaaacgtctatactgacgagatggagctgtgccagttgccactgaacaacaagtacaacttcaagtacataatcaactcaggcccaatcaagtctattcaagatctgtgcgagaaagtgctggacatccccatcagtgaactctacaaggctctttcaatagcggaagaggagcgataccaacgggcctctgtgccgaaaaaagacggcacaatcagagtggtctataaccctcattacctgattcggaagatccagagaaaaattaattcccgcatcttcaatccaaaggtcaagttaggcaagaatccaggtgtgattaagtggcccccctacatttttggatgcattccgactcagtatcaggaggtcgacgaaggggaactgatcaccgacagtagggattatattgcgtgtgccaaaaaacactgtctgtccaagtccattcttaagattgacatatccaacttcttcgacaacgtgcacaagtctatagtagaggacattttcaaagaactcctgaagtatcctgatgacgtggccgaggtgttggccgatatctgctgtaaaggcgagcatctggtccagggaggacttaccagctcatacctagcatccctcgccctctgggacgttgaacccgaggtggttaaacgccttaacaataagggcctcaagtacaccagactgattgatgatataacagtttcgagcaagaaacagaattttcagtttgacttggtgaaggatgtaatcgttaatatgctacacaacaaggacctccctgtaaacaactcaaagacggaagtcagctacgctagtaccaagccactgatagtccacgggctgcgcgttaatttcaaggagcccagactgcccagcgatgaagtgagccgaatccgggctaatgttcacaacgtggaaaaattggcaaaagagcgacactaccgcacgatccacccttatcgcaaagatttcaataggtgcatggggcgtgtgaacaaactaaaaaggctcggacataatgctcataagcctcttttgaagagattacaagctatcttgcccctcccaagtaagctggatatttctaggtgtgaaaaaatgatcactcggctggaggccgattttgacaaaggtaaagggaataccatctggtattggagaaggtataatcgggcaagccagcggctcatcgtattaaagcgtacatttattcatcaggccctggattttcgtgagaggctgaaaaatgtgaagcctacagtggtgtga

SEQ ID NO: 10763 - RNA, 987 nt, unidentified
  source 1..987: mol_type = other RNA; note = synthetic construct
atgacctatcgaatgtattttgaaaggaaagtctcagggcctatcgatagccgagctaagctttgccaggccctctctatcggggacgaagagctgacacaagcattggcattgaccgaagccgagcgttacaccgaatcaagtgttcctaaggctgatggaacaacgcgcacaatctataaccctcaccacaagatcagaaaactccagaggcgaatcaatactaggttctttaatccttcgaagaaaatccacggaaatgatagcggcattatccggtggccaagttacatttttggttgtgtgcctaacgatataggcgacgacggcgaaaccgaggtacagaaggactatgtggcatgtgcaagagttcattgtccaagcaagtccattctcaagatggacattagtgacttctataacaatgtccaccgcgacttggtgttagaagtcttcaaggatatgctgggtttcacggacgatgaggtggcgtccttactgactgatatttgctgcaaaggcgattcacttgttcaggggggactgacctccagctacctggcctgcctggccctatacgacgaggagccagaggtggttcggcggctcaaacgtaaaggtttcaggtacactcggctgattgatgacataactatatcctctcccaacgaaaacgtgaactttgactacgtcaaggatttggtggtgaacatgctgcacgctaaggagctccccgtgaaccgcgacaaaacaaaggttcaatacgtatctacagagccgctgctggtacatggccttcgggtgaacttcaaagagccgagactgcccaaaggagaagctgcgagaatcagggccaatgtgcataatgtggagagactcgccaaggagagacactaccgcaccattcatccctataggcgcgattttaataagtgtatgggccgtgtcaataaacttgctcgggtcaaccccccactagccgggtga

SEQ ID NO: 10764 - RNA, 1209 nt, unidentified
  source 1..1209: mol_type = other RNA; note = synthetic construct
atgaccaccgcactgatcaatgacaagatcaagaagagcaatagcgccctcatagggaacttcaagaatcttcttcacgcactcgagatctctgatgacgacgtcagcaagttgagggcctttctgccccatgacaggtacaaggaaaaaacaatcaagaagaaggacggatccgaccgtaaggtgtatgcccccatcccagtgctcaagaaaattcagaacagaatcaaaaaccgcatccttgctaatcaggatgttatatcttggccatcctacatcttcggttcaatcaagaaccagaaaattgagggcgggggtatcgatagtcgggactacgtgagctgtgccgccaagcactcaggcgccaagagtctgctgacagttgacattaaagacttcttcgataatgtgcacgaggacatagtggcagctgtgtttgagcgctacgtctcgacagataaagaagtgattaattggttgctcgacgtatgctgctacgagcaacacctggttcaaggagcccctacctcttcttatttggcgaacatgtccctatatgacattgaacctcagctggtccataaactggccagaaagggcctgatctatactcggctggttgatgatatttccgtatccagcaagatctatgactacaactttagctacgcattgaaactgatagaggatgccttatcagaaaaaggactctacctaaaccctgagaagataagtcaaaggtcagtggggtcagcgcctctcaccatgcatggactgagaattgactatcagactgctcggctgcccgcagctgaagtagggcagattcgagcgcacgtgaagaatctagaggatgccgccaaaagttataaatctaggacctcctatgcttaccgccaggattacgctcggtgcatgggcagagtcaacaagctggcacgagtgaagcacaaccagcatagtaaatatctcgctagattaagggctatccagccactgcccagcggcaatgaatccacatactgtctcaagaagttagaggtcctggagaaaacttatcttgaagcaaaggagacgttctcctaccgtaaaaacttttaccgcttgcaagagaaaatcaatattctgtcgcggagctttccgcgctctgcggaagatatgaaaaagcgaatgaagcttattgccccaccgcccaaagatggtaaatga

SEQ ID NO: 10765 - RNA, 1218 nt, unidentified
  source 1..1218: mol_type = other RNA; note = synthetic construct
atgagccgaccaaccatccgcaatagtgcacccatcaatacactggaaaccctcctaaaaaccctgagtatatcttccgatcagctggaagaaatccttgcattgtctgccggtgagcggtacactaaacctctcaatgacgttcacaagaaggatggatcaatacggaaaatcaggtgtccacatcattctctgcgagtgattcagcggcgcatcagcaaaaggctgatatacgacaaggtgatctggccagagtatctgtttggcagcattagaacccgggattatgaggacttatcggagagggattacatcagctgcgcggccaagcattgcggggccaagtccttgattaagattgacgtggagaactttttcgataatgtgtcaagagaaacggtggttgggatttttaaagacctgatcagatgctccgacaaaaattccgagctgcttagtgagatttgttgctatgaggacaatctcgttcagggggctattacaagctccgcattagcgatgctcgccctgtgggacattgagggcaaggtcgtcgatagactcgctcggaagggcctagtatatactagattagtcgacgacataactatcagttctaaatcccataacttcaacttcgatcacgccctgaatatcgtgaaacaaatgttgtacgaaaaggatctgcccttcaaccaagccaagaccaagatcgaacgtctgtcctcagaagcattgacggtgcacgggctaagggtcgcttttaaggaacctagactcccgagcagcgaacctcgggtcatacgaagttacgtacagcgactcgaaaaacttgctagcgacggtttccacaggcgtacagccgattaccggaaggattacaacagatgtgtgggcaaggtggtcaaactgcacagggtgaagcacaacaagtaccggcccctgaaagaccgattggatagaatcccaccgcttccttcaaagagggaccttaaggtggttgagaagctgatctgtcgcctggagagggattataattctgagacaaaaggaattggtggaggaaagtatcaggacacttactggtacaaaaagcgttattctcgcattatgtatcgcctgtcaattgtaaaacgctcctacaagaacaaatatgacgagtatatcgagcgccttgacaaggtgaaacccgataccaaaggcctctacaacgattga

SEQ ID NO: 10766 - RNA, 1203 nt, unidentified
  source 1..1203: mol_type = other RNA; note = synthetic construct
atgatcgacccacgctttcctctattcccagagaagaccaccgagaaaagcataagcacactccagtcactggccgacgctttcagcatccctctggccgacctggaaaaagcccgccagctgagccccatcgagcgctatcgagcgaaagaaatacccaaggccggtggaggaattaggcaagtctacaatcctagctacctgattaggctcatccagtctagggttaacaaaaggatttttctggacctggtgcgctggccgggctatttgtacgggtcattacccaatacttatatcgacgatgagcctgtgtatcgggactacattgcatgcgctaaaaatcactgcctctccaagagtctgcttaagattgacatctcgaactttttcgacaacattcacagagatcatgtttaccggatcttcaacggcctgctgaagtttcctccaccagtaagcgagtatctaacggatatatgctgttatgaggattttctcgtgcagggtgctctgacatccagttatctggcaaccctctgtttttggaattgtgaaggagatgtggtgaaacgtttgtcaagaaaaggactggtttacacaagacttgtcgatgacattaccgttagtagtcggagacatggcttcaatttcgactacgctgagcaccatatcaagatgatgcttatcgacctggacttacctgcgaacgacagaaaaaagcagatactcagggatgggattgaaccccttcacgtgcatgggcttcgggtgaattaccagactccccggcttccagccgatgaagtgcgacggatcagatcagccgtgcataatgtcgtaaagatggccaagatcaataactacagaacatcttcctcctatcgctcattgcacgaccggtgtgttggtcgggtgaacaaattggcacgcgtaggccacaacaaacacaagatctttaaggaccaactgttaggcgtgctccccctaccgtctcgaagggatgtcgagaaagccgagggcgctatttctttcctggaatccctcgatagaagccgaatcaaggagaggagatacactaggaagtaccacctcgtgcgttacagggtcagtataattgcacgtacctatgaaaaggaggcacgctctttcgaatcccgattgtacgccctgtctgattgcgtcgggtcctatgattggtga

SEQ ID NO: 10767 - RNA, 1203 nt, unidentified
  source 1..1203: mol_type = other RNA; note = synthetic construct
atgattgacccacgatttccactgttcccggagaagacctcaaaacaagccatttcttctctggaaagtttagccgaagcactgtctgtgacagttaaggatctcgaggaagttcgctcccttgaaagcgacaagtgttataggttgaaggagatcccgaagaatggcggcggactcaggaaagtctatgacccccaccctctgattcgccgtctgcagtcaagaatcaacaaaaggatctttctcgacctgatacaatggcccggataccttttcggttccctgcccaatatcaatattgacggacagctcgtaagtcgcgattacattgcttgcgcacagaaacactgcaaagctaaatctctcttgaaggtagacgtaaataactttttcgacaacatacaccgagatcatgtcttcgacatctttcgcatgtttctgaagttttctgatgaggtgtccaattgcctcgctgacatatgctgttataacggtttccttgtgcaaggcgcgcttacgtcgagctacatagctacactctgtttttggcagaatgaagggtacgtggtgaaacggttatcccggaaaggtctgatctacacacgactggtcgatgatatcactgtgagctctaagcgccacgatttcaacttcgaatatgcagaacaccacattaaaatgatgttggtggacttggatctccctgccaataagcggaagcgtgaaatcctacgcgatggaatcgagccactgcaggtccatggcctaagggtgaactacgccagtcctaggctgccagccgatgaggtcagacgtatcagggccgccgtgaagaacgtggtccggatgtccaaaattaacaactaccggaccagcctatcatatcgagctatgcacgatcggtgtatggggcgggtaaataaattagcgagggtggggcataacaagcatggggacttcaagagagagcttgttgacgtgatccccctgcccagtgttagagacttagagaaggctgagagctccattagcttcctggagaaattggaccctgagcgcctcaaactgcggaagtacaccagaagataccatctggcaaagtacagagtgagcattgtggccaggacttattgccaggaggcagatgacctgtcgtttagactgcagaagttgtcagttttcgtcggcgattatgaactttga

SEQ ID NO: 10768 - RNA, 1197 nt, unidentified
  source 1..1197: mol_type = other RNA; note = synthetic construct
atgaatacaatgataagctctctctatccccagaaatcaagtacaagcagcattagtaacctggagaatttggcagaatcattgagcttggataaaaacctgctcgagtattctcagaaactgacacaggaagaacgatacaagaagattaaaatacccaagtccaataactcctacagaactgtgcatgatcctatcgacatcattcgtaagattcagaatagaatcaacacccgcatattcacccaacttgtggactggccagattatctctttggtagtattccaaatgacatcattgacagcagagattatatttcatgtgcccgtaaacattgtctggccaagtctatcttcaaacttgacatttccaacttctatgataacattcatcgcgacttcgtgtacgacatcttcaacaactttttcaaattcccgacggaggtgtccgattttctcaccgatatctgttgctacgacgattacctacctcagggggccttgacaagtagctacatcgcaaccctgtgcttttggaatgtcgaaggcgatctggttaagagattccaacgaaagaatctcgtttatactaggttggtagacgacatcacggtgtcttccaaaaaacacgattacgactttgagtacgtggagaagcacattaagaacatgctcctgcactttgacttcccagtgaataattctaagaccaaaatcatgcgggatggccttgaacctctaaacgttcacgggttacgcgtaaattatccagagccgagactgcccagtgctgaggtgaacaaaattagagctgctgtgcataatgtcgtcaaaatgtcgaagatcaataactacaggacttcaaagtcctaccggaacctttacgatagggcactgggaagggttaataagctggcgcgggtcggacacaataagcactctgaactgataaataagcttaagaaggtcacccctctgcccagcaaacgggacctgaactatatcaagaacaacatccggactctcaagaaccttaatgagctggactgcaaaaaactacgccagctcaaatataagcgcaaataccatctgatcaattataggatatccatcttgaaccgaacctttcccaacaaggcctcaacattaaggaacgagttaaaactgctgaaggataagattctcgacaagcagtga

SEQ ID NO: 10769 - RNA, 1107 nt, unidentified
  source 1..1107: mol_type = other RNA; note = synthetic construct
gtagcagagctcgaagcgatcagaggcattcctttgtctgaaaggtacagggagaagcctcttcaaaaaggccatggaaagatccgcttggtgtataacccctctttcaaaatccgtttaatccagaacctgatcaacacacgcctgtttaaagatctcatctggtggccagaatttctgtttgggtcgctgcctaattcactgcacgaagagcgactgatcgagagggactacatagcttgcgcttccgtccattgtggggctaaaagcatatataagatcgacatcagcgatttctttgactcgatacacaaagacttcgtgtatgagatattctccaagctcttctcatacccccacgaagtggccgaatacctgaccgatgtttgttgctatgaaaataagatcccccagggtggactgaccagcagttatattgctactgcatgcttctgggatcttgagggtgaggttgtgaaaaaactcagtaggaaggggttgaaatacaccaggctcgtcgacgatattacagtgagcactacggtttcaaactacgatttctcctacgtggaccgccatgtccgcgacatgctgattgctaaggacttgccagtgaacgagagtaagacactagccctgtattctggcatggcccccctgtttgtgcatggattacgggtcgattttaaacagcctcgcctgccagctaaggagatcgccaacgtcagagccagcgtgcacaatgtttgttcttgggctaaggtagacagctacagaacttccgtgacatatcgggccgcgtttgataggtgcttgggccgggtgaataagctggctagagtgggccacgaaaagcacgcagtatacgtggccaagcttcgtaaagtcgcaccgctaccctcccagtttgacattgatagtgccgaggcctcaatctctcgacttgaaaaaataagcaccgccaagctcgtgtctgtaaaatacaaacggcatttcgcactggtcaggtatcggattaccattattaagcggagattcccatccattgcggagaagttcaagttacgactcagagcccttgaggttcgcagaaatgcagcactgtga

SEQ ID NO: 10770 - RNA, 1278 nt, unidentified
  source 1..1278: mol_type = other RNA; note = synthetic construct
atgactgtgacaccatgttatagcgccttggactatgggggggtaggccacgacattaagctgccccggatggctgtggaaatgacagacctgaggcctgagaagatcactaaatcctcaatcggtagcattagcaaattgtcagttgtcttaagtatcccagagtctgacctgtcagcaattctcaagatactgccagaaaatcggtataagaagatcacaatacccaagggggtgggcggcgaaaggatcgtctatagtgccacacccctactcaggaaaattcagcacaggatcaatacgcggatcttcaaaaagctgattaagtggccgccttacctgtacggctctttgcctaatgataaagaactggttggaggtcagacgaagaccaccgtccagcgggactatatagcctgtgcccaaaaccattgcggggccaagtctattctgaaactcgatatcgccaatttctttgagaacattcatcgtgatacagtgaaaaagatctttcgcaaattcttccactatcccgagaatgtgtcggactatctgaccgaagtgtgctgttacggcgacaccctcgtgcagggcgctcttacctccagctacctggcttctttgtgcatgtgggatactgagtacaaagtgatacagaagcttagccgccgtaatctagtgtacaccagactggtcgacgatattacaatttcctctaagcacaggggatatgacttcagaaatgcagagtcacatgttagagccatgatgctcaaaaaggattttcctctgaacctgtccaaaaccaaaattatgcgagcgggatccagcccattgctggtccatggattgatagtaaactttcgcacccccaggctgccttcttcagagatcagccgcatcaaggctagtgtaaacaatctagtgaaggcaagtgccactgataactaccgaacaacttactcttttcgtgcacaatacttcaggtgcttaggtcgagtcaatagactggcgcgcgtgaaccacaacaagcacgaatacctcattaacaagcttaaaaagatccggccaaagccgtgtaaaaccgatatcgagagagttgagaacgctatcgaccggctcaagtccctcaaagataagacgactgactcgtaccgcaggatttacaacatcgcaagatatcggatcgggatagttagtcgaagctttgacagaaaatccatgattttactttccgaactgaaaaagcttgagaagcccgtgagcaaaatcgattga

SEQ ID NO: 10771 - RNA, 1230 nt, unidentified
  source 1..1230: mol_type = other RNA; note = synthetic construct
atgatccacacttatttttccggcgctgcaatgttgccgggtaaaggagttcagaaaattgcgaggcattcgattggcagcgtgagatcactctgccgcacgctgagcatagaggagtccgaactggacgaattactgacttggccagcagacgcaagatttaaaaagaagaagatcgagaagagctctggtgggcaccgtacggtgttcgttcctaattggaaatttagacgcatccagaggaagattaataagcgaatcctgggaaacaccaagataatccgctggcccaaatatatatttggctccgtgccctccagtagcgcggatgcagaagaggttgtcggacgtgattacatcgcttgtgccgctgtccacgcagggtcaaaaagtatcctgaaggttgacatcagtgatttctttgataacgtggaacacgacgtagtctccgatgtgttcgagaagttcctgaaatatcccccagaggtagttgaagctctctgtaacgtgtgttgccttaaaggccggcttccccaaggcgctccaacctcatcttacctagctaaccttgcattctgggacgtggaacacaggctcgtgcgtcgtttgcatcaaaaaggcttgagatacacacggtatgtcgatgatattaccatttcctctagaaaacacgcccaggactttagcctggccctgcgactggtagacggtatgctcattgataagaacctttcccgcaatgagaaaaaaactctcaccctgcggtctggaatcaacccattagtggtgcatggcctagccgtcgaacatagcgtcccccggatgcctgcccaggaatacaagcggattagggcgtctgtgcgggccttggaaaatttcgtgacagaccctggattcaggacttacaacgcttatagaaggatgtttaacacatgccaggggcgcgtcaataaactgtctcggctcaagcgcgttgcccacgccagttacgtgaataggctgaggaggattcgccctctgccttcgcaccgagacttagcctggtgcaagaaggtggccgagcgactccttgcacggttcaaggtaccgggggctaccgatgggtatttctttaagagagacttgttcagactacgcgagaggctgaatctgctgagaagaacatacctccatgaggccgccgagcttaagaatcggatctcacacatacgaatctttagccatgagtga

SEQ ID NO: 10772 - RNA, 1200 nt, unidentified
  source 1..1200: mol_type = other RNA; note = synthetic construct
atgtcgctcaagagccacgtcacgaaggtcagtcgacatagcattggatccgtgagaagcctgtgcaggaccctgagcatcgatgagccagaattacaagcacttttgtcctgggtgcctgagtcaaggtttaagaagaaggccgtgacaaagtcatcaggtggaagtcgtacagtgtacgtgccgcattggcgttaccgcaagatcctgcggaagatcaacaaaagaatcctgggaaataccaaaatcatacggtggcccgactacgtttttggctctgtccccagttccgatgctgatgacgcgcggctgattggcagagactacatcgcatgtgccgccgtccacagctcttccaagagcatactcaaagttgatatttgcgacttctttgacaatgtagaacagccactggtccgcaacatctatactgacttcctcaaatatcccccagctgtggccgaaacactttgtaatctgtgctgtatacatggcaaaatacctcaaggggctcctacatcatcttatcttgctaacctggtgttctgggatctggaggctaatctggtggccaggctaaagcagaaaggcctcacctacacccgctacgttgatgacatcacaatttcgagtcgtaaatacagccaggacttttcactcgcactgaaactggttgaccagatgctgatggataaagacctcacccggtctgaggtgaaaactcaggtactcaggtctgggaccaaacccctgctcgtacactccctgagagtggaacacgccactcctagaattccaagtccagaatatagaaggatcagatccgccgtgcgcacgctggagaattttgcagcagatgccgggttccggacttatgatgcctaccggcgaatgtttaacgtctgtttgggtcgggtcaacaagcttagcaggttgcgcaagaagtcccatactgcttacatcacccgcctcaatcgagtggggccgctaccttctcatagggatttacgatggtgccaaaggaccgcgagggaggtgcttaagagattcgcgattcccggcgagtctgagcgctttttcttccggaggaaacttttccgcttacgtgaacggctgaacctattgcagagaacatatgttcacgaagcatccgccatccgagacagcttggctcagattaagatttattcacacgagtga

SEQ ID NO: 10773 - RNA, 1167 nt, unidentified
  source 1..1167: mol_type = other RNA; note = synthetic construct
atgactaaactcatcgaggatttcaccaagcgagttgctgggtcaatctcttcgattccaacactggctaatgccctcgatatcaatcttagcgaaatagagaacttgctgaataccccagccgatcagaggtacaaggaaaaattcatcgaaaagaagcatggcggtgtccggaaagtttacaaccccagcgccctggtccggaaaatccaacagagaattattaatcgcatcttcaagccactggtagactggcctttttttgtgtacggatcaatccctaagagcaacggccagccggcaaaagactatgttgcggcagccaatgtccacgctggcgctggatctctgcttaagatggatattaaggacttctttgacaatatccaacgcgaggtggtctttgacgtgtttttcgacttctttaagtacccgtatcccgtgagtgagattctaacagacatctgttgtcgcgatgataggctgtgtcaaggcgcgttgacgagttcatacctcgccgcattatgcatttttgacgtggaggcaaagatggttaaaagaattgagaagaaaggggtcacttatactagatatgtcgatgatatcaccatcagttccaagaacaggtcctacgatttttcctacgtggagaaggttgtggaggaggtgctgatgagcaaagacctgcccgtaaataaaggcaagacctcagttataaacctgactagtaagcctctcctggtgcacggtttacgggtgaacaccagcaatgccagactgcccattgcagaagtaaaacgaataagggccgctgtgcagcaccttgaagtggcctccagggagcccaactatatcacactgccaacctatcgtgaagaattcaacaaatgcatgggacgcgtcaataaactcgctcgcgtagggcatattcagcattccgctctggtgaatagacttaagagaattcggcctaagtctacgcgctctgacctatacgtggccattcagatgttgaaaatcatacggcgtacatctcagcaacggagacagcactatttcttcaaaaaacagtgcgcccaggccaagactctcttgacattgatcaagaagaacaacaaatacagccgaagggcagcgatactcctgaactacttaaggaagatctga

SEQ ID NO: 10774 - RNA, 1188 nt, unidentified
  source 1..1188: mol_type = other RNA; note = synthetic construct
atgctaacagaccttcccatcaaccgcagttcatcaggaataagcactcttatttccctgagcaagacgcttggatttagcctcgaggagttggaagacatccgaaatatccctctcgataaacgttacttcaaactcgagaaaccaaagatcgatggcactaagagagttgtctaccgggtgcatcacaaactcaaaaggctgcaaagacgaattaattcacgcattttccgggagctcgtgatctggcctgagtttctgttcgggtccatccctaatgacaatgatgaagtgtcgctgaaacgggattatatttcctgcgctagtagacattgttcagcaaagagcatactgaagatcgacataaagaactttttcgacaatatccacagagacttagtctctgacatattctctgacttcttcagaattaagagcgaagctaacgagtacatcgtcgacatttgctgtttagaaaacttcatcgtgcagggcgcgctgactagtagttatatcgcctctttatgcctgcatgatcttgaaaccaatgtgtaccgcagggccaagcgcaaaggacttatctatacgaggctggttgacgatattacagtgtccaccaaggtaaacgatttcgactttacccagataaagaaacacatcgagacaatgctcgccgagaaggatttgcctattaactatgagaaatccggtgtttttcagattagcacaaaaccactgctggtgcacggcctgcgtgtcgactattccaaaccgaggctgcccagcgatgaggtaaagaagatccgcgcatcactgcataatctcattgggaatgcagtaaagaacaataataagaccactatcgcttatcggacagagtataatcgctgtatgggcagaatttccaaactggggaggctaggccacgaaaaacacaaggttttcatgggaaagattaaatgtatcagacccatgccatcctacctcgatgtgaaaaattgcaagaaaaagctgaaggggttggaatctctatactcgaggggttttaaccgttctaacaaatactctcgggaatttaacgtggtcagccattacatcaccttgatcaagaggagtaactcttttatgaagattgccaacgagtttcgggagcgattgaacaagataaagcccaacgtggaaaaatga

SEQ ID NO: 10775 - RNA, 1191 nt, unidentified
  source 1..1191: mol_type = other RNA; note = synthetic construct
atgtccaatgacctccccagtaacaagtctaacagcggaatttctacactcacgagcctctctaaagcattggggtttagtatcgacgagttagtggaaattagatctattcctcttgataggcgctaccataagctggaaaaacccaaaagtgatggaagcatgcgcatcgtgtatcgcccacaccacaagctgaagcgcttgcagagacgtatcaataacagaatttttcgggagctggttatctggcccaattttctgtttggcagcgtgccaaacgacaatgatggggaggattctctgaatcgggactacatcacttgcgccaatcagcattgtggggccaaaaccctactgaaggtagacataaagaacttcttcgacaatattcacaaggagctggtcagtgacatcttctccgatttcttctatatcaacgccgaggccaacgattacataaccgatatatgttgcgctggcgaattcatcgtgcaaggcgccttaacgtcctcctacattgcttcgctgtgcttgcacgatgtcgaaactaccgtctatcgcagagctaagaggaagggccttgtttatactaggctggtggatgatatcacagtatcgagcaaggtttatgactacgacttctcacagattaagaaacatatagaggatatgctagcagagaaagaccttccgataaacatcgttaaaagcggcgtgtttcaggtttctaccaagcctttgttagtccacgggctgcgcgtcgatcataataagcccaggctcccttcatacgaggtgcggaaaatccgggcgtcactgaacaatcttatcggtaactccatcaaaaacaataacaagacatccctggcctatagagtggagtacaaccgatgtatgggaagaataaataagctcgggcgactgggccacgaaaaacatgctgtgttcatgggtcgtattaaaaaggtaaggccaatgccaagtttccaggacgtgcgtgaatgcaagaagaaaattaaatggcttgagattcagtacagcaaaggatttaacaagagcgacaagtattttcgggtctttcaaatcactggtcacgtcatttccctcatcaatcggtcagacgcgttctcaaccattgcaaaggaactcaggacacgactgaataaggtgaaacctgacgtggaaaaatga

SEQ ID NO: 10776 - RNA, 1191 nt, unidentified
  source 1..1191: mol_type = other RNA; note = synthetic construct
atgccaagcgatattccaatcaataaatccaactccggtattagcacactcaacgccttgtctaagacattggggttctcactactggaactcgacgagattaggaatatcccgttggataagcgatatgtgaaactggaaaagccaaaggccgacggaagtgtgcgggtagtttaccggccccatcacaaacttaaaaggctgcagcgcaggataaattctcgcatctttcgcgagctcgtggtgtggcctgattttttattcggctcagtgcctaatgacaatgatgaggagcagtcattaaagagagactatatcacttgtgctgggcaacactgctccgcaaagagcatcctgaaaatcgacataaggaattttttcgacaacattcaccgcgacctagtttctaacattttcaacgatttcctgtgcattaagtcggaggccaatgagtatatagtggatatctgttgcgcgggcgacttcatcgtgcagggagctctgacatcgtcatatattgcaagtctgtgtctgcatgatgtcgaaaccaaagtgtgccggagagcccgtcggaaaggtcttacttacacccgtctcgtcgacgacatcaccgtgtcttccaaggtctatgatttcgacttcagtcaaatccgaaaacacattgaggatatgctggccgaaaaagacctccccattaattccgataaatcaggggttcaccagatcagtaccaagcccctccttgttcatggcctgagaatagatcacagcaaaccaaggctgcctagcgacgaggtcaaaagaattcgagcttctcttcataacctcatcaataactctagcaagaacaataacaagacgtccctagcataccgggtggagtacaataggtgtatgggcaggataaacaagttgggacgactgggtcacgaaaagcacactgtctttatgggcaagatcagaaaagtgcgccctatgccgagctatcgggacgtacgcgaatgcaagaagaaattaaagagagtcgagtacctttactcaaagggactcaacaagagcgagaagtactttcggaactttcagctggttgggcataacatctccttgattaatagatccagcagtttttctgtcctggctaaggaattccgtgtaaggctgaacaaggtgaaacccgatgtggaaaaatga

SEQ ID NO: 10777 - RNA, 1191 nt, unidentified
  source 1..1191: mol_type = other RNA; note = synthetic construct
atgagtagcgaactgcccattaaaaaaagcaattcagggatcagtaccttagattctctatcaaaaaccctgggatttagcttggaagagctcgaagagatccggtccattcccttggagaaacggtattttaaactggagaagccaaagacagacggtacaatgcggacagtttacagaccgcaccataagctgaagcgattgcaaagacgcataaataaacgcatctttagagaactggttatttggccagattttctcttcggcagcgtccccaatgacaacgacgatgaagacagtatcaaaagagactacatcacttgtgccagccttcactgcagcgcgaaatccatcctcaagattgacattaagaacttcttcgacaacattcacaaggaccttgtaggtgatattttcgaagggtttctgtgcataaagtcagaggctaaagagtacatgattgatgtgtgttgcgccggagaattcatcgtgcagggcgccctgacctcctcttacattgcttccctgtgtctgtatgacgttgagactcaagtctacaggcgcgcaaagcgcaagggcctgacatacactaggctcgtggatgatatcactgtgtcctcaaagatctatgatttcgacttcacgcagattaggaagcatatagaggacatgctggcagaaaaggacctgccaatcaatttcgacaagtctggggtgtttcagatttctaccaagcctctcttggtgcacggtcttcgaatagatcataataagcctagactgccatctaatgaggtgcggcgaattcgtgctagcctacataacctcatcaacaacgccacgaaaaacaattcgaaaaccagcctcccgtatcgcatcgaatataacagatgtatgggacgcataaataagttaggccggctagggcacgaaaaacacgccgtctttatggagaagatcaaaagggtcagacctatgccttccttctccgatgtaaaggagtgcaaaaagaaacttaagaagttggaggagctccacgcaaaaggatttaataaaagtgagcgttaccttaggaactttcagttagtgggccattccatctcgctgatcaaacggtctgattcattcagtatcctggctaaggagctgcgtatgaggctgaacaggataaagcccaacgtcgaaaagtga

SEQ ID NO: 10778 - RNA, 1191 nt, unidentified
  source 1..1191: mol_type = other RNA; note = synthetic construct
atgagccccgatctgccgaccaaaaagagttcctcagggtttagtaccctgacttccctgagtaaaactctgggcttttccctggaggagctgaatgagattcgtgacatctcaatcgataaaaggtatgtgaagttagagaaaccaaagacagacgggtccatgcgaatcgtctatcggccccatcacaagctaaaaaggctgcagagacgcattaacaagaggatcttccgtgaacttatcgtgtggccaagctttctgttcggaagcgttcctaatgacaacgatgaggaggacgctctcaagagggattatattacgtgtgcttcacagcattgttcggcaaagtctatcctcaaaatcgacattaagaacttctttgacaacatacatcgagacttggttggagacatcttcgagaatttcctgtgtattaaatcagaagccaaggaatatatggtagatgtttgctgcgcaggcgactttatagtgcaaggcgctctgacaagctcttatattgcctccttatgcttgtacgatgtggagactacagtgtatagaagggctaagcggaaagggctcacctacacaagattggtcgacgatatcactgtttctagcaaagtgtacgattttgatttcacgcagataaggaaacatattgaagacatgctggccggaaaagatcttcctcttaaccacgacaagagcggtgtctttaagattagtactaagcccttactagtgcacggtttgagaatagaccatgataagccacgcatcccttccgacgaagtgaaacgtattcgcgcctctctgtacaacctgacatccaactcgaaaaagaataataacaagacctcagcggcataccgagtagaatacaatagatgcatgggacggatcaacaagctcggccgactcaaacacgagaagcacgtcattttcatggagaaaataaaacgcatccgcccaatgcccagttttcgggatgtaaaggagtgtaaaaaacggatcttgtggcttgaaaagctgtatagcaagggcctcaacaagaccgagcggtacttccgcgtgtaccaggtgaccgggcacaacatttctctcatcaataggagcgcctccttctctgacatcgccaaggaacaccggttcagacttaataaggtcaagcctaatgtggaaagatga

SEQ ID NO: 10779 - RNA, 1194 nt, unidentified
  source 1..1194: mol_type = other RNA; note = synthetic construct
atgcttagtgaccttcccaggaataaatctatttctggaatttccaccctcctgagtctggccagagctctgggtctgcctcgcgaatacctcgaggaaattaaaaatatgcctctggagacaagatatagcaagttggagaaaccaaagatcgacggcagcatgagagtggtgtataggccacaccacaagctgaaaaagctccagcggcgaatcaataaccgtatattccgggaactgatcatctggccagaattcctttttgggagtatccctaatgacaacgactcagacgatgacgccctaaaaagggactacatcacctgtgctggccagcattgctccgcgaaaagcatcctgaagatggatatcaagaacttcttcgacaatatacaccgagatctggttgatgatatttttgagaactttctccacatctcactggaggcaaaagaatacttagtcgacttctgctgtagcggcgattttatcgtccaaggcgctcttacttcctcctacattgcctccttatgcctctacgatatagagactaaagtctaccgtagagcaaagagaaaggggttggtgtatactagatttgtggatgacataaccgtttcctcagagatctataacttcgacttttcacagattcgaaaacatatcgaggacatgcttgccgacaaggacctccctattaatctggagaagacaggtgtctatcaggtatctacaaagcccttgctggtgcatggactaaggattgatcattctacaccccggctgccaagttatgaagtccggaacattcgcgcatccctacacaatctcatgaagaattcgacgaagaacaacaataaaaccagtttggcctatagggttgagtacaaccgctgcatggggaagattaataaactgggacgcttagggcacgagaagcacgacgtgttcatgaaaaaaatcaagaagattcgccccatgccctcttacaaggatgtgaaacattgtaaggagatgctgaaaaagcttgaagatctctacgaaaagggctttaacaaaagcaacaagtattaccgtgaataccaaatagtaggacacaacatcagcctgatcaaaaggtctaattcattcttggtggtgagcgaagatctgcggaagcggcataacaagattaaaccgaatttcgagaagtga

SEQ ID NO: 10780 - RNA, 1188 nt, unidentified
  source 1..1188: mol_type = other RNA; note = synthetic construct
atgagctcagataggccaataaaaacaactgccagtgccattcctagcctgaagaaactgagccagaccctggggttcagtatcgaagagcttgaagagattcgggccatccccctggagaaaaggtatgttaagctggaaaaacccaagattgacggcaccatgaggaccgtgtacaggccacatttcaagctgaagcgcttgcagcggcgtattaactctcggatttttagacctttggtcatctggcccgtttacctgtatggctctgttccatgtgacaatgacgatgaatcaatcaaacgcgactacatcacgtgcgcaagtcagcattgcgccgcaaagacaatcctcaagattgacatcaaaaacttcttcgataacatccaccaggacatcgtccgcgatgtgtttgacaaagtgctcaatattaaggacgatgctttagactacattgtggacgtatgttgtgcaggagactttattgtgcaaggggcgctgacatcctcctacattgcttctctttgtctacatgatgtggaggctgatatttacgctcgcgctaagagaaagaaactcgtgtacactaggctggttgatgacatcaccgtgtcctcaaagatccacgatttcgacttttcccaaatccgcaaacacatcgaagacatgctagccaaaaaagacctgcccataaatgtggaaaagtctggcgtctttatcacaagtacgaagccgcttgtcgtgcatggactgagaatcgaccactctaaacctaggttaccttcagatgaggtcaagaagataagagcgtcattgcacaatcttatcgccaacgcatcgaagaacaacaataaaacttccttggcctatcgaatcgagttcaatagatgcatgggcaggataaacaaacttggtcgggtcggtcacgagaagcacctggtgttcatgagcaagataaaattgatacgaccgatgccatcctataaggatattgtagattgcaagggaaaactagtaaaactcgagaagctgcatgccaaagggtataataccagcgatatctactttcggagatatcagctggtcagtcacctgttaagcctcattaatcgctctagctccttccatgaggttgtgaaggatctcagaaagcgtctcaaccgaattaagcccaacgtgcagcggtga

SEQ ID NO: 10781 - RNA, 1188 nt, unidentified
  source 1..1188: mol_type = other RNA; note = synthetic construct
atgcccagtgatatagctatcaataagtctgactcaggcatttcaacactgcagtcgttggccaagacgctgggtttttccctgcaggagctgcaggagatccaatccattcctctcgacaaacgctatcagaagctggaaaagcccaaagtggacgggaccaaaaggatcgtttacaaacctcatcacaaacttaagcgcctgcagagaagaatcaattcccgtatctttcgggagttggtggtatggccagatttcctctacggaagcattcctggcgataatgacgaagatgacctaataaagagagactacgtcaattgcgccagccagcattgtgctgcaaaaagtatactgaaggtggacataaagaacttctttgacaatatccacaaggacctcgtgcggtctatttttgagaatttcctccacattaacagtgatgctctcgattatcttgtggatgtgtgttgcatgggggatttcattgttcaaggagcacttacctcatcttatatagcctccttgtgtctatacgatgtggagactaaagttgtgcgacgagcccggagaaagaagctagtttacactaggttggtggatgatatcacagttagctccaaaatctacgacttcgacttcagccagatcaagaagcatattgaagatatgctggcggacaaggacttaccactgaatcaggagaagaccggtgtcttccaaaccagcacaaagcccctgacggtccacggccttagggtggaccacagtaaaccccgcctcccttcggacgaagtaaaaaaaatcaggagctctttacacaaccttgtcatcaacagcaaaaaaaacaacaacaagactacagctgcgtaccgtgtggagtataatcggtgcatgggcaaaattaataagctcgggagagtaggccacgagaaacacgagcaatttatgttgaaaatcaagtccatccgcccaatgccgagcaagcgagatatcatagaatgcaacaagaagattaccactctggagaaactgttcaaggccggactgtcctctcatgaaagttacaaacgcaagttttatctggtgtcacatcagatttcaatcgtcaaaaggtctaatgcatataagaacattgccgacgaactgcgggagaggttatccaaggtcaaaattaacgaaaactga

SEQ ID NO: 10782 - RNA, 1191 nt, unidentified
  source 1..1191: mol_type = other RNA; note = synthetic construct
atgaccacggacgtgcccattaaaaaatcgtcaagcggtatcagcagtctggagagcttgtccaagacattagggatttctttgctcgagttgagcgagatacgcggcatccctactaataaacggtatgagaaaattctggtgcccaaagctgacggatctcaacgcatagtctataagccacattacaagatcaagaaaatccagcgtagaattaacagcaggatttttagggaattggtcatctggccagatttcttatttggatccattccaaacgataacgacactgaggaatctattaaacgggactatgtttcctgttcaagcctgcactgcggcgctaagtctatcctgaagattgatatcaagaacttcttcgacaacattcacaaggatctggtgagtgacatcttttgcaactttttctgtatcaagggcgacgccttaaactttctggtcgatatttgcgtaaaagacgactttattgtacagggagcactgacctcctcttacatagcctctctttgtcttcacgacgtggagagtaaaatcgtgcgaagagcacgcaggaagaatctggtttacacacggctcgtcgatgacatagttatcagctccaaggtcttcgattttgacttcagtcagatccgaaagcatgtggaggacatgctcgcagacaaagatctgcccctcaaccatgaaaaatccggcatcttctacaattcgactaagccactcacagttcatgggctgcgagtggaccatcacaaacctagactgccgagtgatgaggtgaagagaatcagggcctctgtgcacaatctagttaccctatcccggaaaaacaatgcgaggacgagtctcgctttccggaaagaatacaaccgttgtatgggtcgcataaataagcttaccagagtaaagcacgagaaggacaaggtcttcaagaaaatggtggaattcatttaccctatgccttcatacggcgatatcatatcatgcaaaaaggatatcagctcacttgaaacctcatttaaaaatgggttcaacaagacagaatggtattaccgtaagtataatctcgtgtcctataagatctccatcattaaaaggtctagcgcctttattaatctggccgatgaactgcgcgatcggataaagaaggtgaaacccaatgaggatagatga

SEQ ID NO: 10783 - RNA, 1188 nt, unidentified
  source 1..1188: mol_type = other RNA; note = synthetic construct
atgtcatcggaccttcccaaaaatacttcctccaaggggattagcagcctgagtctgctttcaaaaaccttaggaatagctgtggaagaactgcgagagattagagctatccccctggacaaaagatacgagaagattctcgttccaaaatccgacgggacaaaccgtatcgtatacaagccacattacaagatcaagaaggtccaaagaaaaatcaattctcggatcttccgcaagctcgttgtctggccagattttttgtttgggagcgtgcctaatgacaatgatgacgaggactccatcaaaagggactatgtgacctgtgcctcactccattgcggtgcaaaatcaattctgaagattgatatccggaacttctttgataacatacacagggagctagtttccgatattttcagcaccttttttaagtgcaagtctacggccttggactatctcgtcgacttttgcacaaagggcgatttcattgtgcagggcgctcttacttcttcatatattgcctcgctgtgtctgtatgataaggagacgcacgtggtccgtagggcaaggcgaaagggcctgacatacacccgcctggttgacgatataacaatctctagcaccgtgtttgatttcgacttcaaccagattcggaaacatgtggaggacatgctggcagataaggatttacccttgaattacgagaaatctggagtgttccataacagtactacaccactcatggtgcacggtctgcggatagatcatttgactccgcgactcccctctgacgaagttaaaagaattagggcttccctaaacaacctgattaatctgagcgagaagaacaactctcgtaccagtcttgcattcagaaaagaatacaatcgctgtttaggaagagtgaacaagcttggccgcgtggggcacgaaaagcaccctatctttctgaagaagatcaaggtcatctaccctatgccttcatataaggatgtcatctcctgcaaaaaagccattgcgagtctcgaaaccagttacgtaaatggctttagcgacaaagactggtattcccgcaagttcaatctggcgagccacaaaataagcatcatcaatcggagtctcgccttccagttgatcgccaaacagctacgggtaaggctgaacaaagtgaagccggacgaagagtga

SEQ ID NO: 10784 - RNA, 1221 nt, unidentified
  source 1..1221: mol_type = other RNA; note = synthetic construct
atgggccggccctatgtcaccctcttcggcgaaattatggacaagttcaagccatattctaagtccaaagctcctatctcaacactccaaaagttggcccaaactctgtctattagcatcgatgaacttaacgaaattagtgcattaccagaggatgaaaagtacgagcggaaggagctgcctaaagccgatgggtctaaaagagtcgtttacagcctgcatccaaagatgcgcttactgcagagcaggattaacaagcggattttcaaagagctggtcatcttcccgccttttctatttggctccgtgcctggcaagaatgacggcgccaatagtaatattaagcgcgattatgtctcctgcgccaaagcccattgcggtgccaaaaccgttcttaaagttgacataagcaacttcttcgataatatacacaaggaccttgtgagagacgtgtttaataatgtcttgaacatcagggacgaagcgttggaatatgtgacaaacctatgttgtaaaggggacttcgtggtccagggcgccctgacatcatcttacattgccacactgtgtctctacgagcaggagggaaacgtttaccagcgggcaatccgaaagaacctggtctacactaggctcgtagatgacatcacggtgtcctcaaaaatcaatggttacgatttcacccagatcctgagccatatcgagaatatgttgtcaactcacgaccttccagtgaacaaacgcaagacaaaaatattccactgtagtagtgagcccattaaaatacacgggctcagggtggattacaactctccccgactcccttcagatgaggtaaaaaggatccgggctagcctccataacctgaagaaattagcggtgaagaacaatactaagacgtccatggcttatagaaaagagtttaaccgttgcatgggacgcatcaataaactggggagagtaggacacgacaaatacgagctgtttaaggaacagttgctggcaattaagccgatgccatccccccgagatatcactatagttgaatcggctgtgacctccctggaaatcagctgctctaaaggaaatgggaataagcactggtataagcgtaagtataaccttaccctgtacaagctgatcattctcacccgcagtaaggcatttgacggtattgtggacacctttaaggagagactaaagaaggtgaaacccgcttga

SEQ ID NO: 10785 - RNA, 1185 nt, unidentified
  source 1..1185: mol_type = other RNA; note = synthetic construct
atggacaagtttaagccctttagtaagtctaacgctcccatttctacattactaaaacttagccagaccttgtccatctctgttgacgagctgcgcgagatagaagcattaccagatgacgagaaatatacacgcaaagacctcccaaaggcagatggatcaaatcgggtcgtgtacagcctgcatcccaagatgcgtctggtccagtcaagaattaacaagcgcatattcaaggagctgctggtttttcctcctttcctgttcgggagtgttccatccaaaaatgatggtgtggattccaatgtcaagagagactacgtgtcgtgcgccaaagcgcactgtggggctaagacggtactgaaagtggacatcagtaacttcttcgataatatccacaaggacctagtgcgagacgtgtttagcaatgtgatcaacattcaagacgaagcccttgattatgtaaccaagatctgctgtaaaggcgacttcgtagtgcagggcgcactgacttcatcgtatatagccaccctctgcctttacgaacaggaaggagttatttaccaaagggcattacggaagaatctggtgtacactaggctggtagatgacataacggtgagctcaaagattaacaactacgactttacccagattcttggccacattgaggatatgctggccgagcacgacctgcccatcaacaaaagaaaaaccaaaatcctccactgtagctccgaaccaatcaaaattcacgggctgcgggtcgattataagtctccgagacttccgtcagatgaggtcaagaggatccgcgcctccctgcataacctcaaaaagctcgccgtgaagaataacaccaagacaagcgtggcttatcgtaaggaattcaaccgatgcatgggtcggatcaataagttgggccgggtgggccatgaaaaatacaaagtcttcaaggagcagttgctggagatcaagcctatgccctccctgcgcgatagtaaaataattgatgccgcgatcaatagcctggagttgtcctattctaaaggaaactctaataagcattggtacaaaaggaagcatgacctcacactctataagcttatcattctcacaagaagccagagttttgacaagactgtttctttgtttcgagctaggctaaaaaaagtctcccctacttga

SEQ ID NO: 10786 - RNA, 1185 nt, unidentified
  source 1..1185: mol_type = other RNA; note = synthetic construct
atggacaagtttaaaccttacagcaaatctaatgcgcccattacaaccctcgagaagttgtctaaagccctcagtatcagcgtggaggaacttaaagctatcgcagaattaagcctggatgaaaagtacacactcaaagagatccctaaaatcgatgggtcgaaacggattgtatactcactgcatccaaagatgagactgttgcagtcccgaattaataaacggattttcaaggagttggtcgttttcccaagcttcctgttcggatcagtgcctagtaaaaacgacgtgcttaactctaatgtcaaaagggattacgtgtcctgtgccaaggctcactgtggagcgaagacggtactgaaagtagacatcagcaacttctttgacaacattcaccgtgatctcgtgaggagtgtgttcgaggaaatcctgcatatcaaggacgaagcccttgagtatctagtggacatctgtaccaaggatgacttcgttgtgcagggggctctgacttctagctatatagcaacactctgcttatttgccgtcgagggcgacgtcgttagacgcgctcagcgtaagggcctggtgtacacacgcctggtagatgatataactgtcagctccaagatctcaaactacgattttagccaaatgcagtcgcacatagagcggatgctgtccgaacatgacctgcccatcaataagcataagaccaaaattttccactgcagttcagagcccatcaaagtgcacggcttgagggtggattatgattcccctcgcctaccgtcagatgaggttaagagaattcgcgcatccatccacaatttgaaactgctggctgccaagaacaacactaaaacgagtgtggcctatcgaaaggaattcaataggtgcatgggtcgggtcaataagcttggaagagtggggcatgaaaaatacgagtcctttaagaaacagctgcaagccatcaagccaatgcccagtaagagggacgttgccgtcattgacgcagctataaagtctctcgaactttcatattccaagggtaatcagaacaaacactggtataaacgaaagtacgacctaacccgctataaaatgattattctgaccagatccgaaagctttaaggagaagctggagtgctttaagtctcggttagcatctctcaagcccctctga

SEQ ID NO: 10787 - RNA, 1194 nt, unidentified
  source 1..1194: mol_type = other RNA; note = synthetic construct
atgttcaaaccctccttgaagaacacaaatcagggctacatcagtagtttagagtcactcagccggaccctgagcataccgatcgacaaactgattgaaatatccaatatccctgtggatgataagtaccttttgaaagaaattcccaaggcagatggttctactaggcatgtatataagttgcacccagacctcagactcctgcagtccaggattaattcccgaattttcagagagctgatcgtgtggcccgactttctcttcggctcgattccaaatgataatgacccttcttctgaagacgtgaagagagattatatcagctgtgccggccttcattgccaagccaaaacgattctgaaggttgatatcaaggactttttcgataacatccacgaagacctagtgaaagacattttttctaacgtccttaacatcaaagacaaatccctcgaatacctaacacaggcctgttgccggaatggatttatcgtgcagggcgcactgacaagctcttacatagcatccctttgtctcttcgacatggaagggaagatcgtgagtcgagcgcggaagaagaatctagtatacaccaggttagtggatgacatcactgtgagctccaaaatcagcaattatgacttctcacagattcgtcagcatattgagtcgatgctggccgaaaaggatcttcccatcaacaacaaaaagaccaaggtgttttatagctccacccaaccactgtacgtgcacgggctgatagtcgattattcaaaaccacgactgccgtcagatgaagttagaaagataagggcttctctgaacaatattagcaagctggccgtgaaaaacaatagtcgtaccagtgttgcgtacaggaaggagtataataggtgcttcgggaagattggcaagctgaaaagagtcggacacaacaagtacgaggtctttctgggaaagatcaaaaagataaagcccatgccttctttacgggacgtcaagatggcaaaagccacagtaaaaagcctggaggtttcacacgctaaaggtaacaacaacaaatactggttcaagcgcaagtacgatctcgctcgctataagatcgtgattttgaaccgcactaaagagttcgagttgctggtcgctgagctccgggagcgcatgaaaaatgttaaacctaactttgagcgctga

SEQ ID NO: 10788 - RNA, 1215 nt, unidentified
  source 1..1215: mol_type = other RNA; note = synthetic construct
atgctgaataatgagaattattgtccccacaccccatacagcatcgccaaaaagcggatcacgtctctgaaaatactgagcgacactctttccattagcgagagtgaactcattcggatcaatagcttgtccgaccatgaaaagtacaccgagcttaaagtgcccaagattgatggcaccgacaggatcgtctactccttaaactcagacctgagaaaggtgcagtatcgaatcaacaaacgcatatttcgtgagctcattaaatggccgaatcatctatttgggtcggtgcccagtaacaacgactccaataaggaccaaattaagcgggattacgtcgcatgcgcatcgttacattgcggcgcgaagagtattctgaagatcgacatcaacaacttcttcgataatatccacaaggatattgtgaccgacatcttctcaaacgtcttgaagattgaaggatacgccctagaaattataacagacctgtgttgtaaaggaaacttcatcgtccagggtgctctaacctcaagttacatcgctagcctgtgtctccatgacttagaggccgatattatcaaacgtgcagagagaaaaaatctggtttatactcgcctggtggatgatatcaccgtgtccagcaaactttccaatttcgatttctcccagattaaaagccacatagaaaacatgctggccaataaggatctgcctgtgaataaaaacaagtccaagattctcaaggaatcaatacagcccctcgtagtacacggactccgagttgactttgagcagcctcgcatacctagtgacgaggtgaaaaagattagagcttctcttcataacctctgcaatttggcgaaaaagaataacatgaggacgtcctctacatataggaaagaatataatcggtgcctgggccgaatcaatcgcctcgggagactgaatcacaacaagcactctagctttataaagatcatcgagaagatcaaaccactgccttcatggcgcgatgtccaaaaaacaaaggccgcccttaactcattgaaggctagctattctaaggggaacaacaacaagtcttggtatatcaggaaataccacttgacttactacagaacatctattctgaacaggagtactgagtttcacgatatggttatttacctgcgggaaaagctgaaaaagatcaagccaaaagacaaaaggggttga

SEQ ID NO: 10789 - RNA, 1188 nt, unidentified
  source 1..1188: mol_type = other RNA; note = synthetic construct
atgacgagcaataagccaataagcaagagtaaaaagccaatcctaaacttggacgtcttgagcgcaaccttgtcaatagataaggtggaactcttaagagtggactcacttccgtctgatgagaagtataaacaaatcactctggccaaaatcgacggctctaagcgaatcgtctacagtctcagcgccgatctgaggaaaatacagtcaagaatcaataagcgcatctttcgtgagctaataatttggcctgattacctgtttggttccgtccccaacgaaaatgataatgacgactctattagaagagactacgtggcttgcgcagagcttcattgtggggcaaagtccattctgaaggttgacatcaaagattttttcgaccatattcacagggatctcgtcaagcagatcttcgagaacgttctgaatatccacaacgatgccttggaactgatcacaaacctctgctgtaaagatgacttcattgtccagggcgccctgactagctcctatattgcaaccttgtgtcttttcgaccaagaacatgagattgttaccaggacgaggcgcaatggactggtgtataccaggttggtggatgacattactgtaagcagtaaactgagtaactttgactttagtcacatccagatgcatatagacaatatgttagcttccaaagatcttcctatcaacaagtctaaatccaaagttaccaaagtgtctatggaaccactgaccgtgcacgggctgcgggtggattttatcagccccagagtcccatccgacgaggtgaaacggatccgggcctccttacataacctgaatatgcttgtgaagaaatctaacagccggactagtgccgcttaccgaaaggagtacaaccggtgccttggacgcatcaatcggctcggcagactggggcacaataagtaccccattttcctggagtcgatcaagaaaattattcccctcccgtcttggcgtgatgtgctcaaaacaaaggcggctctgaaaagcctggagtcatcgtactcaaagggtaacaagaataagtcatggtacattcgtaagtatgacctgacatatcaccgaacagcgatactcaaccgctcccctgtattcaataagctagtaatctatatccgcaacaaactcaacggaattaagcctgacgaaaggtga

SEQ ID NO: 10790 - RNA, 1185 nt, unidentified
  source 1..1185: mol_type = other RNA; note = synthetic construct
atgagcattgatatccccacccgcaagcagaatatcaaaagtctgcgatccatgcactcactttcaagttgcctggatatttctttgggcgacctgaacgaggcacgggctctgacgagcgaattaagatacaagaagaaggaggtgaagaagatcaatggagacaccagagacgtgtatgatcctcatcaactaatcaggagaatccaaaagaggatcaacaatcggatctttaagcccctcataatctggcccaattatatttatggcagtgtgccatcaaacaaagaagagaagaaactgggtatcgaacgccactacatagcttgcgcgaagcagcactgcaaagctaaaacaatcctgaaagtggacattaaaagcttcttcgataacatccataaggatattgtgcgcgatatttttaaccgcgtcttcaagttcaagggcgatgcgctggagtaccttactgatatttgttgctacgagcataggatcgttcagggcgcattaacttcatcgtatattgcatcattgtgtctgttcgaccttgaagcagacgtcgttaatagaacccggagaaaacaactcacttatactaggctcgtcgatgacatcacagtatcctccccactggtcaatttcgatatgtcccagatattggaacacattaaaaacatgctggcccagaaggacctgcctgtgaacgagtctaaaacccaggtgtataacatctccacggagtctctcaaagtgcatggtttacggatctccttcaatgagccacgcctgccttctgatgaagtagggaggatacgtgctagcgtgcacaatctcgaggggctagccaaaaaaaataattctttgaccagcgtcgcctacagggtagaatttaacagatgtgttgggcgagttaacaagctgggacgtgtgaagcacaagaagtacaagacactcagcgacaaactacgcctgatacagccgaaagctgccaagagggacctgtccaaaattgaacgagccatatgttttctcgagaatagttatctgggcggaaacagcaagaagcattactacaagaaaaagtacgaccttgctctctttaacttgatcattcttagacggacagcagcctacatttctttcgccgacgggtttaaggcccggctgagtaaaattaaatattga

SEQ ID NO: 10791 - RNA, 1185 nt, unidentified
  source 1..1185: mol_type = other RNA; note = synthetic construct
atgattactgatataccgatcaaaaagccaaatacgaattctctgcgcagtctccacagtctaagcagctgtctgaacatcagtttaagcgacctcaatgaagcacgggagatgccaagccatctcagatacaagaaaaagcaggtcaaaaagatcaacggcgactcgcgtgatgtatatgacccccatcctctcatccgcaggatccagaagagaattaacaaccgtatcttcaaagagctgataatttggcccggatttatctatgggtctgtgcccaccaataaggaggaaaaaaaggcaggtatcgaaaggcattatatagcctgtgccaaacaacactgcaacgcaaaaaccattcttaaggtggacatcaagaactttttcgacaatattcaccgagacgtggtctacagcattttccagagagtgttcaaattcaagggagaagtcttgaactatcttacagacatctgctgttttgatcacaaaattgtgcagggcgccttgacatcatcctacatagcttctctatgcctgttcgatttagagcacaatgtggtgaaccgggcgcgccgaaagcagctggtttacacaagactggttgacgacatcaccgtaagctccaaacttgtgggatacaacatgaaccagattctggagcacatcaaatcaatgctagatgaaaaggatctgccactcaatgaggacaaaactcaagttcacaatatttcaactgagtcgctgaaggtacatggcttgcggatctcttttaatgaacctagacttccctcagatgaggtcgggcggatacgggcttctgttcacaatttggagcagctggctaagaaaaacaactccatcacctccattgcttacaggctcgaatacaatcgctgcgtcggccgagtgaacaagcttggaagggtgaaacatgggaaatataagatcctgagtgccaagctgaaactcattcagcctaaagcagctaagagagacatagacaagattgagagggccgtgcaattcctggaaaactcctataaggggggtaatagccagaaggattattacaagaagaagtacgatttggccttctttaatctgatcatcttacgcaggacagcgggctttgtgtccattgccgatggttttaaaaaacggctggagaaggtcaagtactga

SEQ ID NO: 10792 - RNA, 1185 nt, unidentified
  source 1..1185: mol_type = other RNA; note = synthetic construct
atggtcgcgagaaatcccataaaaaagccaggggcccagagcttgaggagcctccaatccctctcatcttgcctggatattacactcgctgatctgaaaactgccattgcaatgccaagtcaccagcggtacaagaaaaagcaagtcaagaagattaacggagagctccgagacgtctacgatccccaccagctgatccggcgtatccagaagcgcattaacaacagaatcttcaaggagctgattctttggccagattatatttacggttcagtgccgacaaataaggacgaaaaaaagaaaggcatcgagagacattatattgcctgtgcccgcaagcattgtaacgcaaaaacgatcttaaaagtggacatcaagaactttttcgacaatatccatcgcgacatcgtgtattccatattctctaaagtactcaagttcaaaggggaggctctggaatacctgaccgacatatgctgctatgatgacactatagttcagggcgccctcaccagttcgtacattgcatccttgtgtttatttgatgtcgagtctgacattgtaaaccgggccgagcgcaaaaagttggtttataccagactggttgatgacatcaccgtgtctagtaagctggtcaattataatatgaaccagattctggaccacatcaaagacatgttggctggaaaagatctccccatcaacgaagataaaacacaggtgcacaatatcagcactgagagcctgaaggtccacggattacgcattagttttaatgaacctcggcttccttctgacgaagtgggcaggataagggcgtcagtgcacaacctggaaaaactggccaaaaagaacaattccattacatcagtggcctaccgtatcgaatataatagatgcgtgggcagggtgaataaactgggtagattgaaccataataagtacaaagtgctaagcctgcgtctgaaggatatccaacctaaggctgctaagagggatattgtaaaaatcgaccgggcaataaagttcctagagaattcctacaaggggggaaacagcaagaaggattactataagaagaaatacgaccttaccctgtataacctaatcatcctccgacggacgcccgggtttcttcttatcgagaaaggctttcgagacaggctgcagaaggttaaatactga

SEQ ID NO: 10793 - RNA, 1143 nt, unidentified
  source 1..1143: mol_type = other RNA; note = synthetic construct
atgagaagtttgcagtctttatccagcgcgctggatatctcattgcaggagctggaaatggcaaaaaacatgccttgtaacatccgatacaagaagattgagctgaagaaggtgaatggcgatatccgggacgtctataatccacactcactgattcggaagattcagaagagaataaacaatcgcattttcaagaccctcataatttggcccgactatctgtttggatctgtgcccagtaataaggaggaaaaaaaacaggggattgaacggcactatattgcctgcgcaaaaaagcattgtcaagccaaaactattcttaaggtcgacatcaagtctttctttgataacatccatcgcgacgtcgtgtattccatctttaagaaggttttcaagtacaaaggcgatgcactggagtatctcgtggacatctgctgctacgagtcaaatgtagttcaaggggccttaacatcttcatatattgccagcctgtgtctgtttgacgtcgaatacgaagtattccgccgggccgagaggaaagaactggtgtataccagactggttgatgacataacagtgagttccaagacggtgggatacaatatgtcccagattctcgaccacattcgaaacatgctgatggagaaggatctacctcttaatgaagagaagactcaagtccacaatatctctaccgagagcttaaaagtgcacggactgagggtgagttttgatacaccgaggcttccagctgatgaagtgggccgcatccgggcctcggtgcataacctcgagcagctcagtaaaaagaacaattcgttgactagcgctgcttacaggctggagtataaccgttgcataggtagagtaaataaactgaagagacttgggaacaacaaacatccaatgctgcgagacaaacttaaagctatactgcccaaagcggccaagcgtgacatcgacaagttgaaaagggcagtcagctacttggagtcttcctttgcatccgttaacagcggcaagttctactacaaaaagaaatacgatctgaccatccacggtctaatcatcctccggcgcacacctgccttcagcagcatcgaagcttccctcagacagaggctctcactagtgaaatactga

SEQ ID NO: 10794 - RNA, 1074 nt, unidentified
  source 1..1074: mol_type = other RNA; note = synthetic construct
atgccgtaccacgagcggtataaggagatcgaactcaagaagtcatccggagatgtgcggatagtatataatcccgctcacttgataagaaagatccagaaacggatcaacaatcggattttcaaaccactcattctctggcctaactacctctttggctcaatccctaaaaatgagcttgataagaaggaaggtattgaccgacattacattgcctgcgcaaggaagcactgtgaggccaagacaatcctgaaagtggacattaagaacttctttgacaacatacacagagacattgtgtacgacgtttttaagaaggtcctgaaatataagggggaggctttggaataccttgtggatatatgctgctttggagataagatcgtacagggtgccctgacctcttcttacatagcaagtctttgtctattcgatctggaatttgatatcgtcaaacgcgccgcgaggaaacagctggtgtacactaggctagtggacgacattactgtgtcctccaaaattgtcaatttcgatatgagccagatgctaaatcacatcaagaacatgctgctgaacaaggacttaccaatcaatgagaagaaaacgcaagtccacaacatctcaaccgaatctctgaccgtgcatgggcttaggatctctttcgcaacaccccgcttgcccgcccacgaagttggcagaatccgcgctagcatccataatctggagcaactgtcgaaaaaaaataacagtctcacctccgttgcttaccgtctggaatataaccgatgtgttggccgagtgaacaagttggtccggttaaaccataataagaaggacgagttcaaaagaagattaaaagccatactccctaaggcgagtaaaaaagatattaaggagatcacaaggtcaattaactttctcgagagcagctatgcactggggaattccaataaggcttactacaaaaagaagtacgacctgacaatctataggcttatcattctgaaacgcactccaagctatcatgagatggaggccgaattccgtaaccgcctgttgaatattaaatattga

SEQ ID NO: 10795 - RNA, 1146 nt, unidentified
  source 1..1146: mol_type = other RNA; note = synthetic construct
ctgcggtccctgcagtcgctgagcaacgccctagatatctctatctctgatctgaatgctgccattaatatacccgttgagaagaggtaccacaggcttgagttgagtaaagtcaacggagagaaaagaattgtcttcgatccagatcatagagttaggaaaattcaacgcaggattaacaagcgcatctttaaggaactcattctatggcccgagtacctttttggctctatcccaactaaccaatcggacaaagagaacaagatagaacgacactatatagcctgcgctgcaaagcattgcaaagcgaagaccattctcaaactggacatcaagaacttctttgagaacattcatagggatatcgtcgtaagcatcttcagcgatgtcttccagtacaaaggagaggccttgaaatacctcgtggacatctgttgttacaatgagtacatcgtgcagggggctcttacctcatcctacatcgcatctttgtgcctgttcgatgtggaatatgacgtctttcgacgggctgaacggaagggcctggtgtacactcgcctggtagacgacatcacaatttcctcaagggttgtggactatgatatggcacagatcaagtctcatgtcgaaaatatgctgaacgaaaaagatctccccatcaatcagaagaagacggaggtgcacaatatcagcacagaagccttaaccgtacatgggctgcgcgtatctttcaacgagccgagactcgccagtaacgaggttaaaagaattaaagcctcagtccacaacatagtgaatctgagtcagaagaataatagcaagacttcagaagcttatcgcatcgagtataatcggtgtatgggtagagtgaataagttagggcgggtgggccacaataagtataaactgctactggacacacttaagaaaattaagcctaaggcgagtctgctcgacttgcagtccgtgcacaaactcgtgggagagctcgaaaagctgcacgtgaaaggtagctacaacgaatttgaatttaagcgtaagtacaacttggcagttttcaaacttattgtgataaaccgaaccgactcctataaacctttcagcgactggattaaatcccgtttagagaagataaagccttgctga

SEQ ID NO: 10796 - RNA, 978 nt, unidentified
  source 1..978: mol_type = other RNA; note = synthetic construct
atgagtgtgaattttccggtgaagaagcctggagccaagtccctgcggagcttgcagagtctaagcgatgcccttgacatttccatctctgacctgcaagcagctaaaaaactcacaaaggaggaacgatacaaacgcatagaaatcccaaaggtcaatggtgacgtaagagtcgtgtacaggcccgaccaccgcattaggaggatccagagaaggatcaacaagcgcatttttaaggaactaattttgtggccttcttatctctttgggagtattccctctacgaaacctgagaagcgcgagggcatcgagcggcattacatcgcatgcgcccaaaaacattgtaacgcgaaaatcatccttaaattggatattcggaacttcttcgaaaacatacacaaggacattgtcgaggatatcttctctaaagttctcaaatacaagggagatgcgcttaattatctggtggacctgtgttgctttgatgataatatcgtccagggggctctgacatcatcatacatcgcttccctgtgtctgcatgatctggaatacgacgtttatcgaagagccgagcgtaagaaactggcttacacccgacttgtcgatgatatcactgtgtcaagcaaaaccgtaaattatgacatgggacagattcgcggccacattgaggaaatgctgaacaagaaggacttacccatcaacataaataagtcagaagtgcacgacgtgtccactgagcccttaaccgtgcacggcttacgggtttccttcgacaagccaagactggccagcgatgaggtacgtaggatcaaagccagcgtgtataacataactcagctggccatgaagaacaattcgaagaccacagtggcatataggattgagtacaatagatgcatggggagagttaataagctgggtcgggtgaagcacaacaaacatctcgtcttgctcaacatactcaaagcaatttga

SEQ ID NO: 10797 - RNA, 1197 nt, unidentified
  source 1..1197: mol_type = other RNA; note = synthetic construct
atgtctattatcagacctgagaaacttaaagacagcggaagtctcaaaaagctcgagtccctgagccgagccctagggctgtcagtaaacgagttgaaagaagtgaaatccctcccactgtcgaagcgctatacagaagtgaaggttcccaaaatcgatggcacctttcgtatcgtttacaagcctgattaccgcctgcgaaaggttcagagacggattaataaccgcattttcaaggaattggtgagctggccgtattatctttttggttcagtgcctagcagtccagatgataaaaagaatgggataaagcgggattacgtcaattgtgcaaagaaacattgcaacgccaagaccattcttaaggtcgacatcaagaacttctttgacaacatccatagggacctggtggaggacatcttcaagaactttttcaagtataagggcgaggctctggaatacctggtggatctttgctgtaacggcggatatattgtgcaaggggcgcttaccagttcttacattgccacactctgtctctacgacattgaatttgatatcgtcaagagggcagagaggaagaatctcgtgtacacccggttggtggacgatatcactatctccagcaaagtgtcgaattttgacttcagtcagattaagatgcatgtcgagaagatgatgttggaaaaggacctgcccctgaatctcgagaaaactaagattcaccacatttcaacagaacccctgagcgttcatggactccgtgtaagcttcgatacgccgcgtctagcttccgacgaggtaaagagaataagagcatctctctctaacttaatcgcgctgtcaaagaaaaacaactccataacttccgccacatatcggaaagaatatgatcgatgcatgggcaaagtgaacaaactgggtcgcgtggaacacaataagcaccctatctttctgaacaagctgaaaaatatccgcccccttccatctgagaaagacgcttgtcgggccttggctaatatacacaggttagaggtcatgtacaaaaatggcaattccgccaaatattcttacatccggtccttccacctagcctcatacagactgatcattttaagcagaaccgcatgcttctctaggctggtcaacagtttgcgcgttaggctgaagaaaatagagccaaaactgcagaattga

SEQ ID NO: 10798 - RNA, 1200 nt, unidentified
  source 1..1200: mol_type = other RNA; note = synthetic construct
atgtatatcaagaaaccccagatcaccacactgaatgccatcgctaatgtgtctaacctgtgctccgttttagacatttctgaggaggagctcaatcaggcactagcattaagtgattacgatagatatgttcaggccaaaaccgagaaaaatgatgggtcatttcgcaccattcacaagcctcattacttgttgcgaaaggttcagcgcaggataaatacccgaatctttcagaagattgtgaggtggccatcttacatctttggaagcgtccctaatacaaaggatgaagggaacaacgtggtggaaaacaaggattatgtgtcatgcgccgctcaacattgcggtgctaagtccctcttaaaactggacataaaggatttcttcgataacatcgatatcttccacgtgaagaagattttcacaggcctgttcaagtacaattgtgacgttagcaacgtcctgtcagacatctgttgctataggggggttgttgtacaaggagcactgacttcgtcctacatcgcttccctgtgtttgtgggacgaggaatacaaaattatagagcgtcttcagagaaaaggacttgtctacacccggcttgtggatgacataacagtatccagcaggattagcaattttcagttcgaccatgcccaaagtatcatcagtaagatgttgcaagacaaagacctccccattaacaacaacaaaaccaaggtctttcatgcaagcattgaaccacttatggtgcacggcatgcgcgtcaatttcaaagagccccggtatccgagtgatgaggtgaggagactacgcgctgccgtgcagaatattgaaaagctgtcatccgaggtgggttaccggactacgtttgcgtatcggaaagactttaaccgatgcatgggccgcgtcaacaagctcaaaagagtaaaacacgaaaagcaccaggtgctcatcaataagcttaataaaatcctgccactccccagcaaaactgacctccgtcgttgtaagctggcggtgaagcggctggagaacgatttcaacaacaaaaaggagtcttattggtacaaaaagcgctattacatggcccaggacaggctgaacgtgctgcagagaacgtactacaagactgccttgaaactgagatctcggctgaatgtcattaagcctgaatatgacaacgtagaaaatgcctga

SEQ ID NO: 10799 - RNA, 1197 nt, unidentified
  source 1..1197: mol_type = other RNA; note = synthetic construct
atgcaaaaagataagccatatatcacgaccacaaatgtcatttcttctatccctaacctctgcaaaagtcttaatataaccgaggacgaactgtctcaggccctgtctcttggaagcgacatgtacgtgagagacagagtcgaaaaatcagacgggagctaccgggtgatccacaagcctcactatctcctccggaagattcagagacgcattaacaagaggatatttcagaagcttgtgggctggccaagttacatattcggtagcgttcctaataccgtaaattataagggcgaggtcgtcgaacccaaagactatgtgagctgcgctgctcagcactgcggagctaagtccttattgaagctggatattaaagacttcttcgataacatccacatttatcatgtggaacgcattttttcggggttctttcattacaacgaggaggtgtctaagactctatcccagatttgtacttacaataacgtggtcgtgcaaggggctttgacaagttcctacatcgcatcattatgtctgtgggacaaagaacttgaggtggtcgagaggctgaaaaggaagaacctcgtatacacacggttggtggacgatatcactgtttcctcaaaggtgtccaattaccagttcgacaacgcatccgccttaatcgtggagatgctgcgaagcaaagatctgccagtgaataacaacaaaacaaaggtgttccatgccactatcgagcccttgatggtccacggtatgcgagttaactttaaagagcctcgctatccgtctgatgaagtgaggcgtctgagagccgcggtgcgaaacgttgaaatgctggcctcagagccaggatatcgcacaacctttgcataccgaaaagatttcaaccgttgtatgggcagggtgagcaaacttaagcgggtaaagcacgaaaaacataaacatctggtagagagactgaataaggtcctgccgctgccctcgagaaccgacctcagacgctgcaagctcagcgtcaggaggctggaaaacgactataataaaaagcgcgagagttactggtacaagaagcggttttacatggttcacgatcgcctgaatgttttgcaacggacctacttcaagacggcctatcagctcagagagcggctaaaaaagatccgtccctggtatgatcacgttgagaatgaatga

SEQ ID NO: 10800 - RNA, 1188 nt, unidentified
  source 1..1188: mol_type = other RNA; note = synthetic construct
atggataggctgatccctgaaaagagcacgtttcagtcaatctctaatatcaagaacctgtgcgccgctctggacatttcggagaaagatttgtcatccgctctatccctgcgcgacaatgagaaatacgtcatagaccatgttgagaaaagcgatggtaccctccgaaaaatccataagccgcattatgaaatccgaaagattcagaggcggatcaataagcgcatcttcaaaaagattgtgctgtggcccgactatatctacggctgcatccccaacgaaatctcgtccgatggcaagctcattaaagccagagactatgtaagttgcgcaagccagcactgttccacaaagagtctgctcaagatcgacataaaagacttcttcgacaatatttctgcccatctcgtgttcgagatgttttcacgctttttcaagtacaacgatgaaataagccaaacactgactaaactctgctgtttcaagggaactctgatacaaggcgcccttaccagcagctacattgcagcactctgtttgtgggacctggaacacaaagtcgtttcccgcctgaaacggaaacagttgacctatacgcgcttagtggatgacattactatttcttcaaagaccagtaacttccagtttgattacgctcttactctagtcagcaacatgctattagaaaaggagctgcctataaacctccataagaccaagtcttcttccagcagcattcttccactggtcgttcacggaatgagggtgaactttgaagagcccagataccctagtaacgaagtgaaaaaacttagggccgcagtgcacaatatcgagaaactcgcgtccgagcccggttacaggatcacacatgcctaccgacgggactttaacagatgtatggggcgggtaaacaaattaaagcgtgtggggcacaattctcactctaaactggttgagaagctgttgagggtcctcccattgcctgcgaaggtggatctgaaacggagtcataccattgtggctagactggagaaggattttaaggaaaagcacacatcatattggtatcacaagagattctacaaggcccacgatcgtcttaatatcctgcagcggacatactccaagaccgctcaggagctgagattgaaacttaaggccattaaaccaaagtatgagaattga

SEQ ID NO: 10801 - RNA, 1194 nt, unidentified
  source 1..1194: mol_type = other RNA; note = synthetic construct
atggaacgactctctccgatcaaaagttctagtaagagcatatccaacaagttgaatttatgcaagacactggacatcaccattgatgaactcgattcagctctgacattgcccaacaatcagaaatatatcactgcatacatcgacaagcccaatggcgagcagagaaaaatacataagcctcactacaagataaggaagatccagagaaggatcaacaaccggatattcaaacgattggttctgtggccatcgtacatttatgggtgcattccaaacgaaaaggatgagacaaccaatatcactattcaagcgcgcgactacgtgtcatgtgctgccgagcattgtacaagcacttctttactgaagattgacatcaaggatttcttcgacaacattagcttctacctcgttaacgacatgtttctgaatttcttcaagtatcccactgaagtaagtaaaattctgtctgagatctgctgttacaaaggcaacttgattcagggcgcactgacgtcttcatacatcgcagccctctgcctatgggactgcgaggagaagttagttgctagactgaaaagaaaagggctccgctatacccgtctggtggatgatataaccatcagctccacaatcagcaattaccagtttgactacgccattagctgtgtaaccaatactctcaatgagaaagagcttccaattaatcctgagaaaacctccatttcatacgagagtattacgccgctaatggtccatggtatgaggatcaactttccagaaccaagatatcccgcgaacgaagtgaaaaagcttcgggccgccgtgcacaacatagaaaggcttgcatccgagcctggatatcgcatcaccttcgcctatcggaaagatttttccaggtgtatgggacgcatcaacaagctgaagcgggtgaaacatagctctcacggtaagctggtgagccgtctgcaaaaaattctgcctcttcctgctaaggtggatatcaaacgggccaagatcatggtcgacaggctggtcaaggattttgatgaaaagaaggacacctattggtaccaccggcgattttatcgcgctcacgacagacttaatgtcttgcagcgtacctataataaaacatccaagatcctgcgcgagaagctcaaggggaaatcccccacttacgacaacaaatga

SEQ ID NO: 10802 - RNA, 1200 nt, unidentified
  source 1..1200: mol_type = other RNA; note = synthetic construct
atgtgtaatctgtcaccgaagaagaccacagaacatagcattagtagtatagccaacctttgcgacgcactggacatcacaccaaacgatcttgatgagctgtccctgctttctgatcaagaccgctacacgcgggacacagtggagaagtccaatggcactctgaggactatttacaaaccccattttctcctgcggaaaattcagagaaggatcaatcgacgcatttttacaaggatcgtggagtggcctgattacatatttggaagcgtcccaaataccaagggcccagacaagaaagtgattcagcggaaggactacgtcagttgcgccgcacaacattgtgaaagcaaaagcttgctgaagatcgacatcaaggatttcttcgacaatatacacatctaccacgtgaagaagatcttcttagacttcttcaagtatcccgaagacgtgagtgagctgttagcggatatttgctgtttcgagcagcgagtagttcagggggcactcacctccagctatatagcctcactgtgcctgtgggataccgagccccagctcgtcaaaaggttgcagcgtaacaacctgacttataccagattagttgacgacattactgtttcctctaaagtgtctaactttcagttcgaaatggctatgtcccagattacccggatcctagaggacaaggatctgcccatcaactacagcaagacaaaagtatcttacgtctcaatctctcccttgatggtacacggtatgagagtcaatttctccgaacctagatatccatcagatgagctgcggaaactacgagcgtctgtgcacaatattgaaaagttggcttcccagactggctatcgcactaccttcgcctacaggaaagattttaaccgatgtatggggagggttaacaaactcaaacgcgtgaaacataataaacacgctgtgctgttgaaaaagttgaagaaaatccttcctctcccttcgaaaacagatctcaagagaatcagcctgagcgtgaagcggctggagtcagactatctcgacaagaaggaaacgtattggtatcgcaagcgtttttacatggcccaagataggcttaacattctcaatcggacctttaaccagagtgctgcccaatacagagagcgtctaaatagaatcaagccgctgtacgatcgcgtggaaaacggatga

SEQ ID NO: 10803 - RNA, 1101 nt, unidentified
  source 1..1101: mol_type = other RNA; note = synthetic construct
atgaactctttatctcctcagaagaacactactgaatccattgctagcatcacaaatctttgcaccgcccttagtatctcaatcgacgagcttaatactgtactgcagatggagccaagtgagtggtatgtcaaggattatgtgcccaagtccgatgggagtgaacgtgtgatttacaagccccatcacttactgagaagaatccagcgccgcattaataagagaatcctatctcggatcatcaagtggcctgaattcatttacggaagtgtgccaaacgagaaggtagacgccaacaccataattagaaaagactacgtgtcctgcgctgcaaaacattgcggtgcaaagagcattctgaaagtggatataaaagacttcttcgacaatatccagcagtatcacgttctcaacattttcagaggatttttcaactactccgatgaagtttctaagacattggccaatttgtgttgctataatgagagggtggtccagggcgccctgacaagttcctacattgcatctctatgtctgtgggatgtggaaaccgaagtcgtcaaacgattgatgcgacatcgcctggtttacacgcgacttgtggatgacatcaccgtgagctccacagtaagcaactttcaatttgactcagctctgtcatacattcggtctatgctggaagggaaagacctcccactgaacatggccaagacaaaaagcctgtatgtctccgttgagcctctgctggtgcacggcatgcgggttaattttcctgagccccggtacccgtcagacgagatcaggaaactccgcgctagcgtccacaacctggagagactggcgtcacaagtcggttatcgcaccacatacgcgtataggactgatttcaataggtgtatgggccgagtgaataagttgaagcgggtgggacataacaagcacgccgtactcctcaaaaagctcaaaaagatacttcccttgccatcgaagaccgatttaaaaaggatcaacgtgactataagccggctcgagagcgattttgaccgcaagcgtacgaggaccgggatcaggaaagacatcctgagacgtatgattggctga

SEQ ID NO: 10804 - RNA, 1188 nt, unidentified
  source 1..1188: mol_type = other RNA; note = synthetic construct
atgtatcaactggagccaatcaaaaagacaaagcaggtgattgcatccatcccaaatctgtgctccgccctagatatcactatagacgaactgaataaagctttatcgctatcaagtgaggagaggtacgtccaggggaaggttagtaaatccgacggctcttacagggacgtgtacaacccccacaatctgattaggaagattcagcgccgcattaaccgaagaattttcatcaagctggtgggttggccctcatacatctttggatccatcccaaacaacatagacaagaacggcaaagtgctggaagctaaggattacgtgaattgtgccgcccagcactgcctggcaaaatcgctgctgaaaatggacttaaaggatttcttcaacaacatccacatagaccatgtgaaggagatgttcgagaaattctttaactaccccaaggacgtctctgaggcactgtccaatatatgttgtcgaggcgattccttggtacagggagccttgacaagcagttatattgccagtctctgtttatgggacctggaacctcatctggtaaaaagactcaagcgaaagcaactgatttacacccggctggtcgatgatatcaccgtttcttcaaagatctctaattttcagttcgacatgaccattgaacacattactagcatgttgcacgaaatggacctcccaattaataatagcaagaccaaagtcgcatacacaagcatcgaaccgctcacggtccacgggatgagggttaactttaaagagcctagatatcctagcgatgaagtacggagactcagagcggcggtgcataatatcgagtctcttgctagcgagccaggatacagagtgacttttgcctatcgtaaggattttaacaggtgcatgggtcgggtcaataaacttaaacgggtggagcatgagaaacaccagacgctagttaacaaactccttaagatccttcctcttccctcagaaaaagatcttaagaggtgcaaagctagcatcttgcggttggaaacagacttcccgctgaagggggacacctattggtatcgcaagagattctacatcgtgcatgaccgcctgaatgtgctccaaaggacctataagcgcactgccctcaagctgcgtaaccggatgaagcccatacgccctgagtatgatgattga

SEQ ID NO: 10805 - RNA, 1188 nt, unidentified
  source 1..1188: mol_type = other RNA; note = synthetic construct
atgtaccagcttgagcctattaagaaaacggacgagtccattgcctctatagagaatctctgtaataccctcgatatcagcctcaaggagattaacgaagccttgagcttgagccctgacgagaggtacgtgtataggaaaatcccaaaatccgacggcagttacagagaagtgtataaccctcacaatctcatccgtaaaatccagcgcaggatcaacagaaggatctttattaaacttgtcaagtggccttcctatatcttcgggtcgattcccaataacgtagattcagtggggcaggtcttagaagctaaagactacgtaagttgcgccttccaacactgtcagtcgaagtctcttctgaaaatggatctgaaggatttctttaacaacgtccacatcgatcatgtgcatgatatctttgaggggtttttcaactacccctctgaggtgagtcgggtgctgtcagacctgtgttgcagagaggactccttagtacaaggagctctaacatcatcttacatagcgtccctgtgcctgtggcgtttcgagccgctgcttgtcaagcggctgaagagaaaaaatctcgtgtatactcgcttagttgatgatattaccgtcagctctaagatatcaaatttccagttcgacatgacgatcgaacatatcaaaaatatgctgtacgaaatggatcttccactcaacaatgagaagactaaggtcatttatacaagcatagaaccactcacagttcatggtatgagagtgaattttaaggagcccagatatagttcagacgaagtgcgaaaattgcgttccgcagtgcataacatcgagtgcctggcatccgagcccggttaccgggttacttttgcatatcggcgagacttcaaccgctgtatgggacggattaacaagctaaagcgcgtgggccacgagaagcacaaaaccctggtgagtaagctgttgaaaattttgccactgcctagcgaaaaggacctaaagagatgcaaggctagcatcctgcgactggaagccgattatccgctgaagggcgactcttactggtacaggaaaaggttttatatactgcacgaccggcttaacgttctccagaggacctacaataaaaccgccgacagcattcgcgaccgcatgaaggaaatcacacccaaatacgatgattga

SEQ ID NO: 10806 - RNA, 1203 nt, unidentified
  source 1..1203: mol_type = other RNA; note = synthetic construct
atgtacgcattccaatttcaccccattaagaagtcaactagtgtcattgccaatttcaagaagctgtgcgaggctctgaatatcagtgaggtggagatgaagaaagcgctcagtctcccacccgaggagcgatatgtggcctcctccgtgaaaaaagccgatggaagtactcgggccattttcaagcctcacaacttgatccggaagattcagcggagaataaatcgaaggatttttaaaacgctcgtgatctggcctagctatttatacggctctattcctaacactattgaccctaccacgaagaaagtaattgaacacaaagactatgtcaactgtgccgcgcagcattgtagcagcaagtctctgctgaagatggatataaaggatttcttcgacaatatccatcgcgactatgtcagcgacatattcacagtgtttttcaaatttccaccagatgtgtccgaggcactgacatcgatttgttgtcgtgaaaatactttggtgcaaggggctcttacatcctcctacctcgctaatctggtgttatgggatatcgaaggtgacctggtaaaaaagcttaaccgcaaaaacctaacctataccagactggtggacgacatcacagtttcatccaaggtatctaatttccaattcgatcttgccatatccctgatcagctctgctctgatctctaaagagctgcccatcaacaccagcaaaacacaggtttcttacgtctcaagtaatccgctaaccgttcacgggatgcgggtcaattttcccgaacctagatacccgagcgatgaggtgaggaagctgagggcatcggtccataacctgcagtgccttgcatcacaaccaggctaccgacagtcacattcctatcgtaaagactatgcttgctgtatgggaagggtgaacaagctgaagagggttaaacatgaaaaacacgccgtccttatcaagaagctgaacaaaatcaagcccctaccaagcgaagtggaccagagacgctgcaagcagatgctcagacgcttgcagaacgactacaagaataagcacttggattactggtactgcaaacggttttatcggttgcacgatagactcaacgttctccagcgcaaatcttgctttcgtgatttagccgaaaagatccgcgaggagatgaggctcataaaacccacctacgaccagtga

SEQ ID NO: 10807 - RNA, 1203 nt, unidentified
  source 1..1203: mol_type = other RNA; note = synthetic construct
atgcggaacatccgacctgcccttacaacctctaagccgatcaagtcactggcaagtctcgaatccaccctggggctttctagcaagcaactctctgagattcttgacattccagagtgtcagaaatatgtcgagaaggctgttccgaagccagatggttccctgaggactgtataccgacctcatcctttgatcaggaaagctcagcgccgcattaacaataatatcttcaaggagatcgtgatctggccctcatacgtttttggctcactgcctaacagtgtcatcaatcaggatgaaattgagcgtaaagactatatttcctgcgctgcccagcattgtggagccaagagcctcctgaaaatggacatcaaaagcttcttcgacaacattcacattgactacgtgaaccacatgttttgcaatttcttcgattattccagtgacgtcgccgatatcctcagccggctttgctgtcgaggcgatttcatagtgcaggggggcctcacaagctcttatgtggcttcacttattctgtgggagtttgaacccaagctagtaaagagactaaccagaaagaagctgatatacactcgcctagtggacgatattagtataagcagtaagatctccaactttgacttctctatgacaaagtccttagtgacgaatactctccacgagctggacttgcccgtaaacgagaggaaaaccaaagtttcatatgtcagcacagaaccattgtccgtgcatggcattcgagttaattttaaagaacctcggctgccctcgaatgaagtccgctgcatcagggcagcagtgcacaatctgacggtgctggcgagccagcctggatatcgtaccactcatgactacaggagtgattttagccgctgtatgggcagggtgaacaagttaaagcgggtcgagcatgagaaacacaaggactttctggaaatcttgcagaacatcaagccccttccatcaccaaaagatctgaagagagcccgtgagatgctcggaagactggagcgggattacacaacccaatccggttctagagggtaccggaccaggttcttcagattacaagagagactgaacgtgctgtcgaggaagaaagaatacctgaatgacgcgaaaaagatacgccacaaactcaaatctttgaaacccgatgaaactgcccggtccaacttttga

SEQ ID NO: 10808 - RNA, 1194 nt, unidentified
  source 1..1194: mol_type = other RNA; note = synthetic construct
atgaggaatctcaatcctactctcactaccgtcaagcccatcacaacattggagaggactctcggcttggatagtaatgagatttctaccatcctggctatccccgagaatcagaaatacgttgaaaaaacagttccaaaagccgatggctcgctccggaccgtatacaggccccatccgctgattcggaaagctcagcgaaagatcaacaacaacattttcaaggagatcgtgatttggcccagctatgtcttcggctcactgccaaatagtgtcatcgacaaaaacgagattgagaggaaggattacatatcctgcgccgcaaagcattgcggggccaagtccctgctcaagatggacatcaagaactttttcgacaacatccacattgaccatgtagtctctatgttcataaatttcttcggatgtaaggcggaaattgctaatacactgtcacgcttgtgttgtaaaggtgagtttattgttcaagggggcctgacaagtagctacgtggcctcgctcattctgtggcaactggagccggagcttgtccggcgactgtctcggaaaaaactgacatacacccgcctagtggatgatatcagcatcagcagtaaaacctcccactttgacttcagtatggtgatatcactcgtgaccaacatgttacatgaattagacttgccagtgaatgagactaaaacgaaggtttcccacctgagcacggaacctctgtctgtgcacggaatccggattaattttaagcagccacgactgccttccaacgaggtgcgccgcatacgtgcatcagtgcataatctaactgtgctggcatctcagcctggttacagaactacgcacgattataggggcgattttgctcggtgcatgggaagagtcaacaaacttaaaagagtggaacacgagaaacactccgagtttttatcaatcctgcagaagattaagccactgccctcccctaaagatcttacccgtgcgagggaaatgcttagcaggctagaaagagactatagcgacaagaacgagacaagagggtatcggacccgatattttcgtcttcaggaacgcctcaacgtattgtatagaaagaaggactacatctgcgaagccaagagcataagaaagaagctgaaatctatcaagcccaacgaaaatgcccgcaacaatttctga

SEQ ID NO: 10809 - RNA, 1203 nt, unidentified
  source 1..1203: mol_type = other RNA; note = synthetic construct
atgtatctttctcaaccctccttaaacactaaaaatgccatcaactctatggccgccttggagaaaacccttggacttactgctaaagaaatccaaagcatcattagcttgcccgaatcacagaaatacttcgagaagaaggtgccaaaaagcgatggatccatacgactcgtgtactgtcctcacccacaggtgaggcgagcccagaggaagatcaacaacaacatcttcaagaaactggtgaagtggcccagctacatctttgggtccatacctaacacaaaaattagtaaggagcagatagagaagaaggactatatttcttgcgctggacaacattgtggcgcgaagagcctcctcaagatggacatcaagtccttcttcgacaacattcattttgaccacgtcttggatatgttcgtgaatttcttccattacgacaaagatgtgtcttttactttagcgaagctgtgctgcaaatctaactatattgtgcaaggtggcctgacctccagctacgtcgcctccctgattctctggaggcatgagcccgagctagtaaagcgtttgcagcggaaaaacctgacctacaccagactggtggacgacattagtatcagctcgcatgtcagtaatttcgatttttccatggttcagcagctagtcacaaacatgctgtatgaaatagacctgccggtgaataacgataagactaaggtataccatctcagtacagaacctctgacgatccacggcatccgcgttaacttcaatgaaccacgcctgcctgctaacgaggttcggaagatacgtgcagctgtgcacaatctcacgattctggcatctcagccggggtataggacacttcactcatatagagaggactacgcaagatgcatgggtcgggtcaataagctaaagagggttcagcacgagaagcacagtgaatttctgaaaaccctgcagaatatcagacctttgccatcagaaaaagatttaaagcgagcacgcgtggtctaccaccggctcatgaggaattactcagaaaagaaagatacaagagggtatagaacctcattctttaaacttcaagagcggctcaatgtactgtgtcggaaaaagtgttttcgtgaggaggcccagaaaattcgccgcaagctgaaagaaatcgcccccagcaagcaggccaaagagaatttttga

SEQ ID NO: 10810 - RNA, 1203 nt, unidentified
  source 1..1203: mol_type = other RNA; note = synthetic construct
atgacgattatcgagcccagccttaatactcctaatgtgatcgcttctataagggcgctcgagaagaccctcggattgactcagcaggacataactactgcgttagagattccggaatctaagaaataccacgtgaaacaggtcccaaagcagaatggggagttacgttcggtgtatcgacctcatccactgattcggagggcacagagacgaatcaacaacaacatctttaagaagatcgtgctttggcctagctatatctttggcagtcttccgaataccattaacaagaacaatgaagtggagagaaaggattacatctcatgcgctgctcaacactgcggcgccaagagcctcctgaaaatggatatcaaggacttcttcgacaatatccacatcgatcatgttcgctcaatgttcatacactttttcaagtgtggggatgatgtagcagatattctggccaaactgtgctgtaaagagaaccacgtggttcagggtggactgacaagttcatatattgcctgtctaattctgtggaacatagagcacaaattggtgaatcggctcgcccgtaaaaacttgacttatacaagactgatggacgacattacagtgagctccaagatttctaattttgacttcagcatgaccactaatctcatcgccaacatgcttcaagaactggatctccctatcaacacctctaaaacaaaagtgtgccatttgtccaccgaacccctgaccgtccatggtgtgagagtaaattttaaagagccacgcttccccagcaacgaagttaaacgaatacgggcctccgtacacaatctgacaatcctggcatcccagcccggctatagactgacacatgactataggagtgattacgcacgctgtatggggagggtcaataagttgaagcgggtgaatcatgagaagcacaaggaattcttagtcatcctccagaaaattctgcctctaccaagtgtcagggataagaaacgcgctaaacaaatgttcataaggctaatcaaggactaccgcattaagtataaaaccaaaggatacagaaccaggtactttcggctccaggaacgcctgaacgttctttccagaaagaaagactacctgaacttcacgaaatacatccggaagaagctgaagaacattaagcccgacgagcactcaaagacggacttttga

SEQ ID NO: 10811 - RNA, 1206 nt, unidentified
  source 1..1206: mol_type = other RNA; note = synthetic construct
atgactataatcaaaccccagaagatccatcctacaaccattgcctcaaagtctgcactgtgtgtaaccctgggatttactctgctggagctgaatgaagtactaagtgtgcctagctctgaacgatataaaagaaaggagatcgacaaaccagatgggtccaagagggtagtgtataacccacatcccctcattcgacgtgcccagcgacgcatcaataccaacattttcaagaagcttgtgagctggccatattatctctacggcagcattcctaataccgtgataaaggagtcaggtttacctaagattatcatccgcaaagactacgtcacgtgcgcgagcaaacattgtggcgctaagtccctgttgaagatggacattaagaatttcttcgacaacatccacgaaaaccatgtcaggaacttattccttaggtttttccactttagccccgaggtggctcacattcttacaaatatctgctgtcacgaatctaatgtggtgcagggtagtcccacctcttcgtatattgccagtctcatactttgggatgttgagcacctggcagttaagaagatctccagaaaaaacctggtttacacgcggctggtcgacgatatttccgtgagctccaaatcatccaaatacgattttagcatgatcgaagacatcatcactcagatgctgacctcccgcgacttacccgtcaacaagaaaaaaaccaagcattgctatctatccacagagccgctaactgttcacggaatacgcattaattacaaagaaccccggtttccttcagatgaaatacggagactccggtcatacgtgcacaacctccagactttggctaagcaacctggctataggacaacacattcttaccggactgactatgcaatttgtatgggaaaggtgaacaaacttaaacgggtgaatcacaacaaacacttcatttttttggagcagttgcgtgccatcagaccactgccaagtgaggacgatctggataggtgccgctacgtcatcgcacgcttggatgcttataatacaatccatgggaacgagtctttcagctacaggaagcggttctacaggctgcaagagcgactcaatgtcctgcagagactctcgaagtacaaaaccgccgccaaggaaatgagagcgcgtctgaagagtctcagaccgccaaacgaggtttga

SEQ ID NO: 10812 - RNA, 1227 nt, unidentified
  source 1..1227: mol_type = other RNA; note = synthetic construct
atggctaagcctcttttgtttaacctgaagacaatgtaccagatcctaaaaccagagaagattaactcgaaatccattagttcattggacaatttatgcgaggctctgaatatctctgttgacgagttaaacgaggccctcaacctcccggagagtgaaaagtatactgaaaaaaccgtcccaaagtctaatggcgcaattcgacacgttttcaaaccccatcacctgctgaggaaaattcagcggcggatcaataaaagaatatttaccaagctggtgaagtggccatcctacctgtacggcaccctgcccaacgatctggatggaaacggtgacattatactcaaccgagactacataaattgtgccagacaacattgccagtccaaatctctgctgaaggtggacattaaggatttcttcgacaacatccacgaggattacgttttcgaaattttccacgtttttctcaagtatcctgatgatgtatctaaagcactgacaaagatctgctgccacaataaaaacgtggtgcagggggcacttacgtcgagctatatctcatgtctctctctttggaatatggagcacaagatcgtgaagagactgcaacgtaagaatttgatatatactcggttggtcgacgatatcaccgtgagctccaaggtgtccaactataactttgatgcggccctctcacacataaaaaacatgctgtatgagcgtgacttgcccctgaacattgaaaaaacacgcccctactatatcagcatggagcctcttacagtacatgggctgcgggtgaattttgacactcccaggctcccaagcgatgaagtcagaaaaatccgagcggccgtccataatatttccaaattatccagcgaacctggttacagaaccaccttcgcttatcggaaggactacaatcgctgtattgggcgggtgaataagttgaagcgcatcggacatgaaaagcacgaggccctgctgaaaaagcttatcgagattccacctctacccagcaggaaggatatcgaacgtactagggcatcaatcgagaggcttgagagagacttccagtctaaaggcagcagttattggtactacaaacgcttctaccgagctcatgaccgcctgaacgtgctccagaggaggtttgatgtcatcgccagtgaattacgcgatagactcaaggaaattaagccgctatacgacaaaaattga

SEQ ID NO: 10813 - RNA, 1266 nt, unidentified
  source 1..1266: mol_type = other RNA; note = synthetic construct
atgagcatcttgcaatacatgaatgagaatcagccaatccaggctcctatcaagcccactttaaagaccagtaaaaagatctcttctcccgaaaatctgctggtggcccttgggctgagcgcatccgagctgaattgcgctctgtatatgacctccgccgaaagatatactgcgaagaaggtccccaagtcgtcaggcggtgaaaggattgtccacattcctcacccgttgatcaaaaagattcagcggaggattaataacagagtgttgtcgaagattgttgtatggccatactacttattcggcagcgtgccttccgagatcgatgttctgtacgaagacgccatcctgaaacgcgattatatatcctgtgcccagcaacactgcaaagcaaagtctatcttgaagtatgacatcgagaactttttcgataacatccattacgatctggtgaacgacatcttcatcaacttctttaagttcgactgcgataccgctagaattctgagtgacctctgttgtattgactcagaagacgggtcacatattgtgcagggggccccaacttctagctatctcgcctgcctctgcctgtgggatatagaacatgacatagtgcagcgacttaagaggaaaaaccttatctatacacggctcgtggacgacattacggtcagtagcaagatatatgactacaactttgagaacgcaaaaaaatcaatcgaggacatgattcatgagaaggacttccccattaacaaagcaaaatccagagctctgtctacctctagtgaacctctgctcgtgcatggcttacgtgttaattttcacacacccagactaccatctgatgaagtaggacggattcgtgcctccgtgaaaaacgtggagctgcgagcggcaactaataattttcggacctcaaaagcttaccgcaaggcgttcgagcgatgtcttggacgtgtccacaagctcgctcgggttggccacaacgcccacacaaagcttcgcgataggctccttaagattcagccactaccgtcccaaagggatatagatagagtaaaacacaatgtgacgaggctggagatcttggcagccaatggctgtgatgacctgcgctactcccggagctattacatcagcatgtacatcctgaatatcattaacagaacagaacgctacaaacctctagtcagcgagctgcgcgccaggctccatgctatagcccccagtaaagaggtcggtggaacctattttgattga

SEQ ID NO: 10814 - RNA, 1227 nt, unidentified
  source 1..1227: mol_type = other RNA; note = synthetic construct
atggctccattgcagcctacactgaaaacaaccaagaagattgcatcttccgccaatctgttgaccgccctcgggcttgatgagagcgagctgagttctgccctcgcaatgacaccggcggaaagatacacagccaagaaggtgcccaagtcatctgggggcgagaggactgttcatatcccccatcctctcatcaaaaaaatccagcggcggattaacaaccgcatcctgagtaagatcgtgatctggccctattatttgtttggctctgtgcccagtgagattgatgtcctgtacgaagacgagatcttgaagagagactacataagctgcgctcagcaacattgtagggccaagtccattcttaagtacgatatagagaacttcttcgaccacattcactacgacctggtgtatgagattttcactaacttcttcaactacaatgacgagacttccaagactctctcaaatctttgttgtatggagtccgatgatggacatcacattgtccagggcgcacccaccagcagctacctagcatgcctgtgcctgtgggatatagagcataaagtcgtgacaagactggaacggaacaatctcgtgtatacccggctggtagacgacatcaccataagctcaaagattcacgactataactttgagaatgccaagaaatcgatcgaggacatgattcacggaaaggattttcctatcaataaagcgaaatcacgcacattctctattagcaatgaaccattactagtgcacggcctgagggtgaactttaacaccccgcgcttaccaagtgacgaagtgggaagaataagggctgccgtgaaaaacatcgaactccgagcggccaaaaataatttccgcacctccaaggcttatagaaaagcttttgaaaaatgcctgggtcgggtccataaattagccagggtaggtcacaattcgcacattaagttgcgagatagactgctaaagatcaaaccactgcctagtatgcgcgatataaacatggtcaagaggtatatcgatagactcgaagttcaggctaagtccggggttgacgacattaagtactcacgttcctatcacatcaccatgtactaccttaatatcatcaaccggactgaacgataccaaagcctggttagcgaactgcgtgcaaggctccatcttattacgccttctaaagaggatcgcggcacgtattttgactga

SEQ ID NO: 10815 - RNA, 1227 nt, unidentified
  source 1..1227: mol_type = other RNA; note = synthetic construct
atggcgccccaaaaaccaacgttgaagacagataagaagatcgcctccttagcaaatctcctgaccgctctgggcctggatgaatctgagctcctgtctgccctgagcatgacttacctcgagagatacacccccaaaaaggtcccgaaaagttccggtggggagcggaccgtgcacattcctcatccactcattaagaagatccagagacgtatcaataacagaatcttcagcaagatcgttatctggccctattatctgtttgggtcagtacctagtgagatcgatgtgctgtatgaaaatgagttgttgaaacgcgactacatatcctgtgctcagcagcattgcaaagccaagagcattctcaagtacgatattgaaaacttcttcgaccacattcattatgaccttgtgtacgagatcttcactaagtttttcaaatacgaccacgaagtctctaggattctttctgatttgtgctgcattgacggcgaagaggggaatcacatagtgcagggcgctcccacatcgtcctatctagcatgtctatgtctttgggatgttgagtgtaacatcatcaaaagactggaacggaaaaaccttgtgtatacaaggctagtcgatgatattactgtcagctccaagatccatgactacaacttcgaaaatgcgaaaaagactatagaggacatgattcatggaaaggactttcccatcaacaaggaaaagtctcgaacctttaacatttcgaacgagccgctctccgtccacgggttacgggtgaattttaatacacctcggctgccttcagacgaggtaggcaggataagggccagcgtgaagaacattgaattgcgcgcagctacgaacaactttagaacctcaaaagcatatcgcaaagccttcgagcgatgcctgggtcgtgtgcacaaactggcccgggttggacatgaggcccacatcaagctcaaagagcgtttacgaaagattaaacctctgccaagcccaaaggacgtaaataaagtgaagcactatgtggatagactcgaagttatcgctaaaacaggatgcgacaatatcaagtacagtcgctcttaccacataaccatgtactatctgaatatcgtgtacaggactgaaaagtatcgcccactggtcagtgagctgcggtcaaggcttcatgcaatagcccccagcaaggaagagaaaggcacctacttcgattga

SEQ ID NO: 10816 - RNA, 1269 nt, unidentified
  source 1..1269: mol_type = other RNA; note = synthetic construct
atgtctatcctcaagaatgttactaatagcagcgtgtctgtcgcccccaataaacctacgctcaagaccaccaagactattgctagcctggccaacctgtgtacagctttaggtattgatagcagcgaattggatgccgcacgctccatgacgtcctcgcagagatatgtcgagaagaaggttccaaagagctctggaggagaacgcaccgttttcatcccacacccgctcattaagaaaattcagaggaggatcaataaccgggtgttctctcgaatagtggtatggccctactatttgtttgggagcgttcctagtgaaattgaggttactcaccataacgatattctaaagcgggactatatatcatgcgcgaatcagcattgcaagtccaaaagtatcttgaagtacgacatcgaaaatttcttcgacaacatccattacgacctggtgtatgaactgttcacagatttcttccactattctgatgacgttgccgaggtgctttcagatctctgttgcatcaatggcgtaaacggatacgtggtgcaaggggctcccacctcctcctatctggcctcactgtgcctgtgggacgtcgagtacaaggtggtcaagaggttagagcggaaaaatctggtgtatacacgactcgtggacgacattaccgtcagcagtaagatacacgactacaattttgaaaacgcacgtcaggctattgaagagatgatcctgaacaaggatctccccatcaacaaatccaagtcgaagagttttagtatttcatctgagcctctctccgtgcatggcctgcgggtgaactttaacaccccgagattgccaagtgacgaggtggggagaatcagagcatccgtgaaaaacatagagcttcgtgcctctactaataatttccgaacaagcaaagcttatcgcaaagcttttgagaggtcattgggccgggtccacaagcttgcccgtgtaggccacgaagcacatcggaagcttaaagacagactactgaagattcagccacttccttccaaaagagatgtccagcgagtgaaacgcgcagtcgatctgctggagcaaaaatctaaaggctgtgtggacgaaatcaggtatgccaggagctaccacatcgcgatgtactacttaaacatagtgaaccgcactgataggtacaagcctttggtcgagtcactgcgcacaagactccacctgatcgcccccgataaagagaaacatggtgactactttgaggaagtatga

SEQ ID NO: 10817 - RNA, 1173 nt, unidentified
  source 1..1173: mol_type = other RNA; note = synthetic construct
atgcccaaattgatctcaaaaaacaagatctcttccgtggataacctctgtcgggctctggatatcagtagatgcgaactggatgccatctacgccttaaatgatgatgaaaaatactcagagccttctaagctggcgttcaaaaaggacgggaagaaacgcgtcattaaatgcccgattcctattataaggaaagtgcagaacaggatcaactcacgcatctttaaaactctggtgaagtggccagaatttctctttggcagtataccaaatgatgagttcgaggacattgaattaaagaaggactacgttacatgcgcaagcctgcattgcgaagctaaatctttactcaaaatcgacatcagcgattttttctccaacatacatgaagacttcgtccgagaacttttccttgacttcttcaattatgatgaggacctggttgactatctcattaagatctgttgttacaaaggtaccctggtgcagggagctcttaccagttcctatattgcatccttgattctatggaatgaggagagatatgtggtgagaaagctggagcgctggggcctagtgtatactcgtctggtcgatgacataactgtcagctctaagcgaagtaagtataattttagcatcgccgaacaccatatatacgagatgctattcaaaaaagacctgcccgtaaacaaggaaaagtccaagaccttctttagctcaagctccccactcacagtgcatgggctgagagtgtcatttaagacccctaggttgccttctgacgaagtacgcaggattcgagcagccgtccagtgtctggagaatctctactccgagcccaattataatacgagctattcgtatcggaaggactttcaacggtgtgtgggaagagttaataaactggctcgcgtacaccacgagaagcacaagccattgatgaacaggctgaggaaaatccgtccgaaaccctcggaaattgaccttaagatttccaagaagatcctgagcaaacttaagatggagtacgacgacaaaaaggataaatactggtacaagaagcagtactggcaattggtggatcgggttaacctcatctctagtacataccacaaagaggcctgctacttccggaacgagctcaagaacatcaagcccgagtttgattga

SEQ ID NO: 10818 - RNA, 1173 nt, unidentified
  source 1..1173: mol_type = other RNA; note = synthetic construct
atgccgaggctgatctccaagaataagatttcttccgtggataacttttgtcacgctcttgacatcccaagacaggagcttgatttgatttacagtctgacagacgaagacaagtatacagagcctgctaaattggcctttaaaaaggacggaaaaaaacgcgtcatcaaatgccccactccgtcaattaggaaggtccagagcagaataaacagccgaatctttaaaaagctcatcaagtggcctgaatttatctttggaagtataccaaacgacgactttgaggagcacgagctgaagaaagattatgtgacctgcgcctccctgcattgtgaagccaagtccttactgaagatagacatcagcgattttttctctaacatccatcaggatttcgtggaggaactgttcaaaaacttctttaagtacgacgaagagctggtaaagtacttggtccacatttgctgctataaaggcaccctcgtccagggcgcactaacatcttcctatattgcttccttgattctgtgggatgaagagaggaaagtcgtgaagaaacttgatcggtggggtctggtttacacccggctcgttgatgacataactgtgagctcaaagacttcgcgatacaatttctcagtggtggagcaccacatatacgagatgctgttcaaaaaagaccttcctgtaaacaaggagaagtcaaaaatcttcttcagcagttctagtccactcacagtgcacgggctgcgggtaagtttcaagactccaaggcttccctcggatgaggtgagaaaaattcgcgccgcagttcagtctctagaagtgctgtatagcgaacccaattataatacgagcttcagctacagaaaagattttcaacggtgtgtcgggcgcgttaataagctcgcacgtgtgtctcatgaaaaacataagcccctgatgaatcgtctccgcaaaattaagcccaagccttccgaggtggacatcaaaatcgcgtataaagtgttagccaagttaaagaaagactacaccaacaagaaagacaagttttggtacaagaagcaatattggcagctcgtcgatagagttaatctgatctcaaccaccttttacttcgaagctgcctccattaggaaggatttgatcaacattaagcctgaattcgagtga

SEQ ID NO: 10819 - RNA, 1170 nt, unidentified
  source 1..1170: mol_type = other RNA; note = synthetic construct
atgcctaagatcatccccaagaataagatctctaaagtcgataacttctgccaggtgctcgatatatctagagaagaactagaggccattattcagctcaacgatgaggataagtacctcgaaccgaaaaccctggctttcaaaaagaatggtaagaaaaggctcgtgaaatgtccaatacaacctctcaggaagattcagaaacgtatcaataatcggattttcaaggagatcatccaatggccagagtttgttttcggctcagtgcccaatgatgatgagctagaaattcagaaagactatgtcacctgtgctagcctgcactgcgaggccaaatccctgctgaaggtggacataagcgattttttcttgaacattcatgaggactttgtgcgagacttattcaagcggttctttaattacgacgaggaattgtgtgattatctcgtagcattatgctgctacaatggcaccctggtgcagggagccctgacatcatcatatcttgccagccttatcctgtgggacctggagcggagcgtcgtcaacaagctcaaacgctggaagctgacttacactagactggtggatgatatcactgtctcgtcgaagatttccaaattcaactttgagattgcggaacatcacatcaagaatatgctcatgcttaaggacctgcccgttaattccaacaagtctaaggtcatctactcttcatcttccccactgatggtgcacgggctgcgcgttagctttaaaacaccgaggctacccagtgacgaggtgagaagaattcgggcagccgtgcagtccttagaacggttgtataatgagcctaactacaacaccagtttttcctacagaaaggaccaccaaaggtgtacagggagggttaacaagctggcacgcgtgaaacatgaaaaacacaaggctctgatgcgacgtcttaaaaaaatacgccctaacccaagcattgtagacgtaaaaatcgccgagaagattttggtgaagcttaagaaagactaccccacaaagcatagtaaatattggtatgcgagacagtattggaagctgatcgaccgcatcaacattatcaaccagagcttcataatcgatgccaaaaggttgcgagctgaagcaagtaaaatcaagcccgaaaatacgatatga

SEQ ID NO: 10820 - RNA, 1176 nt, unidentified
  source 1..1176: mol_type = other RNA; note = synthetic construct
atgccgaagataaccacgactaagaaaatctctaacatcgacaactttgcaaaggcaataggagttagcaaagagtacatcgattcagtgatctctctgtctgatgatgataagtatacagacccaaagaagaaggcctttaagaaggacggaaaaatccgaatagtgaagtgcccctctagcaagctgcggaagattcaatctagaattaacacccggatcttcaaggatttgataaaatggccggactttctgtatggctccatccctaatgatgacgacggtgaaatcgagattaagaaggactacattagttgtgcaagccgccattgtgaggcccgctcgttacttaagatcgacatcagtgacttcttccttaatattcacgagtccttcgtctatgacctgttcaacaagtttttcaaatacgatgatgagctttgccggtgtctagtaagtctgtgctgttacaaaggtaccctcgtgcaaggcgctctcacgtcatcgtacattgctagcttgattctctgggatgtcgaaagtaatttggtgaggcggctggaacgttggcagctggtctacacacggctggtggatgatattactgtgagttccaaagtggaaaaatataacttcgacatagccaagtatcacattaaggaaatgctcttttccaaagacctgcccatcaatgaaaaaaaaaccagcgtgagctacaattcatctacacctctgatggtacacgggctaagagttagctttaaaacccccaggcttccctcatatgaagttaagaggattcgcagctctgtgcagtccttagagttactgtttaaggagcccgggtataatacttccttcggctatcgaaaagattatcagaaatgcatggggcgagtcaataaactcgcgagagttcagcataacaagtttcctattctgatgaatcgcctgaagaagatcagacctaaatgctccaaattggatgtcaagatatcaaggcgtatcctcagaaaactccaggaggactacccacagaagaaagacatgttctggtacaagaaacagtactacaaacttattgacaggatcaactttatctcaaacacattcaagagcgaggcccatgaaattcgcctggacgctaagaaaatctccccaccagaggatgactga

SEQ ID NO: 10821 - RNA, 1188 nt, unidentified
  source 1..1188: mol_type = other RNA; note = synthetic construct
atgatccaacccaagtataagttcggaccaatcaaagatttgaaccagttggccgccagtctctcctacacactaaaagagctgaacacactgctgtctaccccagacgataaaaaatattccgaccccagccagcctgcgtataagaaggacggctccatccgtaaaataaagaacccctctgatgattttagacgggtacaaggccgcattaaccacaggatattcaaacaggggattgagtggcctagttatctgtttggatccatccctaaggaatcagcaggtagagagactgattatatcgagtgtgcacgtagacatgtggaggccaaaagtatttgtaagatcgacataaccaacttctttgacaacattcacgagatcttcgtgtacgaaatgtttctggaactgtttaggtttcccgaacctgtcgctaaagcactgacgaatctatgctgctataacaaatcattggtccagggtgcaaggacctctagttacattgctacactgatcctctggaaggaagaagggcgcatcttcgagcggctctcgcggaaaaatctggtgtacactcggcttattgatgatataacggtgtcttcaaagatcgctaactacaacttcgatgttcccaaaaagcacatcgagaacatgctcctggagattgacttgcctgtgaatgaagacaagtttaagatccagtacaccagcatgaccccccttgaggtacacggcgtgcgcgtgacttattctaagcctagcttcagcaagtccgagatgatgaatattaaagctgccgttcaccatctcgaggtcctagtcaaaactccaaatacacgaaccgagatgtggtaccgaaaggactacaataggtgcatggggcgggttaataagttagccagggtgaagtcccccaggcataagaagcttgtcaaaaagcttaaggtgattagaccactgccgtctttaaaagacctgaactacagcaaaatacgcttgaagaacctgaaagaagacagcaaaaacagcaagaaaatcgcgtcgtattcatactacaagagatacttcttactcatgaatcgcacaaatctcatcaagctgacttatccagataaggccaaagcccttcgaaatgaactgtacaaaattaagccgaagtataatccaaaggacttcaaatga

SEQ ID NO: 10822 - RNA, 1173 nt, unidentified
  source 1..1173: mol_type = other RNA; note = synthetic construct
atggacatcccaaaatataatcaccctccattcgtcgaattggacaagctatgcaagatgctcagaatctctcgaacagagctggaaaatatactgagttccccctccgatgtgcggtacaaggacccaaagactactgcttataaaaaggatggctccattaggaaaattaaatgtccgctgaaagaacttcgctctattcaggagaagatcaacaataacatcttcaagaccgggttttattggcctaagtacttatttggctcaattcctaagaaagcagcactctctaatagggattatgtgagctgtgttagcttgcattgccgcgccaaatcaatctgcaagattgatattagcaacttctttgacaacgtgcacatctctctagtcaaatccgtgttcaagaatctgtgccacttttcggatgaggttacagatgtgctggctgatctgtgttgttacaatgatttcctggttcaaggagcgctgacaagctcatatctcgccaccttgattctgtgggacaaggaacccgaactggtggagaatctcaaaaaaaaggggctcgtctacactcggctcgtggacgacataacgatcagtagcagaatttccaactacaactttgatatcgccaccaagcgggtggaagtgatgctgctggagaaagaccttcccatcaacaagtctaagtacgagtataactacctctccatagagcccttaaccgtacacggcctcagagtctcatttgacaaaccgaaactgcccaaacacgagagcagcaacatccgggcatctgtgaaaaacttggagaatcttgcccagctggacagtgcccgtaccaaaatgtggttcaggacagactacaatcgatgcatgggtagggtaaataagctggctagagtcaagaaccagaagcatcaggcgttagtagaacgtttgaaggttatagaaccacttccctcaataaacgacattaagtatgccagactgaggctcaagaatctggaagctgattactccaccaaaaagaaaacgttcaattacaagaagcgctactataaactaaaccaacggatccatcttatcagtaagacttatcctgatgtcgcaaaaaagattcgcgagagccttaaagaggtgcccccagacgagaagcctatctga

SEQ ID NO: 10823 - RNA, 1176 nt, unidentified
  source 1..1176: mol_type = other RNA; note = synthetic construct
atggactctaatctttatcgagacaatcctatcaatagcatccgcaatctccttgccgctttggatatttccgagtcggaatatgaaaagtttctgatcaccaaggaagaggatcgctaccatcggccacatgcagaggcctttaagaaggatggatctgttcgcaaggtgtactgcccatgtaagctcaccagaaaattccaaaggagactgaacaacaggattttcaagaagagtatagtgtggccaccgtacgtctttgggagcattcccatagatgtgaagacacatgagtcgaaagattatatcaagtgtgctgctatgcactgcaagtccaaaagtcttctcaaactggatatcagcgatttcttcgacaacattgatcagtaccacgtggtgaaaatctttactgaggctttttcataccaccaggaagtggcagacttcatttccaaaatctgctgtttcaaaggccatctcgtgcagggcgcattgacgtctagttatgtcgcaaatctcattttctacgacttggaacctgagctggtcaaaagtttgtcccggaaaaacctaacatatactaggttcatagacgacatcaccgtatcttctaaggtgagccactataacttttcctccacaaagagactgatcgaggacatgctgttaaaaaaaaacctccccctgaatgagcaaaaagtggaagtactctactcatcaaccaagcctctgatggtccacgggctgcgggttgacttcagcgagccgagactaccaagtaaggaggttgccaacattcgagcggagctgaataacctgaagcggaaggccaaagaaaaaaagtaccgtaagtctcggtcctaccgtaaatcatacgacaaatgtctgggaagggtgaataaactggcgagggtcaagcacagcgcccatgccaagtttaagcctcagctcaaagaaatacagccattaccctcagccgttgatatcaaactgtgccacgtaatacttaaaaagttggctagctttcccgatgacaagagagagtcttattggtataagaagcgcttcaaccagttagtctaccttaacggtattatcaagcgcctgtaccctaagagctattccatcattaaagagaaatccaaggaactagaacccaagagccgagtgtattga

SEQ ID NO: 10824 - RNA, 1185 nt, unidentified
  source 1..1185: mol_type = other RNA; note = synthetic construct
atggaaattaagtattaccgcggcgacccaatcaagaagctcgagaattttatctcctttttagatctggaggatgattacgaggcattcatatcttccaattccagcagtcggtaccgtgagccggttaagtctgcctataaatctgatggctcaaaacgcagggtcctatgcccaaacaaactgacaaggaaattccagagaaggatcaacaatcggttctttaagccgaaaattatctggccagagttcgtgtacggctccattcccaagcttataaatgggatagaagactctagggaccatattaagtgtgctgaaaagcattgtggtgccaagtcactgctgaaaatggatatctcggacttcttcgacaatatacacaaggaacacattaaggacatactcgtgaatacgcttgacctgagcaacgaagtagccgactttatttgcgatgtttgttgcttcgagaataccttagtgcagggggcccttaccagcagctatgtcgcaaacctgatttttttcgacctcgaacatttgttggttaagaggcttgagagaaaaggactgacttatacacgctttatcgacgatatctcagtgagctctactgcttcaaactttaactttaacacagccaagaagcttatcgaggacatgctgctccaaaaagacctgcctattaatgagcaaaaggaggaagtaagttacagcagtataaaacctctgatggtgcacggactgcgagtcgagttcgatcagccccgcctgcccgctaaggagatcgctaagatccgggcagaagtgcacgcattgaccaaaaaagcccaggaaaacaattttagaaagtcacgaagttaccggagatcctttgatcggtgtctcggacgcatccacaaattggccagagtcaagcatcccaagcacgggtactttaaaaacgcgctgtctgatattcagcccttaccttccgcggtggacatcaaacattgcttcttcattatcaagaagctagagacttatcctgatagctatagggagaaatactggtataagaaacggttcaacctcgtcgtgtacatgaacggcattatcaagcgactgtataaagataagtacaccgagatctccgagagactcaaagaaattgaaccaaaggaccgtaaatacgacatcggctga

SEQ ID NO: 10825 - RNA, 1164 nt, unidentified
  source 1..1164: mol_type = other RNA; note = synthetic construct
atggactactgtaaatatcccaaagcccctatcctctcaatcaaaaaactgtgcttgcatctcggcgtggccgagagcaatctcaagaaggcacttttgattccccataacttgcgatacaaagatccatcaagtccggcttataagaaggatgggtctagaaggctcatcaagagtccaaaagatcctattcgcacaattcagagaaagttaaacagtaggctattctctcacgttaagtgggcctcctacctgtacggcagcatacctaaggggaaaaatggagacatcaaggattacattggtgctgccaaggtgcactgccaggcgaagagcatctgcaaattggatatcagcgacttttttaacaacatagcagagccccacgtcatcgagatgttcaggctgttcttccggtttagcgagacagtgtcaaaggatttagctaatgtggtcacttataaaggcaatctggtacagggggcactgacgtcctcttacctggccatgctgctcttctgggacctggaacctcaacttgtgtcgagactgaaaagcaagggtgtaaaatataccaggctggttgacgacataacactgtcctctgaagtgcacaattttgactttaagctctctatccgtctggttgaagaaatgttagcaaaaaaggaccttcacctaaatgaagtgaaggtcaaaagctcctatatttcaaccgagcttcttctggtccatggcctcaacattaacaatgacaccccctgccttccaaagggagagctgcgcaaagtacgggccgcggtgcataacctctgttcagaggctgatgaggagattcggaaggaatactggtatcgcaaggaatttgagaagtgtttgggccgagtccataagctgaagtcttttgggaaaactcggagcttcaacaatctcatgaacaagttgaatcgagttaagccactggcctccaaacaagacctgaaatacgctatgaagagagtggcctcgctgaagcgcgattacaagaaccgtaggaaacggagttccttcacctacagaaaaaggtatttcatcgcacagtataaggtgggattcctgaaggacgattacagtctagaacacaacctcttacgctccgagctgaaaagagtgaaaccgaaatga

SEQ ID NO: 10826 - RNA, 1113 nt, unidentified
  source 1..1113: mol_type = other RNA; note = synthetic construct
atgagtctgcacctgggtgttcagacgagtgacattaataaagcgctgcttattcccgctgattctaggtataaggatcctagcagcccggcatacaagaaggatgggaccaagcgcttgatcaaaagccctcgggatcccattaggaccctacagcgtaagatcaacacaacccttttctgtcatcttaaatgggccaactacctctatggcagtattcctaagggcaaagagggcgatgtgaaagactatataaacgccgctgcaattcattgtcagagaaagtccatatgtaaactggacatagctgactacttcaataacatcacagagcaccacgtgaacaatctgtttaacgacttctttcgcttttcagaagacgttagtaaagtcctgaccgatattgtctcgtataaatctaatcttgtgcaaggagccctgacttcctcctatcttgcaatgctgttgttctgggacctcgagccacaactcgtcactagattgaaatacaaaggcataaagtacacacgattggtggacgatatcactttatcttccaatgttcatgacttcgatttctccttagccatcaagctggtggaggatatgctcaaggagaaggatctgcacttgaatcaggtgaagattcagtcttcatctatctctacacagctgctactggtgcacggcctcaatatcaataataagctgccatgcctcccaaagggagagttaaagaggatccgggctgccgtccattccatctcctgcgtgaccgacgaaaagatgagacgggaaaactggtttaggaaggattatgaaaagtgcttggggagggtctacaagctcaaatcattcggtaagaacaagagcttcaacaacctcatcaacaaactaaataaggtacggcctctggcctcaagcaaggacctgaagtatgctaaaaaaagagtgcagagcctgaagtcagactataaacgcggaaaaaaaaaggagagctttgcctaccgcaaacgttactttttcgcacaatacaagatcgggttcctcaaggtagaatttccccaggcgtactttattctgcgaagtgagcttaaaaaagtgaaaccctga

SEQ ID NO: 10827 - RNA, 1182 nt, unidentified
  source 1..1182: mol_type = other RNA; note = synthetic construct
atggacagatgttcctacattaattcaccaatcagctctttgtcctctctgtctaagaccctgggagaggatatctcgcaaatcgtggcagttgcagacgcccccgcgtcagagaagtacaataaacccaagacaccggtgttcaaaaaagataaaaccgagcgcattgtcaggtccccagttagggctcttcggagtttacagtatcgcattaacaagcaaatcatggtgaagggcgtgagctggccttcttatctatttggctccattcccaaaggacacaatggtgaagtctcacaggactatatcgccgccgctaaagtccactgtggggcaaagtctctctgctgccttgatattagcgacttctttgataacattcacgcttgtgatgtgtttgccgtctttaacgaactgtttcactttagcactgaagtcagtaccatcctcaccaagctggtaactttcgatgagcgacttgttcagggggcgctcactagttcatacctggccatgttggtactatggaagactgaacctggccttgtggaggctctcggacggaagaatatcaactactctagactggtggacgacattacactcagcaccaaaaagtacaattataacttctcgtacgaggtgtcactgatagaaaagacactgcatgaaaaggggctcttcttcaacgaggagaaagccaaggtttatagtgtctccagcgagctaatgttagttcatgggttgaacgtgatgggaaaaaatccagcaatgccaaggtatgaagctcgtagaatacgggccgccgtaagacagttggagaaactggcagaacaggagggcgccaggtgcgagatgtggtacaggcgagaatacaatcgctgccagggtagggtgtataagctggagcggtttggcaaaagcaactccttccgtaacctgctcaatcggctgcagaagatcacgcctttacccagtaaaaaggacataacgtacgccaaactgagagtcaaaaagcttgaaagcgacttcaacaatgtgaagaagcgcgagacatataactatatgcgacgcttttccatagcgtcccatagagtggcattcctgaaaggttactacgatgaagagtggaagaagctgaggacccgtttgaaggctatcttccctgactaccggaaatga

SEQ ID NO: 10828 - RNA, 1206 nt, unidentified
  source 1..1206: mol_type = other RNA; note = synthetic construct
atgaccactcctgacatccccttgtttaaggctggtccaattaagtcaaaggcccatctggcaaaagttctcaacattgacattagcgacattgacgatgtcttgaatatgcctttagataagcggtatagacctcccaaaaacccaatcctgaaatcagacggaacgatcagaaaaatttttaaccctcaccgcaaggtgcgctttctacagcgacgtatcaataatcggataaacaagcagtgtatcagatggcccagctacatatatggatccatcccgaagtctattgaaaatgggaacagggactatgtagaatgcgcccacaaacattgcggcgctaaatcgattcttaaggtggacatcagcaatttcttcgataacatccaggagttccacgtcaagaatatgtttaagaatctcttccgctacagcgatgaggtgagtgagattatcacaaatatatgctgttacggggatcgtgtggtgcagggggcccttacctcttcatacattgcctctttgatcctgtgggacgttgagctctatctcgtaaggaagctaaagcggctgaacctgacatatactaggctggtggatgacatcaccgtcagcagtacatctcataactttgatttcaatggaacctcaaagctgattgaggagatgctgaatgagaagggtctgcctcagaacatagataagactcgggtgtatcgtctgagtagtgagcccctcaaggtgcacgggctcgtggtttccttcccgaatccaatttactccaaagacgaagtgaagaatatccgcgctgccgtacatcagttgaaacatagagctgaaaaacaggaagatcagaaaagcaaatcttatagaaacgactaccaaaggatccttggccgagttaacaagctgtccagagtcaagaacgacaaacacgcaaagcttatcaagattttacggtccgatggcctccgaccaaagccatcccagtctgacaaaataagcgcagagaaaaggttcgataaaatagtcatcgactatagtcggaagaagtcacaatacaacttctacaaaaggtaccactacttaaagcacctgctgttctttatcaaaggagaaggcggcagcgattacaaaaaatttgcgcaagacaagcttgacaaactgtcccgctatgaacccgagtttaaaattaaggattactga

SEQ ID NO: 10829 - RNA, 1026 nt, unidentified
  source 1..1026: mol_type = other RNA; note = synthetic construct
atggacaacattaagccgatctttcaggcaggccccatcaagtctatttcccggctggtgacagctctcggaatcaccttaagcgaactggaacacgtgctgcatctttccccaaatgagcgatattccgacctaaagaatccaatctacaagaaagatggaagcgtcagggtaattaagaaccccaatagagatatcaggaaaattcagttcagattgaaccaacggattagtaaagcttgtgtgagatggcctgattatctgttcggatcaattcctaaaaccgatcagtctggcaaccgggactacgttgcctgcgcgcaggttcattgcggcgctaaatcgatcctaaagctagacgtcagtagttttttcgacagcatacacaaggatcacgtctacagcctgtttcacggtctgttcaggtactcagaagaggtgtctctgtgcctcgccaatatctgttgttacgaggaccatctcgtgcagggagcactcacgagttcctacatcgcgactctgattttgtgggacgtcgagcaggaattggtgcgcaagcttagacgagcaggcctgaaatacactcgacttgtggatgacataaccatatcatctacgtgccatggttatgatttctcaatggctgagaagctcgtttttgacatgctggccgccaagtcgctgagccttaacgtgaaaaagagtgtcgtatataggactgggaccgagtctttgaaggttcacgggcttgaggtgagcttctctaagcccaatctgccaaagtccgaggtgaagaaaatccgtgccgcagtccatcaaattagcctgctcgccaaaaacaaaagcgtgcgcaggacctacaagtatcgggctaattatcaccggacactcgggcgtgtgaataaactcgccaggttagaaaacgacaagcgcgaccgctttttaaaagtactgttgtccacatccgttagacccctgcctagtggccgcgatactgggagagattcaacactgtgtataatctga

SEQ ID NO: 10830 - RNA, 1176 nt, unidentified
  source 1..1176: mol_type = other RNA; note = synthetic construct
atgaataccaaattcgaatttctgggaagccctatcaaagatatcgatcacttggctaaaattctggatgtggacattgaggacatactctatgcggtacagattgaggacgaggataaatattcttctcgaaccatcgctaaaaaagacggcagagaaaggaccgtgtacaatcccaaaccaattttcagaaagattcagagacgcattaagaatagaatattctcccagatcagttggcccgattttgtcttcggctcaattccagcggacgacaacagccacgatttcatcgaatgtgcacaacaacactgtctagcccagtctatactgaagcttgacatagaggactttttcgataatatctctcaggagctggtagaaagcatctttaaaaagttctttcggtaccctgatccagtctccgagatactggccactttatgctgcgtggacctcaaggtcccgcagggtggaattacatcaagttacctggcatcaattgcacttcatagcttagaagaaaaccttttccttcggatgaagtcaaaaaagttaacctatacacgctatgtcgacgatatcactatctcctccaagaacagagactttaacttcgaggctatcataaacattgttgagtccttgctcaacaatctgaatctgcccctgaacaagaagaaaatcgagattaataggttctcctcgatccccctgactgttcacaatatacgtgtggattttaagtcgccaaggtacgacaaaacagaagttaagaacattcgggctgccattcatcgcttgtctgaactagccaagaagcctaatcatcgaacacactactattatcggatcgactttaataggtgccagggcctcatcagcaaactgcaacgggtgaaccatcagagttatacgaagctccaaaacaagctgaataaaatctatcctttgcccaacgacagcgacatcaaatacatcgagaagagtattaaggagctgaaagtgttctttccgaagcagattggggaagggaactacatttacaacaagaagttcttcaagatccagcataggatcggttttctcaaatctcaccctaaaaagatctacgatagcaaagcctttgatctgaacgccgagctccagctttaccgtatccgcaataaggtgtga

SEQ ID NO: 10831 - RNA, 1173 nt, unidentified
  source 1..1173: mol_type = other RNA; note = synthetic construct
atgaacactaagttcgaatttttgggttcacccattaaagatatcgaccatttggcagagatcctcgatctagacattaatgatatactattcgctgcccagctggatgatgcagatagatatacctctcgttcaatagcgaaacccgatgggcgggagcgcattgtctataatccaaagcccattttccggaaaattcagcgaaggattaaaaataggctgttcacacagatctcctggcctgactttgtttttggaagtatcccagcagatgaaaagtctcacgacttcatcgagtgtgcccagcagcactgcctcgcacaatccgtactcaagctggacatcgaagacttcttcgacaatattactatgaggctggtacaggacatctttgaaatattcttccattaccctgaggacgtgagcgaaatactggctcagctgtgctgtgtggatctgaaagtgccacaaggcggaatcacttccagctacctggcctcgattgctctgttttctctggaggaaaagcttttcctgagattgaagtccaagaagttaacatatacgaggtatgtcgatgacatcaccatctcttccaaaaaccgcgactttaactacgacagcatcattaatattgtggagaacctgttaaacagcatcaatttgccactcaacaagaagaagattgaggtgaaccggttcagcagcacacctttgaaggttcacaatatccgcatagactttaaagaaccgaaatacgacaagtccgaggtgaagaatattcgcgcggccatccaccgactttcagagctcgccaaaaagcccaaccatcgaacacactacttttataggattgacttcaatcgttgccaaggtttagtttctaaacttagacgggtgaaccatcccagttatctgaaactccaggataggctcaacaagattgctcctataccaaataacgccgatgtcaaatacatcaagaactcaatcatcgagctgataaagtactttccgcaacagaaaggagaaggcagttacgtctacaacaagagattctttaaaacccagagccggatcgggtttctgaagagtcaccctaagaaaatctacaataatcttgccgtgcagctcaacaccgagcttcagctatatagaatgcgcggcaaatga

SEQ ID NO: 10832 - RNA, 1200 nt, unidentified
  source 1..1200: mol_type = other RNA; note = synthetic construct
atgaatgagctcaccaaaattatctacaaggggggtccaatttccaggtctgagctatctactgtgttaggagtggacgaaatcgagttggattttattctcatgctggaagacgaggccaagtacaaaagtagccagctagtgaaaaatgatgggaggttccgaaatattaataatccatcccccattgtcagaaagatccaacgcaagataaagaaccggatcttcagtttgatctcctggccagtctatctgtatggctcgatacccgctgagaatgaaaactcacatgatttcatcgcgtgcgcctcccgacattgtcgggccaagtctctcgtgaaacttgatgttgaggattttttcgacaacatatcacaggagcttgtacaaaagatcttcgagaatgttatgttctttgacaaggatgctgcagataccctagctaaaatttgttgcctggacggcagagtgcctcaagggggaatcacatcaagttacctggcaaccttggccctgtacagcattgaggagagactctattttcggctcaaaaacaagaaactcgtctatacacgctatgtcgacgacattacgatttcaagcaaggaccgtgatttctccttcgacatgattatcaagatcattgaaaaggaactgaactctttagaccttcccttaaacaaagacaaggtggaaatttgtcggtttggtctggaacctttgaaagtccacaacgttcgcgtggattctaaactgcccaggtatgatcaggccgacgtaaaaaggatcaaagctatggtgcaccgattggagctgctggtgaaaaaacctaattaccgcactcactatttttaccggcaggattataatagttgcatgggattcatcaacaaactgggccgcgttgagcatccgtcctactttaaactcaagaacaagctcaagaagatctttccactgccgaataacgcggatgtaacatacgtgaggaatagcatcgacaacttgaaggaacttaagcttaatagcaagaatgcatttgtgtaccagaagaagttctacaagatacagtaccgtatagccctgctcaagaaacaccctaaaggcatctataacgcaaaagccgtcgaactgaacagggagctgcagctgctgagactgaacgacgaacttgagagaaagaccgaaagcggcaactga

SEQ ID NO: 10833 - RNA, 1179 nt, unidentified
  source 1..1179: mol_type = other RNA; note = synthetic construct
atgataaagtccaagtacatatacaaaggaagcaagattgactctctagataagctgtcagaagtcttgtctatcgatattgatgagcttactaacgttcttctgctggaagatgaggctaagtataaggccggattcatcaaaaaaagcaatggcaagctgcggaacatttataatcctaatacctctctccggaagatccaaagacgcatcaagaatcgaatatttacccagcaaatcgagtggcccgattatatttttggcagtattccagcagatgaaatttcttcaaacgattacgtggcatcggccgagaaacactgtggcgcacgtgctctgctaaaactcgacattgaggacttctttgacaacatcacacaagagctggttgagaagatcttcaagaacttcttcaagtacaatgacgagctctccaaaatactagctcagctgtgctgcgtcgatggcaaagttccccagggaggcattacctcctcctatatcgccagcctggcgttgttttctattgaagagcgcctctttttccggctcaaaaacaaaaagctgatctatacgagatacattgatgacattaccatcagcagtaaaaattccgagtacaatttcgactccatcattaaaattgtggaagggcagttgaatagcatcgacctgcccttaaacatcgacaaaatcaaagtggaaaggttcagcagtaaggcgctcaaagtacataacatacgtgtggatctgaagacacccaagttcgacaaaatagaagtgaaaaacatcagggccgccattcacagactcgaacagttagtcaaaaagccgaattatcgcactcactacttctacagaattgattttaaccgatgtcaaggtctggtgtctaaattgtccagggtcaatcacgtgtcagtagaaaagttgcagaggaagttaaacgcaatcaagccacttcctaacaaggccgacatcaagtttatcgaggacagtattaagtcacttaaaaagcacttcccactgcagaaggagaatgggagctttatatacaaccgcaagttctttaagatccagcataggatcgggtttctcaaatcacatcctaagggtatctatactgaaaaagctatcagccttaatacagagctgcagaaatacagactgatacggtga

SEQ ID NO: 10834 - RNA, 1185 nt, unidentified
  source 1..1185: mol_type = other RNA; note = synthetic construct
atgaataacgtcaactttgtgtaccggagcaagaagttccaaaagttcttagatctggctaagagattggatttgagcgcagcggaaattctgaagataagcaagattccagattctgagaaatacgaaacagatgagatagaaaagtcagatgggcgcattaggaaaattcataagccttgcgctgacatccggaagatacagagacggatcaataagaggatttttaatgccgtgatctggcccaactacatttatggtagcatccctgcaaacaaactgaacaacgaaaacaaagactatgtggagtgcgcaagcatgcattgtcaagcaagaacgatcctgaagctcgatattgaagatttcttcgacaatgtgtctgaggatctcgtgtacaggatctttaataagctctttggtttttcagagaaggtcagtctcgttctagcccgaatctgcaccgtcgacggagcattacctcagggaggcctgaccagcagttatctcgcttcactcgccctttttgaaatcgagtccaatatatactcccggctgaagaacaagaaactgacatacacaagatatgtggatgatatcaccatttccagcaagaaagacaattttaacttccagtctaccatcaacatactagaagttgccttaaactccattgacttgcctctcaatcaggctaagattaacgtttcaaacttctcctccgagcttctgcgcgtccacaatattagggtggaccagtctaaacccagactggacaaagccgaagtggtaaagataaaggacaatgtaagtaggcttaaagagattgcctttgacaaaaaacagcccaatatccgcacttactacttctacagagaggattttaatcgctgtctgggccttattaataaattggggagggtgaatcacccctcgtatgagaagctcaacaaggccctgatgaaaatatacccaatcccaaacctgtctgacatccagtacgtccgtgacagtatcaacaaactgaaaaacttgtatccggcgtacatgaattcgtacatctatcgaaaacttttcttccggatccaacatcgcattggcttcatcaaaaagcacaagatctatgagaagactgctcgtaacctgaatctagaactgcagaagtatcgagccatgtatgagaaatga

SEQ ID NO: 10835 - RNA, 1197 nt, unidentified
  source 1..1197: mol_type = other RNA; note = synthetic construct
atgacaatacctgacaagtacctgttcaagttaaataccacgaataagatctcgtctctcaataatctagcctccgcactgggagtgactttgagtgatctgaagtatgccgcaaacctccccgacaataaaaagtacgagcacttctttatcaagaagtccgatgggagggagaggttgatccacaaaccttgcaaggaaatcaggaatatacagcgcaggatcaaccaccgaatctttaaaccactggtgatttggcctgtgtatctgtttggctctgtccccagtgaaaaacatgagcccgcacatgactatattaactgcgccaagaggcattgtctcagtaagtctgtactgaaactggatattaaggacttcttcgataatatcgacgaaagcctagtcaaaaaaatcttccgcgagttcttcaaatacagtgaatctgtcgttaatatcctcacaaagatttgttgcgtgaacgggcatgttcctcagggtgcgcttacctcatcttatattgcttcactgtgcctcttttcgatcgagccactgttagcccagcggctgaacaataagaatctccggtacaccagatacgtggacgacataaccatttccactacgaaacacaaatttgatttcaacgctaccatcaatatcgtggagaacctcctgaattcagtggacctgccgcttaacatcgagaagattaagaccgaatacttttcaacagagccattaaaagtgcataaccttaggatcgactttaacaaaccaagatacgacaaaagcgaaacaaagaacctgcgggctgccattaaccgtctttccatacaaaagaagattcccaattaccgcagccactatttttatcgtagcgattataaccgatgtgtaggattgatcaacaaaatcagccgggttaataatccctgttccaaccgcttcttcaagaagatcaaaaaaattaagcccctgcctaacccaaacgatcttgagtacgtcagaaagagcattttcgaactgattcgggattccctgactcacaaaaatacataccggtacagaaaaaagttctttagaactcagcagcgactgatctttattagaagccacccgcaatatatatatgagggctctgccaatgctttgaacatactcctacagaagtatcgcttgaactacgaggaaaagtga

SEQ ID NO: 10836 - RNA, 1197 nt, unidentified
  source 1..1197: mol_type = other RNA; note = synthetic construct
atgtctttaccagaaaactacctgtttcggttgaacacagctaataagatttcctccctgaacaatttggccaaggccctcggtgtgcaagtcagctacctacgcaagattgctgatttgcccgatgagaagaagtacgaggtattctccataaagaaaaatgacggcagagagcggctgatccataagccctgcaaagaaattcggaacattcaacgcaggattaaccacagaatatttaagcccctcattatctggccgacctttctgtatgggtctattcctgccgagaaggaggagccagtgaacgattacattaattgtgccaaaaaacactgcctgagtaagagtgttctgaagcttgacatcaaggacttttttgataacatcgatgaggcgctggtgaaaaacatcttccgagactttttcaagtacagcgaggccgtctctaatctgctcaccaaaatctgctgtgtcaatggacacgtcccacagggcgcattaacatcaagttatattgctagcctttgtctttattccatagaaccaattctagcacagagactgaacaacaagaagcttaaatacacgcgctatgttgatgacatcactatctctaccaagaaaaacaattacgacttcaatgccaccattaatatagttgaaggggctctcaatagcattgatttgcctctgaacatcgagaagatcaaagtggaatatttcagtactaagcccatcaaagtgcacaatctgaggattgacttcaaaacacctcgatacgataaagacgaagcacggaagataagatccgcgatcgataggctggtgaaacagaaggaaatccctaactatcggtcacattatttctatcgtgccgattataatcgctgcatcggattgataaacaaaatcaatcggctaaagcaccccagcagcaaaaactttctcaagaagatccttagaatcaaaccattaccgaatcctaatgacctggactatgtaaggcgctccatctttgagctctcgagagactacgctattatgaagaacagctatcagtaccgcaagaaattcttcaggatccagcaacgtctcattttcataaggtcacatcctcagatgatctacgaaaactctgcacaggtgctgaattcaattctccagaaataccgacccctgtacgaggagaaatga

SEQ ID NO: 10837 - RNA, 1176 nt, unidentified
  source 1..1176: mol_type = other RNA; note = synthetic construct
atggatgagctcaaggtgcgccttaaggatggcgtcgacccaatccagtcagtggacaatctgtgtagtgccctggacattcctagatccgaattagacgaggtgttggctctctcagacgatgaaaggtatattgagatctccctgccaaagtctaacggttctcgccgcctcgtgtatgaccctcaccccagactgagacgtatacaacggaggatcaaaagccggcttctggtgagtcagattctgtacccccgatatttatatggcagtctttctgacagtgaatacccgcgggactacattagatgtgcatccattcactgcggggctaaagtcctgcttaaggcggatatcaaaaattttttcgacaacatcagccgtcgacttgtccttgagatatttgagagggtgttccattatccggaggaggtttccgacgtactaagcgatctatgcaccagggcaggcgtggttccccaaggagccagcacttccagctttttggccaacctgtgtctcttgaacgagtggtgcttcgtccgcgatatccagtacgaaaagttgcgctataccaggttagtggatgatatcacaatctcttcaaccacaaccggaaaggacctgtctagatgcatgcgaacactcactgcaatgatagagtcagctgggttcgagctgaatgagaataaaaccggaatcgagcatgtgacaacgaaggcctttagcgttcacggcctcagaattaacaaaccatcgccttgcctgcccagagaagaagtacggcgcatacgggccgacgttcacaacctgaaacggaaagctagtgtgccaaacgcaagagtatctttcgagtatcgtaaactatacgaaagcatctccgggcgtgtgaataagctgaaaaggctgaatcacggccgctacaatgaacttcggaggcagatgaacgccatcctccccttacctagcaccaaggacattaagcgatgtcagattatgctcgccactctggagagggactacgatctgcaccgggactcatacctgtacaagttgcgatattccagactgatccataggctcggtattttgaagcgcatttacctgcatgaagcggctgcaatccgggatgccctccaggatctgaagcctgaatttgtcaatgaagctgattga

SEQ ID NO: 10838 - RNA, 1173 nt, unidentified
  source 1..1173: mol_type = other RNA; note = synthetic construct
atggaagagctgaaagccagaaccaaagatggaattgacccgatccaaaacctcgacaatctgtgtgatgccctgggcatcagccgggaggaattggacacagctttatctctgacggacgaagacaggtacgttgagatcaagcttaggaagaaaaacggatccacccgtatagtctacaaccctcacccaaaactgcgtcgcatccagaggagaataaagaacagaatcctatcgtcacagatcatttacccccactatctgtatgggagcctttccgataaggagaatcctcgagactacattcggtgcgccgcagtgcattgcggcgccaaaaccgtgctcaaggtggacatcagaaactttttcgacaatatatcgcgcgatctggtgtttgaagtcttcaagaccattttacattaccccccagaagtctctgacacactcgccaacttgtgcacacgctgtggagtagtgccacagggcgccagtactagcagttttattgctaacttgtgtctgcttgacgagcatgacctggtgaggaaactttcttacgacagtctgcgctatacccggctaattgatgatattactatcagctccaagactcccaacaaggacttagagaagtggatgagggtgctcaagcgaatgatcgaagactctgattttgaactcaatgaggaaaagtctggtatcgagcacgtggcgttgaaagcattcagtgtgcacggcctgcgcataaatcggagcactccagggctcacaagagaggaggtgaggaagatccgttctgatgtccataacctcaagaataaagcaagcgaacctaatgctagggtatcattcgagtatagacgactgtttgagtccgtttccggcaaagtgaataagttgaaacgcgttaaccaccccaggtacaatatcctgcgcaaacaaatgagagatattctgcctcttccctcaaagaaggatattaaacgatgccagatcatgctcgctacgctggtccgggatcatgccaatcacaacagctcatatttgtacaaggttagacatgcccggctgaggcaccggcttggtattctccggcgcatatatcaccacgaagcagcggctatgagacagaccctacgagggctggagccgaacttctccgacgatacatga

SEQ ID NO: 10839 - RNA, 1173 nt, unidentified
  source 1..1173: mol_type = other RNA; note = synthetic construct
atggatgaattttctcctcatgccaagcctaatattgctcctattcagagtattgccaacctctgcaatgccctcagcttaaccagagaagaatttgattatgcaagctctctcgccactccaaacgggtacatcccgatcgagttaactaagaaggatggcagcaaaaggaccgtttttgatccacaccccgcccttaggcgagttcagcgaagaatcaagaaccgtattttggcgactaatgtggtgtaccctaagttcctatacggcagcctctcagaccctgatcacccgcgggactacgtgaggtgcgcagctatccactgtggagccaaaacaatcgcgaagatagacattagtaatttcttcgacaacatcgattacgaccttacatttcgaatctttgcagacatactgcattatccccgggaggtatctctggcactggcaaacatatgcacccgcgaaggcaccatcccacaaggagccgctacttcttcttttatcgccaatctgtgtctgttcgaggagggtggcttggtggaggggttcacgcgcgagaatctgagatatactaggctggtggatgacattacactatcctccacatcgacacagaaaaacctaacccgccacttttccaaactcgagaagatgctgcaagatgctggatttactctgaacgtcgataaatcagggatcgaacatatcagtaccaaagcattctcccttcatggacttcgcataagccaggcttccccccaactccctagagaagagataagaaagatcagagctgacgttcacaacctgaagcaggaggccgccaaagccaatgctagggtatccttcaattatcgacggcttttcgagtcagtgtcaggcaaggtcaacaaactgaaacgtctggagcacccccgctatcaaacgctgcgggcgcagctcaccgacattaggcccttgcccagcaaaagggatattcgccggtgtcaggtcatgttggcaacactgaaacgggacttcccagaccacagtgaaagctacttatacaagaagcggtatttccgcctcagacatcgagtgggtatcctgagacgtatttacgagagggaggctcagaagattacccaggaactgaaggatttgaagccacggcacgtcgacgaacattga

SEQ ID NO: 10840 - RNA, 1179 nt, unidentified
  source 1..1179: mol_type = other RNA; note = synthetic construct
atggacgagtacgcccctcagaagacaacatctgagtctatctttagcattgataacctgttagccgccctcggactcagcgaagcagaatacaagagtatccaggacttggaggagaagaatcgctacacccctcttcaccttaagaaaaagaatggcgatgaccgcgtggtctttgatcctcaccccctagtgcggaagttccagagaagaatcaagaacagactgtttaaccagatcagatatccaacatatctttatggctcaatttccgatccagaacatccgcgggattacatctcctgtgcacagcgccattgtaaagccaagaccatcctgaagatcgacattacttccttcttcgattttatcgactatgacctcgtctacaaaatcttcaacgagctgttcttctacagcgacgagattagcgaagctctggctaatatatgcacaagggagggggttgtgccccaaggagcgcctacctcctcctttattgctaacctctgtttttttgataccgagggacgtatcgtgaaagggctggaacgacagcaacttagctatacgaggctcacagatgatataactgtgtctagtgccattcaggacaaagatctgaacaaagcgaagtcaacgatagtctcaatgattgagcatgctggcttcaaagttaatgaggctaaaacatctatcgaatctatctccaccaccgcattcaaagtgcacggtttgagggtgaacaaggaaactccgcaactgcccagggatgagatccgcgcaattagggccgccgtgaacaatctaaagattctgagccgagagcctaatgcccgcacatcgttcgactacagaaaaagatacgaatcaattagtggtagagtcaataagttggctaggacggggcatccccggtataagaaacacaggctagaactgaagtccatattgccactgccctcacagaaagacattcggcgatgcctcactatgctttctaccctgatgcgggactatgacgtattttgcagcactccactgtacatgaagcgttaccaccggctccgacaccgtttgatactcttacagcgcgtatataaacatgaggcaaaaaagatctggactgaattaaaggttctgaccccaaccaaaagtaaggccgaacacgagctgtga

SEQ ID NO: 10841 - RNA, 1179 nt, unidentified
  source 1..1179: mol_type = other RNA; note = synthetic construct
atggacgaatacgtgccaaaaaagctgactgacgaatccattttcagtgtggacaacctcatatccgcactcgggatctgtgaggccgattttaaaatcatccaatcgctggaaacaaaagaccgctatactgccatcaacttaaagaagaagaatggggatgatagaattgtctacgatcctcatcctctgatcaggaaaatccaacggcggattaaaaaccgtattttcactcagatccgatatcccaagtacctctatggtagcataagcgatccggattgccccagggactacattagctgtgccagccgccattgtaaggccaagaccattctgaagatcgatatcacgtctttcttcgataatatagactacgacctcgtgtacaagatcttcagagagctctttttttacagcgacgaagtgtccgagactctcgctgggatttgcacaagagaaggcgtggttccacagggcgcgcctaccagttcatttatagcgaatctttgctttttcgacattgagggcggaatcgttaaaggcttggagagacagaacttaaattacacccgcctgactgatgatattacagtcagctcaacgacccaggacaaagacctgaataaagccaaggacaaaattatctctatgatacagaacgccggttttagaataaatgaggacaagacctgcattgaaagtatttcaacaaccgccttcaagatccacggactgcggatcaataaaaatacacctcagctgccacgggatgagatcaagcggatacgagctgcagtaaacaacctgaaaatcctatctaaggagccgaacgcccgtacatccttccactaccgcaagctttatgagtcagtgtctggccgcgtcaacaaattggcaaggaccggacatcccaggtatcacaaacacagacaggatctcagggatatcttgccactgcctagtcaaaaggacattaaaagatgcctagtaatgctttctactctgatgcgggaccacgaaaccttgtgttccagccccttatatatgaagaggtatcaccgtcttcgacatcgcctgatcttgctgcagaggacctacaagcatgaagctaacaagatctggaaaacaattaaggacctgacgcccaccaagtccgctgcagagcacgctctgtga

SEQ ID NO: 10842 - RNA, 1170 nt, unidentified
  source 1..1170: mol_type = other RNA; note = synthetic construct
atggacgagttttcctttagcaaaactaccaatcagtctatctcgaacatagcaaatctggcttacgccttggacgtgtcagaagaactgattgatgaagccttagccctcccaagcgatcagcggtatactccccatcggccagggaacggaaatcggctggtgtacaggcctcatccactgatacggaagattcagcgcaagataaaaaacagaatcctggtcgacctggttaggtacccccgatacctctatgggtcattgcgagatgtgggattcccacgtgactacataagttgtgcgcaggtccactgtctctccaagagcgtcctgaagatcgatatcaccaagtttttcgacaatatttcggcgaacgtggtggaagacatttattccgacttcttcagctttccttttcctgtggccgatgttctggccaacctgtgcacgcacgaagggtgggttcctcagggagcccccacctctagtcatctggcaaatctatgctttttcagagaggagccctcattggtacgccagctgcatagacagggcttgaggtatactaggttaatcgacgacattaccattagttgcgattcctatggctacgacttcacaaaagacgaagagcgggtccgccgcctaattacagagaagggtttcagtgtcaacgaggctaaaacgggcctccactaccagggcaattctaacatcaagatccacgggctgagaattaatttcccgaaacctcaaatgactcaagaggaaagccgcaatatccgtgtggcagtgcaccaggtcgaacagtgggctgcagagccgaactgccgaacctccatcgcttatcgaaaacttttcgagtccacatctggacgggttaacaagctcaagagactctctcatagcaaatatgatcggtaccgaaagcgcctgcaaaagctcctaccactgcccagcaataaagattatgataggtgtattggcctttataatggcgtagtggcagacgctgccaagggtgtgcactcatttcggtactaccgtagatactgtcttctgcagaacaggcttaacttgatccaacgcaccagatcttatagggccgaggccgtgagaatgagggctgtattaaagggacttaaacccacatacaaaaacgatatctga

SEQ ID NO: 10843 - RNA, 1149 nt, unidentified
  source 1..1149: mol_type = other RNA; note = synthetic construct
atggaccagttaaccttcacaaaaaagaccgatcaaagtattggcccctccgccgaaaacctcgctaacgccctgggcatctccccagaagagttggatgaagctttgcagatccccagcgcacagcgctacattccctttacagtctccggcggtactcgcgtcgtatataggacccattctcgtataaagtttatccagcagaagatcaagaaccggattcttgcagactgcattaattatccgaaatacgtgttcggcagcataaaggatcctgattttaaaagagactacgtgaactgtgctgcacaacactgcggggcccgatccctgctcaaggttgacatcgagaagttcttcgataatatttcaatcggaaacgtgaggagaatcttcagggatctgctgcattaccctgatcccgtttgtagcatgttatgcgacctgaccacgcataatgggtatctaccacagggggcaccaaccagctctcacttggctaccctatgttttttcaaggaagagccggacattgtggaacaggcgcaagctcagggattagtgtacacaagacttatggatgatatcacagtatcttcaaagagttatgactatgactttcaccggctcgaacgcctgatccggaatatgattgaaaccaaggacctgaccgtcaacgaaggaaaatccgagacttttcctacggtcagtagcactactctggtgcacggcctgaaaattaataccgagactctgcgcgtttctgataaaacactctccaacattcgagccgccataaaccagcttgagaaggacgcaaagcagcctaacaagagaacgttgagcaattataggaaacggtacgaaagaacaagcgggtcgctgtcagtgctacatagactcggtcaccctaagtacgaaaaataccgccgaaaactccggaggcttaggccacttccctctccctattttctcaataaaacatgggagctgatggagtcaatcgagaacatccaagacatgcgtgagagtgcgatataccgcaagaggttctacatgctgcatcacaagctgaatctggcccagagaactttcaaggccgaggccaaaactatgcgggagcgtttgaaggagatcaaaccaaaatga

SEQ ID NO: 10844 - RNA, 1083 nt, unidentified
  source 1..1083: mol_type = other RNA; note = synthetic construct
atggcccacctgcaggatcttgcccttccttttgacgggcgttacttcgaactgagcaaacccaagcggaacgggggcacgaggatagtgtatgatccacaccctgatctgaaggcaattcagaagaagattaactctcggatcttccgcgctgtgttttaccccagatacctgtatggtgggattcgcgacacgctggatagccgggattatattaaatgcgcgaccgtgcattgcccatctggagtagtcgcacaactggacatcgacggtttcttcgataatatcttgtttcaccagatctatgaggtgttcactgggttcttccattatagcccggacgtcagcaacttgttagctaggatttgtgccaaagacgagtttaacctgccccaaggtgcccccacaagtgttgctctgtccaacctcgtgttctttaacgacgagcctaatctggttcgccatatcctcgactccggagcccgttacactagattcatcgatgatattaccatcagccacccagactcaaagtttcctatcgagaaatacgcgaaagccacaatacgcatcattgaaaggaatggctttaggatcaacgaatctaaatcaggcacactccgagacacaggcctgatagacgtgttcggaattagagttaatggagccattccgaggactccccagaattacagtaagaatctgcggagaaagatctaccagttggaggagctcgcaaaaatcccaaatgagcgaaagcaggaggggtatcgtacctcatggaactccacatccggcagactcgccaaacttaagcggaccagtagtggcaagtatcgaacttaccggaaaaggctgaacaagatcaagcctcttacccatgaaagagaagccaggcgggtgaaggcaaaaacccgacgcatgttggtcgattcacaaaagatacagaatcccgaggcttttaaaaaacgctaccagaagctaatgcacgagattggaagcttaaagtccacttacccagctctaaacacctcgctcaagtctttaatggctcaggtaagagaaaatatggcagaagaatga

SEQ ID NO: 10845 - RNA, 1083 nt, unidentified
  source 1..1083: mol_type = other RNA; note = synthetic construct
atggaacatttggaagcgttggcccagccctttgagggccgttacttcgagatccagaaaccaaaaaagaacggtggaatacgagtggtgtatgatccccacccacacctcaaggctgtgcagaaaaaaattaacagcaggatctttcgaaccgtaacctaccctcgctacctgtatggaggaatcagagatactgccgactcaagagattacatcaagtgcgccacagtccactgtccttctagtgtggtcgtcaagctcgacatagacagctttttcgactccgttctgagccaccaggtgctggatatctttagcgacttcttcaattattctcccgcagtagccgagctcctaactaggctgtgcacaaaagacgattttaaccttccgcagggcgcaccaacctcagtcgccctttcaaatttagtttttttccgggaggaacccgggctcgcaagaggaatcgagggcagcggtgcacgatatacacgattcattgacgatatcaccatcagtcactcggattctaagttcccagttgagaagtacctgaaggctgcgaggcgggtcattaccgagaagggctttgacattaatgaagataagacgcaaactgtgcgggacactgggctgatcgatgtgttcgggattcgggtgaatggagctacacctaaaacccctaagaaatactccaaagagcttagacagaaaatataccgcctggaagaattggccaggatcccgaatgaacggaagcaggaaggttatagagcttcttggcattcaacatccggcagactggctaaactcaagaggaccaacagtgggaaatatcggacgtaccgtcgcaggttagacaagattaagcctctgacacacgagagagaggccagccgtattaaagccaagacccgccgcctgctcaacgactcccaacaaatacataacaaggatgctttccgcaaacggtaccaaaagattatgcatgagatcggccttctaaagtccacttatcccgccctgaatactagtctgaaatctttgatgaagcaggtgagggagaacatggacgcacagtga

SEQ ID NO: 10846 - RNA, 1149 nt, unidentified
  source 1..1149: mol_type = other RNA; note = synthetic construct
atgccactgaacatctcgtactcagcaccgcatcggatagcatcaaagaggaatttggccaaagccctcaacatcggcgacgaagagctggagtatctgattgctcagaaaaaccaccattaccgccagaagagactccctaaaaagtccggtggaactcgaactgtttatgctcccgagagaaatctgaaggcactacagaggaaaatcgtcgcccgcattttccacttggttagattccccccatacctccagggctccatctctgatcccgagaaccaaagggactacattaagtgcgcaacacagcactgtggtgctgtggctgtgagccatatcgacataaagaactttttcgatgggatcgaattcgacagagtggttgacatctttgaaggagtatttctattccgttccgaagtcagcttactgttagcggaactttgcacgctcgatgggtatgtaccacaaggggcccctacaagctcatatatcgcaaacatgatctttttcaaggatgaacccaaaatcgtgaatctggccaataaatctggtattacatacactcgccttgtcgatgacataacaatcagtaccgacgtgaagaatacctgtctgagaaccttgacaaagaaggtgatccgcatgattgagagttacgacttggagattaacgctgataagactaaatccatgatccgggggtctgtgccattgaccgtgcatggaatacgggtagtcgagaaaaaacccaaaattagtcgcgacgaatataggaatattcgtgatgccgtgcacagagtcgttcttgcgtcgagcacccctaactaccggaccaaatttgagtatttcaaactctaccacagggtgtccggccggctgtctaagcttaagaggttagagcatcctggctacactcgacttcgtaataagctgaaaccactgctgccgctccccagcaagggatttaaggctaaggtcaccgaaaagattgagaaactcgagcggaattactctctgagctccagccacgagtggtataagaaagaatggaacgtgacaagttacaagctgggcatagtgggccgaacgtataaaaaggaatcctctgagctgcgcgccaggatcaaggccattagaccttcatga

SEQ ID NO: 10847 - RNA, 1149 nt, unidentified
  source 1..1149: mol_type = other RNA; note = synthetic construct
atgaaaatctccacctacaaacccattaatgtgatagggaatccagctaacctagctgccgccctggatagcagcctggaagagcttggctccttgattgaaaacaaagccaagctgtaccaaaagaaaatcatacccaagaagaacggaaaatctcgtaccgtgtattctgtggaccgtgaactgaagaagatccagaataagatcaacaaccggatctttagcgaagttgagtttgcgtcttacctcttcgggagtataagtgaccctgacctgcccagggattatctcctgtgcgccgaatcacattgtcccagcgctatcattgcaactattgacatcaaggatttcttcgatcacattaccgacgagaaagtggaaaagatcttcagtggcttctttaattttcctgacgacgtcgcagaattgcttacagagctatgtacgtttcaggggagagttccccaaggcgccccgacatcgagctatctcgccaacctgatgtttggaactcaggagaaacgcatcgccaaagctgccaatgaatgcggtgccagatattccagattgttggatgacatcattatttcatcccctcagaagaatttcagtatagataccctgtatcagcgcgtggagcagatgattgtgaatagcggctttcaaataaacgagacaaaatccaaggtagacatccttgggcccaaacctctcgaggtacatggaattgttgtcacaggcaactcccctaaggtgtctaaacttaagtaccaggagatcaggaggctggtgcaccaggtgtcggatctttcaaagaccgataatagaagaacgactcaccgctactataagaagtaccatcgggcatacggcctgttatcaatcttgaaacgagtcaaccatccggcgcacaagaagttaaagagcaagctcacatctgcaccaccactcccttccaacaggttccgcaatagtattttccgccggctctccaaactggagtcaaaacaccaaatccatcagcagcggaaatggttcgcaaaggactggaatcggattagccacgagttaggtattctgcgaaggtcttatccagaggatgctaccaatgctaggaaccgactgaacctgatcactccatacgtctga

SEQ ID NO: 10848 - RNA, 1182 nt, unidentified
  source 1..1182: mol_type = other RNA; note = synthetic construct
atggctaaggacttttcctttaaaaacacgtttacccccattcagaaaaaggaatcattgctggccctgttggggatcagcgacatcgataaatttgagaagctgataagcgatggggtggagaaagcctactatataaagccccctatcgaaaagaagaacggcggacataggatcgtatacgctcctaatcgaatgcttaagtccatactgcggaagattaataacaagatcttctctcagatcaacttcccggattacctgtatgggtccattcctgacaaagaaaacccaagggactatatcttatgtgcccagcaacactgtaaatctaagatcctggtcaaaatggacattgagaactttttcccaacaatgaaatcgaagttcgtgtatcaaatcttcaaggaactcttccgcttttctgatgaagtctcaaatattcttaccacactgactacctacgagggattcgtgccacagggtgcccctactagcacttacctcgcgaacttgtacttttacgattgcgaaccctccaaagttagctatttgcgcaagcttggctttcggtacaccaggctcattgatgacattacaatctctagactgaataaggaagaggactggaagttcgtagagagcgttatatccaacttcattaagcagaaagagctcaccgtcaacaatgagaaaaccaaactattatccgctaaatctccccagagtttcaaggtccacggcctgtgcatcgaggatgaggcacctcgttttagtaagaccgagcgtactaatataaaaacgcaggtccaccaggttgtgagaacagcctatggccgcgatcaaatcagaatgcagcctagtttccacaagaagtacttttcagtgaaaggaaagatcacaaaactcaaaagggtagactgtcccgactatccagtgcttaaaaatctcctgaagaaacattgcgatccgctgccagagcacaaggaaattaaaaggattaaccgggtgatttcaaatctaagcaaggaccatgtgagcatcggacatactgagcgatacaagagtcgctatttccaggtggtgtttagactggacatcctcaagaagttataccccgttgaagcaaatgaattccgggcaagactgcggcaaattggtccaacaaaaaacgagaattga

SEQ ID NO: 10849 - RNA, 987 nt, unidentified
  source 1..987: mol_type = other RNA; note = synthetic construct
atgctcaagagcatactgcggaagattaacaacaagatcttctcccaggtgaatttccctgactacctgtatggctctatccccgataaagaatctcctagggactatattctgtgcgcacagcaacactgtaagtcgaagattttgataaagcttgacatcgagaacttcttccccaccatgaaggataggtttgtatacaaaatcttcaaggagctgttcagatttagcgacgaggtcagttccatattgacaaagctcactacatatgagggctttgtgccgcagggcgccccaacttccacataccttgcgaatctgtacttctacgactgcgagccttcaaaagtccggtacttgcgtgggctaggattcagatacacccgcctgatcgacgatatcactatatcaaggatcaaaaaggaaggggactggaaatttgtcgaaagcattatctccgagtttatcaacaaaaaggagctgaccgttaatgaagagaagacgaaacttcttagtgctgactcaccacaatcctttaaggtgcatggtctgtgtattgaggacaccacccccaggtttaccaagatcgaacgaagcaacatacggacgcaggtttaccaagttgtcaaaactggatatggacacgataaaattcgcatgcagttaagttaccacaagaagtatttctctgtgaaagggaagatcacaaaactcaaaagagtgaactgcccagattatccgttgctgaagaaactcctgaagaaacattgtgatccattacctgaacacaaggaaattaaacggattaatcgcgtgatttcaaatctcagcaaggatcacacaaattttggccataccgagagatataagagcaggtatttccaggtggtattcagactggatattctcaaaaagctgtaccccatcgaggcctctgagtttcgctcccgactacgtcagatcggtcccatcaaaaacgaaaattga

SEQ ID NO: 10850 - RNA, 1182 nt, unidentified
  source 1..1182: mol_type = other RNA; note = synthetic construct
atgccgaagggcttcagctttaaggatactttcacacccatccagcgcaaagagtctctgattgggctactcgggattaaagacatcgaaaaatttgagtcgttgttgagggatggtgtagaaaatgcttactacatcaaaccgccaattaagaaaaaaaacggtggcgaaaggatcgtttatgcacctaatcgtatgctgaagagcatactgcgcaagatcaacaatcgcatcttcaaccagatcaatttccccgactatctttacggatcaattccagataaggagaatccacgagactatatcctgtgcgctcaccagcactgtaaggctaaaatcctgatcaagctggacattgagaatttctttccaaccatgaagacgaagtttgttttcaatatcttcaaggacctcttcaaattctccgacgaggtgtctaacattctcactaaactcactacctatgacggatttgtgcctcagggagcccctaccagcacataccttgcgaatttatacttctatgattgcgagcctaataaagtcaattatctgcgtagtcttggatttcgctatacccggctgattgatgacattactgtgagtcggctgaaaaaagagggggattggaaattcgttgaaaccattatatccgagtttattacccagaaggagttaagcgtgaacaaggataagacgcaactgctatccgcaaactctccccaatcctttaaggtgcatggcttatgcatcgaggaaacaacccccaggttcaccaagaacgagcgaataaatatcaaaacacaggtgaaacgggtggtcaaaacaggctacaacagagacaacataagaatgcagaagaactatcatgacgtctacttctcagtcaagggcaagatcacaaaactgaagagggtaaactgtccagattaccctttgctgaagaaactcttggcaaaacactgtgatccactccctgaacacaaagagataaagcggattaatagagtcatcagtaacttgagcaaagaccatgccacttttgggtcaactgaaagatacaggtccagatactttcaagtgattttccggctggaaatcctgaagaagctttaccccgtggaggccaacgaatttaaggcccgactcaagcttatttctcccataaagaacgaaaattga

SEQ ID NO: 10851 - RNA, 1182 nt, unidentified
  source 1..1182: mol_type = other RNA; note = synthetic construct
atgcccaaggattttagtttcaaggacacttttacccctatccaaaaaaaagaatcactgattgcacttctggggatcaaagacgtggagaaatttaacaacttagtgcgggatggtgtagaacgtagctactatgtaaaaccccccattaagaagaagaatgggggcgagcgtattgtgtatgctcctaataggatgctgaaaaccatattgcggaagataaacaataagatcttcaaccagatcaactacccaaactacttatacggctctattcccgataaagagaacccgcgcgattatattctctgtgcccaacagcattgcaaagccaaaatactcatcaagattgacatcgaaaacttctttccaacaatgaaggcgaaattcgttttcaaactcttcaaagaggtgttcaagttctccgacgaggtgtcggatattcttactaagctcacgacctacgacggatttgtcccacagggagctcctactagtacatatctggccaatctgtattttcacgattgcgaaccaaataaggtgtcttacttacgcagcctgggctttagatacacgagactgatagacgacattacaatctctagattggaaaaggagggcgattggaaatttgtggaggggatcattagcgacttcatcaagcagaaggagctgaccatcaatgacaaaaaaaccaagttgctctccacacactctacacagtcattcaaggtacacggcttgtgtattgaagaaagcagtcccaggtttactaaaaacgagcggctagtcattaagacccaggtgaacagaattgtgaagactggttacgggaatgataaaatcaggatggacaagaactatcataactcctattttagcgtcaagggaaagaccacaaaactgaagagggttaattgccccgactaccctgtcctgaagaagctcctctcacgccactgtgatccgcttcctgaacataaggaaatcaaacgaattaatcgggttatatccaatctgtcaaaggattacgccgtttgcggaaataccgagcgctatctaaggcggtattttcaggtgatcttccgaatcgagatactgaaaaaactttaccctgtcgaggcaaacgaattcaagctgagacttaaactgatctccccaatcaagaacgagaattga

SEQ ID NO: 10852 - RNA, 1173 nt, unidentified
  source 1..1173: mol_type = other RNA; note = synthetic construct
atggcctcctcctttagcttcaaggaaacctttacaccaattcagtccgtgcagagtctgataaatctacttggtgtgaaagacaccgagaagtttgaggatctcatcagaaacggcgccgagacatcgtattacatcaaaccccctataaagaaaaagaacgggggggagaggatcgtgtacgcgcctaataaaatgctcaagtcccttctccgtaaagtcaaccagaaaattttcacccagatcaattacccagattatctcttcggatctataccggataaggaaaatcctcgtgactatatactgtgcgcagagcagcattgcaaagctaaggtgctcattaagatcgacatcgagaatttcttccctaccatgcgggaagagtacgtctataagatcttcaacaagcttctgaagtgcagcgaagaggttgcccagattttgacaaaattaactacctttgacgggtacgttccccagggagctcctacatcaacctatctggccaacctgtatttcttcgatagtgagcccaagaaggtacaacacctaagaaataacggctttcggtacacccgcctgattgatgacattacggtatctagggcaactaaagaaggctcctggaaatacgtggaatctttcatcggggagtttattactcaaaaacacctcagtatcaacaaagataagacgatatcacgctcttccagcagtcctcaacagtttaaagtgcactctctgagtattgagggagaaaagccgaagtttccacggattgagagactgaaaatcaaagaccatgtgcacagggtcgtcaagacaggttacggaaaggacaacgaaaggatgaaaaagagcttccattacctgtattttagcgttagaggcaaaatcactaaattaaagcgcgtggactgttccgattatcccattttcaagaagatgctgaagcgacactgtgatcccctcccagaccataaagaaatcatccgccttaatcgggtgatcagcaacttgtcacgagactttaattctttgggcgagagcgagcggtataagaataggtacttcaaggtcatgttcagattatcgattctgaaaaaactgtacccaaaggaaactaacgaatttaagaagcgattgaagctgatctcacccaaaaagtga

SEQ ID NO: 10853 - RNA, 1191 nt, unidentified
  source 1..1191: mol_type = other RNA; note = synthetic construct
atgcagtccaacaacttcgtcatcaataagaagaacctgccacccatcaaaaacgtcgattccctgattaaacttctgggcgttgacgccggatatctggatttcttgattgagcacggggtggagaagaactactaccggaaagatccgattcccaaaaagaatggaggagaaagaatcgtgtatgctcccaacaagaaactaaagagcctgctgaaaaggatcaacaacaagattttctcccagatctcttttcctcactatttatacggaagcattagtgactctgaacaccccagagactacattcgttgcgcaagtgtgcactgcaaagctaagatcctgataaagatcgacattcaggacttctttccatccatggacagcgttggtgtcaattcgatcttcagcaaattcttcaatttcagcgacgaaatctctcaaatcctgactaaactgacaacctatcatggcatcgtgccccaggggtcacctacatctacctttcttgcgaatctgtatttctacgacgtggagcctagcatcgtctcacacttggagagcgagggttttcgctatacccgactgattgacgacataaccatctccaagagtgagaggggggaatcatacaagtacataaagcctaggatcataaagatgattaccaacaagggcctggtgataaatgagaagaaatgtagcgagcagtcactgaaaagttcccagtcctttaaggtgcacggtttatgcattgaagaagagactccgaagttctctaaaccagagattctgaagattagaggccaagtatttaacatcctcagggttggctattgtaatgataaaatgaggatgtctcgggactttcataagttttacttctccgtaaaggggaaaacaacgaaactcaagcgtgtcaatagcccagaatacacagagttgaagaaactgctcaaaagaaattgtgatcccttgcctgatcatctcgagatcaaacggttgaaccgagttataagtaacctatcgaaggattatgtgcttctccataatagcaagcggtataagtctcgcttttttcatgtgtacttcagactcgtgattttatccaagctttacaaagaggaagccgatgaatttaaaactcggcttaagcgcatccgcccatcatcagatatgtctagtctctga

SEQ ID NO: 10854 - RNA, 1065 nt, unidentified
  source 1..1065: mol_type = other RNA; note = synthetic construct
atgctgacccgcggggtggctagcttctatacagagaaggaaatcaataagaagagtggtggaaagaggttgctgcacgctcctaatcggaaaattaaattcatcctccgcaaggtgaacaacaagatctttaacaaggttctgttcccacactacttatttgggagtattagcgacaaagagaatcctagagattacatcagatgcgccgaggtacactgcaaagcgaagattctgatcaaggtggacatcagtaactttttccccagcattaatacatactccgtgcgagatatctacaaggtgttctttaacttctcggacgaggtcagcgatgttcttactgaattaaccacagtgaatggcacggtcccccaaggagcacctacttctacatttctctccaacctctatttctacaacatagagccacagttggtgaaatatcttgagtctctgggctttcgctacacccggctgatagatgatattaccatctccaagttggacaaaaataacttccggttcgcggacgatcgtgtcaaagccatgatcacgcagaaagggctaactatcaacgaaggaaaatcatccatccagtctaccgtggcagccaaagggtataaggtgcatggcgtctgcatagacgaagacaagccccgctttactaagtccgaatgtatgaagattactgacgaggtgtatcagattgcccgcgtaggttataatagaagcgatgttaggatgaggcagtcttaccacaaagcttattactcagtcaagggcaaaattaccaagctaaaacgtgtgggatatgtgaaatacaatgacctgaggaaggttctcaacaaacactgtgaaccactgccggaccatgatgaaatcaagcggctcaatagagtaatttcaaacattcagagagactataccggcaagcctgcaacagataactataagaggaggtactaccaagcccatttcagactgagcgttcttcggcgcatatacaaggaggaggccaaacagtttcgagctcgactgatctcagtccggcccaatcgttga

SEQ ID NO: 10855 - RNA, 1170 nt, unidentified
  source 1..1170: mol_type = other RNA; note = synthetic construct
atgaataacaggccaacatatcatggcggggtaatttctaatccactgaccctggctagagtgctcgggattgagctggcagatcttctggctatgtcagtggatacagtatcacactacaaggccaaagagatcaacaagaagactgtgggagctggcaagcgcgtcatccatatgccagacgagtccatcaagcggctgctccgaagagtaaacagccgtatttttaacggagtgacctttccggggtatttgtatggttccatttccgatcaggagaatcctagggattatatcaagtgtgccgagttacattgcagagccagtgtgctgatcaaagtggacatcagtaatttcttcagccagataactacagaacacgtgtacaagatctttctcaaattcttcaacttcagtcacgaagtctccgaaatcttatctaaaattaccactgtgacaggctttgttccccagggcgcacccacatcaaccttcatcgctaatttgtgtttttttgaaaccgaagcgtccctggttacgtacctgcacggagctggtttccgctactctagacttattgatgatattacggtcagtaccctcaacaataaattaccttggcagtatgttgaggaccggattgtgaggtttctagacaaagaggggttctctatcaacgccgacaaaaccgaaagcatatctactcctagtgcgcaatcgtttaaggttcatggcctctgcataggcgacgagaaacctagattctccaagaaacatattgatgagatcaagaagagcgtcaattgcgtgcttaagaaagcactctttagcgacaagaatcgaaaagaaaagtcataccacaagctattctattccacacaaggaaagacgactaaactgaagagagtcaagcacaacagctacccaagcctcaaaaaggcccttgggaggtatgcattgcccctgcccgatgaacgtgagtcttaccgcctgaatatagccgtcaagaatttggagcgcgattacccgacattgtcgtcaaagctggcctatcgcaaccggtactacaaagcaaaattccgggtgggtatcctaagcaggatttatcgacgggacgccaccctgctgaacaacaggctgaaagacatccttcccacttacgaggactga

SEQ ID NO: 10856 - RNA, 1188 nt, unidentified
  source 1..1188: mol_type = other RNA; note = synthetic construct
atggataaaccacactacccttgtcggcccatcggaagtgtggacgtcctggccaacactctcggagtccatattcgtagattgaggaatatagcttctaaggtcgattcatcgtacacatcttatgagctgaagccccacccagtgaccaataaagttagaactgtggttgaacccaaacacgagcttaaaaaaatccagaagaagatcaactccaggatttttctgcatgttaactttcccgagtatctgcagggaggcattagagccaccagtcagagcaagcgcgattatatcgagaacgcatcgcgacatggccgcagccagaccctcatcaatttagacgtgaagaacttctacccaaacatcaaagcggacgtggtcagggacatctttaagtacttcttcaagttctccgacgatgtcgtggatatcctgacaactttaacgacttacagggggagtatcccgcaaggagggtgtacctcaagttacctagctaatctggtatttttcaacgacgaataccggattgtgagctcattgagagggcggaaccttcggtatacgcgcttgttggacgatattacaatctcctcagtaaccaccatagacaacaagaccagcgaaaaaattattaaagacatcgccggcatgctgcggaagcggaatctgtctctgaagtcacccaagactaaagtaactgacagatctgaaatgcataaggactttgaggtgacaggtctgtgcgtgcgcgcaagcgaacctaaagtgagaaagaaagatcgacgcctaattcgtctcagcgtctttcaatgcgagtctcaggccaagaccgataggacaagcgatgattaccacaagaattggaataaaacctccgggctggttgctaagcttaagcgactcaatcacagtcaggccaaagattatcgtaagagactggcagagattctcccattgtatgacgagtatcgcgaaagcaaaattgtgaagagggcgtatgctgccctcaaagtgcctgtctcctctcacgagaaaatcggcacaataaggtcctacaacaacctgatataccagctcggtatattaagccgaacaaacaaaaaggtggcaaaaggcctttccaagtccctgaaggaccattactcatctgttcctacgatcgagaatttctgggaaaattga

SEQ ID NO: 10857 - RNA, 1188 nt, unidentified
  source 1..1188: mol_type = other RNA; note = synthetic construct
atggataaaccccactacccatgtcagcctattgggagcattgacgtcctggctaacacacttggcgtgcataagcgtaagctaatctccatcgcttcaaaagtgaatacttcctactctagctatgaacttcctgcacaccctattaccaaaaaggtccgaaccgttgttgaagctaaacacgagctgaaaaagatccagaagcggattaattctcgcatatttctgcacgtgaagtttccagaatacctgcagggtggtattcgggccacagacaaggtaaaacgtgactatatagaaaacgccaccaaacacggcagatcacaaaccctgatcaacttagacgtgaaaaatttctaccccaatatcaaaagcgaagtggtaagggacatctttaagtatttcttcaagttctccgacgaggtcgtcgacatactcaccaccctgacaacctatcggggctgtgttccgcagggaggatgtacgagttcatacctcgccaatttggtgttctttaacgatgagtaccgcttggtcagtagcctccgcggacgccagctacgctatactagactgctggacgacatcactatctcgtctgtgaagaaaatagaccaaaagctgagcgagaagatcattaaggaggttgcgggtatgctgagaaaaaggagcctcagcctgaagtcacctaaaactaaagtttctgataggtccgagatgcacaaagatttcgaggtgacggggttgtgcgtgcgagactcggagcccaaggtgcgcaaaaaagatagaaggcacatcagacagctagtctttaactgcgagcttaaggccgtgaacgatcggacatccgatgagtatcatgctctctggaacaagaccagtggattggtggccaagctgaagcggcttaaacattctcaggcatccgactaccgaaaacgtctcgcggtgattctgccactttacgatcagtaccaggaagggaagattgtgaagagggccaatgcagccttaaaagtacccgttgatctgcattctaagttcggggtgatgcggaggtttaactccctcatctatcaactgggcatcttatcaagaacaaataagtccgtcgcaaagggcctgtcttgcttgctcaagaagcattacagtagcgtaccaagtattaatgatttctgggaaacttga

SEQ ID NO: 10858 - RNA, 1188 nt, unidentified
  source 1..1188: mol_type = other RNA; note = synthetic construct
atggataagcctctgtatccttgcaaaagcataggttccattcaggtcctcgctcagactttgggcgtacatccgaagaaactcgtgagcttggctcggaaggccaatgcgtcttatacttcatacgaactgccaccccatccaaccactcaaaaaattagagtagtcgttgagcccaaacacgagctgaaaaagctgcagaaaaggataaacagccgtattttcatcaatgtcaagttcccaaactacctgcagggtggcttgaaggccacctctaccgtgaagcgagactacatcgcgaatgcctttctccacggcaagagcaaaactttaattaacctggacgtgaagaacttctacccgaacataaagcagaagaacattgtggacatattcaagtacttctttaagttctctgacgaggtggtagacatcctgaccgccctgacaacatataatgggagtcttcctcagggaggctgtacttcaagttaccttgccaaccttgtttttttcaacgaggaatataagcttgtctctagctttcgggggcagaagctgcgctacacaagactattggatgatataacgatctcatccgagaaaactatcatcgacaaagacaaagagaagattatcaaaagggttgccgccatgctgaaaaagcacgggctctcgctcaaaagttcgaaaaccaaagtgactgatcgcagcgagatgcacaaagattttgaagttaccggattatgtgtgagagcaacaacccccaaggcgtctaaaaaagatcggcgctatgtgcgacaactagtccacaattgcgaactgatggcagtgaaggagaagaccagcaatgagtaccacgcactctggaacaagacctccggattagtggcccggctcacacagttgaagcataatgaggctaaagggtttagagagcggctgtccgaaatcctacctgaatacgaccaataccagaaagataaagtcatcaagagggctagagctgcacttaaggtgcccagtacagctcactctgagtggggcacaatccgcaggtataaccgaattatctatcatctgggaattctggcccgcacggacaagaaacaagcacaccgtattaagctcacgctgaagaagcattactcctcaaggccaaccatcaatgaatattgggaatcctga

SEQ ID NO: 10859 - RNA, 1188 nt, unidentified
  source 1..1188: mol_type = other RNA; note = synthetic construct
atggacaagcctttatacccctgtagctccatcggaactttagacgttctgagcaagaccctcggggttcatcctaagaagctgaagagcattgcaagcaaagtgaacgactcttactcaaagtatgaacttccagctcatcctacgacgggcaaagtgcgggaggtgtttgaacctaagcacgaactcaaaaaaatccagaagcgcattaacagccgaatctttgaacacatcatctttcccgaatatcttcaaggcgggatcaaggcaacccccgagattgcccgtgattatatcgccaatgccacaattcacggcaggagtaagactctgattaacctcgatgtccggaacttttatcccaatataaaggagaacgtggtgagcgatatattcaagtacttcttcaagttctcagatgaggtggtagaaattctgacgaagatcaccacttacaatgggtccctgccacagggaggatgcacatccagttaccttgctaacctcgttttttacaacgatgaataccgcttgttctctagtctcaagggaagaggtctaaggtacacccgattgctggacgacattacaatttcatcgccccagttgatcgacaaagagctgtctgtccaactgatcaaagatgtggccgcattactgaggaaaaggaacctgaaccttaagagcaataaaaccaagatcacaaacagaagtgagatacacaaggacttcgaggtcaccggtttgtgtgtcagagcggccaagccgcgcacacggaaaaaagaccgcatgtatgtgagacaactagttttcaattgcgagaagatggcggtcgagtctaaatctagtgaggagtttcataaactgtggaataagaccagcggcctgattgcaaagctggacaggctgaagaaatcacacgctaaagattaccggaaaagactatccgtgatcctgccgatttacgatcagtatcaggagaataagattatcaaacgttccaagcgagctctcaaggtaccaatcacttcccattcgcagtggggtactatacagcagtataataacctcatctaccagctcggcattcttgggcggaccaagaaaggccttgccaaaaatttgcgcaaatctctgaaactgcactattcctcagtgccaacaataaataaattctgggaacaatga

SEQ ID NO: 10860 - RNA, 1188 nt, unidentified
  source 1..1188: mol_type = other RNA; note = synthetic construct
atggataagcctctttatccctgcaaacccattgggagtatcgaagtgctcgccaagactctcggcattcacacatcgaaactgcagtctattagtaagaagatagaggaaagctatacgcctcataccttgaagccaaatagctcaacaggtaaagtacgatcagtgttcgatccaaaatttgagctcaagaagttacagaagcgcataaattcccggatcttcgaaaacattaagttccctgagtacctgcagggcggactgaaggccacggcttcctgcaaaagagactatgtggagaatgccgaaattcacggtcggagtaaaaccctgatcaacctcgatgttaaagatttctaccccaatatcaaggttgacaccgtgcgtgatatcttcaagaacttttttcgcttctctgacgacgtcgtagacatactgactgtaatcaccacctatagaggatgccttccgcaggggggatgtacctcttcatatctggctaatctggtgttttacaacaacgaatacaggcttttcagctctctgaggggccgaggtttgcggtacacgagactgctagacgatattaccataagcagcaagactgctattgacaacaaagtccgcgaaaaggctatcaaagacgtcgcagccatgctgaagaagaagaatcttcgcttaaagtcctccaaaaccaagattacagatagaacagagatgcacaaagatttcgaggtgactggcctctgtgtgcgtagtaggctgccaaacatcccgaagaaggaaagaaagtatatccggcaattggtgtttaattgtgaaaaaatcggacgcaatgacaagacaagcaaagagtaccattctctgtggaacaaaactagtgggttagtgactcggctggggcggcttggaaatacacaagcctctgattataggtcaaggctctccgaggtcctacctgaatacgacgagtatgaagaggcaaagctggtgaagaggtcaaacgcggccctgaaagttccccagtccgagcacctcaaatggggcgtgattaagcgatacaacatcattatctaccacctgggcatcttgacaagaactaaaaccctgttggcacgtaatctacgcaacaaattgaaggagcattacagcctcgtcccatccgttaaagacttttgggagaaatga

SEQ ID NO: 10861 - RNA, 1188 nt, unidentified
  source 1..1188: mol_type = other RNA; note = synthetic construct
atggacaaaccactctatccttgcaagcccatcggtagcattcatgtgttggccaatactctcggcgtacaccccttgaaactgaaatcaatcgccaataaagccgaatccagttacacctcctacaatcttaagcagcacccgaccaccggaaaggttaggacagtgtgtgatcctaaacatgagttgaagaagatccagaaaaggttaaactccaggattttcgctaaagtggaatttcccccatatgtgcagggggggatcaaggccactattgactctaaacgtgactatatcgaaaacgccaccattcatggacgatctcagacacttataaacctggacgtcaaaaatttctatcccaatgtgaaggccgatgccgtcaagaatatcttcaagtactttttccggttctctgatgacgtcgtggatttacttaccaaactcaccacataccgcggctctctgcctcagggaggttgtgcatcatcatacctcgcgaacctagtttttttcaatgatgagtaccggctcgttagcagcctgcgcgggaaacaaattcgctacactagacttctggatgacgtcactattagcagccagaagccactggacggcaacaccagcgaaaaaattatcaagcaggtcgcagcaatgctgaggaagcataacctatcactgaaatcaccaaaaaccaaggtgtccgaccgaaaagagctgcacaaagagtttgaagttacaggactgtgcgtaagggctagctttcctaaggttcgcaagcaagatcggcgctatgtcaggcaattagtgttcaattgcgagcagttggcagctcagactagaacttcggaggactatcactccctgtggaacaagacatccggcttggtggctaagctggtgagactccagcacagtgaaggcaagtcctatagaaagcgactcacgaagatactacctctgtacgatcagtatcaggagaataagatctgtaagagatactatgcggcccttaaggtaccccgggagcaacacgtgcagtggggtaccataaacaagtacaacaaactcatgtactctctggggatcctgagtcggacgaacaaaaagcgtgctcaacacttcagaaaaaagctggcaacacattacagttctgtgccggtcatagaagacttttgggagagttga

SEQ ID NO: 10862 - RNA, 1185 nt, unidentified
  source 1..1185: mol_type = other RNA; note = synthetic construct
atggataaaccacgatatccatgtaagcccattgggtcgattgatgttctcgccacaacgttgggcgtgcacaaaaagaaactcatcgacattgccagcaaagtgaactctagttacacttctcacgagctgccgaaacaccctatcaccgggaagatccgcaaggtggtggatccaaagcatgagttaaagaagattcagaagcgcatcaatagtcgaatcttcgagcttgtcatcttccctccatacctgcatggaggcatcaaagccacgagctcaattaaaagggattatgtggaaaatgccagccagcacgggcacagccaaacactaataaacctggacgtgaagaacttctaccccaacatcaaaacaaacgcggtgtccggcatcttcaaatatttctttcggttttccgatgacgtcgtggagatactcaccactctcaccacttataatggaagcttgccccaggggggctgcacttcctcatatctggcgaatttagtcttttttaacaccgagtacaagctggttagttcgtttagaggtaaggcaattcgttataccaggctgttggacgacattacgatcagctcaaagaataaaattgactctaagagcaccactaaaattatccaaaaagtatccgctatgctgcggaaaaatgaactttctctcaagagcaataagacaaaaatcagcgatagaagcgagatacacaaagaattcgaagtgaccggtctgtgggtccagcctgtaaatccgcagatgcggaagaaggacgtcagacatgtgcgtcagcttgtgttcgaatgcgaaaagctggcctcaaagtctaagacatcagaggactttcatatcttgtggaataaaacctcaggactggtagcaaaactatccaggcttaaccactctcaagccatatcccaccgcgagcgcttatctaacatgctgcccgagtacgatcaggaagcacaggacaagttggttagaagtacaaatgctgctctgaaggtgcctgtctcctctcattccaagtggggcgtcctgaaaaagtacaacctgatcatctataacctcggtattctggctcggactaacaagattctctccaaaaagcttagggtttcactaaaaaagcattactccagtgttaccacaataagtgagtactggggatga

SEQ ID NO: 10863 - RNA, 1188 nt, unidentified
  source 1..1188: mol_type = other RNA; note = synthetic construct
atggacaagcctctgtatccctgcaaaccaatcggatccatcgacgttctggctaagactctgggggtgcatcctaccaaactgatcgacattgccagtcaagtgaacaattcttatacctcctatcagctgcccgctcatcctgtgacaggtaaggagaggacggtcttggaacccaagtacgagcttaagaagattcagaagcggattaactcccgaatctttgaacaggtccagtttccgagctatttacaagggggattaaaagcctcacactcaattaagagggattatgttcagaacgccactatccactcgcatagtcaaactctcatcaacttggatgtcaagaacttctatcccaatattaagacagaagcggtaagcaacatcttcaagtacttcttcaatttctcagatgacgtagtgtcaatcctcattaaactgaccacctaccacgggtctataccgcagggcggctgcacaagctcatatctggcaaacctggtgctctttaacagtgaatacaagctggtgagtagcctacggggcaagaatgtccgctactctcgcctcctagacgatattacgatctctagcaagacaaaacttgatcctaaattcatcgagaagacaataaaagacgtggccgcacttctgaaaaagcagaaactgagcctgaggtcccagaagacgaagattacagacagggccgagattcataaggagtttgaagtaaccggcctgtgggttagaccatcccaacctcaggtgcggaaaaaagatagaaggtacatccgccaattggtcttcaattgtgaacaaaagtccaaaaccgataagacaagtgacgagtttcataaactgtggaatcagacttctggccaggtgaccatacttgagcgacttaaacactcccaggctagcgattaccgccagagattggcgaaaatttacccagaatatgaccagtatcaggagaacaagttgatccggaaaattaaagctgccctcaaagttcccataagcgagcaccaccagctgggtaccatcaaaagatacaacgggctcatataccagctaggaatcttatcgagaaccaaaaagactctgtccaagaatttccgtcgtaccctcaaggcacactactctactgtgccaactctcaataatttttggaacaagtga

SEQ ID NO: 10864 - RNA, 1194 nt, unidentified
  source 1..1194: mol_type = other RNA; note = synthetic construct
atggataaaccacagtatccctgcaaatccattgcaagcgtggaagtcttggcaaaaactcttggggtgcaccttaagctgctcaataatatcgcttcgaaagtcgaggaatcctattcttcctatgtattgccagctcacaaggtgagtggaaagatacggaccgtctttgagcccaagcatgagttgaagaagatccagaaacggattaactctcgcatttttgagcgtgttatcttccctgaatatctcatcggcggcattaaggccactcctacaatccccagggactacgttcaaaatgccaggatacattccaaaagcaagacattgatcaacctggacgtaagaaacttctacccaacaatcaaagcacaggaggtgaagaagatctacaagtacttctttaagttcagtgacgaggttgttgaactacttaccctgctgaccacctataaaggcgccgtccctcagggtggctgtactagcagttacctcgccaacctcattttttttaatagcgagtatcagatcgtgagcagcctgcggggacaaaacattcgctattccagactactggatgacattacgatcagttcaacatccgagatctcaagcaaaaaaatcacggtaatcattaagtcagtctcagctatgctcaagaaacacaatctgtctctgaaggggaagaaaacaaagataagcgatcgagatgaatgccacaaggatttcgaggtgaccggtctgtgggtgaaggaggctgaaccaaaactgcggaaagaggaagtgaggcgaataagacagctggtctatcattgtcagcttgaatctatcaatggcatggactcagacgagtaccataaaatctggaataatgtgtctgggctggtgactaagttaacccgcctgaaacactctcagggaaaaaagtacagggatatcttgactctcattttaccgatatacaacgactacgagattaacaagctcaagaagaagattaacttcgcccttaagatccctaaagaagatcactataggataggggtgattaagaagtacaaccaactgaactacaagttaggcatcctaggacgcacccacaaaggtatggccaaagatgcgagaaaacgtctgaagtgccattacagtacaattcccaaaatggacaattattgggaaatggactcctga

SEQ ID NO: 10865 - RNA, 1188 nt, unidentified
  source 1..1188: mol_type = other RNA; note = synthetic construct
atggataaaccctattacggttgcgcaagtatcggatccgtggacgttctggcgaagacgctgggcgtcaacgttaaaatcctggagagcatagtaagcaaagtggacgattcatatacttcttacgatctggcccctcaccctgtaacaggcaaagtccggaccgtggtggaacccaagcacgatctgaagaaacttcaaaagcgtattaactccaggattttttgcggagtgaaattcccatcatatctccagggcgggatcgcctcaactgaagatgtggaccgcagctacattaagaatgcggaaatccactgttcatcccggaccctcattaatctcgacatcaagaacttctacacgaacattaagtatgacgttgtattcgacatctacaagaattttttccgctttagcatcccggtttgcgacgtcttgaccaaactgactacctataagaagcaggtgccccagggtgcttgcaccagcagctatttagctaacctggtcttctataacaatgagtacctgctcgtgagctttctgcggggaaaggggttttcctactctcgcttgttggacgatataacaatttccgccaagagtgagtgttcagagatccttacatccgacatcattaagcgagtcgcatctatgctgaggaagaaggacctgaagatcaacaataagaagacaaagatcacagataagagagaagagcataaggaatacaaagtgactggactttgggtgaagcacgccacccccaaactcagaaaagacgagaggcggtatattagaatgctagtgtacgtctgtgagtgcaaagctcaggaaagcaggtccacagatgaatatcatgcattctggaacaagaccagtgggttggtggccaaactgaagcagctgtcacatagccaagcagatagttatcgcaaaagattatcgtctattctgccaatctgttctgaagagaaagtgtacagtataaatcggcgtgtcaaaaatgctctaaaaatccctgttgccgatcacgggtcggtgtccgtaattaggcgatataacaaacttatgtaccagttaggcatcctctctcgaactgagcctgagcttgccaaatccctcagaaagaaaatgttgcaccattacccatctataaagaccataaatgagtactggcatggctga

SEQ ID NO: 10866 - RNA, 1188 nt, unidentified
  source 1..1188: mol_type = other RNA; note = synthetic construct
atggataagccgtactatccatgtgattccattggttccgttgaggtactggcaaagacactggggctgcaccccttgcatctccaaaatatcgcggacaaagccgaagagtcatatacaacttttctcctaagtcctaaccctaaaacaggcaaggaacgcgaggtgcgggaagccaagttcgagctgaagagaatccagaaaaggatcaacagcaggattttcgaacacgtcatttttcccgcatatttacagggcgggttaaaggctaccgaagaccaaggcagggattacgttgagaatgcgtcaatccatagccggtgccgaactttaattaacctggacgtgcgtaatttctatccaaacataaaggctcgctctgtcaaggacgtgtttaagcagttctttcgtttctccgatgaggtcgtggatctccttgtgaagctgaccaccttccaaggcgcaatcccccagggcgggtgtactagcagttaccttgccaacctagtctttttcaataacgaataccacctggtaagcaaactcaggggacagggtttcgcatacagcagattgcttgacgatattaccatatcctctgacaaagaactgagtcaggccaaggcctcagaagtgatacgcatggtggctgctatgcttactaagcagaagctgcggttgaacggggacaaaacctcaatatcttacagaaatgaactctccgctaagtttgaggttacagggctgtggattaaacacaaacagcctaaagtccgcaaacaggagcgccggtacatcagacagctcgtttataattgcgagctgaaatctaaacaggacaagaccacagattcttatcataccctttggaataagacctcgggactggtgacgaaactagagagactgaatcactctcaggcgggcagctatagaaaacggctggcagtaattcttcccgaatacagtccaatgcaaacggaccagttgctcaagaaagtttcggccgctatgaaggtccctgcctcagagcaccgaaagttgggagtgatcaagcgatacaaccagatcaagtaccagctgggaatcctgagtcggacacaaaaaggtgtggcaaggaaggctaggaaggccctcgtggcccattatagctccgcctccactaaactggaggtgtgggagagctga

SEQ ID NO: 10867 - RNA, 1188 nt, unidentified
  source 1..1188: mol_type = other RNA; note = synthetic construct
atggacaaacctctgtatacctgcaaacccatcgcctcaatcggactgctggccaaaacgctgggcgtgcaccctgaccatctggtggatgtggcgaataagattgacacaagctatacttctttcgaactagcacctcacccaaagacaggcaaggtgcgaactgttcttgaggccaagaagaatctcaagcgtattcagaagcgtataaactcccgaatattctccaacgtcaaatttccggcttacctccaaggtggactcaaaagtgacgagagcacccaacgcgattatattgagaacgcgagactacacagtcattgtagaacactgatccagcttgatgtgcggaacttttatcccaacattaaaccaatctacgtcgagccagtctttaaacagctgtttaggttcaatgacgaggtgtctcagatcttgacgcagctgactacctacaagaattctgtccctcagggtgggtgcacttcatcatacatcgccaatctcctgttcttcaattccgagtaccatttagtctcaaaattgaggggacaaggtctgcagtacagcagattgctcgatgatatcacaatcagttcgcaggaggagcttagtaagcagaagtgtgaggaggtgataaaactcgtcgcaggcatgttgacaaagtatggccttaagttgaaagggtccaagacccagaccgagtaccggtctaaccgcaatgctaacttagaagtgactggggtgtgggttaaacatagggccccgaaggtgcgcaaagaagaaagacggtacgttagacaactggtgtacgtatgcgaacagaaagcaaaggtatccaagaccacccaggaataccacgaacactggaacaggacctcaggactcgttgccaagttagagaggctggaacatggccaagctaaaaaatatcgtgagagactgagggcaattcttcccatatattctgaatccactgccaaccaggtactaaagagtgtgaatacagctctcaaggttcccaagaccagccacaaggagctggggcgcgtcaaccggttgaataagatctactaccaactgagcattctgagccggacgaaacggtatgaagctaagaaagcccgacgccagctgaagcagtattatagctcttccccaacaaaacaggagatttgggaaatctga

SEQ ID NO: 10868 - RNA, 1167 nt, unidentified
  source 1..1167: mol_type = other RNA; note = synthetic construct
atggataaaccatattacccctttaatgcaattgccagtatagaagccttggctcggacccttgggatccatccaaagttactttgtagcatcgctgacaaggtcgagtcttcctactccacatatgatctagcgaacaagaacaggacagtattcgaacctaagtacgagctaaagaagatccaaaagaggattaacagccgcatctttgagaaggtggaatatcctctgtatctgcagggaggcataaaaagcgaagttaaacgcgactacgtggagaacgccaaaattcattcacatgcagagacactgatttctctggacatcaagaagttctacactaacatcaaagccgataaagtgttttccgtgtttaagtacttctttaagttcccagacgacgtgtccacgattctgaccacactgactacctacagaggtagggtaccgcagggaggttgtacatcttcgtatctggcaaacctggtctttttcaattctgaatactcattggtgtctgccttccggggcaaggacgttaaatacagtagactattggacgacgttaccctcagctcagaaaaaaacttagatagcatcaagtgcacgaatcttattaagaacgtcgtggctatgtttcgatcctacgagctgcggctgaacactaagaagactaaaatcgagtacagaggcaaggctaataaaggattcgaggtcaccggcctttgggttgaacacaagaaacctaaagtaagacgaaaagaacaacggtacatccgccaactcgtctataactgcgagctgcagtataatgatcggaagacaaatagtgagtatcatgagctgtggaacaagactagtggcaaagtggcgaaactcgtccgtctggaccacagccaggccaaaaatttgcgagaaaggttgcgcctcgtgctgccccagtacgataataataccgcttataagcttaagaagctcaccaataaatcactccaggtgcccaaagaacaccaccagaaaatagggagaattcgtgattataaccgcttaatcttcaaacttgggattctcaagaggtcccaccctgccctggcaaaagtgctgataaagaagatgaagagccactatctcaacgtgcccaccaataaagagtactggctggagtga

SEQ ID NO: 10869 - RNA, 1167 nt, unidentified
  source 1..1167: mol_type = other RNA; note = synthetic construct
atggacaaaccatactatccacatgacgccatcgcctccgtcgagaaacttgctctgaccctcgggattcaccctaaccgcctcctttccatagctgaccgcgccgacgagtcatacactgagtatgaactggtggataaagacaggaccgtttttgagcccaagtacgagttgaagaagatccagaagcggataaattccagaatattcgagttggtggagtttcctctgtatctacagggaggaatccgggctaatgttaagagagattacgtcgaaaatgccaaaatccacgctaacgcaacgaccctaatttctctggacatcaagaagttctacacaaatatcaaggcagacaaagtctcagctatttacaagtacttcttcaaattccccgatgaagtcgtagacattctgacgaagttaaccacctataaagggaaggttccacaaggaggctgcacctccagctacctggccaatctggtcttttttaacagtgagtataggcttgtcagtgcctttcgcggtaaaggcatttcctatagccgcctgctggacgatgtgactctctcatcagcgagcaacctcgatagctctggctgcactgaagctattaggaaggtggtgggcatgtttacagcacacgacctgaagttgaactctaagaagactaagatcgaatatcgaggcaaggccgccaaggggttcgaagtgacaggtctttgggtggagcacaaaaaaccaaagctccgtagaaaagaaaggaggtacgtgcggcagctggtatataactgtgagctcaagtacgaatctgataagacaacacccgaatatcacgagctctggaacaaaacaagcgggaaagttgcaaagttaacccgtcttgaacatagccaggcgaaggccctgagaaagaggttacggaatgtgctccccgaatacgatgattacaccgcaaataagctgaaacatctggcctatcgagctctgcaagtgcctaaagagcaccatcagaaaattggacgagttaacgatttcaatcggctaatcttcaaattgggtgtgctgagacgcagtcacccttcgctggcaaaggtattgatcaagaaactcaaagtccattacaaaaacgtgccgactaagaaagagtattggcttgagtga

SEQ ID NO: 10870 - RNA, 1188 nt, unidentified
  source 1..1188: mol_type = other RNA; note = synthetic construct
atggacaagcctcactacccgtttgagcccattgggagcatcgataagttagccagaacactgggggtgtctccagccgttatggaggcaatctcaaaccggattgacgaatcttattcggagtatgagcttcccccacatccaaaaacaggtaaggtgcgaaccgtgttcgaagcgaagcacgaactcaaacggatacagaaacgcatcaacagtcgcatctttgagctgatagaataccccacctatctgcaggggggcattaaggctactcctaaaagggattatgtggagaacgctaatatgcacgtgggagccaactccttgatttcccttgatatcaagaacttctaccctaatatcaaggcttctcaggtcttcaacatcttcaaacagctgttcaatttccccgatgcgctcgcaaaaatcctgactaagctaactacctacaaaggtaccgtgccccaggggggctgtacgtctacctatctggcaaacctcgtgttcttcaattccgagtatcacttggtcagtgcatttcgagggcaaggaattgtttattcaaggcttttggacgacgtggtgctgtcctctccaaaagtattgtcgaacagcgaatgcactgatgccatccaaaaggttgctggcatgtttaagaaatacgaatttcgtctgaacagctcaaaaacaaaagtggagttccgcggcaacagcaatagtgagttcaatgtaacgggcctgtggatcgaacacagtaagcctaaaattaggaagaaggaaagacgatacattaggcaactggtctttaattgcgaactgaagtacatccagagcaagcatagcgatgactaccacattttttggaataagacaagcggtctggttgccaaactcgagcgcctgaaacatccgcaggctaagaagtatcgggacaggctgaaacaggtacttcctatatatgacgacgtcaacattcggaagatcataaagttaaccaacaaagcactaaaggtcccaaaagaggaacattccagatacggcagaatccagaattgtaatcgtatactctaccggctcggcatcttaggacgctcagaggccaagctcgccaaaaatctgagaaggaagcttaaatctcattactccaccattcccactaagaaggagtactggtttggaacagcctga

SEQ ID NO: 10871 - RNA, 1179 nt, unidentified
  source 1..1179: mol_type = other RNA; note = synthetic construct
atggacaagccatactacccatatcaagccattggtagcatcgaattgctggcccgcacactaggcattagctctaagaggctgatcagcatagcctcacgcgtggacaatagttatgcagagtttgagttacatccccacccaaaaacaaataaaatcaggaccgtgtttgatcccaagtatgaactcaagaagttacagaagagaattaactcccggatcttcgaaaaagtgcaataccctaaataccttcaaggcggaattaaagcacccgactccagggactatgtcgagaatgcgaagattcatagtaaatccaatacgctgatctccctcgacattaaaaacttttaccccaacatcaaagagaaatacgtgtatgacatattcaagcagtttctgaacttcccggatgaagtgtcaaagatattgacaactcttactacgtacaaaggatttgttcctcagggggcagtgacatcaagctatatagccaaccttatattcttcaatagcgagtatagcatcgtttctgccctgcgaaccaaaggcgtaatttattccagactcttagacgatgtctctattagttctgagaagcgtcttaatgagactgaaatcaccaagaacattaagttcgttgtttcaatgttcactaagtatgacctcaagcttaacaccaagaagaccaagaaagagtataagaacaagaagaacccgtacgaagtgactggtttgtgggtcgggcacgctaagcctaaagcaagaaaactggaacggaggtatattagacagctcgtgtacaattgcgagctgaaatacccttctatgaaagattccagcgattatcatgagctgtggaataagtccagtggcctggtcgccaaactggaaagattgggccattctcaggctaaacgactgcgggctcgcatgtcaagcgtattgccttgttacgatgatattgaaatcatcaagaccaagaaactcattcggaaggcgctaaaagtgccacgggagtaccatcagaagcacggacacatcaagatctttaacaaactgatctaccgttgcgggatcctgagtcgcacccacaaaaagctctcgaagcacctgaggcaacagctgcaggctcactaccagaatgtccccacaatccgagagtactggcacggatga

SEQ ID NO: 10872 - RNA, 1191 nt, unidentified
  source 1..1191: mol_type = other RNA; note = synthetic construct
atggacaagcccgaatacccccataaggccataggctccgtcgacgcgttagcccaatcactgggtacgaaccctagcgccctgaaaaacttggtgagtaaagtcgataattcttacactcccatcttgattagcactaacaatgggacaaaggagcgccaggtctatgagccgaaatactacttaaaaaagatccagaaacgcatcaatcgagagatatttgagaaagtgaaattcccaacctacctgcaaggctccatccgggatgttaaaaacacccgagactttgtgaagaacgctggagttcacagtggagccaatgacttgatcagtctagatataaccggattttatgaccacattaaggaggaatatgtgtctgatatcttcactaaactcttttccttccctcccgacgtgtccgaaattctgactaaactcgttacctacaaggggattgtaccacagggcgcttgtacctcttcatacgttgctaacctggtattcttcaatagcgaatatcgagtctattcaagactgaagaaccgccacaatgtcaagtatactcggctcctggatgatgtgacactgtcctcagagcggcgcctgacggacaaggagcttaccatttgcattgacgaggttaaaagcctctttcgtaagtacgatcttaagagtaatgactcgaaaaagaaggtacagacccgtaaattccacggtcatctggattttcaggtcaccgggttgtgggtaggccataaaactccaagactgcggaagaaggagaggagatatatcaggcaactggtgtattcctgcgagcgcgaatatgaacgggatagtacaaagacagaataccacgagttatggaacagaactagcggcaaggtggctaagatggccaggctaaatcattcacagtctagggcgcttagagaacgtctcaaaaaggtgctgcctacctacaatcaggaccaagccgagacgcttatctacaacatcaaaaggttcgtcgacaaagtgaaaaagaacaagataaagagcgaccctgcaaagacaaaaaacttcaacacattggtgtaccaggtgaatatcctgacccggacaaataaaagccttgcaaattccctcagactacagctcatgtctattaggaagagcgtgaacctgaagtctgcactctgggattga

SEQ ID NO: 10873 - RNA, 1167 nt, unidentified
  source 1..1167: mol_type = other RNA; note = synthetic construct
atggataagccctactatccccataaacccattggatcagtggctatcttggccaatactctcgggatcacggagctgaaattaagggcgattgcatctgacagcgacaacagttacactgaatttctgatctctgatggtaagcgaaccgtttgtgaacctaaattcgagctgaaaaaactccagaagcggataaacaggcggattttcgagaaggtgcagtatccagagtatcttcagggagggatcaagagtacgagcaagagggactacgtgcaaaacgcacttatacactccaaggccactaccctgataagcttagacatccgccgctttttcgataatgtgaaagagtcgtacgtttacgatgtctataagtaccttttcaagtttccagacgaagtagcagagttgctagcgcgagttacaacctataggggaaccctccctcagggtgcctgcacctctacgtacctggccaacctcattttctttaactccgaatatcgggtcgtgtccattttgagagggcgaggcattagctatagtagactgctggatgatgtcacactctcaagtggcgagaacctgaaaaaggaagaagtaacaaactccataaaggaggtgattgatctcttcaaaaagtacgacctccggcagaacaataagaaactgaaagtcgagtacagagacactccaaatggcgatttctgcgtgacagggctctgggtcgagcactcaacccctaaactgaagaagaaggaaaggaagtatatccgtcagttagtgtacgagactgaaaaactgtataggacagaccgtaccagcgaaaagtaccacgaactgtggggcaaagcttctggtaaagtggccaagttgaatcggctgggccataaacagtccgatagcctgcggcaaagactttctaacatcctaccggagtttgacaagtatactaccaagaaaatcgtgactatccactaccgcttgctgtccatccccaagatcaaacataagagaattgacgttgctaaacagtacaataaacaacttcacaagctcggaattttgtcaagaaccaataagaccctagccaaaaagctgcgcatggctctgaagcagcactttaatcaagtaacaacaatcgagcgctattggcatgactga

SEQ ID NO: 10874 - RNA, 1179 nt, unidentified
  source 1..1179: mol_type = other RNA; note = synthetic construct
atggacaagccgtattatcccttccgccctatttctagcattgccattctggcgaaaaccttaggtattcacgagaaaatgttgcttaacctcgcaaataaggtggatgatagttacacagaattcctgataaacgtgaaagggaaagatcggacagtttatgagcctaagcacgatctgaaaaaactgcaaaagcgcatcaaccacaggatattcgagaaggtgcagtacccagtgtatttgcaggggggcattaaagatccaagtaacaaaagagactacgttgaaaatgcaaagatacactgcgagagggatcccaatatcattatctccattgacatcaagagtttctacgacaatatcaaaagcgactacgtgtttaacgtgtataagaacttcttcatcttccctgacgaagtaagtgagattcttacaaagctgactacatttaagaacaaggtccctcagggagcctgcaccagctcatacctagctaacctgatttttttcaacaccgaatactccctcgtctccaaatttcggagcacgggaatttgctatactagattactggacgacgttactctgagttccaataagtttttgtcagaggaaaagatctccagctctatcaaagatgtggtagcaatgtttagaaagtacaagctcaagcacaataataagaagactaaggtcgagtgtcagaagaatgctaagaattcctttaagatcacaggcctgtgggtggggcatagcaaacccaaaaccacccggcacgatcgcaggtacataaggctgttagtcaagatctgcgaaaacaagtttaaagacgacaagtattcactcgagtatcataccttttggaataagacgtcgggactcgtagccaaactgtcgcgtctggaacagtctaatcatgtcagcctgcgtgaaagaatgagcatgatccttccattgtacgacgataaggagaaagataagataatccgggagtgtaaggccatcctcaaattcaacaataaagtggctttcaccatcggccaagtggagactattaacaaggttatcggcaaacttggtattctcgcccgaaacaacaaatcactatctaaaatatggcgctccaggatccgaaaacattgtcagtcactgccctctaaaagatctatgtggctttga

SEQ ID NO: 10875 - RNA, 1179 nt, unidentified
  source 1..1179: mol_type = other RNA; note = synthetic construct
atggacaaaccctattacccctttcgtccgatctcctccacatcaatcctggccaaaaccctggggatccacgagaaaatgctgttaaacttggccaacaaggtggatgattcctacacggaattcctgattaatgtgaagggtaaggatagaactgtgtatgaaccaaaacatgatcttaaacggctgcagaagagaatcaaccataggatatttgagaaagtccaatacccttcatacttgcaggggggaataaaggacaatagcaacaagagggactatgttgagaatgccaagatccactgtgacaataatcctaacctcataatctctctggacatcaaatcgttctatgatagtatcaagtccgactacatcctaaatgtgtacaagaacttcttccactttccagatgaggtgagtctcatccttaccaaattaaccacttataggaacaaggtcccccagggagcgtgtacaagtagctacttagctaaccttgtgtttttcaatagcgagtattcgctcgttagcaaatttcgaagtaaaggcatttgctatactagactgctagatgacgtcaccctgagcacaaataaaaagatttccgaggagtacatttccgcatctatacgcgacgttgtcgccatgttccgcaaatacaatctgaagcacaacaacaagaaaaccaaagtggagttccagaaaagcgcaaaggactcttttaaaattacaggattgtgggtaggccacgctacccctaagactactcgccacgaccggcgatatatacggcttctcgtgaagatttgtgagaacaaattcaaggacagcaaatacgacttggaatatcacgcattttggaataaaacatcaggcatggtagccaagcttgcccgtctggatcagtccaatcatgtcaagctcagagaacggatgtctcaaatcctgccccattacgatgtgcgcgaaaaggaaaagatcattcgcgaatgcaaaatggttctgaagttcaacaacaagattagctttacgatcggtcagattgatgctattaacaagctcatcgggaagttgggcatcctctcaaggaataacaaggctctgtctagagtgtggaggaatcggattcataagcactgcaaaagtaagccatctaaacgatcaatgtggctgtga

SEQ ID NO: 10876 - RNA, 1179 nt, unidentified
  source 1..1179: mol_type = other RNA; note = synthetic construct
atggataagccctattacccttttagacctatctctagcatcccaacattagcaaaaaccctgggtatccatgaggtcctgctggtgaatttgagtaacaagatagatgactcatacaccgaattcttgattaatgtgaaaggtaaagaccgaactgtgtatgaaccaaaacacgagttgaaacgcctgcaaaaaaggatcaaccaccgaatctttgagaaggttcagtatccgggatatctccaagggggcatcaaggataacaataacaagcgggactatgtggaaaatgctaatatccattgtgagcacaaacccaacattataatctcaattgacatccggtccttttacgataatataaagtccaacttcgtcttccttatctacaagaacttctttcatttccctgacgaggtggctaatatactgactaaactcacgacatttagaaataaggttccccagggcgcctgcacctctagctacttggccaaccttattttctttaactctgaatactccctggtatcctctttcaggaacaatagtatcacatatacacgcctcctagacgatgtgactctctcgtccagcaaggctctgtccgaatcccagatcactgcttctataaaggaggtcatcggcatgtttaataagtacaacctcaagcataacaacaagaaaacgaaagttgaaacccagaagaacagcaaagactcattcaaaattaccgggttatgggtgggacacagcaagcctaaggcgactagaaaagaacggcgttacatcagactgctggtaaagatttgcgaaaacaaagccaataccgatatttattctgaggagtaccacgcattttggaataagactagcggccttgtcgccaaattaacccgcctggaccagagcaaccacaaggatctgcgtgagaggctgaacgcaattctacccctttatgatgacaagagtaagaacaaggtgatacgggagtgtaagatcatcctcaggtacaataataaggtttcactcagtatcggacaggtcgacacagtgaataaactgattggcaaacttgggattctgtcaaggaataaccgcgccttgagtaagatttggagaaccaagattcggaaacatttcaaatgcatgccaacaaaaaaggagatttggcagtga

SEQ ID NO: 10877 - RNA, 1242 nt, unidentified
  source 1..1242: mol_type = other RNA; note = synthetic construct
atggtcgattttgatgccaattacttgctaacaagctttactccccttaaacattggtgcgctatggacaaaccatactatcctcacaatcccatctccagtgtagctattctcgctaagaccctcgggattaggaaggaccttttggtgaacttagtgaacaaagttgattctagctacacagagtttctcattacggtcaagaacaaggaccgtacagtttatgagcctaagttcgagctgaagaaattacagaagcgcatcaattctagaatctttgagaaggtccaatatcccacgtacctgcagggtgggatcaaagatgattctaacaagcgtgattatgtcgaaaatgcggcacttcactgcaagaataagcctgagacaattatctccatagacatcaaaagcttctacgataacattcggagtagctatatcaacgacatctacaagaacttctttaatttccccgacgaagtggccgataccctgaccaaactgacgacctacaggaataaagtgccgcagggcgcgtgtacttctagttatctcgcaaacctcatattctacaacagtgaatatactctcgtgtcaaagttccgcaataagaacattacctataccaggctgctggatgacgtgaccttaactagcagggacaacataagcgaagagaaaatctctgaacacatcaaatcggtcgttggcatgtttcggaagtacaacctgaagcacaacaacaaaaagactaaagtggagactcaaaagaatgccaaaaactccttcaaaatcaccggtctttgggttggacatgccaagccaaagatcacacgacatgacagaagatacattcgcctgcttgtgaagatttgtgagaataagttcaaagacgacaaatactccgaggagtatcatgccttttggaatcggacctcaggaatggtagccaagctgactagactggatcagtcaaaccacattgaattgcgcaaacggatggcaacaatcctgcctttgtacgatgacaacgagaaagataagattattcgagagtgcagacgggtgctcaggttcaataataaaatcgacctatcaatcggccagttggacatcataaataagctaatcggaaagctcgggatactggctcgaaataacaatgcactgtccaaaatttggaggaacaagataaagaatcactttccactgctgccaacaaaacgcgaaatttgggaatga

SEQ ID NO: 10878 - RNA, 1188 nt, unidentified
  source 1..1188: mol_type = other RNA; note = synthetic construct
atgctcatggataagccctattacccgcacaaggcgatcagtagtgtgaacgtacttgccaagacactcggaattagggagagcctgcttattgaactgagcatcaaatcagatacttcctaccatgagtttacagtttgcaccaaaaaagggaaggacagaacggtctatgaacctaagccattgctcaaaaggcttcagaagaaaataaactcgcggattttcgagaaagttaagtacccaatttacctgcaagggggaattaaagacgagatttccaagagagattatgtcgagaatgctcgcctgcatagtaaatctaagccttctcacctaattggcttggatatcaagagcttctacgacaatataaagacccccaaggtccatgacatctacaagtatttcttcaagtttccagacccagtttgcgacgtgctcacgaaactgaccacccacaagggcaaactcccgcaaggagcttgtacaagcagctatctcgctaacctggtttttttcaattcggaatacagtctagtctcatactttcgcaaaatgggcgtgacatacaccagactgttagacgatgtgactctgtcatcacctgtgcagctgtcagagcaccaggtcggagaagcaatcaaaaaagtcgtgggtctgttcaaaaagtataacctgaagcataacaacaagaaaacctccatcgagaacaataagaacattaagaatggcttccaggtgaccggtttgtgggtgggccacagcgaacccaaaactacaagggatgagcggcgttatatccgaatcctggtaaagacttgcgaacagaagcataagtctgacccctacagtcaagagtttcacgaattgtggaataagtcctccgggcttgtagccaaattaaaacggctaggtcagcctagccacgattctctccgcgcacgactttcagtggtgctgccattatatgaccagaaaatggcctctaaactgatcatggaatgtaagagccttctgactataaagaataagatccagtacagcgccggcgaggtgtccaacattaacaagacactgtataaactcgggatactctcccggaataatcctatatctagttccatctggagaaagcgtatcagggcaaactttaaaaatctgccctctaagaaagagttgtgggagtga

SEQ ID NO: 10879 - RNA, 1182 nt, unidentified
  source 1..1182: mol_type = other RNA; note = synthetic construct
atggacaagccgtattacccttacaaggctatttcctccatcgagacactggcaaaaacattggggattcgggtgaatctgttaagcctgttagtggagaaatcagatagctcttatcacgagttcattgtttgtactaagaagggaaaggacagaaccgtttatgagccaaaacccctccttaaaagacttcagaagaagatcaacagcagaattttcgaaaaggtcaaatacccagtgtacctgcaaggtggcataaaggacgagataaataagcgcgattatgtagagaatgcgctgctgcacagtaagaacaagccgaaacagttgattggcttggacatcaaatctttctacgacaatatcaagtctgataaagtgttcgatatctacaagtacttcttcaagtttccagaccctgtgtccgatgccctcacaaaactcacaacttttaagggaaaacttccccagggggcctgtacatccagttaccttgctaacttggtctttttcaattccgagtataacctggtgagttactttaggaacatgaatatcacctatactcgactgctagatgacgtgacgctgtcaagccctgttaagctgtccgagaaacagatcggggaatcaattaagaaggttgttgctatgttcaggaagtacaatctcaagcacaataataagaagaccagtatagagtgcaataggaaccttaaaaatggatttcaggtaactggcttgtgggtcggccatgcaaccccaaaaactacgcgagacgaacggcgctatgtgcgtctactggtaaaaacctgcgagcagaaatataaaaacaacccctacactgaggaatatcatgaactctggaataaaacatcgggattagtggccaaactcaagaggctcaatcaaccctctcacgataccctgagaaaccggctgtcattagtcctgcctctctatgacgcagtgatggtgagcaagcttatgatggagtgcaaatctctattgcgggtcaagaacaagattgaatacagcgtctcggaagtgaaccatataaacaaaaccctgtacaagctgggtattctgagccgtaataaccccggcagggcctctatctggcgcaagaagatcatcgccaactttaaaaacctccctaccaaacgcgaactgtgggaatga

SEQ ID NO: 10880 - RNA, 1179 nt, unidentified
  source 1..1179: mol_type = other RNA; note = synthetic construct
atggacaaaccaaactacccacacaaacctatttctgaggtttctgtgttagccaaaactctcggcatcagtgaagttatgctgaagtccatagctagcaaggtagataccagttataccgaatttgacattgagtcaaacgggaaggataggcatgtctacgagcccaaattcaatctcaagaagcttcagaagaggattaactcccgcatctttgagcacgtcaatttcccttcatatttacacggggggatccgggatgtgaacatccgccgagactacgtggagaatgctagactccactctaagactaaggtcaacagcttgatcaacctggacatcaggagcttttatgacaacattaagatcgacaaagtctacaagatctacaagtacttcttcaaattcaccgatccggtgtgcgagatcctcacaactctaacaacctataagaataaggtgccacaaggcgcctgtacgtcatcatacctggccaacctcgtcttctacaattccgagtatcaggtggtttccgcactgcgctgcaagggcatcacttacacccgtcttttagacgacgtaacactaagttccaagaagactctgagtgagacaacaatttctaatagcatcaaaagcgtcataggaatgtttaccaaacatggactgaaacagaacaagaagaagatgaaaatagagagcattcagaacaagaaagatggctttcaggtgactggtttgtgggtgggtcatgcggagcccaaaacccgccgggatgaacgtcggtatattagacttatggtgtatgtatgcgaaaaggaataccctaattcaatgagcaccgagtcttaccatgagctctggaataaaacgtccggactggtggcaaaactgaacaggctcaatcagtcgaattataaatccctgcgagaaagactgggcgccgtgctgcccttgtataacgattcagaaagagacaagatcattcgcgaatgtaaatctctgctaaagctggacagctctaaacctgttagttatgggcaattggattccatcaacaaaatatactcgaggttgggaattctggctcgaaacaatacaaatctcagcagatcctggcggaaaaagcttcggagtcactttaggaaactgcccacgaagaaggaaatttggctttga

SEQ ID NO: 10881 - RNA, 1179 nt, unidentified
  source 1..1179: mol_type = other RNA; note = synthetic construct
atggacaaaccttattatccacacaagcctatctccagcgtggaagtccttgctaagaccttgggagtctctgaaccggccttaaggtcaatagccaataaggcggggaactcatataccgagtttctgattgagagtaaaggcaaggacagaactgtctacgaccccaagtttgagctcaagaagattcagaaaaggattaactctagactctttgagaacgtgatttttcccagttacctgcaaggcggaatacatgacaaggaaaatcgccgggattacgtcgaaaatgccaaaatccattctaccgagaaaatcaagtccctgatcaacctggatatcaagtcattctatgacaacatcaagaaagctaaggtgaacgacatttttaagtacttcttcaagttccccgatccagtgtgcgatatcctgacaagcctgacaacttataagaataaagtgccacagggagcatgcaccagcagttaccttgcaaacctagtttttttcaattcggagtaccttgaagtgtctaagttgcgcggcaagggtgttacttacacacgactcctggacgatgttacgttatcatcatccaagcagctgaatgacgaagagatcgagatttacattaaaagcattcatggcatgttcaagaaacacggcctcaaattcaacaacaagaaaaccaaaatcgagcatattaagagcaagaaagaagggtttcggataactgggctctgggtggggcaccagctgcctaaaaccactcggaacgagcgcaggtatatacgtttactggtcagaatttgtgagaacgagtatagcaaatctatgtattccgaaggctatcatgaactatggaacaaaacatctgggctcgtagccaagctgaaccgcctcaatcaaagtaatcacgagagccttcggacccgactgggtctgattctacctttgtacgatgatgctgaacgggataagatccttagggaatgtcgcaatctcttgaagataaaggccacaatcgagctgaagtacggccacgtggacagtatcaataaagcatacggaaaacttggtatcctctccaggaataataaactggtatcccgaatgtggagaaaaaagctgaagtcccacttcagaaaactgcccacgaaacgtgacatctggttgtga

SEQ ID NO: 10882 - RNA, 1173 nt, unidentified
  source 1..1173: mol_type = other RNA; note = synthetic construct
atggataagccatactacccgcatcagccaatcagtacaatagagtccttggcgcgttgtctaggcgtcaccaccattaccctgaacagcatttcctcagccatcgattccagctacacagagtttgtgattagctcgaagaacaaggagcgaactgtatacgagcccaaatttgagctgaaaagaatccagaaaaggataaataaccggatttttgagaaggtggaattcccccgatatctgcacggaggcattaagtccctcgaacataaaagagactacgtcgaaaatgccaagatgcactccaatacttcagtagaaaccataattgggctcgacgtgaagaatttctatgacaacatcaagaaagagcgcgtgtatatcatttacagccagttctttaacttccctcatgaggtgtccgagctgttgactcaattgactacatacaagaacaaagtgccccagggggcctgcacctctagctatcttgctaacctcatcttcttcaattcagagtatggactggtttctaagcttagggggaagaaaatcacatatacgagactgctggatgatgtaaccatctccgccgccaaaaaaatttctgacgaggaaatcacaaaggtcattagagacgtgagcgcactctttaccaagcacggtctgaagttaaattcaggaaaaacgcgcgttcaccatgacaagtatgctgctgactcattcgaagtgacaggcctttgggtcggcaacattgcccctaaaacccggcggcaggaacgcagatacattcggagcctcgtgcacgcatgcgaaaatgagtacttggttgataagtacagttcggattatcatgccttatggaacaagactagtggcctagttgccaagctctatcgcctagagcaatctaatcacaaggctcttcgggaaaggctggggaaaatactgccactgtttgacgacgtggcaaaacgtaagatcatcatcgattgtaaaagcatgctgaaaatcgcaccctgctctctgaactatggtaaactgaagaggctgaatttgatctacagtaagcttggaatactctctcgaaactacaagtgtgaggcgaagttatggaggaaaaagctcaaagctcacttcgtgaagcaccctaaaaaaagtgaagtctggtga

SEQ ID NO: 10883 - RNA, 1173 nt, unidentified
  source 1..1173: mol_type = other RNA; note = synthetic construct
atggacaagcctaattatcctcattgcccgatagcttctatagatgctctggccaggtgtctcggagtggcctcgacaaagctgttgagcattagccgtgatatcgataacagttacagtgagttcatcatcgaaagtaagggcaaggatcgcaccgtgtacgaacccaagttcgagctcaaacgtgtgcaaaagcgcatcaatcagcggattttcgaaaaagtgaagtatcctatctacctccacggcggaatccgggatccagacaataaaagggactacgttgaaaatgcaagaattcacagcgcgaacagttgcaaaaccattattgggctagacgttcgcaatttctacgataatattcgcgccgacaaagtgacaccgatcttcaagctcctcttcaaatttccaaacgacgtctccgaactactgacaaaactgactacataccgaggcaaggtacctcagggtgcctgcacctcttcatacatcgcaaacctggtgttttttaactctgaatacacggtcgtatcacgcctgagaagcctgggaatctcatatactcggctccttgatgacgtgacattgagcagccccaaggagctttccccagaaaggatcagcgagtgtatcagatcagtggtcgcactctttaaaaagcacggtttagagcacaacaaaaaaaagacccgaatagaaaacaagaacaataacgcccagtcctttattgtgaccgggctgtgggtcggccacaaaaccccaaaagttacgcgacatgagcggagatacattcgcaccatggtgcatgcctgtgagcgactctacttggatgacaactctactgatgcgtatcataatatctggaataagacttccgggctcgttgccaagttaaacagacttgagcaaagtaaccacaagggcctgagggagcgtttgaataaggtgctgcccgtctatgacgaggctgctcggaggaagataatactggactgcaaaagcttgctgaaactgaacgctacatcacttacctatgggcagcttactagactgaacctggtctattccaaacttggaattctgtccagatctttcttattcgagtccaggctatggcggaggcggctgaatgcacattttaagaataagcccaagaaatctgaggtatggtga

SEQ ID NO: 10884 - RNA, 1179 nt, unidentified
  source 1..1179: mol_type = other RNA; note = synthetic construct
atggataagccctattatccacacaatccaatctcagacgtttcaaccctcgcgaaaactctggggattaatgaggtcatgctgaatgtcatagtgtccaacgtcgatacctcttacaccaaatttgacatacctagcaaaaacaagacacggacggtgtatgagcccaagcttaaccttaaaaagatacagaagcgcattaactcccgcatctttgaggccatccagttccctatctacctacaaggaggcatcaaggattctgttgacaaaagggactacgttgaaaacgccagaacccattctgtcaactcccctagcactctgattaatctcgacatcaagagcttctacgacaacattaagtacgacaaagtgttcgacatcttcaagtacttcttcaaatttcctgatgacgtatcaaaggtgctgactgatttgacgaccttcaaaaacaaggtgccccagggcgcttgtacatctagttatctggcaaaccttgtcttttttaataccgagtactcaattgtgtcatctctgaggggcaaagaaatttattatacaaggctcctggacgatgtcactatgagcgcttgctgcgtgttaccggaagaaatcatttcggaatccattaagaaggttgtggggatgtttaagcagtatgggttcaaatcgaacaataagaagaagaagatcgagtacaacaagaatatgaaaggtggctttcaagtgactggtttatggataggccatacgaatcccaagaccacaaaaaaggaacggcggtttataagactgctggtgcacacctgtttcaaaaagtacaacgagagtatgacaaacgagtcctatcacgagctgtggaataaagctagtggacttgtagcaaaacttaagaggctggatcagagcaatcacaaggccctgcgtgagaagctcgccagtattttgccgctgtacgatgacagcgagcgcaagaaaatcgtgcatgagtgcaataggttgttaaaaattccaagcagcaaaactctcacatatggagaaatcgatcgtatcaatcgcgtattttacaagctaggaatcctctcccggagtgaaaagaatttgtccagaatgtggagacgaaaactcaaacagcacttcaaaaacatcccaaaaaagcgagcatcttggctgtga

SEQ ID NO: 10885 - RNA, 1176 nt, unidentified
  source 1..1176: mol_type = other RNA; note = synthetic construct
atggataaaccctattacccccattcaccaatttcagacctcccgacactcgctaaaacattaggagtgaacctggtcatgctgaacgtgatcgtaaacaaagttgatgactcctacaccgagttccaaattccaagtaagaacaggtttcgcaccgtgtatgaacctaaattgaatctgaagcgcatccaaaaaagaataaacagccggatttttgagttcattcagttccccttttatctgcagggaggcgtaaaagatagcatagacaaaagggactacgtggagaatgccaagatgcattcctctaacaaccctgaaacgctgatctccctcgatatcaagagcttttacgacaacattaagtctgataaggtcttcgacattttcaagtacttcttcaagtttcccgacgacgtctccaatactcttaccaagctgactacctttaaaaataaggtgccacagggggcctgtaccagtagctacctggccaatttggtgttcttcaactcagaatacacgatcgtgtcaaatctgaggggtaaaggcatatgttattcacgtctgctagatgacgttaccatgtctgcaaattatagtctttctgaggaggttgtctctgagtccatcaaaaaggtggtcgggatgtttaaacagtacggactcaaaagtaacaataagaagaagaggatcgaaaacaacaaaaatctcaagggagggttccaggtgacagggttgtgggtcggccacaaaaacccaaagactacaaagctggaacggagatttatcagactactggtacacacatgcttcaaaaaatataacgagagcatgacttcggattcctaccacgagttgtggaataagaccagcggtctggtggcgaaattaaaaagacttgatcagagcaaccataaggcattacgggagaaactcgctaggattctgccgctctatgatgagaacgagaagaagaaaatcatacaggagtgcaatcgcgtgctacggattgccccttccaagactttgacatatggcgaaattgaccgtatcaataagcttttctacaaactgggcgtgctgtctagaaatgaaaagcaacttagtcgaatgtggcgcaagaagctcaagtttcactttaagaatatccctcggaaacgagaagtttggtga

SEQ ID NO: 10886 - RNA, 1197 nt, unidentified
  source 1..1197: mol_type = other RNA; note = synthetic construct
atgaccagacttcaggtgtttatggataagccatattacccgtattcccctatcgcatcaatcgatagcttgtccctcaccctaggagtggtgccgaaagtgctgctggacattgccaagaactccagcaattcttacactgaatttattgtcccaagcaagaacaaagaccgtctggtctacgaacccaagtacgagttgaaaaaaatccagaaacgcatcaacgcgaggctgttcgagaaggtgcagtacccactgtatcttcagggagggataaaggataaccttgtaaaacgcgattatgtcgagaatgcaaagctgcatgttaagtctaagcacctgattaatttagacatcaaggccttctacgataatattaaaccccatcacgtgttctcagtgtacaaatacctcttcaagtttcctgatgacgtctgcgacgtgctgactcagctgaccacatataaaaatcgagtcccccaaggcgcctgtacttcgtcctatattgcgaatctaattttcttcaacgacgagtatacactggttagttcttttaggcagcagggcatctcttacagtaggctgttagacgacgtaacactgagttctaacaaggaactgagctcagaagacgtcacaaacgctatcaaaaaagtggccgccctttttaagaagtacgacttgagactgaagaacagcaaaacgaagatagaggttaagagtaacaaggaggccgaatataaggtgacgggattgtggatcggtaatggggagcctaaggttcgcaaagacgaacggcgatacatacgccagctcgtgtatatatgtggcctcaagtatgcaaaatcttccagctgccaagagtaccacgaattttggaacaaaatcagcggcatggtagcaaaactcactcgcttaaatcatccagaggctgctaaactgcgtgtgaagctcagtaacattcttcccactttctcagtagaagtgaagagaaaagttatccacgatatcaaaaagctcatgagaaagcctgctacccaaggctcctacaccttgggggagattgctcgggtcaataattcaatgtacctgcttggtattctggggcggaccgatttcaacctcgcccggaatctaagaagggatctcaagaggaaatacaagaacttgcccacatataatcagatctggtcctga

SEQ ID NO: 10887 - RNA, 1176 nt, unidentified
  source 1..1176: mol_type = other RNA; note = synthetic construct
atggataagccctattacccccactcgtcaattgcgagcattgatagtctgagttctaccttgggcgtggttccacaacgtctcctggatatagcaaaaaactcctgcaattcctataccgagtttgttgtgccatcaaaaaataaggacagactggtgtatgaaccgaaatacgagctgaagattattcagaaacgaatcaacgcacggatctttgaaaaggttgaatatcctgaatacctgcagggaggtatcaaggacctggctaaaaagcgggattatgtggagaattcaaaaatacacgtgaattccaagcatctgattaacctggatattaagtccttctacgacaatatcaaaccattacacgtacataacgtctacaagaacctcttcaagtttagcgacgaggtgtgcgacgtactgaccctgctaactgtgtacaaaaaccgggtaccccagggggcctgtacatcaagctacatcgctaacttaattttcttcaattccgagtacacacttgtgagctcctttcggcagcagtctataatctatagtcgtctgctggacgatgtgacgctttcctctaataaagaacttccccaagacaccgtcacgaaagccatcaaaagcgtggccgcggtgtttaagaagtatgatctgcgacttaagaattctaaaactaaagtcgaggtcaagtcagataagaagagcgaatacaaagtcacaggcctatggattggcaacggagaacctcgcgctcgcaaaagtgagaggagatatattaggcagctcgtttacatctgtgggctcaaacaccacactagcagttcttcgcaggagtaccatgatttctggaacaaggtcagcggaatggttgccaagctgactcgcctcaaccatcctgagagtgcatctctcagactgaagatgtctgacatcttgccaaccttctcaaaggagatgaaggccaagatcatcttagacatcaagaaactcctaaggaaaccgtccgctcagtgcagctatacacaaggtgagatagcaagagtgaacaaagccttttacttgttggggatcctgggcaggacagacaagattctcgccaagaatctgcgctgtgacttgaagcgaaaatataagaaccttcctacctacaatgaagtctggaggtga

SEQ ID NO: 10888 - RNA, 1176 nt, unidentified
  source 1..1176: mol_type = other RNA; note = synthetic construct
atggataaaccttactacccttacagccctatagccagtatagacgccctatctttaaccctgggcgttattccagaagcactggttgatatcgcacggaaatccagctccagctatacagagtttgtggtgccttcaaaaaacaaggaccgccttgtgtatgaaccgaagcacgatctgaaacggatccagaagagaatcaatacaaggatattcgaaaaggttgagtatccacggtacctacaggggggtatcaaagatgcactgatcaaacgcgattacgtcgagaatgccagtctgcatacaacttccaagcatctcattaaccttgatatcaagtccttctacgacaacatcaaggcttgccatgtctttgccgtatacaaatactttttcaagttccccgacgatgtgtgtgaaattttaactctgcttacaacctacaagaataaggtgccccaaggggcttgcacctcaagctatattgccaacctgatttttttcaactccgagtactctctcgtctcgtctttccgccagcggggcgtcacatacactagattgttggacgacgtgactctgagtagcaataaagagctggccgaagaggaaatcaccaaggccattaaagacgttagtgccctctttaagaagtatgatctccgtctgaagaacaacaaaacaaagatcgaactgaaggcgaataaggacgctgactacaaagtgacgggactgtggataggcaatggcgcacccagagtaagaaagcatgagcgacgatatatcaggcagctggtgtatgtgtgctctctgaaatataaagagtccagttcatcaaaggagtatcacgatctctggaacaaagtatcaggaatggtcgctaagttgaccaggctcaagcacagcgacgcttctggattgagatctaaactgaccgaaatgttaccaacctttggtgacgatgtgaagaggaagatcattcacgacattaaaaagctgatgaggaaaccagatccccaatgttcctatacgcacggcgagattgcgcgcgtgaataaggccatctacctacttgggatcttgagccgtaccgatcgcaacctcgcaaataacctccgacgggaccttaaaaggaagtacaaaaacctgccgacttataatgacatttggagctga

SEQ ID NO: 10889 - RNA, 1176 nt, unidentified
  source 1..1176: mol_type = other RNA; note = synthetic construct
atggataagccttattatcctcacaaacccataggatcacttgacgctctggccaaaactctgggggtgcaccccaaactgctgttagatttcgccgagaaggcaaatagcagctacacatctttcaatattgtctccaagtcggggaagattcgtactgtgtatgaaccaaagtacgagctcaaaaagattcagaagagaataaatgaccgtatattcgaagccgtcagatttccactgtacctgcagggaggcatcagtgatgatcagtcaaaaagggattacgttgaaaacgctaaaattcacgccaactctcagtgcctcatcgttctcgacatcaaaaatttttacgggaacatcaagagcgactatgtcttcgacgtcttcaaatacctgtttaagttccccgacgaggtgagcatgctgctcacgaaactggtatgcctgagaggtagggtaccgcagggggcatgtacctcttcttacgtggctaacctagtgttccacaatagtgagtatcatgttgtgtcctattttcgacaacggggggttgtttatagtcgcctgttggatgacgtgaccctaagtacgaatgatcgccccagcgctgagagcactcaggaatacattgagagagtgattgcgctctttaaaaagtacgatttaaagcccaggtcggataagatcaaagtctatattaagggttcacacgcctacacctacgacgtgaccggactttgggtcggtcacgcaaaacctaaattgcggaaaagtgagcggcggtacatcaggcaactggtgtttgaatgcgagaaaaagtatcaggcttcttcctgtgacccatcatatcataagttctggaattacgtaagcggccaggtggcaaagatgacacggctcggccaccatcaatccaaggagttgaggcgacgcctgggcttaatcctgccgacaatcgatgctcttgaggaacagaagatcgccgcagacgtgcaaaaaattgccaagctccgccgcaatcatacctacaaatccggcgacatctcacggataaacaagctctactataagttgggacttctgtccagaacaaacaagggcaggtccaaggccttgcgatctatgctaaaaagcgcgcatccaaacgtccctaacaagagagaatattggctttga

SEQ ID NO: 10890 - RNA, 1176 nt, unidentified
  source 1..1176: mol_type = other RNA; note = synthetic construct
atggataagccatattatccccacctgcctatcagtactaatgaaaccctcgccaaaaccctcggcgtgcatccaaagcttctacaggacttttgcgctaggagtaactcatcctatacatcattttctgttactagcaaatcggggaagcagcggattgtctttgagcccaaatatgagctgaagaagttacagaagagaattaaccaccgtatctttgagaaggtgagatttcccatatacctgcaagggggcatcaaagactatgagaaaaagcgtgactatgtcgagaatgcaaagatccatgctaactccaagacactgatctctctcgacattaagaacttctatgataacattggtgaggcctacgtgtacagagtattcaagtacttctttaacttcccagacgaagtatcaaagacccttacagccttggttaccctcaatgggagagttcctcaaggtgcctgcacttcttcttacatcgccaatctgatctttttcaattccgagtataggatcgtcgcaaatctgcggggacagggagtgaaatacacccgcttactggatgatattaccttgagcattgagagtgagatctctgaagagcatactagccagctgataaaggatgtgatagccctattcaaaaaacatgacctcaaggtgcagaacaagaagacaaagatttccgtcaaacactcgcatgctcagccatatgacgtgacaggcctttggatcggacattctaagcctaaattgcgaaaatccgagcgcaggtacatccgccagctggtgttcgaatgtgaaaagaagcactcacagggtagtgcggagatagactaccacaaattctggaatcacgtgagcggccaggtcgcaaaaatgcaccggctgggacactcccaaagcgctgacttgaggtcaaggctggcaatgatcctgcctacgctcgatgatctgtccgaacgcaaacttgaaatcgacctaaacaagctcataaacagcaaaaagcaaaccagcttaaagtacggcgatattacgcggattaacaaagtgttctacactctggggatcctcagtcgaaccaagagaaataagagccgcaaattgcgacggaaactgaaaaatgcgtacccgaaaattcccacaaaggttgaatactggctttga

SEQ ID NO: 10891 - RNA, 1176 nt, unidentified
  source 1..1176: mol_type = other RNA; note = synthetic construct
atggataagccttactacccgtttaagccaattgggagtttggatgcactggctacaacactcggtgtacatcctaaactgcttacggacttttccaacaaggcaaatgatagttacgtgaagttcgaaatcgtgtccaagtcaaacaagaggagaacagtctatgagcccaagttcgaactgaaacgactgcagaagaggatcaattctcgcattttcgaaaaagtggagtacccagtctatcttcacggcggaatctccgatgaaattaacaaaagagactatgtggagaacgctaagttgcatgcaaaatcaaacactttgatttgcctagacatcaaagacttctacgggtcgatcctcctggaccacgtattcgacgtcttcaagaatttcttccactttcccccagacgttagcagcctcttaacgaagcttgtgaccttaaatgggaatgtcccccagggagcctgcacctctagctacctagcaaatctcgttttcttcaactccgagtataatcttgtgtcgcgctttagaggacgcggcgttacctattctagactgctggacgacgtcactttatcttcaaatgataaactgtccgatacactggttcagaaatatattgaggaggtgtctaagctctttgccaaatactccctccacataaaaaacaagaagaccagggtccacatcaaatcagatcattccaaaccttacgatgttaccggactgtgggtgggccacagctctcctcgcctacgaaagtcagatcgtcgcaatatcaggcatgaagtctttctgtgtgaaaaggagtttgaatttgactccaccagcgagaagtatcataagcagtggaaccgggtgtctggcctcgtggccaaaatgcagaggctgcagcacagccaagccaagatcttgcggcaaaggctgagcaaagtgctgcccacttacagtgacgccgacgctgctgccgtgatccgtgatgccaataagatattgaacgctaaaaagaaggagaatatgaaaatcggcgagcttaatcggattaaccgggtgctgtatagtctgggtatactgggaagaactaacagtggcaaggcgaaaagcctcgggaagaacattcgagccaagtacaacaaccttccaggtaaacgggcgttttgggtatga

SEQ ID NO: 10892 - RNA, 1182 nt, unidentified
  source 1..1182: mol_type = other RNA; note = synthetic construct
atggccaaagataagccttactacccccacggtccaattggaagcttagcgatcctggccaaaaccctgggcgtcccacccaaattgctgagcgatctggccaagaaagctagtagttcatatactccttttgtcatagagacaaaggggggaaaacagcgtgacgtatacgaaccaaaatacgagctgaagagactgcagaagaggattaacagccgcctctttgagaagatcgagtaccccacctacctacagggaggagtgaaggacgaagctcagccacgggattacattgaaaatagcaagattcatgccgggagcaaattcttgatctcgctcgatatccggaacttctatgacaatatccatatcgattccgtcctcagcatttttaagcacctatttaagttcccagaggacgtctcaactctgctcacgtctctggttaccagagaaggtaaagtgccccaaggcgcctgcacatcctcttacattgctaatctgattttccataactcagagtactcctatgtgaaaaagttgcgtgataacgggttttattattcgagactgctggacgatgtgaccatttctgctgatcgcctagtcccgcaggaagaggtaaccaagactattaaatatgtggctggactcttcagtgagcacgggctccggctgaggggtagtaagacaaagatagagagagccgacgacctgaaatctgcttatgcggtgacaggtgtttgggttggccacggcatccctaagatccgccgaacggagcgcgacatgatccgacattctgtgtacatatgtgaacaggaatatgcaaagaattgcttctccgacgaataccacgccctttggaacaaagtgagcgggcaagtggcaaagctcacacgacttaatcatgcacaggcacctaagctgagacaccgcatgaggtccatcttgccgctttatgacagcaaggccaccgcaagtatctggcgggagactgataaaatgcttaagcggcctaaaaaatcccacactaagattggggttataaacgcgtatcgccgtttaatctaccagctcggcatcttggctaggaccgacaagggcttatctagagccctgaggcggcaactgcagtccaggttttcaggcgtgccctcaaaagcccttatgtgggagtga

SEQ ID NO: 10893 - RNA, 1182 nt, unidentified
  source 1..1182: mol_type = other RNA; note = synthetic construct
atggcaaaggacaaaccctattacccgcatcagccaattggcagccttgcgacgctggccaaaacactcggattgccgcctaagctgctatccgacctgtccagaaaggctgatgtcagttacaccccattcaatatcattaccaaaggcggaaagtctagggacgtattcgagcccaagtatgaactgaaaagactgcaaaaacggataaactcgcgactcttcgagtgtgtggaataccctttctatctacaggggggaatcaaggacgatgcgaaaccccgggactatattgagaactcacgaattcacagcgggagccagtttttgatttctctggacatccgggatttttatggcaacatacagcttgagagcgtaagatcagtcttcaagcacctcttcaaatttccagatgatgtgtctgagacgttagttaagcttgtaacccgagaaggccgtgtgccacaaggtgcctgcacaagctcttacgtcgccaacctgatctttcataatagcgagtactcctacgtcaagaaactgagggataagggcttttcctactcccgcttgcttgacgatgttaccatctcctgcaatagattaatccctcaggaagaggctactgagatcatcaagtatgtttcaggcctattcagggaacatggtctgcggctcaggactaataagaccaagctggaacggagtgacgatctgaaagcatcttacagtgtgacaggagtgtgggtgggacatggggtgcctaaaatacgaagagccgaacgcgacatgatccgtcatagtgtgtacatatgtgagcgggagtgcgtgaaagataggtatagcgacgcctaccacgacctctggaataaggtcagcggccaggttgcaaagcttactagattgaaccacgttcaggctccagccctgagagatcgcatgcgggacattctgcccttgtatgattcaaaagccgtggcttccgtgaggcgtgaagtcgacaagatgttaaaacgccctgtggctcaccactctaaagtacccgtgattgatgcataccgccagctggtgaataagctgggtatcctcgggaggacaaacaagaccctggcaaaagccctccgcagacaactcaaggcgaggtttgccggggtccccactaaggctatgatgtgggagtga

SEQ ID NO: 10894 - RNA, 1047 nt, unidentified
  source 1..1047: mol_type = other RNA; note = synthetic construct
atggaaacaaaaggagggaaaattagaaacgtctacgaacccaagtacgagctgaagcgcctgcagaagagaatcaatagtcgcctgtttgaagcggtggaatacccaaagtatctccaaggcggcatcaaagatgaggagaatccgagagattacattgagaattcgaggatacacgccgggagccggttcctgatctccctcgatattcgggatttctatgacaacatcccctttgcgagcgtagtgtccgtcttcaagtatttcttcaagttccccgacgacgtctcagaagttctcgccaaactcgtgaccagagagggtagagtgccacagggagcatgtacaagttcttacatcgccaacctgatattccacaactctgaattttcgtacgtcaagcgcctacgcgacaagggcttcagctatagccgactgctagacgatgttactatttcatccgatcgtttggtggctcaggaagaggccacagcgtctataagatacatcgcagggctttttcgtgagcacggtctgcggctgcgacaaagcaaaactaaaatggaaagatcagacgacctgaaagctccttacgccgtaaccggcgtgtgggttggtcacggggttcccaaaatcaggcgagcagagcgcgacaccatcaggcacagtgtccatatctgcgagtgcgagtatgaaaaggataggtttagcgatgagtatcacgccctgtggaacaaggtgtctggacaggtggcaaaactgacgaggttggaacatgcacaggctcctaagcttcgcaagaggatgcggaaaatactccctttatatgattccaaagccattgcttccatcctgcgggagacagataaaatgcttcggcgccctaagtcccatcattctaagatcggagtgattgacgcttaccggaggttaattaataagctcggcattttgagtcgaactgacaggaccctttctcgtgccatgagaaagcagttgaaggccaagttttcagacgtgccaagcaaagctatgatgtgggagtga

SEQ ID NO: 10895 - RNA, 1179 nt, unidentified
  source 1..1179: mol_type = other RNA; note = synthetic construct
atggccaaagataaaccttattaccctcacgcttccattgggtctttagctatgttggctaagactctgggcgtgcatccaaaagtgctcacagatttagccagcaaggcctccaactcctatacacacttcctggttagcacaaagggaaaggaccgtgacgtgtatgagccgaagtttgaacttaaaaaactgcagaaacgcattaactccaggctcttcgagaaggtgcagttccccaactatctgcagggcggcattaaggacgagagcaatccccgcgactacattgaaaatagtaggatccacgccggtagcaagtttctcatctcattggatatccgaaatttttacgactctataccacttgaaagtgttatttccgtgttcaaacactttttcaagtttccagatgacgtttcagatgtccttgcccggatcgttactagggacggacgggtcccccaaggtggatgcaccagtagctatgtggccaatctcatttttcacaactcggagtattcatacgtgaaaaagttacgtgacgagggattttcttatagtagactactagatgacgtcaccatctcctcgcctaggctgattagccaggacgaggcaacccagcgtatcagatacctcaccggcctgttcaaggagcatggattgcggctgagacaatctaagacaaagctcgaaagaagcgacgatcttaacgcagcttacaaggtgaccggcgtgtgggtagggcatgggatacccaagctgcggcggtccgagagagatatgatccggcattcagtatacatctgtgagaaggaatacgcaaaaaaccctttcagcgacgagtaccacgttatgtggaacagggtcagcggccaggtggctaaactaactcgcctggatcatagtcaggctccaaaactgcgagacaggatgggtgaaattctgcctctgtacgattcaaaagcggtggcatccatctggcgagaagccgatagaatgttgcgccgcccattgtcttctcacaagcgcatcgcagtcatacagagttatcgcaggcttgtgaataagctggggataatgacgagaacgaatagaccgctcgcgaaaaatctgcgacggcaactgaaagccaggttctcaggggtcccctctaaggtaatgatgtgggaatga

SEQ ID NO: 10896 - RNA, 1182 nt, unidentified
  source 1..1182: mol_type = other RNA; note = synthetic construct
atggcaaaggacaagccatactatcctcacgcttccattggatccgtagcaatgctggctaagacactcggggtacaccccaagctgttaaatgatctggccggtagggctactgactcatatacgcatttcgttatccgaaccaaaggggataaggagcgcaacgtgtacgagcctaagtatgagctgaaaaagctccagaagcgcatcaatagtaggctcttcgagaaagtgcactaccccttttatctacagggcggagtgagagacgaagaccacccacgcgactatatagaaaattcacgcatccatgctggctccaagagcctgatatctctggacattcgcaatttttacgataacattccttacgagtcggtcgtctccatcttcaagtatttcttcaacttccccgatgaagtgtctgatctgcttagcaaaattgtcacaagagacgggaaagtgccacagggtgcctgtacatcttcatatgttgcgaatctgatcttccacaacagcgagtacaattttgtgtcccggctcagaaaccagggggtgacctacagccggttgctggacgatgtcaccttgagctccagtcggcttctgagtcaggacgaagtttctggctatataaaatacgtggcaggactcttttcggaacacaagttgagaatcaaaaagtctaagaccaaaatcgaacggtccgacgacctgagcgcagagtatacggtgaccggagtttgggtgggacatggcgtaccgaaaataaggcgggccgagcgtgatctcatcaggcactcagtatacatctgcgagagagaataccaaaaagataggtttagagacgaatatcacgagctgtggaacaaagtgagcggccaggtcgccaagcttactagactggaacattctcaggctttgaagcttagagcccgaatgcgcgatattctgccactatacgatggtaaagcaactgcggccatcattcgtgaggccgacttactcctgaaacgtcctaggactagccatgtcaaggttagtgtcgtgaacgcttaccggcgattgattaatcgactgggcattctcactaggacaaacaaaacattagcccgcgggcttcggaggcaactgaagaccaagttttcagatgtgcccagtaaggtgctaatgtgggagtga

SEQ ID NO: 10897 - RNA, 1182 nt, unidentified
  source 1..1182: mol_type = other RNA; note = synthetic construct
atggcaaaggacaaaccatattaccctaatgcccctatcgcatccattgaggtgcttgcaaagtgcctgggagtctctccccgcgtgatgctggacctggctggaaaagtaggatcatcctatacagaattcttggtgtctagtaagtccaaagacagaaccgtgtacgagccgaaattcgagctgaagaagctgcagaagaggataaatagcaggatcttctctgcggtccagtttccgacttacttacaagggggaatcaaagatgccaagtcaccccgcgactacgttagaaacggggagtttcatgccggtagctgtatgctggtgtctctcgatatccgaaacttctatgataacatcaagagggaaagggtagaggatgtgttcaagaacttctttagattcccccctgatgtctgtcaggttctcaccgacctggtaacacttaagggcaaggtcccacaaggcgcttgtactagctcctacattgctaatctagtgtttcacaattctgaatactccatcgtgagctatctacgcagtaaaggcattacgtacacccggctcctggatgacgtgaccttgagttcgaaaaagcctctcagtgacgagagcctgtctgatgtgattggccgaattagtggcatgttcaagaagcatggactccggatccacccaggcaagaagaagatagagttggcctcggactccagatcagactataaggtcactggggtatgggtggggcatggggttcccaaacttcgtcggaaagaaagggattatattcggcatctcgtgtatatctgcgagtgcgaatacaagaaagatccaacacaggactcttatcacgagctgtggtcaaggacttctgcccacgtcgccacaatgacccggcttgagcacagtcagagcgtcgaactcagaaaaagaatgagcaagatacttcccttattttccgaagcccgcaaaaaacaagttatcgtggaagcaggtaagctgctgcggcgcgacttttccaaagctatgagattgggtgttataaagacgtacaacaaaacaatgcactccttaggtatcttgagccgaaccgatcgtgcgaagagcaaaaggctgcgcaaagagctgcgtctgaaattttcaggcattcagtcaatgcagcagtactgggagggctga

SEQ ID NO: 10898 - RNA, 1182 nt, unidentified
  source 1..1182: mol_type = other RNA; note = synthetic construct
atggcaaaagataaaccctattacccaaacgcgagcatcgccagcattgatattctcgccaaatgtctgggggttagcccaaaggtgatgcttgacctcgcatccaagactgaaagctcctacactgagtttctggtatcatctaaatccaaggaccgcaccgtgtatgaaccgaagttcgagctgaaaaaactgcagaaacgcataaatgcccggatctttgccgctgtacagttccccggctatctgcagggcggcataaaggattccgattctcctagagattatgtgcgtaacgggaaatgtcatgccggttccaatatgctcgtcagcctggatatcagaaacttctacgacaatataaagcgagagagtgtggaagacatctttaggaacttctttcggttcagccccgaggtatgcagcgtgctgacagacatcgttacactgaagggaaaggtacctcagggtgcctgcacgtcttcgtacattgccaacttggtcttccacaatacagagtacagtgtcgtctcttatttgagatcccgggggatcacctacaccaggttactcgatgatgtgaccctgagttccaaatctgagcttagtgacgaggttctaagtgagatcatctttaaggtgtccggaatgtttaagaagcataaacttcgcattcaccctggaaaaaagaaaatcgaaatcgctaaagacagtcgctccgaatataaggtcactggtgtgtgggttgggcacggcgtcccaaagctccgacggaaggaacgcgactatattcgtcatctagtctacatctgcgagcaagaatacaaaaaggacccctctgtcgacagctatcacgagttatggaatcggacttcagctcatgttgcgacaatgactagaatggagcactcacaggctgtggacctccgggagcgaatgtctaagattttgcctgtttttggcgtggatcgtaagacacaagtgatagtggaagccaacaaacttctgaggcgcgatatttcaaataatgtgagaatcggcgtgataaagacgtacaacaagaccatgcactcgctgggaattttgagcaggaccgacagggcagcatcaaggtactacaagagagctctgagaaggaagttctcaggggtgaaaaccattcagcagttctgggaagagtga

SEQ ID NO: 10899 - RNA, 1179 nt, unidentified
  source 1..1179: mol_type = other RNA; note = synthetic construct
atggcaaaggaccggccttattatccaaacgcaagtatctcttcgatcgatgtcttggcaaagtgcctaggagtgtctccaaaggtgatgttatctttggccaaaaatagctctaatagttatacccagttcacagttcccagcaagggcaaggacagggttgtgtacgaaccgaaactgaatctgaaaaaaatacagaagcgcattaacagccgaattttcgagcatgtgcaatttcccccttacctgcagggaggtatcaaagacaacctgagcccacgggactacgtagagaactcaaaatttcacgctgggagtagcgtcttggtgtccctcgacataaggaacttctacgataacatcaaatacgattccgtctacgacgtatttctgtatttcttcaagtttgagccatcagtgtgtaccgtcttaacagacttagtcactctaaacgggaaggtgcctcagggggcctgcacatcttcttacatcgccaatctggttttccataatcacgaatattccctcgtctcctactttcgaagcaagggaattacctatagcagactcctggacgacgtaactctctctagctcaaaagagatccccccccaggagattgaagaggctattagtaaggtggccgagatgtttaagcgacacaagctgcgcattcaccccaaaaaaaaaaaaatcgaagtgtccagtgacaccagatccgagtacaaagtgacgggtgtctgggtgggacatggcgtgcctaagctgcgtagaaaagagagagattatatacgccaactcgtatatatctgtgagttggagtataagaaggaccccacagcggaagattatcacgatctgtggaatagggcttctgcccaggtggccaagatgactcggttggatcactcacaggccagcgctctcaggtcccgtatgagtaagctgctgccgctctactcccctgcgaagcgcaaacaagttattatcaaggcaaaaacccttctttcaagaaataagtccgatgctaaggaacttggcttcattaagatgtacaacaaaacgtaccatagccttggcatactgtcgaggactgataagccaacctcacggtactataaggcagccctggaacggaagttctcagttgaacctatcaaacagttttgggagaattga

SEQ ID NO: 10900 - RNA, 1182 nt, unidentified
  source 1..1182: mol_type = other RNA; note = synthetic construct
atggctaaggacaaaccgtactatccccactcaagcatatcaagtattgatacacttgctaagtgcctcggcgtggctcctaaagtcatgctggatctggccagagatacagaaaattcttacactgaattcgttgtgccatctaaggggaaggacaggaccgtttacgatcctaaacataatctcaagaagattcagaaacgtatcaactcacggatatttgaacatgtcttattccctgaatacttgcaagggggaatccgcgatgtcgatagtccccgggaccacgtaaacaatggacgagcccataccgggagctccgtgctggtgtcacttgacattcgaaacttttacgacaatatcaagtacccgtctgttttcgatgtgtttaagaacttcttcaagtttccagacgaggtgtcaaaagtcctggctgacttggtcacgttccgcggcaaggtcccccaaggtgcctgtaccagtagttatgtggccaatctggttttccataacacagaatatagcgtggtgagctacttaaaatcgagaggtattcagtatacacggctgctcgatgacgtggcactgtccagcaacagagtgatctcaaaggccgacctggagggcgccatagagaaagttgccggaatgtttaagcgtcataaactgcgtatccaccccagaaagaagaaaatcgagtactcctccgactccagatcggagtataaagtgactggcgtgtgggttgcgcacggggtacctaagttacggaggaaggaccgagactacatcaggcacctggtccacatctgcgagctagagtttctgaaggatccaaccgctgattcttatcacgagctgtggaatcgcagctctgctcaggtagcgcagatgactaggctcggacacagccaggcagcatccctccggagtcggatgagcgaaattttgcctttgtacggcccctccaggaaaacccagctaaacattgaggtgaaaaaactgctcggtcgcaagcaatctgagtctaatagtctgggcttcatcagaacttaccacaagcttataaacgcacttgggattttgtccaggaccgataggggactcgcccgcagctatagaggcctgcttacggcaaagtttccacatgtgcgctccaaagtaaaatattgggaacagtga

SEQ ID NO: 10901 - RNA, 1182 nt, unidentified
  source 1..1182: mol_type = other RNA; note = synthetic construct
atggcaaaagacaaacccttttatccgcatgccccaatcagcacccttgacgtcctggctaaaagcttgggcgtgagcccccaggtaatgtcaaagctgagctctagtgcggatgatagttacacagctttttcagtgagttccaaaaacaaggaccggacggtttatgatccaaagtataacctgaagaaactgcagaaacgtatcaattcaaggatcttcgaacacgtggtgtttccacagtacctccacggggggattagagacgtgtcacattccagagattacataaataactctcgcatccacgcaggttcccgcgtcttggtcagcctggatatcaagaacttctacgacaacattaaacgggactccgtcttcgacatctttaagtctttctttcgattccctgacgaggtgtctacactgctgaccaatgtggtgaccatgcgaggcaaagttccacaagggggatgtaccagttcctatgtggccaatctcattttccataacacagagtactctgtcgtgtcatatctgagatcgtttggaatcgagtacagtcgtttactagacgatgttacactgtccagcagccatccaatacccccggagaagctggaacaagctatctctaaagttgcaggtatgttcaagcgacacgggttgagagtacaccctcacaagaagaaaatcgaaagctcctccgattcccgctctccctacgaggttactggcgtgtgggtcggacacggcgtccctaagatccgcaggaaagatagggattacgccagacagctcgtgtatatttgcactaaggagtatctcaaagactacacttcagatgcgtaccatgccctgtggaataagagttcagcccacgtggcaaggatgacccggttggatcacgcccaggcacgccaacttagagacagattaagcaaaattctccctcagtatagcgcggctcggattaaacagctgtcgttcgaatacaagaagctcataaataggcccgtggctgacgtagccacgcttggctttagtaagagctttcataagctcatacattccatcggtattttaagccggactgacgctcacctagcccggcactataggaagtccctgcgcgccaagttccctagggtactttctaaagccgatcattggggaatttga

SEQ ID NO: 10902 - RNA, 1182 nt, unidentified
  source 1..1182: mol_type = other RNA; note = synthetic construct
atggccaaagacaaaccctactatccgctctcaccgatagcaagtatcaacgctctggctaaaaccctgggggtcgtgcctaagctcctggtcgatatagcagccaatgtatcaacaagctacacttctttcgatattgaatctaagaagggaaaactgaggacagtctatgaccccaagtacgagctaaagaggctccagaaacgcattaattcccgtatatttgagaaggtaatctttcccctttatctgcagggcgggattaaggatcaggagaatcccagagattatgttgagaattgcaaattgcatgcagggtcaagctttcttatctcgctggacatcaaaaatttctatgacaacatccggatgtcttccgtgttcgatattttcaagtacttcttcaagttccctgatccagtgtgcgaaatcctgaccagcctcgtgactttggatgggcacgtaccccaaggcgcctgtacctcttcttacattgccaacttagttttccacaattccgaatataagctcgtgtcatgttttagagatcagggactgaactacagtcgccttttagacgatgtcaccgtcagcagcaaaaacttgatttcacaggagaagacaactgacatcatcaggtccgtcgcggctgtgtttaagaagtacgacctacgactgaattccaagaaaaccaaggttgaaaggtctgatgatttgggtgctgactttaaagtcacgggcctgtgggttggccatggtcagccaaaattgaagaaggacgaacggcggtacattaggcaactagtgtatgtgtgcgaaaaagactaccagaataacccttgtagcgagaagtatcatgaactgtggaaccgcgtgagtggaaaagtggccatcctgacacggcttaagcacgtggaggcccagaacctccgagccagactgggttgtgtgctgcctctctatgatgaggacgctaaagccaagatttgctttgagagtaaaaaacttctccgcagacacccatccacccacagcaaagtgggcgttatgactgcgtaccacaagatcatccatagtttgggaatactgacacggacggacagagcacttgctaggtccctgagaaagcaactgcgagcacgctacagcgccctcccattaaagcgtgacatttgggagtga

SEQ ID NO: 10903 - RNA, 1182 nt, unidentified
  source 1..1182: mol_type = other RNA; note = synthetic construct
atggctaaggacaaaccgtactatcccctatctccaattgcatccatcgagacactggccaaggcactgggggtggtacctgggctccttaaagacttgggcgaggatgcgtctaatagctacactaagtttgacatagtaacgaaaaacggcaaagaaaggacagtgtacgaccccaagtacgaattgaaacggctccaaaagaggattaatagtcgcctgttcgagaaggttatctaccctggctacctgcagggcggcattaaagatccaaacaacacccgggattacgttgaaaattgcaagttacacgctggaagcaagttcctcatttccctggacatcaaaaatttttacgacaacatccgtgagacatcagttctgtctatattcaagcactttttcaagtttcctgacgacgtaagcgtgttgctcactaagctggtgaccctgaatggtcgcgtgccacagggagcttgtacctcatcctatgtcgctaacttagtctttcataatagcgagtattcgctcgtgagtaaactgaaaagtcggggtcttgtctatacccgactgctagacgatgtgactatttcttccagtactctgctgacccaagatgtggccacggacctgatcaaagatgtggcggccgtgttcaggaaacacaatttgcgacttaacaactccaaaacaaaagtggagagaagcgatgatctcgctgccgagtataaagtcaccggattgtgggtcagccatgggcagcctaaactgaagaaggaggaacgcaggtatatcaggcagctggtctacatctgcgagcaggagcatcagaagagccccttcgaagagtcttatcatgatctttggaatcgcgtgtccggtaaggtggcaattgttacacgcttaaagcacgttgaagccgccgacctgcgtggacggttatcaaaaatacttcccctctatgacagcaccaagaggtcacagatccttttcgaagcccagaagttgctaagaaagcacccatcaacccatactagaatgggcgtgatcaactcttaccacaagataattcacgctatcgggattctgacaagaactgatagagttctcgcaagagccctccgacggcaactgaaggcaaaatttagtgatctcccgctgaagtcccaggtctgggaatga

SEQ ID NO: 10904 - RNA, 1182 nt, unidentified
  source 1..1182: mol_type = other RNA; note = synthetic construct
atggctatggacaagccttattacccctacagacctatctctagtatcgatgcattggccaggactctcggcgtcgtgccaaagctgctgtgtgatcttgcagacgaccctgccacttcgtatgtgaaattcaccattttctccaagaatggcaaacagcgggacgtctatgaaccgaagtacgaattaaagcgtctgcagaagaggatcaactcccggatatttgagttggtgatctttccctcctacctgcagggtggaattaaggacgtcgaattccctagagattacattgagaactctaaaatccatgcgggatctggcgcgctcgttagcgtggacatcaaagatttctacaattccatccgagagccctccgttctctccatatttaagaacttcttctcatttccggacgacgttagctgtctgttaacacggctagtgatgttggaaggccgcgtgccacagggagcatgcaccagttcctatgtggccaatctcatttttcacaacagcgaatattcactggtgagtaagtttcgcgccaaaggcctggcttattctcgcctgctagatgatgtgaccgtgtcagctaccaaacccatttcacaggaggaaagtacacttgcgatcaaaagcattgctgccatggctcgcaagcatgacctgagactgaatagcaagaaaacgaaaattgaaaggtcagatgatatcaatgccgattatgcagtgaccggtgtctgggtagggcacggagtccctaaactgcggaaggatgagcgacgacatatccgccacttggtctatatttgcgagaaggagtacgccaaggactgcttctctgtggaataccatagcctgtggaatagggttagcgggcaggtttcaaagttgactcgtctgaagcacgcccaagcaaaatcgctcagagagaggatgggcaacatccttccaaagtacgacttccaagccaaagccaagataatatatgagtgtagcagactcctccggcgccccgtaagctctcacaagaaaatcggggtaataaacaactaccgaaggttaatctactctattgggattctttccagaacagaccggagtacagctaaagcccttcgtagacagctggtggagaggtttgcaggtgtcccatccaaagctgagatgtggagttga

SEQ ID NO: 10905 - RNA, 1182 nt, unidentified
  source 1..1182: mol_type = other RNA; note = synthetic construct
atggccaaagataagccttactacccccatcatccgatcggaagtgtggaaagcctggcaaagtgtctcggcctgcctcctagactgttgaaagacctcagcgaagacacctcaaacagctacaccgagttttctattacctctaagtccgggaaagaaaggattgtgtatgacccaaagttcgaactaaagaggctgcagaaacggatcaacagccgcctgtttgagggcgtattctacccctcctatctgcagggagggatccgagatcagaaaaatccccgtgactatatcgtgaacggtacaattcacgctgggtcaaagaatctgataggcatcgatattaaggacttctacaacaacataaaggaggagtcagtcaagcccattttcacgaggttattcaattttccagatgccgttgcttcgattcttacaaagttagttacccgtgatgggcgggtgccacaaggtgcctgtacaagctcctatgtcgccaacctggtgttctttaactcagaatacagcctggtcagtagaatgagggcaagaggtttttcctacactagactcttggacgatgtaacattatccagcaaacggcctatcaccaaggaggaaagtactgaactgatcaaggaggtggcggcgatattcaagaaacacaatttgcgcctaaacaataaaaagaccaagcaggagtctgccggggacgtcaaagctgaatataaagtgacgggagtgtgggtgggccatggcatccccaagctacgaaaggcagagagacggcacatccgccatctggtgtatatctgcgagaaagagtatcttaaatgccgcttcagcgaggaataccacgccctgtggaataggatatctggtcaggttgctaaactcacacgactcgagcacagtcaggctgaagacctgcggcttcgcatgtctggaatcctccccgagtacgataatcaaatgaaagcctccattatctttgaagcagataagcttttgaagaagcctgtagcccaccacgtccgcccaggagttatatcatccctcaataagaccctgtatagtcttggcattctgactcggactgacaaaccactcgctagacattacaaaaaaatgttgaggctgcgttttattaacgcaccgactaagtctgagatgtggggctga

SEQ ID NO: 10906 - RNA, 1173 nt, unidentified
  source 1..1173: mol_type = other RNA; note = synthetic construct
atggataagccatactatccgcataatggcatcagtagcatccagagccttgcaaaaaccttaggtattcacccttcacttctcgtggatatcgcttctaaaaccaccgactcttatactgagtttcagattacgagtaagaacggaaagattcgcaccgtatatgatccaaagtatgaactgaagcgaattcagaagaacatcaatcagaagatcctggagaaagtggagtaccccacctacctgcagggcggaataagggatctcgaaaatcgtagatcctatgtggacaatgcggggatacacgctggcagcaaccacatactgtcattggacattaagaacttttacgacaacatccgccctgagaaagtgaaagaaatcttcctgtacttctttaagttctctgatgagacatctgaattgctaactaaattggtcacactggggaataaagtgccccaaggtgcctgcacttctagctatattgccaaccttgtcttctttaattcggaatacaggatctttagcgaactcaagtccaagggaatctcgtacagtcgcctcctggacgacgttaccttatcctctagaaaacacctgagccgggacgaggcctcagagcacatacgccttgtttgctctatctttaagaagaatggcctgaggctgaacaacaagaaaactaagaatgagctaaaggggtccaaccccaatttcaaagtcacaggtttatgggttgagcacaaaaatccaaagattccaaagaaggagaggcatcatacacggcacttggtgtacatctgcgaaaaagagtatgctaaaagccctagctcagaacactatcatcagctgtggaataagacatccggccaggtggccaagctcaaacaactggggcattcacagcacaaacagttgaggactagactgaagaaaatcctgcccatccttgatgagagtagtaagaagaagttgattctcgactgtaaaaaactccttcacctggaacggaacgcaaaagagcgtttcggagtactgaaacggatcaacaagtgtatttacatgttaggcatactgtccagatccgacaagggactgtccagcaacctacgaagacaactgctcaaacatttcggggatctccctacgcataaggattactggatttga

SEQ ID NO: 10907 - RNA, 1191 nt, unidentified
  source 1..1191: mol_type = other RNA; note = synthetic construct
atgaaattaaagccacactacccgcataatccaatcgcgtctattgaagcccttgccataactctgggaatccatcccaaactcctgcaagacctggccaataaggccaacgatagctatattaactttacagtgagcagtacaaacaggaagggcgaggacaaagatcgtcacgtttgtgaacccaagcacgaactgaaaaagctccagaagagaatcaatagtcgtattttcgagaaagtggagtatcccaattatctacaaggtggcattaaagatgaggagaaccccagggactacgtcgctaacgccacacggcatgctaacgcaaatcagattatatgcatagacgtcaagcagttctacccttcaattaaatctcagtacgtggtcaaggtgttccaatattttctcaactttcctcctgacgtgagcgagattctgacgaaactcgtgacctatcatggtcgggttccgcagggaggatgcaccagctcctacatcgcaaacctcatattttacgataccgaatacttgctagtgtcagaactgcagaagcacgggatccagtattcccgattgctcgatgacatcacgcttagcacacaaaaaaatttcactaaggagcaggagaatttctacattaagaagattgccgacatcttcaaaaaatacgagctgaagatcaacaataagaagaccagaaatgaacactcatcaaacccagccgtatcctttgaggtcactggcctgtggataggccacaagaagccaaaggctagaaaagaggaacgaaggttcatccgccagctggtgtttatgtgtgagagagagtacacccagtctccctattctgagaaataccatgaaaggtggaacgaagcgagtggcaaagtagcaaagcttcagagattagaacaccttcaggcaacaaagttgcgcgaacggctcggaatcatcctgccattgtatgatgaaaacatgcaatcccagataaatcaggagactaagaaactggtcaagctgtccgctcctcaaaaccagcggctggggaacatcaaacgcgtgaacattctgattcacaaattggggattcttgcacgcaataataagagcctggctaatagtttaaggtcgcagatcaatgaggtttatgccaacaagcctaccatcaaagagatctgggaatga

SEQ ID NO: 10908 - RNA, 1191 nt, unidentified
  source 1..1191: mol_type = other RNA; note = synthetic construct
atgaagctcaagccccactacccatataatccgattgcgtcaatcgaggccctggccaccactctgggcattcacccaaagttgctgcaggatttagctaacaaggtggacgattcttacacgaactttatcgtgaaaagcaaaaacaagaagggcgaacagaaagatagggacgtatgtgaaccaaaatatgagctgaagaaactgcaaaagcgaataaactctcggatttttgaaaaagtcgagtatcccttgtatctccaggggggtattcgggacgaagaatcgccacgtgattacttcgccaacgctacctgccatgctaacgcaacccagatcatttgtatcgacatcaagaagttctatcccaacatcaagtctaaatatgtcaccaaagtcttccagtacttttttaagttcccccccgatgtgagtgagctccttactaaactagttacataccatgacagggtaccccaaggcgggtgttcaagcagctacattgcaaacctaattttttacgacacagaatacctgctggtgagtgagctgcagagacattccatccagtactctcggctattagatgacatcaccctgtcatcccagcagaatttcaccaaggaccaggaaacacagtacatccagaagattgcaaagattttcaagaagtacgagcttaagatcaactccaagaaaacgaaaatagagcacagagccaatcctgaggtgggattcgaggtgacaggactctggattggacataagaaacctaaagcacgaaaagaagaaaggcgttttattcgccagttagttttcatgtgcgagagagagtataagcttaacccttgcagcgaaaaataccacgagagatggaacgaggtgtccgggaaggtggctaaattgcagcgcctcgagcacctgcaagccaggaaactgcgggaacgactcagactcatccttccgctgtatgatgagaatgttcaaaatcagatcactcaggaagcgaagaagctgattaaactgcctagccctcaaaatcaacgcttgaataatataaagcgggtcaaccagctgatatataagctgggtatccttgcccgcaataataagactctcgctaacagtctgaggttgcagatcaataaagcctatgccaataaaccaacaataaaagagatctgggagtga

SEQ ID NO: 10909 - RNA, 1179 nt, unidentified
  source 1..1179: mol_type = other RNA; note = synthetic construct
atgaagctagctccacactatcccaacaatcccattgcttctgtggaggccctagcaataaccctggggatacaccctaaactgctgctcgacctgtccaataagattgacaacagttacactagtttcttaacccctcaaaaaaacggaaaggaacgcctggttcacgaaccgaagtatgagctgaagaagctgcaaaagagaatcaattcacgaatctttgagaaggtggaatatccggagtaccttcagggtgggatcaaggatgaaaacaatcccagagattacgttgcaaacgcactgcggcattcccacgctaaccagattatatgcattgacattaagcagttctaccctaacattaagtccgaatatgtctccaaaattttccagcacttctttaagttcccagcgcatattgctgaactcctgaccaaaattgttacccttcataacagggtgcctcagggagcatgcacatcaagctacatcgctaacctcctattttatgataccgagtatctccttgtctctgagctgcagaaacacaatatccagtatagtcgattactggatgacatcactttgtcaacccagacaacgttgactaaagaacaggaaacgttttacatcaagaagatcgccgcccttttcaaaaagtacgagctcaagattaatggcagaaaaactcgtatagaacaccgggccaacccagaggcctctttcgaggttacaggactgtggatcgggcacaaaaaaccaaagagccgcaaagaggagagacgatttatcaggcagttggtgtttatgtgtgagcgggagtataaggtaaatcgctgtagcgaaaaataccatgaaaggtggaatgaagtctcgggtaaggtggccaagctgcaacgtctccagcatgtgcaggccaaaaagcttcgggagcggctcagcctcgtgttgcctgtatatgacgagcccatgcagaaacaactgatccaggagacaaaaaaattggtcaaggtgacagcgccccaaaatcagaggatcggcaatatcaagagagtgaactccctgtactaccgcctgggcatactgggccgcaacaataaatctttagccaatagccttaggctccagttgaacaaggtctacggcaacaaacaaactaaaaaggaaatctgggagtga

SEQ ID NO: 10910 - RNA, 1191 nt, unidentified
  source 1..1191: mol_type = other RNA; note = synthetic construct
atgaagttaaaaccccactatccacacaatcctattgccagcattgaggctctggcaaccacacttggtatacatccaaagctcctccaggacctggcaaataaagccgacgatagttacaccgactttctaataacctcaaaaaacaggaaaggcgaggtgaaagataggaccgtctgtgaaccaaaatttgagctcaaaaagctccagaagagaattaacagcagaatctttgaaaaggtggagtaccctctgtatttacagggcggaattagggatgaagagagccccagagactatgtggcaaacgcgcagattcatgcgcatgcaaatcagatcatttgtatcgacattaagcagttttacccatctatcaagatcccccacgtcaagaacatcttcaagtacttcttcaaattccctgaagaagtcagtgagatgttggccaagttggttacttacagaggagctgtgccccaaggcggatgcacatcgtcttacattgccaacctgatattctacgatacggaatatttactggtgtcagagctgcgtaagcactccgtcaaatatagccggctgctcgatgacatcaccctgtccgccgagaaggatttcaccaaagagcaggaagaatttttcatccggaaaatctcagccatgtttacgaagtatgggctatccatgcacagcggaaaaaagaggatagagcaccgctccaattccgatgtaagctttgaggtgacagggctctggattggtcataagaaacctaaggctaggaaggaagagcgccgcttcgtacgccaactggtgttcatgtgcgagcgggagtacaaagtgagcccatacactaaagagtatcatgaacggtggaacgaagtctctgggaaagtggctaaactgcagcgtctggagcaccagcaagccaagaaccttcgcaaacggctggggctgatccttccgttgtacgacgagaatatggagaagcaattgactcacgaaacaaagaagctgatcactctttctctgccccagagtaagaggcctggcaacataaagagagttaattcgttgatcaacaagctcggcattctgtcacgaaataacaaagccctggcacgatccctacgactccagctttctacagtttatgctgacaagccgagtaataaggagatctgggaatga

SEQ ID NO: 10911 - RNA, 909 nt, unidentified
  source 1..909: mol_type = other RNA; note = synthetic construct
atggacaaaccattctacccatttcccggtatcggctcagtagaagcccttgctaaggctttggatgtgcatcacgatctgcttctggacatagcgaaaaaagtggaccagtcttatacgagctttgacataccgaaaaagaacaactccggctaccggactgtctgcgagcctaagcacgaactgaagcgcctgcaaaagaaaataaactctcggatcctcgagctggtgaaataccctagctacctccagggcgggattaaagataaaagtctctctcgcgactatgttaaaaacgcagccattcatgtgaagcccaccgttctgatctcgctcgacatcaagaatttctaccctaatatccatcgatctcacgtgttaaatgtcttcaagaatttcttgggctttcatcccgatgtggcagaggtgctgacatgcttgaccacactcaatgatagggtacctcaagggggatgttgttccagctatctggctaacctgattttctttggagacgaattcaaactcgttcagaagttgaggaagctgggatggagatactcccgcctgttagatgatattagtatctcatcaacagacgacattaaggacaatatcagccccattaaggagatctcaagcctatgcaagcgttacggtctgaaactgaacaacagtaagaccgatgtctcccacaggagcaatggagtagcttcccttgccgtcactggcgtgtggattgggcactctgaagccaaactacggaaggatgagagaagatatatcagacagcttgtttatgtgtgcgagaagaaatatgccgatgacccatgtgatagtaaataccacgacttttggaacagggtgagcgggaaggtcgcaaagctctcccgaatggaacatgtgtga

SEQ ID NO: 10912 - RNA, 1197 nt, unidentified
  source 1..1197: mol_type = other RNA; note = synthetic construct
atgccccagaagtccgccaaaaagcctcactatccgtacaaacccatcggctcagttgaaacccttgcaagaatgcttggcgtgcatccaaaaatcttgacagatattgcaaaccgtaccgacgactcctacactgacttcactatcacgacgcctagtggaaaagagcgcaatgtttctgagcccaagttcaccctcaagaagatccaaaaaaggatcaataggaccatcctcgaaaaggtggagtatcccctttatctgatgggagggatccgcgaccttgaagaaccgcgggattacgtgagcaatgccagtgcgcacgctggcgctagcaccattattaagctggacatcaagaacttctaccctaacatccggagacaaaacgtgtacgatatctttcggtacctcttgcgatttccagagcctgtatctgacctgctaacaacattatgcgtaagacaccatcgtctcccacagggcgcctgcacttcatcttacctggccaacctgatattttttaatgccgagtatcagttggctgctagcttcgaacgccaggccatcgcgtacacacggctgctggatgacataaccatcagcagcccaaagcaattaactcccgccaagacgaccgagatcataaggtcagtcgcagcaatgtgtaagaaacatgggctgaagctgaataataagaagaccagagttgatcgagtgcaccagagggactccgactacattgtgacagggctctgggctaaacacagtgtcccgaaagtcccaagacacgagagacgcgccatccgcaagatggtccacgattgtgagaacaggttcaccacagatcccgcatcgcctgagtatcatagtatgtggaaccaagctagcggaaaaatagccaaactcaaacggctgggtcattcccaggcccagcctttgcgggcacgaatgagaaagattcttccccagattggggatcaggagaaggataatctaattctcgaatgcaaaaagctggcaaacaaatcacggcgaaacacagataggattggtcacattctgagagtgaatcgggccatacataaagtgggcctgttgtctaggactgacaagaggctggctcgctccttacgccgtcaggtggtcgcggcttatcctaacaaaccaactattaaggactattgggaaattaagtga

SEQ ID NO: 10913 - RNA, 1032 nt, unidentified
  source 1..1032: mol_type = other RNA; note = synthetic construct
atgtcatataagcaattcaaagtggaaacaggaaagaataagaaggaacgccagattttcgaaccgaaacgaagcctgaagggtatccaaaagaagatcaacaaggaaatctttgagaagattgattacccacattatcttcacggggcactgtcgggcagggattatatttctaatgcagccgtgcacactagaaagagaaccgtgatctgtcttgacataaccaacttctacccctctataagcaagaaagatgtctgcagcatatttaagaacctgatgcgattttctcccgaggtgtcattgtgcctgaccgagcttgtcacccttaatgacaaggtgccacagggcggatgctgtagctcctatattgcgaacttgctgttttttaattcggagtacaacctgtacaacaggttgaaatctatgggactatcatattcccgcctgttggacgatatcacaatcagtagtgacaaagacctctcctccgaagagaaaactaaggtaatcaagctcgtccacggaatggttaatcagtacagactgagtatcaatgagagcaaaacgactattgagcattcaaaggatagctctagcaagctgtccgttacaggcctgtgggtaaagcacggggtgccaaaactgactaaggagaaccggcgttacattcggtacctggtttatatttgcaaaaaacagggcgcttatgagagacataccaaggaatatcatgacttgtggaacaggtgtagtgggaaagtggcccagatgtctcgcttaggtcacgtgcaggctgttgaactccgcgcaatactctccgagatcatgcctgtgtatgacgactacaaaatttccaagctaaagttaatggccaaacactacctcaataaattcacgcctcctctgacagacgaccagattcggaaaatcgatcgtatgttatacgatttcgatatcgtcggcagaaccaataaaaacctcgccaaactgtaccggaggaagcttgtcgctctcctgcccgataggtga

SEQ ID NO: 10914 - RNA, 1140 nt, unidentified
  source 1..1140: mol_type = other RNA; note = synthetic construct
atgaataaaccgcgcttcaatgggacacctattgcctcactggacagtctggcagctatgctgggaattgatagaaagagattggattggatggtactgtccgtgtcaaggtcttataaacagtttacggtcgagacagggaagaataaaaaagagaggaagatctttgagcccaagcgctcacttaaaggcattcagaagaaaatcaacaaggagattttcgagaacattgactaccctcactacctgcacggggccattaccggccgcgattacatcagcaatgcttcagtccacactaaaaagaagaccataatctgtctggacattaccaacttttaccccagcattagcaaacgcgatgtgacactcatctttaaaaatcttatgcgtttctccccagacgtgagcattgctttgacagaattggttaccctgaacaaccaggtaccccagggaggatgctgttcttcttatatcgccaacctgctgttcttcaactccgagtataacctatataatcgactccagtctatcggttactcgtatactcgacttttagatgacatcaccatatctagtgatgaggatatctcccttgaggaaaaaactaaggtgatccagctagtgtacaggatggtcagtcagcacagattgtctataaatgaagacaagaccactatcgagcatacaaaggactccagcagtaagctctccgtcacgggcctgtgggtgaaacacggcgtgccaaagttaaccaaagaaaataggcggtatattagatatctcgtgtacatttgccagaagcaagcagcatatgagcggcacactaaggaataccatgacctgtggaacaggtgcagcggcaaagtcgcgcaaatgagccggctgggacatgttcaggccaacgaattacggtgtgtgctctcagatatactgcccatctacgacgattacaagatagggaagctgaagtacgttgctaaacattatcttagcaagtttacacatccattgagtgaagagcaaatcagaaaagttgacaggatgatctacgacttcgatatcgtgggtcggaccaatgagaaactggccaaggactatcgatccaagctacgcgccctcctccctgaacgttga

SEQ ID NO: 10915 - RNA, 996 nt, unidentified
  source 1..996: mol_type = other RNA; note = synthetic construct
aaaaagcgaactatcttcgaaccaaaaaaagccctcaaagccctgcaaaagaagattaaccgggagatctttgagaatgtgacatatcctagctatcttcacggaggactgaaggaaaaagactacataagtaattccgcaagtcacacaaagaagaaaacgatcatatgtatggacattcaggatttctatccgagcattagtaagagagatgtccaccaaatttttcaatacctgatgcgtttttcacctgatgttagctccgcgctgactgagcttgtcacactgaacgggaaggtgccacagggtgcatgttgcagcagctatatagctaacctggtgttcttcaataaggagttcaacatcgtgaacaagctctctaggaaaggactgtcatacaccaggctgttggacgatatcaccgtcagttcagataacgacctctctgatgccgaaaaaactgagattattcagctggtaaccggtatggcccgttcctatcggcttaacatcaataaagacaagacttctatcgagcactctaaggattccaatgctaagctccaggtcacagggttgtgggttaaacatggcatccccaagttgacaaaagcagaccgccgctacattaggtaccttgtgtacatttgcaaaaaggactatgatgccaagaaagacagcgtggagtaccatgatctctggaacaaatgctctggcaaagttgctcagatggaacgactcggccattcgcaggccaaggacttaaggcagaccctatcagaaatattgcccatttacgacgagtttcggatcaagaagtgtactatgtttgccaagagatacatcaagacgttttcccccccactgtccgaagagcagatcagcaaggtgaataaactgatttacaaattcgggatcgtagctagaacccagaagaatttagcgaaaacctatagacgcgagctacgggcattactgcctatcgaaaagcaatga

SEQ ID NO: 10916 - RNA, 1143 nt, unidentified
  source 1..1143: mol_type = other RNA; note = synthetic construct
atgatgaagcccctattcaatggcacccaactcgcatcccaggactctttagctgcaatgctcggagttacaacagagaggttgaataaaattgtcctgtccatccctaaaagctataagagcttcaacattgaaacggggaagaacaagaaggtccgaacattatttgaaccaaaaaaggggctgaagcatatccagaagaagatcaacaaggagatattcgagaacgttaattaccccaattacctgcacggcggactgaaagagcgggattatgttagtaatgccgggactcacgccgggaaaaagaccataatttccctggacatcgagaacttttacccctcaatatccaaaagggacatcttgaacatcttcaagaacatgatgagattttctccttcaatctccgagactctgaccgagctggtcactctcgatggtaagcttccacaaggcgcctgctgttcaagctacatcgcaaatctcatcttctttaacgatgagcacaacattgtaaggaagatcaataatatgggcatgaactatactcgtcttctggatgacgtgacgatttcgtcagacaagaaactgagcaaggaagaagaaacaaaggccatcaccaccgttgtagggatgattaatcgtcatcgcctgtctttgaatgatgcgaagacagtaattgagaaatcagatcatccaaactctaagcttcatgtcaccggcctgtgggtgaaacacaaaacacccaagataaacaaagagaacagaaggtacattcgatatcttgtctttatatgcgagaaagaatctgccgtggacagaactagcaccgagtatcacaccttgtggaacaaggctagtggtaaagtggctcagatgagcagagtgggccacgagcagagtgtggaactccgggaaaagttaggaaagattttgccgctgtatgacgagttcaaaatccggaaaatcgtgttcctggctaacaattacatcaaaaacttttccctgcctctctctgaagaacaggtgagcaaagtgaataagattatttacgatgtgggtatcgtgggacgctccaataaaaagctaagtaatgaactgcggaagaaactccgcagtattcttcctaaagacgcctga

SEQ ID NO: 10917 - RNA, 1140 nt, unidentified
  source 1..1140: mol_type = other RNA; note = synthetic construct
atgaaacctctttttaacggcacccagttaagtagccactcaagtctcgccgccatgttgggcgttactccggaaatcttggataagatcgtgctgtctattccaaagtcctacaaggacttctgcattaaaacgggtaaaaacaaaaaggaacgagctatctttgagcctaaaaagggcctgaagtacattcagaaaaagatcaacgaggaaatcttctgcaaagtgaagtacccagtatatctgcacgggggcctaaagaatagagattatgtgagcaatgctggttttcattcaggtaagaagaccatcatatctttagacatcaccaatttctacccatcaattagcaagaaggatatcctgaacatcttcaagaatatgatgcggtttagcccatcgatcagcgagacactaactaagcttgtgacccttaacgacaaactgccccagggagcctgtacaagctcctatatagcgaacctgatttttttcaatgacgagcacaacattgtctccaaactgaatcgcatgggcatgacatatactcggcttctggacgacatcacgattagttccgacaagaagctctctaaagaagaagagacaaaggctattaccaccgttatcggcatgattaatcgtcatagactctctatcaataacgacaagactgtgattgaaaagtccgatcaccataattccaaactgcatgttactggactctgggtcaaacacaagaaacccaaagtctcaaaagagaatcgcagatacattaggtatctggtgttcatatgtcaaaaggaaagtgtggtggataggacatcgtccgagtatcacaaattgtggaacaaagcatctggaaaagtagcacaaatgcataggctgggacaccctcagtccatagaactgcgggagaaactctcagagatactccccctctatgatgagtacaaaatccgaaagatcgtcttccttagcaacaattacatcaagaactttagtctgcccttgagcgatgagcagattaagaaggtcaacaagatcatctacgaaattgggatagttgggcgcaccaacaagaaattggccaatgagttaagggggaaaatgaagtctatgctgcctaaggtgaaatga

SEQ ID NO: 10918 - RNA, 1155 nt, unidentified
  source 1..1155: mol_type = other RNA; note = synthetic construct
atgaataaaccctactataaaaaatcgcccatagcatcagttgagaaattgagcctcacactcaatgtgaccccagaacgtttggccgtgatcgtcgataacatccacaactcttacaaaacgttcactaaggtcactggtcggaacaagaaagagaggtcactgagtgaacctaaaaagggactgaagaagctgcagaagaggattaatcaggagatctttgagaacgtaagttttcctgattacctgcatggaggcttaaaaggaaaggattatttatccaacgctaaggtacacaccaataaaaagcatcttatttccctggacatcgaaaacttctatccctctattagcaagaagaatgtgcttgagatcttcaagtatatgatgcgtttccctgaggacgtgagtaaggtgctgacagaactggtcactctggatgggcacgttccacaggggtcctgttgctctagctatatcgcaaacctcgtgttctttaataccgagtataactacgtcaaccagcttaagaataaaggctaccattacacacggctactggatgacataactatttccagtgataaggagctcgacaaaaaggaaaaaaccttcatcatcaaccagatgcgcgcaatggttgaaaagcatcgcttgaaaataaacgacgagaagaccaaggtggagtcacacacggatcttcgctcttcttttgaggtaactggcctgtggaccaaacataagaatccaaaactcagaaaaccccaaagaagacacattagatacctggtgttcatctgtagcaagcaggccgagtatgaaaggacaagcaatgaataccatgccctgtggaataaggtgagcgggaaggtggcgcagatgcaacggataggtcacactcaggctaaccagctgcgagaacaactgaccaagatccttccgatttacgacgacttcaagatcaagaaggtgatttacctagctgacattctcagcaagacaaagaaagaggaaatcacctttgccaaagttgagcggtatcgcaagataattcacaaactcgacattgtctcgaggtccaataaaaaattagccgacaagcaccgatcagtgttgcacacaatctttaaagattgcaaagtcgaatccgagtga

SEQ ID NO: 10919 - RNA, 1155 nt, unidentified
  source 1..1155: mol_type = other RNA; note = synthetic construct
atgaaaaagcctatctacaaaaagagccccattggatctctggaaagtctgagcgccatgttgggcatcaatcaatctcagttggaccacataattaattccattcccaactcctacaaatccttcaagattgagacaggtaagaaactcaagttgagacagctgcacgaacctaaaaaaggcctgaagtctcttcagaagaaattaaacaaggagatcttcgagaacattgaatatccgtattatcttcatggagggatcaaaaaccgggactacctgtccaacgccaggatccattccggatcaaagtccctgatatctctggatattaaggacttttaccccaatattcgtaaaactgacgtcataaacatcttcaagaatcttatgcgctttccagcggatatctcagaggccctcacaaaactcgtgactctgaacggtgaggtgcctcaggggagttgttgcagcagctacatcgccaatttgatctttttcaacaacgagtacaacatcgtcaccaagatcgagaataaagggtttagatacactagacttctggatgatattacaatttcaagcgatcgtgaactgacgaacaacgaaaaaaccttcatcatcaatagcgtaaggtctatgataaagtcacaccggctgaacataaatgaggacaagactaaaatcgagtcttcctcgaatctgaatgacggctttgaagtgacaggcctctgggcaaagcacaaagctccaaaggttagaaaaaatcaccgcgaccacatcaggcatctcgtcttcatttgtaagaagcaagccgaatatgataaagaatcgcccgaataccatgcactatggaataaagcttcaggcaaagtggctcagctgacccgcctaaatcatgccgagagtaatccactacgaataattcttaactccattctgcctgagtacaacgagcacaagatcaaaaagattaccaagatcgctgacaatttaatcaaggagaaaaacaaggtgacgagcaatgatctcatcaacaagatcaacaagctcttgtatgaactgagtattgtttcaaggacccgaaaaagtttagcatatcggtatcggaagaagataaacagctgctttagctctgtactcaaggtgagtatttga

SEQ ID NO: 10920 - RNA, 1104 nt, unidentified
  source 1..1104: mol_type = other RNA; note = synthetic construct
atgctgggaatatccaaatctcagctagacaacattatcaatcacgtctccgacagttacaaatcctttattaaagaaacggggaagaataagaagtcaagagagctgtttgaacccaagaaaacactcaagcaaatccagaagaaactgaacaaagagatatttgagggcatcacttatcctaactacttacatggcggtatcaagaacaaagattacatcacaaatgccaaagtgcattcgggagccaaaagcatcatttcactggacatcgagaacttctacccaagtattcggaagaacgatgtgctgaacatcttcaagaacctcatgaagttccctcaggatgtaagcgagtccttgactaagcttgtgacgttaaatggggttgtgccacaaggatcctgttgctcttcatatatcgctaatctcgtctttttcaacagtgagtaccaccttgtgacaaaagtcaagaataagaggtttgagtactcccggttgctcgacgacataaccatctcctccaaaactgagttcaccaacgaggagaagacatttgtcattaataatgtcagagcaatggcaaatcggtaccgactaagcctgaacgaaaacaagaccaagatcgaaaatagtagcgatctcaagtctgatttcgaagttaccgggctgtgggccaaacattctgtgccgaagctgaagaagtgtcaccgccgctatattagatatatcgtgttcatatgcgagaaacaggccctttttgatcgaacctcaatggattaccatgctctgtggaacaaggctagtggtaaagttgcgcagctgaaaagacttaaccacagcgaaagcaatatgctgcgtgacaggctgtctttggtgttgcccgaatatgacgacgataagattcagaagataattaagatcgccgacaacctcctggttaacggccacaagctgaatgctattgacctcaaggacaagatcaatcaccttttctacgaattcggcattgtaagcaggactaaaaaatcattagcatatcggtatcgcaaaaaaattagggccaatttttcttcgatcaccgataaagtgacaattagctga

SEQ ID NO: 10921 - RNA, 1185 nt, unidentified
  source 1..1185: mol_type = other RNA; note = synthetic construct
atggctaacgacaagccttactactccaagaaacccattgccagcgtagaggcgttggcacagtgccttggcgtcaccccagaacgactcttgctgattgccaagaattcggaaaagagttacatagagtttacggtttacacaggaaaggacaagactaacctcaaaaagcgggtcctgcatgaaccaaaacccttcttaaagagcatccagaagaagattaaccgggagatcttcgagcatgtcatctatccggagtaccttcacggtggactgaaggagagggattatataacaaacgtgtcactacacgcaggggccaaaaccattatcgcgatggatatccaggacttttacccaagtatccagaggactcatgtccaagacatatttactctgctgtgcaaattcccgcctgccatatcatccctgattactgacttgattaccatcaatggtagagtggctcagggggcctgttgttccagctacatagctaacctgattttcttcaattcagagtacggcagaattagcaaattccgctctcaaggcctcacctatactcggttactggatgatatcacaatcagctctcgcgtggtgcttgaggagaaaaaaatctccaatgctatcgaatctgtggcaagtctgttcaccaaatttggcctcaagttgcatcccagaaagaccaaagtcgaacaatcctcagacacaaaagccaaatttgaagtgacaggcctgtgggccaagcacgggaatcctaagattaggaagaaagatcgccattacgtgaggcacctcgtattcatttgccagaaggaatttgaaaaagacagtaactgtagcaagtatcacgagttatggaacatgacatccggtaaagtggctgttctcaccaggttgaagcacgcacagagcaaagatctgagaaagaagctagggagtgttctgccaacctatgactctgaggcctccgctaagcttcagcgtatcgcgtataaactctgccgcatccccgaaaccgaaacgtcttctcctggaaaactgaagatttaccacaagctgaagtatcactttggaatcgtggctcggacggaccgtcagctggcaaagaaatggaaagaggttcttgatacaaaattcaaggccagcgccatcgcagcccgatcaactaatgagtga

SEQ ID NO: 10922 - RNA, 1158 nt, unidentified
  source 1..1158: mol_type = other RNA; note = synthetic construct
atgaagaagcctatatataacggcaagcccatcagtactttggatgccctgtctaaagctctgggcaccaatctctctagactgcgcatttttattgacaccgccgaaaatagctatactacttttaccttggagaagaaagttaatggaattgtggtaaaggaacgcacgctgaatgagcccaagaagaatctgaaagaccttcagaaacgaatcaaccaggcaatatttaacaacgtgagctacccggagtacttgcaggggggaattaaaggcaaagactttatcaccaattccaagaatcacctctctgctaaaagcctgattaatctcgatatcaaggatttctaccctagcatttcaatacatcacgtctatgccatctacaacaaactgttcaaattcccacacacagtgtcagacgccttggtgaagctgacaactaagaatggggtggtcacgcagggagggtgttgcagttcctacattgcgaacctgatctttttcaatagcgagcatgatcttgttcagaagctagaatccaggtccctgacatatacaaggctcattgatgacatcactatctccagcgcaaagccaatgtctaaggacgagattacaaacaccataaatctgacgaacaatcacctaacaaagttcaacttaaacctgaaccgcgacaaaaccaacattgaccatcatcacaacaagtcagataatttcgaagtgaccggtttatgggtcagacacggtaaaccaaaagtcaaatccgcagttagacgacagatacgtcagctggtgtttaagtgcaagatccaatatgagctgtgtcctacagacaagtcttatcatgacttgtggaataagacttctggcaaagtagccattctaaccaggctcggccacgccaacagcaaaatctacagaaaaaagttatccgagatcctccccctgtacgatatcaagaaggaagaaaagatcgagcggatcattaactaccttatcgataccgaatcgaaggagatcaatagtcccaggcggatcaaactctatcacaagatgatttaccattgcggaatacttgggcggagtaacaagtcaaaagcgaaacttctcaaaaacaaactgaaagctaagttcatcgctgtccaagtgtga

SEQ ID NO: 10923 - RNA, 1185 nt, unidentified
  source 1..1185: mol_type = other RNA; note = synthetic construct
atggcggataaaccttactacccagggtccagtgtagctcacatcagtacactcgctgccatgttggagattaacagagacttaatcgagaagcatagcaagaatacgtcgagctcatataccacttttctaatctctcctccctctaaaaagagccgagaagtgtctgaacccaaggagtccttgaagaagattcagaagcgcattaatagtcgaatcatgtctgaagtggattaccccaagtatcttatggggggaatcagggataccgcatccaggagagactatgtaaacaactccaaactgcacctgaagccagagactctcattaatctggacatcgagaacttctttcccaatatacacaaagagcacgttaagaacgtctttaagtacctgtttcggttctcagaagatgtgtccgagactctcagctgcctcacaaccctcgaaggtgtcgtgccacagggtggttgcacatcaacataccttgggaatctagtgttctttaattacgagtacggcgttgtgagtaagttgcgcagcaaaggcatcagttattcgcgactgctggacgatattacgctgtcctctaagaagagactgaccgaagaggagaaaacctgggccatctctctcgtggctggaatgatcaaccactacggaatgaatatgcatgacgggaagactcggattgaacatcgtgaatcaagggacgccaaatatgaagtcactggagcatgggtacggcatggcgagcctaaaatcagaaaagacgacaggaagaagattcgctcagcagtgaggaagtgtgagataatgtatgaggaatccccgtacagcagcgagtaccacaaacagtggaataaaacaagcggaagagtggctcaactgggcaggttcaatcataaagccgaggaaaaaaagctgcgggagcggttaaagaccatcttaccactgtatgatgacgtgtattcaaaaacacttagtgttaaggtgaaccaggtcgttcgccgtcggagaaagaaccaaataaacattgatagcgtcggcaccaggaactacatattgaaactgtatcacgagctggggataatggcccgcactaagaaaacccaggccagacgcctcaaacagtctcttcgtgaaaacttcggcaatattatctccaaccctcactactga

SEQ ID NO: 10924 - RNA, 1182 nt, unidentified
  source 1..1182: mol_type = other RNA; note = synthetic construct
atggcagacaaaccttactacccactgccccccatcggctcagtctcagtgcttgccgcgatgctcaaaatcaatgagaagcagctgatccatatcgcgaataatgcatctaattcgtacactagctttgaaattactcctgagggaaagaaaccacgcgatgtagtggaacccaaagagcagctcaagtatgtccagaagaagatcaacgctatgatattttccgaggtcaaatacccgatatatctcatgggcgggatttcagacaaggtgcaatctcgggattatatcaataacggaaaacttcacctgaataaaaacaccctaatcaacctggacatcgaaaactttttccctaatattaagcacgtgtacgtgaaaaagatcttcacgcacttgttcaagtttcctgaaagcgtgtccgagatcctgacaaagttaacaaccctcaatgggcgactcccccagggaggttgttctagtacctatatcgccaatttgctgttcttcaactatgaataccacatagttagtcagcttaggaacaaagggattacatactctcgtctgctagatgatatcaccctctccagcaataagaaactgaacaaggaggataaaacgcatgctatttccgccgttgacggtctgattaagcggttcgagctgtcgatcaatacaagtaagacaagaatcgagcacaaggacgatcttagcgctcagtacgaagtgaccggctcctgggtcaggtttggagaattgaaatttccaggcaaagccaggaagaagattagatctgccgtaaaaaagtgcgaattaatgtaccaagagaactgctattcagcagagtaccatagtcagtggaatcgtactagcggtcgcgttgcacagcttaaaagattcgggcatcataagcaggagcgggagtttcggactcgacttggaaaaatattaccgctgtatgacgaacagcaagccattaccttgcgcactaaggtgtaccaactggtcaagaagaggaagctcaataaactgaggttggacaacccaggcctacgcaagcagatactcacactctaccaccagttgggcattctggctagaaacaacacctccagcaaaattctgaagaacgaactgagagagaacttcagcttcctgattaacaatccctattattga

SEQ ID NO: 10925 - RNA, 1182 nt, unidentified
  source 1..1182: mol_type = other RNA; note = synthetic construct
atgggagataaaccacactacccatttgagcctattgcatcgtcaaagacactcgcaaaaacgctgggtgttaatctgccactcctgctgaaaacagccagcaacacctctaacagctacacatctttcatcgtgccaactaaatcaaaagaccgaacggtctatgagccgaagacaaccttgaagtatatccagaagaagatcaacaaagagatattatcacgcgtggaattccctagctatctgatgggcggcataaaggacactcagagtcctcgggattacctcgctaattccaggatgcacctaagaaaagagagcctcataaatctggatatcgagaatttctaccactccatcaagaaaccttacgccacccagattttcaagcaactgttcaaattcaacgacgaggtgtccaatcttctgacagaacttgttacccttgacgggcaggtaccccaaggggcctgcacttcctcttacattgccaacctcgtattctttaactcggagtataccgtggtcaataacctgagagccaagaagatagcatacacccggttgctagatgatattacactgtctgctgaccgtaagctgactaatatagagaaggaatggttaatcagccaggttactggaatgattgtctcccatgaacttaagatcaaagatgccaagacacggatcgagaatagggatcacccaagatcccgctacgaagtgaccggggcttgggtgaaatatggggagcccaaactgagaaagaaggaaaggaataaaatccggcatgatgtgtatatttgtgagctctttcacgaaaaggaccccaccaccgaagaatatcaccgtctgtggaaccgcacatcaggcttggtgagtaaattgggaaggttcaaccataaaaatgaggcggacaagctcagaaagaggttgagttttattctgcccaagtactctgacatccaggctaaaactctgcaaaccaaaatttaccagatcgtcaaccgcaagaagaagaacaatatcgacatcaacaatcctggcctcagcaagcagatcctgcgattttatcacaacctaggcattctgtctcggacgcatccgcatcttagcaaacccttaaagaatcagcttcgcagtgaatttggtactatgattaggaacgagtactattga

SEQ ID NO: 10926 - RNA, 1176 nt, unidentified
  source 1..1176: mol_type = other RNA; note = synthetic construct
atggcagacaaaccatactacccccatgcccctatcagcaacatcgacacattagcgaaaatgctgggcgtcaggtcctccctgctgattttgatcgccaacaaggccaattcgtcgtacgtgagtttcgaagtagagacaaagaacaagcagcgcatggtgaacgagcctaagacgattctcaaatacatccagaagaagataaactcccaaatcttcaatagcgttgagtttccggcttatctcatgggaggtatccgtgaccccaaaacaccaagggattacattagcaatgcagccatacacgcgaaagcaaaaaccctgatatctctggatgtgaaagacttttttcccaccacccaggaagttcatatcaagtccgtgtttaagaacttattcaatttccccgaagacgtaagcaacactttgacaaagcttgtctctctgaatggcagactgcctcagggagggtgcacctcttcatatgtggccaaccttatattccacaactcagagtataaggtggtgagtcagttgcgccagaagggaattaggtacactcgtctcctcgatgacattacacttagcgccaacagaccactgtctaagaacgagtgtgagaagtatattcgcctcgtggctggcatgatcaccaagcatgacttaaccattaattcaggcaagaccaaagtcgagtattcaaaaaacatcgctagcccatatgaggttaccggggcatgggtccgacatggtaaacctaaattgcggaaaaaggaaagaaatgagatcagacacatagtacacattgtcgaaaagaagtacgctgaaaacccctacgataaagagtaccacgacctatggaataaagcctctggcctggtggctaagctgaaacggtttgaacacatcaatgagagtaagggactgcgcaagaagctgaaagccacacttcctctttacgatgaccaaaaagccgagactctgcgggttcaagcaaataagctcctgaggcgacaggctagaaacactttgaattataatagtgggaccaaaaagtctatcgataaactagtgtatgacctgggcattctctccaggactcggccagaaatcagcaagccgctaaaaaagaaaattaaggattccttcacggggatcgattttgatggtatttga

SEQ ID NO: 10927 - RNA, 1188 nt, unidentified
  source 1..1188: mol_type = other RNA; note = synthetic construct
atgaattctgtccgccgcgacaagccctattacccaagctcgcctattagttcggtgtcccgcctgtccgatgttctggaggtaagagaaaacgtgctccgggatctgatccaaaacaaaagcacacattaccactcttttagcatcgaaaccacatcctcagatggcaagaagaaaaatcggagcatacatgagccaaaatttttgctcaagaaactgcaaaagaggatcaatagtaggatattgtccaaggtggagtatccccactaccttcagggtggtatttatgacgaggataacccccgagactactactctaacgctgccattcacagtaaagctaactgcgtaatgtctgtcgatatcaaaaacttctacccttccatcaaaaccgagcaggtgaccagaatctttaagttcttcttcaaattcccacaagacgtgtcagagttgctcgctgaactggtcacttatgagggatttgtcccgcagggggccgtgacctcatcatatatagccaatctgctgttctttgaagacgagtacaaggtcgtggcgcacttagcaggcaaaaagctactctattctcggctcttagacgatatcaccatctccggcaagtctataagcaaccaggactttggaaagattaaaacccaaatcgttgggatgtttaagaagagaggggtgaggattaataggaagaaaacagcccttgtgtatagcggcatccgatcagtgacgggcctgagggttgagcactccactcctcggtgtgatagaaaggaaaaacggaggatacgagcagcggtgaagcactgcgagatccagtaccagattgaccgtacatccgacgaatatcatagtttgtggaatagtacctcagggaaagttgccaaactggagcgcgtcggacacagccaggcaaagaagctgagaacgagactccagcagatttacccgactctttctacaggtcaggtacacgctctgaagattgccatcaaaaagctggagaaggttccaagttccaaacgtatgaaaattggatacctgaagcaggtgaataagctaattcatcgcactagcctggtgttccggacagacaaacccctcgcacattctttaactgaacgtcttatcaccatcaagcctgtcaagacttacagcgatttctgggaaaaatga

SEQ ID NO: 10928 - RNA, 1233 nt, unidentified
  source 1..1233: mol_type = other RNA; note = synthetic construct
atgaacaagtttaatttcgataaaccctactacacccaaagaccgatttctagcattaaggcccttgccaatgcactaggggcagaccagcaggcgctcattcaactcgccaacaataaaacgaactaccactattataccaagcatgtcaagtcaggaagtaaaactaagcagcgttccatttttgatgccaaacacagcttgaagaagattcagaaacgcataatatcccgaattttctgtcacatagaattccctcaatatctccatggcggcataaaggatctgaaccagccccgagactacttttccaatgcaaccgtccactgcaattcgaaaaatatcatcagtcttgacatcaagaacttttacgactcagtgcgggacgacaaggtcctcatcatcttcctcaatttcttcaagtttccaaaagatgtagcccagatattgactcagctggttactgtgcagtggtccgattacgacaaggatatctctcaatccgccagacacctgcctcaaggggcacctactagttcctacttagcaaacctgatctttttcgataatgagtacaaactgttcaaccacttcaaaaggcagaaaatctcttatacaaggctgctggatgacattacgatctcttctttgagcgaatttacaaaggcccagaagactaaaatcatcacacgggtggctggaatggtaagagagagcgacctgaagctcaacaacaagaaaaccatttgcacaagctttcgcgaaccaggcaagaagatgattgtgaccgggttgtgggttaatcattcaattcccaaactgcagaaacatagccttaaaaagatcctagagggagtgaaatcgtgcgagtatatccattccagatgtccattttcctttgaataccacaaggaatggaatacttactctggtaaggttgctaatatggctcggagttatccaaatcttgccaagagactaagggtgaggttaagcacgatcctgcccattttcagtcctaaacagaccctggtgcttgagcggcagatcgataccttactcaatagcaaaaccacacagaccaacaagctgactaacataaagcgcttcaacaaggcttactatgcgatcggtatcatttcacggacagacaagcgcctggctaggaaactgcgatcacgcctgttgacccgtatgccgaacattacatataaagactattgggagaactga

SEQ ID NO: 10929 - RNA, 1170 nt, unidentified
  source 1..1170: mol_type = other RNA; note = synthetic construct
atgcgcccacagtacctcaaaaagcccatcgggactgtcgcaactcttagtgccgccctcagagtttcagaaccggtcctgcggcacgcggagagtaaccttgacgcccactatacgccttacgaaatcccaaagcgggacggtagagtccgttctattgtgatcccgtcactgcatctcaaaaccatccagaagcggatcaacagagaaatttttgcacatgtcgaatacccttcctatttatacggaggggtgaatggccaggactacgtcagaaatgccagcgctcaccgcggagcacaagtactcattgctctggatgtgaaagacttttacccatccatatcacgcaaacgggtcgccaacatctttcagcatttcttgcacttcggagctgaggtgagcgacttgctcgccgggctgacaacctatcaaaataaggttcctcaaggggcttgcacctctagccacctggctaacctggtacttcacgatgttgaatattctattgcccagtattgtcacaatgcaggcctggtgtacacaaggcttctggatgacattacaatatccagtcgaaagcacgtgtctggagagaagataaccaagattattgcgatggtgtcgagaatgctgaaatccaagggcctgaaaatcaagagacagaagacgaagatcacctcaaaaagcaaccctgaggaccttatggaggtaactggcttatggctgaataggggcgccccccgcgcaaactcattcgctaggcgagcaattagggtggaggtgtataagtgttcccagagcgccaaaaaagacaaggccagttccaactaccataaagatcacgccagcgccagcggaaaggtggccatgttaaattacctgggccatggtgaggcaggtcggctgagaaaaatgttggcggacatcctccccatatacgatgagcgagaattgactaagacagaaaaaatggttcggatgttgcggaggagtagcgagaaggacagggaaaagtacgcttataacgtgcgtttccataaagtgatgcagcgcctgaatatcgtggcaaggaccgataaagttctagccgatcgtctacgacaggagctgtgcgcttctcgcccagtcaagtcctctaatgcggctctctatgatgagcccatctga

SEQ ID NO: 10930 - RNA, 1011 nt, unidentified
  source 1..1011: mol_type = other RNA; note = synthetic construct
atgataccatccttgcacctgaaaaccatccagaagagaatcaatcgcgagattttcagccatgtaacgtatcccgaatacctgtacgggggcgtgccaggaaaagattatgtgcggaatgccaaacggcacgaactggcacacgttgtcatcgcactggacgttaagaacttttatccatccatcagcaaactgagggtttctaatatctaccagcacctcttcaagttcggggcggacgtgtccgactttctcgctgccttgaccacttacgagaataaagttcctcaaggtgcctgtacttctagccacctagctaacctagtgctccatgatgtggagagttccgtcgtcaaatattgcaacgattcgggactggtgtacacacgattactggacgatataactatttcttccactagacgcctccctgagaagaaggtagagaaaatcgtcggcatggtggctacgatgctgaaaggcaaagggcttaaactgaagcacaacaaaaccagggtttcaacaaaggctaaccccgaggaacttatggaagttacaggattatggctgaatagaggagcaccccgagtccattcagtgagcagacggctggtgcgtgtggaggtgtataagtgcaaagaagcagcgaaagtggaacgagtgtcagaatcctatcataaggcttttgccagggcttctggccgcgtggcaatgctctgctacctcggccacgccgaaagtgggaggttaagaaagagcttgagtgagatgcttcctctttatgacgtaagggaggtcaccaagaccaagaagatcgtcaagatgctgggtcggacatctgagaaggatcggagtaagtacagctacaatgtaagctacttcaagaccatgcagcgcattaacattgtgtcacgcacagaccccctgttggcccgtactctcaggcatcagttgctgatgtgtaagcctaagaacaaatcggacgccgccctttacgatgagccgatttga

SEQ ID NO: 10931 - RNA, 1170 nt, unidentified
  source 1..1170: mol_type = other RNA; note = synthetic construct
atgaggccatattatacaaaaaaccggattggatctgtggcggccttatccgctgcgcttcgggtttccgagccaattctgaaacacaccgcagataatctcgagaggcactacacgccctacgagataccgaaatcaaacggaaaacccagactgattgtgatcccctcgctccacctcaaaaccattcaaaagcggatcaaccgcgagatcttttcgcatgtggcctatccacactatctgtatggtggtgtgagcgggaaagattatgtgcggaatgccgaagcccaccagaatgcacatgttgtcattgccctggatgtgaaggacttctacccctccatcagctttgcacgagtagtaggcatttaccagcacttcctgaagtttaatcctgaggtagccgaactgctggccagtctgaccacatttaagaacaaagtgccccagggggcctgtacatcctcccacttggctaatctggtcttgcatgatgtcgagtatagtatcgctcaatactgtgagaacttcggcctgatttatactagactccttgacgacattacagtgtctagcacgaaggctttaagcccacagaaaataaagaagatcatcgacatgatcagcaaaatgctccgagacaaaggcctgagggttaagcatcagaaaacccgcgtgtctagcaaagcaaaccctgagaacctgatggaagttactgggctgtggttgaacagaggagctcctcgtgccaatagttttgacagacgcttagtcagggtagaagtgtacaagtgcaaacaggcggccgcagtcgatcgcacaagacctgagtaccataaggcgcatgcaagtgtctcagggaaggttgcaatgcttaattacctaggccacgctgaagccggacgtttcaggactacactagctgaaatactgcctttgtactctgtgggcgagatcaccaaaaccgaaaagatcgtggccatgctctgcaagtcatccctcaaggatagaggtaagtatacctacaacctgaattactacaagactatgcagcgacttaacatcgtggcacggagcgacttcgctttggctaaaaggcttcgcgtcaagctgctcggctacaagccgactaagctgtcatctgacgccctatatgatgaaccaatatga

SEQ ID NO: 10932 - RNA, 1191 nt, unidentified
  source 1..1191: mol_type = other RNA; note = synthetic construct
atgtccacgtttttctccgtcatgcgtccatactatacaaaaaaaccgatcgggactacagctgcgctggcctctgctttgcgggtgagcgaacctgtgctgaaacacgccgccaacaatcttgaccggcactataccccatatctcatccctaagggtgacgggaagcaacgtgcgattgttatacccagtttgcacctgaaaactatccagaagcggatcaatcgcgaaattttctcgcacattgaatacccacactacctgtacggcggaatcgacggcaaggactatgtaaggaatgcaggcgcgcataaggacagacatactataatagctcttgatgtcaaagacttctatcctagtattacattcgagcgggtgttaggagtgtaccagcacttcctgaagtttagccccgaggttgccgagcttttggccaagctcaccacatttaacaagagggtgcctcaaggtgcatgtacttcttcccacctggccaatctagtgctgcatgatgtcgagtatcatgtggtgcagtactgtgagaatgcaggactaacctatacacggctgctggatgatattaccgtcagcagccccaagcccctgcctgtacagagagtgtctaagatcatcgagatgattagtaaaatgctcaaggggaaagggctcaggctgaaaaaaccaaagacccgcgttagttcaaagtcaaacccagagtctttgatggaagtgacaggtctgtggctgaaccggggagctccccgagtcaatagcgcgacgagacgagcaatcagggtcgaagtgtaccagtgcaaacaggctgccgctacctccagaacttccttagactaccataaaaagcatgcatcggcctcaggcaaggtcgccatgctgaactatcttatgcacgcagaagcaggcaggctcagaaaagcacttgccgacatactgccgctctacgatgtttctgagatgacgaagacccgtaagattgtggagatgctctctagagcttccgttgccgataggggcaagtacagttttagcctctcctattttaagaccatgcagcgcctaaacatcgtggcccgaagcgatgccgctttggcccactcactgcgccgcaaacttctggtatgcaaaccaacaaaacctagctcagctactttatacgacgaacccatctga

SEQ ID NO: 10933 - RNA, 1089 nt, unidentified
  source 1..1089: mol_type = other RNA; note = synthetic construct
atgcatactgctcgaaatatcgaaaagcactacacgccatacgaaataccaaaggcggacggaaaagttcgcgctattgtgatccctagcctgcatctgaagacattgcagaaaaggatcaaccgagaaatctttagcaacatcgtgtatccaccctatctttacggaggtattgagggtaaagactacgttcggaacgcttccgcgcatcgttccgctcatgtcgtgattgcccttgacgtcaaagatttttaccctagtatcagctttcacagagtcctcaacatattccagtacttcttcaaattctccccggaagtgtccgagctcctagcaaagcttaccacttttcagaataagctgccgcaaggcgctgctacctcctcacacttggccaacctggtgctgcatgataccgagtatcacttagcacagtattgtgaaaatgccggattgatttacactcgtttacttgacgacatcaccattagttcaaccaagcccctctcggaacagaggatttctaagctcatcgacatggtcgcgagaatgcttagggagaaggggttgaaactgaagaacaagaagacaaggatctcgtctcgcagcaatcctaagatcttgatggaagtgactggcctgtggctgaacagaggctcacctcgtgtctctacagacaacagacgcaaaattagaaccgaggtgcaccaatgcgctgtggcagccatgacttctcggacatctcaaagttatcacaaggcccacgcctccgtttctgggaaggtggcaatgctcaatcacgtagggcatgcagaggcagaacgctttcggaaaacactggccgatatcctccccctgtatgatgccaatgagctgacgaagaccataaatatcgtgaacgttttaagccggtccagtgagtcagatcgggaggagtacgccttcaatctgaactacttcaaaacaatgcagcggattaacattgtagcacgcagcgatcccaggctcgcccgaagactgagggaaaaactagccacctgcaaaccaataaatcagagcgacgaggctctgtatgatgagcccatatga

SEQ ID NO: 10934 - RNA, 1188 nt, unidentified
  source 1..1188: mol_type = other RNA; note = synthetic construct
atgctaaccctgctccccatgaggccattctataaaaagaagaagatcggatctgtggcctccttgggcgccgcactgagagtttccgatgtcgtgctgaaacatactgccgccacccttgaacaacactacacaccttacgaaattcccaagaaaagtgggaaacctaggtccattttgataccgagtcttcaccttaagacactgcaaaagcgcattaatcgtgaaatctttgcccacgttcaataccctgattatctgtttggcggtgtcgagggaaaagactatgtacgcaacgcaagggtgcacgccggtagtcacgtgctcatctcactggatgtcaaggacttttacccttccatcacgttcgacagagttaagagaatctaccagcatttcttgcagttcgatccagccgtgtccgaattactcgccaaactcactacgtataataattcagtgccgcagggggcttgcactagctctcatctcgctaacctgattctgcacgacgtggaataccacttggcacagtactgtgctaccgcaaaattgacctacactcggcttttagacgacatatgcatttcaagcaagacagccctgtctaaggagaagattgctaagctgatcgataaggtcagctcaatgctgcgcgataaaggcatgaagcttaagcatcaaaaaacaagagtgtgttccaaaagcaaccccaaagaactgatggaggtcactggcctgtggattaacaggggcgcgcctcgggtcaaacccacagagagacgcaagatacgagtggatgttcacaggtgtcaggtcctggctaatcagagtctgaccaatcgggagtacgatcgtgcacatgctagtgtttctggacgggtagctatgttatcttatctggggcactcggaggctgagcgcctcagaaagtcagtggcggccatacttccacagtttgatattcatgagatcagcaaaacgaagaaaatcgtagcgctgctcagccgagcgtctgccaaagaccggaacaagtattcctttatcctcaacttcaacaagaccatgcagcgtttgaatatcgtggcacgaaccgacccaaagctagccgtgcagctccgcaaaagcatggccacctgccggcccacaaagagggctgacgcaactctatatgacgagccaatctga

SEQ ID NO: 10935 - RNA, 1074 nt, unidentified
  source 1..1074: mol_type = other RNA; note = synthetic construct
atgctgcggaagactctgcactttctttccaattctcaggaacgaagagaggcatcctttgactcctacagcagcctccacctgaaaacgctacagaagaggattaatcgggaaatctttgcgcacgtcgagtaccctaattatttaagtggagacattgagggcaaggattatgtccggaacgcaaaggcccatgctgggtcgtacgtgctcatcagtctggacgtgaaagatttctacccaagcataaacttcaatcaggtgaaacggatcttccaatattttctgaagttcgagccgggaactagtgagctcctagctaagctcacaacatttaacaactcactgccccagggggcttgtacctcctctcacctggccaacctcgtgctgcataacgtggaataccacctcgcgcagtattgcaagaccgcccgcctcacatacacaaggttactggacgacatctgtatttcttcaaattctccaatctccaaagagaagatttcacgccttatcgaaaaggtcagtaagatgcttagggatgagggtctaaaactgaagcatcggaagacacgagttagctctagatccaatcccaaagaactgatggaagtaactggtctgtggataaacaggggcgcccccagagtcaaatcagctgaacgccgagctattagagtagaagtgtattgctgcaaagacgccgcccagacatcacttaccgatcgcgagtatcataaggcctacgcacgcgttagcagaaaggtcgcaatgctgaatcacttaaaccacagagaagccagccgcttgcggagaggcctgagtgagatcctgctccgttttgacatacacgagattactaaaacggagaaagtggttgctatgttgatgcgtgcaagcatcaaagatagggagaaacattctttcatcctgaacttcaacaagaccatgaatcgacttaatatcgtggcaaggaccgatccaaagttggcgatacgtttgaggaaggagatggccaagtgtaggcctactaaacggacctccgccaccttgtacgaccaacctatttga

SEQ ID NO: 10936 - RNA, 1071 nt, unidentified
  source 1..1071: mol_type = other RNA; note = synthetic construct
atggacaaacactacaccccataccagattccgaagaaaaatggaaaacctcgcacaatcatgataccatctttgcatctgaaaaccctccaaaagcgcattaatcgagagatcttttcccacgttaagtatcccgactacttgtacgggggcgtcgagggtaaggattatgtgaggaacgcagagatgcacgcgaaagctcatgtgttggtgagcctggatgtgaaggacttttatcccagcatcagtgctgacagggtgacaggcatttaccagtatctcctcaaattcaacccaggagtggcagaactgctggcgaggttgactacctataaaggcgccgtgccccagggtgcttgtacttcttctcatctggccaatctcatcctgcacgacgtcgaataccatgtagcccagtattgtaagaatgcaggactggtgtatacaagactgctggatgatatctgcgtgagttcggaggccgctcttagtgagaagaagatatcacgcatcatagaaatgatctctcggatgcttcgtgataagggtcttaagctaaagcaccagaaaacccgaatttctagtaagagcaaccctaaggaacttatggaagttacggggttatgggtcaatcgtgggatgcccagggtcaattccactgagaggaggagcatcagagttgaggtgcaccggtgccggcaattagccgcaggcagacggaccgatcttgcgtaccacaaagcccacggctccgtgtcaggcaaggtcgctatgctgaactatctccggcattcagaggctggaaggctacggagaagcttgggggccattctgcccgagtacgaccaggccgaaatgaccaagactgttaagattgttgaaatgctgtcgagaacaagccctaaagacagagaaaagtactcctttaacgtatccttcttcaaaacgctccagcgactgaacgtcgtggcacgcacagatccgaagctggccgtacgcttacgcaaaaaactcgccagctgcagaccaaccaaacattcatccgcaactctgtacgacgagcctatttga

SEQ ID NO: 10937 - RNA, 1134 nt, unidentified
  source 1..1134: mol_type = other RNA; note = synthetic construct
atgaacgcactgtgcgcagctctgaggattagcgagtccgctctgaagcatctggcagccaacctggatcgacactatactcccttcgagatacctaaagataacggtaagagacgcgccttgctcataccgagcctgcatctgaagaccctgcagaaacgcatcaatagggagattttttcgcacgttgcgtaccctgcttatctgtacggcggggtagaaaatcgggattacgtaaaaaatgcaagtgttcaccaacgcgccgaggtgctgatagcactcgacgtgaaggacttttacccatctatcgaaatgaaacaggtcgtctccatcttccaacacctatttaagttccctaaggaagtcgccgacattttagcccggctcacgacttacgagggcaaggtccctcagggggcttgcactagcagtcacatcgctaacctagtgcttcacgatgtggagtaccatatcgcccaagacttccataaccggaattatgtgtacacacgtctcttggatgacatctgcgtgtcatcacttaagcccctgagtcctgagaaggtggaagacgtgattaagaaggtgtcttccatggtcaaaaagaagggcctgaagctgagggctgccaaaaccagaattactagcaggtccaaccccgaatctctcatggaggtcacgggactttggctgaatcgcggcacaccacgtgtaaatccgaaacagaggcggagcatacggtcagcagtttatcagtgtcagaagacagctatgagtgacaattcgagcttgacatatcatgtggagcacgccagcgcctcagggaaggttgccatgttgaagtatcttaaatacggagacgcaactcgaatgagaaccatcttacagggtatcgtgcccgtgtacgataaagctgagctcaccaaaacaaagaagatcgttgatatgctttgtagaacctctcaccgggatagggagaagtacgcgtactctttgggatatcacaaagccaaacatcgcattaacattgtctccagaaccgaacccatgctggcccatgcgttacgagcgaaactcaaaaaatgtccaccaacaaagaccagatccgaaatgatttatgacgaatctatctga

SEQ ID NO: 10938 - RNA, 1215 nt, unidentified
  source 1..1215: mol_type = other RNA; note = synthetic construct
atgactaccctcagcagccacgcctgctttatgctgagtggcttcatgcggcctcagtacaataaaaacccaatccgatccattgattccctgtgcgacgctttgagggtcagtgaggtggtgttgcggcatacagcggagaatattcaacatcactacacgccttatagtattcccaaggcaaatgggaagacaagggtggttcatatccctagcctgcatctcaagaccatacaaaaacgcatcaacaaggagatcttttcacacattacttaccccgattacctgtacggcgggatagaaggtaaagattacgtgaaaaatgccaacgcgcacgctggagcaaacgtgctaatcgccttggacgtcaaggatttttatcctagcatcaagagagaacacgtaactgatgtgtaccagcatctatgcaacttctcaaaggacgttgcggaactgctcacagacctgacaacgcttcgcgagcgcgttccccagggtgcttgtacctcctctcatcttgcaaacctcgtgttacacaaggtggaatatcccgtcgttcagaatttaagaaaccaagactttcgctatactcggcttctcgacgatatttgtatatctgcatctaagttcctgtcaccagctaagatcgagacaatcatttccgacgtcgctaggatgttgaagagcaaagagctgagactgcacccaaaaaagaagtcgattacctccaaaaacaatcccgagagccttatggaagtaactggcctatggctgaatagggggcacgctagggctaaacgggaagagaggcgcgccatccgtaccgaggtctaccgctgcgagaaggaggccgctagaagtaggtactcacccgaataccacaagatgcatggaagcgtgtctggccgtgtggcaaaactgaactatttgcaccacccggaggccaaaaacttccgactgcggctgcaggagatcctgccactctatgacgagcatgaaattatcaagaccagcaaaattgccagtgtgctttctaaagtagcaaaggcagatagagccaaacactggttcgccatacagcaccataaggcccagtatagagtgaatatcgttggacggaccaatgtcaaaatggcctccaaactctcacgacagctgtctctctgtagaccacctaagacactgtccgaattaatttatgacgaaccgatctga

SEQ ID NO: 10939 - RNA, 1170 nt, unidentified
  source 1..1170: mol_type = other RNA; note = synthetic construct
atgcggccgatatttaacaaaaagtctatcggcagcatcgaagccctttcagacgctcttcaggtgaataagcacattctccaaaacaccgccgataacatttttcagcattaccatccatacgaaatcaagaaaaaagatgggggcactaggcttatccacatacctaccctgcatctgaagattatccagaagagaatcaacaagaacatattcgataacgtgacatatcccgactacttgcatggagggatagaggataaggattatgtaaagaatgccctgagccacgcaaacgctgaggctatcatctgcctggacataaagaatttttacccctccattacacagaccagggtttctaagatcttccagtacttcttcaagttccccgaggacgtgtcaaacttactcgcgaaactgtgttgtcacgaagaaagggttcctcaaggtgcgtgcacttcctcccatctggcaaatctggccttctttgattccgagtatcactttgcatccttttgcaaatccaagaagtacacatataccaggctattggacgacattacgatctcgaaaagctcagctttcagcgacacagaaattagtaaagcgatcgcttctgtaaagagcatcatctctccacatggcattaagctgaacaataagaagcagaagatcgtgtcaaggagtaacccaaaggacctcatggaggtgactgggttatggctgaatcggggacgccctagagcccaccgctcctatcgcaaagtcgtcagattggagatgcatatttgcgagaaaatggccaaaacagaccgatttagtgaggaataccacaaactgcataatcgtgtgtctggaaaggttagcaaattaagttacctgggtcaccacgaagctaccaactatcgcgatactctacagaaaattttgcctctctatgatattcacaaggcaacgaatcttcacaagaatgcactgatcctcagcaaagtcaacgccaatatccggaagaaattcgcctatttcaaacggtactcaaagattaactacgagctgaatatcctcgccagaaataataaaccattgagcaagaccattcgaaatattctgtctaactgtaaacccagtggcctccgtgacgatcttctgtacaacgagccgatatga

SEQ ID NO: 10940 - RNA, 1170 nt, unidentified
  source 1..1170: mol_type = other RNA; note = synthetic construct
atgcgtccattttatgatgcccgacctatagggagcctggctgcactgtcaaaaacattgcaggtggaattgtcaattttgcaacggacagcgtccaacattgaagagcattaccatgcccacgaaattgttaaaaagtccggcggtacacgggagatcaatatcccctccaatcatctgaaaattatacagaagaggatcaacaaacacatctttgaaaatgtggtctatccttcttacctccatggcggcctgccagagaaggattatgtaaagaatgccaactgccatagctccgccgaggttgtgatcgctttggatattaagaacttttaccccagtatcagcatcgataaggtggaagaaattttccagttcttctgtcacttccctaaggacgtctcaaaattactcgcagagttatgctgcctaaacaattcggtacctcagggagggtgctcctcctctcacatagccaacttaattcttaacaacactgagtacagtctcgtctcttggctgtcttcaaagaagtatacttacactaggctgctggacgacataaatatctcgtctaaacacctgattagtaaagaggagatcactaagattatcaagaaaaccaaggaaaccataagtaagagcgatctgaagcttaacaataagaagcagaagatcacgagccggtccaatcccgaaattctgatggaggtgaccggtctgtggcttaatcgcggaacccccaaagctcatacgtatgatcgcaaactgattcgagcggaaatgcacaaatgtcagaccatggccaaaaaagaccgctttagcgctgagtatcatgagattcacaattccatcagcggcaaagtggccaagctcagctacctgaagcacaaagaatcagaaagatacaggtacatcctcagaggaattctgccgctctttgacaaaagcaaagaggtgagtatcagaaagcaggcaaactatctcctgaagtctaaaccgaactacaggaagaaatacgtttacttcaagaagtatcacaagctattgtataagctcaacatccttacaagaaacaacaaatctctggcaaatcaaatcaaagggaatcttaagtcatgtaaaccactgggcatgaaggacgagctactttacaatgagccaatatga

SEQ ID NO: 10941 - RNA, 1155 nt, unidentified
  source 1..1155: mol_type = other RNA; note = synthetic construct
atgcgtgcacaatatacaaagaaacccatcggctctttggaagtcctgtcaagagctttagagattgacctgggtgtactcatcaacaccgccaacgccattgaccagcattatcatgcccaccaaatccctaaaaaaaaaggcggtttccgtactattaacataccaaccttgcacctgaagtccatccagaagaagatcaactcgcgaattttcagcaatgtcgtgtatccggaatacctctttgggggaatcaaagagagggactacgttaaaaatgccgcacagcatgccggatgcaaagcgctgattgcactggatgttaaggatttctacccaagtatatctctgaatgcagtgaaagacatctttcagtactttttcaggttcccccgggacgtcgccgaattgctgggtaagctctgttgcctcaacgaacgggttcctcaaggcgcttgcacaagcagtcatctggctaatctgtctctccaggagaacgagtaccattttgcccagtattgcaagaataaggggtggacatatacgcggctgctcgacgatatttcagtgtctagcaaagaggtctttcagcagaaggatgtcgacgccatcatttccaaggcaaaggcagtgctagcaggcgcccgcctcaaattaaacaataaaaagacccgcatcttgtcgaaggctaaccccgtggatctaatggaggtaaccggactttggttaaacagagggaggccaagagctcacaggtccgatcgcaacgccatccgatccgaggtgtaccaatgtgaaatccttgctaaggaaggcagagagcgtaaaaagtatcatgacttccactcacacgttagcggacgcgtgagcaagctcgcgtacctggagcacgcgaatagcaaactgtacagagaacggctgcggaagattctgcctatatacgatgtgaaccaggctactaatcttcttcgccaggccgagtatataagtaaaacgaccctgagcaatcgaaagtctgtggcctactacaagaaatatcacatactaaagcaccggttgaatatccttatgagaacagatagggggttggctaggcgcattcagtcaatgctcagtctttgtaagcccactctgcagtcctccgacatgctgtga

SEQ ID NO: 10942 - RNA, 1098 nt, unidentified
  source 1..1098: mol_type = other RNA; note = synthetic construct
atggatttggggatcctcagaaataccatccggacaatagataagcattatcatccgcactcaatacccaaaaagaatggaggttccaggatcatccatattcccacgacacacctgaaaaccattcagaagaggattaaccgccagatctttgataatgttatctatccttcgtacctatttggaggcgtgcgggaaaaagattatgtgcgaaatactagtgagcatggagggtgtaacgcacttgtggctttagacgtgaaggacttctatcctagtattaccgttgctgctgtgaagaagattttccaatatttctgcaagttccccgctgaagtagctgaaaccctagccggtctgtgttgcctgaacgggagggtgccacaaggcgcctgtacgtccagtcacctcgccaacttagttctccatgacgaagagtatcacctggctcagtactgcaagaataaaggctggacttacacccggctcttggatgacatatctgtgtcatccaaggcagagtttgacgtgaaggagatcgacgccatcattaggaaagtaaaatacatgctgggaaaatctgctttgaaactcaacaacaggaagacccgggtcctgacaaaagcaaatcccgtgaatctgatggaggtgacaggcctgtggcttaaccgcggcgttccacgtgcccacagagcagatagaaatactatacgaggagaagtccatcagtgcgaggtagccgctcgtgacagcaggacagaaaagcagtaccacgagttacacaatagagtcagcggtcgggtcgcgaaactgtcttacctgaagcatgccaactcccgcgagtaccgtgagagactgagatcagtccttcctctgtacgacgagcaccaagcgaccaacctgctcaagcaggcgcggtacatggcaaaaactaaaacgaacatccgaaagactcctgcgtactgcaagaagtattttattcttcagcaccgcctcaacatcttgatgaggactgatcgcggggccgcaggcaaaattcgcgccatcctgacaacctgtagaccagccatcgccagcgccagcgcatatattgaatga

SEQ ID NO: 10943 - RNA, 1170 nt, unidentified
  source 1..1170: mol_type = other RNA; note = synthetic construct
atgcgcccacaatatctggcaaagccaatcgccagtctgaacgtgctgtcagtcgctctcggcgtcgacatcgacgtactcagaaacgccgcttcaaacatcgaacgccactaccatcctcatagtgtccccaaaaaagatgggtctttgcggtctatatatatcccctcgatccatctaaagaagatacagaagcggatcaataggaatatcttcgagaacatctcttatcctggatatctttttggtggaatcaaagagcgtgactacgtgaagaatgcgaatgcccatgcatccgcagaactgttgatcgccctggacgtcaggggattttacccttccatcacaagggacaagaccttgaacattttcaagttcttcttcaagttctctcacgatgtggcctcgcttctggcggatttgacatgccttaggggacaagtaccccagggcgcctgcaccagctctcacttagcaaacttagttcttcacgacactgagtatcatttggtccagcacttgaacaataaaggcctaacatacacgaggcttcttgacgatattagcatctcctctaaaacccaactcgaagaaaagcaggtgcagactctgattggcaaggtgcgcaccatgctgaacgagcagggcctaaagctgcagaacaagaaaactaagattaccagcagaaagaatcccgaaaacctcatggaggttactggattatggctgaatcgtgggcgggccagagtgcaccgcaatgagagaaggattattcgagcagagctgcacaaatgtgaaagcatgtcccgcctctccaagagcagccctgagtaccacgatttttataaccggctgtccggtagagttgccaagctcacgtacctcgaacacaaggaggctctgagttatcgatcaagattgcgtgaaatactgccgatttacgagaagaatgagatacatcgcacaattcagttagtgaccagtctgcaaaaatcctcaatcaaagatcgaggcaaatacgcttactacgctaaatttcaccaggtgaggtaccggctgaatattctgggtagaactgacggggggctcgctaaaaaactggccaccaccctccagacatgtaagccaacaagcgataaagagcggctgttttatcatgacattatatga

SEQ ID NO: 10944 - RNA, 1170 nt, unidentified
  source 1..1170: mol_type = other RNA; note = synthetic construct
atgaggcctctgtaccttgctaagcctatcgcctcactgcaggctttgtcctctgcccttagaattgacgtgcatgtgctcaaatcaacagcggccaacatagaccggcactatcatccacactccgttcctaagaaagatgggagtagccgatcgatctacattcccagcatacatctgaagaaaatccagaaacggatcaaccggaacatttttgacaaaattaagtaccccgattacctgtttggaggtattaaagagcgtgactatgtaaagaacgccaacgcccatgcaagcgccgagacgctgatcgcactcgacattcgggggttctatccctccatcacgtatgaaaaaaccctgaagatcttcaagttcttcttcaaattccccgaggacgtggccgcattgctcaccgatttagtgtgcctccgcggaagggtcccacaaggtgcttgtacaagctcccacatcgcaaacctgtccctgcacgaagctgagtaccatctcgttcagcacatacgtaataaggaatttacatacactcgcctgttagacgatatctcaatctcttctaagaagcagataaacgaaattcagatacagactctcattgggaaagtccgcaagatgctcaatgaacaagggtttaaactacaaaacaagaagacccggatcacatcaagaaagaatccagaaaaactgatggaggttaccggattgtggttgaatagaggccaggcgcgcttacaccgccaggaacgaaggctgattagagctgagctccacaattgcgagaaactcagcaagctatctagaacctcgatcgactaccacgagctgcataatagtctgtccggcagagtggccaagttgacttaccttggccacaaggaggctgcctgctaccgcagccggctaagggaaattcttccggtgtatgatgataatgaaatccataggacaatcaaactggtatcttttctggagaaaagtagtgtcaacgataggaagaagtatgcatattacgccaaattccatcaggtgggctaccgtcttaacattctgagacgaacccaaagcggccttgctaataaactggcggaaatactgaggacttgtaagccccctctgaataaggaggagttgttttatcacgagatcatttga

SEQ ID NO: 10945 - RNA, 1164 nt, unidentified
  source 1..1164: mol_type = other RNA; note = synthetic construct
atgaggcccatttactccgcgcagcccattgggagtaccgctgccttggcgttggcacttggaatgtccgagagcgcgcttcttgcactggccgcttcagcttccatcagatattctgccttcgagataccaaaaaagaattcggataaggtgcgcaccgtgtgcgagccacatcacgagcttaaggtggcccagaaaagaataaatagggccgtctttgaacacgtcgtatacccagaatacctgcagggaggcattgccgatcgcgactacgtccggaacgctagaatccatgcccacagtaaaagtttgatagccttggacgtgcagaatttttatgacaatatacaagccccagacgtgctcaagatcttcaaattcttctgcaaattcccggaagatgtggcacgggtcctcacccagctgaccacaaggggtggtcgagtgcctcagggcgcatgcacttcgtcccatatcgcaaacctggtgtttttcgctactgaacaccgcgtagttagagagttttttcaacagggcctccgctattctaggctcctggacgacatcacagtttcttccgctaagcaactgagccaggagagaactagcaagattatccacaaagtgaaacttctgctcgccgagaagcatctgcgcttgaagacgtctaagactcgggtttcttccaacagtaaccctgaggtcctaatggaagtcacagggctgtggttaaaccggggcgcacctcgagcttttagggctgagcgacatgatattagagcccgcatgttcaaactggagcggatgcatgagttgagctcacacgatctggactaccacgccgagcacaatcgcatcagcggacgggtagctaaaattacttacctgggacatttcgaagcagagaactatagatcacgtctccagaagattctccctacctatgacggcaccgaagtggcccgtacacttaagctagttcgattactgtgtgcaacacccgcccatcagcgggataatctggcgtacatcgataagtaccaccacgtgctctatcgtctggggatcctctctcggacccacaggagactggcttcaaagcaaagggcactggtgatgaaatgtgcccccagcacgagcagggaagaactattatatgggtga

SEQ ID NO: 10946 - RNA, 1161 nt, unidentified
  source 1..1161: mol_type = other RNA; note = synthetic construct
atgcggccgatctttcatggaaaacctatcgcctctattgccagcttagcagcagctctcgggctcaatgccacgactctgcaggacttttcagcgcgggcccagagccagtatacccgtttcgagatccccaagaaaaatgggggaactagaaccatctgctctcctacccatgatcttaaggtcattcagaagcgtatcaacagagcaattttcagtaacgttgagtttccacccttcctcttcggcggcattgagggaaaagattacgttaaaaatgctcaagctcacgctggcgccaaaactattattacactcgacgtgacggatttttacccatccatctctaagaaaagagtcgccgagatcttcaagtatttctgtcacttccccgacccggtgagccatttgctcgcagaacttgtgacactggatgaggtcgtgccacagggagcttgtacaagtagttatattgccaaccttgtgctctttgagactgaacatcgcttggtagaagaatttcgccagaggaagctgacatactcccgactgttggacgatatctgcatctcctcccagcgaaacatcgcacctaaagaggtccaggaaataattagccggactgcttcgctgttaaaaagcaagggtttcaggatcaagaatcgcaagaccagggtgagctcagcttccaatcctgaaaccctgatggaggtgactggcttatggctaaaccgaggtcacccaagagtttttcgggctgaaagagagaagatccgtacccaactgcacaggtgcgaggagaatttcaagatatcaagaacagcacccgaatatcatcaagaacacgatagattgagtggcctcgtggccaagccaacataccttaatcattttgaggccactaacttccgcaaccggctgtcagcgaagctgcctcactacaacagggcggacacctataagacggagaaaatagtggaatctctggaacgcgtcaatatgggtgaccgcgggaagatctcttacattgagaagtttaaccaggtaacccaccggataaatatactagcaaggtccaacgccaaactggccacaaacctgcgggacaggctgcgaaaacacgcccccaccaaaaccaaggaggacctgatttacgggtga

SEQ ID NO: 10947 - RNA, 1206 nt, unidentified
  source 1..1206: mol_type = other RNA; note = synthetic construct
atggatcacaggagcgtccagcttagcaggtgtttatttcttagcatgaggccaattttcaacggaacaccaatcgcctcagtcgatgccctggctcgttcccttagtctgagcgcacagcagttacggacattggcgggagcagttagtggccactaccgcgattttgacatccctaagcgcgacggctcctttaggactgtgtcagggcctactgaggaactgaaaattatccaacggcggatcaatagacacatctttgagagagtgcagtatccctcgtacctcttcggttccatcaaggagcggaactacgtgcagaacgcacggagccattcccgcgcccatgtaatcgtggccatggacgttgagaatttcttcccaagtatcaaaagggaggctgtgctgaacatatttaagaacctcttccgctttccgcaagaagtggcctctctgctagccgacctttgtactaaagacggccacgtcccacaaggggcttgtacctctagctatatcgccaacttagccctgcacgatatcgagcacagactggtgagcaatctgcggcacgaaggcctgatatactctagactgaccgacgatatttctatctcctcccctcatcccctggcgaaaaagcgcatcgagtccttggtggtacaagttgccgaaatgttgaagtgcaagggattcaaacccaagagaaggaagacaaaggtcacctctaagaataactctgcagaactcatggaagtcaccggactctggttgaatctcggcgaacccagagtcaaaagagatgaacgggcatcaattcgcacagaggtgaggcgatgcattcgcgagtccaaagtcgaacgaacgagtcctgagttccacaagctccatgaccgtacgtctgggcgggtggccatgctcagtcagttgaagcatcgtgaagcgaatcgtttccgcgtggctctgagactgtgcgcacccctatactcaccaatagagattaaacgaacccagaagattgtagctgctgtttgcaagacccccctaaggagccgggaaactgctgtgtatatacagcgattttatcaggctagatacagggtaaatattgtgtcaaggacagaccctaaacttgccaaagagctgcatgcacgactgagctcgcacgttccgaaaatgaaaaaggaggaggccatttatggttga

SEQ ID NO: 10948 - RNA, 1185 nt, unidentified
  source 1..1185: mol_type = other RNA; note = synthetic construct
atgtccgtgatttttaacagttgcatgaaggcaaagttccttggcactccaatcgctcgagttgagtcccttgcgagaacattgggtgtgagtatccacgatttacgcaccattgctggggccgcttcctccaggtacaatgacttccagattgataagaaagatgggggcaaaagggacgtgagctcgcctcgcatagagctgaagctaattcagaaacggatcaaccgcgaaatttttgaaaaggtctacttcccatcttacctgaacggcgggatcaaagggcgtgattatgtgaagaacgcatatgaacatggaaactcggagactatcatctctttggacatagagaacttttaccctaaggtatctcggatcagcatactgaacatctttaagaacttcctgaaacagcccgaagagatagccgagattctgaccaatctctgcacaaaagacaataaattgcctcaaggtggttgtgccagttcttacctggccaatcttgtgttcttcgacattgagcccagactcgttagcaggcttcaggaagagggctttacttacacacgtttaatcgacgacattaccatttactcaaagaaccttatctccaagaaaaaaatctcagacctcatcgaaagcatcacaaagatgctgaagtctagaggattcaaattgaagcagaaaaagactcgatgtacctcagctagcaatcccgagaagctgatggaggtcacaggactgtggctgaatcggggggcaccacgggttagacggaacgagagggccgaaattcggaaggaggtgagagaatgcctgatctccgcagagctgaataagaccgataaggagtatcacgatctccatcagaaagtatctggaagggtcgctaagctgagtcaactgaatcactgtcaagccgaacgctttaggaaagaattgcgggaaatcctccccatctatagcgacgcggatattcgaaagactcgccgactcgtcgccaaaatcataaaaacccctcgtacaacgagaagtagcctcggctatattaaaaagtaccaccagatcgtgtataggataaacattctagccaggagcaataagtccatcgctagatcattacgcgagaaaatgaaaatatgcgcaccgaccattacgaaggagaattcaattcatggctga

SEQ ID NO: 10949 - RNA, 1179 nt, unidentified
  source 1..1179: mol_type = other RNA; note = synthetic construct
atgaatatttcatatagtcatcctcccatcggctctataagcaagttagccaaaatgctcgacgtctcagaagcctatttgtaccaggttgccaaaaaccccgagaatttttacgcattttccgagattcctaaaaagaatggagattttaggactatctcggatccggtgaaggagctcaagattgttcagcgccgcattatccggagaattttctgcaattgcatatttccaacctaccttttcggttccattaaggacattgaaaatccaagggattttgttcgcaacgcgcagtttcactcgaacgcgaatgaagtgatggctttcgacatagatagctttttccctagcatccaggctaagtacgtaaaacttgtgttcaagtacctgctcaacttccccaatgatgtatccgacctcctggtgaagctgacaactttgaatggctccatcccccaaggggcaccaacatctccttacatcgcaaacctggtgttctacgatcaagagccgaaacttgtcaagctgtttacagacaaaaagctgcggtattctcggctggtagatgatatcactatcagttccgaaaagcctattacatccgggaacaaaaccttcatctacgagcaggtgaaaaaactattggacagtaagagcctcaagatcaacaagaaaaagtatcaggtcacgaacacatccaacagtggaaaaaaaaccatcgtgaccggcctcataatcgagaacaatattgtcaagcttcccaaggagacaatcaaaagcatctccaggcaggtttatactctgaacagaatggccgacgtggccactactgatgtgaagtatcacaaagctcacggaagcaccagcgggctggtcgctctgtatagccgtttgtctaaggagaagagtgacgtgcatagactgtctctcaggggaataaaaccaacgtattcaccatctcggttaaaaaaaatagctagtctgtgtcgacgcttcattaaatacggtgagtcacacaccaaaaagcatggcgatgaagactatgccaagaaatactacaagtacaagcacaagatttctatcattcgtcgaaccgacaaaaagaccgcctacagattagacctagcattgaagcctatcaagccccttcatctgctgtcaagctatcacgaatga

SEQ ID NO: 10950 - RNA, 1179 nt, unidentified
  source 1..1179: mol_type = other RNA; note = synthetic construct
atgaaaatagcctactcaaactcgtctattgggtccgtcgcagcccttgccaaaatgctagacgtgactgagaatttcctgacccttgtggccagtaaacctgatgatttctactccatcagcaagatccccaagaaaaccgacggcttcagaacaatttcagatccagtcaaagagctgaagattgtgcagcgtcggatcgttcgcaggatcttcagcaaatgtagttttccgtcctacttattcggatctattagggacgaaatcaacccaagagattttgtgcgcaatgcgcaatatcattcacaggctagggaggtaatggcttttgatgttgagtcgttttttccctcagtaagaccccaatttgttaagaaggtcttgaagttcctcttcaaccttcccaatgaagtggcagagatgcttgtctctctgatgacactccaggacgggctacctcagggagctccaacaagcagttatgtggctaatctcattttttatgactgcgaacacaagatagtgaagacgctgaatgctatgggattcacttacagtcgcctggtggacgacatcacggtcagttccaagactataatcaagaacgaggaaaggaggtttatttatgagcaaatctctaagatgctgggcgagaagaagctcaaaatctctcagcgaaagtatggtgtcactaacactacagtgatcgggaaaaaaacggtggttaccggattagtggtcgaagataagatgattaaactccctaaggagaaggtaaaactgattgggcagatggtgtacgagctgaagtcaaaggccgaggttagcaccaccgatcacgagtatcataaatccttcaacaaagccagcggcttggtggcactctactctcgtctgaatactaagaaagccgaaatacaccggcagcaccttcggcagatactgcccacatacgacaataaaaaggccaaaaaaatcggttggttgtgtcggaagtttattggctacagcaaattgcatccaagcaaatttagcgaggaaggctataccagaaagtactacaaattcaagcacaagatttccatcttgtcccgcacaaaccgaaccctggcaatctctctcgaaaaggacctgaagcctctgaaaccgacctgcctgttagcgtccttccatgaatga

SEQ ID NO: 10951 - RNA, 1179 nt, unidentified
  source 1..1179: mol_type = other RNA; note = synthetic construct
atgcgtatcgagtatcagggaaagccgattagaagtatcaaagccctctcaacctgtctaggcgtgagcgaggactctctgagtcagattagcctggatattgagaatcagtacagtatctccgaaatcccaaagaagaaagggggctttcgcaccattagcgaccccctccctcccctgaaaatcatccagaggcgcatcgttagacgaattttctccaacatcaaattccctgactatctcttcggctcaattaaagatgacaataatcccagggatttttataagaacgccctctaccatcagaaggctaaggaagtgctgtcgttcgatattgagagttttttcccatcatgccgacctaagttcatctacaagatctacaagtacctgttcaacttttctgacgaggtcagccacttgctggtgaacctgacaacattaaataatggccttccacaaggagcaccgacaagttcttatttggctaacctgtttttctacgacaacgaacacaagattttcaagactcttaagagcaaaggatttctgtactccagactgattgacgatattgtagtgagcaagcagtctaagatcaactcaaacgagaaacagttcatttataggaacatcctgagcctccttagagagaaagaagtcaaccttaacaaggacaaatactcctactctaatactaaaacacacgggaaaaaaacgattataactggtctacaagtgcgaaatggtaacactatcctccccaaagaaaaaaccaccgaaatacacaagaagattcacgagattgaacatttgggggaggtcgatcgcacctccaataaatttcacgaggcctacggcacagcttcaggattgttagcgctttataagagggtggatataaccaaagcagagaaattacacaagaagataatcaccatcaagcccatttaccatcctaatcggataaagaagatcaagtggatttgcaacaaatttgttcggatctccaagtccaatcctcggagaatcggggagtataatcacgctaaaaagtatcatcggctgatgcataagatctctataatacgtaggacccatactgcattggccaaacagctgaaagcccggatgcaaagcatcaagcccacgcgcctcctgtcggaatatgaaccatga

SEQ ID NO: 10952 - RNA, 1182 nt, unidentified
  source 1..1182: mol_type = other RNA; note = synthetic construct
atgcctctgcaagtcacatatcgcggctcacccatccgttccctggaagccctgtctagcgcattgtcgtgcgatgaacctattctgaagcacatcagcaatcacgtcgcagattactacactttctttgagatagagaagaaaagtggtggcgcacgacaaatcaagcctcctaagccaatcctgaaagccatccagaagcggattaactctaggatcttcagtctttgcgagtttcccgagtatctccagggcagtattaaggacgccacgaacccacgcgatttcgtgtctaacgctcgggcacatagcaacgggaagactgtcgttgcggccgatatcaagaatttttacccgtcagtaaccgaaagcaatgtgaaggagattttcaaatacttgttcagattctccgacgacgtgacagccgtgctcgtagctttaacaacactggacaattcattgcctcaaggagctcccaccagctcttatctcgctaatctggtgttctacaataacgaacataagctcgtgaccgaactgagaagaaaagggctcatatacactcggctgatcgacgatattaccgtgtcctctccggtggttctcgacaagaatgaacaggaatggatcatacggaagataaaaggctttactgctagtaagggtttagagttgcacaggggtaaactcaaggtctgtaccacctccaccccaggggccaacgtcatcgttaccgggctatggattgacagaggccatccccggatatcgagggaagccaggaacaaaattcgcgcggcggtgcacaggtgtaaaaaagagcatgaagccggacacaagactctgggggagtttcatgacagacacaacagcgtttcaggctctgtggccctaatttccagactgggacatacgcagggtaaacagtatcgccttatcctgaatgagaatctgccagaatactcaaaagagtatgctggcaagcttacaaagatttgttatcgctttagcgccaaaaaaggattacgaaaggagactctcagttacacaaagcgatactaccagcttatgtatcacctgtccatccttggacgttccgataaaaaaaaagcaaacttcctgcggtccctactgaagcagaacccacccaagcactgcctgagggagttgagcgaggagtga

SEQ ID NO: 10953 - RNA, 1260 nt, unidentified
  source 1..1260: mol_type = other RNA; note = synthetic construct
atgtgctttacacttaggtattttcctgagtggctgccacaagtgtttctggagcttatcgacagcttaccttttctgtcactgggatatatgaataggataaccttcgcgtctaggcctatagcctctcgagcagctctcgctaaggcgttaagcattgacgagcgtgttctggccgagtttgagcagaacgcaaacgcatactactatttcttcgagcggcccaagaaacacggcgaaggcatcaggtccattacggctcctaaacctctcctcatgcagctgcagcgtagagtcaacaaccggatcttttccggatgcaactttccacgctatttgcatggatctattaaagatagtgagattccaagggatttcctgaccaatgcccgcgagcatatcaccgccgaccatgtcattaccctggacatcagaaatttttaccccagtatcggcagagaggaagttttcaaaatcttcaagtaccttctccgctttacagatgaagtcgcaagttccctgacaagcttggtcacccttaacggcacggttccacaaggggcccccacaagcagtttcattgctaacatggtgttctacgacagagaacccagattggtggaagaactgatcaggtccggtgtgcgctacactcgcctcttagacgacatcaccctgtccttctctaaccggatttcgtcagaaaagctcaagggggagataatcggtaaagtacggactatgtgtagcgctaagggcttcaaacttcatgatggcaagcagaagattcacagcctcatcagctctccaaatccggccatcgtgacgggacttagcatcaggaataataagttgggtctacccgtggcctaccgtaacaaaacacgcgccaaagtccacaattgcgtgcaacagtatagagctgggcaccagactgccgcagagtaccactctctgcacaacagtactttgggggatataacactgctaaagcgactgaagtataagtgcgctgacacctacgaggaaaagctgcggtcatgtctcccaacctatcaccctaaaaaagctcagcagctccgaagggcttgtgaggatctggccataaagattcggccctcctcagtagcgtccttaactagacggttccacgtgctcatgcattgtctaaccgtgctgcagcgaactaaaccggatctggcagcagccctgagaacattgctgcgcacttcatacgccaaggccatttcgaatgaatga

SEQ ID NO: 10954 - RNA, 1170 nt, unidentified
  source 1..1170: mol_type = other RNA; note = synthetic construct
atgaaccgaattactttcgctagccggcctattgctagtagggcggctctggcgaaaacattgagtctagacgagcgcgtgctccgccagttggagcagaacgtgaacgcactttacctatcctttgagcgcccaaaaaagcatggggaaggcatgagatccatcaccgccccgaaacccgccttaatgcaggtccagagacgcattaatacacggatattctctggctgcaagtttccgagatatttgcacggcagcatcaaagacctggaagcacctagggattttctcaccaatgcatccgaacacaaagccgccgagcacgttataactctggacatcaaaaacttctatcccagtatcgagcgcgaagtggttttcaaaatcttcaagtacctcctgaggtttcctgacgaggtggcgacctctctaaccagtcttgtgaccctggacggcgtagtgccacaaggggcacctacgtcgtcgttcatagcgaacatggtcttctacgatcgcgagcccaagctcgtggaagaattcatccggtcaggggtgcggtataccagacttctggatgatatcacactgtcattcagcaacaggatttcttccgagaagctgaagggtgaggtgattggaaaggttagagctatgtgcagcgaaaagggatttaagttgcacgatgggaaacaacgaatacatgccctgatctcttctccaaacccagcaattgtgactggtgtcagcattcgaaatggacgggtggggcttccccccgtatacagggacaagactcgcgccaaggttcacacatgtgtcaaacagtttgacgccggacatcagacggccgctgagtatcataggctccacaattcagctctcggcgacgtcactcttctgaagagactgaattatagctgcgccgaggcttacgccgaaaagctccggtcctgtctgcctacatacagccccaaaaaagctcggcaacttaggagaatgtgcgaggatctggcaatgaaaatgcgtcctacatccgtggccgctttaacgagacgttttcacgtactgatgcattgtttaaccgtcctgggcaggacaaagccaaatcaggcacggactctgcgaaccttgctccgtacctcacacgccaaggccatctctaatggttga

SEQ ID NO: 10955 - RNA, 1020 nt, unidentified
  source 1..1020: mol_type = other RNA; note = synthetic construct
atgaggagtctgtcagagcccattctgctccttaagattctgcagaaacggatccttaacaggatcttctgccatatcaagtttcctcactacctgcacggcggtatcaaagcaaccaaccccagagacttccactccaatgctagcgcacacttaggggcggaggtggccatcacactagatatcaaaagcttttttccaaacgtcacatccatggtcgttgaaaactccttcctgaggctgttccagtttcctgacgaggtcgcgaccgtgttggccaagttgacgatgctaaataatcagttaccacagggtgcccccaccagcagctgcattagcaacatcattctgttcgatagggaatacaagatagctgccaacctggaggcccaaggattccagtatactcggctgattgatgacattactatttcgagcaagaagaagatttcctccgaaagagtttcaaaggtcatagatatcatcgcaaaaatgctgggacactacgggcttaagatccatccagacaaaacacacgtacggtctaagggcaatcctctggacctgatgactattaccgggctgtggataaaccggggcagccctaagctcgaccgaaaaaaatgctttgagatatcttgtgaggttatccagctgaagcgcgaggctcttaaaaacggggtgaatgaggtgaaataccatacacgttacagttctgttgccggaaaggtggctctcctcgaacgtttgaaccattctcgcgccacacgcctcaagctaatcttggataccattctgccaacctataataattatgacgtggcaaaagtcgctaacttagtgtcaaagttctgtaagaatcaacgagattccaacagtatcggctatctcaaaaagttttatcagctccagcatgctgtgtctatagtgaagagaacgcacgtacccaccgcaaaaagtttgcaagccctccttaatatcagacgcccgaaaaggactatgtcagaattctacggctga

SEQ ID NO: 10956 - RNA, 1179 nt, unidentified
  source 1..1179: mol_type = other RNA; note = synthetic construct
atggcctctaagcataaaatttactacgatggactcccaattgggtctatcaaaacccttgcgaagactctgtcatgcacagaagctcgcttaatcaagatatcaacagacccaagcttcttttatactacttttctcaagaccgtcaaaaataagaatagggagcttagcgaacctaaccccgagttgaagctgatccagaagcgaatcgtgagtagaatctttaaccacatcaaattccctcactatttacatggcggtatcaaagccttggaccccagggatttccactccaacgccaaggctcactcaggagccgagactgccattacactggacatcaagaacttcttcccgtccattaaagctgaccaggtcgagaacctctttctgcatctgttcaagttccctcctaatgtgagcagtgtgatgtctaaactgacaactctaaataactgtatcccccaaggggctcccacttcaagttacataagcaatctgatccttactgaaaaagaatatcggattgcggccaagctcgagtcccagggctttatatacaccaggctgatcgacgatatcacaattagtagcaagaaagaactgcccgagaaaaagatcacccagataatcaccaatatcgcaggaatgcttacacattataacttcgagctccatcctgagaaagtacacatatattctcggtcaaatccagaaaagttaatggttatcaccggtctgtggctgaaccgcggcatgccaagaattgagaagtctcgcagactgcagatatccaatgatgtgattgctattgccaagctcgcaacaagctccaccgggacgtccgatgcaagttaccacgagaagtttaatgccgcttctggcaaagttgccttgctacaacgatttaagcacaccgaagcacggaggctcagggccatcctgaacgaaatccagccgacgtataatgattacgacaagtgcaagattaacaagctggctttccgttttttgaataaaaagacctccaaagagacgattggctatctgaagaaattttaccaattccagtaccgtgccagcattattaaaagaacagaccccgcactagcgaagcggattcaggaaaaacttaacttgaaccgcccaacttcgaccaaaaaggcattctacgagtga

SEQ ID NO: 10957 - RNA, 1176 nt, unidentified
  source 1..1176: mol_type = other RNA; note = synthetic construct
atgactacccataagatcttttattctgctaagcctattgggagcatcgccaagctggccacagccttagggttcacagagagcttcctccgaagtgtgagcaacaggacgacagactactacaccgagtttgttaagagcgtgaaaggtaaagatagggaactgagcgagccaaagccccacctcaaaacactgcagaaaagaattaacacacgcatattctctcatgtgaaatttccttcatacctccacggcggtataaagaccatagatccacgagattttgtgaccaatgccagtcaacactgtaaatcagaaacggccatcaccctcgacatcaaaggctttttcccgtctatcaccacagcacaggtcgaaaacatcttccgtaatctgcttaatttcccgaacgaagtctcagcattgctggcgagcatagtcactcttaacggtttactgcctcagggcgctcccacatcctcctacatttctaacctcgtgatgtgggagaaagagtgcagacttgtgtcgaggtttgagggcagggggctgatttacacgcgcctcatagacgacatgactatttcgtccaaaacaagaatcccagaaaagctagtgactaagattatcgaagatgtagcgggaatgctccagcactacaattataccttgcatcccaagaagaagaacattttcagtaaacgtgatcccgagcacctgatgttgataaccggattatggctaaatcggggggcccccaagctactgaaggaaaaacgggcagaaatctctcatggagtgattgctgctacccacatggcttctgagcctgacatgatcttcaatcctaaatatcacgccatccatgccacctgttccgggaaggtagccctgcttcagcgccttggccacactcgagcgatcagactgcggaatatcttgaattccattgagccacaattctccccacagtattgccaccgcatttcagttgttgtccggaaattttacgcaaagggcagggtcaagaacgatctgggaagtctgaaaatcttctatgagtttcagcataaggtgagcattgttaaacggactgaccctatcctggctaagaagctccagatctatctgaacgcaattcgcccccaagccactatgagagagttgaacggatga

SEQ ID NO: 10958 - RNA, 1185 nt, unidentified
  source 1..1185: mol_type = other RNA; note = synthetic construct
atggccacctacgacaagatttactatgagtcaaacccaataggctctgtcgctgccctggcgaaatcactcgacgtcgcagagtcccgtctgctgcaggtggctgccgacatccaatcgttttatcacatcttcgagaaaacggtgggcaagaagaccagacagttatgcaatcctaacgacgaactgaaacgccttcaaaagaaggtggtcagtaggatctttgcacatctggtttttccaccgtacctgcatggcggaatcaaagccgaggatcctagggattttttgagcaacgctggggtacacgtgggagcccatgtggccatcgccattgacgtgaaggactttttcccttcaatctccgagcagtctattgcccaagcgttcaaactgctgttcagattccccaaggaggtagctgagatcctggctaaacttaccaccttaaatgggtttgttccacagggcgcccctactagcacctaccttagtaacgtggtgatgttcgacaaagagtataggctggtggctcgcctaagggcaaaaggcctccgttacagcagactgatcgacgatattacaatcagttcagagaagagcatgatgccctccgagattgatagggtcacaactgatgtaattaaaatgctgcgagcctataacttttatcatcacgaagccaaataccggatcctaacaagaagcaaccccaaggacttgatgatggtgacaggactgtggctcaatagaggggcaccccgcgtggctcggaagaagagagaagatattgccgcccacgtggtccagttgtctaagcgcgcacttgagaatcacgcgcgagaagatgagtcctaccatcaggaattccacgcgttatctggtaaggttgcactcctacagcgggtcggacaccgagaagcttcccggctgagatctatactccgcgaaattaagccgatatatggtgagcaggaactgaggaggcttcggaaaattatccccgcattttgtgaaaaggtgatagaccgaagcaagttggggtacataaaaaagttctatcgtttccagtactgcgttggtatcgtccggaattcccacccaaagctcgctgcaactctccaagccagtctcaatagcgttcgccctactaaaacgctgcgggaattggatgagcatgaatga

SEQ ID NO: 10959 - RNA, 1173 nt, unidentified
  source 1..1173: mol_type = other RNA; note = synthetic construct
atgagacagaatcacaagatagtgtatgatgcttcttccatcggctctctgcaggttctggccaagacccttgacatcagcgtgcaccgcatccagaagattgcaagcgtccagacggacttttacacaattttcgagaagcaggtgaaaaataagatccgagagttagcagaaccaaaagccgaactcaagattattcacaagcggattatcagccgaatcttctcccatttcagatttccacactatctgcacggggggatcaaagctgacacccccagagatttcatctccaacgctagcgctcacgccgcttgcaaaacagcgatcgctatggacataaaatctttttaccccagcattacatacgaacatgtgtatcaaatgttcctgcggttgtgcaagtttccccctcaggtcagtgaggcacttgcaggcctgactaccttgaacggatcagtgccacaaggcgccccaacatcaagttacattgcgaacctcgtgatttgggaccgcgagtataagctagcgtcccttttcgagcagaagggtttcgtatatactcggctcatagatgacatcaccgtatctaccgaaaaaagcatgtcgaaagaggccatcgagaacgtgattaagctggtaagcagtatgctagtgaattacggattcaaaattcaccctgataaaactcagatttactccaagtcaaatcccgaaaaacttatgctgatcacgggcctctggctgaacagaggcatgcctcgtttggatgctgataagcgggtgaaaatatccgcctcggttacacgcctcaccaaaaacggggtcaaagattgtgtgtcagacgaatatcaccaacaacatagtaagctggccggtcaggtcgccctcctgaaaaggctgaagcatgttgaagccggacagttacgcaaactgctggacgcaactccgccgatattcgagcattcaaagatcgccaagatccagaaggtggtgaagatgtttgtcagaaaagagattgactcctctaagctcggatacctgcagcgtttttttcatcttcagcatcaagttagcatagtcaagaggaccaatcctaggatcgcacggcagttacagatcatgttgaataaaaggaggcccacatctactaaggagagtcactacgcctga

SEQ ID NO: 10960 - RNA, 1026 nt, unidentified
  source 1..1026: mol_type = other RNA; note = synthetic construct
atgatcaagccacagcttttctactaccccctggccgggatccaatctattgagtcacttgccaagcatctggatattgacttagacaaactcacctatttgttggaaaacatcaactctcagtatattggcccaatctttatcaaaaagagcaatggtggtagcagacccatttacaggtgccgtccccaactgaagtacttcctgaagcggctgaacagtaaagtgtttaagttggtgcactatcctaacttcctgtatggagccttgcctaataaaagcatttataccaatgcgagccaacacctcaatgctaaggtcatgtgtaatttcgacatcaaatcgtactttaccactattacgtttgatcacgtgttcgatatcttcaagaattttttccacttctccaccgaggtgtctaacattcttgccacattaacaacgataaacaatcaagtgccgcagggctccccttgctccacttacatagccaatcttgttttttaccgctccgaggtcaatgtggcaaacaaactgaaagacaagaactacgtttataccagattcatagatgacatcactgtttcatctcagtacaaaaaaaccaagaaggacatcgaagaggtacatacaatcgtgatcgggatgattcgcgcttataagtttagcctgcagactgagaagcggagcattgctccctcacataaatgccagattctaacagtcaatcagatcaatatcgtcaaatccaacctcagtatttcaaaagaaaaccggaagaagataagagctgcagtccacgaactcaaatgtaatctgaacgataacaacatagagtttgtagtgaagaacttcgaaagtgtttatgggcgagtgcagtacctgaaaaatatccatattaaggaagcacagggcatgctgaaacagctagagcaaataaggagtaaaatcctcaagccactccagatttacaagtatcgaaagttaaaggaggccatcaggaagaaacagggatacaagctgtga

SEQ ID NO: 10961 - RNA, 1056 nt, unidentified
  source 1..1056: mol_type = other RNA; note = synthetic construct
atgctgaatctgcaattcaaatacccactggctgctgtacagtccatcgagagcctggcgaagcatttgaatatcgactgcaacacaataatctacttattggagaacatcgactttctctacgaaggcccaataccaatactaaagtccaatggaaaaactaggcccatctatctgtgtaaacccagactcaaatacttcattaagcgcttgaacagcaagatttttaaagtggtgagctaccccgattttttgtatggggccctaccaaacagagatacatacaccaacgtctcacagcatctgaacgccaaggtgatctgcaactttgacatcgaatctttcttcactgcgattacatatgagcatgttttcgatatcttcaagaacttctttcacttctcggctgaagtcagccaagtactggcaaagctgacaacggtcaataaccaagtacctcagggttccccttgtagttcttacattgccaatctcgtgttctacagaagcgaggtcaatgttgtgcagaagctccggaataagaattttgtgtacacccggtttatcgacgatatttctgtgtccagcctttcaaaaaaaaaaaagaaggacatcgaggaagtccaccgaatcgtgataggaatgattagagcctatcagttcagtcttcagactgagaagatctctattgccccttcccataaaacccagagcctcaccgtgaataagatcaacatagtcaaaagtaggctttccatccctaaaaaaaagcgcgcaaatattcgagctgccctgtaccagctggaacagcacttccaggaaaaagacatgaaatttgtggtgaagaactttgagtcagttcagggcaaggttcagtatctctctaagtttcacccgaagattgcagataagatgatgaaaaggctggagaagatccacattaaaattgcacaacccctgaatcactataagaggaaccgtcttaaaagtgatattcgcaagtatcggaacattaacttcatacggaataaatcagccttaaccgagaagatctga

SEQ ID NO: 10962 - RNA, 1020 nt, unidentified
  source 1..1020: mol_type = other RNA; note = synthetic construct
atgtcccccagcgcaaccagtgcgccatcttacagccagcgtagaattggaacactgcaggccctgcacgttcctttggggttaccagccagcgatttgctggccctggccgaaagggctgacggactatatcgagtagctaaacgcataacaaagccagacgggagtattagaatcgcatacgacacactggatccactgaagggagtacatcggagagtgaaaagtcagattctagaccacgtgtcctatcccgcctacctcactggttcaatcaagggctgtgacgcaaaagtgaacgcttcccttcacgctcgcgctcggattgttatcaacgaggatattagcggctttttcccttcaacatctgctgacagggttttcagtatatggcacaatttcttcggcttttccgaggaagtcgctagatgcctgacgcgtctcaccactcgacacggggaactcccccaaggagccatcactagctcattcctggccaatttagtattttggcgcgacgaacctgccctgcatgacaagttcgcggcacaggggcttgtgtactctaggtacgtcgatgatatcgccgtgtctagtaaaacatttttgaccaacaaggagaaaaccgacgtcatccgtcaggtctatggaatgctccttaagcacggctaccgcgctaaaagagcaaaacatgagatcgccacttctgcccgccggatggcagtgaccaaactggcggttaacagcaagcctggtctggatggcgcaaccagagacaagacgagggcagtggtgcaagctgtcgagcagaggtccgcccaaggcgaagtgttgtcgtttgatcggggtccttatgctcaggccatgggcaaggtgctccatttagagcggtttcatccgggtgatgcggctcccctgaagcgaaggcttctcgcactgaaggaggccgccgcctcaataaccagctcccacccctctacttggcggccgaatgagaagaaactcgggtcccactcatga

SEQ ID NO: 10963 - RNA, 972 nt, unidentified
  source 1..972: mol_type = other RNA; note = synthetic construct
atgtcacaatcagctaccaacgccccctcttattcccagaggcgaatcggcactctccaggctctgcatgtggccctgggaatgccagtgggggatctgcccacccttgcagaacgcgccaatgacctgtacagggtagccaagagcatcaccaagccggacggaagtattagaaatacctacgacgctagagagcccctgaaagaggtgcaccgaaggatcaaaagtcagattctggatcacgtcaactaccctgcatatctcacaggatcaattaagggctgtgattacaaggtgaatgcgtcactccacgcacgggctcgcatagtcattaacgaggacataagcgggttttttccaagcacgtccgccgatcgggtatttagcatctggcgggggtttttcggattctctgaagacgtggcaaggtgcctcacccagctaaccactcgacacggtgagcttccccagggcgcaattacatctagcttcttggcaaacctggttttctggtgggacgagcctgaactgtttggcaaattcgccgcacaggggttagtttattcgcgttatgtagatgacatcgcggtgtcttccaaaacttttttgacaaatgaggctaagacaaacgttgttagacaggtctacggtatgctattgaagcatggctataaagctaagcgcgctaagcatgagatagccacaagtggctccagaatggctgtcactaaactggccgtgaacaataagccaggtctggacaaggccacgcggaataagatccgtgcagtggtccatgccgtggaaagacggatcgcacaaggcgaagcgctcagcttcgaacgcgggccttacgcccaggctatggggcaagtgcttcacttggagaggttccacccaggtgatgctgcccctctgaaacgcaggcttctggccctcaaagaggccggagcggccttaccgcattcctga

SEQ ID NO: 10964 - RNA, 996 nt, unidentified
  source 1..996: mol_type = other RNA; note = synthetic construct
atgtccccgtccgctacctctgccccgttctactctcagcggcgaatcgggactttgcacgcactccaggtaccactgggcaggtcagtcagcgaactgctggtgcttgcgaccagggcagattccctgtatcgtgtcgctaagagtatgacgaaggcggatggcactattcgtaacacctatgatgccctggagcctctcaaagaagttcacaggagaatcaagggccaaatactggaccacgtgaactacccagcctacctgactggaagcatcaagggaactgactataaagttaatgcaagccttcatgtgcgcgccaaaatcgtgattaatgaggatatttccgggtttttcccatccacttcggctgatcgcgtcttttcaatctggaggggcttctttgggttctctgaagacgtggcgcagtgcctaacccaactaacaacaaaacacggagagctcccccagggtgctattacctctagctttctcgccaacttagtcttttggcgagacgagcctgccttgagagctcggtttgcagcccagggactggtatattcacgatacgtggacgatatcgctgtaagtagcaaggctttcttaacagacgaggagaagagtgacgtggtgcgccacgtgtacgggatgctgcgcgaacacgggtatcagcccaagcgcgctaaacacgagattgctaccgcgggaacacggatggctgttaccaaacttgccgttaacgccaagcccggcttggacaagtctgctagatcaaggataagggccgtcgtccatgcagtggagcagagagtggccagtggcgaagccctgagcctggaaagaggtccctacgcccaagccatgggccaggtgagacatttggaacggttccatcctggtgaggccgcccctctcaaacaacggcttctggcactcaagaaagcaacgaagccccagagcccaaattccgatgaccatgcagagacagcatga

SEQ ID NO: 10965 - RNA, 984 nt, unidentified
  source 1..984: mol_type = other RNA; note = synthetic construct
atgaatcctagtgccacaaatgcaccatcctatcgacaacggcgaataggatcactcgaagcgctacacaacagcttgggccttcctgcctccaacctcctggcccttgctgaaagggccaatattctctatcgggtggcaaagtctatcaccaaagccgatggctccatcagaaacacttatgacgcgctggaaccgttaaaggagacacaccgtcgtattaagagccagatcttggatcacgtgtcgtttcccgcttacctgaccggcagcattaagggatgcgattacaagaccaatgctaccttacacgttggagctaggattctcataaacgaggacataagtggtttctttccttccacctccgcagaccgcgtgttcaacgtgtggcattgctttttcggcttcagtaaagctgtagctcaatgtctcactctgctgacgacacgacatggtgagctgccacagggagccatcacatcctcattcctggccaatctggtgttttggcaggatgagccaactctgcacgctaaactggcgagtcagggccttatttactcccgctacgttgacgacatcgcagtatctagtaaatcatttttgactgacgaggagaagtctaaggccgtcagacatgtctatgggatgctcctgaaacatgggtaccagccaaaacgggctaagcacgaaatcagcacatctgcaacccggatggcagtgaccaagcttgccattaactcaaagcctggccttgatagagccacgaggtctaggatccgcgccatcgtccacgcagttgagaggaggttcgagttgggtgaagtgctaagcttcgatcaggggccctacgcgaaagccatgggacaggtgagacacctggagcgctttcatcccggggaagcagcccccctgaagaatcggctcctggctttaaaaagcattagcagaacacgctctcggcatagaaaagtcgaatga

SEQ ID NO: 10966 - RNA, 960 nt, unidentified
  source 1..960: mol_type = other RNA; note = synthetic construct
atgtcacccccagccacgagcgcaccgagctactctcagcgccggatcgggaccttaaacgccctgagactacccctggggctctccgtggacgagctgttatcactcgctcagcgtgcggacggcttgtatagagtcgcgaagagtataaccaagccagatgggtctatccggaacacatacgacgcccttgcccctctcaaggctgtgcaccggcgaatcaaatcccagatcctggaccacgtggtgtatcccgcctacctcactgggagcatcaaaggttctgattataaagtcaatgctagtctgcatacatccgcacgcatagtcattaatgaggacatttctggttttttccccagtacaagcgcagaacacgttttcaacatttggcacggacttttcggattctcccaggaagtatcacaatgcctgactcagttgactacccgtcaaggcgagcttccacaaggcgccattacgagttcgtttctggcaaaccttgttttttggcaggatgagccgacattgcatgctagattcgccgccgaaggcctggtctactcaaggtatgttgatgacattgccgtgtcttcgaaaacctttctatctaatcaggagaaatccgaggtgatgagaaagatttacggtatgcttctcaaacacgggtaccagcccaagcgcgcaaaacatgagatctccacaagcgggactaggatggaagtcaccaaactgagcgtgaatgctaagccaggcctgggaaaggcagtatacagcaagacccgagctgctgttcgggatatcgaagagagaatagccttgggtgaggtgctgtcctttgaacggggcccttatgcacaggcgatgggaagggtgctccacctcgagaggttccatcctggcaaggcggcccctctgaaacgcaggctgttagctctgaaggaaggagccaagacttga

SEQ ID NO: 10967 - RNA, 960 nt, unidentified
  source 1..960: mol_type = other RNA; note = synthetic construct
atgaatctgcaggcaacgagtgcaccctcttactcccagcatcgtattggtaccctgaacagccttcggttgccgttaggactcagtgtcgacaaattgttatctctggcccagagagccgactctctctatcgcgtggcaaaaagcatcactaagcctgatggtagtatcaggaacacctatgacgctgtggcctccctaaaagccgttcaccggcgcattaagagccagatcctggatcacgtaatctatccagcttacctgactggcagtataaagggaagcgactacaaagtcaacgcagctctgcacactaatgccagaatcgtgatcaatgaggacatttctggcttcttccccgcaacctccacggagcatgtgttcaacatctggtatggacttttcggattttctcaggaggtgtcacagtgccttacacagctcaccactcgacaaggcgagctgcctcaaggcgcgattacatcaagctttctggctaacctggtgttttggcaggatgaacctaccctccatgccgagtttgctgcccagggcctggtctacagccgctatgttgacgatattgccgtgtcgtccaagacatttctgtccaacaaggagaaatcagaggtagtaaggcagatttacggtatgttgttgaagcacggctaccagcccaaacgaacaaaacacgaaataagcacctccgggacaaggatggaggtgactaagctctcagtcaatgcgaagcccgggctcggtaaggccgtgtattctaaaaccagggctgcagttcacgatatagaaagacggatcgccaatggggaagtcctgtcgttcgaaagaggaccttacgcgcaagtgatgggccgcgttctgcatctagaacgtttccatccagggaaggccgctccactgaaaaagcggttactcgctcttcaagaggggacaaagacctga

SEQ ID NO: 10968 - RNA, 960 nt, unidentified
  source 1..960: mol_type = other RNA; note = synthetic construct
atgtctctgtccgccatctccgcccctttatacagacagagacggattggcactctacacgccttgcacgtgccgctagggctctctgtggacgagttgctttcgcttgcaaagagggcagatggtctgtaccgcgtggccaaatccattgcgaaacccgacggaagtatacgcaatacatatgacgctctggcgcctttgaaagaagtacaccgacggataaagtcccaaattttggatcatgtggattatcccgcatatctgaccggtagtatcaagggatcagattacaaggtcaatgccgctctgcatagcaacgcacgcatagtcatcaatgaggatatcagcggctttttccccagcacgagtgccgaactggtcttcaaggtttggaacggacttttcggtttctcacaggatgtttcccagtgcctaacacaactcacaaccagacaaggcgaactgccccagggcgccattacttcttcgtttctggcaaacttggtgttctggcaggacgaaccaatacttcataccaagctggccagccagggtctgatctacagcagatatgtggacgacattgctgtgtctagtaaagcctttctgaccaatcaggagaagagcgaggtaatgaggcagatctacgggatgctgcttaaattaggctaccagccaaagcgagccaaacacgagatctccacatctggggctagaatggaagtcacgaagctgtcagtgaacgcgaagccagggttaggaaaggccgtctactctcgtactcgtgccgcagtgagggacattgagctccgcatttccaacggcgaaatcctctcatttgagcgggggccttatgctcaagctatgggacgggttctgcatctcgagaggtttcaccctggcaaagcggctccactcaagaagaggctcatcgctctgaaagagagcgcaaaaacctga

SEQ ID NO: 10969 - RNA, 972 nt, unidentified
  source 1..972: mol_type = other RNA; note = synthetic construct
atgattcacaccccgagcgattcccccttctattccaagaggagaatttcaagcatgaccgctctgtccaaggcccttaacatcagtcccattgaactgttaaatcttgcgaaccgcgccgaccatatgtataggctcgcatccacaattacgaaacctgatgggagtacaaggcagacttgggacgcttacgcgccactgaaaaaggtgcagcggaacataagaaggaatatactggactacgttgtgtatccggcatatctcaccggaagcctaaaggggtgcgattacaaggttaatgcctccttgcacgtcggcgccactattgtcatcaatgaagatatcacccggttctttccatcaactagcacggcaatcgtgcagtcaatctggcgatatttttttggtttttcacacgaggtggcagagtgcctcaccaagctaacaacccggcagggagagctgccacaaggcgctattacaagtagcttcttggctaacctggccttctggaaggacgagcccgccttgcaggcatctttccgcgctcgcgggataatctactctagatacgtcgacgatatcgctgttagctctgtgaattttctggataaaccagccaagaccaatgtaatagcctctatctacggtatgctctccaggcatggctatcagcccaagagagcaaagcatgagatcagaacttctggtcaacgcatggaagtgactaaattaagtgtaaactcgaagcctgggatctctagtgcaaaacagagccagattcgttcagctgtgcatcacctggaacaagccatcctccggggcgagattattgaattcgacaaaggaccttacgcccaaacactgggactggtccacctgcttgctcgatttcaccctggcaaagcgaagaaacttaagcagcgtctcttggccctgaaatccagcggctgtacaaacatgtacacctga

SEQ ID NO: 10970 - RNA, 972 nt, unidentified
  source 1..972: mol_type = other RNA; note = synthetic construct
atgatccatacaccgtccgacagccctttttacagcaaacgccgcatttccagcatgaccgcactttcaaaggctctcaatatctctccaattgaattgctgaacctggcgaatagggccgatcacatgtatcgcctcgccaattctattaccaaacccgatggaagcactaggcagacctgggacgcctacgctccactgaaaaaggttcagagaaacataagacacaacatactggattacgtcgtttaccctgcctatcttacaggctcccttaaagggtgtgactacaaaacaaacgcaacactgcatgccggctcatccatcgtaattaacgaagacattaccctgttcttcccatcaacgtccgatacgattgtccacaatatctggcagcacttttttggtttcggaaacgaggtcgctgagtgcttgaccaagctgactacaaggcagggcgagcttccccaaggggccattacctctagtttcctcgcgaacttggtgttttggaaggacgagcctatcctccaagccagttttagagccagagggattatttacagccgatatgtggacgatatcgcggttagcagtgtgaactttctagataagcctaccaagactaatgtgatagcaagtatctatgggatgctctctcggcacggctaccagccaaagcgggctaagcatgaaatcaggacttctgggcagcgtatggaggtgacaaaattaagcgtaaattctaagcccggcttgagttcagctaaaaaatcccagatacgttcagcagtgtatcatcttgaacaggccatcctccgaggagaaatcatcgagttcgacaagggcccgtacgcacagactctgggtttagtgcacctgctggcacggttccattccggaaaggccaagaagctgaaacaacggctgctagctctgaaatcggctggtcacgccaatatgtatccctga

SEQ ID NO: 10971 - RNA, 972 nt, unidentified
  source 1..972: mol_type = other RNA; note = synthetic construct
atgaatcacataccttctgattccccgttttattgtaggcggagaatttccaatatggcagccttgagcaaagcattaaatacttctctggacgagctgaactcactggcacgtagagccgatcagatgtatcggctcgcctccagcctgacaaagcctgatggtagtgtgagacagacctgggatgcatatgaaccactcaagaaggtgcagcgcagtatcaggtgtaacattttggataatgtggtgtaccccgcgtacctgaccggaagcctcaaaggatgcgattacaaggttaacgcttctcttcatattggcgcgaaaatcgtcatcaatgaggacattacatgcttcttcccctcgacaagcgccaccattgtccagaatatctggcgaaactttttcgggttcggaaaggaggtggccgagtgcctgacaaggctaaccactcggcaggaggaacttcctcagggcgctataacctcatcttttttggcaaatctagctttttggaaggacgaacccgttttacaggctagcttacgagcccgagggctgatctattctcgctacgtcgacgacatagccgtgagcagtgttaacttcctcgacaactccgccaagtcagcggtgatcgcttgtgtatacgggatgctgttcagacacggttatcgcccaaaacgcacgaagcatgaaatcaaaacgtcgggcgagaggatggaagtaactcggctgtccgtgaattcaaaaccaggtctttctgcttcccgtcaaagccagatccggagtgccgtcaaccacctcgaacaagcttttctgcggggcgagattattgaatttggcaaggggccatacgcccaaactctgggccaggtccatcttctggcaagattccaccccggaaaagccgagaagttgaagcaaaggctgagggctctcaagaaaatggagcgcatgaacaaatgcccttga

SEQ ID NO: 10972 - RNA, 972 nt, unidentified
  source 1..972: mol_type = other RNA; note = synthetic construct
atgaagcataccctccctgacggcccattctacagtagaaggagaattcactccatggcaagcctcgccaaagccttaaacattcctgcttctgagctgatttcactggcttgccgcgcagatcgcatgtacagactggcaaacaacatccctaaggctgatggatccgtgaggcaaacttgggacgctcatgagcccttgaagaagatacacaggtctatacggcggaatatccttgaccacgtgacttatccctactatttgacggggtcactgaaaggatgcgactataaggtcaatgcctctctgcacgccggtgcaacaatcgttatcaacgaagacattacaggatttttcccaggtacctccgccgccgtagtccattgtatctggcggaatttcttctgctttggccaggatgtcgccgactgtctgacccgattaacaacaagacacggcgagctgcctcagggggccattaccagcagtttcctggcaaatcttgcgttctgggatgccgaatccgctctccatagcagttttaaggctcgcgggttaatctatagccgttacgtggatgacatcgccgtgtcctcagaaacatttctggataacagcaccaaaaccgaggtgatagctagcctctatggcatgctcttccgccatggataccgtccgaagcgcactaaacacgagattaggacgtctggggagagaatggatgttaccaagctttcagtgaattcgaaacccgggctatccacttcgcggcagagccagatccgatccgcggtaaatcacattgaacaagcgttcttgaggggagagatcacagtgtttgactctggcccatacgcacagactctaggccaggttcatctgctggctcgatttcaccccggtaaagcagaaaaattgaaacaacggctgctggccctcaagaagcttgcccagagtaacaagtgttcttga

SEQ ID NO: 10973 - RNA, 963 nt, unidentified
  source 1..963: mol_type = other RNA; note = synthetic construct
atgaaccccgtacttagtgacgcaccgttctaccgcagacgccgaattggctctgtggcctccctcgccaaagcgctgtccgttaaggaggatgaattattctcactggccgctcgggccgatcagatgtacagactcgcctcttctgtgcttaagcctgacgggtctgtccgccagacttgggatgctcgggagcctctgaagtctctccatcgaagtattagacggaatattcttgacctcgtcgcatggccctcgtatttgaccggcagccttaaaggttgcgactataaagttaatgcaagcctgcatgccggcgctaggatagtcatcagcgaggatatcagcggattctttccagctaccacagaggcaattgtgcggcacatatggcgcgggttctttggattcagtcaggatgtggcggattgcctcacaaggctaacgactagacatggagccttacctcagggggccatcacatccagctttctggctaacctggcgttctgggacgtcgagccagaactgcaggctggcttccgcgctagggggctaatctactcccgctatgttgacgacattgatgtgtcttcctatacatttttggacaatcacgcaaaagccgccatcatcgcagatatttacggcatgctgtttcgtaggggttatcagcccaaaagagccaagcacgaaatcactacctccggccagagaatggaagtgaccaaactctcagtgaacagccggccagggttgaccgctagtaagcaatcgcagatacgttcagccgtgtaccacgccgagcaggcattcttaaggggagagatcacttgttttgactcaggcatttacgccatcacgctgggacaagtaaacctgctggcacggtttcaccccggtaaggctgagaagctgctgcaacgaatgcgtgcgttgaggaataagagcgaagaatcctga

SEQ ID NO: 10974 - RNA, 969 nt, unidentified
  source 1..969: mol_type = other RNA; note = synthetic construct
atgaatccttctaccattctgcccagatacaaacgacagcggatagcatccttagacgcactgcaggcagctctcggcgttagcatcgagcagctccagtcactggcggaacacgctgacaacagctacagggtcgcgaagtctgttattaaaccagatggatccactcgccatacatacgatgccttcaaacccctcaaggatattcaccgtaaaatcaagaaccacattctcgatcatgtggcctatccttcctatctgactggcagtataaagggttgcgactataaagtgaacgctgagattcacacccaggctaagattgtcatctcggaggacataacggcgttctttccctcaactaccgccaaaaaagtatttaaaatctggcgtgacttctttggttttaactccgatgtggcaagatgtcttactcggctgaccacaaggaaaaatgaactgccacaaggcgcaatcacgtcttctttcttggccaatcttgtgttctggcagagtgagcctttcttatacgaacaattctctatgcggcatctcaagtactcccggtatgtggacgacatcgtcgttagcagcaagtccttcttggacgatgtagagaagacagaggtgatccgccaaatatacggcatgctgctgaccaatgggtaccacccaaagagagctaagcacgaaatttcaacaagtgcctcgcgaatggaagtcactaagcttgccgtgaatattaaaccgggactgaagaaggccaaaaaaagcatgatccgcgcagccgtccacagactggagacattgatcagcgaggggaaggaaatcagttttgagagcggcgattttgtggaggttatggggcaggtgcagcatatgaagaggtttcatcccggaaaggctgaagccttgattaagaggctaaacaccctaaagctgtcatatatcgtgcttcacaacaaatga

SEQ ID NO: 10975 - RNA, 987 nt, unidentified
  source 1..987: mol_type = other RNA; note = synthetic construct
atgcatttgtctaccatcaacgcgccttcctacaagaggaagaggatcgggactctagaagcattggcatacccactgggccttaacgctgccgctctggaagatctcgctcggagggcagacgcaatgtaccgactggccaaggagatagtaaaaccggatggttcagtacgccacacctatgatgctttcaaaccacttaaagttgtccatggtcggatcaagagggagattttagatcaggtggcatttccgctgtacttaactggcagcatcaagggacgggattacaaggtgaacgcgacactgcactcgcgggcgaaaattgtcataaatgaggacataagtgggtttttcccagcaacaacgagtcagcacgtcttcgacatttggcaccgcttttttggtttctccgaggccgtggcaagatgcctgacagacctcaccacttatcacggcgaactcccccaaggcgctatcacaagcccagctctcgctaatctggttttctggaggcgcgagccccagttacaggccgaatttgctgccaaaggatggacttatagcaggtacgtggacgatattgccgtgtcatccactattggcatggccccccatcaaaagacagaggccatcagaaaagtctacggactgctgagcgggtatggatataagcccaaacgaaataaacatgagattaccactgccgcccagcgcatggtggttaccaagctgtccatcaatgccaagcctggactggcccaatctgaacgtgaccgaattagagccgcggtgcacgaggtggagagactagtctcatctggcaacagcatctccacagacagtggggtgtatgccaaggcaatggggagagttaccacgctcgcccgtttccatcctggcgaagccgcaccactccggcagagactgcttcgggctaaacagacccttcagcctttgttgtctccttcaacccgcgctccctga

SEQ ID NO: 10976 - RNA, 999 nt, unidentified
  source 1..999: mol_type = other RNA; note = synthetic construct
atgtccctaagcacctcaagcaattcacccttctacaagggtactcctatacgacaacgtacctcacttgccgcagccctcgggtccactttgcaccgaatagagtacgtggcgccacgcgccaataaactgtatcgcctggcccacgcagaactgaaatccgatggcacgatcagacagacatttgacgccaaacctctattgaaggacctgcataggaggatcaagactgaaatcctggatcgcgtgacttttcctgattatctgactggaagtctgaaaggacgcgactacaagtctaacgcagaactgcacgaaggggccgcaatcgtaattgctgaggacatagagaacttctttccgaatacaacctcggataaggtgttcgacatctggaggcatttcttccggtttagtgagccagtcgctcagttactgacctctctgactaccaaggacggggccttaccccaaggggccatcacaagcccacagcttgctaacctcgttttttggcgggatgagccccttttgcaggctaagctggccgccgacgatattacctatagccggtttgtcgacgacgtgacagtctctagtgtggtgccaatccccgccgagaataagacggagctggtcggagctatttacggcctcttgagacgtaacggtcttcagcccaagagagtaaagcacgagctgaaaacaaggagagaacgcatggctgttaccaaactcacagtcaacgataaggcaggcctgtccgcaaaagagagatcacgaattagagccgcggtgcatcggttagagctcaagggcgcgcaacagcttctcgaggctggtgaactggccagcgtgctaggcaaggttcaccatatggctaggttccacccaggcgaggcaaggcccctcaaagctcggctgttgaaaattagcgcccatggatgtgcagctaccccgtctgaacagtccccactccctccttgcagtgaaccttga

SEQ ID NO: 10977 - RNA, 951 nt, unidentified
  source 1..951: mol_type = other RNA; note = synthetic construct
atgaacccctctccgtcggacagccctagttacaacggtaggcccatcagaagtattcagagcctagccaaggccgtgtactgtaagcctcagcggctggcttttgtgtccgagagagcatctgacttataccgggttgccaaggaagtgcccaaagcagatggaaccgttaggcgcacctacgatgccaaaaagttgctgaaggacattcacaggcttataaaaacagagatcctcgatcgagttgattttccaccttatctgacgggatccctgaaggggcaggactataaaagcaacgccgagatccacgtcggagctgctattgtcattgccgaagatattgggaatttcttcccatctactaccgcggagcgcgtgctagacatctggagaaacttcttcaggtttagtgcagaagtggcacaatgcttgactaatctgactacacggaataacgaactcccacagggcgcaattacctcaccccaactcgccaatctggtgttctggagaaatgagccacagctgcatgcacgctttaaagcggacggtgtcgactactcacgttttgtggatgacgtggttgcaagctctaagacacccatcacgccgaaaaagaagaccgagatcatagccgccatctatggcctgatgaagcgctccggctaccagccaaaaagacgaaagcatgaattgaaaacagctcgtgagcggatgacagtaactacccttaacgtcaacgacacagtggggatacctaaagaggaacgatcacggatccgcgccgctgtccacaggcttgaagggcttgtaacctccggtcggggcgaggtggatctgaagcatgagtatgcggtcgtagctggcaaggtgaataatctgggaaggttccaccctggcgaggctcgtactctcagagaaaggttagctgccctggatctctgctga

SEQ ID NO: 10978 - RNA, 948 nt, unidentified
  source 1..948: mol_type = other RNA; note = synthetic construct
atgaatcgcctgccaacgtcaagtcccttatactccggccaagcaatccgacgaatcgagagcctgggcaaggccttgcggttctccccacagcggttgggatatctcgggaacaacgccgataggttgtatcggatcgcccatgagatcgaaaagtctgatgggagtaaacgggtaactttcgatgccaagccggctttgaaggaagtgcaccgtcggatcaagagcgagattctggatagggtcaccttcccactgtacctgaccggcagcattaaaggcagagattacaaaacaaacgccgagcttcacgtaggagccgccctggttattacagaggacatcggaagcttctttcctagcaccaccactgcacacgtctttgacgtctggagaaactttttcagattctctgacgaagtcgcgaggttactgacagctctgactacaaggaatggtgagctgcctcagggagcaattacttcgccacatctggcaaatcttgttttttggagggatgaacccgcactccacgacagattcgccgctgacggtattgtgtactctagattcgtggacgatattgccgcttcttccaagaccccgatacctcccgaacacaaaaacgagatagtgcgtctcatatttggactcatgcttagaaggggctataagcctaagcgcgagaaacacgacctgaaaaccgcggggcaacagatgactgtgacgaagctaaccgtgaatcagcttcccggcttacccaaggctgagcgcggtcgaatccgcgctgctgtggaccatctcgagcgcctcgcatcaaggggccctctcagtgccgaacagtggcgtgaacatgcgtcagtttccgggagagtgacacatctggcccgctttcacccaggggaagctgcaggtctaaaagcccggcttaaaatgctgcacccctga

SEQ ID NO: 10979 - RNA, 963 nt, unidentified
  source 1..963: mol_type = other RNA; note = synthetic construct
atgaaccagtccaccactaactgtccttcatacgacgcaaagcccatccggctcatcactagcctggcgaaggccctggaaaccgacgaaaatcagctcctccttcttgcagacgaggctaatgagctctaccgtatagcaaaaaaaataagaaagcctgatgggtctttgcgcagaacctatgacgcattgccaaggctgaaagacattcagcggagaattaagtttcgtatcttggatagagtgacatttccatcgtatttaaccggttcccttaagggcagggattacaaagttaacgccgccctgcattctggtgctaaaatccttatcgccgaggatattggatcatttttccccagcacatcagcttccagggtgtttgacatctggaagaacttcttcgggttcggccacgaggtggcttgctgcctgactaagctgacgaccttacggaatgaactaccccaaggagcaataacaagtgcgcaccttgccaatctcgttttctggcgagaggagccgcagttgcggactcgtctggatcagtctggcattgtctatagtcgcttcgtcgatgatgtagctgtaagcagcagatctgtgatagaaccagctcaaaaaacagaggtggtgacatccatctacggaatgatgatccggcatggatatcgccccaaacgaaccaaacacgaactgcacacagccagaaaccgaatggtcgttacgaagttgaccgtcaacgctaagcctgggctggaaaagactgaaaggagtaagatcagggccatggtgcatgagttagagcgcctctccgaaagcctggacaatactcaagcgattctggaccgcctcaactcagtggccggcaagatcaatatgctgggccggtttcaccctgggaaggcccagagcctgaaaaagaggctgctagaggtcaaacagattattgcagcccgctga

SEQ ID NO: 10980 - RNA, 912 nt, unidentified
  source 1..912: mol_type = other RNA; note = synthetic construct
atgctctccctggctcataaagccaacacaatgtacaggattgctaaggaggtggagaaaggcgacggtaccgttaggcgcacctttgacgcccaccgcccactcaaagatatccaccgtaggatcaagctggaaattctggataaggtggtgtttccagactatctgacgggctctatcaaggggagagactataaggttaatgccgcattacacgccggtgctaaaatagtgatttcagaagacatcggggctttcttccctagtactacagatgcaatagtctttgacatctggcatgggttttttggcttcagtcacgatgtggccacctgtttgacacggctcactacttataatggcgagctgccacaaggagcgattacctcccctcagctagccaaccttgtcttctggcgttctgaaccagtcatgtaccagcgcatggcggatatggggctgaaatacagccgatttgtagacgacattgcagtttcgtcccggctggtgatcgcccccgaagcaaagaccgtgatcattagtctgatctacggaatgatgttcagacagggctataggcctaagaggagcaagcatgacataagcacatctaaggatcggatgacggtgacaaaactcactgtgaatcacaaacctggccttgcctccagccagcgatctcaaataagagccgctgtccacgctctggagtgcaacttggctgttaaacagaccgccgatgtagcagcgaagttgccctcagtgattggaaaggtcatcatgcttcgccggttccatcccggagaggggctgagactaaaacaacggttagcagcaatccaggcttcccagtcaccgcagagagaatgcaaggccgagctccagttcggtcccttagccggaagcctgtga

SEQ ID NO: 10981 - RNA, 1041 nt, unidentified
  source 1..1041: mol_type = other RNA; note = synthetic construct
atgattcacgtcaaccggctcgaagttccacgctatactgccaccccaattgaaagcatggcagccctatccagggccttgggcgttaccaaccagcacctggcggccgtagctgctaaggcaagctcgctgtatcgggtggcggataagattgaaaaggcagacggaacattacgcgaaacatttgacgctaaacccgtcctgaaagatatccaccgcagaattaaactcgccatcctggaccgagtgtcctttccaaattacttgaccgggagtgtgaaaggacaagactacaggactaacgctcttctgcatagaaattccaaaatcctgataagcgaggatatccaggggttcttcccctccacaacccagcatctcgtccaggagatttggtcccagttcttcggcttctcagccgatgtggcgcagtgtctaacggctctctgcacgaaagacggtgcccttcctcagggcgctataacatctcctcacattgccaacctggtgttctggagggttgagccggccattagagcagagatggcttttagaggcttgcggtattcacgatatgtggatgacgtttgcgtgtcttctagcaccggcattgcccatgcagataagcagtctgtaatctccgtgatctacgctatgctggctcggcatggctactccgctaagcgttcgaagcacaagatccagacagccagtgggaggatcactgccactaagctcggtgtcaatggtgatccctctttaagcggacagcaacgcgggcagatacgagcggcggtgcacaagctggagctgacctttgctgccggggcattttctgacgcacgtgccttgctgcctagcgtgaccggaagggtcagtatgctcgcacgctttcacagcactgagggacaagcccttaagcagagaatcgcctcagtaagggaacaactgttacttgtccccatggttaccagagccgatgacgcaacacataaagcaatccgggattcagtggacgacataagtactgtgccttggtga

SEQ ID NO: 10982 - RNA, 1035 nt, unidentified
  source 1..1035: mol_type = other RNA; note = synthetic construct
atgatcctgatgaaccagatagaagtaccccggtataccgccgcacccattgaatctatggctgccctctcccgagccttaggggtcacatctgcacatctactcgccgtagcagcacgggccagcagtctttatagagtggcagagaaagtggagaaagccgacgggacttttcgcgagactttcgacgccaaacctgtcctaaaggacattcatcggcggatcaaaagtagcatcctggaccgggtggcattcccgagatacctgactggttccattaagggccaggattaccgcacgaacgcgctgctgcaccggaatagcaagattctgattagcgaggatatacaaggattcttcccctctacaggccagtgcctggtttacgaggtgtggtcacaattctttggcttttcggatgacgtttcaagatgtctgacctccctttgcgtgaaggatggcgtgttgccccaggggggaatcacaagcgcccatctggccaaccttgtgttttggcgcgtcgaaccagcagtgagggctgaactggcacgtttcggaattcgctatagcaggtatgtggatgatatctgtctctcatcccctgatgctatcggacacgaggacaagaagaaagtgatagcgctcgtctacgctatgctggctcgtcatgggtactccgccaagaggagtaaacacaatgttcaaacctcccgaggcaggattgtcgcgaccaaactcggtgttaatcgcgaaccaagcctctctagacagcagaggggacagatccgagccgcggttcacaagttagagagtttgtttgccgacggagatcttgacggcgtcagggaacgtttgccatccgcaggcggtagagtgagtatgttagggaggtttcacgctgccgagggggctgctctggctaagagactggcctctatcagacgcgcccttgacctcctgcctgtcatcagcaagacctcggctgtgatgtcacaggtgtcacactctgatttggacggcacagtaccttggtga

SEQ ID NO: 10983 - RNA, 1026 nt, unidentified
  source 1..1026: mol_type = other RNA; note = synthetic construct
atggatctgtttttaatcaagccaagataccgggcttccccgatcaggagtatcgcagcactggcacgatctctccgctgggatgctctcgctctagtggatatggcggagcgcgctaatgggatgtggcggacagtgaaacctaaacccgggtctatccggcagaccttcgacgcgatgggaccactgaaggagattcaccagagcctgaagctaaatatctttagtaaggtggactttcctgagtatctccagggctctcttaaaggccgcgactacgtttccaacgcctcactccacaaagacaagcaaattttgatatgtgaagacgtcaagggcttttttccgagcgttggggcagcctatgtggaggacgtatggtgcggctttttcggcttcgccccagacgtagcgaagcttcttacgaaactgacgactaaggacgggtgcctgccccagggatgtattgccagctctttcctggctaacttggtgctgtggcgacatgaacctctgctgcacgctaaactagcccagcgtggtataacctactccaggtacgttgatgatatggttatgagtgccgccacacatctggataaggcaacccagacatgggtcatagcgcaagtctatgggatgctcgcccggcacaatctcaaggctagccgtaagaaacatgaagtcttcagcgccacacaacccatgattgcaactaaactgatcgtgaaccgcaaacccagtttgagccttaagaagcggtcacaggtcagagctcaagtgagacaactggaaattgcagtgggaaccggtctggatgccgaagagcttagagacttagccaataaagccgcccagcaggtgggccagttaggtaggttccataaaacccaggccgagcacctcaggaacagaatcgctatcgtgaggggaaccttgcctattgagcacccatcaatcattactgctccctccaacgcacctctctcgcaggagttgtccactggatccctgtcttcaaagtga

SEQ ID NO: 10984 - RNA, 1029 nt, unidentified
  source 1..1029: mol_type = other RNA; note = synthetic construct
atggacttatttctgatcaaacctcggtatagggctagcccaatcaggagcatcgccgccttagccaggggacttaggtgggatgctaaggctctggtcgaactggcggagcgggctaacggtatgtggcggactgtcaaaccaaagccggggtctacccgccagacatttgatgccatggggcctttgaaagagattcataaaagactgaagctcaacatcttccccaaggtggattttccagaataccttcaagggagtctaaagggacgtgactacgtaaccaacgccagcttgcacaaagacaagcagattctcatttgtgaggatgttaaaggcttctttcccagtgtgtccgcggcctatgtggaggacgtgtggtgctcatttttcggattcgcaccggaggtggccaaactgctgactcagttgacgaccaaagacggctcctttcctcagggctctattgcaagctctttcctggcaaacctagtcatgtggcggtatgaaccgctcctccacgcaaagctcgcacagcgaggcataacctattcaagatacgttgacgatatggttatgtccgctgcaactcacctggataaggaaacacaaacatgggtcatagcccaggtgtacgggatgctggctcagcacggtctgagagctagccgtaagaagcatgaggtgttctcggcttcaaagcccatgatagccacgaagctgattgtaaatagaaaaccttccctctcccctaaaaagcgcagtcaagtgcggacacaggttaggcaattggagatcgcggccgcagacggagtgaatgctgaggagctttgggacctggccaataaggccgcacagcgagtcggacaattaggcagattccataaaacccccgcagcctctctcaagaaccgcattgccatcgtgcgcggtagtctgccccccgaaaatcagcccgcgatcaccgggcagactatcgctccactttaccaggaacaccctccaacaggcactgccccatgggaatga

SEQ ID NO: 10985 - RNA, 1029 nt, unidentified
  source 1..1029: mol_type = other RNA; note = synthetic construct
atggatctgtatcccatcaagcctaggtacagatccaaccctgtgaaaagcatcgctgccttagcgagaggcctgaggtgggatgctcaatctctcgtagagctcgcagaccgagcaaatgggatgtggcgtaccgttaaacccaaacccgggtcaacccgccagacttttgatgcgatgggacagttgaaagaaatacatcagcggcttaagctgaacgtcttctccaaggtggactttcccgagtatctgcaaggtagcttgaagggtagagattacgtcactaatgcgtccatccataagggtaagcagattctgatttgtgaggacgtgaaaggcttttttccatctgtcagtgcagccttcgtagaagatgtgtggtgcggattctttcgtttcagtccggatgtggctaaactgctcacaaggctcaccaccaaggacggatatctacctcagggcgctattaccagcagcttcttagctaacttggtcatgtggcgctacgaaccctggctccacgccaagtttgcccaacgcggcataacttattcccgctacgttgacgacatggcaatgagctcggccacacatcttgacaaggagacacaaacatggatcatcgctcaggtctacgggatgcttgctcagcacggcctgaaggcgtctagaaagaagcacgaggtgttctcagcttcacagccgatgatcgcaactaagctgactgtaaatcgaaaaccatctctgagtccaaaaaagcagtctaaggtgaggactcgagtgcggcaactggagattgccgccacatccggagcaagcaccgatgaacttagggagctggccaacaaagcagcccagcaggtcggccagctagggagattccacaaaacgcccgcagccaaactgaagtcccgcattgccgttgtgcgggacaatctgtcaccagaggccttgagtgttaccacggctccagccaaagtgcggctagacaccgtgcctctcgtgacagatgcccggccttgggaatga

SEQ ID NO: 10986 - RNA, 1023 nt, unidentified
  source 1..1023: mol_type = other RNA; note = synthetic construct
atgtcgctgtgcctcagtaaaccatcttatcaagctaaacctattcggagtattgccgccttagctcgggctcttaggtggggagaacaggcgctggtgcagcttgccgaccggtcagagtctatgtggagaacagttaagccacagcctgggtctacccgccagacattcgacgcaatgggtcagcttaaagagctgcacactaggctgaagttgcacatcttctcaaaggtggtctttccagactacctgcaaggaagtctggcaggacgcgattacgtgacgaatgcctccctgcacgcaaagaagaaaatccttatatgtgaggacgtcaagagattctttccttccgtcggcgccatttacatcgaacaggtgtggcgggattgcttaggcttcgcccccgatgtggctcgcttgctgaccaagctcactacaaagggcgggtatctgcctcaaggagccatcacgtcttcattcctagccaacttggtgctttggcgtcacgaacccctgctccacgctaaattaaaacagcgggggataagctactccaggtacgtggacgacatggcactcagcagcgcaagccacctggacaaggacacacagacatgggcaattgcgcaggtttatgggatgctagccaggcatgacctgaaagcctccagagacaagcacgatgtttttgcagctagcagacccatgatcgccaccaaactgatcgtgaaccatagtccctccctcggcgcgaaaaaacgctcacaggttcgagctcaggtcctccagttggaaatggccgccgcgagcgtggtggatgctgatcagattaggggcttggccaacaaggccgctcaacgtgtcggtcaactgggccgatttcataagaccgcagcagctcacctaaagtcccgcatcgccaccgtaagagatactctgactgcggattctagggtagcaataaccggggagcgagccgctcattgggagcatctcgagggtgaaaatccgtggagctattga

SEQ ID NO: 10987 - RNA, 1011 nt, unidentified
  source 1..1011: mol_type = other RNA; note = synthetic construct
atgagcctctcactgagcaagcccatttacaaggccaaaccaattcgcagtttggcgtctctagccaaagctctcggtctggacgaaaaacgattgaaagaactggctctgaaagccgacacactctggagggcagtgaagcctgagcccggctccaccagacagacattcgacgcctatgaacccctgaaaagagtccacgaacggatcaagcgtagtatctttagcaaggtgtctttcccagcttatctacacgggtctttgaaggggtgtgattacgtgacaaacgcagcacttcataagggccaacaaatactgatttgcgaggatgtgaaatctttttttcctagcgttcagtccgtctacgtacgcgacgtgtgggcaggactcttcggtttctcgtccgaggtcgccgacatcctgacagccctgaccactaaagatggagctcttccacagggcgggatcacaagctcctatttggccaatttggtgctgtggcgcaaggagcctttactgcaagctaaacttgcagcccgtggcattacctactctcgctacgttgacgatatgagcatgtcttctaagactctgctggataaagaaacccagtcgtgggtcatcgcccaggtttatggcatgctggcatttcatgggctgaaggcatccagaaagaagcacgatgttttcagcgcgagcaaaccaatgatagccaccaaattgatcgtgaatcagaagcccgccctaccgaaggcaaaaagatcaaacatccgggcccaggtaaaacaactggagttagcgtcacagagttcaattcctctcgaggaactcaagatattagctaataaggctagtcagagggtcggactcctcggtaggttccacgaaacggaggccaacgccctgcgacttcggattaaggcggtgagggcttcctttacgtcaactgaggaagtgcgggtgaccggcgctaagcttgaggacggacatgagtccagtactatctcctga

SEQ ID NO: 10988 - RNA, 990 nt, unidentified
  source 1..990: mol_type = other RNA; note = synthetic construct
atgtctcttgctgctctggcacgggctttgcggctgtccgttggcgagctccatgcattggctgagagagcagatcagtcctaccggaccgtcaagcccgagccagggtcaacgagacagacctttgatgctctaggccagctgaaaacagtccatcgacgtattaaggaagtggtattcgtgaatgtgtattttccggagtatctgcaaggaagtctgaaaggcagggattacgtgaccaatgctctcctgcatactaataaacagctcttggtttgtgaggacgtaaaaaaatttttcccctctgtaaccgccgctttagttgaggatgtatggcacgggttcttcagatttgccccagaagtcgccaagctgctgactcgcctgacaactaagagcgggcacctccctcagggagccatcaccagttcttatatagcaaaccttgttatgtggcgccacgagcctctgctccaggcaaagtttgctgcccgaggaatcacatattctcggtacgtggacgatatggccatgtcctggtcttgccatgtggataaggagacgcaaacttgggtcatagctcaggtgtacgggatgttagcccaacacggcttgaaggccggtcgtgccaaacatgaggtcttctccgccagtgaaccaatgatcgcaacaaagctcattgtgaaccgcaaaccgagcctttcagcgaagaagcggtcacaagtgaggtcccaggtctaccagttagaacgagcggaagaagacggcaccgagactatgtcggtcgacgccctggctattaaagccagccagagggtgggtcagctgggaagattccacgttacccaggccgcacacctgagggagagggtgaaggcggtgcgcagcagacttagtgtggaagcaaacgccgccatcagcatgcccactgaaacccccacaacaccaagccccgaagacctatcagacgcacctgcgccttgggagtga

SEQ ID NO: 10989 - RNA, 1029 nt, unidentified
  source 1..1029: mol_type = other RNA; note = synthetic construct
atggccctgtacctgagtaagccttcttatcggtgcaaacccgttcggagcatcgcagcattagcacgcgccctcaatttcgaagagcaggctctgagggtggtcgcggaaaatgctgatcagcgttacagaactgtggcgccaccacctggttcctctagacagactttcgacgctctgggccaattgaaggagattcatcgccggatcaaaacaaccttctttgacagggtgaaattccctgactatctgcacggatcactcaagggctgcgactatgtgacaaatgcacagctacacactaagaagcagctgctgatctgtgaggatgtcaagaaatttttcccaagtgtgacctcagagaaagtggaagatgtctggtgtgctttcttcggattcgcaccagaagtcgcccaccttcttgctagcctcacaactaagcagggcgccttaccccaaggagcagtcactagcagctacttggcgaacttggtcctgtggcgggatgaaccccttctgcatgctaagctggccgcacgcgggataacctattctagatacgttgatgacattgccatgtcatttagcatcaggccctccaaagagacacaaacgtgggtgatcgcccaggtgtacggcatgctgcgcaagaacggtctgacggccggtcgatctaagcatgagatttttagtgcctccgagcctatgatcgctaccaagctgattgtgaacagtaagccctcactgtcacagaaaaaacgaagccaggttcgagctcaggtgagacaactcgagatggcccagtcctccggcctagactctgagatggtaagggtactcgcggaacaggccgcccagaaagtaggccagctcgggaggtttcaccctacacaagccgctagacttaaaggaagggtgaaggcagtgcggcttgggttaccaatagagtccttttcgtcccgcgttaccaacagcaccggggttagtaatccgagcccctctgaagatctccgtttgccgtgggaatga

SEQ ID NO: 10990 - RNA, 1038 nt, unidentified
  source 1..1038: mol_type = other RNA; note = synthetic construct
atgagcttgactccccacaaggctacttacagcaaggaaccgctgcggaccgttaagagtctgtgtgcgatgctacgacttgaggagcaagccttgcgagatctggcggctcatgctccagccctctatcggagggttaaacctaagcctgggtctaaaagagaaacttttgatgctctcccccgcctcaaagtcatccataaacgcatcaagactcaggtgctagaaagggttcgatttcccagctaccttaccggatccgtgaaggggagagactacaaggagaacgccgcaaaacacgccggccagcgtgtggtgatttgcgaagacgtgaaaggcttttttccctctgtgacagccgagatggtatgcgacatctggcagggaattttcggatgtagttctgacgtggcgcagctgctgacacagctgacaaccaaggacggtgctctgcctcaaggggctattccctccagttatcttgccaacctggtcctgtggcggacggagcctttggtccacgccaagttggacgcacagggcattacgtattcccggtatgtagacgatatcacaatgagctcaccgcggaggctgtccgtcgctcagaagcaggcagccatagggatggtgtacggcatgctgtcagaggccggactgcgtgcaggacgcgaaaagcacgatgtattcaatggctcgaaaccaatgatcgtgaccaagttagtggtgaatgagaaaccatctctcaccaagaaaaaaaggtcagccgtgagagccgccgtttttcagttccagcaaaccttggccctgggcgaacctactgcagataccgttataacactcaacaagttagctcagagagtcggtcaacttgggaggttccatccgcgcgaggcagcagtcctcaaattaaggctccaggccacgcgcgcgttcatcgataaggcccagccccaaaccctcactaccggcctgcttcccgacgcaagactgacaacaccaccagagggtgctccagctccttgggatgacctatga

SEQ ID NO: 10991 - RNA, 1020 nt, unidentified
  source 1..1020: mol_type = other RNA; note = synthetic construct
atgagccttttcttgaggaagcctagctatccttgcaagccgattaatagcctccgctcactggctgcagctttgcgcgttaccgaggatgagctgctgtctgtggcgaacattgcggacacactgtaccgcaaggtcaagctaaagcccggcagcgatcggcagacattcgatgcgacgcccaggttgaaaagactgcacgcaaggattaagtcagtgatcctcgccaaggtcatcttcccagactatcttacaggctccctgaaagggagagactacaagaccaacgccagtctgcatatcaataaatccgttctgatcacagaagacgtcaagggctttttcggctctgtctctgacgtgcgagtgaatgatgtgtggagacactttttccgcttcgacgcttccgtcgctgaaaccctgactctccttacaaccaggcgaggcgctctaccacagggggcaatatcttcaagctatttggccaacctagcaatgtggtcagatgagccgcttctgcacgccaaactggctgcccggggaattatttattccagatacgtggacgatatgtgtatgtctagcaatactccactcagtatagcagaaaaaacccggactatcgaggacgtatacggaatgctgatgaaaaacggtttgtcggcccgtcgtgataaacatgatatcactcccgccacgggaagaatgctcgttactaagctcgtggtgaaccgaaaaccggcactcccaccagagcaaaggtcccgtatcagagccatggtatttcaagccgaacagatggcacgcaatgaggctgaccccaagctgagtatagccgccctgaataaggccgccaacaaggttggccagctcggacggtttcattgcaacttatccaaacctcttaaagctcggctggctctggccagggctcccttaccacaccctttagcggaaccccggtttaccgggcctgacaccggtagtacaggggatgcacctggagtgccctgggagtga

SEQ ID NO: 10992 - RNA, 1008 nt, unidentified
  source 1..1008: mol_type = other RNA; note = synthetic construct
atgagtctgaacctgcggaagcccacgtacccttttcgccccattggctcactggcagccctcgctaacacactgaaagtgagcgagtccgagctagtgcacatcgccaagaatgccggctcactttatagggccgtccagctgaaacccggcagcaccaggcaggtgttcgatgctaagcccccgctcaagccaatccatagccggatcaaagaatttatcctttccgaggtccactttccctcctacctcaccggctctctgaagggacgagattacaaggctaatgctgaaatccatgcaggtcaagcagtggtgatatgcgaggacgtaaaggggttctttaattccgtgagtgagacatgtgtgttcgacatctggagacatttcttcctctttggtacagccgtgtcacaagtccttacgtcactgaccactaaagacggagctctggtacagggagccattcccagtagctatttagccaatctggcactgtggcgagatgaagccctgttgcacgcgaagcttgaggcccagggtatccggtatagtcgatatgttgacgatattgtgatgtcgagctccactcccctagagccatctcgcaagaccgagctgattgcgtctgtctacggaatgctgaggcggaacgggttgtccgccaggagagacaagcacgaaattgctccggccaccaaacagatggttactaccaaactcgtagtcaacagaagagcagccttacctcctgctcgtcgcgcaaacgctcgcactgcagtgttccaggccgaaatgctcgtcgctaatcacggggtggaggcagcccaggcggttatagcaaaagccgctgggagggttggccagctggcaagatttcatcctaacttggctgcccctctccaagaacgcttagcccggttgaggaaacaggcggcgactcgtaaatctcttccaacaatggagcctagcgaaacaccgaccccaccaccagaaaaggattcttga

SEQ ID NO: 10993 - RNA, 1059 nt, unidentified
  source 1..1059: mol_type = other RNA; note = synthetic construct
atgtccctcattctgaataaaccgtcttatccctttaatcctatttggacaaacgagaaacttgctaaggctcttcgcactgaactggccgagctagaagcgatcgccatcgtcgctgacaggagctataggcctgtgcggatggatccaggcagcacaagagaggtcttttccgccaagccccggctgaaggccattcagcgccgaattaaggaggctatcctgcaacgggtgaggttcccagagtacttgaccgggagtgtgaaggggagggattacgtgaccaacgcaaaactccacactggtgccagaatattaatttgtgaagacgtgagcaagtttttcccttccgtttcagcagaacgcgtttgggacatctggaggcacttctttggatttggcgatgatgtcgctcaccttctgaccaagctgacaacgaaagctggcacactgcctcagggggcaggtacgtcatcttatttagctaacttggtgttgtggagagacgagccctacctgcaggcaaaactcgccaaacacggactcacatatagtagatacgtggacgacatggccatgtcaagcaaactcgatatcaccccggtggaacaggagagaatcatcgccgacgtgtacggcatgctgcgacggaatggcctttccgctaagcggaagaagcatgagatattcagcagttcccagcgtatgattgttaccaaggtaattgtaaacactaagccatcttggtctaaagctcgccgatctgccgtgcgaacccaggtgcatgaactggagaaaagagtggttgccgaggacgtcggtgcggaattgcataagttcgcagatcgcaccagcaacctggttgggcaactcggccgtttccacgtacgggaggcaggattactgagggcccgggtaaggaaggcacgcgaggtcatgaatcgcgccaccaggatacattttactatctccccaactacaggagcccaccagagttcgagactagtggatgtccccccctgggaaatgaaatgcagacgtgcggtcaaaagctcatga

SEQ ID NO: 10994 - RNA, 1026 nt, unidentified
  source 1..1026: mol_type = other RNA; note = synthetic construct
atgtccctgatcttgagcaagccgatttacccatgcgacccagtttggaccctggaaaagttaggcgaagcactgcgtatagaccttgctgagctacaggcagttgccgccgtcgctaaccgctcttacactaaaaagttggtgaaaaaagaccgggaggtgttttctgcccggcctcgcctgaagctgattcaaaacagaatcaagatggcgtttctccacagggtgatatttcccgagtaccttaccggatctcttaggggttgcgactatgtaactaatgccaagattcacaccaatgctaggattttgatctgtgaggatgtccagcagtttttccccagcgtaggtagcgagaaagtgaaggatatctggttgaactttttcgggttttctgagggcgtggcggaactgctcacaaaactgacaactaaagctggggccgtgccccaaggggcatcaactagctcatatctggccaatcttgtgttatggcgaacggagccactcctgcaagccaagctcgctgaccatggcattacgtattccaggtatgtggatgacatgagtataagtagcgaattccagctcgagcccgccgagctagaacggatcatcgcggacgtatacggcatgctgaggaagaatggactcagtgccaaaagaaaaaagcatgagattttccgtgagtcacagcgaatggtcgtgacaaaggtcatcgttaacaagaaagcatccctgtccaaggacagacgatccgcaattagaacccaggttcacgtcctggagagccggatagctgctggtgaaaactcaatcgaattgtcgaaattcctggaccagaccagtcacaaggtgggccagcttggcaggttccacaaaaatgattaccgcgatttactgcctcgcgtgcgcgctgccagagaagcactgagaatcaaccctccgcccttcattacaggagataatgatcggtggccagaagccgcccctcctcatgcaccatgggagctcggagggatctga

SEQ ID NO: 10995 - RNA, 1047 nt, unidentified
  source 1..1047: mol_type = other RNA; note = synthetic construct
atgtctcagctgcaacctcccccgcgatataggcacaatccaatccactcagtggctgcccttagcagggtgctggggtattctgtggagactttgaagcatgtggcaggaacttcaagctcccggtaccgccttgccaaacctatcctcaaagaagacggtagcttccgcagaccctttgatgccctgtaccctctgaaggacatacagatcaggatcaaacaacgaattctcacagcggtaatcttcccagcatatctgaccggaagcctgaaggggcaagaccaggtccggaatgctaagttgcatcagggcgcctcaataactgtttgcgaagatattaagtccttttttccctctaccacctcggaggtgattttcgacatttggcgaggtttctttggtttttccgaggatgttagtaacctgctcactctgctgacgaccaaggacgatctgttaccgcagggggctgtgacatcttcccaccttgcgaatctcgtgttttggcgccgtgagcatgcactctatctcgggctggcttcgcagggggttcggtacagccggtacgtggacgatattaccctaagcagccgactccccgtcacccatgacgacctcgcacggcacatttcccttgtctacgggatgatcagatctactggtcacagggcccacaggggaaaacaggagatccagagagcccacaggggaatgcgtgccacgaaactgttggtgaataggcgcgcggctttgggcacagctgaaagacaagccacccgcgccgcagtcttcgcactggaaaggagtttcgcagtcacaggcggagtattgtgtccagccctgatcaaggagttaaacagtgtgagtggccgtgtgtcccgcttagcccggcttcatgctaacgagggccaggcgctacgggctagactgacaaaattaagaaacgaagtcggcaagtctcacagagtaagaaacgatttctcacaggttgaggtgataggcgttgaaccagcccctcccgaaacaggcgagggaatgcagtga

SEQ ID NO: 10996 - RNA, 966 nt, unidentified
  source 1..966: mol_type = other RNA; note = synthetic construct
atgtctcagctgcaaccaccgccacagtacagccacaaaccaattcattctattgcagcgctgagccgggtcctgggttattcaatcgacacactgagtcacgtagcagaggtttcaagcagtagatatcggctggctaagcccgtggtgaaggcggatgggtcaacccggcagcccttcgatgctttgttccctctgaagaatatacagatccgcatcaagcagaggatcctaacagctgtttcctttcctgcttacttgactggcagcttgaaaggccaagatcaggttcggaatgcctctttgcatcagggtgcatctataaccgtgtgtgaagacatcaagagttttttccccaacacgacttccgagatcattttcgacatttggcgaggctttttcggtttttccgagaacgtatcgaacatcctcaccctcctgaccaccaaagacggggtcctgcctcagggcgctgttacaagctcgcaccttgccaatctggtgttttggcgccaggagcacagtctctacgtgcgtctcgcctccgagggggtcagctacagtaggtacgtcgatgacatcacgcttagctcactgcttcccttgaattcaaacgaactcgcccggcatatttcactggtgtatggaatgattcgctctactggacatcacgcccacagaggcaagcaagagatccagcgtgcacacagggggatgcgcgcaactaaactgttagtgaatagaaggcctgccctttctaccgctgaacgccacgcaattagggctgcagtctattccctggaacggtccttagccgccgccgaaggagtgctttgctcctctctagcgaaagagcttaacagcgcttccggacgtgtggccagattaacacgcctccataggagcgaaggcctggccctgcgagagagactcctccgaataagaaaccaactggataatagttga

SEQ ID NO: 10997 - RNA, 984 nt, unidentified
  source 1..984: mol_type = other RNA; note = synthetic construct
atgacacaaccaccccccaggtatccactgcgcgcaatagtgcgtttagataaactcgcactggttctgggcgtttcgcttgacctgctgctcgcggtgagtaaggacgcttcaagtcgttataggctggcgaaacttatcgtgaaacctgatgggtctaccaggcagccactggatgcgaaggtacctctgaaaggaatacagaggcgcattaaggaacggattttggagaaagtagtttttccggactacctcactggtagcctcaagggcagggatgctagagcaaatgcacgcctccacgtcggagctagcattgtcctcagcgaagatattgccaattttttcccttctaccaaggacacacttgtgttcaagatttggaggcaatttttcggtttcgccccagatgtggctgagatcctgacatcccttactacgaaggatggggagctaccccagggtgcttgcacctcaagctacttagccaatctggccttttggagagaggaacatcgcctgtatgaggtgtttcgggctcaagggatagcttatagtcggtacgtggacgacgtctccgtgtcctccaaacggcgcttgagcaacgaagagctttcagcttgcatcaaaaacgtttacggcatgatgggaagatctggattcagaccccggcgtaaaaaacaagagatccagagggccaactcccctatgctggtcaccaagttgttggccaaccgaagaccggccatctctgtgaaggaacgacaggcaattagagccagcctgtaccagctcgagcagagtgtggccgccaaggcaggtgacgacttgagctctaagctggagtcaatcgccggcagagtcaatcgcctatgtcagatgcaccctgtggaaggcgagcgactgaaggtgcgggtacgggtcttacgagggcagatcggcatgggcgcatccgaagtttgtggacccgtcactgggcagtga

SEQ ID NO: 10998 - RNA, 957 nt, unidentified
  source 1..957: mol_type = other RNA; note = synthetic construct
atgtccagggttcctccgcctagttatccccacggctcaatccagtcactggccgcactgtccaggacactaggggtccccgcggataagcttctgcagatcgccaaggacgccgacaatagctatcggcttgccaagccaattgtcaaggcggatggatctgtaagacgccctgttgacgcaagggtcaagttaaagggcgtccaagtgcggattaaagaacggatattagaccaggtgaggttccccgattacctcaccggttctctgaagggaaaagatgctgtggcaaacgctagactacacgtaggcgctagcgtcgtggtgtgcgaggacgtagccggctttttcccagctacctcctcaccggctgtgcttggcatctggcgcggtttttttgggttcagcacggaggtaagcgagctgctcacgcagctgacaaccctgaatggcgcactcccagagggagccgtgacatctagtcatcttgccaacctggctttctggcgggaagagcacgcactctacgaggagctgcaccgcgaagggatcagatattcccgctacgtggacgatgtttctgtttctagtgttaaccaactgtccagacaggaattagctgcatgtatcagccgggtgtataccatgatggggcgcaatggttaccgtcctaaacgggctaaacaacagatacagtgggcgaatgggccagtgttggtgactaaattgcagaccaacactagggtggccctgactaaaaaggaaagacacgccattcgaggggccgtgcatggtttggaaagaatggcgcttgccggcccctcagatgagctcctgcgacgactgtccagcgtgagtggacaagtcgctaggctgcgtagactccatcccaacgagggacagatgctcaagtcgcgtctagacgccttgaggcgcctgttgacagcagccgtctga

SEQ ID NO: 10999 - RNA, 1020 nt, unidentified
  source 1..1020: mol_type = other RNA; note = synthetic construct
atgaaccacaccgccgctcagcctaagtatacctcgtcccctgtcagatcgctcgccgccttatctcgttccctaggcctgagcgtggccgagctccagagaattggcgacgccgcttctagcctttaccgggacgccaagccaatcatcaaagtggatggatcaatccggagaacattcgacgcctttccagtgttaaagaacatccatcgaagactccaaacgcagttcttccagcgcgtggtcttccccgattacctgaccggatccttgaagggtcgcgatgcccggcgaaatgcagccctccacacaggcgcagccatcgtggttactgaggacataaagaatttctttcccagtaccgatgctaaagtagtgtatagtatttgggccaatttttttcggttcgctcctgaggtagcacggcttctgaccgctctgacagtcaaagacggggcattgccgcaaggggcaatcacttctagttacctggcaaaccttgcgttttgggatcgagaatggaggctgtacgaaaacctgcgcgataagggaatttcttactctaggtatgtggacgatgtcaccttctccagcaaagaaaaactgtcaaatgagcggattggctgctgcatagctggagtgtacggcttaatggctgccaagggactaaaggcgaagcgctccaaacatgagattcgcagggggaacggtagaatgctcacgactaagcttatggtaaacacacgtccagcgctgatgacaagggaacggcaaaatatacgtgctgccgtgcatcaactggaggttctgagccgctggaattcaaccgactccgtgagctttaaaagtgagttcagcagagtttctggcagggtcgggaggctctcacagcttcaccccatggaaggcgccgctttgagggcacgattggctactctcagggccggtctgtatgcgaaccagcagttgggtagacagctgagccagtttgcaggggtgactctggactgtgttatctga

SEQ ID NO: 11000 - RNA, 963 nt, unidentified
  source 1..963: mol_type = other RNA; note = synthetic construct
atgaacccaaaggcggcacaacccaaatataccttcagtcccgtccgatcactcgctagcctttcacgctccttaggagtgagtgttgtggacttgcagcgtatcggagatacagcggggggcctgtatcgggatggtaagccaattattaaggcagatgggtctattcgaagaacattcgacgcattacctttgctgaagtctgtccaccggcgcatccaggctaggttctttcagagagtggtgttccctgattatattacaggctctctgaagggtagggatgctcgcagaaatgccgtcctgcacgctggggctgccatcgttgtgaccgaggacatcaagaacttctttccctccacggatgccaaggtagtctacagcatctgggtgtcattctttcggtttgccccagaggtggcccagcttctcactatgctaactattaaagatggagcattaccgcagggcgcgataaccagctcctacctggccaatctagcattctgggaccgcgaatggcgcttgtacgaaaacctgagagacagaggcatatcttactcaagatatgtggacgacgtgacctgcagtagtaaggagcaactgaacaacgagaaaatcggaagctgtatcgccgaagtatacggcctgatggcctcgaaaggctttcaggccaagcgatccaaacacgaaatacgtcgtgggaatggccctatgctgaccacgaagctgatgattaacgctaggcccgctctcttgactagagagcggcagaacatccggacagccgtgcatcagcttgaggttctctccaaaaattccaccgacccagtcaggctcaaaagcgagatcaatcgagtatctggacgcgttggtaggctgagccagtttcatcctattgaaggggccgcactgcgggctaggcttacaactctcagggtgggtctggacctcaatcaatga

SEQ ID NO: 11001 - RNA, 984 nt, unidentified
  source 1..984: mol_type = other RNA; note = synthetic construct
atggtccagctggcctctcgcccaaactataaatacagccctgtgcaatcctgcgcgagtctgtcaaaggtgctggccgtctccccgtctgccctgaaagccctagcagccaattctaataacttgtacaggctagccaatccaatactgaagccggacggctctgtacgccagccttacgatgctctttatcccttgaaacttgtgcacgagagactgaaactgcgggtctttgctcacgtgagcttcccagactatctcaccggcagcctcaaaggaaaggatgcaatcaagaacgccagttttcacgcaggcgccaagatcgttgtctgtgaggatattaaggactttttccccagtgtcactgcagatgttgtgtactctatttggcagggattctttaacttcgcgcctgaagtgtccaggctcctgacatccttatgcactaaggacggaagcctgccccagggggcaatcacatcaagctacttggctaacctcgtgttctggaagcaagagtggaggttgtatgaggatctcaagagcagaggtatcgtttactcccgttacgtggacgatgtgaccgtgtcatcacgagagggccttgacaaggaacaattgagcgaatgtataggtaaagtttatgggctaatggccgctaacgggctcaggcccaaacggaagaagcaggaaatccaacgggctcatgcccctatgagagccacgaaactgatggtcaataagcgggcagctctgtccctgggcgaacgtaaagctattagggctgcggtacatcagttagagttagaagtagcccaggtcaatatgccaaaagagctgatggcgaagctcaatagtgtgtcgggaagagttgcacgcttggcccagctgcacgtagtgcaggggaacgagcttaaaaatcgcatcagagctcttcgagtgcggattaagctcctgaccacactggcactgcatgacaaatga

SEQ ID NO: 11002 - RNA, 981 nt, unidentified
  source 1..981: mol_type = other RNA; note = synthetic construct
atgacgcctgatgcctccaagccgtcttaccgctgctctcccataagaagtctggacagcttgagcagagcactcggtgtgagcctagagacactcaatcgattagcaagccgcgcggacgattcttatcggctggcaaaggctatcgttaaaccagatggtaccatccgtcaaccttttgatgcccagccacctcttaaagctatccatcgccgccttcagaaaaggatattcgacaacgtcaggtttccagactacttgacaggctccctgaaggggaaagatgccagatggaacgccgcccttcacaccggcgctaaaattgttgtgacggaggacatcaagaatttttttccaagcgtgactgctaatattgtctattccatttgggcaggcttctttaggttcgagggcaacgtcgcccagctcctcaccctgctgtgtactaaggatggaatgctgccccagggggctatcccctcttcctatctcgctaacttagcgttctgggagcaagagtggaaattggtggcaaatttccgggccgctggtatcacatactctagatacgtggacgacgtcaccctgtcaagtcgggaatcactggataagccccagctgaccaggtgtatttcaaacgtgtattcgtttatggccgctcaaggattccgccccaagcggactaaacaggaaattcggcgagcgcatgcccctatgatcgcaacaaagttgatggtgaatcgacgcccggccctgttagtacaggaacggcaggggatcagatcagcggtgtaccaactcgaacgtgaagagatgcgtggatgcgacccaaaagagatcaaggcaaaaattgacagcgttgccggcagggtaggaagactaacccagctgcaccctactgatgggcacgctctgaagctgagaatagccgcccttaggaggaagctcgccagtatttccgctgtccccagtgcaaactga

SEQ ID NO: 11003 - RNA, 981 nt, unidentified
  source 1..981: mol_type = other RNA; note = synthetic construct
atgaagaatccaccgaaaagacccgagtatccacaccgccccattggctctctggacgccttgtctgccgccctccagatctccaggattgagctggaacatgttgcgagcgtcacagacagtcagtaccgcctcgctaagcctattgttaaggcagacggttccatacgccagccatacgatgccctgcctctcttaaagaacgtgcagaggcggatccaagcccggcttctagcccctgttcagtttcctacctaccttacgggtagtatcaaggggagagatgccaggcggaacgccgctattcacgcaggtgctaaagtcgtagtctgtgaagatgtagcaagttttttcccatccacatcgcgactgctggtggagagcatctggactggcttctttgggttctccccagaggtggcacagatgctagccgtcttgaccacgaagaatggctcactgcctcagggagctgtgacaagcagttacctggcaaatctcgcattttggaaaaaagaaccgattctgcagcagcaactggagctcaacggaattgcgtattctcgttatgtggacgatatcaccatctcttccagacgggccctgttaaaccccgagctgtcatggtgcatcgctcagatctatggcatgatgagaggggcagggatgcaagcgaaacgcggaaagcaggaaatctggcgtggcgacggtagaatgttagccactaagcttgtggtgaacaggaggcctgctctcccacccaatgatcgcaaggccattaggactgcagtgttccaactggaggcgcgattcgctgctggcgacgtggaggatacctttgctaccgaactgaatcgggtagccggacgggttgtgaggttggcccagttccatcccgtcataggagccgctttgaaagggagaatagcaagcctccgacaacagctttcagacggccagacaagcgctatagccccctga

SEQ ID NO: 11004 - RNA, 996 nt, unidentified
  source 1..996: mol_type = other RNA; note = synthetic construct
atgaaccctcctcagctcaaaccgaagtacgacctgaagtcaattcgggatatcagtgccttgagcctgagtctatccatgccagaagaactgctgatcaatgtagccgcacaggcagatagcttatatcggaaggccaaacccataattaagccagatggctctctaagacagcctttcgatgccttaccccctcttaaatccattcagcgccgaattaaggaccgcatcctcaaacgagtggaatttcctgagtatttgacaggctcactgagtggcagagactatcggaccaatgctgcaatgcacgtgggtgccgccatcgttatatgcgaggacattgagaagttttttcccgccacgagccgtgagcgcgtgcttgatatctggaggaatttcttttgtttctcggaagacatggctaatttgctcacaagcctaaccaccaacgacgggagcttgcccgagggagctatcacatccagttacctggcgaacctggcgttctggaaccaagagccacggctgcaggcgaagttagcccaaaagaatatcgtgtatagcaggtacgtcgacgatatatcagtttcatccaagcagtttatgcctaaagaggaacaaaccgcacttattgcccaggtttacgggatgctgaaacgtcatggatacaaggccaagagaaggaagcatgaaattttcacgtctggcaggagaatgctcacaactaagctcatggtcaataggaaaccagcactgcagcccaaagacagacagaacatcagagctgccgtgcatgctctggagcagcggatagcttccggcgagtctggagctgaaatcaaaactgagctcaaccgcgtcacttctcgcgtagggcgacttggaaccctgcacgctactgaggccatcccattgaaactcaggctgcggaacgtgcgtcaatctcttcaggcagcaatcctgcagcacaccccgctgattggtgaacccgagtga

SEQ ID NO: 11005 - RNA, 963 nt, unidentified
  source 1..963: mol_type = other RNA; note = synthetic construct
atgacgccgccgctcctgaagccaaagtatgatttgaagcccatccgcgatatatccgccctggccctgagtctaggcatgccagaaaaactgcttatagacgtcgcagctcaagcggacacactgtaccggaaagctaaacccatcgttaagcccgatggcagcatccggcgaccttttgacgctctcccccctttgaaacctattcagcgccgtattaaggaccggattctcaagcgggtggaatttcctgagtacctcactggtagtctggcaggtagagactatagaactaacgccgctatgcatgccggcgccaagatcgtgatttgcgaagacgtggaaggattcttccccagcaccaagagagagagggtgatggatatctggctgaattttttcaggttctctgaagacgttgctaacctcctcaccagcttaacaactaaagagggggaactgccacagggcgccattacctcctcatatctagctaaccttgctttctggaatcaggagccaaggttacaggcaaagctggcgaaacgcgaggtggtatactctcgctacgttgatgatatcgcagtatcatccaagcaaaccttgaccaaggaggagcagacagctctgattgcccaaatttacgggatgcttaaaagacagggctataaggccaaacgaaggaaacacgaaacctttacatcggggcggcggatgttgactactaagctgatggtcaataggaagcctgcccttcagacaaaggagaggcagaatataagagcagcagtgcatgcgctggagcagagaatcgccagcggagaaagggggcttggaatcaaaaccgagttgaatcgagccacgtctcgcgtgggaagactgggtactctgcacccaacagaggcaaaacccctaaaattacgtctgtcccacgtccgccatctcaccaacaaccgtatgtga

SEQ ID NO: 11006 - RNA, 1014 nt, unidentified
  source 1..1014: mol_type = other RNA; note = synthetic construct
atgtcagatccccagagacgtccaaggtacccccaccagaggatacaaagcgtggcctccttgtcagctgccctaaatgtccccgaaggtgaactggcagcgattgccaagatcgctagctcacagtacaggaaagcgaaacccattaccaaggctgatggcagtgtgcgccagccctgggacgcattgccaccacttaagcgggtgcaaaaacagattcaggcaaaattgcttcgcagggttgagtatccttactatctaaccggatctctgccgggaaaaagtcccagagagaacgcctcccttcacactaaacctgcaatcatcatcacagaggacatcgcccggttcttccctacgactcgagctgaacttgtgcatggagtgtgggccggactgtttggctttagcgaagaggtggcaggcatcctcacggcactgacaactaaagatgggttcttacctgaaggtgcccccacatcttcgtacctggccaatctggtgttctgggactgtgagccacggatagtcgaccagctggcccagttggacgcgacctatagccggtatgttgacgatgtcaccgtatctagctctaaggctctcaccccggttgagattgcgcggtgcatggccatagtttacggcatgtttggctcccggggttacaaggcaaagaggagaaagcacgagattgtcagggctaacgcaccgatgcgcgtaacaaagctcgtagtgaataaaagacctgctctgccaaaggccgacagaaaagccgtgagagctgctgtctataagctcgaggggattgtgaactccggccagcccctgcctgacgatattcagactctgctgaactctgcctcagggcgcgtttcccgactcggacaatttcatccaactcaagccgctccactgaaggcacgaatcgccaccatccgtgaacgcctggctcatttaaatgatagtctcgccttaaccgggcacgggcagaagacacctagtaagagctga

SEQ ID NO: 11007 - RNA, 1020 nt, unidentified
  source 1..1020: mol_type = other RNA; note = synthetic construct
atgagcttccgctacaatgccaaccctatcagaagtctggcggttctggctattgccctcgatgtcaccgaatacgagctactgcgcctgtccaatcgggctgacgatctgtacagaaaggcgaagcccattcggaagcctgacggttcgttcaggcagccatatgatgcactcccccagctgaagcatgttcataggaggattaaggagcgattgcttgtgaacgtgcactttcctgcttacctcacaggatccctgccaggcaaaagcccaaaagccaacgcctctttccatgtcggggcaaaaattgttatatgcgaggatgtgcagaagtttttccccagcactcgcgcgacactggtacacgacatctggatgggtttttttgggttcagccaggacgtggccactatcctcaccaagttgaccactagattcggagctctcccggaaggggcaattactagttcatatctggccaacttagtgttctggcgccttgagcccggcctccatgagcagttatctatccgaggaatcgcctatagcaggtacgtggacgacatctgtgtttcctcaaaggagtttctccccgatattgataagtcagctgccatctccgaaatatatacaatgctgggccggttagcttacaccgcaaaaaggaaaaagcacgagatccagacctccgggcaccaaatgtttgcgacgaaacttatggtgaatagaagagtcgcaatcccacacagtgaaaggcataatcttaagtcagcagtgtttcagcttgagggaaagttcaaacacggtgcccgcgacgtggccttctttgaagaattgagccggacaactaaccgagtcggccgtctaggccaattccacatgcaagaggctacaaaactgaaagaacggttgaaaaagctgcgtatgagactggatagtgaaccggtggtaattaccccttctgtccagacggctgccaccataatgtctgccgccaaggcagaggctccttgggactga

SEQ ID NO: 11008 - RNA, 1050 nt, unidentified
  source 1..1050: mol_type = other RNA; note = synthetic construct
atgaagaagccacctaactccgacaaaagcataccgtattacccctgcgaacccattcattccattgccgccctcgaaatggctctgggaataccagagcgctggcttaagagaatcgctgccgcggccaaccagagctatcgccttgccgcagaggagattaaaaaagatgggtcgaaaaggcagaccttcgatgcctaccctagattaaagtatgcacagagacgcataaaggaccgtatcctgtctcgggtcgaatacccagactatctgaatggctcattgaaaggcaggtcccctcggaaaaatgcggaagcacacgtcggggccaaaattacgattggagaggatatcgctaatttctttccaacaatctccagcactctggtgaaagctatgtggtgtgggctgtttggctttagtgaagaggttgccaacctattgaccctcctaaccgttaaggatgatggtgtaccccaaggggcggtgactagcagctacctcgcaaacttggtattctgggccagggagccccaactgtataagcagtttcagaggaggggttaccagtatacgcgctacgtggacgacatttcagtgtcctgcaagagaagaattacagatagcgaaaagtcagagatcatctcttctgtctacgccatgcttaggtcagccggcgtgcaacctaagagacagaagcacgaggtgcacactgctggagctcgaatcgtgaccaccaagctggtgcataacgtccgcgttgctctcccaaaagagatgcgccgtggcatccggacaagtgtgttccaactggaggctcgggcagccttcggcgagcatgacgaagcactccacaaggagttgctgactgtaagctctcgggtgggattacttaatagttttcacccttccgaaggtgcacccctcaaagcgcgtctgaaaaagctgcggaagatgatagaagatgccgcacaggggctgcagcgaacacaggacgttggtcgacaggctgtcggaatctctaatagtgagcccgccccgtgggactga

SEQ ID NO: 11009 - RNA, 975 nt, unidentified
  source 1..975: mol_type = other RNA; note = synthetic construct
atgaagaagagcctgaagattgacggtctggccccctcctatcctcacgaaccaatctacggaatcgccgctctgagcagagctcttggagtgcgggagatgaggctgcagcgtgtggcccagatggctaacgatttgtaccgactggcctctgaggagacgaagctggatggctctaaacgccagacgtacgatgcccagccactcttgaaagcaatccaaaagcggattaaggaccgtatcctagtccgcgttatttgcccgccctatctcaacggctccttaaaaagacgctccacacggaccaacgcggaaccacatgtgggcgctcggatagtgttcgacgaagacatagccaattttttcccttccattagaccagaaatcgttaagaggatgtggctgggcctctttggctttagcaatgacgtcagcaccctgctgacacttctgacagtaaaagaccagggtgtgcctcaaggggccgtgactagttcgtatctcgctaacttcgtgttctgggcacatgaaccttcacttgtgcggcggtttgcggcccaaagattagcatatactcgatttgtcgatgacataagtgtgtctagtaaggctgtcgttgccccccaggctaaatcactggtaatttcagagatttacgggatgttgtcccggcacgggttagagcccaaacgagctaagcataagatctcaactcgacgcgataggatgaccaccaccaagttggtgatcaatgagcgtgttagcctaccgaaagaacgcagaaggaaccttagagccgcggtacacaaactggagcagagagcagcattcgaccagtacgatgagagtctcctgaaggaaattaataaagtcgccgtcaaagtgggacagctcaagggataccacgttgcagaggggacacaactcaaggagaggcttaggtctatcaggagccgcgtgctgctgtctttgtga

SEQ ID NO: 11010 - RNA, 1035 nt, unidentified
  source 1..1035: mol_type = other RNA; note = synthetic construct
atgatgagtgagtttccaaattatccacatcagagaattgggaccctggacgcccttgctcgagtacttgcggttccgaaggaccacttgttaactgtcgcctctagagcggaagtgttgtataggatagccgctcaagagcagaaagcagacggaagtatcagacaaacgttcgacgccaaacctaaactgaaggaaatacagcggaacattaaggaacgcctcctacagaaggtaaagttccccccgtacctccaggggtctttaaaaggcagaagccctcgcctgaatgctgagtcacacaaaggcgctcacctgagcatctctgaagatatccagaacttttttcccagtgtgggtagagatcatgttatgtccatctggagggattttttccgtttttcggatgaggttagcgagttgctgacagctctcacggtgaaggacgacggaatacctcaaggcgctatcaccagctcctacatggcgaatcttgtcttctgggattatgaaccacggctggtggagcaactagccgcaatgggcctcacctacactcggtacgtagacgatgtgattgtgagctcccgacaccaccttactaaggaggtgcagtcactggtcgtggccaagatttacgggatgctgggccggtattcgctccgtcccaaaagggccaaacatgaagtgtccactaggtcaaaacggatgacagccaccaagctcgtcatcaacaagcgcgttgctctcccaaaggagacaagacagaacatccgagctcaggtttttgcaattgagcgcagagtgctggatggagatcgcggggcagacttggtgaaggcactggcctctgctagcagtcgggtgggaaggctggcctcaatgcatcccacaatgggccagggtttaaaggccaggctgaaagtcgtaaggaccacactggcctccgaatcccctcccgaggccttccaggttgcagtcgcatctcgcgtgcctcagagcgtggaggaagacttcgtgcccccatgggtctga

SEQ ID NO: 11011 - RNA, 993 nt, unidentified
  source 1..993: mol_type = other RNA; note = synthetic construct
atgaaaaaaaccaccattgaacccgggcttgcccccttgtatctccactcagcaattcgcggactcgctgcactcagcaaggcactgggggtgaggcagaacgtgctcgagaagcttgccctgtctgcggagacactctatcgagtggcgcgcagtgaagtcaaatctgatggctcaatccgtcagacttacgatgcactgccaaggctgaaagccgtgcaaatcagaataaaggaacgactcctgcagcgggttatttttccctcctacctgcacggatccctgagagagcgttcaccccgaacgaatgccgccacacacataagggccaagatcacattcgctgaagacatttccaactttttcccatccgcttctcgcgccctcgttcaccgtgtctggaaagatctctttggcttctcagaggacgttgccgccttgttgactacactgacaactaaggatggaggtctgcctcagggcgcagtgacttctagctacctggctaacttaattttttgggactatgagcctgatctagtcaagaccctggctctacggggcttgcgctatagcagatacgtcgacgacatcaccgtgagttctaggctgggaatcaaggcctctgataagacctatgtgatcagccagatatacggcatgctgttgcatcacgggttcacccctaaacggaagaaacatgagattacttcggctgcaaagagtatgagaacaaccaagcttgtgcatcataccagagtatcccttccgatcacggaacggaaaaagactcgggctgcggtgtacgccctggaactgagagtaagcgctggcgagtccgggcctggagtaatgaaggagcttgccagcgtgagcacaagggtgggtaggttaggttcctttcacaaaacccaagctatggcactaaagaaacggttagacgttgtccgcgcgactctgaataccttcgaggcctcgccaacggtcagttga

SEQ ID NO: 11012 - RNA, 1011 nt, unidentified
  source 1..1011: mol_type = other RNA; note = synthetic construct
atggaccggcccatttataagcaccgcccagtgcagacaattagcgccttggcacgcgcactcaggatctccgagtcgctgctactgggaattgcaggacgagccaccgatctgtacattggcccgaagcctaaaccaaagaagaacggaggcatccgctatgtatttgacaccaaaccaccgctaaaatcactgctccggcggattaacggaactttcttcaaacacacccaatttcctaagtacctgactggttcccttagcggccgggatttcgtggctaacgtggagattcacagggatgcacgtaatgccgtcaccgaagacatcgctcagtttttcgactgcattagtgctgaatgcgtgtataggatctggaaagacttctttcacttcggcgacgaagtggccgagttactgactaagttgactacgaaagatggtagggtctttcagggcacacccacaagctcctacctggctaatctcgcattttgggaccgggaatgtgccctcgtggaaaagcttaaggccagagggatcagatattcacgctacgtcgacgatatcaccatcagtaccgttagccccctcgctaagggcgacaagaggtgggcgattagccagatatacgccatgatcgggactgccgggttcaaaccccagagaagtaagcatggatcttttagtgcctcatctcccataagaataatggggctgaatgcgaaccgagcgcccacattgccaaaacaggagaggtcagcaatacgagcgcaagtttaccagcttgagcaaagagtggcccaggccgatcaatccgatgatttacgcgctgctctcagcgcagctatcgggaaagtcggtagattgaagaggctgcatccttctgagggcacagccctgcggcttagactggatgccatccgtcgcaccctggacgctcagccagtggtaacccatgctacgattcctatccaggtttccgacgaggccgcatctacacctttctga

SEQ ID NO: 11013 - RNA, 1011 nt, unidentified
  source 1..1011: mol_type = other RNA; note = synthetic construct
atggataggcctgtatataaacatcggcctgttcagacaattagctctctcgctagggccctgcgcgtttccgagtcactgctcctagcaatcggggaacggtccgccgatctgtatattggtcccaaaccaaaacccaaaaaaaacggaggcatccgatacgtgtttgacaccaagcctccactcaaatctctgctgagacggatcaacgcaacatttttcaaacacacccactttccaaaatatcttaccggcagccttagcggccgtgattttgtggccaatgtcgagattcacaaggacgcccgtaatgcggtgactgaggacatcgctcagtttttcgattgcattagcgcagactcggtgtacagaatatggaaggactttttccatttctcagacgaggtggctgcactcctgaccaagttgactaccaaggatggcagagtcttccaaggaacccccacttccagttacctagctaacttggctttctgggaccgggagtttgcacttgtcgaaaagctcaaggcccgcggtatacgctatagtagatacgttgatgacataacgattagcacaacttctgcgctgactgaagaaaacaagaggtgggctatttcacaaatctacgctatgataggagctgccgggttcaagccgcagaggtctaagcacgggtccttcagtgcctcacatgcaattcgaatcatgggcctgaacgccaatcgctcgcccacacttccaaagcaggaacggtccgccatccgagcccaagtgtaccagctggagcagcagatcgttcaggccaacagcggtcctgagctgagggcagccgtgtcttccgccattagcaaggtggggagactgaaaaggttccacccgcgggaggctgaggctttacgcatccgtttgaatgcgatccgccagatcttagatgcaagacccgtcgtaacaaatgcgagtgtcccagtagaagtgacggaagacgtgggagccgcccctttttga

SEQ ID NO: 11014 - RNA, 1011 nt, unidentified
  source 1..1011: mol_type = other RNA; note = synthetic construct
atggaccaccccatctacaagcataggcctgtacagacaatcagctctctcgctcgggccctcagaatatcagagtcccttctcctcgggattgcgggtagagcaacggatctatatatcggcccgaagccaaagccgaaaaaaaatggagggatccggtacgtatttgataccaagcccccattgaagtccctgctgcgcagaattaacgccaccttcttcaaacacacccagtttcctaaatacctgacagggtctttaagtgggagggacttcgtcgccaacgtggaaatacaccgcgacgcaaggaacgccgtcacagaagacatcgctcagttcttcgactgcatcagcgccgactgtgtgtatagaatctggaaagacttctttcacttcggagatgaagtggcagcacttctaaccaagcttactaccaaggatggccgagtgtttcaagggactcctaccagctcttacctggcaaacttggcgttttgggatcgggagttcgccctggttgagaagctgaaggcacgtggcatacgatattcccgttacgtggatgacattacaatatcgacagtgagtaccctggcagagggcgataaaaggtgggccattagccagatctatgcgatgattggagccgccggcttcaagccccaaagatccaaacacggtagctttagcgctaatagtccaattcggatcatgggtctgaatgctaatcgcgctccaactctccctaaacaagagcggtccgccatccgggcacaagtgtaccagctggaacagagggtggctcaggccgaccagtctgtcgatctgagtgcagctctctcagccgccattggaaaggtcggccgattgaaaagactgcatccctcagaaggagccgctctgcgtttgcgccttgacgccatccgcaggacgttagatgcgcagcctgttgttactcatgctaccacacccattcaggcctcaaacgaggtcgacactgctccattttga

SEQ ID NO: 11015 - RNA, 1014 nt, unidentified
  source 1..1014: mol_type = other RNA; note = synthetic construct
atggatcggcctacctatccacatgaacggatccaatctatacagtccctgtgctgtgctttgggtctgtctgagcctaccttacgggccatagcttcgcgagcacccaatctgtatatcggtccaaaacctaagcccaagaagaatggcggaataaggtacgtttttgatacaaagagccctctcaagcctctcctgaaaaagattaattccgtgttctttcggagagtggtattcccacagtatctcaccggctccctctctgggcgcgacttcgttgccaacgtcgacgtgcacagaaattcccgccaggccatcactgaagacatcgcacagttttttgactgcatcaccgccgaccatgtgtaccgaatttggcgcgacttcttcgcttttggggaagatgtagcggatcttctgactaggctaaccactaaaaacgggagggtctaccaagggacaccgactagcagttacctggcaaacttagctttctgggaccgagaaccaatcctggttgagaaacttgctacgcgcaatattagatacagtcgttacgtggacgacattaccatgtcaagcgtgggagtccttgaggccgacgataagagctgggcaatcgctcaggcatatgcaatgattggggccaatggttttaagccccagcgcacgaagcatgccgcattcgaaggcggatctcccattaggattatgggcctgaacgccaaccggcaccccacacttccaaaacaagagcgtgcgcagatcagggctttggtgttccaactggagcagagtctggctagaggagataccggcgccgtgttcagaagcaggctaaacacagcctcaggcaaagtggggcgactgaagaggttgcactcaagagagggagaggccctccggctcaggctgaacaaaatccgccgggtcctggatgttttgcccttagtcacatgtcccactacacctccgggcgaaagagtgcagggtgaggatgcggccccattttga

SEQ ID NO: 11016 - RNA, 945 nt, unidentified
  source 1..945: mol_type = other RNA; note = synthetic construct
atgctgcgatctattatacagcgcgcccataacctatacattggtcctaagccacaggtgaaaaagaatggcggggtgcggtatgtcttcgatacaaagccccctctgaaacccctgctgaaaaaaatcaactccatcttcttccgtcggacccattttccaccctatctcaccggaagcattgcaggccgcgacttcattgccaacgtagaggttcataagggagcgagggttgtcatcacagaggatatcgcgcagttttttgactgcatcacggagcaacacgtctaccgcatctggagagaattttttaggttcagtgacgagatcgctgatctgctgacgcaccttatgaccaaggacggaagggtctttcagggtacaccaacctcgtcatatctcgccaacctggcattctgggacttcgagccccagctggtgaatcgcttggccgcgagagggataaggtacagtcgctacgtagatgacatcagcatttctaccacaaatgatctctccgactcagaaaagcgttgggtggtggctcagatctacgccatgattggccgcggggggtttaaacctcaaagatctaagcaccagtatctgtcatccgcacggccgatcacaataatgggccttaatgcaaacagtagcagggccccaaccatcactagacgagagaggtcccggattagggcccttatttttcaactggagcaaagattcgcaagcggtgaaactgggccagaatttcggcagtcattgtcccatgctatcggcaaagtgggccgactcaaaagattacacaaggtggaaggagccgctctacggactagactcgacactatacaggccgccttggatgctttacctgttaaaactaaggctagcgcaaagttcgagtctcctccggctgacgccattgatgatcaccccttctga

SEQ ID NO: 11017 - RNA, 1011 nt, unidentified
  source 1..1011: mol_type = other RNA; note = synthetic construct
atgaccaaaggacctgcctacagatacgctcccattctttccatccaggcgctttgcagggccctgggatgtaatgagcctttcctcagatcgctcgctgaacgcgcgtctgggatgtacatcggccccaaacctatgcaaaaaaagtccggcgggatccgattcgtctacgacactaagcaccctctaaaggacgtgctgaaaaaggtgaacagggtcttctttaagaagacccattatccgacctacctaactggttcactggatggacgcgactactcaaccaatgcaggcattcatgcaggggccacaggcgctataacggaggacataagtcagttttttcccagcattaccgccgacatggtttatgagatctggaccaagctgttccgcttcggtcacgagccagccatgttactgactgccttaacaacgaaagatggcgtggtttttcaaggaacacccaccgggtcttatatcgcaaaccttgtattctggtctactgaacacatcgttgtcgagaaactgcagagcttgaatattcgatattcccggtacgtggatgatgtgacactctccaaagcatccacattgtcactcgacgagaagacttgggccattagccagatttatagcatgataggcgcgcagggtttcaagcccaagcgggaaaagcatgggatactgagtggaaagggcgctattaaaatcatggggctgaacgctaacgctaaagtgtcactgccacgtaaggagagaagtctgatcagagccaaagttcatgcactcgaaaaacggttcgagagtggcgaaatcgatttttcctttaggacagaactgaacaaggtcagcggggtagtgggtaaaatgagcaggtttcacaagcacgaggccagccaacttcgcggccggatcaatgtgattaggcgttctatcgaattgatcccaattatcactattggatctcagtatccgagaaccgtcttgccacaggatgtgcagaattga

SEQ ID NO: 11018 - RNA, 1146 nt, unidentified
  source 1..1146: mol_type = other RNA; note = synthetic construct
gccctgggacaccggcccttctacgagcttatagaacagctcctgaggaacagacgattcaataacctccggtgtggccttgcctttgcgtggcacacggacagttcttccagctggtacgcctctaacaccaaggtgctgactgggagccacgacccaatccaatcggtggggagtctgtgtagggcgctggccatcgccgaacccttattgtgctccattgccgaacgggtgccaaacctgtacattggtcctacacgcaagccaaagaaaagcgggaatggcttcagagacgtctatgacacccgactaccgctgaaacctttgctcaagcgcataaataaggttttttttgagcgggtagtttttcctgactacctgcacggctcaatccgtagttgcgacttcatatctaatgccagaatgcatgagggatccgtcaccgtgatcacagaagatatcaagggctttttcgaccatatcactgaggagcacgcttatgccatctggagaagatttttcgggtttggggaggttccctcagaactgctgactaagctcgtcacaaatggaggcagggtctatcagggcagtccgaccagctcctaccttgcaaatctggtcttctgggacatagaacctcggatggtcgagacgctgggagtaagggggttaaggtatagccgtttcgttgatgatgtgaccatgtctcacccaaccagcattgggacagaggagaaaacttgggcgattgcccaggtgtacgctatgctcggttcgcacggcttcaaacccgcaaggcagaaacatgctatctttaatggcagtgcatctcgcactattatgcgggtaaacgtgaacgagcatttgaccattacccccgcagaaaggcgtcaggttagagctatggtgcatcagctcgagcaacgagtgcggtcaggcgagaacacttcagaggtgagacaactactcagctcagctattggaaagatcggtcgaatccagcgccttcacccttcttatgccgaaaaattgcgcgtgcaggctcgcggtatccagttaacactggatgaaatgcccttctccacagagtcccaagcatccttcattgcaagccaggctgatgaaggagattccccattttga

SEQ ID NO: 11019 - RNA, 942 nt, unidentified
  source 1..942: mol_type = other RNA; note = synthetic construct
atgcaatatctgagctataccaaagagaacagaatccagaatataagcagtctgtgtctcgcgttgaaaattaaacaggacgatctcctggagatcgctaacaatgttcagaactactacaagccaccctactttattgaaaaaaaaaacgggggtcagcggtgcattattgatacagtcgaccctctcaaaccgctcttaaagagcattaataaggtgttcttcaagaacgtctacttcccagattatcttactggttctatctcaggccgcgattatatcagcaacgtaaagatccaccgcaactctaagaatattatcaccgaagatatcaccagcttcttcgataacattaccgaatcacacgtgtatgacatctggcggcgctttttcagattttctgatagtgtcgcccagatcttgacacaactgactaccaaggacggcaagatccatcagggggtccctacatcctcctacctggccaacctgagcctatggcgacacgagcagcacttcgtgaacgacttaaagaaaaagggatttgtatacagtcgttacgttgacgatatgactataagttcctccaacgtgatatctagggaagacaagacttgggtgatctcgcacctgattggcatgctgtctgcaaatacactacggataaaaagatccaaacatgcagtgcttacgtctaataaaccaatgaatatcatgggactgaacatcaatggatcaaagcccacaactcctaaaaaggatagggacattatacgagccacccttcatcggtttgacaagcaccccgcttccttttcagttgaggacctgaggtcgttgcaggggaagattattaatatcaggagaatgcatgtgagcaagggcgagaagttcctgaaacaatttaaagagacgctccataagaatcacatcaccatttga

SEQ ID NO: 11020 - RNA, 942 nt, unidentified
  source 1..942: mol_type = other RNA; note = synthetic construct
atgtattttgtggcaaagactgttttgaaagatgatgggacagagcggaccctgtacgacacacgccagcccctgaaaacagtcctgcaccgtatcaacgcccacttcctcagacaggtcgtttaccccgaatacttaaccggaggggtgcccggcaaggattacacggactcagtgaaaattcacgtcggagcccggaccgtggtgaaggaggacatctccaagttctatccatccgtgtcctttgatgtagtacgtgacatatggggaagattctttgggtttgcggatgaggtagccgaactgctggcaatgctcactactagggatggccatctggaacagggcgcacctacctcaggctatctcgccaatctggcactttgggatgttgaatctaaactaatcacgaagcttgacagcatcggcgtgactagatacagccgccatgtcgacgacattaccctgagttccgccgagcatctgtcgtcccagcgaattgactgggttgtgagggccgtaagcgccgctctcgctacaaaaggactactggtgcacaccggcaaacacgaggtcatgcaggccgatggtcaaatcaagattctcaagttggtggggaacgcgaagcctagtctgcctccgaaggaacggagtagggttagggctctggtgcacaatttctgccaaagagtggatgcaggaggtagccaggaggagctggagcagctgcttccacgagtgagaggtcaggcttataaagtcaaacgcttccatctccgctcaggcggccagttggtcgaaagggtggcccaagctgcttctttattggaagaccggaggagcaagtctcctccccggatctctcacatagggtcacaccttgacgacagcgattggctcagtgagcatccaccggttgggggagcgccatgggagttatga

SEQ ID NO: 11021 - RNA, 1047 nt, unidentified
  source 1..1047: mol_type = other RNA; note = synthetic construct
atgaacgcacctaggtaccgccaccacagggtccagtcaattgagtctctgcgccatcctcttgggatgggaccctccgagttactcgccctagcaaaacgcgccagccacctgtaccgtatagccaaaaccgttcctaaggacgatggaacgctacgcgtgctgtatgacacgcgtgagccgctcaaagctgtgttgggcaggattaacgaacacttcttacgacgagttatttatcccgattacctgacaggtggtgtgcctaggaaggactataccgacagcgtgaagatccacgttggcgccaagagcgtcataaaggaggatatctcaaaattttacccatccgtgagcttcgacgttgtacgcgagatctggagcggatttttcgggttcgccgacgaggtgagcgatctgcttacaatgctcacaactagagacgggtacctcgaacagggcgctcccaccagtggatacctcgccaatttggccctgtgggatattgagtcccagcttatcgcccagattgcatctgcaggagccactaggtattcaagacatgttgatgacataaccatctcctcgccggaacacctgtctactagtagagtcgattggatcgtacgtatggtggctggcgcactggcaagtaaaggtttgagggtgaacgcgtcaaagcacgaagtaatgcaggccggcggtcagatcaagattcttaaactggtcggcaatgctaaaccatctctgcccccaaaggagcgaagtcgggtgagagctctggtgcatactttttgcttgcgggtggagtctggggaatccccagaagagctggccttactcttgccgcgggtgagagggcaggctcataaggtgaagcggttccatcggagagctggcgagcggctcgtcgagcaagtcaatcaagcggctcaactgcttaagaaccagaccgcggaagctcagcccgtaaaacagcccacacccaatctggtctttgatgaagccatcgcagggcagcaacctcctgaatccgacccaccatggtga

SEQ ID NO: 11022 - RNA, 972 nt, unidentified
  source 1..972: mol_type = other RNA; note = synthetic construct
atgaacgaggccaaataccttcgtcgcagggtgcggtccatagaggcgcttcgccatcctttgggcatgggtccacgggacctgcagcgtttggcactccgggcttcctctctatactttgtcgcaactacaatgcccaaagcagacggcacactgagagtcctatacgacaccaggaagcctttgaaatccgtactgcaacggataaacgaacatttcttaaggaaggtcgtgtacccgccctatctgacaggaggcgtgccaggcaaggactatactgattcagtgaaaatccacgcgggagctaagacggttattactgaggatattagcaaattctaccccagcgtggggctggaggttgtgcgaaacatttggagtgggctcttcggtttttcagacgaggtagccgacttactcgccgctcttacgactcgggatggacatttggagcaaggggcccccacctcgggctatcttgccaatctggccctgtgggatgtggaacccgccctcatcaaccgactgaccgctatgggagtaagcagatacagccgtcacgttgatgacatcaccctaagctctcttgaaccactcggaacttctcgcgtggactgggtggtccgaaccgtcacccgcaccttggctagtaaggggttacagatccaccctggcaagcaccaggtgatggatgcaggcgagcagatcaaagtgctgaaactggtggggaatattaaggcgtctctcacaccggaggaaagatcaagggtaagggccctggtgcacaattattgcaagcgcgttgagagtggtgatgggctggaagagctcagagctctgctcccatccattagaggccaagcacacaaggttaaacggtttcatcctagggtgggagcccgcctggttgctgaagtcgaacaggcagcccagcagctgcagcatagaatggtcacatggatcaagtcctga

SEQ ID NO: 11023 - RNA, 1059 nt, unidentified
  source 1..1059: mol_type = other RNA; note = synthetic construct
atgactgcgccgcgctatcctcatgaccgaatccagagtatcggctcactcagacatccgttgggaatggacgcacgggagttgactgcccttgccaaacgtgcctccaggttgtattttgtggccaaaaccattcccaaaaacgacggcacacaaagagtgctatacgataccgccaagcctctgaagccagtcctgcaacgtatcaatgacaacttcctgagacgagtgatctacccacactacttgacgggtggggtccccgggaaggactatactgattccgtcaagatacacatcggggctaagagcgtgattaaggaggacatttcaaaattctacccctccgtcacctttgatgtggtgtgcgacatatggagtggcttctttggtttctcccatgaagttgccgacctgcttgcactgctcacaacaagagatgggcatctggagcagggcgcccctacatcagggtaccttgccaatctggccctgtgggatgtggagagctcgctgattgcgaaactggcttcaatcggggtgacccggtatagtcggcacgtcgatgacatcaccctctctagccaggaacacctcagcgctgcgagggtggattgggtggtgaggactgtagccgcagcactcgctagaaaaggcctgttagttcatgcgggaaaacacgaggtcatgcacgctggcggacagatcgaagtgctgaagctcataggaaatacgaaaccatctttaccacccaaggagcgctctcgggttagggcattggtaaataacttttgtcggcgggtcgaatctggagactccgttgaagagcttcaaagcctcttacctagaataaggggtcaggcctataaggtgaagcgctttcaccgaaggaaaggagagcaactaattgagcagattgatcgcgtggctaagattctgcgcgcaagggctggcgaagctcagccaaacatcgataagctgcagagagacatggtagattcttactccgccaacgaaagcttcggccgccagagtgcagttgtagaccctccctggtga

SEQ ID NO: 11024 - RNA, 909 nt, unidentified
  source 1..909: mol_type = other RNA; note = synthetic construct
atggaaccgaacgagctgctaaggttggcaaagagagcaagtcggatgtatttcgtggccaaaacagtccctaaggatgacggcacccagcgcattctttacgacactcgcaaaccactgaagacagttctgcatcggataaatgagcactttctgcgccgtgtcatctatcctgactaccttacgggtggggtgccgggtaaggactatactgactcggtgaagatccacgttcacgccgagtcagtgatcaaagaggacatttcaaagttctatcccagtgtctcctttgatgtggtatacgatatctggtcttctttctttagtttctcaaacgaagtggctgaattactcactatgctgaccaccagagacggccatctggaacagggggcacccacatccggctaccttgccaacctggccctctgggacattgaggctccattggtggctaagctcgcctctattggagtgaccagatactctagacatgttgatgatatcacactgtccagtcccgatcaccttagcgccagccgggttgactgggtggtacgcactgtagcaaccgccctcgcaagcaaaagcttactcgttcatcccggcaaacacgaagtcatgcacgccggccgtagggctatcgaggtcctgaagttggtgggaaatacgaaaccaagcctgccatctaaggagcgatccagggtacgggcgctcgtgcataccttctgtcggagggtcgaagctggggatagcggggaggaactggagagattactccctcgagtgcgaggtcaggcctacaaagtgaagaggtttcaccagaggataggagagcagttggtcctgcaagtggaccaagcggctaaactactgcgcgattccccttcagatgttggatccagatga

SEQ ID NO: 11025 - RNA, 933 nt, unidentified
  source 1..933: mol_type = other RNA; note = synthetic construct
atgtactttgtggcaaaacgtatacctaaggaagacgggaccatccgcgtgctgtttgacacccggcagccgttaaaggccgtcctacagcgcattaattcccaatttctccgtaaagtgcattatcccccatatctgactggaggcgtgcctggaaaagactacgtgtcttcaaccagacttcacgcgcacgcgactctggttattaaagaggatataaggacgttcttcccatctgtccacgctgatgtcgtgctggatatttgggagagattcttcggtttttcgaccgacgtggcccaactcctcacattgctgacgacccgggacggacacctcgaacagggagcacccacaagcggctatctggccaatcttgccctctgggatgttgaggcccgcgtggtatcccagttagctcgcgagtgcgagttgactggctactcaagacacgtagatgatatttgcgtcagcagccctacccctatctctgcctcccaaaaagctcgcgcggtcagtttaattttcggcatgcttgcaagcaagaacctggccccgaaaagagccaagcacattacaatgcatggcggtcagcaaatccggatccttaagctggttgctaaccggaagccatctctgtcagccatagaacagtccaggatccgggcagcagtgcaccagttctgtcgaagggctgcaaacttgggggacccaacctcactcagagctgaactgcccaagatcagggggctggcccatcatctgaagcgatttcatcccaggaagggtgccgtgatgttggctgccatcgatacagttgcccgagctctaaactccacagacgtcgcacagagtgacgtggcacctactgtgagcacttttagcgggccagtagctacaaatgcccccgacagtcaggcgccctgggattga

SEQ ID NO: 11026 - RNA, 957 nt, unidentified
  source 1..957: mol_type = other RNA; note = synthetic construct
atgtcctctgccagctatccgcacgcccgcattcagtcagtcgagtcactaagacacccgttaggcatggggccagtggggctgagacggcttgccaaacgcgcaagtgacatgtattttgtagctcatcgtatccctaaggacgacggatctgagcggattgtctacgacaccagggagcctctcaaatccgttctaagaagaattaatcaacacatcctccgcagggtggtgtatcccgattacctgactggtggtgtcccagggaaggactacaaaagcaacgtggagatacatgtgggcgctgcaacagttgttaaagaagacattagctcgttctttccctccgtgtccgaggtgttggtattcgacatctggcaccgatttttcggatttagtacagatgtggctgaggttctgacagcgctcaccactcgagatggccacctcgaacagggtgctccaacatccggctacctggccaacttagcgttatgggacgtggagcctaatctcgtgcacaggctggccgaagagggcttcaccgcatactcaaggcacgttgatgatatcgttttgagttcaaatgaggaacttgagggaggggagatcgcatgggctgtgtctcagatctatggtactctgcggaagaaggggctgcaggccaaaagggccaagcatgaagtgatgcgactgaataggccaattgtgatcttgaagcttattggaaacgaaaaggcttctttgcccgcaagagagagaagtcgtgtacgggcagtcgtacatcggttttgcaccaacatagaaagcggcgtcgatatagcgctgctggaagccgatcttcccagcgtgcgcggccttgtccacaaggtcaagcgcttccatcctacggagggaaacaaactggtggcccaggtggaacaggccgtccaactcatgcgggctagcaatgggtga

SEQ ID NO: 11027 - RNA, 1023 nt, unidentified
  source 1..1023: mol_type = other RNA; note = synthetic construct
atggtgggtaacgatccgctggtcccaagatacccacacaggcccatagggagcattgacgccctggccagacatttgggggtttcccgccgcgaacttgaacggctcactcgcgcggctccaaggctttaccgggcaaaccccctgcctaagaagggcggaggctttcgctggacctacgacgctagaccccctctcaaacgtctccacgcagccatcaaagagaaacttctccagcccgtggagtatccaagctatctccaaggatcaattcgcgatccagacacacctagggagcccctcaccaatgcggacttgcatgcgggcaactacctgttcattcaggaagacgtagctggttttttcgggtccatcgggccttcagtcgtaaatgatatgtggaggcgttttttcgccttccctgctgatgtcagcgagatcctgacgaacttgactacactgaaagggctggttcctgaaggagctcgcccgagctcctacatcgcaaatctggcattgtgggacgtggaacctcagctagttagggagctgcagggcagagggttcgtgtattccaggtatgtcgatgacgtcgtgatcagtgccccgcggaacttatctcacgaggaaaagacagaggtggtgggacgactgtatggcatgtttgctgccaaggggctgcgggccaagaggcaaaagcatagcatagcaaagaagggccaggccgccggaaaaggtagaggggtgaccgtgaccggatacagcgttgcaggtggacgagcggctgtgtctaaggctgagcgaaatcgcgtacggtctgcagtgcgacagatcgaagttgaggcacgaacacggggcacttcacccgagctgcaagccagattccagtcggccagttctcgggtggacagaattgcccgtgccggatcagctcagggcgtcagattaagacagaggctagccgaacttaaaccctccgtctttccaaaaagtaatcggagggatatttacggtggcggctga

SEQ ID NO: 11028 - RNA, 948 nt, unidentified
  source 1..948: mol_type = other RNA; note = synthetic construct
atgcgtgcgcattatcccaaacagccgatcggctcgatcagcgctctgagcagagcccttgatgttgaggaggacctgctcacccatataggggctaatgtgagtaccttctataggccaggtccccctcagcccaagaaggatggtacattgcggattacccacaatgccgccccagagttgaaaggcatccacagaaaaatcaacaaaagactcctccaggaggtgcagtaccctgactacctgcatggatcaattcgcgtgatcaatgaccccagatcaattaagacaaacgccgctctgcataccaatcagaaaactatactgtgtgaagatgtcgctggcttctttgatgccactactccggctctggttcggaaagtctggcagcacctgttttgtttcccacctacggtggcagaactgctgacaaaactctgcacccacgacgggttcttgcctcaagggtggcgatgctcttcttatctcgctaacctggttctctgggaggacgaagaccggcttgtacgtaatctgaggtgtcgcggctttacatactcccgctacgtcgatgatatgactatatctgcacctcgctttctgtccagagccgacaagagttgggtcgtgcagtcattaatttcaacactagctaggaatggctaccgcttaaagagaggaaagcatgagattcttaaggccgcgggaacgatgaaggtgaacggacagatcgtgaacggtaagcggccaaccctttctactaaatataggaacaatgtccggtggaacgtatacgcactacaaaagatgcacgccctggacgcctcctccgaggagtatcgaagccgatgggaaagctgcagtggcaaggcaatcagggtggcaagctaccacgaaaggaccgggcaaaaattgctcgatcagttatccgccattgcgccccaatga

SEQ ID NO: 11029 - RNA, 1008 nt, unidentified
  source 1..1008: mol_type = other RNA; note = synthetic construct
atgaaatccctccagaacaaaccctgctacaagaacgctcccataaaaaatgttggtgccctggcccgcactctacggctgactgaacctcagctgatccagctggccagaaacgcatcccatatgtatcgtcgtgtgccagtccccaagaaagatggcacgaccaggcatacttgggacgcccagaagcagttaaaagaagtgcatggcatcattaatagtcgaattttccatcgcactacatttcctctgttcctgcagggaggaattcacgacccactctacccgcgcgactatgttcgaaacgcggacattcacgtggaccccagcatactggtgacactggatatcgctgatttcttccccagcaccagtgatagtgctgtgatggggatttggtccgactttttcaggtttccaccagccgtggccaagctgttaactatgctgaccaccaaagacggatttctccctcaaggcgcacgcacgtcatcctaccttgcaaacctcgcgttctttagatcagagcacgacctcgtcgcctgtcttgagcgtcaagggtggagatattctcgcttggtcgacgacattacaatctccaagcaacggagagcctctgatgatgaattgacccaggtgaatacaaccctgttcgcttttgttaatcggcacgggtactcagtaaagaggagtaagcacgatgtacaacggcgcaatgctcggatgagcgtgaacggtctagtagtgaataagaaggtgtcgcttcctaaatctcagaggagaagcatagcgtctgtgctgcacaggacaaacgctgcaatcgatgttggggaaggccataccatgcccgtcaaccgagttagaggccaggtcgcaatggtcaaaaggatgcaccctgagttgggagagaagatgttagctcggcttaagcagagcatctcagcagccgagagcaggccggccatcgaactcaatgactgcgagacagtgccattggatgagagatga

SEQ ID NO: 11030 - RNA, 960 nt, unidentified
  source 1..960: mol_type = other RNA; note = synthetic construct
atgaccgaaccccagttgcttcagctcgctaggaacgcctccaggatgtatcgtaaggttccggtcccgaaaaaagacgggagtacaagatacacctgggacgcccagaaacagctaaaggaggtgcatggacatatcaatagccggatattccatcggactatgttccccctgtttttacagggcggaattagagatcgcctacaccctcgagactatgttcgtaacgccgaaatccacgtagatcctacaatcctggtgacgcttgatattgccgatttttttcccagcacatctgactccgcagtaatggacatctggtctaagttctttaggttcagccctgctgtagccaagctgctgaccatgctgaccactaaggacggatttttacctcaaggcgcgcggacttcttcatatctcgcgaatctggtgttcttctccgacgagcacgacctggttgcacgccttgaacgccagggatggaggtactctcggctcgtcgatgatattactatcagcaagcagcagcgagtcaattcggacgaggtgaccgagacaaaccgaatgctgttcgcttttgtgaatagacacggctactcagttaagcggccaaagcacgatgtgcaaaggagcaatgcccgtacgtccgtgaacggcctcgtcgtcaacaaaaaagtgtcactgcccaagcctcagaggcgctctatttcaagcttgctgcaccgaaccaacctggctatttcgataggggaagagtccactatgcccgtgagcagagtgagaggtcaagcagctatggtgaaaagaatgcatccagagctcggggaaaagatgttggagcgcttgaagcagagtcttagtgtgggtgcacggcggccagccgttatgcctgatgaccaggaggtcagtccacccatccgcagacaaacaaaaaggaaaaattccccaggcacctga

SEQ ID NO: 11031 - RNA, 1017 nt, unidentified
  source 1..1017: mol_type = other RNA; note = synthetic construct
atgaagtcaccactgaataagcctttttataagaacgccccaatcaagagcgttggcgccctcgctcagactttgcagttaaccgagaggcaactccttcagctggcacggaatgcctcccggatgtatagaaaagtgcccatcccaaaaaaagacggaaccacaaggtatacctgggatgctcagaaacagctgaaggaagtccatggtctgatcaatagtaggatatttcaccgcacaacgtttccgctgttcctgcaggggggcattcgggatcagctctacccacgcgattacgtcagaaatgcggatatacacgtcgacgccacaactctcgtcacactggacattgcagacttcttccctagcactagcgattcagctgtaatggatatctggagtactttttttcggtttccccctgtagtggccgcactgttaacaatgctaaccaccaaagatgggttcctgccccaaggtgcaaagaccagctcctatttggcgaatctagctttctttcgggacgaacatgacttagtgacgaggcttcagaaacagggatggcgatactcccggctggtggacgacataactatttctaaccagcgtagagtatcaaacgacgaggtggctgccgtgaaccgtacactgttcgctttcgttaatcgtcatggctactcggtgaagaggccgaagcacgacatccagcgctgcgatgccagaatgagcgttaacaaccttgtggtcaacaaaaaggtgagtctccctaagtctcagagacgatcaatcgcatccttgttgcaccgaacctccgaagccattttcgtcggagaagaatgtgctattcctattaacaaggtgcgcgggcaaattgccatggtgaaaagaatgcaccccgagctgggcgagaagatgctcgccaggctgaaacaaagtatctctgcggttgagaatcgccccactatcgtgctcgatgaccaggaggcagttagctctacctctgatgcccaactttga

SEQ ID NO: 11032 - RNA, 972 nt, unidentified
  source 1..972: mol_type = other RNA; note = synthetic construct
atgtctagtcgtccaaacaagccttcctacaattttgcacccattaaagatgtaaggaccctagctctggcacttgggctcgcggaacgccagctaaatcgcctggctgtaaatgccgggaatatgtaccggagaaagcctatcgcgaaaaaagatggaacggaaagagtgacctgggacgcccacaaacagttaaaagaggtgcaagggagaattaaccagctcttctttcacaaagtcttatttcccctttacctgcaaggttccatccgcgacaaggcctaccctcgagattacgtgcgaaacgcagaaatacatgctggagcctgtgtggccgtcactctggacatcgccgacttcttcccctctaccagggcggagttagtgcaggacatatggagagactttttcaggttcgctcccccggtagctgaagtgctcacacggcttaccactaaggatggcttcctgcctcagggtgccaggacgtcatcctatcttgcaaatctggtcttttggcaacgtgagcattgcctcgttgagacactggagaagcggggctggcgatattcaagactggttgatgacatcaccattagtaaagcaaccgatacatcgcaggccgagctgactgacatcaaccgtattgccattggttgctttcaaggatatggctatagcgttaaaaggtctaagcacaaagtgttgaggcggaaccaccgcattactgtcaacagcctcgtggtgaatgtccatccagctctgcccaaggacgaacgccggaggataggagcccaggttcatcaggtgaaggaggcactgacaagtgggacacaggctgatgtgcctagcgtggcaagcactcgcggcaagatcgctaaggtcgttagattgcacccagagctcggctctagattgtcagataagctgcggcaggccatcccattggacaccgaaggctccccggagtga

SEQ ID NO: 11033 - RNA, 978 nt, unidentified
  source 1..978: mol_type = other RNA; note = synthetic construct
atgtccagacccaatcggccgctgtataaaggggatgagatcgcgtcctctgacgccctggcagaagtgcttggtttaacatcaccacagctccatcagctggcggcaaacgctagtaagatgtatagggaaaatccccagcgaaaaaaggacgggtctttacgcatgacctgggacgctcatcctcaactcaagaaggcacagaagcagattaatcttcggatctttggccgcatattatttcccttgtacctgcagggatctattcgggatagggcataccccagggactacgcgagaaacgccaatattcacagcggcgcagccgttacaatcgccattgacatccaagactttttcccatccataaccccagaccaggtcctgtcagcctggctcggagtgtgtcacttcccatggcaggtagcagagctactcacacgcctgacgaccaaagattctttcctcccgcagggcgctccaacgagtagctacctggctaacctggtcctctgggagaacgagcacgaactggtgagaactttgcagactaggggatggcactattcgcgcctgaccgatgacatcaccctgtcaaagaaagctcctgttgaaaaggatgagattacacggaccacctgcacagctattggtttcatccaaagaaacggttttactgtcaagcgttccaaattgaaggtgatgaaacgaaacgtccctatgactgtgaacaatctggttatcaatgaacatcctgccctacctaaggctgaacgcagacaaatacgagcccagcttcatcaggcgaaacttgctctggccagcggagcacttgtggacgcccaagccatcaatagcgcccgtgggaaggtgggcaaagtagtgcggttccacccccagttgggggccaagatgaaaggcgagttggatcaggagctggatagttggactgtcaggcagctcaacgatgagggctga

SEQ ID NO: 11034 - RNA, 1065 nt, unidentified
  source 1..1065: mol_type = other RNA; note = synthetic construct
atgcatccgaatttactgaagcctttctactcgcacgggcccattcagaacctggatacgctggccgaagttcttgagatctcctgtaagcagctatgcagactggctagaaaagcaaaccagatgtaccgcctggtcccacagcagaagaaggatggctctgtccgtaagacatatgacgcggatcacgctctcaaacgagttcaacacctgatcaagacacggattctttccaaggtccgctacccgctctaccttcagggcggcatccgcgatcccgagaatccacgagactacgctcgcaatgcggcaatccatgcaggacaggcatgcgtaataaatgaagacatagccgatttctaccccagtaccacaagccaccaggtgcgcgacatttggaaacatttctttaggttccccgctggagtggccgactgcttaactcgcctcaccactagaagggggttcctgcctcagggggcgaaaaccagcagctatctcgctaacctagtgttttggaggaccgagtatgagttggtgagacacttggctgcaaagggcctgcggtatagtaggctggccgacgatatcactgggtcatccagcaaaccactgacaaggggtcagaagtccgaagtcatatcagccgtgtattctttcatcaaacgcgatggattttcaccaaagtatcggaagcacgctatctttgagcggaacgaggctatgctggtaaacaacctcgtggtgaatgcccaccctgccctgcctgttagagaaagacaagccgtgcggtgtttagtacacagggcctctaatacgttgaacgccggcaacggtactgtgtctaatgtgcccctggctcatattaagggtaaaattggaaaggtcaaacgttttcatgccagagccggacggagactcgcagctacccttcaagcggccctcaccagcgttcaaaaattggacggctccggcgcacaccatcgaggtagggtggaccgagatcatcgtaatgcccggaggtacgacggacatctgcacgcccctgcaccagcagggagttga

SEQ ID NO: 11035 - RNA, 960 nt, unidentified
  source 1..960: mol_type = other RNA; note = synthetic construct
atgaaccgtctgtgctttagaggccgtcccatcgcatccatcgaggcgctggcatctaccttacacgttagcccaaggtatctgtggtgggtgatagaacgaactgatagactttacaggccaatgaaacctatcataaagccagacggctcagttaggcaaacctacaaccccgcagcccctctcaaagatgtgcagcgaagaatcaatcgcaacattttctcacgggtcgaatttcctatctacttgcagggtgggattcgagatcgcaagacaccgagacattgtgtcgcaaacgcccagctgcatacgaatgcggcgattgtgattaacgaggacatagccggattctttccctccatctctcggcagcaggtgcaggatgtttggcagcattttttcagatttccccttgcaattgctgaaaccttgactgccctcactacatacaatggtgccttgccccaaggtgcccctaccagctcttacctggccaacctggtgctctggaggcaagagccggagctggtcaccaatctggccgccagaggaatccgttattcgaggtacgtcgacgacattacgttaagtagcaagcgcttcctcaacaaccacctcaaggcagatgccgtgaggcaagtacggcgcctatgcaatggcaatgggttccgcatgaaggggcggaaggagcggatcgaaacctccggaaagccaatgagagttaacaatcttcagattaaccacggggtaacactccctaaaaaagagcgagctcggataagagctgctgtccgggtgtgtgaagtgtatcccgctgagtcacgcgacagtagcgagtatcagaaactgctgaattccactctgggcagggtgagcaggttgcgccagcttcacccaaaagaaggcgctgacctgatgcgacggctaacaatcatgaggggagcttctagaagtaagtga

SEQ ID NO: 11036 - RNA, 960 nt, unidentified
  source 1..960: mol_type = other RNA; note = synthetic construct
atgaaccgccctcgattcaagggcaggcccatcggctcgatagaggcactggcgcgcgcactttatgtttccctgcgccagttgcactgggctataggcagggccgatgccctttacaggcccatgaaacctataacaaaaccagacggatctgtgaggcaaacatacaatccagccgctcccttgaaggagattcagcgtagcatcaatagaaacattttcagtagggtgaagtttcctatttatctacagggaggaattcgcgacagaaataacccccgacactgcatcgccaatgctaagctgcactgtggcgccactatcgtgtttaacgaggatatcttttccttctttccatctatcactagaagacaagtccaggacgtttggcagaacctcttccgctttccgccagaaattgccgaagccctgaccatccttaccacctaccaaggaattttgccccagggcgctccaacttcctcctatctggcaaatctagtgctgtggcggcaagaacctgagctggtcacgaacctggctgcccggggtatccgctacagcagatacgtggatgacatcacattatcaagtagaaggttcatctgcaatcatcagaaggcagaagttattcagcaggtgcggcggctgtgcaatggtaacgggttcagaatgaaggggtgtaaggagaggatcgagactagcgggaagcctatgtgtgtcaacaacctccagataaatcacggggtaaccctccccaagaaagaacgggcacgtattcgggccgcggtacgagcttgcgaagtgtaccatagtgagtcacgcgattcaagcgagtatcagaaactgctgaactctacgctcggccgtgtctctcgattacggcagcttcatccgaaagagggtaccgacttgatgaggcggctcacaattatgaccgaagtatccagaagcaaatga

SEQ ID NO: 11037 - RNA, 948 nt, unidentified
  source 1..948: mol_type = other RNA; note = synthetic construct
atgaaccagccctgctttaaggataagcctatcgcatccactgctgccctggccagagccctgcatatcccacacaggcatctgacttgggcgacaaaccgagctgaccggctttaccgcgcattgcaacctatggtcaagcccgacggttcaattaggcaggtattcaacccggctcgacctttgaaggatattcagaggcgtattaacaggcacatatttggcagggtggacttccccttctatctgcagggcggcatacgtgatagaaagaatccacgccactgtctcgcaaacgcgaaactccactctgatgccaaaatagtcattaacgaggacatcagcggatttttcccgtctatcactaaaagacaggtccaaaatatttggcagcattttttccggttccctcccgatattgcgatcattctcaccaagttaaccatccacgacggacaacttccccagggcgctcctacaagctcctaccttgccaacctagcactgtgggaacacgagccacccacagtggaggcactgttcatcaaagggatccggtatagccgctatatagacgacatcaccctgtcaagtacatattttcagaacgaccacagtaaaacggctatgattagaaaggtgcggagcatgtgcaatcgcaataaatacgaggttaaaaggtccaaacatcgtattgaatcgtcaggacagccaatgcgaatcaataatctccagatcaataacgggatttctctgccaaagagggagagagcctgtatccgggctgccgtgcattcctgtgaaaagcacatcgaggaagagcgcaccgccaacgaataccacgtgttgtttaatagtaccgttggtcgcgtgaatcatctccggcaattccatagacacgaggggaagcgactactgaagagactggatgcctgcgcccctttatga

SEQ ID NO: 11038 - RNA, 909 nt, unidentified
  source 1..909: mol_type = other RNA; note = synthetic construct
atggaaaatgcggccgatagcctgtaccgtcccgtcatggtgaagaaaaaagacggcacacggcgcgagtgctttgacgcaaagccccctctgaaggccatgcaagcacggatccaaaacatgatcatgaagaaagtcatatacccaggctacctcaccggtggattggccgacccaaaaacgccccgagattatgtgcgcaatgccgaagcccacaccggggcaagactcatggtgaacgaggacgtggccaagttctttccttccactacccatgaggtggtctacgatatctggagattcgtattcagattcccaaaggaggttgcgaggacactgactaggttaacaactaggtgtggggaactgccgcagggtgctaaaacttcctcctatctcgcaaacttagtcttttgggctcacgaacctagactagtgcagtggctgcacaatgccgggtttagatacacacggtacatagacgatatcaccctcagctccactgccgataagaccagggaggagcttggacaggccattgggcgggtggctagtatgcttaggcgacatggtctgcgcttcaaacgctctaaacatcacattgcctatgccggagaacgaatggaggtgacgggcctcaccgttggcgagaggagcgttggcctgtcacgtaagcgtaagtctatgattagggcgagtgtgcgccagtgcgaatgggcagcaaaaaaaggaatctttgacgatgcgatgcagaagtctgctgcttcactggtcgggcagtatacacggcttcacagaaacaagggaaaagctctaaagcgccgattggcagccttggaagtaagcagaaagctgccagctattgagcccgtggtatcggctgttggcatcgagcctacaacccggtga

SEQ ID NO: 11039 - RNA, 1122 nt, unidentified
  source 1..1122: mol_type = other RNA; note = synthetic construct
atggacgccccaatatacccctttaagcccatacatagcattcgcgccctcgccttggccttaggggagtcagaacaattgctagaacggctcgccacccgcgctgatcaaatgtataggcatgtcccccaggaaaaaaaagtgaaaccgggtaagccaccggagatgagagatacatatgacgcacacgaaccactcaagagggttcagcggaaattggttgatcggattctgtccaaggcaacgttccctccttatctccacggcggcatcaaggaccgcaagagtcccagatcaatccacagcaacgcagcagtccatgccggagctaggttcgtgattcttcaggacatcaggaatttttacccttctatccttaagcggcacgtcgatgctctgttccgcggtctgtttgggttcggggcttccgtagctgccctcctgtccagtatttgtacccgagagggatcaactcctcagggagcctctacctcgggctatatcgcaaacctggtgttctgggacgtagagccaaaaattgtgaaaggcctactgggacgtgggtttcagtacactcgatttgcggatgacatcacaatttcctgcgggcgaaagccatcctctgacgaacttacgaacatcgtgtccactatcaccggcatgcttgcggctaaaggatgccaccagaagcggactaagctccacttacgcgtgagaggccagggcataaaagccgatggcgctatctttcagcctgtcacagtgaccggactgagcgtgttcaattctagtcccggactgaccaagctggagcggcgtagaataagatctgcagtgagggaattcgaggttatgagtgagtcaaccaacaattggagcgacctggaaagcacttatcatagagctatgggccgcgtcgggaggttattggcctgtgggcatcccgacggtgccatgctgaaagagaggctgaacctcgttatgagatcataccaggcccctctgctggagcgttaccaacaagcgattgtggccaattctaatacagagacaagctccctggctgcaccgccaatccttgagtacagcagtgaacaggatggtcccttgccttggcagtga

SEQ ID NO: 11040 - RNA, 1071 nt, unidentified
  source 1..1071: mol_type = other RNA; note = synthetic construct
atggatgctcccacttatcctttcaaacctatccattctctaagggttttagctctggccctcggagagagcgagcaacttctggagcgcttggcagcaagagccgatcgcatgtatcgtcacgttccacaggagaagaaggtgaaaccggggaaacctcctgagactcgtgacacgtatgacgcccatgaacccctgaagagagtgcagcggaagattgtagataggatcctgtgcaacgctaccttcccccagtaccttcacgggggcatacgggatagaaagagtcccagatctattcacagcaacgcagccatacacgcaggcgccaggtttgtcatcctgcaggacattaagaacttctacccatcaatctccattaaacatgttgatgccctctttcgaggtttattcgggtttggcgcaggagtgtccgtcctactgtcaagcatatgcaccagagagggatgtacaccacagggcgcaagcacctccgggtacatcgctaatttggtgttctgggacgttgagcctaaagtggtgaatgacctgctgggccgggggtttcggtacagcaggttcgctgatgacgtaacaattagtagcggtcacgaaccatccagcgatgacctcactaacatcatttctaccatcaccgggatgttggcggcaaagggatgtcaccagaagcgaaccaagctgcacattcgcgtaagaggacaaggcatcgaagccgatgacgccacatttcagcccatcacggtcacaggactctctgtgtttaatagtagtccaggtctgactaagctcgaacggaaacggatacgatcggcggtcagggagcttgaagtgatgtccgagtctacatcggactggactgtgttggaacccaaataccatcgcgctatgggcagagtgggcaggcttctcgcgtgtggccatcctgacggtgaagctctgaaagccaggttaaatgtggctaagcgctcctgccagattccgctgctcgagcgctatcagcaagccatctcagagtcactggccaaagccgttgaagtcgatgtcgagtga

SEQ ID NO: 11041 - RNA, 1125 nt, unidentified
  source 1..1125: mol_type = other RNA; note = synthetic construct
atgaaggcacccctgtatccacataagccaattcactctatcagggcccttgccctggcactcggggaatctgaggccttgcttgagcggttggctgcccgtgcagacaggatgtaccggcacgtgcctcaagaaaagaaagtgaagccaggacagcctccagagacgagggatacttacgatgctcatgaacctctcaagagaattcagaggaaattagtcgatcgggtgctgagtaaggcgattttccccacctatctgcatggcggaatcagagactgcaaaagcccgagatccatccactctaatgcagcagtgcacgctggcgccaggtttgttatcctccaggacatacggaacttctacccctcaatttccaaatcacacgtgcatgctatgtttcggggattgttcggatttggggccggcgtcgccgaactgcttagttcgttatgtacccgctcagggtccacccctcaaggggcatccacttctggctacatcgcaaatctggtattctgggatgttgagcctaaggttgtcagcgacctcagcgggaagggtttccagtatagtcgctttgctgatgacattactatatcctgtacaagagaacccgaagcggacgagctgaccggcatcgtatctgccataacaggcatgcttgccagcaagggctgccatcagaagaggtcgaaactgcacgtgcgaatccgcggtcaggctctcaagtcagaagggactactttccaacccatcaccgtcacaggattgtccatctttaacgctagtcccggactgaccaaatccgagagaaaaagaattcgcagcgccgtgcgcgagctggaactaagcagtgagacaacgagcaattgggttgagctggagcctatgtaccaccgggcgatgggtcgagtgggtcgtttgctggcctgcgctcacccagacggcgaaagcctaaaagtccgactcaatcttattaaacgctcttacgaaaagcctctgctcgagaggtatcagcaggagatagtggaacagtccgcgagagagatcaacaacgtgagctgtgcccgtacactgccctcacaaccgaccgagcccgtagattctccaccatgggagtga

SEQ ID NO: 11042 - RNA, 1083 nt, unidentified
  source 1..1083: mol_type = other RNA; note = synthetic construct
atgaaaagtctggcactcgctttgggcgaaagcgaacaactactggaacgtctggccgccagagcagaccgcatgtatcgccacgtaccccagcaaaagaaagtgaagcccggaatgcctccagagactcgtgacacgtacgatgctcatgagcctctgaagcgtgtgcagaggaagttggtggaccggcttctgtccaaggccgtgttcccggcatacctgcatggcggtatcaaagaccgacagtcacctcggagtattcactcgaacgccgctgttcacgccggctcaaagtacctcgtcctgcaagacattcagaatttttacccctccatttcaatgcaacaggtggatgcgctcttccgccagttgtttggtttctccacaccagtggccacactgctgtcctccatctgcaccagggaaggaagcaccccgcagggtgcctcgacatctggatacatcgcgaacctgctgttctgggatgtagaacctaagatagtcgaagatttaatggggaggggttttcagtatagccgctttgcagatgatataaccgtgtcttgcagacacgagccaagcagcgatgaactatccgatatcgttagtacaatcactgggatgctggcaagtaaggggtgtcggcagaaacgggccaaactgcacatccgagtgagaggccaggggattaaagctgacgatgctacgttccagcccgttactgtcaccggcttgagcgtgtttaacccaactcctggactcaccaagagcgagaggaagtgcattcggtctgctgtgagagagctggaattgatgtctgaggccggctctcgatggttagacctggagcccgtctataatcgcgcaatggggcgcgtcggaaggctcatcgcttgtggccatccagacggcaaggccttcaaaggacggcttaatgcggtcaaactctcacatcaaaccccccttcttgacaggtatcagctcgcagctacaggagtagcggagtccgccactcctcctgttggggtgggccttagagagccatactctgccgagagagacgggcccttaccgtgggactga

SEQ ID NO: 11043 - RNA, 1047 nt, unidentified
  source 1..1047: mol_type = other RNA; note = synthetic construct
atggaagccccaatctacccatttcgccctatccatagcacccaggctttagctctggccttgggggagtcagaacatcttcttgaacgactggcggtgcgtgccgacaggatgtaccggcacgtgccccagaagaaaaaaggtagaccaggcgagactagagacacgtacgacgcacatgagccgttgaagcgcgtccaaagaaagctggtcgatcgggtcttaagtaaggctatatttcctgcatacctgcacggggggatcagagatctgaagagcccgcgctcaattcactctaatgctgcggtccacgccggagctcgcttcgttattctgcaggacatcaggaacttctatccctcaatatctaagattcaagtggacgcgctttttaggggcttgtttggcttcggagcctccgtggctgccctactgtcctctatctgtactcgtgatagctgcgtgccacagggagccagttcaagtggttatatcgctaatctcgtgttttgggatgtggagcctaaagtggtgaaagacctccaggaccgcggattccagtactccaggtttgctgacgacattaccattagctctggccaggaaccttcgacagaggagatttccactatagtaagtacaatcacaggcatgttggcatcaaagggctgtcgccaaaaacgaaccaagttgcatatgcggattcggggacaggggatcaagagcaatgatgccaccttccaacctgtaactgtgacgggcctttcggtgttcaactctgcccccggtctgaccaagctcgaacggaaaagaatccgaagtgcagtcagagaactggaactgctgagggagttaacatccgattgggccgatctcgagccaaaataccaccgggcaatggggagggttgggaggctcctagcatgcggccaccccgatggagtagccctgaaatccagactgaacgttgttaaacgaagctatcagaagtctctcctcgagcgttatcagcagagcgagaacgcaagccccaattccgactcctga

SEQ ID NO: 11044 - RNA, 1047 nt, unidentified
  source 1..1047: mol_type = other RNA; note = synthetic construct
atggaggcaccgatttatccatttaagccaatttactcggctcagtcacttgctctggctctgggcgagtccgaacacctactggaacgattggccgtacgtgctgataggatgtacaggcatgttcctcagaagaagaaaggcaagcctggggagacaagggacacatatgacgcctacgagcctctcaagagagtgcagaggaaactcgttgatagagtgctatccaaagcgatctttcccgcctatttgcacggagggatcagagacttaaagagcccacgctcgatccatagcaatgcagccgtccacgccggagctcggtttgtgatcctgcaggacatccgaaacttctacccctctattagtaagattcaggtcgatactctcttcagaggccttttcggatttgcagccggcgtgtctgccttgttggcgtccatttgtacccgtggggaatcaacaccccagggagctagcactagtggctacatcgccaatctcatcttttgggacgtggagccgaaaattgtcaaatccctgaccgatcgggggttccagtactcccgcttcgccgatgacatcaccataagctgcataagagagccatctagtgaggaactgagtgacattgtgagcaccattaccggcatgttagcatctaagggttgccaccagaagcggtctaaactgcacatgcgcgtacggggccaagggatacgtgccgatgacgcaacgttcctgcccgttaccgtgactggtctgtccgtctttaacggcactccatcactcacgaagctggaaaggaaacgaatcagatctgcggtgaaggagcttgaggtgatctcaggaagcatgcctgagtgggctgcgctcgaacctatgtatcatcgggccatgggtagggttggccgcctccttgcatgtggacatcccgatggggaagcactgaaagcccgcctgaacgtcataaaacggagctaccaaacacccttactggagcgctatcaacagacacttaacgctgaatatgagggtctgaattga

SEQ ID NO: 11045 - RNA, 1053 nt, unidentified
  source 1..1053: mol_type = other RNA; note = synthetic construct
atggacgctccaacgtatcctttcaagcctattcattctatccaggccttggccctcgcgctggatgaaagcgagagactgttggagaggcttgccattcgcgcagatcgcatgtatcggcacgtgccacaggagaaaaaggggaaacggcgagacacctacgacgcacatgaaccacttaaacgtgtacaacgcaagttggtagatagggtgctgagtaaggccatctttcccgcctacctgcacggcggtataagagacagaaagtcacctcggagtatccactcgaatgcttctgtgcacgctggtgccagatatgtcattctccaagatatacgaaacttctaccccagcatcctgaagtcccaggtcgacgatctgtttagagggctatttggattcggtgcctccgtatcagcactgctctcacttatctgcaccagggatggatgcgctccgcagggagctagcacaagtggctacattgcaaatctgatcttctggaatgtggaaccaaaaattgtccaggacttcttagctcaaggcttccagtacagcaggtttgcagatgacattactatatcctgcagccgcgaacccacctccgaggaactgagcggcatcgtgtctaccgttacaggaatgctggctgccaaggggtgccatcagaaacgcaccaagcttcacatgcgtgtgcggggccagggaattaagggggacgatgccacttttacgccgctcactgtgactggactgtctgtctttaacggcgctcccagcctcacaaaactcgagagaaagcggatccgatccgccgtgaaagagttagaagtgatgtcagagtccacacctgggtgggccgtcttggagccaaagtatcatcgcgcaatgggcagggttgggaggttactagcgtgtggtcatcccgacggagaagccctgaaagcgaggctcaacgttgtcaagcggtcttgtcagatccctctgcacgagagataccaacaggccatcagtgaatgtctggcaaaagctgttgaggtggacgtgggctga

SEQ ID NO: 11046 - RNA, 1011 nt, unidentified
  source 1..1011: mol_type = other RNA; note = synthetic construct
atggacgcccccacctatccactgaaaccaatccatagtatacaagccctagccctggctctcggcgagtcagaaagattactcgaaaggctggccgctagagctgatcggatgtacaggcacgtcccacaagagaaaaaggggaagaagcgagatacatatgacgcgcacgaacctctgaaacgcgtccagagaaaactggtggaccggattctgtcgcgcgctatatttcctcgttatctccatggaggtatcagggatataaagactcccagaagcatcttgagtaatgcagcaccacatgcaggagccaagtacgtgattctacaggacatcaagaacttctacccctccattagcgttgatcaggtagaggcccttttccggggactgttcggattcggcgtgcccgtttcagccctgctcagctcaatctgcacgcgcgaaggctctactcctcaaggtgcgagcactagtggctacatcgcaaacttaattttttgggacgttgagcccaaaatcgtcagatccttgctggacgatgggtttcaatactccaggtttgccgacgatataaccatttcctctggccggaaaccttcgtcagatgagctctctttcattgtttctacagtcaccggcatgcttgcatccaaggggtgccaccagaagcgtgcaaagcttcacatgcgggtgcgcggacagggcatcaaagaagacgatcagacatttaagccgttgacggtgaccggtctgtccgtctataatagcgcccccgggcttaccaaactcgagaggaaacgcatcagaagcgctgtgcgcgagttggagattgcgagcgaaagtgtgagagactggaacgtgctggagcctatgtaccaccgtgctatgggtcgggtagggaggttgctggcctgtaggcacccagacggagaggccttaaaggctcgacttaatacactgaagcattctcatcagaagccgctcctggaacgatatcagcaggtgtga

SEQ ID NO: 11047 - RNA, 1113 nt, unidentified
  source 1..1113: mol_type = other RNA; note = synthetic construct
atggatgctccaacttatccgtttaagcccatctactcattacgcgcactggcccttgctctgggggaagacgaacgtctgctggagagggtggccgctagagctgacagaatgtacagacacgtacctcaggagaagaaagggacgaaaggcgaaattaggcatacttatgatgcgcatgagccgttaaagagggttcagagaaaggtagtggatcgcatactcgctaaagcaaaatttccactatacctgcatgggggaatccgggatgtttcctcaccacgaagcatcctgagcaatgccatggtccacgccggcgcgaggtacgttgtcctgcaggacattgagaacttcttccccagtatcagcacacaccaggtcttcaggatctatcgggacctttttggttttggggagcctgtgtccatgctgctggccagtattagcacccgggaggggtctacaccccaaggtgcgagcaccagtggctatctagcaaacctgctgttctgggacgtggagcctaaagtggtcaacgaacttttcatacgggactttcgatactctcgattcgctgatgatatcaccatctcctccgagcgcaagcctacccctcaagagttggcagacattatctcaacgattaccgggatgctcgcttcaaagggatgccggcaaaagcgcaagaaactccacgtcagggtgcgcggacagggagtgaaagtggcagaaggcgactatgaagccttgacagtgactggcctgtctgtttttaattccacacccggcctgaccaaactggagcggaagagaattaggagcgctgtgcgggagctcgaaattctggcctcgtctacaccctcatggagcactatagaaccacgctaccatcaggtcatgggtcgtgtgggccgtctgttggcatgtggacaccccgatggtgaggcccttaagatccgattgaactctgtgaagagattatgccaggtgccactgcttgagaggtacagactcggcctatccgatgacaaagacgtcttggaactcgcctgttccagtgcctctggcgttgccccaagtctcggagtaaatgaacccctcccttgggagtga

SEQ ID NO: 11048 - RNA, 1029 nt, unidentified
  source 1..1029: mol_type = other RNA; note = synthetic construct
atggagtacccactgtatccacataggcctatacacaatttaaactcattggctttgctgctgggagagcctttaagcctgctcatcaaactggcacgcaattccgacaaattgtaccgcaaggtgccacaagttaagaaagatggcaccacgcgggagacattcgacgccagcgagcctctcaaatccatccagcgcaaggtagttgataggctgctggttaaggtgctcttccctaactaccttcatgggggcatacgtgatattaactccccgcggtctgtgtactctaatgtgaaaacccacgtgggtgctagaagtatcattttgcaggacattaagaacttcttccccagcattaccctcgaacgggtcttttccgttttcaaaggcttaatggggttttctgacgcagtgtccaatgtccttgcccacctggtcactcgatatggagcagtcccccaaggcgccagtactagcagctatatcgcgaacctggtattttgggatgtggagccccggctggtggcttggatcaggaaccagaagatggcctactcaagatttgccgatgacatcacaatatcatcgttcgatatgataagtgacgacctgaagaccgaggtagtgcgaagggtgactgggatgcttgcagcaaaagggtttgcgcagaagaggcagaaactgcatgtgctgaagagaggtcaagctattacaaaggccaaccagagcgaagtcgccgtgatcaccggactatctgtcgccggccctagacccggagtcacgaaggaagaacgcaaaaaaatccgctctgctgtaaaagaattcgagacactggccctcatgaatccagattcagatcgtctcaaggagctctataatagagccatgggtcggattggccgactacttgcatgcgggcagagtgacggattcgcgttgaaacagaggatgaatattgctttcgaaaagactaagaagtccatctttgttaagcacgcttttatcgagaacaccgtgcccgactga

SEQ ID NO: 11049 - RNA, 1032 nt, unidentified
  source 1..1032: mol_type = other RNA; note = synthetic construct
atggattctcccctatatccctacaagagcattcacaatattaagtccctggccttactcttgggggaaaccgtgcccttgctgaacaaacttgcagaggactcacataagatgtacaggagggtccctcaggtgaagaaagacgggtccgaaagagagacattcgatgcgcatgagcctctgaaaagcgttcagcgcaagatagtggatcgcctactcgcaaaagtgtcctacccagattatctccacggggggatcagggacagtaactacccccggtcaatatatagtaatgtgaagagtcactctggggctcgcaacttggtcctgcaagacattaaaaactttttcccctccattacaatcgacaaagtgcttagtatcttcaaaggtatgatggggttcggagatgaggttgcggtcatgctgactcgactggtgacaaagggaggcatcgttcctcagggcgcctccaccagctcctacatcgctaatttagtcttttggaacgtggaaccacggcttgtggtgtggatccgagctctgggcatgtcatattctcgcttcgctgacgacatatctatttcgtctaagaacatcattctgccggatcagaagaccgaaatcgtacgtagggtcaccggcatgttggcagccaagggctttttacagaagagacagaagatgcatgtcctcaaaaaaggacagactatcactacggccaaaaaaccggagccagtagtagtgacaggactttcagtcgccggacctagaccaggtgttaccaaggaggagcggaagaagatacgcagcgccgttcgagaatttgagatcttggctgaggctggtgccgatctgattaaactccgggaactctacaatagagccatgggaagggtggggcgtcttctggcctgtggccaaagcgacggtctggcactcaaaaatcggctgaatctggcaatgagacaatgcaacaagcctctgctggaaaagtatgaaaagggcgaggtgggcggcattagcatctga

SEQ ID NO: 11050 - RNA, 1047 nt, unidentified
  source 1..1047: mol_type = other RNA; note = synthetic construct
atggacaagcctcgctactcacaaaagcccatttttaacattgagtcgctcgccctgcgcttgggagaatccccaatgctgttaaataatctggctcgaaacagtcaccgactctatcggacagttccccagcagaagaaggacggctcagtgagggaaaccttcgacgcccatcaacccctcaaagccattcagagaaagatcgtggatagaatctttagtggtgtgatcttcccagactaccttcatggcggaatacgtgatgtcaattctccacgatccatttattcaaatgtggcttgtcacgctggggcaagggtcgttctcatgcaggacattaaaaatttcttcccctccattaccgaggataaggttcttggcgtcttcaaaggcgtactgggcttcggagatgatgtaagtagtctgctggtgaagttgactacacgccggggagtagtccctcaaggggcaagcacgtcctcttacctggccaacctggttttttgggatgtggagcctcggttagtcacttgggttaaggccaacaatctcagctactctagatttgcagatgacattaccataagctccaagggagacgtaagagatgaattaaaaaccgatgtgatacgcaaagtgactgggatgctggcgtccaaagggttctatcagaagcggcagaagatgcacgtgcttaaaaaggggcaggtcatcgtgacaaaaggtggtgttgagccgtttgtcatcacaggcctggctgtgtctggacccaacccaggcgtggcaaaattcgaacgtaagaagattagggccgccgtaaaagagtttgaagacttgatcgggagcggtgtgtttgtcagcgacgttgaaaacaagtacaactcagctatgggcagggtgggaaggctaatcgcctgcggccagagcgacgggatcatcctgaaggagagacttaatgctgcacggctcaaagcctctgtcccgctattggagaaatatctggcggcgaacatcatacctgtggtgcaggccaaggtggaggagtga

SEQ ID NO: 11051 - RNA, 1044 nt, unidentified
  source 1..1044: mol_type = other RNA; note = synthetic construct
atgacaactgccaggtacactcgtaagcctgtgtacagcctcaaaaccctcggactgatgctcggcgagtccccagagttgctgctgagactgggcgcctcaagcagtggattttatcgggaggtgctacagcaaaaaaaagataagtctgtgcgtgttaccttcgatgccttccagcccctgaagagagtccaacgcaaaattgtcgaccggctgcttattcatgtaagctacccttcctacctgcacgggggaattagggacgtagactcccctcgctcccctctgagcaatgctagagcgcacttaggcgccaaatctatagcgctgcaggatattacgaacttcttccccagtatatctagggacaaggtccggaatattttcacaggattgttcggatttggctctggagtggcagagcttttgtccctgctggtcacgaaggacggcttcgttccccagggcgcttcaacaagctcctatttagccaacttagtgttttgggacgtcgagccgcgcttggtcagctggatacatagtcagaaccttatttatacaaggttcgccgacgatatcacaatctctagtaaggtgctggtgagcgatgaacagtggactgaaatcatatcgaaggtgaccggcatgcttgcaaccaaaggttttaagcagaaacgaactaagctccatgtgctcaaaaagggccaagctctgaccaaagggaataagcccgaaccactcgtcatcaccggtctggggatctccgggtcatctaccggtgtggtgaaggccgaacggcacaagatcagagcggccgtacgacagtttgaggctgctattgaaagcggttccagcttcgatgaggtggcacacctgtatcactcagccatggggagggttgggagaatgctcgcctgcggccaaccatcggggtttgaatttaagaaacgcttgaacgaggcaaagcgactaggccagatctctcttatcgataaatacatcgcagaaacttcagctgttagtgacgaggaggttcggggatga

SEQ ID NO: 11052 - RNA, 1041 nt, unidentified
  source 1..1041: mol_type = other RNA; note = synthetic construct
atggatgccatcctataccactgccgccccatatactctctgaagtccctggcgcttgcactgggtgagtccgtggaatttcttggctggttagcttgccaagccgattccctttaccggcccgtgcaactggtgaagaaagatggcaccccgaggtacgcttatgacgcgagagcagacctgaagaaggtgcaaagaaagatagtggatagaatcctcgctcgggtcgtttaccctaaatacctccatgggggcataaaggacgccgacttccgcaggagcatttattcaaacgccaatctgcataccggggccaagtcatatatcgtgcaggatatcagtaacttcttcccttccatcagctttgctaaggtgtatgacgttttctccctgttctttaactttggccacgtcgtcgctcacctgttgactaggctagtcactcgagccggagttgtcccacagggggcgtcaacttcttcttatctggccaatctcgtattttgggacgttgagcctgaagtcgtattgggattgaaggaaaagggattctgttacagtcgtttcgccgatgacattacagtctctagcccaagtgcgttgagtgccgatgaaaaaaccgagatagtgacaaaggtgacaggaatgctcgcccggaagggatttaaacagaagcgctccaaaatgcacgtgttaaaaaaaggccaggccattgctctctctaatgggaaatatgagcctgcccttatcacggggctctcgatcagcggacccaagccagttatcacaaaaaaggagaggaataggattagaggcctggtgaagaactaccaggctctcattgacatggggcgacccgacagcgagctggaaaaagtatttcacaaggtgatgggccaggtgggtcgcattattgcatgtggccaggcagagggtgcagagttaaagaaaaccctgaatgaagcacggagactgtcgaaaaaatctatcttcgagcgtcatgattccctgatcaacgcaagcgaaagctcacaggcttga

SEQ ID NO: 11053 - RNA, 1116 nt, unidentified
  source 1..1116: mol_type = other RNA; note = synthetic construct
atggacgcccccttttaccctcacagctcaatcaattccatcaaggctctggctagggccttgggtgaacccgctgaacgattgctcgcactagctcagaggagttcacgcctctaccgttatgtgccacagaccaagaaggacggcattacaccacgacatacttacgacgcccatgagcctctgaagaccattcaaagaaaaatcgttgaccgggtccttagtaaggtaacgtacccagagtatctccatgggggcatccgcgatcccaaattaccacgcagtatctattccaacgcgcgtatacacattggagccaagactgtgatcttgcaggacattgccgattttttcccctccataacaactgagcacattcagagactgtttgtggggctcttcaggttcagcgccgatgtggccagccttctggcctcactggttactcgggaaggacaggtgccgcaaggagccagtacctctagctatttggctaatctggtattttgggatatagagccagccctggtcacccggtttaaagcccagggaatggcatactctcgattcgctgacgatatcacagtgtcgagcaaaacccgcatcgcttccgcagctactacgcaggttattgcatctgtcacctggatgctgggtcagaaaggttgcctccaaaagagatcaaagctgcacgtgcgcaaaaggggtcaggcattgatcacaggcgagaaagccgaagcagtcacggtgacaggcctggtggtgaatgggccgatacctgcgctccctaaaaaggccagactggctattcggtctgcagtcaaacagctggaagatagggttcggggcaactccggacagctgagcgcggaagacgataaggaggtcaggagagtaatggggcgcatcggccggcttattgcttgtgggcatccggaaggacctcggttaaaggccagagtgcgtgtcctactggcacgaaccccccttttcaagaggtacgcggccggcgtggagatccaaccactcgtggtagctgacacaccccttggcctgaacgcagttgccaacactctacctcacgggcagagagagttaccctggtataccgagtga

SEQ ID NO: 11054 - RNA, 1122 nt, unidentified
  source 1..1122: mol_type = other RNA; note = synthetic construct
atggatgcacctttttatccgcacagtccaattcactcagtgaaagcactcgcccgcgccttaggagaaccagcagagagactcctggccctagcgcaaaggtcttcccgattgtacagatacgtgcctcagaccaagaaggacggggtgactcctaggcacacctatgacgctcatgagcctctgaagacgatccagagaaaaattgtggatagaatgctgtgcaaggtgatctatccagagtatctccatggaggtataaaggacgcaaaactgcccagatctatttacagcaatgcccgtgtgcatatcggtgcgaaaacagtcgtgctgcaggatattgcggatttcttcccctctatcacaacggaacatatccaccgagtgttcgttgggttatttagattcagtcccgttgtggccactcttttagcgtcccttgtaactcgcgaagggcaggtcccacagggagcctcaacctcatcctacctggccaacctggtcttttgggacgttgagcccgccctggttaagaggtttgccgcacaggagatggcttactcacggtttgctgacgacatcactgtgagcagcaaaacacacatatcccctattgccaccacccagatcatcgcttctgtgacttggatgctcggccagaagggctgtctgcagaagcggtctaagttgcatgtgcgcaaaagggggcaagcactcattaccggggacaaggccgacgctgtaactgtcaccggcttggttgtcaacggctccatccccgctctgccaaagcaagccagactggctatccgagccgccgtgaagcagctggaggatagggtcgagggaaatagcggccaactaagcgccgaggatgagaaagaggtacggagggtgatgggccggattggtcggctcatagcttgcggccaccccgaaggacagcgtttgaaagctcgcgttagggcagtgcttacaaaagaaaccctgttcaaacgctacacagcagatcctgaattccacccacacgtcgtggctgcaacaagtgaaaagcggggtgtcccggtaagttcgattgggagcataaagccgcttcgcgaccctccctggaacaaagaatga

SEQ ID NO: 11055 - RNA, 1116 nt, unidentified
  source 1..1116: mol_type = other RNA; note = synthetic construct
atggacgctccgttctatccccactctcctatccactcaatcagcgctcttgctagggccctcggagaacctgtcgagcgacttatcgccctcgcgcatcgtagctcgcgattgtaccgttatgttcctcagaccaagaaagacggaataactcctcggcatacctacgacgcacatgaacccctcaaaacgatccaaaggaagattgtggatagaatcttatctaaggtcgctttccctggttaccttcacggaggtattcgggacccaaagctgccaaggagcatttattctaatgcaagagtgcacactggagcgaaaaccgtgatcctgcaggacatagccgacttctttccctcaatcaccaacgagcatatacacaggcttttcgtgggcttatttcggtttagcgctgatgtggcaacgctgttagccgacctggtgacccgagagggccaggttccacagggagcgagtacttcatcctatctggcaaacctcgtattttgggatatcgaacccgcactggtcacacgcttcaaagcccaaggcttggcctactccaggtttgctgacgatattactgtgtcttccaagacacggattgatcaggccaccacttcccaagttattgctagcgtgacctggatgctggggcagaaaggctgtctgcagaagcgttcaaagctccacgtcaggaagagaggccaggctctgatcacaagtgataaggcggatgccgttactgtgacaggattggttgtcaacggtccaatcccagccctgccaaaaaagcacagaatggccatacgcgcagccgtaaaacagctagaagaccgcttcgaggggaattccgggcagctgagtgcagacgacgaaaaagaggcccgcagagtgatgggtcgcattggcagacttatcgcctgcgggcatccggaggggcaaaggttgaaggcccgggtacgcgtactgctgatgagagcccccttgatggagcggtacgctgataccgaatttcaggtccaaatggtggcagagacaacagctgatctcgatgtggccgcaagtagcctgcagattgatctacctgtggacctcccctggaaagtcggctga

SEQ ID NO: 11056 - RNA, 1089 nt, unidentified
  source 1..1089: mol_type = other RNA; note = synthetic construct
atggacgctccactgtacccgcattccccaatccactcaatcaatgctcttgccagagcactgggcgagccagcagaaagactcctcgcgctggctcagaggacgtcccgtctgtaccgatatgtcgctcagactaagaaggacagaatcacccctcgccatacttacgacgcccacgagccgctgaagaccattcagcgaaaaattgtagaccggatgcttagaaaggtcgtgtatcccaggtatctgcatggcggcatccgtgaccgcaaacttccccggagcatctatagcaacgcgcgcgtccacacaggcgccaaaaccgtcattctgcaagacatttcagatttctttccttccatcacaacagagcatattcaaaggctattcgtggggctgtttcggttcagcgccgacgttgcaagtctgctcgctaacttggttacccgggaggggcaggtccctcaaggtgcttcgacctctagctacttagccaatctggtgttctgggatatcgagcctgccctcgttacacgctttgaggcgcagggtttggcatactcccgctttgccgatgatattaccgtgagttctaggtcacccataagtgccgcggtgaccacacaggtgatagcatccgtgacctggatgctaagccagaagggatgcctccaaaaacggagcaaacttcacgtaagaaagcgaggacaggctctcttgtccggtgagtcagccgaagctgtgacggtcactggcctcgtggtggataaaccgatcccagggctgccaaagaaggtaagactggccatacgggcagccgtgaagcagcttgaagacagggtgaagggagacttacgtcaactgagggccgaagatgagaaagaagctcggcggctgatgggaaggatagggcgcttgattgcatgtgggcaccctgaaggccagagattgaaggcccgagttagggttctcctgactcgcgctcccctactggagagttacgccgcagatgccgatcaccagcctagattacccgccgcaaaactgccctcttcttatcccgacactccaacaatctctgatcagtga

SEQ ID NO: 11057 - RNA, 1122 nt, unidentified
  source 1..1122: mol_type = other RNA; note = synthetic construct
atggatgtgcccttctacccacataacccaatccatagcgtgaaggctctcgcgagggcattgggtgagccagtcgagcggcttttagccctggcccagcggagctcaaggctgtacagatacgtgccacagacaaagaaagatggcataactccgagacacacatacgatgctcatgaaccgctgaaaactattcagcggaagattgttgacaggatgctctgcaaggtgacctaccctgggtatctgcacgggggcatcaaggacgcaaaataccctaggtctatttacagtaacgccagagtccatactggggccaagaccgtgattctgcaggacatcgctgattttttcccttccatcaccacagaacacatccatcgcatttttgtcggcctgttttctttctcagccgaagtggcgactctgctggcgaatttagtgacccgagacggacaggttcctcaaggagccagcacgtcctcctatctcgctaatctggtattctgggacatcgagcccgccttagtcatccgattcaaggcgcagggtctggaatatagtcgttttgctgacgacataacagtctcctctaaagcccgcattagtcctgccgctactacacagattattgcttccgtcacttggatgttgggacaaaagggatgcttccagaaaaggagcaagctccacgtgagaaagcggggccaggctctcattaccggggagaaggcagaggctatcaccgtaaccggcctggtggtggataagccgatccctgccctcccaaaaaaggcacgcctggcaatccgtgccgcagtgaaacagctggaggatagggtccacggctatccaggccagctgtcaatagaggacgaaaaagaggttcgtcgggttatggggcgcatcggaagactgatcgcatgtggtcaccccgaagggcaacggttgaaaacccgcgtgcgcgcccttttgacacgagctcccctacttgagagatatgtggccgatgctgaatttcagcctcaaatggttgccgccacgtctggcgagctttcggtaatggccgcaagcgcattgcccatagatctcccccttgacctaccctgggaagcgggatga

SEQ ID NO: 11058 - RNA, 1155 nt, unidentified
  source 1..1155: mol_type = other RNA; note = synthetic construct
atggaagcacccttatacccgcactcacccatctacagcgtaaaagccttggctcgggccctggatgaaccattcgaacgcctggtggctctcgctaagcgttcaagcaggctgtacaggtacgtgcctcagttcaaaaaggacggcatcacgcccaggcacacgtatgacgcatacgagccgctcaagaccatacagcgaaagattgtggacaggatcctctccaaagtgaactatccccgatatcttcacggaggcattaaggacgcgaagcaaccccgatccatttattctaacgccagagttcacgccggtgcaaagacagttatcctgcaggatatcgcagattttttccccactatcactactgagcatattcgcctaatatttaccggtctgtttcggttttcagaggacgtgggtgccttactcgcagctttggtcacacgggagggccaagtcccacagggagccagtaccagttcttatctggctaatctggttttctgggatatagagccagctctcgtggcgcgcttcaaagcacaggggctggagttttcgagatttgctgacgatatcacagttagctcaaagtcgaatctgcgcgacgccgtaactgcccagatcatttcctccgtgacatggatgctagggcagaagggctgccagcaaaagaggagtaaaatgcatgtgcggaaaagaggccaggccctgctgcggaccgaaaaagctgaggcagtaacagtcaccgggctcgtcgtcgaccggccaactttgtctctgcctaaaaaggagcgaatggcaattcgtgcggccgtgaaacagctcgagctgcgggtagtgggacatcaggggcagttcagcgaagaagacgatagggagattcgccgtgtgatggggagaatcggccgcttgatagcctgtggacaccctgatggtcagagacttaagtctagagtcagggccttgttaatggccgctcctctgctggacagatacatgggcagcgacgaagtgcctgttgtgatgcttgcgtctaccgacgagcttgttagcaccgagagcgccgctgtggaggatctagatctcccatgggatgtcaacgaactgtcccttgcctgcaagcaaaggagtcaaggatccgaaacatga

SEQ ID NO: 11059 - RNA, 1062 nt, unidentified
  source 1..1062: mol_type = other RNA; note = synthetic construct
atggaggttctacgttatccctattcaccaattcactccttaaacgccctggctagagccctcgatgaaccagcagaacgactcgtggctatcgcaaaacgctccagccgcctgtatcggtacgtgccacaaaaaaaaaaagatggcataactccccgccacacctatgacgcacacgaacctttgaagtccatacaacggaagatcgtggataggatgttaaccaaggtcagttaccctgactaccttcaaggtgggattaaggatgcccgtaatcccaggagtatctacgccaacgcgagggtgcatgcggggtcgaaagtggtcattctgcaggatattgctgacttctttcctagtattaccgttgcccacgtccgcgaggtatttagcaagctcttcggattcagccatgacgtcgcccagctgctggctaatcttgttacgagggaaggccaggtaccccaaggcgcctctacctcttcatacctggccaaccttgtcttttgggatattgaacccgccctgatagagaggctcaaggctaagggccttcgttactctcgattcgcagacgacatcacagttagctccaaggctgagatcacacaggattcagtgactcagattatcggatctgtgacttggatgctgggtcagaagggatgccggcctaaacgcagcaaactgcatgttcgcaagagaggacaggcgctgatcagcgatgagaaaatcaatgcggtgacagtgacgggtctggtaatcgacaggtcatttcctggattgccgaagaaggaacggatggctatccgagcagcagtgaagcagctggaggacagtgcctgtgaatggccagaaggcccacccgccgaggagaaaaaggcaatacagagactcatgggcaggatcgggagactaattgcctgtgggcaccctgacgggcagcggttaaaagctagagtgagaacagtgaccagattggtcccattgattgagcggtataccccgaacgtagtggagtccgtcactctcaatcaaacagcccaggaccccgctcagtga

SEQ ID NO: 11060 - RNA, 1038 nt, unidentified
  source 1..1038: mol_type = other RNA; note = synthetic construct
atggatgccctgcattacccccacagtcctatttactcagtctcagccctggcacgggccctaggagaaccgactgaacgactgatagcccttgccaagcgtggtagccggctctaccgctacgtgccccagaccaagaaagatggaaagacccctaggcacacatatgatgcacacgagccactgaagacgatacaacggaagattgtggaccggatcctgtcgaaaatttcatatccctgctacctgcagggaggcatcaaggacgtgcacgctcccaggtccatctatgccaacgctcgagtccatgcggggagcaaatcaatcatattacaagacattgcagacttcttccctagcatcacagtggctcatgtacgccaggtcttttctaaactactgggcttttctgatgaagttagtgagctgctggctgatctcgtgacccgggagggccaagttcctcaaggcgcatctacaagctcctatttggctaaccttgtgttctgggacattgaaccagcattagcagagcgtttcaatgctaagggcctccgctactcccgatttgccgacgacatcaccgtttctagcaagacagatatgccgcaggaggtagcgactctcgtcatcggtagtgtaacttggatgctcgggcagaagggctgccgcccaaaacgcagcaagctgcatgtgaggaaaagagggcaggccttaatctctggagacaaggtggacgcggtcactattaccggacttgtcgtggacggtagttccccttcccttcctaagaaggagaggatggcaatccgtacagctgtgaaacagctcgaggatagcgccagagattgggttgggggcccacccttggaaatgcagaaagatattcagagactgatggggaggattggccggttgatcgcctgtggtcacccagagggactgagattgaaagctagggtgcgcctcgtgacgagaagaggcccacccctggagcagcacacccagattgccgggaatatagaagttcattcctga

SEQ ID NO: 11061 - RNA, 1116 nt, unidentified
  source 1..1116: mol_type = other RNA; note = synthetic construct
atggaagcccccctgtacccacatcggcccatttacagtcttaaggccctttctctggctctggcagagcccgaagccttgctcgtcgccattgccaagcgctcgtctaacctatatcggtatgtgccccagaaaaaacgagacggctctccaagagacacattcgatgcatttgagccactgaaagcaatccagaggaaaatcgtggacaggattctgatcaaagtcaagtatccggtttacctgcacgggggaatccgcgatgttgcacagcctagatcgatttattccaatgctaggtcacacgccgggtctaagagcataattctccaggatatcaagaacttctttccatccatcacaaccgctcatgtgaaagaaatattctccggattttttgggtttagtagcgaggtgtcatccctactggctgcactcacgacaagagccggtcaggtcccgcagggagctagcacttcctcatacttggcgaacctggtgttctggaatgtagagcccgccctggtcaagcagttaggtagcgaggggcttgcgtactctcggttcgccgacgacattaccgtgtctagcaagagtgagatccttcctgaagcaaagtcacggataatatccgctgttacgtggatgctcagtcaaaaaggatgtcagcaaaagaggagcaagctccacatccgtagaagaggccacagtttgcttgaggtgtcagaacccggagcagtgactgtgaccggcctgacagtagaccgcgcttcccctggcatccctaaagacgagcgacgactcatccgtgccatggtcaggagaatagagttacaagcggctgccgaacccggaccattaagcatcgatttggagagggaggtgcgcagactgatgggcaaggtgggtcgactgattgcctgcggccatccagatgggctgaggtttaaagcccgcctccgtactctcctggtccgggttcctgtgctagaacggtacgctgatacactgccaattaacgagattgaagcgttgacctccaatagcgatgtacaggacggtggcatcttcattcctccctgggagatcgaaacccctactaccgaccgcgtttga

SEQ ID NO: 11062 - RNA, 1128 nt, unidentified
  source 1..1128: mol_type = other RNA; note = synthetic construct
atggacgcaccattgtacccacacagacctatttactccttgaaggctctgagcttggcgcttgccgagcccgaagcactgcttgtggcaatcgcaaagcgctcttctaacctgtacagatatgtgcctcagaagaaacgggatggttccaggcgcgacacttttgacgcctacgagcctctgaaagcaattcagaggaaaattgtcgatcggatactgactaaggtgaaataccccgcatatctccatggcgggatccgcgacgctgtacagccacgttccatctatagcaacgctcggtcccacgctggatcaaagtcgatcattctccaggacattaagaacttcttccccagcatcacaacggctcacgtggaggaaatattttcgggactgtttgggttctctaatgaggtgtctagccttttggcggccctcaccacgagagctggccaagttccccagggagcctccacctcctcatatctggccaatctcgttttctgggacgtggagccgaccttagtcaaacagctttctagtgagggcctggcctacagtaggtttgccgacgatataaccgtgtcatccaaatctgagatccctcccatcgctaagagtcgagtgatatcagcagtcacttggatgctgagccaaaaaggctgccagcagaaaaggagtaagctacacattcggagacgaggccaaagcttgatccaggtaaatgaaccaggcgcagtcacagtgacagggctcactgttgataaggttaagccgggaattcctaaagatgaacgaaggttaatccgcgcgatggtgaaaagaattgaaatccaagccgctgccgagcctggtcccttatccatcgatcttgaacgggaatgtagaaagctgatgggaaaggtagggaggctgatcgcctgcggtcacccagacggactgcgcttcaaggctcggctgagagccctgctagtcaggctccccgtcctcgaacgttataccgaggccagcccagatcatgagaacggggtggtagtccgcggcacagcggatcagtattctagcgagtacggggacgttatcattccgagttgggacattgatgtgccttcagcccatggcgtgtga

SEQ ID NO: 11063 - RNA, 1050 nt, unidentified
  source 1..1050: mol_type = other RNA; note = synthetic construct
atggatgcgccaaggtatccatgcaagagcatccatagtctgaaggccctgtctttggccctaggggaaccagtggagcttctgctgagcctggccaagcgctcgagcaatttgtaccgacacgttcctcagaccaaaaaggacggttccgtgcggcacacctatgatgcacatgagcccctgaaaaaagttcagcggaagattgtggacaaatttcttgcaagagtgcgttacccggactacctccatgggggcataaaagaccctaacagcaggcgctctatctactccaacgctagaatccacggcaaggccaagacaattttgctccaggatatcaaggacttttttccttcaatcggcgtgcagcatgtgcagcagatcttcagcgggctgttcgggttctctgatgaggtggcacaggtactggcgctccttactaccaggcacggcgttgtaccgcagggggcatcaacgagcggatatttggcaaacctcgttttttgggacactgaacccgctctcgtcgcccgactgcacgctagaggactaaagtattcaaggttcgccgatgatataacaatttcagccatgacaacactcgagcgatctgccctaaccggcctcgtagccgccgtcactgacatgctggcaaaaaaaggctgccaacagaaacgcaccaaactccacattcggaagaggggacagtcccttctggctaaacccaaagtggaggctggatacgaacctttaactgtcacgggtctgtccgtcttcaatgaggcccctggtttgccaaaggcagaaaggaaagcgattcgggctgccgttaagcaggctgaggaccaggccagtcaaggcgcgagttgggcacaactggagcccacttttagatccgtcatgggtcgcgtgggacggcttatcgcctgtgggcatcccgatggcgaacgttacaagctgagactgaaggccttaaagacaagatgtcaagtccccttactggaccgctatgccgctgctgctaccggagcagatgtgccagtggtgtga

SEQ ID NO: 11064 - RNA, 987 nt, unidentified
  source 1..987: mol_type = other RNA; note = synthetic construct
atggacgccccgcggtatccctataagcctatttactccctcaaggcgctgagccttgcccttggggaacccgttgagctcttaaagtcactcgctaaacgcagcagcagtttgtatcgtcacgtgccacaaactaaaaaggacggctccgttcgcgatacatatgacgcgcaccagcctctgaaggccatccagcgtaagatcgtggataagttcctggcaagagtcaggtaccccgattacctgcatggagggataaaagacccaagtagtccacgatcaatatactcgaacgcgcttacccacgggaaggccaaaaccattctcttacaggacatcaaggactttttccctagcatcagagtccagcatgtggagcacatctttacgggcctgttcggattttctgaggaagtggcacagctgctggcccttctgacaacgcggaatggtgtcattccacagggcgcaagcacctccgggtacttggcaaatctggtgttttgggacattgagcccactcttgtaagtcgcctgaacctccggggtctgaaatactctcggttcgccgatgatatcacaatctccgctatgatgccgttggacgggctcgttctgaccgagctcgtgggagcagtgactgtcatgttggctaaaaaaggctgccaacagaaacgctcaaagctgcatgtaagaaagcgaggccagactattcaggctaaagccggctttgaggccctaaccattaccggactgtcagtgttcaacgccgctccctctctaactaaagccgagagaaaagccataagggctgcagttaagcaagtagaagatcaggctacacaaggcggatcctgggggcaattagaacctacattcagatctgtgatgggcagggtcggtaggttgatcgcttgcggtcaccctgatggagagcggtataagcagaggctgaaaagcgtgcaggaacattgttacaagaagtga

SEQ ID NO: 11065 - RNA, 1047 nt, unidentified
  source 1..1047: mol_type = other RNA; note = synthetic construct
atggacgcaccgctgtacccctttaagccaatttactcactgaaggccctgtctctcaccctgggtgagcctgcagagcttctggagagcctcgctaagcgcagctccaatctgtataggcacgtccctcagactaaaaaggacggaactcctcgtgatacttacgatgcctacgagcctctgaaagctatacagcgaaaaatcgtggacagactcctggcgcgcgtgcgttttccaggctatctacacggcggaatcaaggatccagtcaaacggagaagcatttatagcaatgcacatatccacggcagggcccagtgcgtagtgctgcaggacatcaaagacttctttccaagcattaagacacaacatgttcagcagctcttcgttggactgttcggcttcagtgaaacagtggcaggtatcttggcgcttttgaccaccaggcacggagtggttccccagggagccagctcttccggttacatcgctaatctggtgttttgggacatagaacctgccctggtcgcaaagctcaacacacagggcttgaattactcaagattcgccgatgatattactatcacatctacaaagccgctcgattcatccgctcttacgtccattgtcagtgccgtgactaacatgttagctcagaaaggctgttatcaaaaaagatcgaagctccacatacggaagcgggggcaaactgtgttatcaaagaacggcttcgagccccttaccgtgacagggttgaccatttttaacgccgtgccagggatccccaaggctgagaggaaagccattaggagtgctgtcaaacagctggaagaccaggccacccaggggatgacctggtccgaactggagcccttggtacggcgcgtaatggggcgagttgggcgacttatcgcctgcgctcatcccgaaggcgatagactgaaacaaaggctacatgcgctgaaggcaagatctcaagtcgcccttctcgaccggtatgcggccgcattacaggacgctacggtgaccggacagatacctggttga

SEQ ID NO: 11066 - RNA, 903 nt, unidentified
  source 1..903: mol_type = other RNA; note = synthetic construct
atgattggcctgatcagcttttggggtcaggagatggacgcacctctgtacccattcaaacccatttacagcttaaaagcactgagccttacattgggagagagtgtggagcttttggaaagtctggccatgtgctctagtaacctgtaccgctatgtcccccaggaaaaaaaagacgggacgccacgggacacctatgatgcctttcaacccctgaagtccattcagagaaagatcgtcgatcgactgctcgcaagggtaaggtttcctgcttatctgcacggcggcatcaaggatccagtgaaccgcagaagtatatactccaatgcaaaggtgcatggcaatgccaagttcgtactgctccaggacattaaggattttttcccctccataaaagtccagcatgtgcagcagattttcgagcggttgttcgggttttccgaagaagtatccaagttactggcgttgctaaccacccgaaacggcgttgttcctcaaggggcctcttcttctggttacctggctaacttggtgttctgggacgtggagcctatgctcgtggctagactggaggctcaaggactcaattattcaagattcgccgatgacatcacaatctcatcactcaccccgcttaatagcgtgatgttaacgaaactcgtctcggccgttaccggaatgcttgcagagaagggatgttaccaaaagcggagcaagcttcacgtgaggaggcgtggtcagactctgaagatgaaagtgatcgacgaatttgtgcccctcaccgtcactgggctgacaattttcaaccagataccgggcatcccaaaggcggagcgtaaagccatccgcgctgctgttaaacagctagaagatcaggccactcagggacggacttggacatga

SEQ ID NO: 11067 - RNA, 1029 nt, unidentified
  source 1..1029: mol_type = other RNA; note = synthetic construct
atgaactccgccctgctgtacctggacaaacacaagatggactttccaagctatccttgctcgccgatttactcactaaatgcgttaagtaggcttctcggagaacctctggacgtactgacacgaattgcgcttaagagcgatagtttgtatagacatgttccgcagcgcaagaaggatgggactccaagaccaacttacgatgcccacgagcccctgaagaagattcagaaaaaaatcgccagccgcatactcaatcggatcatctatccacagtacctgcacgggggagtgaaggacctgaagtctcctcggtctatctataccaattgtgcaccacatctgggaaagaacctcataatcctgatggacatagagaacttttacccctcaatatcccgggaacacgtcttttctattttcaacaagtgcttgggcttcagtagcgatgtaagtctgctgctgtcaacgctgctaacacgaaataatcaggtgcctcagggggcatgcacctcatcgcatttagcaaatctcgttttctgggatcttgaatccactacattttcttacctggaggagaacgagttcacctacaccagatttgctgatgacatcactatctccaccgatgcaaacaaggacaaaaaacaaacaggcgaggccgtctccaaagtgatcgctatgcttgcccggaaaggttgtcgattaaagaggaccaagtttcacattcggaggaggggacaggccattgttaaggacgagaaactcacccccatcacagtgactggcctctctcccttcaataaacatacattggctattacgcagagggagcggaacaaaatcagatctagcgtcaagaaaattgaaattcgcgcacatgctggggaaagctggaaagatctcgctccttcctataaccgcgccatgggccgtgtgggtagacttatcagctgtcgccaccccgagggcgacaggttgaagagacgtttgcaaatgctaaagacctatttcgaagccgctgtgtga

SEQ ID NO: 11068 - RNA, 984 nt, unidentified
  source 1..984: mol_type = other RNA; note = synthetic construct
atggagctgccaaagtacccaaacgcgcctatatattccatcaatagcctctcccggatgctgtctgaacctccttccgctctgcagaaactttcagccaaagcagatactctgtataggtccgttccccagaagaaaaaggacggaagtccacgcgaaaccttcgacgcttatgaacccctgaagtctattcagaaaaagatcgccctgagactcctaaacaagacaaaatatccgagttacttgcacggcggcgtgagggacccttcaagtcctcggtccatctactcaaattcaaggccccatttagggagttgccacattatactcctggacattaaggacttctacccctccattacgaagagtcatgtgactaacatcttccaaaatttctttgggtttagcagtgatgtctcagacacactttctagactcctgactaaagatggacgggtcccccagggagcttgcacatcttcccatttggctaaccttattttttgggacgttgagccacaactggtgcacgatttgcaggcaaacggctttaattacaccaggtttgccgatgatattaccattagcagcgccagcaacagagataataaaacgaccggggaagtggtgtccaaagtaatatccatgctgaagtcgaagaattgtcacctcaaacggtcaaagtttcatatccgtagccgaggacagtcgatcactgggaaagacggcgagaaattccctctaacaattacaggtctgtctatctacaacaagagcaaaccaagcatcagccagcacgacagaaataacatcaggtcttctgtaaaggagatagaggtgaagacccatgagggggcaacttggagcgaaatcgccccgctttataaccgcgccatgggccgcgttggcagattgatctcttgtggtcaccccgagggtacccgtctcaagaatcgattacgcatggtcaagaactgcttctga

SEQ ID NO: 11069 - RNA, 1071 nt, unidentified
  source 1..1071: mol_type = other RNA; note = synthetic construct
atggatgccccatattatccgtgtaagccaatttattcccttagagccctgtctctatttctcggggaacctgctgagacactgctgaggttaagcaaaaatgccgatcacatgtatcgcctggtgccccagaaaaagaaagacggtagcctccgcgaaactttcgacgcctatgagtctctgaagcgagttcagaagaagctggtgagtagaatgtttgggcgtgtccggtttccagcttacctccacggaggaatcagggacttcaacagtcccagatccattttttctaatgcaggggtccacgcaggagccaagaccgtcgtcttacaggacatcgaggatttcttcccctctatccggtttgagtacgtatacagcatctaccagggattctttggcttcgagcactcagtagcagaggttctggcgaggctgactaccaagcatgggtgcgtgccccagggcgcttgtacatccagctatatagccaacttggtcttctgggatgtggaaccgatcgtctaccgggccttggcagaaaaaggcgtgaggtacacccgattcgctgatgacatgaccatttcatcagctattgagttgtccaatgacgatataggggatgttatctcaagaattgtgtctatgcttcgttccaagggctgccgtcaaaaacggagcaagctgaatgtgcggcgcagaggtcagggcctcaaaaaggcggaaggattcgagtcgttgactgtcacaggcctcaccgtgtccaacttccatggcgtggggatcacacagaaggagcgcaacaagattcggtctagtgtgaaagagatagaaatcaaggcccatatggacatgccttggtcggaccttgaggtgctgtaccaaagggccatggggagggtaggtagactgctagcttgcaaacaccctgagggcgaacgccttaaaaaccgactcaatacggtgaaaagtttttacgacgtgagcaacgtgcgcgaaacgaaggttgtgatgggagataaatttgttgttctggacgcaagcggcgatgtaccaccttgggtcggttga

SEQ ID NO: 11070 - RNA, 1032 nt, unidentified
  source 1..1032: mol_type = other RNA; note = synthetic construct
atggagcacacatattacccgcatcaccccattaactctctgaaagcgcttaatagggccctcgggatcgacgaggacgaaatctttcacgccctgtcaaacataagctataaagaagtccccatcaaaaagaaggacggtgccattcgagtaacatatgacgctaccagtgcactaaaggtagtgcagaagaaagtcacgtctaatattttccatcgagtgaatttccctcactacatacacggctgtattcgtgataccaagacaccccgcaatatatatacgaatgcttacccacacgccggatgcaagcaggtgatcttgtgtgatatcaaggatttcttcccttccattaaagcaaagaccgtgttctttatcttccgccattgcttagggttttcccccaacgttagccagaggcttacagacctgtgtacctacaacgggacattgccacaaggcgcatcaactagcagttatatagccaacctggcattttgggatgtggagcctctgctggtgaagaagctggagagtttaggactgacctacactagatttgccgacgatattacaataagcgccaagaaaagtatcagcaaatcactgaagactcaggtcctacacgaggtcagaaggactattcgaaaacggggctgctcgctcaaaaaaaacaagactatcgtcctcaagagatctcaagtaatcattggaaaggacaaagaaacgcaggaaactacaagaaatcctattaccgtgacctctctcagcatccaccactcctcagtgaccatctctaaagttgagcgccggaaagtgcgcgcgttcgtggataagctgagcaagaccgagttcaaccgggtttcctaccatgaatggtgccggaggtacagcagtgctatgggccgcgtgtcccgtttgatctcctgtggtcataaggagggggaaccactgaagcagaggctcaaagctcttaaagacgagcataaaaagtttcatcagcggtcttccaatgtttcaggcagaaagtga

SEQ ID NO: 11071 - RNA, 1032 nt, unidentified
  source 1..1032: mol_type = other RNA; note = synthetic construct
atggataagatccagtatccccattctccgatcaattccttgaaagccttacaccgggctctgagagtagacgagtccgtcatgtcaaatgcgttgcagaatattaactacaaggaggttcctcttaagaaaaaagacggaactacaaggatcacctacgacgctgccccagcgctgaaggctgtacaaaagaaaattacttcgcagatcttccacaaaatcacatttccctactatatccatgggtgtatacgagatgccaacaatccaagaagcatatacacgaacgcatcaccgcacgccggcaagaagaacattatactctgtgacattaaggacttctttccatctatcaaggagaagacggtgtttttcatcttcagagagtgcttgagtttctcccccgaagtgtcacagaagcttacagaactgtgtacctacaatggcactcttccacaaggtgccagtacaagttcctacattgctaatttagccttttgggacattgagcctctgctcgtcgaaaaactgtcctcttttggattcacttacactaggtttgcagatgatattaccatgtccaccgataagcctatctcaacaacgctgaagacccaggccctccacgaggtgcgaagagcaattcgcaagcggaactgcagcctgaaaaagcgcaagacaatggtcctgaagcggggccaggtgatcaaagggattgacgagaaaaagcaaaagcccacagattctcctataactgttaccagtctgtccatacaccataaaaacctagctatcagcaagcaggagcggaggaaagtgagggcatgcgtgtataacctcgaaaagaccaatatggaggaaatcagctatcaggaatggtgtcgcaggtattcgtctgccatgggtaaagtgagcagaatcattacctgcggccataaagaaggggagcccctgaaacagcgcctcaaaaaactgaaagacgttcacaagcgtcaccatctacgtagctctaaagtcagcggacggaagtga

SEQ ID NO: 11072 - RNA, 963 nt, unidentified
  source 1..963: mol_type = other RNA; note = synthetic construct
atgcgatccagatgcgaactgaccagcacataccctcacaacgctattatcgatcccgaacacctggcactgcttttaaatacccccccggagaagttgaaggatattgccaatgtggcctccggctcctatcgccccgttcctcaaatgaaaaaagacgggacaccaaggatgacatacgacgcctacccagagctgaagagaattcagcaccaaattgtcaagaagatcttacgtaaggtcaggttcccccgctatctgcatgggggaatccgagataccgacttccctagggatcatgtgtctaacgcagcgctgcacactggtgccaccatactagtgctggatgacattgccgacttctaccctagtctggaccggcagttagtgtttactacctggctgcgctttttcgggtttagcccagaggtcagcgagctgctcacaaacctgacaacaagacatggcgttgtcccccagggagcacgcacgtctagctacctggctaatcttgccttctgggataaagaagcccagctcgtggaagatctaggtaacatcggactcacttactcgaggtttgtagacgacgtgacctattcttcacatcggcagatattgaatagtactatcggaaatgcacgggctaaagtctatcgaatgcttgcatccaaaggatgcaggccgaagcggtcaaaaagccacgtttgtcgcaaggggcagaagctcgaggtgacgggcctcgttaccgctggctcaagccctactatagacaaagacgaacgtaaaagaatccgctctgctgtgcacaaccttgagaaggcggtgggcaaggaggggatgaccccagagaacaggaagaaatgggattccgctaagggcagggtgggtagattggtaagactgaaacatccagaatcacggaagctcagtcagcggttggatgccatcagacaaggctga

SEQ ID NO: 11073 - RNA, 957 nt, unidentified
  source 1..957: mol_type = other RNA; note = synthetic construct
atgagaagtatctgcaagttaactcccacctatcctcataacgccatcattgacccacagcacttggctcttttgctgaatacacccttagagagcctgaaggctactgcaaagatcgccagtgggtcataccgacccgtacctcagaccaagagggacggcagcccccgtatgacctacgacgcttatccagagctgaagcgaattcagcaccagattgtcaagaagatcctacggaaagttagattccctaggtatctccagggtggaataagagacacggagttcccgcgcgatcatgtgagtaatgcagcgctgcatacaggtgcctccattctggtgttggacgatatcgccgatttttatccttcactcgagtcccagttggtgtttaccatttggctgcggtttttcggcttttctccagacgtttcggagctgctgacaaagcttacgacacggcattgcgtcgttccgcagggtgctcgcacttccagttaccttgctaatctcgccttctgggataaggaagccaaactggtggaggatctgggcaatatgggactcacctactctcgctttgtggacgatgtgtcctactcatctcaccaccaagtcagcaacagcactataggagaagccagggcgaaggtctatcgcatgctcgcatccaaaggatgtcggcccaagagatctaaatctcaagtgtgtagaaaagggcagaaattgaaggtcaccgggcttgtggccgcagggaactacccagcggtagggaaagcagaacgtaaacgaatcaggagcgctgtgcacaacctcgagaaagccgttggaagagacggcatgacacctgaaaatctgaaggcctggaactccgcaaaaggccgcgtgggcatgttattcaggctagagcacctggaagctcggtcactgagccaaaggcttgatactctcctgtga

SEQ ID NO: 11074 - RNA, 993 nt, unidentified
  source 1..993: mol_type = other RNA; note = synthetic construct
atgttcgtttcctccgagctgaccccgttctatccccacaatcctattgtggaccctgaacatctggctagacttcttaacactccactcccaaaattagaggccattgccgagagcgctagcagctcataccgcccagtgccccagaaaaagaaggacgggagcccacggatgacctacgacgcctacccagcccttaagcgagtccagcaccagatcgttcagaagacgctgcacaaggtgcgtttccctcgttatctccacggcggcatcaaggacaccgaatttccgcgtgatcacgttagtaacgctgccctccatacgggggctgccatcttgatattggacgacatagcagacttctatcccagtttggatcgcaaactggttttttctgtgtggctgcggttttttcgattcagccctgaggtcgcggccctgctgacaaagctgaccaccaggaaaggatctatcccccaaggtgccaagacatcatcctatctggcaaacctagcattctgggatagagaggcgcaactggtggaagacctaaaagctatgggcctcacttactctaggtttgtagatgatgtcacatactcatcccgctgccgcattcctgattcagctgtcggtgaggcccgggccaaagtatacagaatgctgacttccaagggatgtaggcccaagagatctaagagtcaggtgagtaggaaaggaaggaagctcgaggtgactgggcttatcaccgcgggaagaagccccgcaatcagcaaagatgaacgaaatcgcattcggtcggccgtgcggcatctcgaaaaggctgtgaacgaagagggtatgacacctgaaaatagaaaggcatgggactctgccaaagggagggtaggccgattagtccgcctgaaacacgccgagggcagacggttatcccaacggctggacgcattgctccaggcagctccactggctcatagggtggataatcagtga

SEQ ID NO: 11075 - RNA, 966 nt, unidentified
  source 1..966: mol_type = other RNA; note = synthetic construct
atgaaggcaactcctccactgtatttgcacgctagcatcgggtctataaacagcttaagtctcctcctaggagtgagccctgattctctcaaatccatcggcgatgctgcccagaagatgtacagagaggtgcctcagaaaaagaaagacgggagtttgaggatgacgtacgacgcccatccctcactgaagaaaatccaggacaagatttccaagctcatcctgaagaaagtggtctaccccgactacttacagggaggcctgccaaaaaaagatcaggtgagcaacgcagctaagcactctaaagccatcatcctcattcaagacgatattgaagacttctacccctccctgtccgatacaaccgttcggggggtatggcagcagttctttaagttttctcctgaggtggcaaaactcctaacctcactgaccacgctgaatggcaaggtcccacaaggtgcgaaaaccagtagctatctggctaatctggccttctgggactgtgagcatctgcttgttcagaagttgcttgacaaggatctgacatacactaggtttgccgacgatatcattgtatcaacccgagccatcatatccaactccgagattgcggtggtgagagcttctatttataacatgcttgccctgaagagttgcaagccgaagcggtccaaatcgagagtgtgccgcaagggcactcgtttatcagtgacaggtctaaatacaagccttaaaagtcccatggtaaacaagcaagaaaggaggaaaatacgcgccctccttcacaatctcgaagttagcgtctctttgaacggctatactgcagagaatgtcgctgcatgggaaagcattagaggaaaagttgtccggctgaaacgcctgcgacataaggaagccctgggatttgatgagcggctccacttgctgaagagccgtctgttctcttcatcgtccgtgctttga

SEQ ID NO: 11076 - RNA, 999 nt, unidentified
  source 1..999: mol_type = other RNA; note = synthetic construct
atgctacgggaccggtacctgataattaagattccctctatcgcaaacacgagctcccttgctagtctgttggaaattacagaaaaggagctcttctacattgcagataatgtgcacgagttttataaaccaggcaaaataatgaggaagaaaaatggcgaccctcggcccacacacgatgccaagccagtccttaaacaaatccatgcgcgtattaagaatcgaatcctgaagcaggttgtgtatccatactatatgctcgggggcatttccgatctggaatccccaagatcctgcaaaacacacgctcagatacattctggaaagaaaatcctgatcagtgaggacattgcaaacttctaccccaatacatcctacgaggtggtaaaaaagatctggaagtaccacttcaaattcggagacgaagtgtccgagctgctgactaagctgaccacctttaacggggagttgccccagggttggaaggccagcgggtatatcgccaacctggctttgatcgataaggaacccgagcttgttcgcatcctggaggaaaaagggttgtcttactcaaggttcatagatgacattactgtctcctctccattctatctaacctcaaatgacaagcaattcatcatcagcaatatctatgccatgctgtttagctgcggatacaagccgaaacgaatcaagcatgagattgtgtcacgcgagatgcctatgtcagtcactagtcttaacgtgaataccaaaaaacccaccatacctagcaaggagaggaagattattcgcgccctcgtgtaccagctggaatgtgcctatcctgatgacggcagaagtatcagattttataaactctggctcagcgtctacggcaaagtaaacagagttaagtcttttcatgctgaagagggttctaaattacagatccggatgaggcagattaagccgcctaaacactttttctcgaacaagaagttactcagcacgtcgtga

SEQ ID NO: 11077 - RNA, 963 nt, unidentified
  source 1..963: mol_type = other RNA; note = synthetic construct
atgccgcggaaccgctatccacagccctccatcccccctattgccaatatcacatcactagcgtcacttctgtccgtaaatgtgactgacctgctgtacatagccgacaatatcaacttgttttacaagcctggtaagatactgcagaaaaaaaatggggagcatcggtatacccacgatgctaagagaacccttaaactgatccaccagcacataaagaacaggatcctaaagaagatcgagtacccctactttatgcttggcggaatttccgacccgcagaacccaaggtcgtgtaaggcccatgcacagatccactgcaacaagaagatactgatcaacgaggacatactcgacttctatccaaccacaagctatgaactcgtgaaaagagtgtggaaacaccagttcaatttttccgatacagtggccgaaattctgactaaaatcacgacttatagtgggcaactgccacagggctggaagacaagctcttatattgctaatctggcacttctccccattgaggcccatttagttgagctgttggagaataagggatatagctacagtcggtttattgatgatatcaccgtcagtagccctactttcatctctcctcaggagaagaaaagcattatttctaacatctacggtatgctctttaaatgcgggtacaagcccaagcgaacaaagcacgaaattgtgtcaaacaaagaaaagatgatcgtcacctctttgaacgtcaacactgaaacccctacgctgtcaaaacaagaaaggaataacattcgtgctatggtgtaccaactcgaaaaactgttctccatccagggaaatacccaggcatacattcagaaatggcatagcctgtacggcaaagttaacagactcaaatccttccataagaagaatggcgagcagttgcaagagcgcatgaaactcatcaagccattaaagtga

SEQ ID NO: 11078 - RNA, 963 nt, unidentified
  source 1..963: mol_type = other RNA; note = synthetic construct
atgaggaagattcgataccctatcgctaatatacaacccatcgccaaaattagtagtcttgctcgattactgtcggtgcgtgaggctgacctcctcaacataattgacaacatcgaatcatttcacagacccggaaagttgctgaagaagaaaaacggggatccccgccctactcacgatgccaaatccgaactgaagattattcacgcgagaattaacaatcggatcttgaaaaaggttcagttcccatactatttgcaggggggtatcgccgataagtcctatcccagaagttgcaaggaacacgcccaaacccatagtggtatgaaaatcatcatatgcgaagacatagcagatttttacccgagcacctcctatattactgtcctgaagatctggaagcattttttcaacttctccaacgaggtggccgagattcttacacgtctgacaacttaccagggagcactgccacagggctggaaaacaagctcttacatcgctaatttaaccttttggcattgtgagcctgagctggtgaaaataatcgaggagaaaggcctctcctactctaggtatatcgacgatatcacggtaggatcccgccttcatatttcaaacaatgggaaggagttcgtcattagctctgtttatggcatgctgttttctaacggctacaagcctaagagggaaaagcaggaaattgttagctccgagaaaccaatgatcgtcacatcactcaatgtgaacagtcagaagcccaccatcccgaaaaagttccggaataacgtgagagcaatggtgtaccagctcgaaaagtcttttatctcaattggcaatagcattgagtatgacaagaaatggcgcagcgtgaatggatctgtctgtcgggtaaagagcttccacctatcagaaggggccaaactgcaggagcggatgaggcaaataaaaccaatcaaatga

SEQ ID NO: 11079 - RNA, 966 nt, unidentified
  source 1..966: mol_type = other RNA; note = synthetic construct
atgtcaataaagatctatacacccgagcctaagatccagtacatttctaagattagttccctggcccgaatcctgagtgttaattctaacgacctgcttaatatttccaataacacccagaagttctataaacagggcaagctcatatcgaaaaaaaatggcgagaaaagagtcacccatgatgcaaagccaaatctgaagaatatccacgagattatcaagaataggttacttaagacggtaaactatcccttttacctgcatggtgggatcgccgacccaagcatcaaacgctcttgcctaagtcacgccaagacccacataaattcccacattatttttcaggaagacattgctaacttctttcctaacactgataaaaacacgatcaagaaaacttggaagtacttgttcaatttctcagacgaaatcgcagagatactgagcaatctgaccactcatgaaaacatgctcccgcaaggttggaaaacttcaggctatctcgctaatctcgtgttttgggaaaaagaagctcaacttgtctccaacttggagaagaaaaatctttcttacagccggttcattgatgatatcgtggtgagcagcccatgtcgcatcaataacaacaacaagaacttcatcatctcaagcatttacaacatgttgtaccattacggatatgagcctaaacggtctaaacacaagatttcaacaaggaaagatcccatgagtatcaccgggctgaacatcaaccccaaatttaagtccttgacaatctccaagtctgaaaggaacgaggcgcgtctggctgtttataatctggagaagaattacaaccggattgagaaagaagactatataagactctggaatagcgcctccggaattatcgccagaattagtctgtttcacaagaaagaagcaaagacactacgagagaagataaacaaagtgaagttactctga

SEQ ID NO: 11080 - RNA, 969 nt, unidentified
  source 1..969: mol_type = other RNA; note = synthetic construct
atgtccaccaataactttccgataattaacatccctagcttcagcaaccccgcctctctggcaagtctgctgtctgtttcagagcaggatctctttagaatcacttcttcagtcgataacctctataagcccggtaaaattctccagaaaaagaacggcgagctccgacggacacacgacgctaagaagcctctcaaggacttacacgagattatcaagaacaggatactgaaaaaggtggtctatccctactacctgctaggcggtatagccgatccatttaagccccgcaattgtacaaacaacgcgcttatccattccgggaaaaaaatccttattgcagaagacattgagaatttcttcccatcatcgagttctgacatcgtgttcaatatctggaaactgtgctttaaattctccccaaaaatcgccgacatcttaactaagctcaccacatatcagaaccaactgcctcagggatggaaaacctccgggtatcttgctaacctggtgttttgggataatgaaccggacttggtgagagatttcgaaaaaagaggctatagctacagtcgctttattgacgatatcgccatctcaagcaatcagtttataaacgataaccagaagtcctacattattagccggatctacagtatgctgagacttaagggctacaaacctaaacgcaccaagcatgagatacagactcaaattaaatccatgcacttgacggggctagggattaaccggaagaggcctacagtcccaagaaatcgtaggaataatgtacgcctgttggtgtataatttggaaaagcggcaccgtcatgaaggagacacccatcaataccgagaggactggattagcgtttctggaaaggtaggccacatcaggagcttccacaataatgagtgggagaagctgaagttcaggctgaataagatcaagcccaacgataaagtgtga

SEQ ID NO: 11081 - RNA, 963 nt, unidentified
  source 1..963: mol_type = other RNA; note = synthetic construct
atgccaagggacagacatccggtgattaatatttccccaatcgccaaagttagctccttagcgagtctcttgtcaatcaaagagtccgacctgctgtatattgccgctaatgttgatcgattccatcgccccggcaaagaactaaagaaacggaacggtgagcctcgccaaacccacgatgccgagcagcgcttgaagattattcacggtcgaattaacaaccgcatcctgaaaaaggttgactacccctattaccttcagggaggaatcgcagacaaaaagagaagtcgtggatgcagggccaatgcaatcatacatagcaggaagaagctgataataaccgaggacattaaagacttctttccctgcacatcaaagcggatcgtgaagggcatctggcagtactgttttaggttccatcctgagatcgcagacatcctgactcgtctcacgatctaccagaaccagctgccacaggggtggaagacctcatcttacttagccaatcttgtgttttgggacaaggaaccggatcttgtctctctgctcgaacaacggggctatagctattccaggtatatggatgacattactgtcagctcagggcactacatcaacaaccaccagaagaactatatcatcagcaaagtgtacgagatgctgttttctaagggcttcgccccaaaaagaagcaaacacgagatagtaagtcagtcccaacggatggatattacaggtcttgtggtgaatagaaagaatcccaccgtgctaaagtctaagagacgtggcgtacgagtcggggtcttcaaactggaagaactccctattaataaccgcagtgatgctgattaccgggagtgttgggaacacctctccggactggtgtcttacatatcggcttatcatcctaaagaggggaaaaagttgcgggctcgcctgagaaacatcaagcccaataggtga

SEQ ID NO: 11082 - RNA, 1008 nt, unidentified
  source 1..1008: mol_type = other RNA; note = synthetic construct
atggctccggaatcgaacaaaacctgttccaaagttgggcccattgcacatgtgaaagccttggcaagtattctctctacgacaccatccgagcttatagcactttctgagaatgtaccaagtctgtggaagcccgggaaagtgctaagaaagaaagacgggactccacgccctacacacgatgcccgaaaagcccttaaggtggtccatgaacgcatcaagaataggttactgcgccaggtggattacccagggtacctcctaggcggcattagcgacaagctgacaacccgagactattcccggcacgcagccctgcacgctaaaaagaagatcctgatcagcgaggacatccaggacttcttcccctcaacaaccgctgaggtagtgcaagaaatatggcagcgcttgtttaacttccatcctgacgttgcagagcttctgaccaggctcacaatctatgagggagccttaccccagggctggaaaaccagtggctacttagcgaacctcgctttgtggaggcgggaaccggactttgtcgctagactccaccggcagggtttggcctatagtagattcatggacgatgtgactgtctctgctccgtaccccctgtctaagactcagctgacaaacattatatccggaatttacggcatgctggcctcaggtgaatttgcccccaagcgggccaagcacaaaattgcaactggtcgaagccggatggaggtgactggactgaacgtgaatgccgccaaaccttctatgcctaagaagcgtagggatcaaatcagagcgcaagtttatcagtgcgagcagggatacaagagggatcctcggagcccagagtatctcacgcagtggagaaatgcatcaggcaaggtgggcaccatgaaaagatttaatcctggagaagcgaagtcactgaggacccgtccagctctgtacccccaagtcgcccagaccagccgctatggggctgtctcctttgatttcatcagctga

SEQ ID NO: 11083 - RNA, 999 nt, unidentified
  source 1..999: mol_type = other RNA; note = synthetic construct
atggctctagagaataacaaggcatgtagcaaggtcggctccattgcccgcatcgaagctctggccagtgtgctgtccacaactccagcggagcttttggaactatctgagaatatccatagtctgtggaaaccaggtaaaatactccgtaagaaggacggcaaacctcgccatactcacgacgcaagaaaaccgcttaaggtcattcacgagaggataaaaaaccgcctcctgaagcaggtggattatcctcactacatcttaggcgggatctccgataaacagaccacaagagattattctagacatgcagctctgcactcaaagaaaaagatccttatcagcgaagacattcgagacttctttcctagcacgacctctgacgttgtgctgaacatttggttgcggttttttaactttcatcctgaagtggccgcattactgaccaaactgacaacccacgagggagtactcccccagggctggaaaacctcagggtacctggccaatttggccctttgggaccgcgagcccgatttcgtgactcagctccaccggcagggcctggtttattctcgcttcatggacgatgtcacagtgagcgccccttatcccataagcaagacgcaggtgaccaatattatttcaggtatttacggtatgctcgctagtagggattacaagccaaagcgtagtaaacacaaaatctccaccggacggcataggatggaggtcaccgggttgaatgtgaacgcgacacgaccctcaatgcctaagctgcggaggaaccagatcagagcacaagttttccaatgcgagcagctctttaaacagaatgcccggtccccagaatacctggctcaatggaggaatgccagcggaaacgtcggcactatgaagcggttcaacccctcggaagccaagggactgcgagcgagattaactgctgtaaagccctgcgccccaagaagggactgcacacgtgggttcccgtgttga

SEQ ID NO: 11084 - RNA, 966 nt, unidentified
  source 1..966: mol_type = other RNA; note = synthetic construct
atggagcatcaggatcgtaaagcttacagtaaggttgggcctatcggatgcattgacgcgcttgccagtatgctgtcaatcagcgctaaagacctgttgactgtatctaagagcgtggagagcttctggataccaggtaagacccttcgaaagaaatcaggagagcccaggctcacctcaaacgccaaggagccacttaagggcctgcatgaaaagatcaagaatcgcctcctgaaacgggtgtgctatccttattacctactcgggggcatctccgactccatgatgccccgcgattacaaatgccacgctgctatacactctggaaagaatatcttgatttcggaggatatcaaggactttttcagctccaccaaaaccgatgttgtacactccatatggcagtgtttatttcatacaagtcctgacgtggcatccgtgctgaccagcttaactacatataacgattgtctaccgcaaggctggaagactagcgggtatttggccaaccttgccttttgggacttggaacccgacctcgtggaaaggctggaaaaacgaggcttcagctactcacgcttcattgatgacatcaccgtgagttcccgctgccgtatcggtgcctccaagaaatctttcgtcatatcggagatttacaggatgctgtccctccgaggatacagccccaagcgggcaaaacaccgcattgcaacaaatgataacagaatgggggtcacaggtctgaacgttaacaagaatacgtcttctatgccaaaggagaagaggaaaatcattagggccatggtgcatagatgtgagaatcactacatgcaggacagaacatctgaagggtataggaaatcatgggaacggacatctggcaaggtcagtactctgacccggtttcacgaaactgagggcaataaactgagaaagcggctgcagacggtcaaacctattagatga

SEQ ID NO: 11085 - RNA, 1026 nt, unidentified
  source 1..1026: mol_type = other RNA; note = synthetic construct
atgggctttcatcctctcccacaggtaaccccgatcgccaatatatctagcctggctaacctcttagagatcacagtcgaagatctggagtatgtccttgccaacaaggaccgttactggtgcccagggaagaaactaaccaaacctaatggtgaagtgaggcacacacacaacgcaaagcctcggctgaaagccatacaccagaagattttggacaagctgttgaagaaagtgttttacccgatctacatgcagggcggcgtggcggatctgcttaatccccggagctgtaggacccacgccgcgtttcattgtaataagtctatcgtgatctccgaggacatcaagtcctttttccccaactgcgactataaaaacattagatcgatctggcaggggtttttctgcatggcaccagaaatcgctgagatcttgacacagctgacaacatatcaaaatgagctaccacagggttggaaaacctccggctacctggcacaacttattttctacgatattgagcctaaactcgtcgaagaacttgacaggcagcaagtagcttattccagatacattgatgacatcactatcagctcatcaagactgctgacagatcgacagaagacggacattatctcaaagatttacagcatggttttccacaaggcccatcacccaaatcggaagaagcagactattttttccccctctgttaacggagtggggaaaaccgtgactggactgacggtgaatagcaaaaagcccacaataaacaatgacaaacgcaaaaagctccgaagtgatatacataagttaagcctcagattccacactgacaagaacctgtatagttatgacaaggattggcgctctattacttccaaagtcggacacatcaagactagtcatcctcggcagtggaaaaaattcaggcaagagatgaacgccataaagcccaccttcaaacgcaagaaaaagaccaacaccaaaaaagctgttttcaagggaacgattgatggcaagtga

SEQ ID NO: 11086 - RNA, 966 nt, unidentified
  source 1..966: mol_type = other RNA; note = synthetic construct
atgtctagtaaagacctggctcctagggtaggctctatatcaaatattgcaagagtgtcctccctagcccggatcctggggactacagacgataggctgttgtacatcgccggaaatatcgataagtattggaagccagggaagaagttaccgaaatccgatggtagtatcagaatcaccaatgatgctaacgacgtgctgaagaatatacacgagaggatcaataggaaccttctgaagccatgcttttatccacgatacttaaacgggagtctgccgggcagatcaattagaaaaaacgccgagtttcatctgcgctctatggtgctcgtgaacgaagacatcgaaaatttttaccccagcgcccggttccgccagattaagggcatttggaagtacttcttcaaatgttcagacgaagtggctgtcatcttgacgaagctgaccacatataaaggcagccttccacagggctggaaaccctcgagctatcttgctaaccttctcttctgggacaccgagtatatacttgtcgagaaactccaagcagccggattttcttactcccgcctgatggatgatatcaccgttagcagtcgcaagccctacactcctgaaaaattgtcagttctcataagcgatctcaacctgtttctccactccaaagagtttaagttgaagagaagcaaacactccatcaagccctcttatacacggcaaacagtcaacaatcagattgtgaacggttcgaaggtgaccgtccctcgagagaggcgtaaactgattcgggcgctcgtacacagcttagaaattgactactcttacggagcagtgttctccgacaaatataagactaagtggaagagcgccagtcagcgcgttgggggtctgaaacatggacatctgtcagagcggaattccctacgacagcgtctgcagaacattaagcctagaatcaggttctga

SEQ ID NO: 11087 - RNA, 909 nt, unidentified
  source 1..909: mol_type = other RNA; note = synthetic construct
atggccaagcacctgggcctccctacagaacacttgatcgagatcgctcagaactcagccagccattggaggcaggggcctgatcttgtcaaacccgacggctctattagaaagaccaattccgccacgcagcagctgaaggacgtgcacacgagggttaagtttaagattctccgcaaaaccttttacccagattatttgtacggttctctccccaaaacacttgaacagggagtaaggaatcatattgctaatgcagagctgcacgcgggacagaggctgatcatcagcgccgacattaaagggtactttccaagcgtcgaccccgttgttgtgcacgggatatggcaggggttctacccgtttgcgcatgatgtggctgaggtgctgaccaagctgagtacctacaagaacgaaatgcctcaaggatggggcccaagctcgtacctggcacagttagtattctatgacactgaacatgatgtggtcgagtacttacaatcacagggtttccaatattccagactgaccgatgatataacattgagtaccaaccggtccctcaaaaaatctgagatcactgacgcaatccgcactctgaatcgaatgctcaatcggaagggtactaacattaaccgttcaaagacacgcgtcgacagccccaaaagacagcaaagtgtcaacaagatcaacgtttccgtgcgtggcatgacactaagtcagaaatatcgcaaggctgtgcgagccaaagtgcacaatgtggtgaccaaccctgaactattcggagataagcttcacagagagcttcagtcagcaaagggcaaaatatcctatttgggcaagttccatgaggccgacgccaaaaagctgaaaagccggattcggaattttgagctgtctactaagtga

SEQ ID NO: 11088 - RNA, 975 nt, unidentified
  source 1..975: mol_type = other RNA; note = synthetic construct
atgaggctctctcagctgtcacctcgctatgcgaggcgtcgaatccagcgggtggaatctcttgcaaagttgcttggcacttccccaactgaccttgcagccctggcggccaattctgctcactattggatcccgggccggactaaaacaaagagcgatgggaccaagaggcacacgtccaacgccctcgaaccactaaaatccattcataaggccatcaagaacaaaattctgcgggccacgagttatcctcactacctgatgggaggtcttccatcagacgaagaggccggctgcattcgtcattgtgaagagaatgctaagagacacagcggccagagaattgtggtgacagaagatatcaagagtttctaccccagtattactgcaagtagaattcatgacatttggcaggggttctaccgattctcgccagaggttgcagagttgttgacaaaactcacaacgtaccgcggcgtagtccctcaagggtgggttccatcatcctatcttgccaatctcgccctgtgggactgcgagcccgggttagtcgcacacctcgagcggcagggtctgacctacactaggtggatcgacgatatcaccataagcagcaaaacatttgtggctcccgcgtgtaagaccgccatcgtgacagctgtgtacggtatgctgcgctccgccaatttttctcccgctcgaaccaagcataggataaggacccggggacaaaatcaacgcgtcatgaacctgaacgtgtcgggaaaaagacccaccgtacctcgacagcggttggccgaactgagagctactgttcgcaacctgttacgcgacgctggctcactgtctgcggccgattataccagcaaaagagataggatcgaggggcagataggatccatcagcaggatgcacccgcgcctagctgagagactccggaaccagctggcaagcgtcagacgtcctgcaaattga

SEQ ID NO: 11089 - RNA, 924 nt, unidentified
  source 1..924: mol_type = other RNA; note = synthetic construct
atgtcaatcgtgctgagctccttctatccctacaaacctataagtaggcttgatagcttagcaaaagttctctccgtcgacgtgagtgcactggaaaaaattgcatctctggcctcatcgtactatagggagaataagctcaaaaacaataggatcacttacacagtcctgtccccgctgaaggagatacaggagaagatcaaaaagaatctgctggacaaggtcgtgtgggcctattatctgcactcttatattaagaagcggaatacgaaaaccaacgctaccgctcacctgtttaaaaaagccctctttaataaggacatcaaaaagtacttcgacaattgcaaagaaaagcacatctacaatgtatggtccaagttcttcaactttactgacaatgtggcctctatactgaccaagttgacaattcgaaacggcgagctcccacaaggttcttgtacctctcccagccttagtaacctcatattctggaaagatgaaccacggcttgtgtcagaatttaacaagatcggactagcgtacaccagatatgccgatgatatctcagtttcctctaagaacaaaaaactggataaggtgtacattatcggcaaaatatacgggatgttttccaaaaatggtttcaagcctgctagagagaaacataagatttataacagcagcgagaaaatggtagtgaatgggcagacagtcaactccaaaaacgtgactttggataagaagtacattttgaaggttcgcagctatatttacaagcttgagaaacgtatcaacacgttaacaaagagcgaattcgacatcgactatcagagtattttagggaagattaactacatcaagcagtacaacaaaaagggcctgggactagagtcgcgcttgaataagctcctggacatcttttga

SEQ ID NO: 11090 - RNA, 960 nt, unidentified
  source 1..960: mol_type = other RNA; note = synthetic construct
atgaagccacactacctaaacaagccgatatctagtatttcatccctggccaagtgcctacagacaaccgtcgacgaattgcaaaatctgagcactaatgctgacaagtatttttttcttgccaacagggtccagaaggaagatgggtcttaccgagacacttacgacgtgcgccaacgcctgaagatcatccatgacaagatcaccaaaaatatcctcaagaaggtgtactaccccgattatcttcaaggatccctggcaaagaaagaccacatcagtaacgcagaaatccactctgggaaaaaggtgataataaagggcgacatttccaattttttcccaagcataagcaaagatatcatttaccagatctggattgaattcttcaacttctcaaaggaggtggccgagttgctctcccggctgacaacatttaacggaaagatggtgcagggctgtaaaacatctagttatctggcgaacctggtcctgtggtcccgggagtacaagtttgtgaacctgctgaaatcacagggttttacctatactcgctatgtcgatgatgtgcatgtatccagcgaacgaatcatgcacaaatctgagaagacgaaaattatctctaggatctacaatctcttcgctagcattaacgtacggcctaacagaaagaaacaagagatcatgcctaggaatcagcagcagattgttcacaaactcaacgttgataagagtacccctaacatgcccaaacagaaaagaaacgagattagaaaactcgtgttcatctgcggtaaagccttcgaggacaataatatcaccttgagcgagtacacgaaaaattataacactgtcatgggaaaggttaattatcttagacggctccatcccaaatgtggcaatcttttgctgtcaaatttaaggtcgatttccccattaaagcgtatgaagataattagctga

SEQ ID NO: 11091 - RNA, 951 nt, unidentified
  source 1..951: mol_type = other RNA; note = synthetic construct
atgaaaccacgctacctgaataaaccaatctcttcaatcttttctctcgcaaagtcactccaaactacggtggaagagctgcagtacctaagcgccaacgccgataaatacttctttttggccagtaaagttcagaaagatgacggttcctatcgtgaaatttacgatgtcagtcagaagctgaagaatatccacgacaagattacaaaaaacatcctcaagaaggtctactaccccgactatttgcagggctccctcagcaagaaagatcacatctctaatgcggagatacatactcgcaaaaaagtgattgtcaaaggagacatctcgaatttctttccgtccatcggaaagaacatagtgtatcaagtatgggtggttttctttaatttctccaaggaggtggctgaactcttaagtaacttgatcaccttcaatggtaggatggtacagggctgcaagacatcctcttatcttgccaatctggttctgtggtctagggagtccaaacttgtcgagagcctgaaattgcagggctttacctatacaaggtatgttgacgatgtacatgtgagcgctaagaggattatgagcaagagtgagaaaaccagaatcatcaagggaatctacaacctgttcgcatcaattaacgtgcggcctaacagaaagaagcaggaaattatgcccagaaacttacaacagaccatacacaagctcaatgtgaacaagtctatgccaagcatgcctaaacagaagagaaatgacattcggcaactggtgtttctatgtgggaaagctttcggcgataatcggcttgcaatcaacgagtacacaaagatgtacaattcggtcatggggaacgtgaactatctgcgacgcatacatcctgaagaggggggccggcttctgagcaagctgaagtcaattactccctccaaccgattcatttga

SEQ ID NO: 11092 - RNA, 957 nt, unidentified
  source 1..957: mol_type = other RNA; note = synthetic construct
atgattgtgtatccatataagccaatctcctcactgaaaagtctttctatcgtcctatgcattagcgagcaggagctgcactacatttatatgaactccgatagctactatttcctgacgaaggacattattaaaaacgacggtagtcataggttgacttacgatgtgaaatctaagctcaagaccatccacgataagattaccaaactgatcttgaagaaggtgaattaccctgactatttgcaggggagcctcagcggcaaagatttcataagtaacgccaaaaaccactccaaaaagcggattataatcagcgaggacattactaacttcttcccgtctatatcaaaggaaatcatataccagacgttttccaagctgttcaattttagccccatagtttgtgacatcctttccaaacttgtaacatataaggggtatctcgtccaaggctgtaagacatcatcttacctatgcaatctggtgttatggaatagagaaaaagcgctcgtggacaatttcaaaaagaagggatttacgtacacccggtacgtggatgatatccacattagctcgaactcatttatcaacaacgacgaaaaggaatacatcatcaaaaaggtgtacaatctgatgagaagtatcaatgtcaagcctaatcgcaaaaagcacaaaattatgaccaacgacaatagtcagtctgtccatggagttattgtaaacaaaaaggccgctttttccaaggaatatcgcaatgagatccgaggcctcgtgtttaattgccagaagaagtttaagctttcaattaacgagaaggagtataccaaattctaccaatccgtcttaggtaaagttaatctgttgaagaggctgaacgagaacgaggcaaagaaacatctgaacactctgtctaaaatcaaacccatccacttcaaggaaaaagagaaacatgattga

SEQ ID NO: 11093 - RNA, 945 nt, unidentified
  source 1..945: mol_type = other RNA; note = synthetic construct
atgatgaagttttcatatcaaaacaagcccatttcaagcatcgacagcttggctaaggctttatccatcagtgttgacgaactgttctacctgtacaacaattccgataaattctactacgtcgccaagatagagccaaaacctgatgggtcctttcgtaaaacctatgacgtgaagactcgcctgaagaagattcatgagaagatcaacacaaatatcctgaagtgcgtgaaataccccgattatctacagggctcacttaaggagagagatttcctcagcgatgcaaacaagcacaccaacaagaagattattatcaaggaggacgttagcaatttctttccatctatctccaagaagattgtatatcaggtttgggcgattttctttaacttcactcatgaggtgtctgaaatgcttagtgagctgattacatataaagggttcgtcgtgcagggctgtaagacctccagttacatatgtaatctcatcttgtggaatcgggaggaaaagctcgtaaatgagttcaagaaacgcggctttatatatacaaggtacgtggacgacattcacgtctcatcgtgcaacataatcaaaaaagagaacaagcgatacatcatcaacaacatctataagctcatgtattctgttggagtgcggcctaatcgagaaaagcactctgtcatgcctaaaagcgacgtgcagaccgtgcataacgtaaatgtggataaagccataccaagctttcccaaacagaagaggaacaaaattagacttggtgtgtacaattgcgagaaactgtacgacattgaaaagcacacggaaaaataccggaaactgtattttagggtcctgggacaaatcaatatgatgaaaagattgcacgagaaagaagcccataaattaattcagagactgcgcaagatcaggccggaaaatatctga

SEQ ID NO: 11094 - RNA, 945 nt, unidentified
  source 1..945: mol_type = other RNA; note = synthetic construct
atgatcccaaagtacctctttaaacctgtggccgacttagatcttctggcgaagatacttggcattacaaaacaggaactggacgacctctatcattcttcagattccttttttttcctgcacgagagaaagcaaaagagtgacggttcttatagagacacctataacgttaagaagaggctgaaaattatccacgggaaaattagcaaagagttcctgaagaaagttaattatccggactatctacagggcagcctcaaggataaagattttctgaccaatgccaaaaaccatctgggacaaaaaattctcataactgaggacatcaccaacttttttccctctatcagcaagaaaatcgtcttcgaggtgtgggtcggattctttaaattctcgaaagaagtcagcgagtacctcgctgaacttatcacgttcgagggctacctggttcaggggggaaagacttcatcatacatttgcaaccttatcttctggagtagggaatccgagctagtggactacctcgccaagaagggctacaaatatacacgttacgtcgacgatattactgtgagcgcaaacaaaattatcaccttaaaggagaagaccgatattatacgccggatttattccctgctgaagtctgtaggggccaaacccaatagaatcaaacatcagataatgccacgcaacaagcggcagatcatccacaacctgaatgtgaaccagaataagcccagtatgacaaagaagaagaagaacatgatcaaggcagctgtgttcgaatgtgaaaagaagttccaaaccgatcctaattccaaggagtacttgaaattgttcaataagacaatgggccgagtaaatcacatgaaaaggatacaccctaaaattggtgacgtgttgcagaaaaagttgaaactgatcaagccccaggataaattttga

SEQ ID NO: 11095 - RNA, 966 nt, unidentified
  source 1..966: mol_type = other RNA; note = synthetic construct
atgtccgagcatagtagctttagatatccatacaaaccaatcgcgtccctggaaaaattagccatctgcctgaatataacgcttgaggaactgaactatctacaagagaacgccgactcattttactttctgaccacacgcgaacagaaaaaggacgggagcttccgcgagtgctacgatgtgaagaagcggttgaaggacatacatgagaagatctccatcaagttcctcaaactgattgagtatcctgaatacctgcagggcggcatcaaaaagagggattacatttcaaacgctagtcagcacacatgtagtttcgacttgatagaagaggacatctccaatttttaccctagcatcagccgggagatcatctatcaggtatgggttggattcttctgtttttcacatgaagtcgcagattgtctgtctaagttggtaacttttcaggggtatctggtgcagggatctaaggtcagcggtctgctttgtaatctgattctgtggaaccgagaaacaaagttagtcatgaatctcaagaggcaggggctcacttacacccgttatgtggacgatgtgacggtgtcttgcgatcgctacctcagtaacaaggaaaagcagcaaatcattaggaagatctatgctctgttctacactgtgggagcaaaacccaaccggcgcaaacacaaaattgaaagaaaaggcacacggcagaccgtgaataaccttaatgttacctcagagaacccgaccttgcccaaggagcaaaggaacaaaattcgagccgccgtcttcgaatgcgagaagattttcagaataggtaactcttcccttattcaatacaaggagctgtttgagagcaccaagggccgtgttaatcagctcaaaaggtttcacaaaaaacaggcaaattcgctactcaaaagactcgaggaaattcaccccaataagttcaaagctacttga

SEQ ID NO: 11096 - RNA, 966 nt, unidentified
  source 1..966: mol_type = other RNA; note = synthetic construct
atgaacgattgtacgagtttcaattaccctggaaaacccatcgcttctctggagaaactggcattactcctcggcataagcctcgaagacctgatttacttacaaaaaaacgctgacagtttctacttcctggtgaaaagggaggagaaaaaaaatggctgttttcgggaatgctacgatgtgagagagcgcttgaagaacattcatgagaagaatttcgtcaggcttctaaaggtgatttcttatcctgagtacctacagggcgggattaaaaagagagactatattagcaacgccaaccaacataccagaagccacacaatcataaacgaggacatctccaacttttatccatcaatcagcaggaagatcatctatcaggtatgggtaggattctttcacttctccccggaggtggccgactgtctgtctcagttggttacatttcagggcaagctcgtccagggatcgaaggtgtccggactgctttgcaatctgatcctgtggaatcgagaagataaactggtgatgtcccttaagagccgtggcttgacatatacccgctacgtggatgatattacagtgtcctctaatagatacctgtcaaatcgcgaaaagcagcagatcatccgagagatttatacgctgttttatactgtcggtgcgaaacctaaccggtccaagcacaaaattgcttacaaggggaccaaacagaccgttaataacttgaacgttacttcagaaaagccaacccttcccaaggaaaaacggaacgaaatccgtgcagccgtcttcgaatgcgagaagaagttccaggaagggagtagttctatcgtggagtacaagaagatatttgagtcaactaaaggtagggtcaatcagctcaagcggttccataaaaagcaagccaacgacttactgcaacgcctcgagaaaatacaccccaatagctttaaggccgcatga

SEQ ID NO: 11097 - RNA, 963 nt, unidentified
  source 1..963: mol_type = other RNA; note = synthetic construct
atgaacaagcctgtgtctttttgttatccccacaaaccaatagcctccctggaaaagttggctatttacctgggtatcaccttagaggaactgctctatttacgccagtactctaatagtttttacttcctgcatgaacggaaggaaaaagccgacggcaccttcagggatacttacaacgtgagagatcggctgaagaacgttcacgagaagattgctaagaagttctttacgattctggattaccctgaatatctccagggagggatatgcaaaaggagctctattacaaatgccaaacagcacatcggcatgaatatcctgatcaaggaggacatatctaactttttcccatcaatctccaagaagattgtacatcaggtgtggaccgggttcttccatttttcacatgacgtggcggactgccttgctgagcttgtgacttaccagggctatctcgttcaagggagcaaggtcagtggattcctgtgcaatctaatctggtggcaaagagaggccgacctggttgcagagttccagaaacagggactggtctatacaagattcgtggatgacgtaaccgtcagcacaaaacgcaacctttcaaacgcagagaagaagaagatcatcagcaagatttactcgctctttcacagtgtcgatgccaaggctaatcggaaaaaacagaagatcatgcacaaaggtcaccagcaaactgtcaataacatgaatgttagcataggcaagccgacattgcccaaagagaagcgtaaagaaatcaggaccattgtgttcaaatgtgagctgaccttccaaaataaagaaattcacatcactgcatacgagaagttgtttaactccgcgaaaggcaaggtgttttatctaaaacagtttcatacggtgcaagccgaacagcttttgcagcgactcaacaaaattcagcccaagttctttaactcctga

SEQ ID NO: 11098 - RNA, 936 nt, unidentified
  source 1..936: mol_type = other RNA; note = synthetic construct
atggctgaatttgcatatccgcaccggcctatagcttcgctcgagaaacttgctatcgtcctcgatactaccgtcgccgagttagactttctcagtcagaacgcaaataacttctacttcaaggtgaaaagcatccagaaagccgacgccagctatcgtgacacttacgacgtccgggatagattaaaaaccatccacgccaagatcgtgaagaatttccttagaattatcgattacccagattatatccaaggtggggtacctcaccgggactacctgtccaatactgccatgcacactgcgaagcaggtggtcatatctgaagacattacgaacttcttctcaagcgttagctgcaccatcatatatcaggtctggtctaggttctttaaatttgctcccgttgtgtgtgagtgtctaaccaatctggtgacataccagggatttctcgtacagggcgccaagaccagtgggtacttgtgcaacctgattttttggaaccgcgagcaattcctggttgacacattggcaagtcagggttttacatattcaagattcgtggacgatatttcaataagctccccaaaagtgattacgtccgagcacaagaccgaggtcattgcaaagacatacggaatgttgcagtcttgcggcgtgaaacccaaccgcaaaaaacatcatatcatgtcaaagggcagctcccaaaaggtgcatcgagtgaatgtagtgtccaataaacctacattcgataagaaagagcgcaacgccattcgagccgcagtgcatgaatgtgagatgaacttctccaagagcaaatctagttctgaatatgagaagctgtttaataccactatggggagggttcaaaagatcaagaggcttcacattgaagaagcgaataagctgctggctaggctgcagaagatcaagccctga

SEQ ID NO: 11099 - RNA, 942 nt, unidentified
  source 1..942: mol_type = other RNA; note = synthetic construct
atggataacaatgcattccattatccctataaaccaatcgctaatctgaagtctctggccctcagcctggacatcaccttggagcgattactctttctacagaagaactccgataatttcttttttctgcagggcagagtgaaaaaagaggacgggtccttcagggagacttatgatgtgaaagaggagctgaagaaggtgcatgctaagatcgtgaaaaactttttcaatgtgctgaagttcccttcatatctgcacggcggaattaagaagagggattacattacgaacgccaagcagcacctccaaccaaaaaccatcattagtgaggacatcaaaaatttcttcccctctatcactaagaatctggtctaccagatttggagcaacttctttaagtttagtcatgaggtagccgaatgtttggcggaaattactacatttaaaggtagcctagtgcagggcagcaaggtcagtgggtatattggcaacctggttctctggcaacgggagcccaaacttgtggaggaattcggcaagaaggggtggatatatacacgttttgtcgacgatatcaccatatcgtctaagcgcatacttagcaataaggagaagagcgaaatcatttctaaagtctatggattgttggcaagtataaacgtcaagccgaatcggaagaaacactccatcatgaaaaatggtaaagaccgccaaaaagtgacacagatcaatgtttcaacccagcggcttacattatcaaaaaaggagaggaattccattagatccgaagtttacttctgcgagaagttttacaagaactacaacaaggaagaatacaagaaactctacaactccattaaaggaaaggtatacaaccttcgaagattccaccaggacgaagccgataaactcctgaacaagctgaacaaaatccctccttga

SEQ ID NO: 11100 - RNA, 951 nt, unidentified
  source 1..951: mol_type = other RNA; note = synthetic construct
atgagcaaccctatttacccacataaacccatcgggtccctggaagtattagcgaacgtcctcggaattcgggacattgatgagttactcctgatcaagaagcactctgacaattttttctttgtggcctccgtcattaaaaagagggatgggaccttgcgaaacacttacgatataaagcataagctcaagagcatccatagaaaaatcaagaacgttttcctgaagaagatttactatcccgaatacctgcagggcagtctggcaaagagggattacctgacaaacgcaaacattcacacaaactcaaagtgcataattacagaggacatcaagaatttcttcccctctatatcaaaagacattgtggtgtcgatctggaaaaacatctttcacttcccacacgatgtcagtgaaacccttgcagagctgatcacgtataagggatttttggtacagggttccccagtgagcagttacatagccaatcttgctctgtggtacaaggagccggagttggtgaatactctatctcagaagggctttatttacactcggtatgttgacgacatcagcgtgtctagtaaacgaccgatcacaaaaaaagagaagacccgcataatccggcagatccacacgatgctaagctccattggtgtggagctgaatcgcaaaaaacacaaaattatgccccgtaataacagacaagaaatccatcgcgtgaatgtgaatactaacgctcctaccctgcccaaaaaggagagagaaaaaatcgaatcagccgtctatcaatgcgagataatgtataaaagctccccaaaatcaagcgaatataagaccctgttcaatgctacccagggcagagttaatatgctttctcggttgcattcccctcttgccactaggctcaaatgtaggctcgagaagatcaagcctattaagaacacatga

SEQ ID NO: 11101 - RNA, 948 nt, unidentified
  source 1..948: mol_type = other RNA; note = synthetic construct
atggacatcctgacaaaagtgctggggcttaaggacactaaccagctgaaggaattaaaggagaacagcgactcgttctttttcatagcgaagaaagagaaaaagagggatggtacaatacgcattacctatgacgtgaagagtgagcttaaactggtgcataagaaaatcactcggaagctactcaagaaggttaattacccagattacctcaaaggcagcctaccaaagagagattatttggacaacgccgatgcccacacaagttcaaagtgcatcatcacagaggacatcaagaattttttcccctcaatcagaaaagacatcgtaattagcatctggaaaaacattttccactttccccacgacgtagctgaaactctggctgagctgattacctacaaaggctgtctcgttcagggtggcacagctagctcttacatagctaatttggccctgtggtacaaggaaccagccctcgtcaaagagctgcatgatcaggggtttaggtataccagatatgtggatgatatctccgtgagctccaaaactataattacgccgaaggaaaagaccaaaatcattcgcaagattcacatcatgctttctagcataggagtcaaactgaatcgtaagaagcataaaatcatgcccagaaatgagtcccaaaagattcaccggattaacgttaacactaataatcctaccttgcccaagaacgaaaggcgaaaaattggatcggcagtgtaccaatgtgaacagatgtttaattcttcctccaactctcaggaatatgagaacctgttcaacagcacgttggggcgagtcaatatgttaagtaggctgcatgacagtctcgcagcaaagctcaagtgccggcttgagaagatcaaacctatcaaaaaaaccaccatgtcacaggcctcctcactggtgcctcgctcttga

SEQ ID NO: 11102 - RNA, 939 nt, unidentified
  source 1..939: mol_type = other RNA; note = synthetic construct
atgaacaagccaaattacccctatgaacccattggatcgatttcaacccttgcacgagttctgggcctagaaacacaaaaactccagaacttatacgataactctgacgacttctttttcgtcacaaagaagaaactgaagagcgacggtagcttccgcataacttacgacgtgaaagccgaactgaaaagtgtgcaccggaagatcgccaaggaactttttaagaaggtgttctaccctgagtatctgcagggcgggatcgccaggagggattatatcggtaacgcgaatatccatatcgattccaaatgcatcatcacagaggacatgaagaattttttcccctctatctccaaggaaattgttatcgatgtctggaaaaacgtctttcactttccacctgatgtatcagagattctggctgagttgattacctataaaggatacttggtgcagggatgtgtcgcaagcggctacatttgcaatctggttctgtggaatcgtgaggcaaagctcgtcgtgaaattgaagaaccgaggcttcatctattcacgctatgtggacgatatctctgtgtcttccaaacggattttcacgactaaggagaagactgagattatcaaagacatacactccatggtgacaagtataggggtgaagcttaaccgcaaaaaacacgagattatgccaagaaataacagacagaagatacataggctaaatgttaactcctaccaggcttcaatgcctaagtccgaaagagagaagatcaaagctgccgtgtatcagtgtgagaagctgtacataaccgaaccctctagcgaaaagtacaaaagcctctttaatagtacccaagggagagtaaacagcctgagtaggctgcataaggaccacggcgataaactcaatttacggctcatgaagattaaaccgtactga

SEQ ID NO: 11103 - RNA, 942 nt, unidentified
  source 1..942: mol_type = other RNA; note = synthetic construct
atgaactctccaacttaccctaactcaccaattgggagccctgccattctcgctcgtgtcctgggtattgatcccaacatactcctgagcctcaagaagaactcaaattcatttttcttccaggcaaaaaccgaagaaaaatccgacggcaccctccgaataacatacgatgtgaaagagcctttgaaaacgatccatagaaggatcgctgaaagacttctaaaaaaggtgacgtatccactgtacttgcagggtagtctgcctaaaagagactatttagggaatgccgctatccatacaaactctacctgcatcatttcccaggatgtgaagaacttctttccatccatcagcaaaaatacagtggtgcaagtctggaaaaatgttttcaagtttcccgaggatatcagcgaaattctggcggaactgatcacatatgaggggtttcttgtacaaggctgcatcaccagtagctatatatgtaatctggtcctgtggaatcgggagtctaagctcgttgacgagttaaaagaaaaaggattcacctacacaaggtatgttgacgacattactgtgagttcaaagcgaatcttcacactggaggagaaaaaggagatcataaagtccattcactctatgcttaagtcgatctccgtcaagctgaatcggcgcaaacacaagatcatgccccgtaacagtcagcaacaggtgcacagggtcaatgttaactccgatcgcactactatgcccaagtctgagagggagaaaattaaggccgcagtacatcagtgtgaggaattatacaaaaccctagccgaaactgaggagtacaaaaagttgtttaaccagaccctgggacgcgtggtgcacctcagcagactgcacgaacggcagggcaagaagttgaagcagaagcttagcaagatttacccgcggaagtga

SEQ ID NO: 11104 - RNA, 990 nt, unidentified
  source 1..990: mol_type = other RNA; note = synthetic construct
atgaataaactgtcttacccacatgctcccatcggcgaacttgataagctggccaaagccttgaacattgaattaagcgagttacagacaataaccgataaatccgactcacttttctttcaaacgaaagagatcatcaagaatgacggtagttctcggttcacatacgatgcaaggcccacactcaaagtcatacatggcaaggtttgtgaagctttcctaaaacgcgtgaattaccccgactatttgcagggtagcatcaaacggcgcgattacctgactgacgcccggaagcacgccggatcaaaggtcctgatcagcgaagacattaccaactttttcccctctataagtaaaaaggttgtgcacgaaatgtgggtgggggtctttggattctctaacgttgtggccgagtgccttgcggagctggtgactttaaatggatttgtcgttcagggcgcaaagactagcagctatatttgtaatctggtgctctggaacagagaggagcgtctcgtaaactcacttaaaacgagaggactgatttataccaggtatgtggacgacgtgactgtgtcgtcaaagcgtctgatctcgctgaacgagaaaagcaagatcatcaattccatttactccctattccgcagcattggggcaaaacctaaccgaaataagcacaagattatgccacggaatacccagcaggaagtgcatggcgtaaatgtgaacaaaaaccaaccgaccatgcctaaggaaaaaaggaagaagatcagagcggctgtccacaggtgcgagattacttataagcagaccccagatagtatcgagtactgcgctttgtttaactccgtaatggggaaagtcaacacactcgggagaatgcacacatccgaggccgataagctccgactgcgcctgtctcaagtcaagcctgttagtgcacagtccttgaacaagcctctcgtgtctaataccggcctgataacctga

SEQ ID NO: 11105 - RNA, 945 nt, unidentified
  source 1..945: mol_type = other RNA; note = synthetic construct
atgagaaagcccaattatccccacgcaccgattggtgatctcgataagctggcactggctttgcatgttagcaaaaaggggctgcagacagtgacagcccaatccaatgacctgtttttcctgactcggaagataaagaaagaggatggctcctatagactgacgtacgacgcgaaaccctcgctgaaaagcctacatggcaagatctgtgaggcattcctcaaaagagtagaatacccagactatcttcagggttctattcggaagagggactatctgacagacgctcgcagtcatgtgggctccaaggtgttaatcagcgaggacataaccaacttctttccttcaatttctaagaaaaccgttcacgagatgtgggtcggagtgtttgggttttctaatatcgttgccgaatgcttagccgagctggttacgatgaatggagatgtggtgcaaggagccaagacttcatcttacatttgtaacttggtcctttggaacagggaagcccagctcgtaagtcagctgcgaaagaaaggtctggtatatacccggtacgtcgatgatattactgtctcaagtagacgcagcctctccaagagcgagaagagtaggatcatcagctccatttactcaatgtttcgatcaattggcgctaaacccaaccggcggaaacacaagatcatgccacgtaacacacaacaggacgtgcatggcgtgaacgtgaataaggacaggcctactatgccaatggagaaacgtaatcagataagggcagccgtccaccgctgcgaaatcgcgttcaacgggaggccttcctctagtgaatacgtgtccttgttcaactctgtgatggggaaggtcaataccatgggcagaatgcaccgcagcgaggctggaaaactaaaagcccgactccttcaggttaagcctgtgatcacctga

SEQ ID NO: 11106 - RNA, 945 nt, unidentified
  source 1..945: mol_type = other RNA; note = synthetic construct
atgaaccagccccgctatccctttgctcctataggcgacctggagaaattatccttagccctgggagtgaaactgctagagctgtacgacttgaaggcacgtagtaatgaactgttcttccaaacaagagacattgtaaagcctgatgggtcccatcggatcacttacgacgttcgcgctccactaaaactggttcacggcaagatatgtgaggtgtttctgaggagagtggaatacccggaatacctgcagggcagtattaagaaacgagattacttgactgacgccaataagcacgtcagatctaaagtgttgatcagcgaagacattacgaacttctttccctgtatcagcaagaaagtaattcacgaagtgtgggtgggagtgtttgggttcagcaacgaagtgtcagattttcttgcggagctcgtgaccctggatgggtttgttgtgcagggctccaaaactagcagttatctttgcaatctcgtcctgtggtcccgagaggcacaactcgtgaagaggctgaagatgaagggccttgtctataccaggtacgtggacgacataaccgtctcgagtaaaagaatcttgaacaacaaggagaaatctgatatcatcaacagcatttacgctatgttccggtcagtcggtgccaaacctaatcgcagaaagcacaaaattatgccacgcagcgcacagcaggaagtacacggggttaacgttaatcggcagcaggccacaatgccaaagtataagaggaatcaaattcgggctgcagtacatgagtgcgagatcatattcgattcagattcttcatccgagacatatatctctacattcaactctgccatgggtcgtgttaatacccttggaaggatgcataaggtcgaggccgaaaagctcaaggtgcggctcgaggcggtgaaacccatcctcgtctga

SEQ ID NO: 11107 - RNA, 945 nt, unidentified
  source 1..945: mol_type = other RNA; note = synthetic construct
atgaatctacctgtatatccccatgcttctgtggcgaacctgtcatccctcgctttggcccttggcttgtcactgaaagaactgcatgagctggcgtctacctccgatgactactattttttaacgaggaaaatcgagaagcctgatggctcgctccgactgacttatgacgctcagccaatcctcaaggcaattcacggtaaaatcagcgaagtctttctgaaacgtgtggactaccctcggtttcttcaggggagtataaaaaaaagagactacatctctgacgccaagcagcacgtgtcaagcaaaatgcttatttccgaggatattacaaacttcttcccaagcatctctaagaaggtcgttcatgaggtttgggtgggggtgtttgggttctccaatgaggtagccgatctgttggcagaactggtgacctatcaggggtacgtggtgcaaggctctaagaccagcagctacatatgcaatctggtactgtggaagagggaagctgagttagtcagtaagttggaggccaagggtttcacctacacccggtatgtggacgacgtaacagtctcaacaaagcggattgtttccaaggccgaaaagtcggagatcatcaactctatttattccctcttcagatccgttggcgccaagccgaaccggaaaaaacacaaagtcatgcccaggaacaatcgccaggaagtccacggcgtcaatgtgaacaagactgcccccactatgcccaagaaggcacgagatcaaataagagccgcagtgcaccagtgtgagctcgcatttggagatgacccaactaccagtgagtaccagagcgcttacagtagcgccatgggacgcgtgaatacaatgggaagaatgcatgaaaaagaagctcgcgatctaagggctcgtctggccgcagttaaacctgtgacgaactga

SEQ ID NO: 11108 - RNA, 945 nt, unidentified
  source 1..945: mol_type = other RNA; note = synthetic construct
atgactccaaagtatccgcatgatcccattgcccacgtggattccctgtgcttgagcctgggtgtgacccagtctaaactgaaggagatccaacgaaagtccgatacatacttttttgtcacgaaggaaattgtgaaaaaggacaacacaattagacagaccttcgacgtgaaaccagagctgaaacggatccacgagcggatatgtagtgcgttcttaaagaaggtagagtacccagcttatctgcaaggctccatcaaaaagcgcgactatctcagcaattgtgctctgcacacaggccagaaacttgtcatcagcgaagacgtgaccaatttcttccctagcatctcatcattggtggtacatcagatgtgggttggagtttttaagttttctaacgaaatcgccaccatactcaccgacctcgtttgtttcaacggatggttagtgcagggcgctaagccttcgtccttcatttgcaaccttatcctgtggaacagagaatcaaaattggtggaggaactgaaccagagggggctcaaatacacgcggtatgtcgatgatattaccgtctcatcccctactaatctgtctaagagtagcataacagagattttgagcaacatctacggtatgctggcatccgtgaatgccaagccgaataggaagaaacatcaggtgatgcccaatgggaaaagacagaacgtgcacagagtgaatgtcaaccatagtactcccacactgcctaagaaggagaggtctaagataaaagccgccgtttatcagtgcgagaaggattttgcaatcaaggtcagtaaagacgaatacgaactcctgtacaatcaaactcttggacgagtaaacaacctcaaacgtatgcacccaaagatgggggaggagctacttgcacgcctaaggaaaattaaaccctgcaatcgctcttga

SEQ ID NO: 11109 - RNA, 939 nt, unidentified
  source 1..939: mol_type = other RNA; note = synthetic construct
atgacaccccaatacccgcacgagcccatagccaatttgaatacactgtgcctggcccttggcctgaccgcttcaaagctgaagtacttgcagactaattcggacagctacttcttcataaccaaagaaatcgttaagcctgaccagtctatccggcagacctttgatgttaaaccagagttgaagagaatccatgaaagaatctgcagcgcattcctgcgcaaggtggattaccctaactaccttcaaggtagtattaagaaacgagactatctctccaactgtgcccttcataccaacaagaagctggttatatctgaggacgtcaccaactttttcccatccatcagctccaaaatcgttcacgagatgtgggtcggcgtgtttaagtttagcaacgaaattgctagtatcctcacagatctggtatgttttaagggatggctggtacagggagcaaaaccatctagctttatctgtaacctgattctgtggaatagggaagcgaggctcgtgctcaaactgaatagcatggggttaacttatactcgctatgtggatgacattactgtgtccagctctatgaatctgtctaaatcgctcatcacggaaatactgagtgatatttatgggatgctaggttcagtgaatgccaaacccaatagaaaaaagcataaactcatgcctaacggatcacggcagaacgtccaccgggtgaatgtcaacacggacatcccaacacttcctaagaaggagaggaataaggtgaaggctgcagtccacgagtgctccttaaaattcaaagccgataactcctcaattgagtacaagtctctctataacagtacccttgggcgagtgaacaatctggctcgtatgcaccccaaattgggcaaggagttaaggacaaaactaattcgcttcaagcccattatctga

SEQ ID NO: 11110 - RNA, 1002 nt, unidentified
  source 1..1002: mol_type = other RNA; note = synthetic construct
atgctgattaaacccacttatttacacaaacctatcgggagcatcgagagcttagcaaagtctctcggcctgtctaaggaggacctgattgaactggcgtcaaactctaatgagtacttcttcattgcaaagaaggtcgagaagcccgataaaagtatccgattgacttacgacgtcaagccacggctaaagcaaattcatgagaagatctgttgcaacttgttgaagaaggtaaactaccccgactatattcagggaggggtgcgcggcaagagctatctgagcaactgccaaaaccacacccacaaaaaaatagtgatcaaggaggacgtgtcgaacttctttcccagcatatccaaaaagattatacacgaggtgtgggcaggtttctttcattttccatcagatgtcagtgaacttctgtccgaacttgtgacctttaatgggtatttagttcaaggaggcaaagcttccggattcctgtgtaacctcgtattgtacgaccgggagtctaaactggtggaagagttctccaaaaagggattcaagtatacccggttcgtcgatgatatcacaatatcctgtctccgcaatattacaaaagatgagcagacttacatcattagaaagacctacggtctgctgaaatctatcgaagtgaaccctaataaacgtaagcacaaaatcatgtccaacggggtgcaacagcagctgcatggcgtcaatctcaatacaaataagcctacgcttcctaaggctgaaaggaagaaaattgaagccgccgtttttcagtgcgaaaaagcccatagtgaaaacagcaattcaatccagtacatcaagcagtttaactcagccatgggcagagttaataccatgaaaaggatgcatccaaaagccggtcaggctctcctagagaggctttgcaaaatcaagccgcagattaacagtcgcacatttgagcagaagcacagactggagatcttccgaaatctcgtgaattga

SEQ ID NO: 11111 - RNA, 939 nt, unidentified
  source 1..939: mol_type = other RNA; note = synthetic construct
atgataccactgtaccctcataaacccatcgccagcttgaactcactcgctaaggctctcgggaccacctccgatacactctctaacctgactgccaattccgacaaatacttctatctgaccaaggtgattaacaagcccgatggtagcgtaagaaacacctatgacgtcaagccagagctgaaaaaattccacgagcgcatcaataccttctttttgaagcaggttaagtatcctaacttcttacacggatctctgaaaggcaaggattatatttctaacaccaaagaacacaccaacaaaaaagtggtgatctctacggatgtgtccaactttttcccctcaatttcaaagaagactatacatgaggtgtgggtgggcgtgtttaatttttctcacactgtcgccgactgcctgtccgaactagtcacgcacaagggttttcttgtgcagggctcaaaagtttctagttacctggccaatctggttctgtggggccgggaaagcaaattggtgtgcttctttaataagaaagggtacgtctatactaggtacgtggacgatatcactatttcctgtgaccggaacctgacaaagatagagatcgcggacatcacaagccaggtttatgccatgttaaaatcgattgacgtcgcacctaacaggaaaaaatacgcagtgatgacaaacggaaatagtcaaagcgtacatcgactcaatgtcaaccggagtgtccccacaatgtcaaagtccgagcgcgccaagatcaagtccgcagtattcgagtgtgaaagtaaggctgctgagaatcgtggcactcacgaatacattaaactatacaatcagaccatgggaagagtgaatagcatgaagaggctccatagcgatcttggggacaagctgatcagtagacttaagtgcgttaagccgacaccatga

SEQ ID NO: 11112 - RNA, 939 nt, unidentified
  source 1..939: mol_type = other RNA; note = synthetic construct
atgaaacccacttatccccatcaacctgttgccaaactcgactccctggccctggcacttggcctcacccactcagagctcatcgaactggcttctgttgccaactccatgtatttcgtcaccagagtgattgaaaagccagacggtagtaagaggatcacacacgacgtgaaagctcgcttgaaacgggtgcacgagagaataaatagcgtctttctgaaacaggtcagctaccctagctacttgcagggaagcttaaaagggcgagattacctttccaacacgaaacagcacatcaataagcacatcattatctccgaggatatttctaacttctaccctagcatcagcaacaaggtggtgcacgaggtctgggtgggctgctttggattttctaacgaagttgccagttgccttaccgcactagtaacacataacggacacctagtacagggggggaagacctctagctacatatcaaatctggtgctctggtcccgggaatcgaagcttgtggaagagctgaaaagaaagggcatgacctatacacggtacgtggacgatgttacagtctcctcccctcgacccctgtcaaagtcggagatcacaaacgctattagttctgtgtatggcttgttcaaaacgattaatgtcaaaccgaatcgtacaaagcatgaagtgatgtctaagggcaagaggcagactgttcatcgcgtgaatgtgagcgcgggtcggccaaccttttcaaaaaaggaacgttccaagataaagactgccgtctttcagtgtgagcagctgttccccaaggctagtactactcaagagtacttgtcaatgtatagatctgcactggggagggtaaataccttagcccgcctccataagaaagaggcagatagtctgaaggagaggctgaaagcgattcaaccattcatgtga

SEQ ID NO: 11113 - RNA, 957 nt, unidentified
  source 1..957: mol_type = other RNA; note = synthetic construct
atgacattgaccccgaagtacaattttaagactataggctccattaacgcattagcacgactgctccagatccccctgaacagagtcatttatctctccaataacgccagcgatttctatcgcgtggccagagtggagcagaagaagacaggcgggcaacggatcacatacgatgcctacaaaaccctgaaagtgatccatcggaagatacagacccagattttcaaaaaggtcatctatccccagtacatgcatggctctatcagcggccgctcttacatcacgaatattaagaatcacacgaagtccaagatcgtgatttgcgaagacatctccaactttttcccaactataaaggctgaacaagtagagaaaatgttcatccgactgtttcactacccaaaaaacgtagccaaaacccttaccaatttggtcacacttaacggatccgtgcctcaggggggaatctgctcatcttacattgcaaacctagtgatgtgggagaaagaaagcattttggtcgcgaggctggctcgggaagagctcacttacacccgttatgtggacgacatcactgtttcagctaaaagttatatgtcaaagcctaaagtgagtgaggtgatcgctctgatttacggtatgcttaggtattatggtctggagcctaataaaaagaagcacgaagttctgggcaacggaacatatcaaactgtacatagagttggagtgaatgggaggaggcccagtttcggacacgacgaaaagcagctcatacgcagcgccgttcataacctgcacattctctttgtggataaacaatgtacctacgagaattacctaaaagtgttttcgagcgtcagctcaaaggtcggcaagcttaaacagctgaacgagtaccaggggaagaagtatagaacgttgttaaacaccatcaaactgtctattaaggataattga

SEQ ID NO: 11114 - RNA, 966 nt, unidentified
  source 1..966: mol_type = other RNA; note = synthetic construct
atgacactgacgcctaaatacacactatccccgatcggctccattaacgccttggcacggctgctgcagttgcccctcaatcgcgtacagtatctcgcaaagaattctagcgacctgtaccgcatcgcccgtatcgagcaaaaaaaatcgggagggaaaagggtgacatatgatgcctacaaggaactgaagagtgtccataggaagttacagcaccaaatttttaagaaggtgatctatcctcagtttatgcagggatctataagcggcagaagttatataactaatgtcaagctccataccaagagtaaactcgtgatctgtgaggacatttctaacttctttcctaccatacaggctgaaaaggtcgagaatatgtttatgagattgttccatttcccccaggatgtcgctaaaacactgacctctctggtgaccctgaacggttctattccacagggcggaatctgcagcagttacatcgcaaatctggtgatgtgggagaaggagtcagtgctggtgcttagacttaataacgctaagctaacctatactaggtacgttgacgacattacggtatcatcaaagaactacattaacaagcaggagatcagcgacgtgatcgctagcatatacgggatgttgcagcactatgggtttaaacccaaccgatcaaagcatgatgtcctcgggaatgggtcccatcagactgtgcacagggttggagttaatggtaaacgagcctccttcggcaaggaagaaaagaagaaagtgcgctctgcggtacacaaccttattaatcttttcagcgatggccaatgctcctacgagcactacttaaaaatctttagcagtgttagctccagagtgggaaagattcaacagctcaacgagtatcaaggtaaaaaataccgggaatcactgaacgccatcaaaccatccattaaacggttctatcacggctga

SEQ ID NO: 11115 - RNA, 966 nt, unidentified
  source 1..966: mol_type = other RNA; note = synthetic construct
atgacattaacgccggaatataagctgaaaagtataggctcgatcgatgcactcgctttcttgctggatctgcctttgaacagagtgcagtacctggcaaacaatgcatccgacctgtacagggtcgctcgaattgaacagaagaaaagcggcggacagcgtgtaacttatgacgcttacaaggtgctaaaagcgatacatcgcaagctgcaacaccagatcttcaagaaagtgatctaccctcagtatatgcagggttctatctcaggaaggtcttatataacaaacgtgagataccacactaaatgtaaaatcgtcatttgcgaggacatttcgaatttctttcctacaattcaggccgtacaggtggaaaagatgttcatgcggctctttcgttttcccttagaagttgccaagaccctcactaatctggtaacactgaacggatctgttccacaaggagggatctgcagtagctacatcgctaatctggttatgtgggagaaagagtccattctcgtctcacgccttttgaccgtgaaacttacctatacccggtacgtggatgacatcactgtcagcagcaaatcctatatgacgaaacaggagatttccgaggtgatcgccagtatctatggtatgttgaggtactatggcgtcgaaccaaataagtctaagcacgaggtgctaggcaatgggagccatcaagccgtccatagagttggcgtgaacggcaacagacccagcttcggtaaggaggaaaagaaaaagatacgatcagccgtgcacaacctctctacacttttttccgatgacaagtgtacctatgaggcctacctccgcgaatttagctctgtgagttcacaggttgggaagcttcaacagctgaatgagtaccagggaaaacggtaccggggggatctgaacaccatgaagccctccattaagaggttcaatctggggtga

SEQ ID NO: 11116 - RNA, 909 nt, unidentified
  source 1..909: mol_type = other RNA; note = synthetic construct
atgttgcagctgccggtccctagaattagatatctggcccagaatgcctctgatttctaccgtgtggcaaggataaagaccaaagccaacggggataagaggattacctatgacgcataccgctcactgaaagatcttcacaagacactaaaagtgcggttatttcagaacgtcagttatcccgactacatccaaggagccatctcggggaggtcctatattggtaacgtgaagaagcacacaaaatccaccataattatatgcgaggacattaccaacttttttccaaccatccgagagtccgatgttgagaagatgttcatgcgcttgtttcacttccccaaggaagtggcctcaattctgactggactcgttaccttgaatggcactgtgcctcaaggcggggtttgtagctcctatgtggcgaatctggtcatgtgggaaagggagagcgcattagtgagcctcctccaggctaaaaacctgacatacacacggtacgttgacgacatcactgtaagcagtaaatactacatcgagaaagtggaaatcggcaacgtgatcgcttctatctacgggatgcttaagcatttcggtgtgaagcctaacaaagccaaacacgaggtgctgtcaaacggaatgcatcagaaggtacatcgggtcggcgtaaatggtaagcgcccaagttttggcaaagaggagaagaaacgggtcagatccgccgtctataacctggaagctctgttcaaggacaatacgtgctcttacgatgaatacctcaaggcgttcaattctgctagcgcccttgtggctaagctaaaacaactgaacgaacaccagggacagaaatatcgagaaagcctgaatcttctcaagcccagtgcaaagagagttgagttgtcaaattga

SEQ ID NO: 11117 - RNA, 978 nt, unidentified
  source 1..978: mol_type = other RNA; note = synthetic construct
atgaaccaaacccccgaatacccacacctgtcaatcggaagcattaacagcttggcaagactgctccgtcttcccgtgaaccgggtgaagtacctcgctacaaactcctcagacttttttcgggttgccaggatcgaggaaaaaaaaagcgggggccagcggattacctacgacgccttcaagtgtctcaaagatgttcaccgccgcttgaaggtccagatctttcagcgagtaatctatcctagctatctgcagggctccctgaaaggatgctcctacataaccaacgtcaaaaatcacactaagtccaaaatcgtcatttgcgaagatatatccaattacttcccctctatcaagagccctcttattgaaaagatgttcatccgcttattctccttcccagaggacgtggcacgcattttgactcagctggtaacactaaacggactgctcccccaaggcggggtgtgttcatcttacatcgccaacctgatcatgtgggaaaaggaagtgctcctggtgggaagttttgagaaaaggggtcttacttacaccagatatgtggatgatataacagtcagtagtaaggcgcatctgaccaagtcagagattagcgaggtgatttccagtatctacgggatgatgaagcactatggtataaagccaaatttaaagaagcaccaggtgttaggcgacggttctcatcagaaggtccacaacgttggggtgaatggccgaagaccgtcatttgggaaagaggaaaagaaacgtgtacggtctgcagtgcataaactgaaactgctgtttgacagccctgattgcacatatgaggactatctagccgctttcggcagggcttcttcgttggttggaaagctgaaacagcttaatgagcagcaagctacgaagcataggggcgagctcaataaaattaagccttctttcagaaacgccagcaatagtaatctcgtcgagtga

SEQ ID NO: 11118 - RNA, 978 nt, unidentified
  source 1..978: mol_type = other RNA; note = synthetic construct
atgaccttgattccaaggtatacctccctgagtttaggatctattaatgcactggccagattactgcagctgcccataaatcgggtcagtcacttggcagaaaattcttcctcctattaccgcgtggctaagataaccgagaagaagaacggagacaaaagagtaacatatgacgctttcaaggtactcaaagatgttcaccggaagctaaaaaaccagctgttcaataaggtgatttatcctgactacctgcagggcagtctgcgcggacgtagctacctttccaacgtgaagaaacacaccaagtcaaagctgctcatctgcgaagacataacgaatttctttccgagcatttcagcggcccaggtggagaaaatgtttatgcggctgttttctttcccaaaatgcgtcgcagagattttgacaaagctcgtaacgctgaatgggtgtgtgccccagggaggggtctgtagctcttacatcgctaacctcgtgatgtggaacaaagaggcagtgctcgtggaaaaactgatttctgacgggctgcgctacactagatacgtcgatgatatcacagtgagtagcagaaggtatgtcacaaaggaaaagatcagcaaggtgatcgcgttaatctatgggatgctaggacattacggtgtgaaacctaatcgggccaagcatgaggttctcggcaatggcagccaccagactgttcaccgtgtaggcgtcaacggtagccaaccttccttcggcaaggatgaaaaaaaacgaatcaggtcagccgttcacaagttggataccatgtttcatgacaacaactgctcctacgccgactatcttaaggcttttggttcagtttcatcgaaagtggggaagctgaaacaacttaatgagcatcaagccactaaattccgaggccagctgaacgtgatccgcccctccgtcaaaaggctcaagcttgacatggataactcttga

SEQ ID NO: 11119 - RNA, 960 nt, unidentified
  source 1..960: mol_type = other RNA; note = synthetic construct
atgaacagcgcattttacaacgggaagcccatagcttctattgccgccctcagcagcgcacttaatgtccccgaggacatcctgatcgacatgagccacaacgctaataagtactataagaaaaaccgccccgaaatcaaaagcaacggcaaggagcgcattcactactctgtatcggaatccttgaaggccattcaccaaaggatcaaagttattctcttccaaaacgtgacatacccagagtatcttcagggatccatcagggatacaaagaagacgcgggactacattagtgatgctcgcatgcactccggcaagagaatgctgatatctgaagacgttagcgactttttcccgtccatcaagtatgatcaggtgctcaagttgtggatgtacttcttcaacttcccgaaaaaaattgccaccactctgacggacctgaccacctacaaagggtttttacctcagggatcaaaaacatcatcttacgtcgccaacctaatattttggcaatatgaacctgccctgtacaataagctcaaggcgcagggtatcacttattctcggtatgtggatgatactaccctgtcatttgaccgatacgtgagcgataaagagttaggacagatcatatccagtattttcggtatgatgtgccaggttaatattaagccaaacagagagaagcaagacatcaaaagtagaaagaacaataccacagtacataatctgaatgtcactaagaaaagtcccaccatccctaagaaaaagaaaaacaatctgcggatggcagtgtttaactgtattaagcattctgatctccatggcaggaaatcagagacatataaaaagatgtaccgatccaccatcactagggtgggccagcttgggcgtttgcacccaaatcagtcccagaagctgaaggacaaactagctccatataaacctttcaatagctga

SEQ ID NO: 11120 - RNA, 939 nt, unidentified
  source 1..939: mol_type = other RNA; note = synthetic construct
atgagcgcttactatccccacaaacctatcgccagcattgagtcccttgccaagactttggatgtgactgaagccgaactgttagaggttgcccagaatagcgactcactcttctttgtcgcaaaatgtgtaaagaaggaaaacgggaaggtgagagttacatacgacgcccgccctgcactaaagaacattcacgataggatcaaaatagctctgtttcgggtagtcaaatatcccttctatctgcaaggaggcatcagcggccgagattatatcagcaacaccaagatccatgccggtaaaaagtttcttataaccgaggacgtgtcaaatttctttccctccatccaggactcagtcgtgaagaaaatgtggctctacttcttccacttttctcctgaagtggccgatgtcctgactaagctgaccactcataatggttttgtgccacagggggccaagacgtctggctacatagcaaatctcattttgtgggataaagagcccgtgctcgtggaatatctgcgcaagaaaggaatgagttacagtcgtctggtagatgacattaccatctcgtgcgactacaagccatctaaaaagcttttggcttccatgatttccgatgtgtacgggatgctgctatctaaagacgtcaagccaaacaggggaaagcacaaaatcatgacccagggcgagaagcagcggatacacaacctgaatgttgataaaggaagaccttcattaccgaagtccaaacgagctgacattagggcagcggtgttccaatgcgaagagatggcgaagtacggcagaaagacagaggagtataacaagctgttcaacagtaccgtggggagagttgctacaatgaagcggctccatccgacacaggcaacgattctgaggaatcgccttgacatgatcaaaccaaaaaaatga

SEQ ID NO: 11121 - RNA, 1140 nt, unidentified
  source 1..1140: mol_type = other RNA; note = synthetic construct
atgaatcttcgtccaaaatacacccagaaacctattgggtctattgaagctctggctaatctcctgaacttgactctccatgacctagataagctgattcagtcctcgaacgacgattatatcgtcgccgacaaaatcgagaaggatgatggttctattcgagtcacgtacaaagccaagcccaaactccggaccgcactggacagtattaaatccagggtattcgacaaggtcgagcaccccgattacataacagcgggacagataggtaaaagctatgtagacaatgcgcaggcccacatcaactcaagaatgttgatgtccgaggacattaggaatttctttcctagcattagcgtcaaggaggttaaccgaatcttccagcacttcttttgcttcccgccaaaggtgtccaacgctctaagcgaactttccaccaaagaaggctttctggtgcaggggtcccccctctcaggggaaatcgcaaacctgatattttatcgggatgaacccgaactcgttaagttctgtcaggatcaaggcctccgctacactaggtactatgacgacattcacatctcttcagatgagaaggacttctatgagcttattcctcatttgaagagtgagatataccggatctttgggaaatcaggagtgaagccacatagagccaagaagaagtcacacttctcaacatgtagttctcggctgtccgtgcacgacgtgacagtgaattcgaagaagaccaatcctagccaaaaaagaatctctaaggtgagacagctgctgtttacgtacgagtatatggtggataataactgcgatatcgaggacattataaaaaaataccgctccatccatggacacatcaacacccttcaacagcaaggctattctcaggcaggcaaattaaaggagcatttgagcctgattacttgccgcatcagtgaatctgaagctaagaagtacgcacgtaaataccgcaaagtgaagagcaaaaaggagctgacacagttttcatctaaggtcagcatcttaaaaaggatttccggcagagttgccatggttatcaatagtgagaagaaatgtgccaacgataagatcaagaaaaagctgagtaggaacagcagcatgtga

SEQ ID NO: 11122 - RNA, 1140 nt, unidentified
  source 1..1140: mol_type = other RNA; note = synthetic construct
atgaacctccagcccaaatatacccaaaaacccgtcggttcaatcaaagctctcgccaatttactgaatttgaccctgaacgaactcgaggaattaattcagtcctctaacaatgactacattatagccagtaagatcgagaaggccgacggctctttaagggtgacttataaagctaagcagaaactgagaatcgctctggataccatcaaaagccgcattttcgataaagtcaagcacccagactatatcgcggcaggccagctcggaaaatcatacacgaacaatgccaaggcccatatcaattctaaaatgctcatgagcgaagatatcaagaacttcttcccttcaattagtacaaaggaggttaaccgcatttttcagcacttcttctgctttcctcccgaggtgagcaatgccctatcagaactttcaactaaagacggctttctggttcaggggagcccacttagcggtgaaatcgcaaatcttattttttaccaggacgagccggaactggtcgagtattgtcagtctcaggagctgagatacaccaggtattatgatgatatccacatttcctccgacaagaaagagttccacgaattgatcccacatctgaagtcgaagatctaccggatctttgggaagcatggggtgaggcctcatagatccaagaagaagtcccacttctccacatgtagcagccggctaagtgtgcacgatgttactgtaaatagcaaaaagacaaacccctcacacgagcggattagtaaggtcaggcagctgctgttcacctacgagtatatggtggacaacaatagcaatattgaggacatcattaagaagcacagatccatacgtggacatataaatacgctgcaacagcaagactactcgcaggtgaaccggttgaaagaacaacttagttttatcactcgcaagataaacgagtccgaagccaagaaatacgcacgaaagtacaggaaagtgaaatctaagaaggagctcacacaattttctagcaaggtctgcatattgaagaaaatttcagtacgagtggcgatggtgatcaactccgaaaagaaagcagctgatgataagattaaacgcaaactgtctcgtaacagtgtttcttga

SEQ ID NO: 11123 - RNA, 1056 nt, unidentified
  source 1..1056: mol_type = other RNA; note = synthetic construct
atgcaccttcgggtagagcgtgtttacatcgtggccaataaaatcgaaaaagatgatggaagcctgcgggtgacctataaggcaaagcctaaactccgggtcgtgctagactccattaagagtagaattttcgataaggtcgaacatccagactatatcacagctggccagatcgggaaatcttacatagacaacgcgaaagttcatattaattcccgcatgctgatgtctgaggatatcaggaattttttccccagcattagcataaaggaagtgaaccgcatctttcagcactttttctgcttcccccctaaggtaagcaacgccctgtccgagctgtctacaaaggaaggttatctggtgcaggggtcacctttatctggtgagattgcaaacctggtgttctatagagacgagccggagctcgtgaaatactgccaggaccaaggcttgcggtacacccggtattacgatgatatacacattagtagtgacaagaaggagttcaacgaattgatcccacacctgaaatccgagatatacagaatctttggcaagagtggggtcaagccccatcgctctaaaaaaaaaagccattttagctcctgttcgtcccgattgtccgtccacgacgtgacggtcaattcaaagaaaacaaatccaagccacaaaagaatatctcaggtcaggaagctcctgtttacctacgagcacatggtagataataacttcaacattgaggacatcatcaaaaagtacaggtcaatccttggccatattaataccttgcagcagcaaggctatagtaaggccggaaagctgaaggaacaactgtcactcattacttgtcgtatttctgagtccgaagctaaaaagtacgccagaaagtatcgaaaagttaaatccaagaaggaactgactcagttcagctcgaaggtgtatatcctaaaaaggattagcggaagggttgctatggtgatcaactcagagaagaaccttcaaatgatcaagttacgcaaaagctacctcgtgattcagatctacaatcagcactga

SEQ ID NO: 11124 - RNA, 1140 nt, unidentified
  source 1..1140: mol_type = other RNA; note = synthetic construct
atgaggaatctgtcccccgtgtacaaacaaaaacccatttcctcaatcgatgccctgtgcagactgctgcaggtggagcagagggacctgctgtctctggccgaaaaatctaacagccattacctaaagaagaccgttgaaaaatcgggaagtaagcctcgcgtaacctataaggcatcacccgagcttcgtccaatcttggacagtctgaaggatcgagtcttttcctgtgtctcctttccggcctatatcgccgctggccaactggggaagagttatgtggccaacgctgaatctcacataggtgcaaaaatgctcatgtctgaggacatcaaagactttttcccaagtatcactcagtcccaagtggagaatgtttacaagcatttcttcaaattcgcaccaaatgtgtctctgttactctctgagctatgtaccaaagacggtaaacttgtacaggggtccccactgtcaggatacctcgcaaatctggtgttcttccgggaggaacacagcatagtcgcctcatgcattgaacacggcctacactacacacgttactatgatgacattcacatctcctcatgtcagttgttttacgaggaagtccatgatctcaagcagttactttacgggatgatgggaagagtgggagtttcacctcaccgcagccctaagaagtgcaatattaaattgtcgaacacccgcctttatgtgcatgatgtgacgataaatagtcataagacgagcccttctcgaaaacgcgttagcacagtgcggaacctcctgttcaactttaacaattgtgtctccagcggctgcgacattgaaactctggtgaaacactatcggagcatcttgggccacatcaacacactgcagcagcagggctacgggaagtccaaaaccctcaagaaggagttaagggaagcagtccatcatatcgatgagaaatccgctaagaaatatgcgagaggctacaggaaggtaaagaactcaaaggagtttaaggctttctctttgaaagctagcattctcaagaggattagcggtagagttgccagcgtgatcaacgctgagcacgacacagccaaaaagaagcttgagagaaatcgggcgagtcggaagcccactagctga

SEQ ID NO: 11125 - RNA, 1131 nt, unidentified
  source 1..1131: mol_type = other RNA; note = synthetic construct
atgtgcaatttaagccctatctacaacttaaaacccattggctcaatcgaggcgctgtgcagggtgcttcagattgagcagagcctgttattcagcatcgccaagaatagcaatgctcactactttaagaagacgattaagaagaacaacggcaagcctcgaatcacatacaaggcctccccccaacttaggaacattttggataagctgaagcacagagtgttctctcatatcgtgttcccgtcctacatatctgctggccagctggggaaatcatatgtggacaacgcaaattcacacactggcgcgaagatgttgatgagtgaagacattaaggatttctttcccagtatcacccagctccagatacagcaggtatacaagcatttcttcaagtttacccctgaagtctcacttctgctatccgaactatgtactaaagacggaaaactagtgcagggctcaccactgtccggttatctggccaacttggtcttctttaaagaggagcatactatcgtggacctgtgtatcaaaaatggactccactatacccgatactatgacgatattcatatctctagtcacacacccttctttgaagaggtatcggagttgaagcaacaactctatggcatgatggggagagtgggagtttccccacaccgttcccagaagaagtgtaatattaagctgtcgaacacccggctcgacgttcacgacatcaccatcaacagtcataaaacaagcccaagcaaaaagcgcgtttcccgcgtccggaacctgctcttccaatttcagaaatcagtgtctctgaatgatgatatagaggggatcattaatcagtaccggagcattttgggtcacattaatacactccagcagcaagggtatctcaaaagcaaagctctgaaaaaagagctttctaacattgccctttgcataaacgagaagaacgcaaaaaagtacgctagaggatataggaaagtgaagaacgacaaggaactgaaagcctttagcgccaaagtctccatcctgaagcgcataaacggtaaggtcgcatctgttatcaatgccgaacaggatgctgcaaaaaggaagctgaagaatagacagtctaaaagtaattga

SEQ ID NO: 11126 - RNA, 1116 nt, unidentified
  source 1..1116: mol_type = other RNA; note = synthetic construct
atggttacgaatcttcagttcaaatacaccaacaaacctatttcaagctatgaatcccttagtaagaccttgagcataagtattcaggagatccacgacattgagagcaaatctaatgacttttacacgatcagcaagaagatcaaaaaacctgacggatctctcagagttacatataaagtccatccccgtctgaggtgcgtccttgatttgctgaagaaacgcgtgtttgattctgttgaagctccagaatacattctggctggtcagaagaataggtcttacatcctgaatgcgaagacacacactgagtcacagatgctcctgtgcgaggacattaagtccttctttccaagcattcacaaaaagttcgtcaaaaagatcttccagcacttctttttcttttcacccgatatttccgagagcttagccgagatcagcactttaaataactatcttgtgcaaggctcccccctcagcggcgaaatagcaaacctcatattctttgacctggaaccagccctagtagagagactgaaaaaatacaatctgcgttacacacgctactatgacgacatctacatctcctcaaaagagcataatttctatgaacataccgaggagataaagaggcagatctatcggatgtttaacacagtgaacctgaagcctaatcggaagaaaaacaagatctcaaaacaaagttccagaatatctgtccacaatattaccgtaaattctagcaagatctcaccgtccaaagagcgcctgagtatggtgcggaagaagatttacatcttcaagtgttccattgagaacaacatcgatattcaggatttgatcggacagtataagagtttgcaggggcacatatctaccctgaaaactcaagagtacaccaagcataaaattactaaacgggaactagaactgctgatctcgaaaatcgacgaacgattagccaaaaagtactcgcgaaagttcaggtctgtgaagaccaaggaaaactttaacaagctcgccaactccagtaacctcctgacaaagattagccccagagtgactggggtgtataaggatgagaaaatgaaggcaaagaaacgcctctggaagtga

SEQ ID NO: 11127 - RNA, 1152 nt, unidentified
  source 1..1152: mol_type = other RNA; note = synthetic construct
atggtgagcgaggccaatacggtggagaattttcagtgcaggcaatcacagatagggtctatcaaagccctggccaagactctgtcactcattgaatctgaactcatcgacctggctgagtgcagtgatcagtactataaggtgagtaaagaaatcccaaagtctgacggctctgtgagacgaacctactccgtgtcctatccattgaagaaagttctaatccgcatccggtctaggattatatcgaatgtggattatccggactatatcctggcaggccgcctcggaagatcatacctggataatgccaataagcacaagagcagtgcgatgattctctctgaggacattacccggttctttgatagcataaagcaggagtacgtcgagcagatcttcaagtattttttccatttccccccagacgttgccaagacactgagtcaactgtgtacccttgacggttatttggtccagggctcccctttatccggggatatcgcgaacctaatcttcaacgagaaagagcctaacgttgtgaaactcgctgccgaactcggcctgaaatatagtcggtactacgacgatatctacgtctcaagtctgaccaacaactttgacgcccacattggcactttaagaaccgctatttacggtatgttcgcaagcgtcgaagtgaagcccaataagtctccccaaaaaagccgtgtaatgagatcatctcacagaatggacgtacacgatgtgactgttaactcacataaattgagccctagcaaaaaacgtacctccaaagtccggctgtccgttgacaggctgcgcaagatggtagccgaggatgccgccatttccgacatccttaaggtgtaccgctcgacgtttggacaattgataacacttaagagccagggatctcccaaatacgtaaaaatgaggtcagaactggatcagatcatgaagtccattgaacctgcaaaagctcggaagttcgcaaggaagtttcgaaacatcaaaacagaagcggatttcaaaagtttcgctcagaagatatccgtcttaaagcgaattagcccaagcgtggctggggtgatcaatgcagagagcaagtccgctaagcttaaaattaagtttaagcaggcaactacacattga

SEQ ID NO: 11128 - RNA, 1137 nt, unidentified
  source 1..1137: mol_type = other RNA; note = synthetic construct
atggtgagtgaaacagatcccgtcaatgatttccagtgcaaacagtcccaggtggggagcattcggactctggctaagacccttagtctcaccgagccggaactcgtccggcttgccaagcattcagataagtactataacgtgagtaaggagatccccaaatcagatggatctgtgagactgacatattccgtgtcgtatcctctaaagaaagtgttgattcggatccgcaatcgcattattagcaacgttaattaccctgactatatactcgcggggagacaaggcaaaagctatttggacaacgccaagaagcacaaatccagcactatgatcctgtctgaagatattaccaggttcttcgactcaattaagcaagaatatgtcgaacagctgttcaagtacttcttccgctttccacctgacgtatcccagacgttaagtcaactgtgtaccctggacggttccttagtccagggatcaccaatctctggtgacatagctaacctgatatttcacgagaaagagccaagcgtcgtgcgcttggctgcaagtctggggctgaagtactctagatactacgatgacatatatgttagctcagctaccacgaacttcgactcccacgtggggacaatgagaactgccatctacggcatgttcgcttctgttgaggtaaagccaaataaatcacctcagaagtctcgtgttatgaggagctccaaaaggatggatgtccatgacgtgactgtcaattctcataaattgagcccctctaaaaaacggaccagcgaggtgaggctcaggatcgacagacttcgtaaaatggtagccgacaatgccgagatggccgatatccttaagttttaccggagtacatttggcaagctaatcacactcaaatcgcagggatcccccaaatacgcaaaaatgcggagtgaactggatggcgtgatgaagtccatcgagcccgcaaaagctcgaaagtttgcgcgaaagtttaggaagatcaagaaccagagcgagttctccagctttgcccaacgcatttcaatcctgaaacgaatttctccgtccgttgccggcgtgatcaacgccgaaagcgcaatagcgaagtttaagattgaggcaaagtga

SEQ ID NO: 11129 - RNA, 1125 nt, unidentified
  source 1..1125: mol_type = other RNA; note = synthetic construct
atggagagattcaacttcttctacacacagaagcaaattggtagcctgagcgttctcgcaaagaccctgagcattaccgtcaacgaacttaatcgcttgcgcgcaaactccgattcttactaccagattgcgaagcgggtggtgaaggcagatggctcagagaggataacctatgacgtaaagtaccccctcaaaacaatcttgcaaaaactgaggtcccgcgttatcaagaacgtccagctgcctaaatatatcctggccgggcgtaaaggaaaaagctaccttgacaacgccatggagcatatgtcaaccaagatgatacaatccgaggacatctctaacttcttcgacagcataaagtccaagtacgtgatcaatgtcttcaagtacctgttcaaatttccaaatgatgtcgccgaagctctgactgatctctgtacctttaaaggccacttagtccaggggagtccagtgtccggagacattgccaatctgattttttatcacaaggaacctcagctcgtgcaggctatcgagtcgcttggactcaaatataccaggtattacgacgatatttacgtttcttcgaaagaagggaacttttaccagcatgtgtctttcttaaaagcccagatttatggcatgtttagcagcatccaagtcaaacccaatcgctccctgtctaaaagtagggtgatgcggaattcttcacgaattgatgtgcacgacgtaactgttaatagtcataaacttagtccgtccaggaagagagtctcaaatgtgcgggctcagatcaacaagctcaagaattccgttaatagccggggctgcctttcagaaacgatcagtctgtttaagagtacattgggtcaggtgaacacactgaaggcgcaagggagccccaaagccaaggacatgctcaaaaacatactggacgccctgaagggcatcgatgaagctcaggcaaagaagtattgccgaaaggcgagaaaggtgaaagagctaagacagctgaataagctagctcagaacttgtcagtgttaaaaaaagtgtctcctactattgccggagtagccaacgctgagttgaaacaggcaagagagcgtatcaagaagaagcagtga

SEQ ID NO: 11130 - RNA, 1116 nt, unidentified
  source 1..1116: mol_type = other RNA; note = synthetic construct
atgtctagccagattgaatatccccaggccgggatcgccagtattgactcactggcttctgcccttcgcattccaagctcagaattagttgctctcgccaacaatacaagcaatttgtacagaaagagtgagcaaattgagaaggacgacggatcaaaaaggatcacctatgatgctttgccaccccttaagatcgtgctcagtaacttccgcaaacggatcattgataaggtgctccttccagagtacatatctgcaggtaagaaaggaaagagctatattgataacgccgaggtccacgcaggatccaagggcctgttatccgaagatatcaagaacttctttcctcaggtatcctttaaaagtgtttttgaagcgttcaagtacctgtacaaaatgtcccccgaagtcgctgaagtagccgctctcctgtgtaccaaagatggctacctggtccagggttctcctgttagcggtagcttggccaatattatcttctatgcgaaggagccctttctcgtcgaccgtcttaagttgctgggctttaggtatacccgttattatgacgacgttcacatcagccacaagactgatgactttagccgagacatcggagaacttcgaaccaaagtttacgggatattcattagtcagggcttgcaaccgcataggactgccaaaaagtcaaattacgcaaattcttcccggaggatgtcggtgcatgggatcgtcattaataacgagaagattaagcctaatcctaagaaggtcagcgacacccgggcgatgttattcaagttcgaacggctcctggagacggattacacaatcgatagtgtggtgtcactgtatcgctctatcagaggcaaaatacagaccctgaaagcacaggggtccacaaagtccgaggcctacctcacgactctgaactctctaatgagaaaagtggacgaggcaaaggctaaaaagttcgtacgcaaagtcaggaaggtgaaaacaatcaaagagtacaacaaactgtcatccaagctgtcggtgctgaagaaaatcaacgtgaaagtgactagagtggtgaaaatagagtgcgatctggccaagaaatccctaaaggcatga

SEQ ID NO: 11131 - RNA, 1113 nt, unidentified
  source 1..1113: mol_type = other RNA; note = synthetic construct
atgcacaaaaattggagctactcaaatagacccttagcaaatattgaatccctgctcaagatgttggaaacgaatgaggaaaggctcgcatatgtgctcaagaacaagaagaactatttcaaaaccgtcccagtcctacggaagggcaagaaaagaaccacttacaaagtggtcggcgagttgctgaagatacatgagttgattaagcaacatgtcttcagtaagatctctctgccagaatatatcactggcggccgacggggagtgtcatatctcgatgattgcatcagccactgtaacaaatccattatcattcaggaggacatcaaagacttcttcccctcaataaaggaagagctgatcgctaaagcctttcagtactatatgaacttttcccctgaggtgagtagcctaattgccaagttgagtacactggagggatcgctggttcagggtaccaagctttctacagacatcgctaatctcatttttttagaggaagaagcgctaatctctgctgaagtcggtaagcttgggggcaattatactcgctacgttgatgatataactattagctttgagagcgaagttaataacgaggacatatcaaagatcaagacgatgatcctgtccatggcgttgaagtctggggtgaggcttaaccggcagaagagcaaggtgttaaggaatggacacagtaagattgttcatggcgtaaaagtgattaaggaactgcgccccacccagaaaaggaaagattccatccgaatgtgcctgtttaacctgaagaagaaagtgatcgaaaaggagtccataatggacattctggctctttactttaagatcagaggactcattaacaccctgaaacaacagggggataagaatcacgccgagtacattaagcaagccaatcagctggtagccgccgtagacaaaaaagatgcaatcaaaagtatccgtaagatgagaaaagtgaaagacgtgaaaaaacttcgctctttctactctaaactgaagcctctggggaacatcagcaaaacaattagcgtgatcctcgactcagagtacaagacatgtaaatgcaaattcaacaacaagtccatagagtga

SEQ ID NO: 11132 - RNA, 1101 nt, unidentified
  source 1..1101: mol_type = other RNA; note = synthetic construct
atgcataagaattggaactattcaaataggcctctggctaatttggaatccctctttaagatactcgaaaccaaagaagagcgtctcggatatatcctgaagaacaagatggtctacttcaagaaagttcccgtgatccgaaaagagaagaagcgcacgacatacaaggtaatcggggagctgtccaagatccacgacttgatcaaacagcggatcttcagtaagattacccttccagaatacgtgactgggggaagacgcggaatttcctacatagatgactgcatgtctcattgtgacaaatcgattatcatccaagaggacatcaaagattttttcccaagcattaccgaagaattaattgccaaggcttttcagtactatatgaacttcagccctgaggtttcaagcctcatagccaacctgagcaccctggagggctctctcgtgcagggtacaaaactctctacggatattgccaatctgatatttctcgaggaagaggtgctgatctcggaggaggttgcaaaacttgggggtaattatacccgttatgtggacgacattacaattagtttcgaatcagaggtgaacaatgaggatatctccaagatcaaaacaatgatccttagcatggctattaagagtggcgtgcgactaaataagaagaaaagccgggtactgcggaatggccagtgtaaaatcgtgcacggcgttaaggtcatcaaggaactaagacccactcagaagagaaagaataacatcaggatgtatctgttcaaccttaggaagaaggtgttcgataaggagaacgtcatggacgtgttgtccttttattttaagatacggggcctgataaacactctgaaacagcaaggggatatcaatcacgccaaatacctgaaggaagcaaaccagttagtcgccgacatagacaaaaaagacgccattaagagtatcagggcaatgcgcaaagtcaaagatattaagaagattagagcgttgtactctaaactgaaaccgctgggaaatatttctaaaagcatctcagcgattcttgatgctgagtacaaatcctgcaaatacaagttcaacaactga

SEQ ID NO: 11133 - RNA, 1104 nt, unidentified
  source 1..1104: mol_type = other RNA; note = synthetic construct
atgcataagaattggacatactccgatcgtccactggccaacttagagagcttgtttaagcttttggaaaccaaacaggagcgcctcacctatattctgaagaacaagaagatctacttcaagaaagtgcctgtcatccgcaaggggaagaaacggactacttataaggtcacaggggaattatcccggattcatgagcttattaagcagcgcattttctccaaaatcaccttgccggaatatatcactggcgggaggagaggaatcagctacattgatgactgtatttcccactgtgacaaaagcattataatccaagaggacgtcaaggacttttttccatcaataaccgaaggacttatagccaaggccttccagtattatatgaactttagccctgaggtgagttctctgatagcaaacctgagcacactggaaggctcactagtgcaagggaccaaactctcgacagacattgctaaccttatttttcttgaggaggagatcttcatctcagaggaagtgaccaaactgggcggtaactatactagatacgtggatgatattacgataagtttcgagtctgaggtgaacaataaggacatcagcaagatcaagacaatgatcttctctatggcgattaaatccggagtccgactgaataagaagaaaagtcggattctccgaaatggacagtccaaagtcgtacacggcgtaaaagtgataaaagaactcagacccactcagaagaggaagagcgatatcaggatgtgcctctttaatttacggaaaaagatcctggataaggaaaacatcatggatatcctgtctttctacttcaaaattagaggcctcataaataccctgaaacagcagggcgacgctaagcacacggagtacttgaacgaggttaatcatatcctgacaggtattgacaaaaaggacgcaatcaaatccattcgtgctatgaggaagctacgcgaggtgaagaaactgagggttttttacagtaaactcaaacccttgggtagagtgtcagaaaacgtttctaccatcctggatgttgaataccgggcctgcaagtctaaactgaataagatctga

SEQ ID NO: 11134 - RNA, 996 nt, unidentified
  source 1..996: mol_type = other RNA; note = synthetic construct
atggaaaccaacccaatttacaaggggaaacagatctcaacaattcaagatctcagcgaaatcctcaatgtggaagtgaatcggatcaagcacatactctacagggcgaacagcttctacattgagaacccgcagcccaaagatgacggtaccatgaggatgacgtacatcattaagcctcctctgcagcagatccaagaacgaatcaaggacaatatctttagttgtgtagagtttccccactatctgatgggcgggataagagatgaggccaatcctagagatcatatacgtaatgcaaagatccattcaggcaagaaatggctaatctctcttgacatcaagaattacttccccagcatcaaaaacgagtatgtctacttcatgtggagaaagttctttggcttttcggatgaggtgtcaagggttttaactaggctgacgacatataacggatttctgccacagggctccaaaactagcagtggcatcgccaacctgctgttgtgggacaaagaaccccatttcgtcgattccttgaacaagcaagatttcgtttatactcggtttgtcgatgacattaccatatcatctaccaagttagtggaaaaagagatggtgagtaagataattgtggacatgaaacatcttctgcgccagtacgacctgaaactaaagggaaagaagaccaagtttcagacacgctctcagaaaatgaccgtgaataaagtaacagtcaacggtaaaaagccaactatctcctctgaggagcggaataatattcggctggaagtgcacctcttcgagaaaaaagctgacaatacaaagaattggaacgaaatcgatcacgactattacagcctcatggggaagcttaactatattaagaaggttcactccgcttacgccgagaaattgattagcagactggagattaagcgcgaggagttctattccaaaaactacgaaaaggacgggaacggatgccgactgtga

SEQ ID NO: 11135 - RNA, 936 nt, unidentified
  source 1..936: mol_type = other RNA; note = synthetic construct
atggataagccacaatacaagaagaagccaattggatatgtcgattcccttgccaaggcactcagtgcagaaagggaccacctcattagagtggctaatgatgccgactcattttaccgtcttcataagaggatcgagaaacccgatgggacttttagggagatctatgatgcaagataccctctgaaacttttccagagacgaattaaccggaaactgatctcccgcgtcgatttcccccagtatctacatgccgtgaagcatcggtcccatataacagccgctagtaaacataatattcccctgctgcttctgaacctggatatctccaacttctttccttctatctcatctgagttggtctttgacatatggcggctgttttttagattccctaagcacgtctctcagatgctcaccaaactaacaacatacaacgggttcctgcctcaaggcgcccccactagtccaggcttggctaatttggcgttctgggacattgaaagcaagttagtagaggggatgaatgctaaaggcttcgtgtacacacgattcgtggacgacgtgacgattagctcagaaaggaaagtacagatggacgaactggcaccgattatcgcctcgatttttggaatgtttcgcaaccgcggtgtgaaggctaaccggaataaaatacacatctctacgagcggccacgagatgttggttcacaacctgaatatcaattccggcgtgccaaccatacctaagagggaacgcggtcgtatcagggcggccgtcaaggactgcgagatcacttacaccgaaattatccagaccgaggtttacaaaaagctctggcacagcactttaggacgagtgaattatctgaaccacttccaccccaccgaggcccagaaatatcatcaaagactccaggcagttcggccgagctga

SEQ ID NO: 11136 - RNA, 942 nt, unidentified
  source 1..942: mol_type = other RNA; note = synthetic construct
atggataagccacaataccagaagaaaccaattgcccacatagatagcttggctaaactcctctcagttgacacaaacaaactggtgaatctggctgaccaggctgactctttttactacctctcggagcgaattgagaaacccgacggctcttttagggatgtctatggggtcagggacgagttgaagatcttacagcagcaaattgtgaacaaaatctacagcaatgtccggttcccgaattatctgtatgggtctattaagggcaccaatcatatcatggacgcatatgtgcacgcacatgcccagctgcttgtgaaaatggacatcagcaattttttccccacgctgacctctaagaacatcttcaacatctggaagaggttcttcaacttcagtgagcccgtggccaaaatcctgaccaaactaactacattcaacaattttctgcctcaaggtgcccctactagcccagggcttgctaatcttgccttttgggatattgaatccgcgatagtggatcgcctacagagaaacggctttacctacactcgttttgttgatgacgtaacagtatcatccaaatccagaacagaaatgcacaagttgaacaccattttcaagagtgttttcggaatgtttagatcaaaaggagttaaggccaacaggaagaaaaccaatattagcaccagcggatatcggatggccgtgcacaacctgaacatcaattcgggtacgcctacaatatccactaagaagcgctcccaaataagaagcgctgtccgaggctgcgaaaagagttaccaggaccagaagcagtcagaagattacaaaaagctctgggagagtgccatcggccgcgtgaattatctgtctcagttccaccctactcaagcacaggcactccataagcggttacaggcggtcctgcccgtgtcctaa

SEQ ID NO: 11137 - RNA, 1032 nt, unidentified
  source 1..1032: mol_type = other RNA; note = synthetic construct
atgagtcaaaaccatctttcgaagtcactgcagactccattactcgcacctaagttttcgggcaccaggattagctccgtggagtctttgtcctttgtgctgaaaacacccatcgacgaattggtgagcatcgcagacacaagtgagtcatactatagaatacacaaggagattgagaagccggatgggtccattcgtaaaatctattctgtcagagaaccgctcaaaggaattcagcggaaaatcaacagcctcatactgaagaagtgcaagtacccagagtacctcacaggcagcctccccaactgtacccacatcaagaatatcaactttcatgtgggccaaaaaacgattattagtatcgatgccacgaacttcttccctagcatcaacgcctctgatgtcatgaatctgtgggctgagttctttaactttgagtctcagacttccacattgctgacccagctgtgctccttccaaggtggactggctcagggagcccctactagctcctacatctctaatcttgtgttctgggatgtagagccactcatagttcaggaatttcaccggaagggctacatctattctcgatatgtggacgatatttgtattagcaaatccagtcgcaccactaaagaggaaaaaacctgggcgataaaaactgctcagaaggtattcatctctaaggggctgtccatcaagtcacggaaaaccaagattatggagaagggcagccgccaggaagtcaataaaaagaccatccataacggaaaagttaatgcttcaaaagccgacaaggataaaattcgcgcggagattcacaatctgaagattaggatcgacaagaaccttctacccgacattccatacgaaaagaggtacttatcaatccgaggtaagatcctgtatcttgaaaagttcaacaagacagccgcccaaaaactacagaatcagttggacgaactggttgcatacataaaaagtaaaggggtgatctggagaagccccaaaaataagtatataccttga

SEQ ID NO: 11138 - RNA, 1026 nt, unidentified
  source 1..1026: mol_type = other RNA; note = synthetic construct
atggccgaattagagtacccatttgcccctattggctccttgaacgctctggcacgccatctgggtctaagccggtggtatttggatggggctattgcgaaagctggtccgcgagcctatcgggtgcggaaagtgacacccagcgatgccagaggagtacccgacaaagtggaatacgcgccagccccttggcttaaagaactgcaacgcaccatcaatcgccggcttttaaaggcagttgaaatgcccgcctatgttataggcggcgtgcctggcaggaggattgaagacgccatccaacgacacgcatgtagtcaggcactcctgtcctttgatgttagaagattctacgagtctactagcgctgctgaggtgaggaaggtcttcatgaggctgctccggttccctccagaattgacggacgcccttctggctctgaccacggttagagggcatctgccccgtggcgcacccacaagttcttacttagccaatctcgtcctctttgatgtcgaaccagagctggttgacttcctgtctgggctgcagcctcgggcacttagatactcaaggtgggtggatgatatcaacatctcttcgccatggccgatcgacgagagactggcgggagaggtcaaggaccgagtcagcactatgcttcggcgccacggactgtccatcaactggaccaagtatcgcgagaacttgaggactaaatcagtcgtggtgcatcacgtgagaatagagggtagccgcttttccgtggccggctccaagaggcgtaatgtgagggccgctgtacacaatctcgaactggcatctcagaagcggcctctaagtgctagcgagctctccgaactgaccagacagcgaagtcgcgtagagttcatccgcccgtttcaccctcgagagatggagcccctcagaattaagttgcaggccattaaggagaaacagccaggaaggtcaaaaagcaaggacgggcccgactggcgttcaacagtgtggggatgcacaaagacctga

SEQ ID NO: 11139 - RNA, 1008 nt, unidentified
  source 1..1008: mol_type = other RNA; note = synthetic construct
atgagcaccaaaaaacagagccctgagctccgacccctggtgtctttgtcctacctggagtaccttctgggcacaaaaagagatcgcctgcagaagatcgcgactagtgcgggatcttattaccaaccatttgacatacacaagaaaggcacagataaatggcgtcacattgacaacccccagcatcctctcaaaactctgcagaagcggatactgaagaacatcctcaacaggaatatccgcaggctaccagatgggatgaccggaggtatttccgggagatcgattgtcgaaaatgcaaagattcatatcgggaaggagtgtatcggcgtcattgacatcaaaaattgcttcccctcaaccaattatcatcagataaatcaggtgtggatcgaccatttcggttgtgggtacaagactgctaatctactgacaaagctgaccacctttcaacacagattgcctcaaggagctccgacgtcacctttactttgcaatttcgccctggctccagtttttggcgagattaaagccgtagcagactccgcaggcctggatatcacgattttcatagatgacattaccgtgagcggaagtaaaaagagcataactgactcaatcgagcccattattaagatccttgtgaagcatggctacgccgtccgcaagcgaaaggtgaaggtgataacaagtaactattcccagaaggttacagggatcccagtaaataggaagctctcaatcggtcgggggcacatccaacagattcggaacttgatcctggaaacagcctccttgaaaggatatatccccagcaacgattattgtaagatccagggaaaaatttcctttgctaagagcgtgtctaagacccagggcgtgaagctcggcaaattcgccgaaaaaatgttagtccacccgcttatgcaggtcggtgttaaaaaagatgaggcctctcgggactgcaaaaggtttagtgacaaccacaagtacactgaaagaaactga

SEQ ID NO: 11140 - RNA, 981 nt, unidentified
  source 1..981: mol_type = other RNA; note = synthetic construct
atgaacaattctttgatttctctgaagaagttggaatttacactgtgcaccagcagggacgaattgcgcaggattgcagatagagtgggccgattatacgaaccttatgacctgcacaagaagggaactgataaatggagacacattgacaacccccatgacgagctcaaaaagctgcagcggatcattaacaagaacgtcctcaaaaagaacatttcactcctccctgagcgtatgaccggtggaatcaccggcaaaagcataattgacaatgctaagaatcacgtggggaaagagtacatcctaatcgtggatatcaagaattgttttccaaacacagatcagctcaaaatacttcatgtttggagaacctatttcggatgtggcaatacgactgcacggatcttaacccagctgacgacatttcaggctagacttccccaaggcgccccgaccagctcacttctgtgtaacttcgctctcctgccaattttccgaaaaatcgaccattacgctagtttgaacaatctgtctttcagcatatttgtcgatgatatcactatctccggtaggaaggcagatgtgattaagtccattaagcctatcatcaagattctgaaagagcacgactacgcggtaaagaaaaagaagattaagatcttcgcctccgggtacagtcaacggacaacaggtatcaatgtgaacaagaaactgtcagtcggacgtcggaaacttaacgaaatacgcaagttaatcatcgaatccgccaaactgaaggggtatctccccagcactctaattaataaaatcactggggacatcaactttaccaagcaggtgtcgccaaatgatggcaaaaaacttaaggagctggccaataaactgctgatagcccccatcaagattgttaagtctgagagtgattgcaataccaggacatgcaacgacttcaaacgcaaccacaaatatatattggactga

SEQ ID NO: 11141 - RNA, 978 nt, unidentified
  source 1..978: mol_type = other RNA; note = synthetic construct
atgagcacactccagaagactaaaatcaaatccgtcgcagagttatctcagaccctgaaagtgggggttaaggagtttgttaagacggctaaaaacgccaatctcttctataggccctttgatttatccaaaaagggatccgaaaaatggcgacatattgataatccaaccggcaaattgaagatcatccagaaggctatcaacaagcagatacttcgtgacctaatgtttcaattaccacctaacattatggggggaattgaaaataagtcaatcctggaaaatgcaaaggtgcatgtagggcaggaaatggtggtgacgatcgatataaaaaattgcttcccgaagactaagaacgaagtgattttcactatttggaagaaccttcttggctttgagcccaacagcgccagactgctgacacagctgacaaccactaaagggcacctgccacaaggatctccagccagtcctagcctctccaatctcgctctcctgccgatctcaaaagaaattctgaactacagtaagaagcaccaccttaatttcaccatctatgtcgacgatataacactgtctggtaagaagagttctgctctggactccataagccctgtagtcaaaatcatccaaaaatacggctatgccattcgcaacaaaaaggtgaaaaagatgccctcatataaaacccagaccacaactggcattcagctaaatagcgagatttcaatcggaaagcagaagattgacgagatcaggaaggagattattaacttggcgaagctgcaaaaaccctacataaccaagaaatcgatattcagcaagattgactacgtgaagaaaatctcccccgaaaagggccagaaattgctggagtttgcgaacatgatcctcgaagaggacatcgactacatcgccgttgatcctgagaaggatgagaagcgggactgtaatggtaaagcatgcttggccaaatga

SEQ ID NO: 11142 - RNA, 1026 nt, unidentified
  source 1..1026: mol_type = other RNA; note = synthetic construct
atgagtggccacgaacaccagctgaatatcccgagtccctttccaattctctccgttaacaagctcgctttcattctgcgtaccaaacctaacgaactgaaaaagctgagtgagaacgctggtaattattacaccccttttgacaggaaacagattaaagataatgggaaggtaaagtggagacatattgataatcccgcccccaaactcaaaaaaatacagcagaagatcaaccgtgtgctgctgaaggccaaggttgagtccctcccaacaggcatgaccggcgggattaagggaaggtcaatatttaccaacgcagcccagcacctgaaccagaaagccgttgtcaccatcgatttaaaggactgttttccgagaacatccaacaaaagaatcttccgggtgtggcgcaatcatctgggaacgagcgagtgcgtcgccaacatattaactaagctcactacgttccagcgcaggcttccacaaggctcacctacatcctcaagcctgtgcaatctcgcactattccctttgtttaaaaagacaaagcggtactgccagaaggaaaaatttaacttgactctctatgtcgatgacatcacgatctctggtcagacaattccaattagacttgcaatcgggcggatcatcaatttcatccaggaagaggggtatgcggtgcgacggaataaaatcaagattatgaccgcgagcgtgcaacaaaagacaacaggactgatagtaaacaaacagctgtccgtcagtgcaaaagctagagaggaaattcgaaaagagatattcatcttgagcaggcaggagatgttctcttcaaagcgcatgaggagcctatggggtaagatcaactatattaagaaggtgtcccccaaacaaggcggaaagcttgcttctctggcccacaccctgttattggacactctggccagccattcgtacgaaaatgtgacctctgagaaggaagtgactcgcgagtgtaagaatactcggcgacacaaatactctctttga

SEQ ID NO: 11143 - RNA, 1008 nt, unidentified
  source 1..1008: mol_type = other RNA; note = synthetic construct
atgtcactggcgcgacctcagatcgtgtcatggaatctcatccgacaagtcacaggtttcagtgccgatgagttgagatcagtggccgaacgcgcaggaggactgtacgagagcagagatagactggcccacaaagcaaaaaaacccaaatggcggcatattgacgaccccgtccccgaactcaaacgcatacagagggcccttgtacgcggacttctccggccgatacccctacctgcctttttctgcggatccgtaagtggaagatctccagttgatgctatcaaaccacatgtcggcagaccgtctatcctggccctggatcttcgagactttttcccccgtactagccacaagagagtgtaccgggcatggacgagggtagtgggctgcagtcctgagatcgccggggttttgacacagttaacgaccctgcatcgaagactgccccaaggcgccccatcttcccctccactagccaatctggcctttcttgagattgggctggctatcgagagcgcttgtcggaacgctggtttacgtgtgacattcttcgtggacgacattttaatctccggtgaccagcctggcactgtgctcgatgagattatcgatctgctgcagcagagcggctatggggtcaagaggtccaagatggaattcatgggacctagggaaagacacgcagccctcggcgcggtttttaaccgctttatctcttatggccggggccccttcgcaataatacgtcagaggattttggcactcattgactccgctgaggtgaccccgtcgcaaatcaggtcactcaccggggcggctcactacgtccggtttctgaacaagaaccaaggggataagcttctggctttgattgtgcagttgaggcccactgttgaagacggcccacgggagcctaaggctcagtgggaaacctgccgcggtggaaataagtgtaaggcaaagccaagggggagccgcccactggtgacaactaccgggagctga

SEQ ID NO: 11144 - RNA, 1047 nt, unidentified
  source 1..1047: mol_type = other RNA; note = synthetic construct
atgacacagtcccctgccgccgatccaggattggtgcctctggtaagcatgagaagactagaacagttactgggacgtagcagggaagacttaatccgcctcgccgagcatgccggtagatactacgccccatttgatgaatttaagcctaaccgagcagaaccgagacacattgaccggcccgttggggagctaaagctggtgcaggagaggattcaaacctctatccttcgccatatccctttgccaccaactatgttaggcggggttaaacgttgttcaattcgggacaatgcccagtaccacctgggcagccctttggtcgtcacaatcgacctgcgggattgtttcccgcggactcacgatctggccgtctattccgccttctgcagggtgctcggtgcttctgaaaagattgcacggctcctcaccaagctgacaacctatcagcatcgcgtaccgcaaggcgctcccacttctagccttctcgtcaattgggtcctgctgccacttcatgatgcaattcagacgattgcacagggggctgactgcaggtgcacattctgggttgacgacatcaccgtgagtggacccgcggctttggacgtggtggaacccatagtgatggcgatccaacgccatgggtatagtatccgccaccggaaactgcacctcatgcctgcttgcaggccccaggaggtgactggtgtgctggtgaaccgtcaccccgcagcaagaagggaataccgtaccgagctaagggccactatactgcagctgtcctcagaggtcgaagtatcagctagaaaacttgagcggataaagggccgaatctcgcacgttcgccacctgcatcctagacatggcgagagtttggaccaactccttgagcgaacaatgatgggcaggcgcgtcgatgagctgggagcttgtccacccaaagaggtgcggacgcgcgttcgatgtaaccacgtgcggagacacagggccggaagaagggcctctgctcgatccagagcagataccgggggcattgcgggtgagtga

SEQ ID NO: 11145 - RNA, 1074 nt, unidentified
  source 1..1074: mol_type = other RNA; note = synthetic construct
atgtcagaggcgacagcgcggaccttttatagcaaggccgggctgggttttcatttaaagcgggattggtcgactctcgaaagcctggcagaacacgcgggcgcccactacagaagttttgatgagtggatgggcaataagtggcgtcacttcgacgtaccaagcaagcgccttgccgacgtgcaaagggaaatagccaggttccttaaggcaagagtcaaattcccagatacaatgctgggagggctcaagggaggctcacccaaaaaaaacgctgaggcacaccgaggccagggtctagtgtttaagctcgatatcagagactgcttcccatccatcggtcataggagagtgtttcgcatgtttcgggaacagctcaaattctctgaccctatctccaatcttctgacgaaactgactaccttccagaacaggttaccccaggggagccccgcctctagtgtgattgctaaccttgtcctcatggaattgcacgaatcaattcagttagagtgcgaggcactgggcttgaagtgcacctttttcgtggacgatatcactctgtccggggagagggttcgcgaggtgattgccccagttgtgcggctggttcagcgtcatggattcagtatgcgcccgtgtaaggttcggctcctggctgctcatagggaaaagctgtcagtcacaggggtgcttgttaacagacggaggctgtctgtgggacgaacgcgaaagaataagttgagagcccgcatccatcagctaagcagaggggagcgagtaaccgacagcgatctcaggtctattcagtcctccgtggtccaggtcaaacacataagtaatcatcagggcgaaaccttggagagactggtacaagagaagctgcctaagcgcggtgtgcaaacacctaaagagcgtgccaaaaagatccgcagggtctgtaaatgtacccataaacatcggcacaaacgaaacgaggagagcgtgactgctacacaccagcctgcctcttccgtggctgcaggattgccccggcaacacttcgtccacactctggaagccggcctgagatga

SEQ ID NO: 11146 - RNA, 963 nt, unidentified
  source 1..963: mol_type = other RNA; note = synthetic construct
atgatgctgtccgctaaaccattagtctcccggagggagctctctttccggctggcctttcctagggatagactcgaatctgtggcggagagggccgggagatattaccgccccttcgatcgcgagaagaaacccggggctaaaaaatggcgccatattgacaatcctattgagccgctgaaatgggtccagaagcggataggccggggcatcctgaagtccgtcgacttcccagcagagctcacaggaggattgtcgggtcgatcactcgtggacaatgcaagaccacacataggtcaacctacacttgtgtgcctggatctggactcttttttcccccacgtcaaccatgatagagtttacgacgcactgaggcgccacctcggctgttcaggcgaaattgccaacctgctgactaagctaacgacctttcagaagagactccctcagggcagccccgcatccacattccttgcgaatctcgtgctgatcgatattgtggaagagttgcgggctatcgcacgcgaccgacatctggccttgtcctgttatatcgatgatttgaccttcagcgggatcggagcagaagaggccatcggagatgttgtggcagtgttaaaagcccaccaccttaagattagtcgtgagaaactgagcattgcgcatgaacatgaagctcgaagcgtcacaggcataggggttagcagacggttgaccaagcccagagacaagatgctggaggccagggactttatcaacagcctggccgcttcagagactgtgagtgaacgggaccttgccagagcccgcggaatcgtggctcacgttgggcaggtaaacaagagtcaagccgcctacttagctaggaggctggcccgtctaccacctgcaggtgatgacgctccgcaggaggtagaaaaaaccaagactcgacgttgctcatcttttcttaggccacactga

SEQ ID NO: 11147 - RNA, 978 nt, unidentified
  source 1..978: mol_type = other RNA; note = synthetic construct
atgattaacagctactctgacctgtccccacttgttagcattcggcgactcgagcgcctgttgggctttgataggcaggcgatccagtggatcgccaatagagcagggagatactatcggcctttcgatgtgcgccgggtgggtaccaggaagtggaggcatatcgacaatccgcaaggcaagttgaagactatccagaaaaggattttaactaacatcctgaagaccgtcaacttccccgcggccatcttagggggaattgccggcgctagcattaaagagaacgctcgggtgcatcttggccaacctatcttggttgtgattgacatcaaggacttcttccctaatattacgcaccggaaagcttactcagcctataaaacatgtctaggctgttctgcgaagatagcaggactgctgacgaaactgaccactttccagcgccgtattccacagggagcccccacaagtaccttgctggcaaatatgagcgtcttaacactccacgacgagcttaaggaactagccgataatctcggcctgcgtgtgaccttttgggtggacgacattgctttctcaggtcctaacgcagataagataataggtgccgcagtcgagatcatctcccgacatggttttgccgtatccagcaaaaagataagggtaatgggacgcggaagtaggcaggaggttaccggggtccccattaacagaaagatctccgctgggagaaagtatatcgaagagctgaggaatagcatcctggattttaaacgaactgggatcacagcccacgaatttgcctcactgcgctccaaaatttctcacgtgcggtggctttgccccagtcagggaataaagctcgaagagtttgctaaagaacaactctctgacctcgtgctgtcgatcggctgcaaggcagctaaaaacgagtaccgcaagtgcgaagattggtcaagacacagaagagagccatga

SEQ ID NO: 11148 - RNA, 984 nt, unidentified
  source 1..984: mol_type = other RNA; note = synthetic construct
atggcaggtaccgcgccccctgccgaaagcattttccctatcaaaagcttacggaggctggagcggttgctctgcgtccctagggaagagcttcgattcctggccgacgccgctgagcaccactatcgtccctttgacagatttcgtcctcgcgccgatgggacggtgaaagtgaggcatattgacaaccccgtggacaggctgaagtccgtacaagcaaggatcaattcacgcctcctccgaaccgttccttttccagcaacaatgatcggcggtgtgcgcaggagaggcccaagagatggagccagtcttcactgtgcatccccagatctggttaccttggatctgtccaattgttacccgcgtaccaccaaccggcaggtgttcgcggtgttccgcaacacgttgggctgtagtgaagaggtcgcccggctgctgaccaggctcacaacacgtcagggtcatttaccccaaggcgcccccactagcggactgctttcgaacctgtgtcttctggacctacatcagacaattgctggcctggctgcctctagaggactcgccttttcacagtacgtggatgattttgcactatccgggccgggggctagaaatgcactgggtgacatcctccccatgttctttgggcacgctagcgcgcgcttgaatcgcagtaagctgcgctgctgtggacgcggcagcagacaggaggtcactgggatttgcgttaatcgacgaactatgtctgctagaggcccaaagtatgaagcactcagaaatcgggtaaggtctttcgacccaaacgcctctgacgcgggaactgagcgacaggccatactgggcgcaatcgcccacgtccggtcaataaaccaattgcaggctgattcagtggtccggcttgctgaaaggtgcggattacggcgggacggatgcagggacacaccagattccgttagacctgtggggagagccgctggcgattga

SEQ ID NO: 11149 - RNA, 972 nt, unidentified
  source 1..972: mol_type = other RNA; note = synthetic construct
atgtcaagaagaaagatcgagtctcttctaggcgagaagatcgaatatctggaacacgttgcatccaaagtgggaaattactacaagccttttgacatatacactcccggaaaaaagccccggcacatcgataacccaaactcagaccttaaaaagatccagaagaaaatcaagtcccgggtgttagagacagttatcctgcctgagacaatgatgggtggtattaaagataaaagccacaaggacaacgctctaaggcacattgacaaaaaggtggtgattacgctggacctcaaaagttactttccaaagaccaataaccgaaacatatacgacgtgtttatcaatgtgttcgggtgtaatagggagacagcccacctcttcactaagttgacttcctatcaacggcgtttgccccagggtgccccttctagtaccctgctggctaacatgtgcgtcttgccaatgcataacgatctccaggaacttttcaataggaacgacataacctggaccttttatattgatgacattgctttcagcggggataacgccgataaggtcattgacgaagccatcaaaattatccagaatcatggccagggggtgtcttgcaagaagaaaaagatcatgtacgcgaacaatcgccagatggtaactaaactgtgtgtcaaccgcaaagtcggcatcaagaaggaaaaaatcaacaagatcagagaggatatcattaatctctcctggcaacctaatattgataatcgaaaactgcaggccattaagggaagcattaactacgtaaagagcatctgcgcagtcaggggccaatcactggacaatctgtataaaaagatgttacccgcaaaaaccgggctcataggcaagaaaccgaagataaaaacaacctcgtgcaagtgttctaagaaacatcgcgagtatgtgaagggagttagaaacattagtaataaagagtga

SEQ ID NO: 11150 - RNA, 930 nt, unidentified
  source 1..930: mol_type = other RNA; note = synthetic construct
atgaagtccctgaaccaggacgataatgtgaagctgcgaagcatgcgcagactggagtctctgctggggagaagtcgaaaggatattaagcgaatcgcagagaactccggtcgttactaccggccctttccaaaacgccagggagataaggtccgcaccattgataacccaactggggaattaaagcagatccagaaaagaatccaggaacgtatactgacggacttcgaattgcctgagagtatgctcggaggcgtgaagggccgatcaattaagctcaatgccaaattgcattgcggggctcccacagtggtgcacttggacctggtgaagtgctttccacggatcagtaataaggtcgtatacaaagccttcgtggagcatctgggctgtacacctaggatagccggtctgcttacccagttaactacctatcgccggaggcttcctcaaggctctcctgccagtacgatgctggccaatatctgtctcctgcggatgcacaacgagcttagggacgtagctcagactaatggctcaatgctgtcattcttcgtcgacgacatagggctcagcgggaaccggcccgaggtcttaattgagcaaatgattggaatcgtgcggaaccatggtcactctgtctctcaccgtaaaagaaaaatcatgagaagccatgagccgcaaactctcaccggactatcccttaatagaaggcccctggttccaagaaccaggagggcgcaagttaggaaacagatttatcactgggcctcccagggcaactgcaccgatgaattgcagagaatccgcggtgctgtgaattttgtgcggtgggtttccgaacaccaaggcgaagctctcgagaggacactaagccgcgcacagagctcaacaagcgcagaatctgatcgctcgcggcagggatgttga

SEQ ID NO: 11151 - RNA, 912 nt, unidentified
  source 1..912: mol_type = other RNA; note = synthetic construct
atgacatcttctgaacaacagaagtccagccccaacccctttccactggagtccccgaataagtttgcctggatcatcagagtcaaaccgcacgaactgcaggaggtggcagcagttgcagaatccctgtataatccctacttcgagaagaaaaagggaaaaaaacctcggctgatccacaacccatcagacaggctgaagataatccagaagaagatcaacacgtggattctacagaagtatccttttccggatttcatagtcggcgggattaaaggtaaggccctcgaagaccattttaaattgcatcttaggaaagacatcgttgtgactctcgacattaaaaattgcttcccatctatcaccaacaagcacatttacgacgtgttcaaagataagctcggggccttgagcgatactgctcgcctcgccacactgctaaccgcctacaaggggcagttacctgtaggagcgccaaccagtccacttttggccaacctggtgctgttgcctgtgcttatagagatcaagaagctggttaactctcacggattcgagatgagtcagttcatcgatgacagcgcgttttcgggcaagcgcttacctgtggagctggtgtccgaagtctgtaagatgatggctcgtgctggttttaccatctcacataaaaagacactggtgatgcctaagagtgattcacagacggtgacaaagcgaattgtcaatcaaactcccggaattccacggaaagaaatgaataggattcgaagcgcagtcaatgagctcaaaaacacccccaaaaatgatcccctttatggcaaaagactggctagcgtaaaaggcagagttatatccattcggaagttctacccccaagtggccgagaagttcctccaggagatcggcgggtga

SEQ ID NO: 11152 - RNA, 939 nt, unidentified
  source 1..939: mol_type = other RNA; note = synthetic construct
atggtggctgctcccatactttctattagggatttggccgcccgggtaggcacacctatagagagaatgaccgaaatcgccgacgatattgattctcactaccgccctaccgcactctatgacgagaaaagaggccggagtcgcatgctcaacgtcccgaggaaagaacttaaggccctacagcaacgcattcatcgagttatcctggatccaattgagctctccgcttgcgtgcatggagctgtgtcaggcagaagccctcggactaatgccgagcagcatctcggcaagccctgtgtgatctgcgttgatgtgaaaagtttcttcgactcagtccgccactacgtcgtgtatagaatgtttcggaacgatctcgggttcggaagggacgtggcacgcctgttgacaaggctgaccacgtacgactcccagttgccacagggggctccgactagtccagcaatcgcgaatctggtgctggcatttcaagtggacaagcctctggaagcagctgcggcaagcttggaccttacatacacccggtttgtcgacgacatcgccatctcggggggagatccacggcctctaatcaacgttgcagccaagctgttatccgccaggcgtctgaaggtgcaccgagccactggacgaggtagactcaaacccaagctgaaaatcatgagcggtggggtacaacagaagataacagggctggtcgtaaattctgcgtcagcgcccaccattccccgacgctatagggatcaggtgcgtgcagctatacaccagctgcgagaaatgcagtccggcgcctctttcaaccgctccgtggacagcattagaggaagaattgctcatgtcagacggctgcacccaagcggtgccgctaggttagccggcgagcttgcccgtgttatcgagaataggcgggaatgtggctga

SEQ ID NO: 11153 - RNA, 924 nt, unidentified
  source 1..924: mol_type = other RNA; note = synthetic construct
atgattctggtccagccaatcctttcggtccgagatctggcagccaggttggggatcgaggctggttacttaagggaagtgggcagagacattgagagccattataaaatccagccattgaaacagggagccaaggtgcggatgctggccatccctcaggcggaacttaaaatgattcagagacggataaaccgcgctatcctcgccaaggtacccctcgccaaggcggtttacggaggggtcgcaggcggtagtccacggaaaaacgctgcagagcacgcgaaccaacggtgcgtgattactatggacgtgaagcacttcttccctaatgttcggcattacatggtatatcgcatgtttcgctctgaattgggcttcggtagagatgtagctagcatactgaccagactgacaacataccgttcctatttaccccagggagcgccaacttccaccgccgttgctaatctgctcctggcagcccccgttgatgtgcccatgtcagccgaagctgaaaggcaaggggtgcgctattctaggtttgtcgacgacatcgcaatcagcggggagaatccccggccgttgataaacaaagtggctaaactccttagttccaggaggctgccagttcataggagaaagattaatggaccttcaaagctacgaatagccccgtctggggtggcccagcgtattaccggactaatcgtgaacgcccaaaatggcctgtccgtgcctcgcgagcggagagataaggtgagggctgcaatttacgccctccgcagagctcctaagcacgagcttaaaaaagcagtcgccagcattagaggcaagatcacacacatcgcacagtttaacgctgccgccgcaaagcgtctgaatacctacctcgatggcacgctgcgacagcgactggacggctga

SEQ ID NO: 11154 - RNA, 939 nt, unidentified
  source 1..939: mol_type = other RNA; note = synthetic construct
atgaacgaacctatcctgagcctccagaaactggcctggcggttaggcgtgcccgtcaacaggttgcgccagttggccgacgaaatcagcagggatcaccgagagcactataacgcttttgcactgaagacgggcaaagataagattcgtcagattcggccaccgaaagaagagctaaaggcaattcaaagaaagatcgtgaagagagtgctcgctcccatcggactagcccctaccgcacacggaggtgttcccggaaggagccagcgctccaatgccgagttacatttggggcaagctagagtggtgactgtagatgtcaaaaatttctttgaccgtgtgcagcatcgccggatataccggatgtttagaaatgagcatggcttcggggcggacgtgtccaggctcttaacccgcctgatcactcttcgcggaagccttccacagggcgcccctacttctccagctgctgcaaatctctttctgaggagagcggtcgacgagaagctgggcagtacactcgctaaactgccagtcacatactcccgcttcatagatgaccttacgttctcaggccccgatcctcgatcgcttatcactaccgtggcccatctgctttcagaatgcgggttgaccgtaaaaaagagtaaggttaaaatcgccccacggcattgccctcagaaggtgacaggtctgctcgtgaactctgcaaccgggggtcgactgacaattcccagggcccagagggaagcggtaagagccgctattcaccaactcccgagactggcaatacgaaaagagtgggataagcaagtccgctccatcagggggcggattgcccacgttgagcgttatcaccctggagacggtgcacggctgcggaagtgtttgagagttgctctggacggccagcagccaaaatctgacgcccccctgtga

SEQ ID NO: 11155 - RNA, 906 nt, unidentified
  source 1..906: mol_type = other RNA; note = synthetic construct
atgcggagccctgtagatcactatagcgacgcctggttatctttcgagttaaggcatcctgttgacagattgagactgcttgcaggaatggtacccgaggacctgtacagtgtgaggagggtcgaaataaaccgcaaggttagggatatttcgaacccctgcgatgagctcaaagctgtgcagagaagtatccgcgagcgtctccttctgcccatccctctttccccaattgtgtactctgatgtcccggggcatagcgctgcgcaaaatgcagagagacacctgcatcaggcaaatgtcggaagcgctgatatccgggattgctataactctatgacaaatgccatggtgtttcgagtgttcaggcacacgctgaggctcggtgattcccttgctgacctgctcaccggcctcactacctcacgcggacacttgcctcatggagccccaacatccggtgcactcgccaacctgatcctgtcaccaatcgacgtcgagctagaacgaatagcggtagaactggacctgaagattacacgctacgtggacaatatcgacttttcagggcaaagaacccggcatgccttcctgcccattgtggccttgatccaatccttggggttcgcggtgaagcgccggaaggtgtttaatgcctctagacagcgcgtccagatcgttactggtcgaacagtgagtggccgggtcctgcgtcttcccagagccaaaagggctaacgtgagagcaaacgttcacgaagtgctctgtcgtcggcgagacggcttgccgatacaggataagcagattaacaggctaagaggccgcctgaattatctgcggactcaggggcacccaaaagaagcccgagacttagccacccggctggctgctgttggcattaatatttga

SEQ ID NO: 11156 - RNA, 903 nt, unidentified
  source 1..903: mol_type = other RNA; note = synthetic construct
atgagaatgccagttgaacactacagcgagcgatggttgagtttcaccctgtcacaccccagagagcggcttcgggttctcgccagcactgcagaacgtctctacaagtccggatggagagatgtgaagggtaaacagcgttacattactgagccgtttgaagagctgaaaatagtgcagcgcgctattcgcgaacacctgctgctgcccatccccttaagctccatcgtgtatagcgatgtgcctgggcgctctgctacaatgaacgcggtccagcatgttaaccagcctaatgtggcgtctatcgacatccgggactgctatccatcaatgaccaacgcaatggtcttcagggtctttaggggaccagttggtctgggagataacctggcacatacactgacccgccttaccacgctctccgggcatctaccccaagggacccccacatcaggcgccttggctaatctgattctgtctcctgtcgacgtgatattagagcagatcgccgagggtctgagactcgtcgtcactcgatacgtggacaatattgacttcagtggagtgcgatcccgggaggccatcctgcctactatagttgctctgcaggccgccggcttttcggtaaggcataagaaggtgatgaatgccggctaccgtcgggctcacgtggtaaccggaaatcttgtcgatggctgtaggcttcgcttgcctcatcgaaaacgggccaacgtgagagccgcggtgtatgaaatcgtacagcgctatgaggatgggctcccaatcgcaacgaaggctatgaacagactcagggggaggctccaacacctaaggacacaaggccacccgcgggacgctgaaagattagccgctcagttggtggcagccggcattgcaatttga

SEQ ID NO: 11157 - RNA, 915 nt, unidentified
  source 1..915: mol_type = other RNA; note = synthetic construct
atgccctacaatgtgaagtccattaagtcactggccaagctgctggatgtggatgtggaagagctggtcaggatagaacaaaacccagagaaatactatgagcccttcgaaaaaaagcgaggggagaaatcaaggtctatcgacaacccaactggcgaactcgccgctctgcagattaggattaagaagttcctgctctgcgacgtcgacgtgtttcggcctatagctacgggtggcgtcaaggggcactccacaaagacatcagcactgctgcacaccaataaagattgcgtggcaaccgtggacgtaaaaagctttttcccttgcgtgacaaacaataaggtgtacaaggtcttctgtaacctcggatactcccccccagtgtctcggatgttgaccaggatcaccacttataagggacatctccctcagggttccgcgactagtactatcattgccaatctggccctttataacttcgatgagtacctctacaaccagagcttgagattagggtgtgattgcatccgatttgtggacgacatcattatcagtggcagctacggaaaagtcaccgaacttgtgagccttgtctttcccgccttacatcggatgagattttctgtccaccgcgcgaagaaactgaaaatcatgaagtctaacaagcggcaggaggttctgggactaaccgtgaatagagccgttggcgttacaaaatcatatgtggaggaagttagaacccaaatcgcttgtgtagagaagtgcagtgtaacaagctgtgtatatttgaaacttgttgggaagatacagtatattggcactacgaaacctattatcgctggtaatctaatgcgcaagttgcgcaattccctcatgcgtccggagaaagaatgtctggcatcgatagagcagtga

SEQ ID NO: 11158 - RNA, 1014 nt, unidentified
  source 1..1014: mol_type = other RNA; note = synthetic construct
atgacagtggacctgccagaaaagaacatagacctggcagcagcccctaagctggacctgctgagcatcagagaattagagttcaagcttggtttggaacgaggttacctcaggacccttgctgcacacgccggaggacactataatcccttcgtgaaaccagaaaaagtttttccatttcagcgacggttcaagaacaagaagaagcgcatcatcgataaccccgacgagcagctgcgggatgtccagaagaggatctacagaagactgttgaggcctgaatcgcttcctgattacatttatgggggggtgacaaacaagtgcattcaggataatgtgaaccggcatctgggggccagaatgctggtcaccgtggatattgcgaatttctttcccagtgtgacgaatgagtatatttattggctatggaaccatgtacttagatgttccagcgagatctccatcctgctgacgaaattgacttctttcgagcgccacttaccgcaaggcgccgctacttctacacctctggctaacatcctcatatgcacaatcgataaacagatccggtctgagtgcgaacggatggggattacctactcaacctgggtcgacgatttagcattttcaggagacgacccacgaagaatcataccggtcgtgatcggcgccctgcgcaaaagtggcctacggcttagccgtaagaaaattactatcatgggtcctgccacacgcaaagtgctcaatggcattgtcctcggaaagaaactgggggtaacccgcgaggttcggtctaggattcgcgctggcatccatcgtctcaaaactggagcggttcccatacaagaccagcccaagtacatgaggagcttgattgcccgtattagacaggccgagactatcaattcctcccaaattcaaaagttgaggagtcagctcgctgccgtgctaagggacaggtcaatagctctcaccgagcgacagcagtttctgaaacagctcggctgtgcatga

SEQ ID NO: 11159 - RNA, 957 nt, unidentified
  source 1..957: mol_type = other RNA; note = synthetic construct
atgagtatcccgcagctgagtatcgttagcgtgaacgacctggcgcagcgccttaggattgaccctaaaaaactgcggcacattgccgcccatgccggtgattattacaaacctttcaagcaacgcaagaagcccaaacctttcgcaaagaagtctaagccagccaaggtccgggaaatcgacaatccctcagaattactcaagactatacaacgccgtatctgtgataatcttttgtgcggtgtcccctggccagagcacgtgttcggcggaattaaggaacgaaacacagtcaaaaatgctaagcttcacttgggcaatgagaagctcgttaccatcgacatccgtagctattttcccagtatttccaacaaggtgatatatgacatttggtttagattcttgggatgtggctcagaggtgtccgcaatgttaacacagctgacgacatttcgaagaaggctgcctcaaggggcccctactagtaccgcactggcaaatctggtactcatctctatcgatggggagttggtcgagttttgccggcagaattccattacttacaccacctgggtggatgaccttgccttttctggcgagaacgctgaactcgccctagaaaaggctattagctccttaaggagggctgggctcagagtggcccggaacaaagtaaaagttatgcgaggatcaaaaccacagatcctgatgaatcagacactgaacaactctatgggcgtgaataaaatctataggagcaacgtgagaagcgctatcaataaactggtgacgcatccacccctgaatctgaaagagcagttcgcgtcaataaacagcaagatcagatacgtcgatacaataaacaagaaccaggctcgggcactaaccaagaatctgaactcgaccctcaatcgcattaagaactcctctctctccccgtacactaaagccatttga

SEQ ID NO: 11160 - RNA, 909 nt, unidentified
  source 1..909: mol_type = other RNA; note = synthetic construct
atgaaccgcaatggcagaaaccagttacgactgaatataggaagtctggatgtgctggggtatgccttgggcctgtcacccgaagacccatttataaagatcagcaatcctgccccatttgcagccgacccaatcgagcccaagcaaaggaagatcgataaccccattctaatcacaaaggaaatacagaagagaatcaatcgatcactacttcgcccactgcacctgcccgggcatatatgcggtggggtgaagggcaagaccttattggacaacatcattcctcacctgaatgccagggtgattgttaccgcagacattaagggtttttttccctcaataactactttccaggtgtatgccatttggtccagactcctgggctgttctccggaaatcgctgctattttgactcgcctcacaaccttcgagcgacggctccctcaaggagctccaacgtcttccacgttggccaacctgatcctgttctcgtttgatcagcctatcaggagcttctgcgcacagcatggaattacatacaccacctgggtggacgatctgattttctctggggctgagagcaggtccgtgatcaatgtcgcagttgcggctctcagagagggtggcttttccctccctcataaaaagcttaaaattatgaccgcgggcaaacgcatgagggtgacaggggtccttctggggaaaaaacccggtgtcatccgtcggtatgcacgcgatacaagggccggcatctacagactcactaaaggagacttagccgagccgaaagtagaccggtacgtaaaaagtatccggggacggattgcccacatcaacagactgaaccctaatgtcgcccggagtcttgatcaccagttccagcttgctctcaagcgtgcggttagctga

SEQ ID NO: 11161 - RNA, 990 nt, unidentified
  source 1..990: mol_type = other RNA; note = synthetic construct
atgacacttcagaggaataaaagactgccccttgaccagctccccctgcgatctctacgggaattagagcacttgctgggtgcctctcgcgaggctctgctgagattggctgaatgggaggccaattattccccctttgagcaagccaagccactgaagccacacgcaaagaaaccgcagacaaaaaagctcaggaagatcgataaccccggcgtggaactcaaaaagatacagaggcgcattttgagccggttgcttctcccattaaatctgcctaacttcctgttcggcgccgtgcctaagcggtcagtaagagagcacgccgctgcacatctcggagcgaccaccatcgttaagatggacatcaaatcatactaccccaaccttaccaatgaacacgtctataaggtgtggcacgagatactatgttgctccgcaccagtgtcaaagatcctgacaaagctgactacttgcgatttccatctccctcagggggccccaacttcgccgacacttgccaacttgtttctggctagcatctacggtcccattatacaagattgtgtggctaaggacatcgtggcgaccgtttgggtggatgacttaactttcagcggggaacggagtcgcgacgtgatggagcttgtccgacagaccctcgcctgcaacggcttgcgggactctcgaaagaagcgcgtgattctgacgggaaaaagttctaaactggttacaggagcgaggctcgggagggaagagctcagagcttgtaagctgaaagtccgggagattcgtgcaggcattcataatctgaagaggggtaaagtgacgactcgcgggcgttccaaagatgttcagagcctgctggggaaagtcggctttgtaagaagtctgtgcccttcagatgcaatccctctggaaaaacagttgagatccatcaacgtcagcattcctagtcaagccggactaacctcccgtagcgccaagggctga

SEQ ID NO: 11162 - RNA, 963 nt, unidentified
  source 1..963: mol_type = other RNA; note = synthetic construct
atggacctgcctcagacaaaacctatcgttggatctctgtctgacctggaacaccgcctaggaatcaagcgtggggatttggccgtcctcctacaatgccgtgccggtctttacagaccgttcaagattcccaaaaagcaacacccctacccaggcaaactcagacggctgaaggcttccgagccagtcaagtatagacagattgacgatccggtgaagcagttgaaagacatacagcgacgcatccttgcaactgtactttcccgggtggaactgcccgcttacatgttcggggccgtctcaggtcggactttactcgggcatgccaaggaacatgtgcctaaccagagctcgattgttgtccggatggacattagcagttattaccccaacatcacctgtgagcatgtctattacgtatggaatgtggtactgggctgtccccccccaatcgccaggttgctcactgagcttaccacgtttgactggcatctgcctcaaggcgcgcctacctccccagctatagcaaatatcttcctcgcctcaatttatgctcccatctgcttagcgagcgagcaggcgggactgaccattacaacatgggtggatgatctgattttttcaggcgtggccgcccacacagtgatggagactgtgagggctaccttggcggctcacggttttaagatggcaccagataaacgagagatatttggcccaaaagaccagaagaatatcacggggacacgactggggagattcgaggttcgcgttacccataaaaagatgtccgaactgcgcgccgcaattttcagactggctatcggagcactcgaacctggcgaactcgagaagtacaggcggaacttaagtgccaggatagcacacattgctactatccacaaaggagatgccgcaaaggtgcgcaggcacgccatcaaaagctctgtgatcctgaagtga

SEQ ID NO: 11163 - RNA, 975 nt, unidentified
  source 1..975: mol_type = other RNA; note = synthetic construct
atgatgatcatgaagaagaagaacaagcacaagctgattacaatcagtgacctagctttgcacctgggcatttccgagggttatctacaagatatcctgtccgagttgtattcagaagataccaaactctaccgcagttgggacaaaattaagccaaacggagagacgaggcccatggacgctcctagggataagctcaagtttatccagaaaagaatcaacggacggatcttgcagcggacacagatttcaaaaatagcaaccggcggtgtcaggggacgtaagttgaaagacaatcttatcccacatctcagacagcaaatggtggctaattttgacctgaagcgatttttccccaacatcactaataagcaggtgtatgagatcttcattcttattggagtgtccccagacgtcgccagagttttaactagactgaccacctttaaaaatcgaatccctcagggcgcacctacaagttccatgctggcgaaccttgttgccgggtacggcggcagccattgtctggacggacgcatagaaaatctctgcgccatcaataatttcaatctgcgacgctgggtggacgacatctcaattagcgggcctaattacattaaaaagttcgagccgaccattgagaaaatcatctttgaatccggttttatccccaatcgggataagacggcgttcatttctaaaaacaacgcccagataatcacagggcacctggtgaacgaaaaggcaaacgtagtcaaacaagaaaggagacggatccgcgccatactgcacaagtgcaagactagcggcctcgatggctacagcaaaaaccgtatagatcatcttaaacggtctttacgcgggaaaattgctcacatcagctctataaatcccaggagtgggaacaagctgctcgataagttcaactcaattgagtggtcgagcctgattaatgagatgactaactctgcctga

SEQ ID NO: 11164 - RNA, 999 nt, unidentified
  source 1..999: mol_type = other RNA; note = synthetic construct
atgctgcggatacgacaggtcaaacatttggccagaaggcttaaattccctactcgagtgctggagaagatcgcagaggcgcccgaactgtggtgcgaggagctcgtcctcttagatcctgcgaagccaaccaaaccacggaacgtgctcaacgttcgcgggcagctacgacaactccagagcaggatgctgcgcagcattctgcttcccgtgctgccggtttcccagttttcacacggctccactcgccagcgtcatattaagagtaatatcgaaccccaccttagatccacattcgcttttaccaccgacattgcagatttttacccttctgtgtcccacaatcgcgtctatagactctttgctaaaaccttagagtgttcgccagacgtggcacgcgtttgtaccaagctgtgtacatatgatcaccacttggccctgggcctgattacgtcacccatactcgccgaccagactatgcaccagatcgatagaaggataggactggcctgctggaaggctaagctggtgtatacccggtacgtggacgatttgactatctctggtggatatgatttggctaaaagcgggtttgcaaatcttgtgcaaggcattttggaagagcatggcttcgcagtcaatccagacaagcatagattcggtagactggaagagggcactacaatcacaaaaatccgtgtcaaccgcggtcaccctgatgtacgaaggcagtacgtgaccgaactggaaaggcaaatcgaggacgcccatcggctagccgtagacgagcagttcgacggaccttactacacggaagggcagatctgggggcggattcagtttgtttcttgggtcaacccgggccgtcaacgggccttagtgcggaagttcagagctgtaccatggaacaaagtgaaggaagttgctgagtgcagggggctggtgtgcctgaagaaagtccttagcaagaggattctcgccagtcccggaacagtgtga

SEQ ID NO: 11165 - RNA, 984 nt, unidentified
  source 1..984: mol_type = other RNA; note = synthetic construct
atgctcaacattcagcaagtgaagcacctcgcccaccggttaggggtgtcggtgaaacatttggaggaggtggcggaatctccagaaggatattgtgaagaattggtgctgttggacccagccaaaccggagaaaccccgcgatgtgctggatgtacgtgggcccctcagaaagatgcaactccagctgctcagagaggtcctgctgcctaagctgcctataagcgcacactctcatggtggcgttcgaggcaggcacatcaaaagtaatgtgacgccgcatctggatagcaccttcgtgtttggcacagatatctcagacttctaccctgggatcaaacacaaccgcgtgtaccggttgttcacacagcagtttgggtgcgcacctgacgtcgcccgaatatgcacaaagctttgcacgtatcaatatcatttagccttagggctcattacttctccaatcctagctgatcaggtgatgggacccatcgacgaacgcattggtactgcttgtagaaaggctaagctagtctacacacgctacgtagatgacctcactataagtgggccctttgatttgcatgagaataagtccggcattgccggtctggtgcagagaattcttaacgatcacggcttcgccactaacccatccaagaattccttcggacggcttgccgacggagttcccatcaccaagattcgggttaagagaggccacctggacgtgaggggagagtatgtcaaagagctggaacgacagctggctgacgctgcgtcactggccaatggcggtgattttgacggaccctactacaccgagagccagatcaggggcagggtgcagttcgtatgttgggtgaacccaggcaggaaacgggaactgatgcgccattttcacgtcgtcccttgggacaaagttggacaagaggcagtaaggcgtgggcttgttgcaaccaaaaaggtcctgatgaagagaacctga

SEQ ID NO: 11166 - RNA, 1014 nt, unidentified
  source 1..1014: mol_type = other RNA; note = synthetic construct
atgctcaatctgaaaaccccgaagaatttggcgtaccgcctgggtgtatccctgtccgtgttgagggatgtcgcggatagacccgacgactggatcgagacacttctccttaacgatccaacaagacccaacaaacagagggaggtgttaaatgtaaaggggaagctgaaacagatacagactaggctgctcagagtggtgcttctcccagtgctaaacgtatcgccttattcccacggtggcattagcggtcgtaacatcaagacaaatgcctcttgccacttaaacgccaactatctgttcagtgccgacatctctaatttctatccttccatcggacaccgccgggtctaccaactgtttagtaaacggctcaattgttcgccagacgtttcaaggctgtgcacgaagttaaccacgtacgattacaagctggctctcgggctccccaccagtccaattctggcagaccaattgttccatcccatagatgcacggattgccggggcatgccgaagcatgggactttcttattcccgatttgtcgatgacatcgcaatctcaggaagctttgatttgtcacctgagagctgtggcgtgtctgccttgctagagaggattgttactggaaacggctttgagctgcagctggaaaaatcccgattcggccggctgagtgaggatgaaatgactatcacccagctgcgagtccggaatggaagattggatgtccgggagcagtacgtgctggagctggaacgccaactggctgacgccggcgaactgagcaacgatcgccattttgacggtcctttctacacagagagccaggtgcgcggccgcgttcaattcgtgggctggattaatagggacaggaagagacagcttctccagcgttttagagaagtgaactggacccaggctatggctgttgggagaagccgggggctcgtcgtgcagaagaaaactcttatacgtatgcagaagtctgacctagactcaacagaaacctga

SEQ ID NO: 11167 - RNA, 996 nt, unidentified
  source 1..996: mol_type = other RNA; note = synthetic construct
atgctaaaaatccggcaagtcaagcatctcgcttctgctctttctacgacccctgccgaaatggcggccgtgttgaaatccccagccgacttttatgaggaacttgaactgagagatccgagtcgaccagacaagcctcgcattgttgtcaatgttacaggagccctcagagcgctgcagtccaaactgtaccgtagaatactcctacccaagttgagccaaagtgcacactcacacggtggagtgtccgggcggtccattaaaaccaacgtagagcctcatttaggctcgaagtttgtgttcaaaactgacatcgcaaacttttacccctctatccatttccggcgggtgtacaagttgttcgtggaagatttcgagtgtagcccagacgttgccagtgtttgcaccaaaatctcaacgtatcgtcaccatctcgcactgggactgatatgcagccccatgcttgccgatcaggtattgcgacgcgtggacaggagaattggaggcgcttgcgccggtttagggctggtctacacaaggtatgtggacgatgtggccattagcggtccgtttaatatcgagactagcggcttgcctcgcctggtcgaggatatcttagctaaggacgggtttaaggccaatgctgacaagcacctgttcggctctctcgccgaggacctcagtattacttccctgcgcgaagtccgagggcaccttgatgtgagacgggaatatctggatgagctcgagcgacagatcgatgacgcagcttctctggcaagggatggcgaattcattggcccctacttcacctccgagcagatcctggggcgtgtcagattcgtgtgttgggttaaccctggccgcagaaggagccttatatcacggtttcggacagtgaagtggaaaaaggctagaaaggtggcgaaaaggaggggatacgaggtaactaggaaaaccctgacaaagctgccccgcagggaagagccatcatga

SEQ ID NO: 11168 - RNA, 993 nt, unidentified
  source 1..993: mol_type = other RNA; note = synthetic construct
atgttgaggataaggcagactaaacaccttttagagactctgggagtatcaagcgacgaactgtccgctatcctcgcgaacccgagcgattactatgaggagctcctccttaccgatcctcagaaaccccacaagccccgcgcggtggttaacgtaacaggccggctgcgaaccctacaatcccgcctgtatcggagggtgctgctgactaagctgtgccctagtattcactcgcatgggggagtgagaggtagaagtataaaaacgaacgctgagccccatctcggctccgcttttgttttccgcactgatatttccgatttctacccgagcattcatttccggcgtgtctataggctatttgccgaaagactggaatgctctccagacgtagccagaatctgtaccaagatctgcacctaccggcaccatctcgcccttggtctgatttgttcaccaattttggccgatcaagtgctggcacgggttgacaggagattgggaggcgcctgtgctaaggaaaatctgacctacacaaggtacgtggacgacattgcaatctccggccctttcgattttgagaagtctggctttgctaaccttgtgcagaggatactggccacagacgggttcaaagtcaatcctcagaagcacgtctttggcagtcttgctaaagattgtactatcacaaatctgcgggaggtgcgaggacatctggacgtcagacacgaatatgtggaagagctccagaggcagctcgcagatgcatcatctctggcacaggaccgcgaattcgaggggccatactacacatttggtcagatcttaggacgcgtccgtttcgtgtgctgggtcaatccagggcgacgccgagacttaatgctacgtttgagaagcgtgaactggcgcaccgttaaggccatcgccagaaaacggggctatgaggtgagcaagaagacgttgtctaaacgggacgggcccctcgcccaatga

SEQ ID NO: 11169 - RNA, 993 nt, unidentified
  source 1..993: mol_type = other RNA; note = synthetic construct
atgctgaacgtgcggtccgaaaggtgtttggccgatatcctgggggttactgttcacgcgcttaaagtggatttaggcaggctgaaccgcgatgttcgcgagtttcaactgattgaccccgctcgccccgacaaagttcgggaggtcatccaaattgtaggagcatggcggaggcacctcgacagattgatggaaaggctgctgctcccacgaatcactccttctatccacaatcacgggggtgtcaaggggcgttccatcttcactaacgccagtgcacacgccgagaacgtgtatgtctacaccgctgatgtgcgggactttttcccaagcatacatcatagaagggtgtatcgactcttttttggaaggttcgggtgcagcccggatgtcgctagcatctgcacgcgactctgcacacacaattaccatctggccgtgggactaccctcttcgcctttgctggctgaccaggcaatgcgtgaggtggatgaacggattcatggagcatgtcagagcgctggcttaacctataccagattcgtcgacgacctcacaatttcaggcggtttcgacttcgcaggcagtggcttcctgaaactcctgcctaggattcttgaaaagcatggatttagactgaatccgcgcaaaatagagatagggaggctggatgacggccctcaggtgacaaagctgtgggtgaacagaggacgccccgatgtcgcccgggagttcatccagaggttaatggagcagatggaagatgccgagagactcgccaatggaggcgactttgtaggcccatactttaccccagaccagatttatggtagagtgtgtttcgtgagatccatccgatgggggcgtggtcgggatttgatgcgccggtacagatcagttcagtggtctaaagtggaggccgaagcaggccgccttgggcttgtagctgaacgaaagcgcctaattcctaagcccaaggaagaggcgggctga

SEQ ID NO: 11170 - RNA, 1005 nt, unidentified
  source 1..1005: mol_type = other RNA; note = synthetic construct
atgttacatattggatacgataaactcttggctcggatgcttgggaccaccagggctgagctgaacgacattttggacaatgccgatgagtattttgacgagctgtcccttttcaacccggaaaagccagacaagccccgggacgttatttccgtacgcggcaagctacgaactttccaggcaaagttctataggaaagttctactcaggaagctgtctgtttcaccccattctcacggtggcgtgaaaggacgaaatattaagactaatgccaagccccatctgaattccagatacatatacaagatcgacctccaggacttctttcctagtatcaaacagcctcgcatttaccgccttttcaacagcaaatttgcttgcagcccgcctgtagccaagctgtgtacaaggctgtgcacatacgaacaccacctggccctggggctgataacctcgccaatcctcgccgatcaaataatgcagagcgtcgacactcgtatcgggagcatgtgcgataatgctaaattggagtatacacgttttgtggacgatctgacgatctctggacccttcgattttgaagaaagtgggatcccagacctgatcaaccagatactcctggagtccggcctgaccccaaatcccaagaaatatgtgtacggaaagatcgataacggcatcagtatcaccggcatcaggaaaaatcaggagggtaaaattgacgtggaagaggagtatgcattgaaagtcgaagagcaactggaggcaagcaagtcacttgagctggggaattggcctgatctttcctgtttatatcacactcccgcgcagattcggggtagaattgatcacattaaatggatcaacgaatctagaggcaagaagctgctaaacatttacaagaagatcaactggtcacgggtggatgaggaagcccgcaagttaaaattggtcgtgtcaaagaaaagactcacgaaaaagacaaaaaccctcctcgtggactga

SEQ ID NO: 11171 - RNA, 1014 nt, unidentified
  source 1..1014: mol_type = other RNA; note = synthetic construct
atgctcaatctgtggcgacttgaccagctgtgtcgacttctcaaaactgaccctgaaaaattggcttccgcactggaaagtccctcgaagtttatcaaggagctgttactgtgcgatccagcgggtgagaagcgtcctagacgagtgatagatgtctcaggcgaccttagactggtgcaggagcgcttctatcgtcgggtcctattacagagactgtggccaagccataacagtcacggtggaatacgggggagatccattaagtctaatgtcatcgcccacgcagggagcagattcgccttcaagtctgatattaggaatttctatccttccatccatcgacggagggtttacaggctctttgcggataggttgcactgctccgccgacgtggctagagcatgtacagctctgactacttttaatcaccacttagccctggggcttgtttcatctccgattctagcagaccagatcctctgtcccattgacaacaggatcgcggaagcctgcaagagcatcggcgtggtgtatacccgctttgtcgacgacattacactgtccgctagatatgacttgcgtcggagtaatgtcgccagcattgttcggaagatcctgggagatcatggatttgagattcaccctgggaaagaagctttcggaaggctcgaagatctcgcaataacgggtataaggatgcgagatagtaaactggacgtaacccgcgagtacgccgaccgcctggatcaacagctgaaagatgctaagtcattggccgacggcgcccatttcgatggcccatttcaaaccttcaaccaactcagggggaaggtgcagttcgtggggtgggtaaaccccggacggaaggcttacctcatgcggcgccttttctctatcggccgcgagaaataccggcgcgaggctatcaacaggggcctggtggccagcaaaaccggtctgatgagcctagatcccacaccggcagcccagttgagagtgtttacaccaggctga

SEQ ID NO: 11172 - RNA, 1032 nt, unidentified
  source 1..1032: mol_type = other RNA; note = synthetic construct
atgtctagtatcggcatggacgccaagctgttcagcctgcatcgcccacgccaggtggcagatagactggggctagacgaatcttggctgctccgcctgagcgaagagttgcgcaccgcagaaggccgtagcaactacatccgggaatttaccttgttcgatcctcgaccagggaaaaagccgagggatataataagtgtcaggggtgatctgaggctcgcacagagacgtctccaccagcgcttattgtcccattcaatcgagcctactccttactctcacggaggtgttcgcgggcggtcaattaagacaaatgccgggcaacacgcgagaaatcgatttgtctacctcaccgatattgccaacttctatccatccatccactcatcccgcattaacgatttttttaaatccaacggctgcctgcctgcagttgctagactcctgactagtcttacaaccctagactaccacctggctcttggtcttatcacatctcccatcctggccgaagccatcatccagcccgtggacagacggatcgccgttgcttgtgatcgacagggccttgtctacagcaggtatgtggacgacatatgtatcagttccaagcactcgctgcatggcagcggcattgacgccacagtgagaactattctgagacagtccggattcaaggtgcgggtgtcaaaagacagatttatacgggtagacgagggatgcgcggtaacgggcgtgagaatccaccggggacgcctgtctgtcacgccaagctatattggagagctggagactgatctgagctccgctttgtcttttgcccggggagggcatcataccggcctcttcttcaccaaggagcaactctggggccgagtgcagtttgtccgatggatcaatccgggtagggctaaacccttgattaggttattcaggcaaattccctggcgtcggtacagggttgcggcaagccagtcagggttaattgccgctaaagctttcttcgccgagaggaagagttatgtgctttga

SEQ ID NO: 11173 - RNA, 999 nt, unidentified
  source 1..999: mol_type = other RNA; note = synthetic construct
atgcagaaccccgcgacccgtagcaagtacattaacgaatttaccatagtggacccacgggaggacagaaagccacgcgacgtcatttctatcaggggcgacttcaggacagtgcaacgaagaatttatcagcgtatcctctcccaggtgatcaaacccgggcccagctcacacggcggaatcagaggtaagtcaatcaagtctaacgccgaggcccacctgggtaatgtctacgcctaccaaactgatatcgctaactttttcccttccatacatagagacagggtaagatccgttctgcaaaactacgtcgggagccgagacgtggctgagctgttagctcagttagtcactctggacgaccaccttgcgctgggcctggttacgagtccaattctggcagaggccgtaatccagcccgtggacacccgtatttccggtgcatgccggaaaatgggcctgacatatagcagattcgtcgatgatatctgcattagcggaagttttccgatcgacaagagttgtattcctcggatggtgcgcggaatactccagaacaatgggttcaaaatccgcccagaaaaggatcgcttcgttagcctttctacagatcttttttcattgaccgggatagaaatccgcaaaaatagactgcgggtcccgcagcgctatatcaatgatctggtgcatgatctggagtccgcaaatgcaattgccatgggctgtgaacaccctgttaccttgtattacactagggaacaaatagtgggtcggatccagtttgtcaggtgggtgaataaaggccagtcttccattctcgtgaagaagttcaagaagatcaactggcgactacatagcaaacaggccctccttaggggcttgattgtactcaaaccccggagtgttgataggtcctcaggagctgtgtcggatggaacggtggtgggggagtctacacctctacagtctaaaaaacgaagtattaagtcagtagactga

SEQ ID NO: 11174 - RNA, 987 nt, unidentified
  source 1..987: mol_type = other RNA; note = synthetic construct
atggagtcatcaaatctgcaggccatgaactgcaagacacttaggatacggaccataccgcacctcgccaatcagctgggaatacatgaaaacgggctgatcgacgtagcagaaaatacggaacgctattacagagattttaaacggaatgtgaagggaaaagaccgagatttggtcatgtctatcaaccctttagccatgctccagagacgcattctggatcgaattctgcatcgtctgccaattagtgattacgcgtacggcgctattaagggccgcagtatactagacaacgctaaaaagcattctaacagccttttcatcgctaagttcgacgttaagtccttctatccaagtgtcaggtaccaaaagatctatgactttttcatgggccaggaatgcgcccctgatgtttccagaattttgaccctgctcaccacacggaagtattcgcttcccctgggcacctcaacatcacccatgctcgctgaccaagtgatccagcctttagacaaacgcatttgtgggatggccgcaaaggcggggctgaaatatacgcggtacgtggatgacattactatctccggaagctaccctgtggagcagtttacagacctagtgatcgagattatcaggcagaatggctttaaggttaaacaatccaaaatcgatgtctacgcaccaggtgacggcaaagagaggatcatctgtggcgtcagagtgcagaatggtaaggtatccgcctctactgattacatcaagactctcagaggggaactcttgaaggcaatacagcagagccagcacagggacatctctggagattttgatactcggaaccagtaccgggggcgaattggtttcgtgatgtggttagacaggcccgagggattgaaacttctgagcctgtatcgtaaggtgaaatggcgccacctcgagtggattctgtatgagagaaacaaaagcccccaaaagaccagcctgtga

SEQ ID NO: 11175 - RNA, 969 nt, unidentified
  source 1..969: mol_type = other RNA; note = synthetic construct
atggagccagattccccctcttctgacggcctgcgcatccagagaattgagcacctggcatctcagctgggtttccccgttgacagactcgtggattgcgcagaacacgcaggtgacttctatcatgactttaagaggaacgtgaagggcaaagatcgtgacctgaccatggcgaggcccccacttagcgtcttgcagcgaagaattctcgacaggatcctctgcaggctcccagtatccgagcacgctttcggcgccattaaagggcgtagtattcgggataatgccgtggcacatgcacgggcccctttcgtagctaaactggatatacgtgatttctacccatcaatcagataccagaagatttacgatttctttatggcgcagggatgttcaccggacgttgcccgaacactgactctattaacgacgaggaactattctttacctctgggcaccagcacctcaccgttcttggctgatcaggtggtccatcccatagatactcgcattggagggctggctaaggccaaagggctgaggtatactcgctacgtggatgacgttacactgagtggaccttttgaccttgaacagctggccaagcaaatcgtaacaatcatcagacaagcaggctttgcgattaagaggactaaaatggaattttaccgccctgacgacggcaaggagcggatcatcaccggagtgagagtgcaagacggtaaagttagcgcccccagcaattatatcgaactccttaagcgcgacttggtcttggcccggaaggccagtctccacgaggtggtgcatcaggattttgacacccgggaccagttccgggggaagataggatacgtgatgtggctggatcctaaggctgggagaaagcttatacggctataccgaaaagtcaagtggtcgcactttgagtatgctacatccaggcgcaaatccatggccaaagtctga

SEQ ID NO: 11176 - RNA, 960 nt, unidentified
  source 1..960: mol_type = other RNA; note = synthetic construct
atgatcaagcgcatagtggacaagttaagaatcgtcgaggtgaagcacctgagcatgcacctgggctcaactcccgtggaactggcgcacgtgtgtagcagcattagcagacacccgtcccagtactacagatggtggaacaagtgctttcccaacggcaagaccaggcctatggtggaagtgcgaggtcgtctgcgagaaatactggacagactcaacgatctgcttcagcatgtctgcctcccagaatacgttaacggcggggtaccgggacggtctgttctctcgaacgcaatgccacatctgaataagcctatgttgatgaaaaccgacctcgccaatcattttccccgggtgtctccaggtagggtctacgctatgttccgcaaacagcaagaatgttctcccgaggtggcccggatattgacccggctgacgacacaaagcggggggttgcctcagggcagtccaacttcagttgcagtttccaatctggtcactcttggacttagtagaaggctaaggaggtttgcagaggcccgcggagcagttctaacacagtatgtagacgattatatcttcagtggcggcaaaaggttggctggatgcaaggaaaaaatcatctcaattgtgaagcaagaggggttcaaagcgaatgaggcaaagactgtgtccgtccctgccgacaaggagcagatcgtgacgggaattcgggtaaacggttcccagatggatgccccttcttccaaggtagctgatgtgcgcaaagccatacgtcgcctgcgatgtgagctggaggtgacaggcagtgtccccacaaagcgcattaaaagcatcgaggggaaaatctcatacattgccgcttataatcggggtaccggcaaatatttacgtagacagctcgatcacatcaagaccccaggggtcaggattgccggcagagaggaaattgctggatga

SEQ ID NO: 11177 - RNA, 945 nt, unidentified
  source 1..945: mol_type = other RNA; note = synthetic construct
atgaagcgaaggatctataacctgcgaatcagggacgtgcagcatcttgcaaagctgctgagtacaactcctcaggagttgcacgccctatgcgacaccgtggcgtcacatcccaagaggtactatgtgcagtggagcaaacctactaagaagggcaaaatccggccaatggtgaagattcacggcaggctgcgtgcaatactcgatcagctgaaatctctgctgcacaccatcgctttaccttcccacgtgcacggcggagtacccaaacgctccacatataccaatgccataccccacctggggaaaccgatgttgctccgaattgacctccagaaccatttcccatcagtctcccaccacaaagtgtacgcaatgttccgcaacgaacaaggctgtacccctgatgtcgccaggttgttaactagactcaccacgcttaatggaggattaccacaggggtcccccacatcaacaataatcagcaatctcgtcacccttcatctgagcaaaaggctgagaggatttgcccagtctagaggcgccggttgtactcagtacgtcgatgactataccttttctggggagagaagactcgccaagcatagtgggcggattgtatcaatcgttgctcaagagggattcaaagcgaacccaaccaagacaattgcagtgccagctgattgcgagcaagttactactggtatccgcgtgaacggcaagcaagctgatgttccgacttctaatctaaaggacattcggagcgatctgaatagtctggacaagcagatagctcttggctcgaagagctctgaaaagattatcaaacgcatcgaagggaaaattcggtacgtgagacgctggaaccctggtgccgcaaaaagtctgacccgtaagttgacgcggatcacactcaagcccgccacgtccgctagcacagtctga

SEQ ID NO: 11178 - RNA, 966 nt, unidentified
  source 1..966: mol_type = other RNA; note = synthetic construct
atggctttccatcagggcaccacaatggtctgcaataatctcgataactaccaagaaaatggattaagccctattaacttcatgatatccacaaaagccgccctttacaatactttgaagttcaccgaaaagcacatttggtacatcattaagaacatagcaaagcactacaaggaaaaagaggttgacaaaactaagtatgggaaaccacaactggataagaatgggagtatccgtaaacgaaacctgaggatccccacttatcctttggacagaatccagaagactatacatgagtttatcaccgctcagtcagcctttcccgactacatgtatggatccatccggggtcgcaatcacatccaaaacgcgtttagacattgcaacaatgtctatttcctgaaggtggacctaaagaactttttcccgaacatttctcatagacaggtctatgggagtctagtaaaattcggcctcccccatgatatagcacggatcgtgaccccactcactacagtggagggaaaactgcctcagggcgcccctacctcctgtattattgctaacctggtgctgcagaacgttgcccggcgactgcacgactttgcgaggaccaataacctgacatttacgtgttaccttgacgatttaaccttctcatcgaaggaagatttcagggccctgaacgagaagatccttaatatcattaaggaggaaggctttttcccgagcccaaagaaaatttcttaccgcaaaattagctgcgagattacgggcatcatcgtgaaaaacaacactcttgatctgatacacgagatgaaaagggaggccttgacaaatctccacatctatcactactacatgtctttcctcaagcagagagacagcttgtttaatctgagctatcccaacacattttccaatgctttcctcggtgcaccacgcaatatcacctcaccccagtga

SEQ ID NO: 11179 - RNA, 921 nt, unidentified
  source 1..921: mol_type = other RNA; note = synthetic construct
atgattaagagtgtgcataatttgtatagcttcttaggcctgacccctggggagctcgatagtataactagccgcatcactgaaaactattatcagcgctctcgcccaaaaattaaatatggagaattccagcgggacgattcagggaatatcaaatatagggacctccttataccatcctatcttctgaagtcacgacagcagaggattgcaagactgctctccggtatcacactcccagtgtacatgttcggcagcatcaaagaaaggtcaaacatccagaacgccaggcagcacctgaaccatcaatactttttcaccctggacttgaagaagttcttccctaacatcaatcaccgacaggtgaatatgatgctgtgtgaaaatggcttctcgttttccgtgagtagaatcctcacccagctgacgacctaccaggcgtctttgccgcaaggcgcccctagctccccagtcatagccaatcttgtgtttatgcctactggaaatagactaaacgagctggccaaaatgaacaacataatctttaccacgttccttgacgatctcacattttctagcgatcattgtttcaagaagcggatccccgaaatcattaagattgttaaacaagggggattttacccggcttacgacaaaatgcactaccggaaaggttacagcgaggttacaggcttgtttgtcaagggtgatcggctcgagctgccctactctatgaataaaaaaacccgtgagaaccaccacattaagtcctacaaggagcaggtaagaaagtataactcagtgcgtccctgcttaattaagcactgcaagaaagacctaagactgtttgaggctaataagaagggacatcgcctggtcacattagcacccctgcaaaacctgcccactggcgggctgtga

SEQ ID NO: 11180 - RNA, 912 nt, unidentified
  source 1..912: mol_type = other RNA; note = synthetic construct
atgcctcagaaggagatgataaacacactaacccatctcgcctttgagctcaaattcaaactccccgagatcgagagcataatcaacaacatcgacaagttctactatgaaaaagtggagatcaaaccggataagtttggaaatccgaagttgaaaaatggcgtgatacagaagagggtgctcaaccccagtattacaaggctgaagctgcttcaaaagaacattcagcgtaacatcttattgaagctggaaatgcctgattatgcattcggcgctgtcaaagggaaggacaatgtccagaatgcaaaacaacaccagggcaaaaagtacatctttactaccgacctgaaatcctttttcccaagcattaaccataaacgggtatttgagatgttcagatccttcaacttttcacccactgtggctagagtcctgacccaactgacaacgttcaaaggacggctacctcagggggcaccaacgagtcctaccgttgccaatcttgtcttcgtcaagaccggtaagaaactgctcgagttcgcgaaggaaaataagctcacttttactagctttgtggatgacttgaccttctccgcaccaaccgattttaagtctaaggctcagttcattattgaaactcttcaggctgacggatttaaaattagccacaacaagacgaactacaagacaaaaatgcccgtggtgaccggtgttgtagttaagaataacaagctgtctctgaccgacaatttcaagatcaagttgaacaatactgaggattcaactcccgaacgcatcaaaggcttacagcaatatgccgccaaagtggccaaaacaaattcgtctccactgcttacagccattcgacagcctctgacaggcgggctggcgttactgggacagacctggtga

SEQ ID NO: 11181 - RNA, 936 nt, unidentified
  source 1..936: mol_type = other RNA; note = synthetic construct
atgaatagctcacagttcaagaagaatgaattcaagaaactgtgcgcgaccatcggttttaagcccgcacaggtagaggaactcattagtaagctggatacctattacaaagagtgggtcgaacaaaaaacggataagaaaaccggagactttaaacggtataaggatgggacaatcaagcaacggactattagaccttcccttaaggagttgaaggttatccagacaaacatcaagacgcgcatcctggcacccatagctctgccaaactcagtgcatgggggggtgaaaaagaggagcaatatatccaacgctaaacctcatcagggcaataaatatcagtttaccactgacttgcaggagttttaccccaacatcgacttcaagagagtgtacaatacattcatcggtctgaagttttctccacattatgctcactggctcactaagctgaccacttggaagtacgagcttccacagggcactcctacctctacacacattgccaatctggtgttccttgagacagatattaaactcatagacctatgcaacaagaacggcattacctacacgaggtatgttgacgacttaactttcagttcccagcaggattttaggcacttgttaaacgacatcctccaaattgtgacttcggggggcttcaagctcagctacagaaaaaccaaatactctgataatcagaccatcacaggaattaacgtcttcctgaataaaatagacgctccggaaaaaatcatcgaaaaggccaatgccgagaaaaacacaaagtttaacactaagcctttcacaaactatctgaacaacatccgcaaaaccaatcgtgccaaacggaaaccagccaccaataagtccattgcggcaattggagccggccgaaagcccaatcaccagcaatgtataagcaaactgtga

SEQ ID NO: 11182 - RNA, 903 nt, unidentified
  source 1..903: mol_type = other RNA; note = synthetic construct
atgaacagctcacagttcaagatcaatgagtttaagaagatctgctccatagtgtgtttcaaaccaaatgaggtcgaaaatatcgctaagaacttagacaagtactacaaggagtggattgagaagaagctggacaaaaagaccgggctccccaaaaagtatctggacgggacggagaagcaacggaccatcaggcccagccagaaggaactaaagctgatacagtcacgtattaagaacaagattttggtcccaatcaaacttcccgccgaaatccatggaggcgtgaaagggtgttctaacatcaccaacgctaaaccgcaccagggcaacaaatacgtgttcactacagatttgcaggagttttatccaaacattacaagtcaaagagtgtatgatacattctgcaaactcaagttttccccacattttagccattggctgactaatctgacgacctggaaatacgaactccctcagggaacccctacttccactcacattgcaaaccttgttttcctggacacagacattaagttaatagaactctgcaacgccaataatatcacttacacacggtatgtggatgatctgacattcagtagccaacaggattttaaacacttgctgaaccctatactcgacattgtcacctctggaaatttcaagctgtcttataggaaaactcagtacaaaggcaaacagacaataaccggcgtggatgtatttcttaataaaatcgacgcccccgagaagattatccaaaagtcaaagatcgaggttgataccaaagcagaccttaagccctataccatctacttgaacaatattcgcaagacgaattccctccgaaaatcgctaccgcctactctgggtctggcgaaagtaggtagaaccgaatga

SEQ ID NO: 11183 - RNA, 951 nt, unidentified
  source 1..951: mol_type = other RNA; note = synthetic construct
atgattaagagcttgagacatcttgaagctgtgatcgggtataaactgaaagacatcgacgctgtgctcgacaacctgcataagtattacaatagcttttcgcgcacaaaaaagtcaggcaaaaagcgtgacatcgattcttccgagaatattctgcgtgatttacacaatagaatcaatgaccgcattttcagccagatctctctcccgtaccatgtgaccggttccgtgaagtaccgatcagcggtcctgaacgccaaataccacagtgggaaaaagtatcactttcagactgacctcgttggctattttcagttcgtgtctaataggttggtgtactctacactggtatcattcgggttctccgccgatgtggcctcctacattaccaaaataactacctataagggacacgtaccccaaggtgtgcctactagtccatttctctgcaacgtggtcggactacgcattcttgacggtgagatcctggagttttgcaagtcccgctctataatttacacccggtacatcgatgacctgactttcagcagcgatgtcgacatcaaagatttcatccctgacatactccagatcatcaacaacaagaactttctgtattcccatagaaagacaatctataaagcaggagatattgtggttacgggcgtattaaccacatgtaacggcctgaaaatgccagagcggttgattgaaaagatgagtaacgaggttgatataatcaaaaggaagggctacgagaatttcgcaaatcagattcaacggatacacaagcttgggacgctgaacgctatcgtcgataggcagagagaattagttttccccggacggcttaaagaccgaaagaaaaagaatgcaagcagtgccgtgctagatctcgtctcactggaaaataagaagttggaaattgagagggagattaacctgtactga

SEQ ID NO: 11184 - RNA, 909 nt, unidentified
  source 1..909: mol_type = other RNA; note = synthetic construct
atgatcaagtctaaaaaaattttctccctcgtcctaggctacgaactgaaaacgatcgacaacataatcgagtgtttagaggacgaacagaagagaggaaagtattataacccctacaaggtgaagaaaagtggcgggaagttcagagtcattgcccctagcaggggtgaactgaaaaaaattcaagcgcgaatacacgaaaatatcttctcgcatattcagctacctttctatgttactggaagtctcaaacggagatccggggttatcaatggtaagattcactctggaaagaaataccactttcaaaccgaccttgtgaatttctttggctttgtatcatatcggaatgtgcttaaggcactgaagatgctgggcttttcacatgacgtggcattctacatcaccaagctgacaacctatgacggccaccttccacagggggtgtgcacatcaccctttctcgccaacttggtggggctgaacatcgatgatgctatgctggatttctgcaaatcccgcaacatcacctactcaaggtacgtcgatgacctcactttcagcagccagagcgactttaaagatgagctgaagatcttcttatctgggataattgctcagggattcatctacagttaccgcaagacaaagtataaaattggcagcattgacgttaccgggactaaggtaacaaatgaaggaataaagggcactgacaaacagtacggtcgtgcccttctgatcgatactaaatccagctccttcaagggcctggtcggacatctcgagtatgtggaggagatcaacgataaatttaatctgacaacgtaccgaaacgagaatatttttttgcggtttccaaccaggttgtttccctatatgaacttcaagaagaaagagtctaagtga

SEQ ID NO: 11185 - RNA, 939 nt, unidentified
  source 1..939: mol_type = other RNA; note = synthetic construct
atgggcggatttgactatgcaagctctctgcggctggatggactagcagctgcgcttggggttactgtctctttcttagaaaaactccagatttaccctggtgcgtactacgacgactttgcaaaaaaaaaggatggcggactgaggaagattgtgaaagttgactggcccgtacggcgactgcaagagcgtctgcaccacaacgtattcggcaaaattaaactgccagatttcgtggagtgccagtcaggccgcagctctatcgatcacgctctcagacataaaaaccagacgcagatcatcaccttcgacattgagagctacttcccatccataacttacaggagagttcgccagacattggccttttttgggttcaatcagctcgtgtcagccgtgattgccagaatcaccatccgagatggaagcctcccccaggggacacctacaagtacggacatcgctaatttcgtcggcacatttcttgatcgccggttgcttggtctgtgtgagaagcataactgggtctacagtcgctatgtggacgatgtagctatatctggattcaagaatatgggctgggccaagaagctaatcaacaagataattatctcggaaggcttccgtatctccaccaaacaaggagggttaagtgtgaccatggtgaaggacgtgcctcttgtcactggtgtgaggataaacaaaacctttatccaagccccaaaggagtattatcggagcgtcaggcagaaaatttacctgtggcagaagttcggctatgaatccgcctatcccggcttttcaaagaagcaatccatttccaagctgcacgggaaagtgcattacctgatgtatctcgacaaggtttcaaagagatttaatggtcaagggtaccagttgtttaaacagttccagaagctgcacaaggatccggcctga

SEQ ID NO: 11186 - RNA, 918 nt, unidentified
  source 1..918: mol_type = other RNA; note = synthetic construct
atgtcactgccctcttctcttactaaatggaccccaagtctcgtgacccctcctgatccattatgtccaattgtgggcatcaaatcccccaagtctctggcacgcattctggggtaccccctaagccagctggaggagctttgcggaaatattgagagcaattaccacaagaaggaaatcacaaagaaaaatggtgccgtgcgtgtattgagcgtgccgagcggagcactccgtaaggtccagactgccattctgcggcagcttcaaaaacacccactccatcccgcagcctatggtgccgttcagcgaaggtgccatatagataacgctaaacggcacgctgccgcgccctatgtgtattgcctcgatttttcatcctttttcccatctatcagcagtaaccgaatctataagctgctcgccgaacaattaggatgcagcccccctgtgtcaaacattttgaccaagttgacaacgtacaaatataagctccctaccggcagcccaacctcccctgtactgactaatatcctgtgttttccgctggataatcgcctgaacagtctggcttgtgattatgggctgacgtacacacggtttatcgacgaccttaccttttctggcagaaggatccctgaaggattcatcagaaagacaaaggagattattacttcgttcgggctcctactgaatgacgaaaaagaggagttattcacaccctacaaaggtaagctggttacaggcatcaacgtgaacaccaacaaagtcagggttagtagatactacaagaaatccgtccgcgctcagaagcatcagttcgggcttttcaaggactatatgactgactcagaaaagtccaaagaggagtccagaatagacggcaaagaacaatacataaggttggtccagcggcgctga

SEQ ID NO: 11187 - RNA, 909 nt, unidentified
  source 1..909: mol_type = other RNA; note = synthetic construct
atgtcccatttgcacttccccattaacaccgtgagtgagctatcaaccttgctttctatgcctattcgagatctgtggaggctggcaaagaatacagataaaagctatttcacctggaaggaaccaaaaagcagcgggggctttcgctccctttgcacgccagattctagactgaaggaggttcagaaaaagctgcataagctggttttctccaagataattcactcccggttttcacattacggcttaaagaagaaatcgaatgttaccaatgcttctgaacattacgggaatgatgtgatctttgccttcgatctgaaaagcttctttccgtcaatcaggcctgaacgagtccggaaggcactcattgacgaggtcggttgtcctgcccctctcgcctctctgatcactaagctagtgactttgaactatcagctgccccagggtgctccaacgtctaccgacatagcgaatattgtgacatttcggctgcagagaagattgtatagtcttgctaagcagtggggaatcaagaaattcactatctacgccgacgatatcaccttcagcggaaacaacattccccacggttttatgaagcttgccaagaaagtggtacgtgaggaagggtacaagatccacccagaaaaagggggcgtgttcgacaaaagtggcaatcagataattaccggaataaacatcacacacggcctcacagtgggaaagatgaacaagatctggcgcgctgagaggcaccaaaactttctccaatacctcaaaggccagctgcccactacagagttcgacagctccgagaaaaggtttaatagccgcattgtctattcaaacttcatcaagaaatccgggctgaaagtagcagacaattatttaagttcggcctacaaatga

SEQ ID NO: 11188 - RNA, 1401 nt, unidentified
  source 1..1401: mol_type = other RNA; note = synthetic construct
atggaaaagtggtgtattttacctaacaacctcatacagaagctgaataaagacgatgtgatcgtggcaagcctgactcgtttctgcaagtgtagcactgatgaattgttcgcagtccttaaaaatcggtctaaggaaaacaggtggtggtggtatgggtacacccagtataccaaaaataacggcaaaaagatccgcactattagcgtgccgcgcaagaacctgaaaaaaattcaggaagccattaaagatcgactcgaccagatacccgtttctctggcttccactgcttggaagattggtgattctgccgagaaaaacattgaactgcacaaacacaatctgtatcttctttccatggacatcaaaaatgcctacccgtcaatcaccacccatcgggtgtacaagaacctgcagtgggccttgccactcaaataccggtgccctcagctgattacagatgaggacaaggacatttttattaggacgattacgcatctttgtgtgcacgacaatcagctgccacaatgggctagcacatcgggccagatccagaatatagtgtttagtagtttggatatccagatcgagaaaaaaatacctgaactggtatggagtcatatggtctactcgagatatgctgatgatatggcgataagtttcccacattttagcaccctggagatcctgaaggagaaaatggaaaagtacatacaaaccctgaagaaacaccgagagagaagaagcatcctactggatgagttcagcaaggacacattcatcgttacagataactttgagcagaagtatctgcaaaagaagatcgaggacattaaagagctcatgaaatggtcttggctccccgatgaggaaatttataagcacattggcactcttgacgcctacaagaaaaacatcaagtattcaacctggagaatctccgacatacatgacgagatcttgaaagtcatttggtgggaatggcgcaagatcaataatataaagactaacatgcggaccccccaatccgatcgagaacgcgagatcaatggaatcacactagacgaggaaggtaacaagtggttaaacaaaagaaagagggcccagtatttgaaaatcttcaatcacctcatcaagcactcacaaaacgacctaaaggggttcaccttttaccgtgagaagtttaatacactcgagaactttgacatctgctcttccactatcacgcagataatcgatggaatttatcaccgcattgcaaggatttacggaacagggcggatcccaaagcctctgcatgaagcgtaccagaaggcaaagcataaaaggtcctctcacgagatttacctcacctacctgcccaacaattcagacacaaacaatgaagagttacttttctga

SEQ ID NO: 11189 - RNA, 966 nt, unidentified
  source 1..966: mol_type = other RNA; note = synthetic construct
atgcgcaacaatgaaattaggactctgaagcgtttgtgttccctgctccacctgaaggaggaatacatacttgatctggccagcagagcaaactcttgctactactcatacgacaaaaagagtagaaagaaagacgggacagcaaagattcggcatatagattcccccaacattgagctcaagaacatacaaaagaagattgacagcgcgatcatcaagccttatgtgaacctgcttcctgattacatacacggagcccgaactggaaagagcattgtgaccaatgctaccaatcatgctgggtatgaggccattctgtcattagacatcgaaaactgtttccccagtattacatccaagcgaatctactatatcttccgcaataccatccattgttcagataaagtcgcaagcgtgcttaccacattgacaactaaggacggtgtgctgccacagggttgccctacctctgcgtctctgtgtaatctggtactcgtgcagatgattgaaaaactctccgagattgacgggagtttggactacaatatttcgcactatattgacgatatcttctacagcggcagatattgcgatctgcaaaagattcggaagccggccatgacggaaatcggcaaaaatggctttcgcccaaacactaagaagacactgctagtaaaaaacggaaggcccatgaaagtgacgggcatcacagtcaataccaaagtttccgccggacgtcggcggatacgcaaaattcagaggaaaatcctcaaaatcaccgagaaagataaagccgagtatgacatcgtcctaaagaatagaaaaaggaacaacaactcgaaaatcaaagcttgcaagatcgaaaaactctttggcgagataagcaatgttatctctatcaacaaggagcaggggtataagttaaagaagaagatcgaggctaaattgaatgatcttatcacttga

SEQ ID NO: 11190 - RNA, 981 nt, unidentified
  source 1..981: mol_type = other RNA; note = synthetic construct
atgcgacaggaaccccctaccatccgtcgcccattggagcctcgtgttgtcacaatccagcagctggctgccctggtgaatctaccagtcaaccagttggatagattcgtgctggaagccccgaagctctattccagctttgaggttcctaaacctaatggcaagactagaacaattcgcccaccggcacgcccgcttagagacttacagaggatgctgcttgaggtcctccaggagtgtgtgagatatccaaggtggcttatgggtggtgtgcctaagcgcagtatttttgaccatgcaaaacctcatgtgggatggaaaatggtggccacctttgatgttaaggctttcttcccctcaacacggtcggcgatgattcggcccgtgctcgagagaattgggatcagcgatgccgcggctgatgccgtgctacgactggtaattaaggatgacgaactcccccaggggtccccaactagtggcttcctcgctaacctgacattagaacccgctgaccggagaatcgatgctctgtgcaggcggcacggactgaactttaccaggtatgttgatgacatggccatcagcggcaatactgacctgaccaaatttcaaggtgcgatagtcgaagccgtcaaggagtctggctacgaggtggctcccgagaagatacactacatggatcggtctaagacacaattaattacgaaactccgtgtgaatgacaagataaggccaacccgggagttcatcgccgaggtgaaagccgatatctgggaatgcctgaacgtcggggcagcagtcgttgcaattgaacgcggcgtgcagctccaccgactgaagtcctctcttacgggaaaagtgtcacatatccgatccgccgacagggaagccggcgagaaactgaaaggaatgttgtacggggtagactggaaccagcaactgcacactaagttcgacgtacccagcttgaccgcatga

SEQ ID NO: 11191 - RNA, 954 nt, unidentified
  source 1..954: mol_type = other RNA; note = synthetic construct
atgagggctgaacccccagtcgttaggtataatcggagcctacagatctctactctcgatcaggtggccggatgggtgggagtagagctttcaccgttgtctgatactatcaaccgcgcctctaccatgtactcctgtttcgagataaaaaaaccaaacgggggcagcagaacaattcgaccacctaacaaggtgctgaggaccctgcaacacaatattctgcgcgagctgcagagcatggtcaggtaccctcggtggatgatggggggtatcccgcgccgtagtatctttctgcacgcaggcccccacgtcgctaaacggatggtggcaacgtttgacgtcaagtcattctatcccagcacaaattcctgtctggtcaggtctgtgttagagagactaggcttttccggcgaagctctcgatgcaatggtgcaaattctgatcaaggacgacgagctaccacagggagggccagccagtggcttgattgccaaccttgctctcgagcctgctgaccgtcgcattgacgccatttgccgaaagcatgacttgcggttcacccgctacgtggatgacatcgccatatcaggggaacacgatctcagagtgtaccagggtgcgattattgatgccataggtctgtgtggatatgaggttgcccctgacaaaatcaagtttatgggtaaggaacagtgccaggtgatcacaaaactcgtagtgaatgaacagcttagaccctcgaaatccttcatcttcgaggttaaggccaaaatcagggaatgcctggcgaatggagcatttgttgttgctgtagagcatggcatctccgtgcctcagcttaagagcaaactgaacgggaaggtcagccatataaagcaagcagaccaacggctggggaagagtctccagagaaaattaaatggcgtgaactggtcacgacagctgcccgattga

SEQ ID NO: 11192 - RNA, 957 nt, unidentified
  source 1..957: mol_type = other RNA; note = synthetic construct
atgaatatgctctctcaacacaccatgcagcagaacgactggcctccccctatttccaccagagagaggctggcccgcacgctgaacgtcagtcctgtggtgatcggggaatttgttgcagaacccgcgcggtggtattcccagtttaccgtgcccaaaccctcagggggcaatcgtattatccagccaccgaagaagccactgaggcgagtacaacgggctctgttgcgccttctttacagcagactgcaggtgcctccatacctacacgggggcgtgccgaagaggagcatcttgacccatgctcgcagccaccttgggcgcaaaatggtcgccacactcgacgttaaaaacttcttcccctctacacagcagaagttcgtgcagccaatttttgaaatggccggaatagtggatgaagcgctgactgacgctctcgccattacaatgttagcagagggactgccccaaggcgctccgacttcatcattgctggccaacttagctttcgtccctgtggataaggccgtgatcgccctgtgtcgaagcagaaatctgtcctttagcaggtacgtcgatgatatcgccctcagtggaaatgtggatttcagagagttaaaaggcccactgatagaccggatccacgctgctgagtatgagattgccgaacataaggttcggtttatgcctgcctccgagcggcaggtcgttactggccttgtggtgaaccaaaagctgaggccaacagcagagttcgtagcaacgctcaaaagtgacatcagagtatgcctcggccacggtgtcgactttctcgcggactctgagggtatttccactcgtggaatgcgtatgcgcctatcgggtcgagctgcccatatagccgcagcagatcccaagctgggcaagcggatcagaggaatgttgtgcggggttaaatggaccaccgcatctaggtga

SEQ ID NO: 11193 - RNA, 960 nt, unidentified
  source 1..960: mol_type = other RNA; note = synthetic construct
atgcctattcaattgcacgcaacccgtaaggctgcaaatctggtatccaatcttgacgggctcggcaagttactcggctttccggtcgtgcggttaaacgcggtcatcgaatgcccatctcgacattattccagtttcgacgtccccaagaaaaacggtggcgtgcggacaattgagccgccccacagacctttgcgcgagattcagagatccctgcttaacaggctgtatcgccggatcaaaattccaaagcacatacatggaggagttcccaggcgctctatttttacattcgcaagacctcatgtggggaaaagcatggttgctacgttggatatcaaggatttcttcccaagcgtgggccccagccacttagagccagtgtttttccagctcggttttaggggtgaggcgctgaatgccgtagtgtcgttgactatgctgcgagattgtcttcctcagggcgcccccaccagttgtctactggctaatctgtcattctcaaacgccgacgccagttttaacgctgtctgtcggaaacgcaacctcctgtacggaagattcgttgacgacatcgccatatctggcaatgtggacttcggtgagctgcgcggaacgtttctcggcatcatcgaagccaaggattttcaggccgcagaagataaaattcacttctacgcacaaagccagagacagatagtaaccgggctcgtgctgaacgagaagctgaggcctactcgagaatacgtggccagcctgaaacaaaggatccataattgcagaaccttcggaccaacatttatcgctaattccgatggactgactgtcaggaagctcaaaaatagccttacatcttccgctcgttttgttggccagtctgaccccaagctggggaagaaattgcgggggcttctatgcagtgtggcgtggggggcctcaaccaaccggttctcagactga

SEQ ID NO: 11194 - RNA, 1047 nt, unidentified
  source 1..1047: mol_type = other RNA; note = synthetic construct
atgtcctaccggcatctgcttaagccaggagccaggcgggctgaggctttggtagatgtggacgggctggctcgagcgtgcggacaagatgccactcgcttgcgaaggttgcgcgaaaatctcccgtctgcatacggtcgcattgagaggcctaaacccaagggggggtttcgcatcataaggcctccacgtcaagatctcaaagaggtccaaagaggcctactcgattggctggagacacgcttcaccgccaagccctggatgcacggaggagtagcccagcgcagcataattagtcatgctcaacctcactgtgggaaggccatggtggccgtccttgatgtgagagatttttttgggagcgttcggcgtgagaggcttgctgccctcctcactgcagcaggactggaaggggaagccctggagacactgctggacctcgttacactggatgacaccctcccacagggagctccaacaagttgcctactcgccaacttggctttctttcccgcagaccagcggttcagacgggtgtcagcgaaaaggggtcttgtttacaccagatatctggatgaccttgcactgagcggcgacgaggactttaaagaactgagaggcccactggtggaagctctcacgctggaaggattccaggtggcagcggagaaggtcgccttcatgggtagacatgagccacaggtggtcactggtctggtggtcaatgaccggttacgtcctaccagggccttcagagaagcgctgattgctgaaatcaacgactgtcagatcgagggcttgggcgctcggtccgacagacttggcacaaacccccagaggttgcgggccagactactgggccagatccggcacctggcacgatttgatcccgcacctgcccgccgtttagaacgacgcttaaggagtgcccctggcggccgagctactcagtcatcgagggccagacgacgcaccagcaaggcatcttcctctagctccgcctatctggcccaggagagttcagagccgccctcacggagggcatga

SEQ ID NO: 11195 - RNA, 984 nt, unidentified
  source 1..984: mol_type = other RNA; note = synthetic construct
atgcactacgagctgctcaggcgacggccagctcaggatgctctggctgatgtgagtgacttggcgagagctctcctgcttccgcgcaaggggctgtgtgagctggccgaaaacaccgagtcccattacatcgaaattcggattcctaagcggcatggagggttgcgccggattcacgcacctgacccaagcctgaagaaggctcaacgcgctgtgctacggttgcttgaggatcggatggtgcccaagtcatggatgcatggaggcgtcacaggtcgctctatagttacgcacgccgccccacattgcggcaggtgttgggtggcagttttggacctcgccgatttctttccatctgtcagacgcagcagggtccaggccatcctcgaagcagcaggctttactggcgacgccctgaaagtgctgctggcgcttacaacactcggtggagcattaccccagggggcccctacctcatctcacctcgccaatctcgccttatttccattagacaggagacttcgcagcttggcgaggcgatgggggcttacctattcgagatatctggatgacatcgcactgagtggcaaacgtcccctgcggcccctcaaaggaccactgcacgatgcagtgataagagagggattcaggccctcaccctccaaaaccgcctttatgggtcgtcacgaacctcaagttgttactgggctgctagtgaacgaccgcctgaggcctgtgaagtcctacagacgcgctcttgtggaggaggtcgaagcgtgcagacaggacggcccgaaagtccgagcagccctacagggcatctccgtagcccgctatcggagcaggattttggggcgaatcagacattgggctagattcgatgccgaaaaggccgagcggctggagcgtaggttcagacacctcccccgacctggtgctgcagctagggagactgacggacgtgaaaaagtaggcctgcggtga

SEQ ID NO: 11196 - RNA, 909 nt, unidentified
  source 1..909: mol_type = other RNA; note = synthetic construct
atgtggcgtgtgctgaatgacgactttgcccattggagtccaagacgcttagctgagctcctgggcagggacttagaccggctcgtgcagttgacggagggtacagctggccgataccgagcgatccggctgccaaagcgaggaggcggtcatcgggaactggctgtgccagagccggaactcaaagcgctccagcacgaccttatggtcctgctcgatcgcgctctggaggctcctccatgggtactgggcgggagaaggggtcggtctttcgttgaccatgccgcccgacatcaagggcggtcctggcttctgaccgtggacgtggctgacttcttcgggaggattggacccgccttggtggctcccgttctgagagagtttgggctgcctgaggcaagcataacacttatcgtcgcgctcgcattccgtcacggagccttaccccaaggagccccgtcgtccccactcctagccaaccttgccatggcacctattgatctgcgcctaagacgtctcgcaaggcgcaggggccttgccttctccagatattttgatgatctggctttttcaggcgacagggattttggggagctgagagggcccattgcagcactactccggcaggccggactgccattggccgaacacaagactcgctacactgggcgtgacagacctcaggttgtcaccggcctggtcgtaaacgatagactgaggcccaccaggagctttcggggcgagttggaggaagagctgcgcttgttgcagggtggcgcactccccagacctcgcttagaagccagggtggaaggaagactgcaccacctggcccggttcgatcgacgggaagctgatcgccttaggcgccggtatggaagggcgctgcctagctcttcaagttcttga

SEQ ID NO: 11197 - RNA, 933 nt, unidentified
  source 1..933: mol_type = other RNA; note = synthetic construct
atgcttaaaatcgtgcccctaaaactgaatagcattgctgagattgagaatatcctggggttttccttcgataagattaagaagatcgttgagaacaagaacaacttttattccaaggtaagcatcgtgattaagggcaagatgaggatcctggacatccctaactcgtcactcaaaatcatccagggtaaactggcccactactttggggaaaacgttgtgtggccctattacgtacagggcggtgttaggaatcggagcgtgaaaactaatgcaagacaacattctggaaagaaatttgtcctgaacctggacatcaaagacttctttcctagcatcacaacaaaaatggtgaagaattccctgatggagttgggactcaatcagaaagtgagtactctcatatcagagctttctacctacgaaaacagagttccacaaggctctccctcctctacctacgtggccaatatgttcttcttgaagatcgataaactcatcaacaacttttgcaagaagcacagtttgatttatacacgcttcgtcgatgatctgactatatcagggaaaaacaacatcttcccgtataagggaactattattcagtacattgcgagaaatcgccttatagtcagtgagaaaaagacgacaattcgatcttcaagtgaaaagcagattgtcaccaagctggtcgtgaatgataagattcgaccagacaagaagtacatcctgacgctcaagaaggacataagggaaacctggaaaggaaacgagggcatacgcaaagtcgccttaaagaacaatattaccatgcctaaagtgaagggtaatttatggggccgtaccaactatatccggcagttcgataaaaaaatagggcgggaagtgagggctctactggtaaaaagcaatttcgtggacgtgagctcctga

SEQ ID NO: 11198 - RNA, 972 nt, unidentified
  source 1..972: mol_type = other RNA; note = synthetic construct
atgaagctgctgaagttcctttttgatatcacgctgaacctcacaattcacccccacaaatcgctgaagccccaccaaatccagacagaacaggacgtcgcaagactggccaatcaggaagtcagcgcgctgcaggagataatatctaataaagaggagcactatggatttttcagacaagagaaaaaggatgggaccctacgggatatccatcccccacggaagaaacttaaactcatccaacgcaagattaagaagttcttcgaccatttcccatggcccagatacgtccagggggggatacggaaaaggtcaattttatccaatgctcgtctgcattgcggaaagaagatggtggcctggttagatatccgaaagtttttcccgagcaccaatcccagtatggtgctcgagagcctagaaaaaattggcattggtaaagcagcaagcaagctcattgttgaactgggcacttataaaaatgcgctgcctcagggttcccctgcatctgtgtccttggccaatttggttttcctggatgccgatgacaggtttgagcttttttgtaagaagcaccgactcatctacagtaggtacatcgacgatatctctatctccggcgatatcgatttccgtccacataagggccagttcctcaagtttattgaacaaaaggggtatgtagtagctaaggacaaaattgactttattggacgcgacaggcctcagatagtgaacaacctcgtggtgaacgacaaagttagaccgaacaaagactttattaacgacctgaagaacgatatccggtgttgctggactgaggaaggtatggagcttctggctgccgacttcggcctgttgccaagggagttgcagcgctcactttggggccgcataaatttcaccaaacagtttgatcctaagttatacaaagacctgaaggctatcatgatcggagcctttttcaaatga

SEQ ID NO: 11199 - RNA, 942 nt, unidentified
  source 1..942: mol_type = other RNA; note = synthetic construct
atgccggagaaaagaacggagggcattaaacagattactcaggaatgcgtggccacgctggaaagcatactaaagaacaaaagcgctctttactatgaattcaagatccccaagaaaagtggagaatcccgagtcattaccccctccaagcccccccttaagaatattcagcacaggatcaataagtatttcgccaggaaacagttcccagcctgtgtgcatggatacgttcggaatcggaacgtgctgactaatgctcagtcccatgtggggaagaagtgggttatcacaatcgatctgaaggacttctttccatcttgcgacaccattaaaatcagtcaggccttcctgaacatcttctcaaacgaccaaactattaatctgttgacagagcttgtcacctttaataatcagttgcctcagggtacaccaactagccctataatcagcaacctggtactccataacttagatcaagaatttgtgagactctctaagaagcacggttttacatatacccgctatgcggatgacctaacccttagtactaacggaaaaaacccccacgatttcctgaaagcctttacagacatcataacgtcaaacggcttcaagatcaatcctgacaaactcaaagttatgccctgctcagctcggcaaatcgtcaccgggtttgtggtcaataagtacgatgggaacggctttctgaaaccaaccaagaagtatatctccgacttcaagatcttgattcgcaactgttaccaactcaacatgtttcagcagattgcggcagatcagggcaaaactgtgccgaaactgaagagatcgatagagggcaagatactgtacattaaacacgcaaatcctgcattagctcgtgagattagcaacctcaggtaccctctgaagccatctgccacagagattaccgtaaatatctga

SEQ ID NO: 11200 - RNA, 1152 nt, unidentified
  source 1..1152: mol_type = other RNA; note = synthetic construct
atgacccaccaagatagcaaacttacgattgacgacattggaaataaactgggcgtgaccccacagttccttttagaggcggcatctgccgctagcacccagtatgagctgtttgacctcccaaaaaagtcaggcgggactaggacaatctgtagtcctaaaaatgagttgaaaaggctgcagcggacgatcctggaggagctcttgcacaccttcgccatgccagattacgtacacggttgcgtcaaaggacgatcaatagtcaccaacgctaagccgcacactaataagccgttagtgctcaccatcgacattaaggattttttcggatccatcaatcccgaacaaattaatagaatcttccgcattagcttcaactgcgacgataagtccgctgaagtgcttacagccctgaccacctatggcacatttctgcctcaaggagccccaaccagtcccgctttggccaacatcgcggccctccctctagatgctgccatcctggatatatgtgagcagtccggcctgcagttttcttatacccgttacgtcgacgatattactatttctggcgacaaccgcctggctcttatgctggcaagcttttacaagacagtttccgcacatgggttcaccgcaagtcccggtaagctacgtgtgggtcggccttcgaaccgccagaaagtgacaggcatcatcgttaacaagaagatggccccacccaagaagctgatacggaagattaggcaacagctgtattactgcgagaagttcgggattgaggaccactgtagaaaagaagggatcgaagaacaggaatttttgaatcagatcaacgggatgttaggcttcatcagattgacacagcctacgacagcggatctgttcaagattaaactcacaactctgcaggggtacacttttgtttctgttgacgaatcagtgctcctgatactcaaacatgcagtcgaagaggagaagcatgtcaatttcgtgtaccatggaagtactaggaaagtagcccccgtggaggtgtttatcgatgacgaaggcatgaaatttatgcgaggatatcagactgtgcccgagcagaagtgggaacggtacatgatacctgacatccaaagcctaagactttccgagaacgcctga

SEQ ID NO: 11201 - RNA, 1152 nt, unidentified
  source 1..1152: mol_type = other RNA; note = synthetic construct
atgacgcaccagaaaagtaagctaactattgacgatatcggcaagcgtctcggactcacccctcaatttctgtttgaggccgcaaagacggcagaaacccagtacgaactttttgacctccccaaaaagtctggtggggccaggacaatctgcacacctaagggagagctcaaacgagtgcagagagctattctggaggaactgcttcagcagtttgagatgcccgaattcgtccacgggtgtgtgaaaggacggagcatagttaccaacgccaaaccacatgtggacaaaccactggtactgaagatcgacataaaggacttcttcggttcaataaaacccgctcgggtgctggaaatttacaaggatatcttcgattgcgatgagaagtctgcggaagctctgaccgcgctcacaacctacggcaatttcctaccccaaggcgctcccacttcgccagccttggccaacctggtggctctgcccctggatcgaacacttctcgacatttgtgagcaaagcggcctccagtatgactacaccagatatgtcgatgacatcaccatctccggggattctagactgggacagctcctagccgcattttacaaggccatccagcatcacggctttattgcctcacctgggaagctgaaagttagtaggccatgcaatagacagaaggtgaccggaattatagtgaataagaaaatggcgccacctaaaaaactgattcgcaaaattaggcagcagctctattattgcgagaagttcggtttggaagatcactgtcaaaaggagggtatcgaagaggaagagttcttggataggattaacggaatgttaggctttattagactgactcaaccggtcacagcagacctgttcaagtccaaattgactcgtctgcagaaattcgaacttgttgatcaggacgagagcatcctgctgttgttaaagttggcagtggaagaggagaggcatgtcatcttcagctaccacgaggctactcggaaggtcgccccggtagaaatcttcatagatgacgacgggtttaagtttatgcgcggctaccagacaatgccagagcctaagtgggagcggtatcttatccctgacatccgctcccttcgcatctttgagaaattatga

SEQ ID NO: 11202 - RNA, 1215 nt, unidentified
  source 1..1215: mol_type = other RNA; note = synthetic construct
atgacctccaacctgagcctcaccctaaccgacctctgcgacgagctcgaactgccctctcagtttgtgctagacctcgctaactctgccgaagacgaaaaacgctatcacagttataagcggcttaagaagtccgggggcgctcgttacatcaatgcatcggtcgggtccctgaagagattgcagcgtagcattcacgaacgcattctctctaggcataaaatgcctgagcatttgcacggcggcataaaggggcgctctatcgtgacaaacgctgcagcccatgtaggaaagaaactggtaattaacatcgacctgacagacttcttctcaacgatcaaagtggccgttgttaaacaaatttacatgcgggatcttcacttcgatgacgagacagccactgttctggcccaggtcagtacgttcaaaggagccttgccaacaggggctcccaccagttcagcgctggctaatctggccggcttggtggtggatgacgcagtcatttcaacacttactaagaagattgaacgaacagagtttggatacagccgatacgtggatgatatcaccattagcggcgacgatagaattgtcgagatcttacctgatatctttgaggccgtgaagtccgccgggttcacctgcaacgataaaaagaccagaatcttaaggagatctacccgtcagtgggtaactggagtggtagtgaataggaagctgaatcctccgaaaaacatcgtcagaaaaatccggcagtatctgtactatatgcaccgctggggtgttgaggaacactgtgaaactcacggcataaatccctacaggtttatgagacagataacaggctacattgcctatgtccggctcactcaacctgagttagctgacgaattcctgcggtcccttaaaccgcacctggcacggtttcatcaggtggacgaagaaagcgctcccagcactcttaatatcctgaaggttatgatcgacaaggaggagatagcgcattttctgtatgatagggaggaccgagctgttaaccacccttcctatgagccagtggccgtgtcagtggcgccagagagcctcgacgtcgacgatgatggaactctgaccatgaggggtttcgaactcgcacccaagcaacgctggggtatttaccatttggagagtatctcggcactgtctgataaaccactaacggatgtgacctga

SEQ ID NO: 11203 - RNA, 1317 nt, unidentified
  source 1..1317: mol_type = other RNA; note = synthetic construct
atgcattccctggccttagaggctgtcatcgccgacctggggaaggagaattgtagagcagccctgaccttgctcgcggagatggttggtgtcgagcggcaggctatactggactgcttagaactactgaaccgacatggcgaggtggaggacggagagagggtggtggcttatacatcgttttacaggccaaagaagagcgggggaaaaagactgatcatagcccctgttgagccaattaaggacctgttgaggaaagtaaaagatgagattctctgtcgtagtagcctccctcgcttcgttcacggataccgaacgcggcgctcctggcttacaaatgcccgtgtgcacttcgatgcaggagcggtgtatgccataaacttagacatcaaggactgcttcccttctaccaaaattcagctggtccggcgcgtttactggcagacaaccggccgaatgctcagggatgagggcattccagaagaggtggcaagagccgcagtagagattctcaccgcgctatctaccctgaagtatgggcggtcaaaggtgcccgttttacctgtcggatcacccacttctccagcactcgtgaatctggtgctaactcctgcctgcatccgcattgctagggcactgaaaagactgcccggcgaatacgcattctccatctacggggacgatctgacagtctcaagccgcgaaccattgccgccagaggtcaaaatgatcgtactgcgagagtggcagagactggggtatcgggctaacccgggcaagacaagagtgatgagacgcgatggatccggtacgcccatagaagtcactggcctgatcctcggccgggatcgtattctgttgcctgacgactggctgcagaggactgaacttatgcttatcgcttacgccggctcccccaaatatcctggcgataaggctaaacgcgggctgcaaagtagggtttcaatggtgaggaagctctatggcgtcgagatgcccgggcgagtgggtaactgtttgaagagccttatcgcccaggcgaagtctaatcttgtcatgagggaacgcctcgcagaattgctccggggcaaaatgcctgaagtggtagaaggaagcgaagaagctccagaaccagccatggaacaggccgtggagcaggatcgggattggagaaccgaatacgggcccgtgccccaaagtatggacgccagaggtcaacttttttgggattttgacgatgacagccccggaggagctgatgacccgtttgtgcctgagcacggtcagctggagcaaggcgagtgggagggggagtga

SEQ ID NO: 11204 - RNA, 933 nt, unidentified
  source 1..933: mol_type = other RNA; note = synthetic construct
atgaacagtaaacaggccatgaagtgggccgatattagacccattctgcagagctccgagggcctgagcaggcacttgagcgtgtctgaagacacactgtttagacttagtagaactgccagccgattatatacacggcgcgagatagagaagggaaggatcctgaacctcccctcgggtgagcttaagcggatccagtctctaatccacaagaagattctgctgtttgccccctatcatgcctcaatccacggctatcgcaaaggccgctcacagaggtccgcagcagaacctcatcaagacaaaccaatgttgttgaagggggatatccaaaaatacttcccctctatttctccagacgctgttctcaaagcctttcgacagcttgggatcagttaccaagtttccaagttactcgtggatctgtgtacccatgagggccaactacctcagggggctccgaccagccctctcatctccaatctgatatggtcgcggccagcacgcaggattcggggattcgcggaccagcacggatttgaccacacgatattcggggacgatgtttttatttctggcgcttgccgggcaaaaaagttcaagaacctcttgaagagaatcattcgtgaggaaggtttatctgtgtccgaacgcaaaactcaggcgctcccatgcacaacccgtcaggtggtccttggtctggtcgtcaacaagaatctgggtgtagacaaggatgtgaggagagatattaggcaggtgattcataactacgtgagcaaagggttctcagacccgctcggaagtaatctgcgagcagccaagacctcactggctggacggatcgcccacatcaaacatataaatccttcccagggccaaaaactgcagcgtgaattcaagagaatcaattgggaggagggcgctagcgtatga

SEQ ID NO: 11205 - RNA, 906 nt, unidentified
  source 1..906: mol_type = other RNA; note = synthetic construct
atgaagtggggggaagtgcgcgcccacttgcaatctattgattcactggctcggtatctcggggttggcaaagacactctgttcaggctctgccgaacctcaagtaggtgttacgtccggggagaagagcccaaagattccggaggtgtgagggagttctataaaccacgcggcgaactcaaggagattcagcgcttaatacacaaaagcatcctgttgtttgccccatcccacgaggcaattcacggttacaggaagaaacgcaaccagcgaaccgctgccatgccccatctgaagaaggacatgttggtgaaggctgacatcaaaacctttttccccagcgtaaagcccaaacaggtctatgatgcctttatgggcatcggactacctcattgcgttgcggacatgctcacaaaactgtgtacacacgcagaccaactccctcagggggctccaacatcccctatggtcgccaacctgctttggctgaggcctgctagacggatacaaggagtggccgacaagcatggttttggtcataccatcctgggcgatgatgtgttcttaagcggcaagaagcgtgctgctaagtacaagtccttccttaagagagtaatctctgaagaaggcttccgtgctaatgatagaaagactattgcggtcagtcacaacggaccacagacggtcgcaggcctttctgtgaaccagaaagttaacgtgccgaaagcctacagaaaggccctccgaaatgagatctacagatatgcactgagcggagaggacgagaatgggcttgcccgccagaagggacgggcaagtctggagggcaagattgcgtacgtgaaacagtttaattcgctacaaggggccaaattgcagcagaagctggccgcagggcggaaatga

SEQ ID NO: 11206 - RNA, 909 nt, unidentified
  source 1..909: mol_type = other RNA; note = synthetic construct
atgttcgacagcaggctggcaactgttgaagagctgtcggtgctgatcggggttccttccggcgagcttatctactttgctaccgcgattgaaaagaattaccgaagaaaagtcgagcataaaccagacggggatacccgaatcttcttcgtgccgtcacccggtcttaaaaaaattcagaaatgcattcaccggaggttcctcagaaagctgccagtccacgagtctatacactcatataggcgccggcgggacacaatcagcaacgcctctgtgcacgttggcaagcagatcctcgctaagctggacattaagaagttcttcccctctatactgcctcaacgcgtgtatagggtcttcttgagtcggggttgtagtcctagtgtggcctcccttctgacaaagctgaccacctttgaaaatcagttaccccaggggccaccgacatcacctgggattgctaatcaggtgctcactcccctggccaaaaggctcaagggagtctgcgatcagcataacctcacgctatccatcttcgccgacgatatctttgttagcggatccgagcatgtgccacaagtcaacaatttgttaaagcgcatcgtggaaagcgagggctttacatttaaccttagaaaaaccgagatgcggtggcccggcgaaaagaaaattgtaactgggataagcgtgactgccagaattaacattgagaaaggctattaccgtaaggtacgtgcactggtacatcacgcagcgaaccatggttacatgcacctctttccaggagtgacgcctctgtctgccaaagataagttgcagggcatgattagatatataagtcgcctaaatgcttccaagggacaccagttgcaaatcaagagcctgcagatcgccgatgcaaccaaatga

SEQ ID NO: 11207 - RNA, 999 nt, unidentified
  source 1..999: mol_type = other RNA; note = synthetic construct
atgcgatcgaataactgcttctcaaagagcaaggtattcgtctggccgatctgggcgagaagtctggacaatcacgtgcaggatggcatcccactggccgatctgaccgatttatccgacttggctaggaaactctctgtgaccgaaacggatcttcaggccatcgcccaaactcactctctgtactaccgtagaaaggacaaggtgaagcccgatggccggcggagaactttctacatcccccacggtgacctcaagaaaatacagggggccatcgcaaaaaagttgctcgccccattaccattgcatcgcgccattcattcataccgtaagggcaaaagtaccctgacaaacgctagggtgcacctgggctccccctttatggttaagcttgacatagaggactacttcccaagcatttctcgggaccatgtctttaaacttctgggaaggctcgaattttccgggccgattgccaggatgctagcggtgctcacaacttttaagaaccagctgccccagggagcacccacgtctcaagcaatcgctaatctggtgttcgatgaaatcatcaaaaagcgcattgctcctttatgtgaggcccataatctggaggttacagtatatggcgatgacctgacaatctccggctcaaaacgcatagtcggcctaaagcggctgctcgagacaattatcaaggaggagggatttaaagtgagtactaagcctagcaaaaatcaactgctgcgcgagcacgaccagaaaatggtcaccgggtatgttctaagaggggataaactggatgtccctaagagcagatatcgagaagttagggcaataattcacaactgtttgaaaaacggaggtgctagccagttcgactgcgatgtgaagaccgcaaaacttcgattgcgcgggaagatcgagtatattcggaaggtgaaccctctcaggggaggtaaacttatgagagactttgaacggatttcctggatgtga

SEQ ID NO: 11208 - RNA, 912 nt, unidentified
  source 1..912: mol_type = other RNA; note = synthetic construct
atgagcctgaaagtgcccccttcatcaatcccatctctgggacagacacttggcctacctgacggcgctctggaagcctgcatccgggacctgcccggtcttgtaagccgctgtccgaagcgtaagccctctggatccatgcgaagggtgtacgcccctagagatccgctccacgatatccagcagagaatcctccataagctcctgcggccaatcgagcactctagcgagcttcatggaagcgtggtcgggagaaaccctaagacgaacgtcaccccacacgtaggcgctttcgtgtcaatcagtatggatattaccgacttctatccatccataagcaaggctagggtgaaccgcatctggatagatctgggatactctagacgagtcgcacaagcgctgacgcaccttaccacttttgatcaacacctagcccagggcttcccacccagttccgacattgccaacattgttctggagcaagatctgcttccacgtctgcgccccctgtgctcgcagcatcacttaacattaactatgtaccaggacgatttgactatcagtggtggggcccgcttgaggagtttgggaaatttaatacaacggatcttgctgcagtccgggtatcctgtgaatgtggacaaaacacggattagcaaccctggtcagcgccacatgtcaactggcctcgtctacaacacaaagccgaacattcctaaagagaggtacagagctctccggggggaactgcacaggtgtctgaccaatggcgttattaccgaagccgtcgacagacccatctggcagtataaacatcatctcgcatctcgaatcgagcatgttcggtatcacaatccctccagggcaaataatctccagattgtgtttgaccgtatagactgggggatttga

SEQ ID NO: 11209 - RNA, 990 nt, unidentified
  source 1..990: mol_type = other RNA; note = synthetic construct
atgaagtgtacgaaaataataatcaaccagaccaacaaagaggaaggcattctgcggattaacacaatcgatgagttagctgagaggctgggacactcaccgggagaactcaagcgtatagccaataccaagatccgatactacaaggttaacgaaaaaatcaaaccttccgggaaactgaggactctttacgaacccatgggccctctcagtaagattctaaagctaatcaaggagcgtttgcttgacgggatagagctgcccgaatgcatgcacggctatagaacgggacgggattatatcagcaacgcttgtgtacacgtcggaaaaaacattatctgcaagctcgacattaaaaatttctttcccagcatccatcatggcagagttttcaatatcctgatggatctcggatgctccaaacaggtggccaaacttttgaccagactggtaacatgcgacaaccataccccacaaggctttaatacttcacccacactgagcaatatcgtggtgtctaatctggccaggcgcttgcaggggctctgtaatcactatcgcctgacattaaccatctactctgatgacattaccatatccggcaatatagaacagaaaaagttcgagggcctgttctataaggagcttctcccaattatcgaggagattatcaagcaggagggtttttcgcttaactttggtaagattaagctggtcaagagacgggatagccaaaaggtcactgggatcattgtgaataagaaacctaacattccaaagcaaaagcggcgggaattgctctcaactatcaaagagtaccagatgaacggggtgagtatttcacacgacagcgacctgttaaaagtgaaacagtccctgcgcggtaagatcgcgaacgcacagcgagtgaaccgcagtttcggtcagctgttgctgagggagttcgaaaaaattgattggtccaggagagttagcttttcttctaattga

SEQ ID NO: 11210 - RNA, 1536 nt, unidentified
  source 1..1536: mol_type = other RNA; note = synthetic construct
atgttgaagaatacccttaatatacagtcaatcgaagagctcgctgaaaaattggacgagtcacccgagtatttcaaatcaatttccaagcggattccgaagctgtactactcgcctacaaaacgcaagaaacccaaaggaggggtccggaaaacgaacgagcctataaacaaattgaagtctcttcagtccaaaattctgcgaaacatacttgaatccgtgcctctgaatagctgcatacatggttataggaagaaccattcgccactaactaatgcaaagccacacgtcggcaaaaagtttctcctgaagcttgatatcaaagacttctttcccagtatccactataaacgagtggagaaactgttcagcgatctaggttgttctctggaagtgtctcgcatgttaacgcagctgaccacattccaacattacttgcctcagggtgcgccaacttctccctacatctccaatttaatcccagccaacgttgacaagcagttacaaaagatttgccgccgtaacaatctccctccgcacaagagatatggcgatgacattaccatctccggcaataagaatttcagtaaactgattcccgagatcgagaacacaattaagcagaacggcttcaaaataagcaagaaagagtttctgacccccaaagacaggaaggtggtgaccggcttgattgtgaacacaaaggtcaatgtgcccaaggaaaaggtgagaaaggtatgtgccatcattcacaactgtattaaatatggcccagattcccagaaccgggaagggaaacccaatttcaaggatagtctcagggggcacgttgaatatatcagaagcattaatcctccactgggagataagctcatgcaggagttcaacaaaatcgaatggaatagcccggagaaaatcaccatctctagtgtttctatagagaataatgaggtcgtcgagatctttgtagacggcgctaccagtccaaaccctggacccagcgctattgggtggattgcctttcgtaaggaaaataagctagaagagtacttcgagtatatcgggtgcacaactaacaatatcgccgaatacactgccgttatcagggcactggaagccgcgcagtccaaatggccacaagagaaaatcatcattaggtctgactccgagctggtggtaaaccaagtgaatggaagttggaacattaaccagcagtacctggctgacctgtgtaagcaggtgaagaagtcaggaaaggataccgagtggcaactgctctgggtcagcagaaaggaaaacctggcacataaactgtcaatgcgcggtctttacgaagagaagataaaagcacgggccagcgggcttgctgtgagaaagtcaagccctggaatttacaaagttgagtccgcaagcgggcatggcatgtacgacgtcacactcgcccctgattcttgcacttgcctcttttttcagaaacggaagtgtgtgtgcaagcacatctttgctgcccgaatcgccggcaaggcggacaactga

SEQ ID NO: 11211 - RNA, 984 nt, unidentified
  source 1..984: mol_type = other RNA; note = synthetic construct
atggacgggaaaatatcagagtttgccggatctgcactatattctttgacgtataagatcggttacaatgaggaaaagctaaggtatatcctgagccattttcgagagcagtactacaaacgcaaagaactggacaaaaaaggaaagaaacggattatctcttccccatcaaagaacctgctgaagctccagaggttgattcttgcctacattagcaagaagaccctgtttcctgaaaccttccatggttacaaaaagaagcgtagtaacctgactaacgctcggtgtcacctcaataagcgagttattactaagctggacataaaggacttcttcccatccgtacacttcaagaaagtgctggctttgtttgggtccctgggcttcaatgagcaagagagcaaaatactctctcggcttacaactgcggattattgtctcccgcacggctttagcacatcgcccaccctcgctgcattgatgctcattaatttggataagcgcctcaagactttatttatgaaaatcggcctggattacacctataccttcttcagcgatgatatcacaatctcaggcaacaaaggcattaaaactctgaagaagctgatatgcaaaattttcagacaggaggggtttatcgtcaacgagtcaaagatcaaggagcaaaatttctgggagaagcaggaagtgacaggaatttccgtgaacgaaaaactgaacgtcccttacgattaccgccacaatcttagggccatcgtgcataactgcattaccttagggccccgtacacagatcgacagatttaattccgagttttgcctagacaggaaacttgacttaagcctcagtaaatttagagaacggatcttcggcaaaatcaactatataaagcctattaaccgcgaactgtacaatcagctgctggcctatttcaacaagatcaactggagaacgaataatcccgtcagtgttcttgtgtga

SEQ ID NO: 11212 - RNA, 960 nt, unidentified
  source 1..960: mol_type = other RNA; note = synthetic construct
atgtgcgcagtgaatgagcggaattatttcgatactccctctattcagagcgtggcagaaaagctgcgcctttcagcgaatgccttgcacgaggttttagacaaatttcacacacattaccggaaaaagtcagagacaaagagtggcaaaaccagaacgtatcactgccctttccccgtgctgagggatatccagaagcgaatcaacaaatatatcctgaaggccatccccttgccatcatccatgcatggctacgtagccaagaggtccattctcaccaacgctacagtgcatctgggcaagaagaacattgctaacgtagacattaaaagcttctttccaagtattcactaccagcgcgtgcagagaatcttcaggcaaatcggatttaacgagggagagacgctagtgctgacccgccttacaactgccgattgttgtgttcctcacggtttcccgacttcccctcgcctggctaacctcgtcctgataaatgccgacaagaggctcagagatcttttcggtcagcagaaaattaaccacaccttctattctgacgatataactatttctgggaacaaaaacctgcggcagctcttacagccgatccgcaccatcttccgacaggaaggctttcggatccataggaaggaatcgtctccccagaaaccttactttaaacgtcagaaaatcacaggactccttgtgaacaataagaggctgaatctgcccagagaggacatacggagcctcgaggccattattcacaactgtctagttaaggggccatccagtcaaatagctgaatttgaggcacatttcgggcctccaaagcgagaactgagcaccgtccaaaaatttaaagaacgggtcttgggcaaattgaataatgtgagacgtgtcaattgcgaccaatacaagaagctgaagaaggactttgacagaatcgattggaattga

SEQ ID NO: 11213 - RNA, 903 nt, unidentified
  source 1..903: mol_type = other RNA; note = synthetic construct
atgtgcgaacaatccatcattactaatctgaagaccgttgaggacatcgcgtttacaattggcgtagatgagttccaattaagagagatatcacagaacattccactacactataaacagatctacatcaggaccagtcccactaaaattcggaaaatctctaaacctaacgagaaactcaaggccattcagaagctggtcaataaaaggatcctccagcggatccccttacctgactcagtgcattctcggaagaagcgcagtatactgacaaacgcagaacagcatgtgggcaaagaagtgatcgttagcctggatataaaggacttctttcccagcattagttctttgcgtgtcaaccaacttttcaaaaagattggctacaactccgaagccagcgcagtgctgacgagactcaccaccctggacggatgtctccctcagggtgcccccacatccccatctatcgctaatctaatcattactgacatggataaacgctttgaaactctttgcgccgagcaagagtttacctatacgaggtacacagatgacattaccatctccggggatcagtatgtgcgaaagttcttgccgctcttttgcaagatagtacgccagagcgggtttttggtgaacgaaaagatcaaggtcgagccaaggagtcgtcggcaggagacaactggaatagtcgtgaacgttagaccaaatattccgaaagagaaacacagaaagatatcagctattatccatcgatgtaagaccttcgggccctcgagcgtgacaaatgaagatctgagcaagttccgcgagagactgctgggtcacatctcatacatgtcccacattaatcctaccctgggaaggcggcttctgaacgacttcaatcacatcgcttggtga

SEQ ID NO: 11214 - RNA, 912 nt, unidentified
  source 1..912: mol_type = other RNA; note = synthetic construct
atgtctctagtcgtgatcgggagtgactttcactccccagaggaactcgtggagttcctgggattagattatagcgagattcaacatatcctgcaaacactcagctatcagtatagaccactccttatccctaaggcagaagatgagtggaggaagctcttggctcccaaacgggagttaaaacatacgcagagggtggttttggacatgcttctagacgatgtccccttccccgattccatccatggttacaggaagggacggagcatcctgacaaatgctgagccgcacatacaacaggagttggtcatcaatattgacatcgagaatttctttccatctgtacacccggaacgagttaagcgaaacttcttgatgcttggctaccgtgatcccgtggccaagtttctagtcagattatgtaccttcaaccatcagttgccacaaggtgctccaacctcacctgcacttgcgaatctggccatctccagaaccatgctggccctcgagaagttttgcaagaaaagagggattaacttcactggctacagtgacgatctgaccttttccgggccccaggccatcgagaaacacattgaaacactcatgagcattattagggagaacggctttcgggtcaacaaaaacgaaattaagatacagccttcttcacagctccaggaagtgacaggactggtggtgaatgacaaagttaatctgaacaagtcgctgaagaaaaaagtgcgcgccatgctgcatactgcacggaccaatggacctgaatcactgcaccgcgacaataagccttatcgcaaagatcagctgctcggcctgatacttcacactaaaaacgtagaccagaagctgggcgaaaagcacctgaaggaattctacgagatagactgggagtga

SEQ ID NO: 11215 - RNA, 918 nt, unidentified
  source 1..918: mol_type = other RNA; note = synthetic construct
atgaagaagattatcacacacaaaaacctgtgtaaagacatcaaaaccaccgatgacttttgtagaatactctcactggagaagtctttcgtacagaaacacatccgcctgtgccctcttctttatgtcgagatacctcttaagaagaaagacgggactccccgacctataagggcgccaaaagataagctgaagatcatccaacgcgccatcttgaagaacatcctctccgatattaaactccccccatgctgctacggattctcgaaaaacaagtcaatcattgagaacgcaaaggttcattcaaaaaacgatttcctactgaacctggatatccaggacttctttcccagtgtgcattataaaaaggtgcagcagatttttctggacgtggggctgaacgaccagattgccggaattctgtgttctctcactacttatgaatatcggcttcctcagggggctccgaccagtccatttttagcctccttcgctttgagcaatttagactatagactgatgcagctagcaaaatccaattacttgacatacacccggtactttgatgacatatccttcagcggtaataagagggtggttgtgttggaaaaggatattatgcggatcattaaagaaggcggatacgttgtgaagatcaaaaagaggaaactgtttaccaagaaggaggtcaaggaggtcaatggcattctgatcacagacaaaaagctttctttaaagaacacggacgagctcttcaactacgtgagtgacattaataaatacggtctgtctaagctccaaactgataatcccgagaaagaacgtcagagcattaagggcaagattgcctttctcaaacaaatcgatgagacagtaacgcacagcatagaaaccatcttcaataagatcaattggtga

SEQ ID NO: 11216 - RNA, 915 nt, unidentified
  source 1..915: mol_type = other RNA; note = synthetic construct
atgatcataaggaatctgtcaaaacgagtggaaaccattgacgatttctgtcacctcatcctgctggacaaactatatcttcaaaaactggtcagactgtgccccctccactacattgaaatcccattcaagaagaaggatggaacaccgcgccccattagggcacccaaagaaaagctgaaaattatccaaagagtgatcctagataacttgctcagctgcattaaattgccaccctgttgttacggtttttctaaaggcaagagtattatcgagaacgcgaaagcccacctgaggggtgattatctcctcaatttagacataaaggactttttcccatctgtgcattacaccaaggttgagaagattttccttgggatggggctggatcgtgattttactaatattctgtgcaacttgaccacacatgagtataaactgcctcagggggcccctacctcaccaaaacttgcctcagtggtactgcacaatttggactaccgcctgttaaagttggctcagagtaaccatcttacctatacgaggtactttgatgatatcagcttctccggaaacaagcggattatcactttagaaaaggacatcctgcggatcatccgcgaggagggatatagcgtgcacacatccaaggacaagaaaaaactcttcgcaaagaacgagactaaggagataaacggcattcttctgaaggacaaaaagctgtctctcaagaatatcgacgaattgtttagctacgtcgaaaacatcaatcggcatggcctgtccagactcataacagataatcctgagaaagagcggcagagtatcgctggcaaaatatcgtttcttcgacagattgaccctgaaagatcccacaagctcaaggttctgtacgacttcatcgagtggctatga

SEQ ID NO: 11217 - RNA, 1011 nt, unidentified
  source 1..1011: mol_type = other RNA; note = synthetic construct
atggaccaggaaatcgattttgactcacacgaggacctgcctgtgttacccccacactcatcccccttctgttggcgatgcttcgtttttatgaagaagattctccagatccagaaatctaagtctagcatagacacgcgcgaaaaactgatatcatttctaggactcaagaaagagaaatttgaggagtgtttcaaagtgatccctttactctacgaactgactccaatcttgaaaaagaataacgccggttaccggaagctgtctatcccaaaacaagagctcagagatattcaacggtgcgtgctggataagatttttacagacattaaactgcccagctgtgtatatgggttcagtagtgggaagtctatagtggagaacgccaagtatcacagtaaaaacgactacctgctcaatctcgatattaaagattttttcccgagcgtgcattttgaaagagttcgacagatattcaaagacctggggtttaatgatagtgtcagcgagatcctatgcattctgacaacctacaaccatgaactgcctcagggagccccaaccagtccccttctcgcttcccttgctctgaacaacttggacaagaggctgatgaagctggcttcacttaaccatatcctttattcccgctacttcgacgatatttctttcagcggctctaaaaggatcctggacatcgaggaaacaatcaagcagataatccgtagcgaaaattacagaatcaacagcaaacggtatctgtacggcaagggtgaagcaaaagagatcaatggcatctccatttcctccgggaagctgttcctcaagaataccgacgacctcatgggctatttggaagatcttaaaaatttcggagtcagcaagttaaggtcagataaccctgagaaggagcgcaagtccttgattggcaagatttcgtttctaaaggaagtcgatattgagaagggagtggaggcgaaaaatttgctggagactatcaagtggctttga

SEQ ID NO: 11218 - RNA, 924 nt, unidentified
  source 1..924: mol_type = other RNA; note = synthetic construct
atgaagaagatctatccgcaaactttctcgagattcaaagacctgcggattgagttgctacccaacctgttcggagtgcgagacatggaattttacagggttagttccaacgcccacttcttatatcgccccatagagatcaaaaagaagtctggaggagtgaggcaaatctatgctccaagcggtcgcctcaagtttctccagcggcggatccttagtaaactcttagaaaaagtcaggttacctcctttcgtctttggaggagtgaagggcaaaagcatcattaataacgcgtcctgtcatcttgggtccaagtacctgctgaatctcgatattgagaatttctttccctccgtaaattggcagttggtccgaaaactcttcattgacctgggctgcgactcatctgtggcagatgtgttgactagatttacgacactcgattataggcttccacagggggcccctacttctccatacatactgaacctggtattgtccaacctagaccgtcggtttttcctactggcttgcagcaatcgcctcacatacagtcgttacttcgatgacattacaatcagtgggggtaaaagactgatcggcttggaggagtccttcctcgaaatcctgcgccaggaggggtttaccattaacctgaagaagaagtatctgtacggacccagcgaagacaaaaaggtgaccggccttgtcctgaagagcgggggcagaatggagctggtttctatgtcaggcctcctgaaatacttaaatgaactgataaccgaagggctctcaaatcttgatggcattaatttggagaaggaaaaacagacccttctgggcaaaatagagtttgttaagagcatcgacaaggtggatggtcagaacctgaacacactgtttaacaagatcaaatgggtgtga

SEQ ID NO: 11219 - RNA, 1140 nt, unidentified
  source 1..1140: mol_type = other RNA; note = synthetic construct
atgactcatggcttcagtaacacagaggtcgtgatgataaagacacctgatatccctgaagatatgccgttcctcattgacgactgtacattagccttcttcttgggctttaatacacgtatcctttggtacgctatcacccgcaaggacgaactatacaccagactgacaattcccaagaagagcggggggtcacgcgtcatacatgccccagacaaagttatgaaactgttcggaaagagaattttggagcggctattaaatccccttcaaaaacagcttggggatcacgtaactgcatacagggagggccgatcgacacagatggctgtggaacagcacgtacctgaatgtccgatttgtgatactgcaccaccagggaccgagcatgattgcccccacagagggacctactttaacctggacctgaagaacttctttccatctacccgaagggtctggattaggcagtattttaagcaggtgattggatatagtcattatgttagcgacctgctggcgagtctcgtgacggtttacgcattcactgactccagcggttatcagtttagcggtgttcctcagggaaaccccgcctctggggccatctgcaatctcgtggcagattggatgctggacactcccatgctcgcgctgatagatgatctgaataaggagcagggactggagggcgaatacgcctggaagtataccagatatgctgacgatctggcgtttacgtgcggtaaaaggttctcctactacaaacgcatggccatcttgaataagttgatgaacgtgtgtacccggtcaggctacgccgtgaaccacactaagacccgaatctgggacggcagacaccggaaggcattactgggcgccgtgttcaatacacacactaacatccctagggaccagtatatttccgtccgctccctgacctataattgctggaaacatggttttgagtcccaatgctctcgggctggcaaggacagcgaagaagagctccggtggtggctccttggacgtatcaactacatggagcagatccactctggaaaaggccaacaactcaaatcagtctataacgccgctgtgcagaagtacgataaaaataaaacgcacccaaccgcttga

SEQ ID NO: 11220 - RNA, 1158 nt, unidentified
  source 1..1158: mol_type = other RNA; note = synthetic construct
atgacctacggctttacagaatcaaccttcgagacaattacagttccggatacagaattcttattgctggatgactgcactttggcatttttcatcggttttcggaacaaaaccatgtggcatctgctccagaataagtcagaccagtacaaagtgtttcacatacccaagtcaaatggtaagaaacggattatccacgccccctcccctctgatgaaggtgtttctgcatagacttcacgctcgcctcctgctgccgttacaggagcaattgggcgatcatgtgacggcatataggcctagcaggtccatcgtcgatgccgtgagccgccatatccctgcttgtgacatctgtgatactgctcccaagggacagactccacaacagcatacctgcccaaaacagggcgtctatatcaagatggatctaaagaacttcttcccctccacccgacgagcgtggattcgccactactttcaaagtatagggtattcttttcacgttagcggactactggctaacctcatgacagtgcctattaaaaattcgaaagggatcgacgacgataagtatcggggtaccccccggcagcagttcttccatggaacaccacagggcgctcctaccagtggcgccatctgcaatcttgtggccaaccacagattcgaccaacggattcttgagtactttaacgacagaaataagagggaggggctggaaagtccatgggactggagatacagcaggtacgccgatgacctcactataacctgtggacaagatatacctgcagcagagaaaaaagagattgcgaaggacgtgacgcagatcgtagaatcttctggctataagataaatagagccaaaactcgcattgcgtccgccttctaccgccgtaagatgctgggtattgtcatgaaccagaagccaaacattgagtacaatgaatatctgcgaatcagggccattgtacacaattgcatggtttctgggatcgaaacgcagcatgagagagcagggatgactacacccgaagagctcctccagtatcttaggggcaaggtcagcttcatccgtcaggtgcactccgataagggagacaaactgaaagctgagttggatgtcgccatcgacaactggaaagcccacgacaagtga

SEQ ID NO: 11221 - RNA, 1041 nt, unidentified
  source 1..1041: mol_type = other RNA; note = synthetic construct
atgccctcttatagagagacacgcgtcgatattgtagaattcccgttagaagttccatacgaactgccccacgccattgacgacatgagtcttgctttccatctgggtatcagaaactcgacgatgtggtggatgatccacgacaagaaaaagatgtataaggtgttcaagctgcctaaacgaggaagacctggccgttatagaaacatacagaacccaatcgatgtgttgaagaacgtgcagaagaacatactcagcaggttcctctctgccgtgccagtcatggcacatatcggcgcctatgtccccggtagatcctgtagggacaccgcggcccaacatgtggggaaaggggtgatcgtctcccttgacattcaggacttctttccaagtatgcgcaggtctatggtgaaacagtgcctccacagaaagattggttacgggtacagggtcgcttcactacttgccgagctaatgacctacacaaattttgtaccgcagggggctcctacctcaggactgatcgctaatctggtggcacatgacaggtttgataggcagatcttgcgtgatctcaaggagctcgatccccagtggacatacacccggtactccgatgacatagacctgtctcacccagaagttcaggagcccgaccggttgactgcaatcattgcacttgtgcgggatgccgttgagagtgctggcttcaaactgaatcaacgcaagactaaagtggagcctcattggaagagacaaaaagtgctcggaatggtggtcaatgaacgcgttaacattcctcggtacgagtatatgcgaactaggtccatcatacacaattgcttagtggatggcttcgataaccaatttgaacgagcaggaatgaatagcgctagcggcctgaaatcacacctgcgcggcaaattggcctttttccgccaggtcgatcccattaaggcccagcggctgaaggatcagtttgacctggcctgtcagatgcacgcggatgttcaagacaatgaggtacggtttgacagctga

SEQ ID NO: 11222 - RNA, 1038 nt, unidentified
  source 1..1038: mol_type = other RNA; note = synthetic construct
atgtcctcctataaagagacggagttgtcatacatagacctgccaagtgactcttgtctccagacaacctggccctggctgctggacgactttgccctggccctgcagctaggcatcagatgtaaaaccctgtggttctgcattaccacaaaagataagcagtacaagcgcttcaccataccgaaaagaacggggggaagacggcctattcacgcgcctgaacccgtgatcaagtggatccagcagcagattcatgagcgcatcctcaagccctttcctatcttagactgcgtaggggcctatgtcgaaggaaagcggtgtgcagactctgctcaagtgcatgtcggcgctggcgtgaggattggaatggacttaaaagattttttcccatcacacggtagggcacggatcaggaatttcttcaagaggcattatgggtacaaccaccaggtggcatctctgctcgccgatctgtgcactgttagagaaggtgctcaccactatgctcctcaagggtcccccgccagtccaatgttgtgtaatatgatggcccaggagactcttgatcgagagattatgcgagtgctcggcccacacggatgggcttatacaaggtactctgatgatttgtcattgagccacaaagatgacttaccttcgaaggaggtgaatcaagccataaaacaagttactaagatcagcaaggaaagcggttaccgtattaacctcaagaagactaaggtgcagcgaagatggcggcggcaacagatgctaggcatcgtcaccaatgagaaacttaacatttcacgccctctgtatcgtcagtaccgcgcaatccttcacaactgcctgcatcagggcgtcgaagtaaacgctcttcgctttggttgggaccccccagaaagcttcatctcccatctcgagggaaagatttcctactttgcgagcataagtgagacaaggggcgggaaactgaaaacaatgctgcatgaggttaagagagcactggaagaggaaaatgcccagacccacccgtga

SEQ ID NO: 11223 - RNA, 1119 nt, unidentified
  source 1..1119: mol_type = other RNA; note = synthetic construct
atggaactcaatcaattgcagcagcagttgtcttcacaaaacccagtttacccccagctaagtttataccccgtggcctcccccctgtttaccatacagactaaccgccagttggccctcaagctgaagatgaagtttgcaaatcggctcacatacgtgggaatgaacaaactgaatcactactcgaccctttccataagaaaacgtggagcggcaggcaagtaccgaactctgtataacccagatcagcctatgcgcctgattcagttcaaaatcctgaaggaaatcttggaacaggtgcaggttccagactatctttatgcctttgagaagggccggtcaattcccgctatggcacaaaaacacgtaggtaaaaaagtcattgtgagcgtggatctcaaggattatttccaatcaatcaagcagtaccatctgaaccaggtgttcaaacatctcgggttcggggagaaacctgctctattactgagcgagctctgcacttataaatccttcgtgcctcaaggagcccttacttctccaaagctgtctaatattatcaccacatataccttcggacctttaatcaaggaatactgtgaagaaaggggctatacgctgactatttacgcggacgacatcacaatctcatctgactctttgatagatgacatgggcagcgacaccgtacatagtcttataagttacctgaaagagacagtgggccggtttgggtttagggttaacagcgagaagaccaaagtcatgaagtattaccagagacagtacgtgtgtggtgccgtggtcaactcgaaggtcaatctccaaaaatccgagcgcaatacactgagagccattattcacaactgcgagatcaatggaattgaggccgaagccagcaagacccagatcaccgaagatgagtttattagtgctatgaacggtagactgaactggttcaaccagcttaacccgcaggctgggagccacttcatcaaccagtttaaggagatctatgggcgatccacggcaaatgtcaggaattcccaggatgttagggtagaggaactggtcagccaaggcgttaataatgtggaggtgcagcaggctcaaacagcatga

SEQ ID NO: 11224 - RNA, 1266 nt, unidentified
  source 1..1266: mol_type = other RNA; note = synthetic construct
atgattaagaaaattatagagcggttcctatctatctttaaacgcgagggaactactagcgagaaggagctgcccgagactgagcacaaaccagaattacacactaatctccctagcattaatccgattaaaacctcccataagtcctctgtaacccagaatctgcttaaggaaagactgaaggaagataatatcctgctgctgggtcacctggtgtcaaaagacgaagggaagagcaatcttaagatacctggtattcccaattttaacacaatctcagatgtgttggaatacttcgagaaggagtacaaaataaagaaaagtaagctcgcaaacttcgccagcttttctagtaagactaatcagttctacatcgagcggaagattcttcagaaatcctccaaaattggaaacaaagcgaggtatatttacattccgaaaccatttgtcaagtttgtccaaaaagtcatccttaaggacatactggagaaggtagagactcccccacagttagttggcttcaccaagaacaaatccatcaaagacgccgtggtgtcacatgttaaaaaggacgtggtgctcattttggacattgaaaagttctttcagaacaccaccgccaagaaggtgttcaatatcttcaagaatatcggctattccagggaggttagtctgtttctgacagctctgacaacaacgaaagtaaaggtggaaaacaaaaaggggtttaaaggcaaacgggccctacccacaggatcgcctaccagcccatatttaagcaagttggctttgattgactttgttgcagagctgaacgaactgatcaagaagtggcaaaatatgccgatcaaagatgtcgatttttctgtgtacgccgataacatcatcataagcttcaacaccgagaacaaagaaaagcgcaaggagatttctaaggggatcatagagaatcttcaggaactcctcaaaaaacacggctataagttgaacaaggaaaaaaccaagatcctcacgaagaagaagaaggtgctgggactcgtcatcaatgaaaagatcaacatcgacagaaactattacagaaaattgcgagctgagattcataatctctggaagaataagcagcgttttggcgaatcatccttccagatcgatgagaagctgatccaaaaaatcagggggaaactgaactatcttaaactgattaaccccagtaaatacaactcgctcttcataaaatactctacacacctggaagagctattctga

SEQ ID NO: 11225 - RNA, 1170 nt, unidentified
  source 1..1170: mol_type = other RNA; note = synthetic construct
atgctgaagaacattttcaactacatcaagaagatccttaagctggaaaataagaacaaaaccaagagcgtgtatctgagcggcctgaagatcaagacaactgataatctgaaaactaaccctctggagtactttaaatcggaggaaagaaagctgttagaggtcaatagtagtattaacccggatattccatattttccgtcaatcaaggaaatcctgaaatatttcaacgacaactacaaggtgttaccaaagatgcttataaactttgccttgttcaacacaaagacgtcagatttttacattgagaaacggatcataacgaaaaataaggagaggtacatttacattcccaaaaacttcacaaagaagattcagaagatcataaagaaggatatcctcgataaactgacctttcccgaagagatttgcggttacattaaaaacaagaacatcaaactcgccgtggaaaaacacgttaaaaaagacatcctcattctgatcgacattaaaaatttcttccccggcattgggaggataaaagttcgcaaggcttttgaaaacttgggttatccttccgacgtggccgcttttctcaccgccctcactaccacaaagatcaagtaccaagaagacaacaaaattaagacaaagtgtgctctgccaataggctcacctacttcccctaccatagcgaatctaatcatcacaaacatcaataaccagatcaagaactacttcaaaacccttcagaacgataataacatcagctctattgaccacactatctatgcagacaacattatcatttccttcaataccagcctaaaaggacaggacctcaaaaatatcaccaacaagatcatcattgagctcaagaagattatagcaaagaacaaactgaagatcaacgatagtaaaatccgtgtactgaaaaaacggaaaattgtcctcggactgtccataaatcagaagatcaacatcaacaagaagtactacaaaaaccttcgagccgagatacataatctgagcttcaataagaacaagctgactaaagagaagatagagacgttgaaagggaaattgtcttacttgaactttatcaaccccaacaaatacaacaacctttacaagaagtaccatacacgcttatctgaaattttccaatga

SEQ ID NO: 11226 - RNA, 3057 nt, unidentified
  source 1..3057: mol_type = other RNA; note = synthetic construct
atgaatagcatcaattattccaccaagtataagtttgtcgacgacaatttgttcctgattgcaaaaattaaccccaagaccaaaaaacagtgtctcgtatttcagcagattgacaaggaatctagaaatgtaatcttctcccgtcagctgacttgcattcacaccgctgtcacccgcatatctattgctgactacgagtcaatgataaacgatgactctgagaggaagaagttcaacaacaacttgctcaacatcataagtaccgagaatctggagccaatcgatttggaactcgacgaaaaatattttgccttcaagtcatgggttcagggcatcgccgaaagcggtctaagtgcgatattgattcaagacgagatcgagagaatggccctcatcaacaaccccatttctattttcctgtcttcatgtctcataaaggctgagcctgattttattgatgattacctggcactaatcaagcagagctgtaagaataaagatatctggaacaaagggaatgagaatagggacaattggcaccgctctagcttaattgctagcgtggatcgaatcattacgattatcaaagaactcgacgaaactgagttacttgtagagacagtctacaagctcattaagttctatatcactgagtccctgcccacatgcgtgataaactttatcctggaaaaattcgacttcaatatcctgggagacttgctggcagaactggaatacgactggatagtgaagatctacaacgattctcagttagaggagagaaacagagacttaattttttcgttccgaattgaaaccgattccgaatttgtcaatgattacctggaggtgatcaagaaagaagcgaatatcaaaatcaagagagataactcgggcaaagaggatgatcgcggtgagaatccctccctgaaaaagaaggtgaagaaaatcatctacgtgattaatcacatcaagaaggagcaatcccggcgcgaactgagctacaagttttttaagctttacttcacagagtcacttccacttcaggtgatgatcctgatcttcgagaacataaactcctatactctgtcaaacattctcgataacctcgaaaatgattggatcaagaagattctcaacgattacatccaaagcattaagattaagtgcaagaacaactatgagcaaagggagtcagacaagatctatgaaagctggaataagcagtcactgaggtactctatctcaattatcctaactttcatcgaacgtatggaaaatcctaaaaagagatccgaggtgttgtacagcgtttttaaattctacttcaccgagtgcttgccggtctatgtgctgaactatatcttcaagaccgtgaagaagaaatttctccgtgaggtgcttagtgacctggagagaaattgggtgattacagcatacaatacccctgatctgaagaaagaacacaagttcctgatcttcagctttttaattgccaccgactccgaatttctgaatgactacctcaaggtgataaagctgtgcaattcggggaaagaccataatcgggaaaatgtttccagtttgaaaaagagcgttaagaagttcattcgggtcatcaatgatatcgagaactataggatcaagaaaaaactgttgtacaagctgcttgatctgtatttcactgaatcattgccaagttatatcctccggctgatatttgacacaatgaacaaaaagaaccactccaatatcctggacctcatgcaaaacatgcctaataactggatcgtggccatccacaacatcgaagatttctataacaagaagtgcctgtttaatcagttttgtagaaaacacgacctgtctgacttactgttcatacaggattacagcatatggaactccaccatgtctcacagatggagggtttttgacgtccttaaacatatcgatcgggaggagatcaataaaaaagcccgcaagaataacattgacagtttctttattcggaactgcataactaaggtcaaaagcaagaaaaataccattgaagagcttgtcaaacataaaactaaggttcctaagatcggaagcatttatgaattctgcgtgctcgccaactacaatccaaaaaaacttaaacgatggctcgcaccccagatttccctgcataaatcctacatcgaaaaaaaaatccccaagagaaaaggagggtataggacgttgcacattccttatcccaaacttaaacgaattcaggtgtggattaaggaggaaatcctggacaaactccccgccctgcagtgtgctaccggcttcatcaagaataaatcaacgaagaacaacgccaaaccgcattgtcaaaagaaactgatcatcaaaatggatctcatggacttctttcccagcatcaagttttggcagatttacaggatatttcgctctctgcggtatattcatgagataagtatcgtactgacatatctttgtacagtgccattagcgaagcatataacacacaagggcaaccagaaagagtactttctagagacaagttttaggttcctgcctcagggggccccaacaagtcctggtctgtctaatctcgtattgatagaagctgacaaggagttacagaatcttaccaagtctctaaatatgagctatacgcggtatgcagacgatctaactttttctgtgaacgacagcgagtttaaaattaggcccttcatccagaaggttttcaacattgtgcgcaagcatcacttctgggtgaacaaaaagaaaatcaagattcttaggccgtacatgcaacaacgcgtgactggactggtcgtgaataaagaagttcacattccacggtcctactatatgcgcatacgtgggatcctgcataagttggagaactacggcagtgagatgcctctcgaggaacgaaagacactaaaaaatatggtatccggcatgattgcctacatgcactcaattcagccacggaaagctgagaagatgattaactggtacaaccgaatcaaaataaacgtcagtaagtga

SEQ ID NO: 11227 - RNA, 1359 nt, unidentified
  source 1..1359: mol_type = other RNA; note = synthetic construct
atgattgcgaaaaaaaaggtgaagaagtcaaagattgagaagctcccggtgcgcgtgaaaaaaatgctcaatatcggcctgtggtcttatgaagtgcaagtgcctgacgatcagacccttgagcggttacatcttctggaccgggatataatcaagaggaaaaaggatatccacattcccgagacagggaaaaaacagatctatcgacaggccgaaaaacagtatgataaacattcgagcaagaaaagaagcgagagaaaaaagttggccccaatacggcaaatcaaaaaaaaagaggactgggaagagtttaagaaggtaaatttcgtccacctcggtacgagcgtttcgaattggctcaatctcagggtagagaacactgataagttaaataaggtcggtctgccatctattagcgattcccatcagctcgccaagttgctgggaattagcattgctcagataaagtactttgcgtatcaccgcaaaagtagtcaagtgaaccactatgtcgatttttacatccctaaaggcaaacgcggccgtcgactgatctccaggccgaagaaggagttggaaaatatccaaagcatcatcaaaaaggagatcctggacaagattagtttttccgacgccgttttcgggttcattcctggaaagtcccacataaataatgctcaggagcacgtgaaacgagacttcatcatcaacattgatatccaggacttcttcccatctaccaacttctataaggtcagatccatcttcaggaaccttggatactccggggaaatttcatctgtgctggctcttcttaccaccaaacaggacacacggtcaatcactattggcgaagatcagtaccataccttcactgaaaataggtacctgccccagggcgcatgtacttctcccaccctgtctaacctggcactggtgaaggtagataaccaactaattaagcgtagtattgagctggggtacaagtactccagatacgtggacgacttgacctttagcatcaataagccaatctccaaaataaagacgctgctgtatatggtgaggaagacactcgaataccacggatatgaggccaacccccataagacaaagattctaggcaagaacaacagccagaacattactgggttagttattaattcaggagagtcaaacgtccctcggtattggagacggcgcctaagagctgcagttcatcagtttcagtacataaaagacgacgaaataaagagtatcgagctggtgcgtctgctcggttgcatcaattatttgaaaatcagccactctcgccttgcccagaactactttgaactggtcacaaaatactaccaatga

SEQ ID NO: 11228 - RNA, 1005 nt, unidentified
  source 1..1005: mol_type = other RNA; note = synthetic construct
atgaagctcaacgattttaatgatgttagttgcgtcctgggggaggagctgaagatgcttacgtacctcaagaaactgaaaaacaggctgtacacatcttattacataaaaaagcgcaacggcaaacgggagattaatacttatctctacaagcgcagactgtctgacctcgaggatgacattcctcagctgcatggctatgaattagccaaactcagccgcgcatccgaaaagcttgaggagatccacaggaagatcgattccagaattctcgacgaaatagaattgcccgagtgcgtcaacggctttaaaaagggcgagagtattaaaaaggctgtgcagccgcacgtcggtaatgactatgtcgcctgtcttgacattcataacttcttccctagtgtaaaatcagattacgtgctggaagggctccagtcctgtgggatcggtgctgacgcagcttggctgatcgcccggctggtgtcatacaagggacatctgccacaaggcgcggtgacatcacccaaggctagcaatattgcgttcatgaaggtagacaagcagatcttagaattgtctagatcgaagggaattacctacactcggtacgccgatgacttggtttttagcgccaattttgaactcaaggacttcgttgaggaagctatccagctggtcaccaatgcaggctacaccattaacagccagaaaatcaaattctacggacccaaggagcctcactatatactggggatcatcgcaaatagcaaactgaacatgccaagggataaacgacggaacttggaagccgccatccacaattatgtggataagcaccttgtgcctgctggagtgaacgagatcaggtataagaaaacattactaggcaaggccgcatatatgctgtccataaacccaaatttggggcgtctacaaaaactagtgatgaaactgagagagttcgaccccaacggtattgagtttgaacgaatctaccttggagattga

SEQ ID NO: 11229 - RNA, 1032 nt, unidentified
  source 1..1032: mol_type = other RNA; note = synthetic construct
atgaacgccgaagcagttgcattagagatccaggaaccgctgaagaagctcacctacctcgagaagataagaaataggctgtacgtcgagtattacatttcgaagcggtccgggggcaaaagagagatctgtgtgtacctgtgcgattccaaggaggctcaggctcgtctgaaaaataagcttcgcaccctgaaaaaaaacgatgctgagctggagaagcttgtgcgcgccgcccaggagcttaagacagtgcatcggaaactgaaagaattattggatcgcatacctctgccagactgcgtatttgggttcagaaaaaacgagagtattgttacttgtgccaggaaacacgtgggaaaaaagtatgtcatcagccttgacataaaggattttttcccatccgttacatctgacatggtgctccggcagttgaagcgagagggtttcgaagatactggggcatggctcatagctcggttagtcgccttcaaaggtgtcctgcctcagggtgccatcacaagcccagcggcctcaaacgtagctttcaaaccctatgacgagaagctgcagaaatacttcgaagaacgaggctttgtgtatacccgttacgctgacgacgtcaccgtgtctactgaccaggaagtcacagatgagatgatccaacaaatcgtggaagaaacgagtcaaattattgcaccctttaagtggaacgcgaaaaagattaaaatctacggacctaacgaaccacactacgtgttgggcctcattgtaaacgccaagcctaatgtgcccaagcagaagaggaggctcatcagggccatggtgcataattttgtgcgcaaacacgcattgccgcagggcgaggaccccattagatataagcgaaagctcatgggaaagctggcgtattgcctgtttgttaatccccatatcgaaagcctgctagagctatacgaagagcttagaaaattcgatcctaatcgggtcagcgagtggaagtctctgtatgtttcagaggaggagggcgaatga

SEQ ID NO: 11230 - RNA, 963 nt, unidentified
  source 1..963: mol_type = other RNA; note = synthetic construct
atgcaaaaaatcggctacgccaatcgactcaatctgccaaggaaattgttgacctaccttgagaagatcagatcccggctgtacgctgattattatctgaggaagaaagatggatccaagcgcgagatagccgtctatgtttgtgacagtcgcatcgccagccagctggatgagaagcttgttgagtactctaaagtgttgaaactcgtgcatcggaggatcaaaaacctccttgacgaaacaattgacctgcctgattgcgtgttcggattcaaaaaaaactgctctacaaagatcgccgcatcaaaacacgtggggaagaagtacatcttctcagtggatataaaggactttttcccctccattactagcgatatggttcagcaagcgttgatgaatgagggggtggagcagaacgatgcttggctaattgcaagactggttgcctacaaaggacgcctgccccagggtgcaatcactagcccaacggtgtcgaacgtcgtgtttaaacctaaagacctgcagattctcaagctctgtgaacgttacggcctcacctatacacgttatgctgatgacttaacctttagtaccaacgacgaaattaattgggtggaattcactgacgaactggagaagatactgcagccagaataccggattaacactaagaagttaaagatctacgggcctaagcaggcccattatgtcctgggcctcattgtcaacagaaaggtgaatacccccaagtcttataggaggacgctgcgagcagctgtgtataactacttgaatggcaaagtgccctatggtgtcgaccctgtaaagtacaaagctacactaaaagccaagctgggctacgcgctttatatcaacgagataccgagccttcggcgcctgtacgagcaattaaagagatttgacccaaatgaggtaaagaattgggaacacatcgtcgtatga

SEQ ID NO: 11231 - RNA, 924 nt, unidentified
  source 1..924: mol_type = other RNA; note = synthetic construct
atgaggttaataaagcagttggcgcaagaactcaacaagtcggaaatcgaggttagtcacttcctcctgaacgcgcctaaaaaatataaagtgtacaccatccccaagagaaccagcggccatcgcactattgctcagccctccagagaattaaaagagtatcagcgaaagtacctcgaactgcagcagcttcctattcacgatgtcgctatggcatatagacagggcgtgtccataaagcagaacgccatcgcacacaaaaataatccatatctcctcaagatggacttggagaatttctttaacagcatcagcaacattttgttttgggaagtatgggagtcaattcagccgctgccatccaaacaagacaagaaggttctcgaacaactgctgttttggtgtccctcaaagattaccggtggagccctgatcctttctatcggagcacctagttccccattagtgagtaacttcttcatgtacctattcgactgcgctctcagcgagaagtgcggagagaagaatattacttacactcggtacgccgatgacctgaccttctctacaaaaagtgagggggtgctttttgacattcccaagctggtagaggagctgctgcatgaaaagtttgggaatcatatcaagatcaatcggaagaagacaaaattctcatctaaagcccacaataggcacgtgacagggattacactgagcaacgatggaaaacttagccttggccgttctaggaagcgctacatcaaacacctggtccatcagatccaggtgggttgtctgtccgatgaggatatcttgcacctaaaaggcctgctagcctttgctgaacatatagagcctaccttcctccaagccctgaaaaagaagtattcagtcgagttgatcacgcagattataaaaggctga

SEQ ID NO: 11232 - RNA, 924 nt, unidentified
  source 1..924: mol_type = other RNA; note = synthetic construct
atgggattaatcaaacagctggcccagaatctctgtaagagcgaagcagaggttgcacactttttgttgaatgccccaaaaatgtacaaggtatatacgattcccaaaaggacctccgggcatcggaccattgctcagccaagcaaagaactcaaggaatatcagaggaagtatctcgaactgcagcagttacccattcacgaagcggcgatggcttaccgagagggcatcggtattaagcaaaatgccatagcccacaaaaacaatccttacctgctgaagctggacctggagaatttcttcaactcaatcagtaacctgcttttctgggaagtgtggaaaagcattcaacccctccccagctccaaagatcagaaggccctggagcaactgttattttggtgcccgagcaagattacagggggccgtctggtgctatctattggtgctccatccagtcctctggtgtccaacttctttatgtaccagtttgactgtactatcagtgagatctgccgccataagaacatcgtgtacactcgctatgccgacgatttgactttttccaccaagattaagggcatcctgttcgatatgcctaacatagtaaaggaccacctatcactgcattttggcgacgcaatcaacatcaacaagaagaagacaaagttctcgtctaaagctcataatcggcacgtgacaggaataaccttgaataacgatgggaaactttctctcggaagggagagaaaaagatatatcaagcacttggtccatcaggttaaactgggctgcctcgagaatgaggataagcaacaccttgtcggactacttgccttcgtgaaacacattgaacctatgttcctcgagtcactgaaaaacaaatactctgtcgagcttatcacaaagatcatagaagggtga

SEQ ID NO: 11233 - RNA, 933 nt, unidentified
  source 1..933: mol_type = other RNA; note = synthetic construct
atgagtctcatcaaacagttggcccagaagctgaataagtcagaaatcgaggtgtctcatttcctcctgaatgcaccgaaaaagtacaaggtttatacaattcccaagcggacatctggacacagaaccattgctcagccttcaaaggaacttaagaagtatcagagaaagtatcttgaactccagcaactgcccatccatgaggccgcgatggcatatcgcgaaggcattagcattaaacaaaatgctatcgcccataaaaacaacccttatctcttaaagctggacttagagaacttctttaatagcatcagcaattccctcttctggaaagtgtggaagagtatcaaaccactgccaccccgacaagatcagcgagcactagagcagctgctgttttggtgcccaagtaaaaccacgggcggttccttagtcttgagcataggggccccaagcagtcctctggtgtccaacttcttcatgtaccattttgatttcgatatctccgagatttgcagaaaaaaaggtatcacctacacaaggtacgccgatgacctgaccttttccacaaaaaacaaggagatactattcgagcttcctcagattgtcaaagaacacctggaggaacactttgagaactcgatcaagattaacaagaagaaaaccaggttctcttccaaggctcacaataggcacgtaactgggatcactctgaataatgatggcaagctctctttgggccggaaacgtaagcggtacattaaacaccttgtgcaccaggttcaaataggatgtttgagcgacgaagaccgcttgcatctgaaagggctgctggcttttgccaagcacatcgagcccatgtttctccagtcacttaagaagaaatactctgtggacctgattactcagataatcgaagactcaaacggatga

SEQ ID NO: 11234 - RNA, 924 nt, unidentified
  source 1..924: mol_type = other RNA; note = synthetic construct
atgtcccttatcaagcaactcgcccagaagctcaataagtccgaagtcgaagtgtcaaggtttctgagcaatgctcccaagaaatacaaggtatacacaatccctaaacggacctccggccataggactatcgcccagccgtctaaagaactcaaagaatatcagcgcatatacctcgaagttcaacagtttccactgcataaggcagcaatggcctatagagaaggcatttcgataaaacagaatgctatggcccacaagagtaacccttatctgttaaagatggacctagagaacttctttaacagcatctcaaacaatcttttctggaatgtgtgggagaaaataaagcccctcccattgccacaggaacagctgattattgagaagttactgttctggtgcccttctaagactaccggtggaagcctgatcctgtccataggtgcaccttcaagtcccctgattagtaacttcatcatgtatcagttcgacaccgttataaaccagatgtgtgtcaacaagaatatcacatacacccggtacgctgatgacctgacattcagcaccaaaggcaaaggagagctgtttgacatccccaaagtcgtagaggaatacctgttcgagatctttgggaacgctatcaaaattaacaaaaagaagacggcgttcagttccaaagcccacaatagacatgtgacaggcattactttgaataataacggcaacgtgagcttggggcggcaaagaaaaaggtacatcaagcacctcgtgcatcaatttaagttgggatgcctttctgaggaggatcgcctgcacctgcgtgggctgttatctttttcaaagcacattgagccaatgttcctccagagccttaagaaaaagtattctgtggagctaatcgatcagattattcgaggatga

SEQ ID NO: 11235 - RNA, 933 nt, unidentified
  source 1..933: mol_type = other RNA; note = synthetic construct
atgactctgatcgagcagctggctctggagctcaagaagtccgaagacgaagtggctcgattcctcctttctgcccctaagaggtacaaagtctatacaataccaaagcggacttcagggcaccgtgtcatcgcccagcccagtaaagaacttaaagagtatcagcggaagtacttggagcttcagcagttgcccatccatgattccgcaatggcttatagaaagggtatgtctattaagcagaatgcaatcgcccacaaaaataatccgtatctcctcaaactggatttggagaacttttttaactccataagcgacaaactattctggaaagtgtgggaatcgattctaccactgccaagcgaccaggacaagcaaactctggaaaacctcttgttttggtgtcctagcaagacaacgggaggcgccctcgtgctctcaatcggtgcacctagtagccccttagtcagtaacttcttcatgtaccaatttgattgcacactttctaaactgtgcgtggagaaagaaattatgtacacccgctacgcggacgatctgactttttctacaaagcataaagacagcctgttcaccctgcctgaactgatcaaggagaaattggctgttttatttggatcagctatcaggatcaataggaaaaagacccgcttctcaagtagggcgcacaacagacatgtaaccgggattaccattagcaatgatgggtccctgagcctaggacgggagagaaagcgctatattaagcacctggtttaccaagtgaagcttaataagctggacgccgaggatcggcaacatctgcgaggcctcattgccttcgcaaaacacgtagaacccgtgttcgtgcagtccttaaagagaaagtactctgccgagctgataacccagatcgttgaggagtccaacggctga

SEQ ID NO: 11236 - RNA, 933 nt, unidentified
  source 1..933: mol_type = other RNA; note = synthetic construct
atgacactgattgaacagttggcgcttgagctgaaaaagagcgaagaggaagtaaataggttcctcctgtccgcaccaaaaaagtataaggtctacaccattcctaagagaacttccggccatagagttatagctcagccctcaaaggaattgaagatgtatcagcggaaattcctggaactgcagaatctcccaattcacagtagcgccatggcctaccgagagggcctgagcattaagcaaaacgctattgcccacaaaaataacccgtacttgctgaaactggacctggagaacttctttaattccattagtaacaagctcttctggaacgtgtgggagtccatccaacccttacccagcgagcaagacatgagaacactagagaaactcttgttttggtgtcctagtaagacgactggggggaccctcatcctatctattggagccccatcttctcctctgatcagtaactttttcatgtatcagttcgattgcatactctccggattatgttttgagaagggcatcgtgtacacacgctatgcagacgatctgactttttcgacaaagtacaagaacatcctcttcgatcttcccatcctgatcaaggagaaactgtcagatctttttggctcttcaatccgcatcaaccggaaaaaaaccaagttttcttcaaaagctcacaatagacatgtgaccgggatcaccataaataatgaaggttgcataagcattggtcgggagaggaaacgttacatcaagcacttaattcatcagagccagctgaatcgccttgacgccgatgacaggcagcacttgaggggcctgatagcctttgcaaagcatatcgaacctatgttcttccaatcccttaaacgaaagtattcggctgagatcattacccagatcgtcgaggaaagcaacggatga

SEQ ID NO: 11237 - RNA, 924 nt, unidentified
  source 1..924: mol_type = other RNA; note = synthetic construct
atgtccttgatcaagcagctggccttttccctgaaaaagaacgaagatgaggttattaggtttcttctcaacgccccaaagaaatacaaggtgtatactatacccaagcgcactagtggccaccgggtaattgcccagccatctaaggagcttaaaatctaccagcgcgagtatctggagctccagcagttaccaattcacgatacagctatcgcttatagagaggggatctcaattaaagaaaatgccatcgcgcataaggataaccagtatctgcttaagctggacctggaaaattttttcaactccatctccaatcacctgttctgggagatttgggagtccatcattcctctgcctctgaaaagcgacaaacaaatcctcgataacttactgttctggtgtccctcaaagaaaaccggcggcaacctcgtgctgtcaattggtgcacctacatctccccttatcagtaacttcttcatgtacaagtttgacagcatcgtgtcaaaagcctgcttggaaaaaaatatcacctacacacggtatgctgacgacctaacgttcagcactaattacaaggatactctattcgaagtgcccttgtttattaagaaacaattgacagcactgttcggaaactcgattaggattaatcgaaagaagaccaagttcagtagcaaggcacataacaggcatattaccgggataaccattaacaatgacggaaaactctctttgggtcggaaacgtaagagatacataaaacacctgatccatcaattccagttaaatacgctggggaaagaggataagctccacctaaagggactcatgtcttttgctaaacacatcgagccgatctttatacagagccttgtcaaaaagtacagctttgaactgatcaccaagataatggaggaatga

SEQ ID NO: 11238 - RNA, 933 nt, unidentified
  source 1..933: mol_type = other RNA; note = synthetic construct
atgacccttgtcgagcggctggcactggagcttaagaagagcgaaggggagatcacacattttctgcaatccgcgccaaagaggtataaagtgtacactattcctaagaggacaagcggacaccgagttatcgcccagcctagcaaggaattaaaagaataccagaggaaattcctcgagatacaacagttgcccattcacggctcagcaatggcgtaccgaaaagggatatccattaagcagaacgccattgctcataagaataacccctatctgctgaagctcgacttggaaaatttcttcaattccatcagtgacaagttgttttgggaagtatggggtgctatccttcctctgccgtcgaaccaggataagcagacacttgagaacctactgttctggtgcccatctaagatcaccggcggagcactcgtgttaagcattggagccccttcttctcccctgatatccaatttcttcatgtaccagtttgattgtgcactatcagagttttgcgccgaaaaaaagatcacctatacgcgttatgccgacgacctgaccttcagtactaagaataaagacaccctctttgttctgcccgagttcgtgaaagaaaaacttagtgaactctttggttcctcaattcgcattaacaggaaaaagacgaaatttagctctcgggctcataatagacacgtcactggcataactatcagtaacaatggcaatctcagcctcgggcgcgagagaaaaagatatatcaagcatttggtgcaccaggtcaagttatccaaactgaacagcgaggatcgccaacacctgcggggcctgatcgcttttgccaagtacattgagccagtgttcatcgagtctctgaagagaaaatactcagaggatttgattacacagatcatcgaggaaccaaacgattga

SEQ ID NO: 11239 - RNA, 933 nt, unidentified
  source 1..933: mol_type = other RNA; note = synthetic construct
atgacgctgatcgaacggttggccttggaactgaaaaaatcagaagatgagatcacacactttctccaaagtgctcctaagcgctataaggtgtacaccatccctaaaagaactagcgggcatagggtcattgcgcaaccttctaaagagctcaaggagtatcagaggaaattcctggagatacagaatctgccaatccacgaaagcgccatggcttatcgcaagggggttagtatcaaacacaatgccatagcacacaagaacaatccttacctgctgaaaatggatcttgaaaacttcttcaactcaatcagcgacaagattttctggaagacatgggaatccatcctgcccttgccgagctcgcaggacaaaaagacattggagaatctgctgttttggtgcccctctaagaagaccgaaggagctctcgtcctatctattggagctccatcttcacccttagtgtccaatttcttcatgtaccagtttgattgcgccgtgagtaacttttgttccgagaaggagatcgtttatactagatacgcggatgacttaacgttctctaccaaacataaagacagtctttttttcgcaccatccatggtgaaggagaatttacgagagctttttggcggtactatccgaattaacaggaagaagactcggtttagctcccgtgcccacaatcggcatgtgaccggcatcaccattgcaaacaacggttctctgagcctggggagagagcgtaaaaggtacatcaagcacctcgtgcaccaggcccagctcaacaagctcgacattgagtcccgccagcatcttagaggactcatagcatttgccaagcatgtagaacccgtcttcctgaagtcgctgaaacggaaatacacatcagagctaataacccaaattattgaggaaagcaatggctga

SEQ ID NO: 11240 - RNA, 945 nt, unidentified
  source 1..945: mol_type = other RNA; note = synthetic construct
atggagctagagatgactctcattgaacagttggcccttaaattgaaaaagagcgaagatcaagttgcccatttcctcctatccgcccctaaaaggtacaaagtttacaccatcccaaagagaacctcagggcacagggtgatcgctcagcccagcaaggagttgaaagaataccagcggaagtatctggaactgcagaaacttcctattcacgattctgctacagcatacagaaaggggaccggaattaagcaaaatgccttcgcccataagaacaatccctatctgctgaagctggacctggaaaacttctttaattccatcagcaacaaactgttttgggaggtgtgggagagcattctccccctaccaccagagcacgacaagcaggctttggagaggctcttattctggtgccccagtaagacgaccggaggtgcactcgtcctgagtattggcgcccctagttcaccactgatctctaatttcttcatgtaccagtttgactgtgccctgagtaagttatgcgttgagaaggagataatgtatacacgttatgctgacgatctgaccttttctacgaaacacaaggattcccttttcgcactccctgaactcgtgaaggagaagctggtggaacattttggctcagcaatacgaatcaaccgcaagaaaactagattttcgtctaaagcgcataaccgccacgtaactggcataacaatctctaacaatggtaatctctcattaggacgcgagcgaaaacggtacatcaagcatctggtccaccaggtgcagctgaacaaactggatgcggaagacagacaacacttgcgggggcttatcgcttttagcaagcacgtagaaccgctgttcgtgcaatccctgaaaaggaaatattccgccgagcttattacacagattgtcgaggaaagcaatgactga

SEQ ID NO: 11241 - RNA, 933 nt, unidentified
  source 1..933: mol_type = other RNA; note = synthetic construct
atgacactcattagaaagctcgccctcgaactcgagaaatcagaagatgaagtggcaaattttttgctcaacgcaccaaagcgctacaaagtgtataccatacctaagaggacttccggacatcgggttatagctcagcccagtaaagagttaaaggagtatcagcgcaagtacctcggctttcagaaattgcctatccatgattccgcgctggcatatcggaaaggcattagtatcaagcaaaatgctctcgcccacaagaataacccctacctgcttaagctggaccttgagaactttttcaattccatttctgacaagttgttctggaaagtatgggcttcgttactgccacttccaagtagccaggatcggcaaacccttaaaaatctgttattctggtgtcctagcaagaaaacgggaggaccgctggtgttgtcaatcggagccccctctagccccctgatatctaacttctttatgtacaagttcgacagcatcatgtccaaattctgctcagagagggaaattgtgtacactcgatatgcggatgacctgacatttagcactaaacacaagggcagcctgtttcagctgcccgaggtggtcaaggagatgctatccgaactgttcggtggggcaataaggatcaaccggaaaaagacaaggtttagctccaaagcccacaatagacatgtcaccgggataaccatcaacaacaatggtgatattagtatcggccgtaagcagaagcgatatattaagtacctggtccaccaggttgaactaaatagagctgggagagaggacattgaacatcttcgcggcctgattgccttcgcctcacacatcgaacctatgttcatccaatctctgaagaagaaatacacaaccgagatcatttctaaaatcatcgaggggcagaacggttga

SEQ ID NO: 11242 - RNA, 933 nt, unidentified
  source 1..933: mol_type = other RNA; note = synthetic construct
atgtccttagtgaaacagctaagcctgggtctgaatcggtctgaggaagaagtgtctagatttctgctcaacgctcccaaaaaatataaggtatacaccatcccaaagcgaacctcaggccacagggtaatcgcccagcctagcaaggagctgaagcggtaccagcgccagtatctggaaatccaaaagcttcctatccaccattcagccatggcctatagacaaggcataagcattaaggaaaacgccgcagcacaccagaagtccaggtatctcctgaagttagacttcgagaatttctttaactccatatcctctcacgtgttttggaaagtctgggagtcgatccacccccttcctagcgagctggaccgacagacattggaaaaattgctgttctggtgtccttctaagaagagcggagggccactagtcctgagtattggggctccctcgagtccgttggtgtccaacttctttatgtatcatttcgactgccacctgagtcagatttgcctagagaaagagattgtgtacaccagatacgcggatgatttgactttcagcaccaaccacaaagacattctctttgatctgccacttctggtgaaggagcagctcgtcacactctttggcggaactatcagaatcaaccgcaagaagacacgctttagttctaaggcacataatcgtcacgtgactggaatcacgatcaacaataatggtaaactctcactcgggcgggaaaggaaaaggtacataaaacatctggttcatcaggttaagctgaagaaatcagataaagaagaccgtcttcatcttcggggcctgctggctttcgctaagcacattgagccactcttcatgcaaagcttgattaagaaatactccgccgagctgatattaaaaatcgttgaagagcccaatgattga

SEQ ID NO: 11243 - RNA, 933 nt, unidentified
  source 1..933: mol_type = other RNA; note = synthetic construct
atgaccgtagtggagcagctggcgctcgtcctcaaaaagtctccaacagacgtaacactttttttgaacaacgcacccaagaagtacaaagtctacaccatacctaaacggactagcgggcatagggtgattgcccaaccaagcaaggaattaaaaatctaccagcgcaagttcctggagttacaggaccttcccattcatgagtctgctatggcatatcgtaaggggctttcaattaagaataatgctaatgcccacaagaacaaccggtatctgctaaagctagacctggagaacttcttcaactcaatctcgagcgagctcttttggaaagtgtgggggtcaatcttgccccggccccctgaaaccgataaacgaacacttgaaaatctcctgttttggtgtccgtccaagacgaccggaggcaggctgatcctctccataggtgcccctagctccccactcgtgagcaacttttttatgtacaagtttgacggtgctgtccaagttctctgcgcagagagagaaattaaatataccagatacgctgatgatctgacattctccaccaatcaaaaaaatacgctgttcgaactgccgaggctgatcgagatccagttaatgactttgttcggcagtgaaatcagggtgaatcgcaagaagaccaaattttcttctacagcccataacagacatgttactggcattacaataagcaatgaccagaagctgagtctgggacgctctagaaagcgttatattaaacacctggtccaccagtatatcttgaacaaactggatcctgaacacactcagcaccttcgaggactgctatccttcgccaagcatgtggaaccatcattcctccacagtttggccaaaaaatacagtactgagctgattgtgaagatcgttgagtcccgggatgagtga

SEQ ID NO: 11244 - RNA, 933 nt, unidentified
  source 1..933: mol_type = other RNA; note = synthetic construct
atgtctctgattgaaaaactcgcctcagctttgaaaaagagtgaggccgaggtgttaatctttcttaagaacgcaccgaaaaagtacaaagtgtacaccatcccaaaaagaacatccgggcacagagtcatcgcccaaccatccaaggagctgaaagagtatcagcggaagtatctggaattgcaggattttcccattcacaacagcgccatagcatatcggaagaatttctctatcaaggacaatgcgaatgcgcataagaaaaatcgctacctgctaaagttagatctggagaatttcttcaactccataagcaatcacctattttggcgcgtctgggaaagtattttacctatgcctcccgaggctgataaaaggattctggaaaatctcctgttttggtgtccaagtaaaacaatcggaggacggctcattctaagtataggggcaccttcaagccccttgatctccaactttttcatgtacaagtttgacgacgctatctatgagatttgcatggagcgtgaaatcaagtataccaggtatgccgatgacctgactttctctactaacaggaaaaacatactctttgaactccctcatctcgttgagacgctgcttttctctctttttggctcagccatcagaatcaacaagaagaagaccaagttctccagcacaggacacaaccgccacgtaacaggcattaccattagcaataaccagaaactttctctcggcagagatcgaaaacgatacatcaagcatctggtgcaccactacatgttggaaaaactgtccaacgaggacacccagcatctgcggggtctgctcagcttcgctaaacatgttgagcccctgttccttcactcgttggaaaataagtactcaactgggctgatccataagattgtggagggtagggatgactga

SEQ ID NO: 11245 - RNA, 924 nt, unidentified
  source 1..924: mol_type = other RNA; note = synthetic construct
atgagcgtcattgagaagttggcccttgcactcgagaagtcagaagccaaagtaattgcttttttacggaatgcacccaataagtataagatttacaccatcccgaagagaacctctggccatcggatcatcgctcagccatccaaagagctgaaactctaccagagaaaattccttatgctgcagaagttgcccgtgcacaagtcagccatggcgtatagaaacggcctctctattaaagataacgccgaactccacaaacgaaacaggtatctcttgaagatggacttcgaaaacttcttcaattcgatcagttctgagctgttctggtcagtctggaagaatacaatcggcacacctactgatctggacaagtacacattggaaagactgctattctggaggccatcaaagaatactgccggacgcctgatccttagcgtgggagcgcccagcagtccaatggtcagcaactttctaatgtacaaattcgactgcctggtgcacgaaatatgcgctagcaaggaaatcacgtacacgcgttatgccgacgatctgacattctccacttgtcacaaagacgtattattcgaggttcctgcactcatagaggccaatcttgaacacctctacgacggtgcactgcggatcaataaaaggaagaccaagttttctagcatggctcataaccgacatgtgaccggggtgaccattaacaacaaggctagtctgtcccttgggcggtcccgtaagaggtatatcaaacatttgacacaccagtttgtgttagataaactgtcctctgatgatcgcctgcatctgcgcggtctgatcgcttttgcaaaacacattgagcctaccttttttcaatccctggttaagaagtacactgccgagagcataagtaaaattatagaggactga

SEQ ID NO: 11246 - RNA, 933 nt, unidentified
  source 1..933: mol_type = other RNA; note = synthetic construct
atgtcttttatcaaacagctggcccagaagctgaataagtctgagtctgagatagaacacttcctggttagtgcccctaagagatacaaggtttatactattcccaagcgtaccagcggtcaccgggtaatcgcccagccgagcaaagagctcaaaacttatcaaagagcattcctcgacattcagtctctgccaatacataatgccgccacggcatacaggacagggctatcgatcaaagagaacgcattagcccataagaacaaccagtatctcttgaaactggacctggagaacttctttaatagtatctcctcccgacttttctggaaggtgtggcaatcaatactgccaaagctcgcttcagaggacaagactttgatggagaatcttcttttttggtgtccttcaaaagctacaggaggacccttagtcctgtcgataggggctccaagcagccctctgatcagcaatttcttcatgtaccactttgatatcgcaatcagtcagttctgctccgagaacaaaatttcctacacccgctatgcggatgacctgaccttcagcacaaaccagaaagatctccttttctcagtgcccacctttgtcggcgaacaactgaaaaatctttttggaaacggcatcaagatcaaccgcaagaagacgtccttcagttctaaggcgcataacaggcacgtgacaggcattaccattaataatgaaggcaaactgtccttgggtagagagcggaagaggtacattaaacatctcgtgcatcaataccagctgaataagctaaatcaggaagacatttttcacctcaaagggctgttggcctttgctaagcacattgagcccaagttcatcaacactttaaagagcaaacactctgatgaattgatcacccggatttttgaagaacagaacgattga

SEQ ID NO: 11247 - RNA, 933 nt, unidentified
  source 1..933: mol_type = other RNA; note = synthetic construct
atggagctcatcaaaaaactggctacaaagcttaacaagtccgagtctgaagtcattaggttccttgccagcgcgcccctcaaatataaagtgtacaccattcctaagaggacaagcgggcaccgggttattgctcagccaagtagggaattgaaagagtaccaacgcgcattcataagcctgtacagacttaatatccatgacgctgcgatggcatatcgggagggcctgagcatcaaggacaacgccaagttgcattgtaagaacaggtatcttctgaaaatcgatctggagagcttctttaactcaattaccagtgagttattctggacgatatggcagcagcactacgaaatgccaaataatgatgagaaagtcctgatggagcgccttctcttttggagtccctcaaaatctagtacgggtaagctggtgctgtctataggagccccctcaagccctctcttgtccaacttttttatgtaccagttcgacgagctcgtgactcagcattgcgagtccttagagatcaagtacacccgatatgcagatgatctcaccttctccaccaaagcaaagaatgttctgtttgacatgcctcggtacatctccgatacattaacaaatctattcgggtcagccctgatcatcaatagacgtaagaccgccttctcttcgaaagctcacaatcgccatgtgactggtatcactattgacaacgaatctgatctgtccctgggccgggaaaagaagagatacattaagcatctggtgcaccagtatagactaaacaagctggacaaagaaaatgtcttccacttgaagggcttgctggcctttgccaagcacatagaaccgaagtttatcactagcctcgagattaaatattcggctgaggtaatcacacaaatttttgaagaacgaaacggatga

SEQ ID NO: 11248 - RNA, 933 nt, unidentified
  source 1..933: mol_type = other RNA; note = synthetic construct
atggaatttatagcaacactggctgccaaactatcaaagagtgagccagaagtggtgtcatttctcgcttcagccccactgaaatataaggtgtataccatccctaaacggacaagcggtcacagagtcattgcgcaaccatcccgcgaattaaaggagtaccagcgcaccttcctctctatttacaagctgaagatccattctgcagcaatggcctaccgagagggacttagcattaaagataacgcccaggcacactgcaaaaacagatacctgctaaagattgacctcaagaacttcttcaattccataagtaacgaactcttctggaatgtttggcagcagcactacaccctgcctgccaagagggaaaaagtcctgatggagaggctcttattctggagcccttccaaaagcagcaagggcaagttgatacttagtatcggagcccccagctcacccttgatcagcaacttttttatgtaccagtttgacgagttagtgacacagcaatgtgagactctcaatataacttacacacgatatgctgatgatcttactttcagtactaatgagaaagacatcctgttcgatatacccaaagccgtcactgagtttctgacgctgttgtttggcaactctatgatcattaacagaaggaaaacggtattctcttccatggctcacaaccgccatatcaccgggatcaccatcaataataagtccgagctgtctcttgggcgggagcggaagcgttatattaaacatctggttcaccactatcagaccaaacagattgaccaggagacaatcctgcaactcaagggcttgctggccttctcgtcccatatcgaaccggacttcatcaagaggctggaggcgaagtattcttccgctgtgattagccaaatttttgaagaacagaatggttga

SEQ ID NO: 11249 - RNA, 933 nt, unidentified
  source 1..933: mol_type = other RNA; note = synthetic construct
atgtctctgatcaagaaattggctaagaagctggagaagagtgaggctgaggtggccacctttcttgctaacgctcccttgaagtacaaggtgtataaaatccctaagcggacttctggtcaccgggtgatcgcccaaccctccaaggaacttaagaagtatcagcgagcatttatcagcctgttcaaactgacaatccataattctgccatggcgtatcgggagaagaggagtatcaaagataacgccaataaacacaaacacaacccatatttactcaagctagacctggagaacttctttaacagcatctcaagcgaacttttttggaaagtttggcaagcccattaccctatcccacagactgaggataaagtgttcatggaaaaactgctcttctggtcaccgtctaagagcgtatatggcaagctgatcttatcaattggagcccccacatcccccctgctatcgaatttctttatgtaccagtttgatcacatcatacatgatttatgcgtccatagagagataatatacacacgctacgccgacgatctgaccttctccaccaaacataaaggtgcactgtttaatatgcctgacctcgtcaccgaacagctgagaaagtgtttcggggaggcgataaacattaatcgtcgaaaaactgctttcagttccaagggccacaacagacacattacagggattactattgacaataatgacaacctctcactcggacgcgaaaggaagaggtacattaagcacctcattaatgagtacaagttcaacaaacttggcaaggaagacatcaatcacctgaaagggctgttggcatacgcaaaacatattgagccaagcttgatgacccgcctggaacacaagtattccacggagttgatgacgcagctctttgaggaaaactatgaatga

SEQ ID NO: 11250 - RNA, 933 nt, unidentified
  source 1..933: mol_type = other RNA; note = synthetic construct
atgtccttcttggaggaactagccagcgtgttgcagaaaagcgaggctgaggttgaaggcttcctggagggagcacccaaaaagtatcggacgtacaagattcctaaacgcactagcggctttcggacaatcgctcagcctagtaaggagctgaaggagtaccaacgggccttcttgaagatacagtctttaccaatccataacgcggccaaagcctatagaaagaacctttcgatcaaggataatgctacagtccacaaatctagcagatactttctgagtatggacctggaaaacttctttaatagcatttcttccgatctgttctggcgcgtgtattcacggcactttgacagtttcagcgggcaggataagcgagtgatggaatcactgctcttctggtccccaggcaaaagcaataaacagggactggtgctatcagtcggcgctccctcatccccgctcttgagtaacttcttcatgtacacattcgatctgattatgtccaattattgtgacgaaaccaacatcctgtacacaaggtatgcagatgactttacgttctctactaatgacaagaacatcctgttttccgttcctgaggtggtaaagggatttttagagaaatgctttgggagggggattaacgttaacaaacgtaagaccgtattttccagtaaggcacataaccgacacgtcaccggaatcactataaataataacggtgacctgtctctcggtagggagcgcaagagatacattaaacaccttattttccagtacagcatcaacaagcttgaggaaggcatgctccaacacttacaggggcttctcgccttttctaatcatattgagcccatgtttatcttcaccctgaatgaaaagtataccaaagagctgatgctcagaatatcagaagaaaggcatgtgtga

SEQ ID NO: 11251 - RNA, 933 nt, unidentified
  source 1..933: mol_type = other RNA; note = synthetic construct
atgtcatttcttcgggtcttagcaagtaaggtgaacaaaacagagacagaggtaatacagtacttggccaatgccccactgaagtacaaagtgtatactatccccaagcgcacaagtggcaatcgtgtgatagctcaacctaccaaagaactcaaagagtatcagagggcttttctgcagatcaagtcctttccagttcaccaggtcgccacagcctactgtttaggactgtctatcaaagacaacgcgctgagccataaggctaattcctacctgctcaaaatggacttgaagaatttcttcaactccattaacaacaacctgttctggaagatatgggccgtcaacaagaagcttccggaagccaaggacaaggagttaatcgaaaaactgctattctggagccccagcaagagtctgcagggcaaactgattctgtctgtgggtgctccttctagccctctgctatcgaatttcatcatgtattcattcgatgagcacttgtttaaggcatgcaacaagctgaatgtgacgtacacccgctacgcagatgatctcacgtttagcaccaacaagaaagacattttgtttaaagtgcccaacctggttgcagaacagctcagatttgaattcggctccagcattatcgttaacaggaaaaagaccaagttctcatcaaaagcccataacaggcatgtaactggaattactctcaataacaatcaggctatcagtctggggcggaaacgaaaaagatatatcaaacacctggtgcatcaactgctactcaataagctgactgtcgatgacataaatcacctcaaagggttgcttgcgttcgcaaagcacattgagccaacctttatcctttcccttgaaaagaagtattctctcgctaagattacccacatcttcgaggccgagaatgagtga

SEQ ID NO: 11252 - RNA, 933 nt, unidentified
  source 1..933: mol_type = other RNA; note = synthetic construct
atggagatcgtacggtctttagcccaaaaactcaatattacggagcaggaggtgagttcattcctggcctcagcaccgttgaaatataaggtctacaagatccccaaaaggaccagcggttttaggattatagctcaacccagcaaaaaactgaaggaataccagcgggcctttatcgagctttttccactggcttgtcaccaggccgcatacgcgtatcgcgagggaatttctatcaaggataatgccctcattcataagaagtctaagtacctgcttaagattgacctggagaatttcttcaactccatcaccaacgaactattctgggacatttggcaaaaaaacagcgtccttccagatctgaatgaaaaggtgctgttggagcggctgctgttctggtcccccgataagaaaatctctagtcgcttaatcctgtccgtgggtgctccttccagtccatccctctcaaactttttcatgtacgactttgatgagagcctatctagatattgcctcgaaaagaaaatacgttatacccggtacgcagacgaccttactttctccacatacgaaaaggggattctgtttgaaatccctgattttgtcagtcacatcctcagacagctctttggagataaactgtcaatcaatcgtaggaaaaccattttcagcagcaaagcccacaaccgacatgtgactggcgttacattaagcaacgaagagagtctgtcgatcgggagacagaggaaaagatacattaagcatctcgtgcaccagtatctcctgaacaagctggaccaggacgatgtttcccatttgaagggccttttggcgttcgctaagcacatcgagcctgatttcttggaccgcctgaaagcaaagtattctgacaagacaatatcacagatactaggcgaacgaaatgggtga

SEQ ID NO: 11253 - RNA, 933 nt, unidentified
  source 1..933: mol_type = other RNA; note = synthetic construct
atgggcatcattgagtcactcgccggcaagctggacaagtccccatcagcagtcaagaagttcctggcaagcgcgagtctaaagtaccgggtgtatacaattccaaaaaggacacatggatacaggttaatagcccatcctagcaaagagctgaagaaatatcagcgagccttcctcgaactgatgcctttggccatccacccttgtgcaatggcataccgtaagggactgtccattaaggacaacgcgcttgctcacgttgataagaagtatttgctgaagctggatctggagaacttcttcaacagcatagatcctaacatcttctggaaggtttatcaccttcacgaggaggtctgtgagccctcttctctgggtgagcgcttactcattgatcaattgttgttttggtgcccctccaaaagaaaaggagggaagcttgtgctgagcgtaggtgctccatccagccccatggtcagtaatttttgcatgctcttctttgatgtcgtgatctctaagtactgcaaaatcaatcacatctcctacaccagatatgctgacgacttgacctttagtacgaacgaaaaaggtgccctgtttaaaattccggaactcgttagggacactctgttcagcgagtttgggaatcgggttgtgctgaacaatgccaagactaaattctcttctagagctcacaacaggcacgtaaccggagtgaccctttcgaatagtgacacaatatcagtgggcagagaacgaaaacgctacatcaaacacctggtgcatgaatatcagctagggcggatgaattacgaggaaatcctacatctcaaaggcttactctcacatgtgtcccatattgagccagtgtttatcaatagcctggccaaaaagtacggccccgatgtccttaagcgcattcacaaggaatga

SEQ ID NO: 11254 - RNA, 942 nt, unidentified
  source 1..942: mol_type = other RNA; note = synthetic construct
atgggaattgtcaagcagctggccagcgaacttgacaaatccgaggctgaaatcatggcattcctcagccgcgcgcccctgtactacaaggtgtataaaataccgaagcgcacacacggggagcgtacaattgcacagcctacccccgagctaaaaaatctgcagagaacttttctcctgcttaaccctcttcctatgcattccgcagctatggcttataggtccggtttaagcattaaggacaatgctaacgctcataagcgcaactcatacctattaaagctcgacttgaatagcttctttaattcgatcactcccgctattttttgggcagagtgggataagttttttgatccattggactctaacgaaaagacactgatagaacgactgctgttctggagtcctagcaagagtttgagcggctccctcatgctctcagtgggagccccatctagcccagcagtatctaactttgtcatgcacgggtttgacacaaaactggaccagctgagtcggaacaaaggcgtagtgtacacgagatatgccgatgacctaactttcagtactcgaaatcagggggttctgatgggaatgcccgagctggtgaccgacttactggttgagtgcttcggcgcggccctgaccgttaaccggtctaaaacaatcttctcttccaaggcccacaataggcatgtgaccgggatcaccctcacgaacgaggccaagctttcattgggaaggaaaagaaaacggtacatcaagcacctggtccatcaattcaccctccaacagctcggccttgaagatgtgaattatcttaggggactgctgtcattcgcaaagcacatcgaaccagatttcatctacgccttggagaaaaaatatggtgctgccgccctgattgccatatacgaggtgaatgatggcggctccaagtga

SEQ ID NO: 11255 - RNA, 933 nt, unidentified
  source 1..933: mol_type = other RNA; note = synthetic construct
atggctattgtgtcctttctggccactcacttggacattcccgaagatcaagtggagagcattgtacagcgcgcaccccttctctacaaagtgtacaagattcctaaacgaagcttcggtaccagaactatcgcccagcccactcccgagttgaaaaagctacagcgtgccttcttactcaccaaaccgttgccagttcattctgccgcaatggcctatcaacctggcctttccataaagaaaaacgctctgcaccacctgcacaataagtacctgttgaagctggatttgcttaacttcttcaattccatcacgccggatatcctttggcaagaatggaaacagcattttgaaattcctcccccaaaagaaaaaaagcacatcgagaatctgctcttttgggccccacaacggaaaccaaatacacacttaatgcttagcgtgggagctcctagttctcctaatctctcgaactttatcctgtacaggtttgacgaacggttacagaatctgtgcaagaagctgaacataacatacacaaggtatgccgatgacctgaccttctccacaaacacaagatatgcgctgttcagtataccagaacaggtcgcaatgctgctcaacgaactgtttaccgggcgcattaatatcaacaagagaaagacgatcttcacctctaaagcccacaaccggcacgttactggagtgggcctcagttctgagaacaagctgagcctagggcgagctaagaagaggtacctcaaacatctggtccatcagtttaccctctcactgctggcagacgaggagatctcacacctccagggttggctagctcacgcgaaacatatcgagcccaccttcatagagtcacttacaaataagtatggccaggacattatccataagattttcgagactaaccatgattga

SEQ ID NO: 11256 - RNA, 1050 nt, unidentified
  source 1..1050: mol_type = other RNA; note = synthetic construct
atggtagctattgtgagccctcccaacttagttccaagattgggaggggaaactatcgccagctccagcaaagagctgtctcctagagccaaaagctgggcctttctgtggactgtcctgatgggagtgattgagcagcttgctagtgcactgggcaagaaagacgaggatgtcattgacttcttggttaccgcccctcgcaagtataaagtgtacaccattcctaaaaggagcgtgggccacagattgattgcccagcccagtcaggagctgaagatatatcagaagaagtacatcgagcttaatccgctccccgtgcacgatacagccatggcttacaggcaagggctctctatcaaggaaaacgccaaggcgcaccagaaaaatagttacctactgaagatggatcttgagaattttttcaactcgatcacgacagatgtcttttggcaggagtggcttgctttctacccgcaaccatctgacgtggactccatcattctggaacgcctgctgttctgggctcccaacaaaaagctagacggcaagctgattttgtctataggtgcgccctcctcaccagcactctcgaattttattatgcatcgatttgacgaagccgtcgtaaacaactgcgtggcaatcggagtgaagtatacccgatatgcagacgatctcacattttcaagcaacaccaaggatatcttattcaccctccctgggctgattgaaaacattctgatgatgctcttcaacggagccatacgcgttaataagaggaaaacgatcttttcaagcaaggctcataatcgtcacgttaccggcgtgacaatcagtaatgacaacaacatttccttgggtcgggagcggaaacggtatatcaaacatctggtgtatcagtacatgaatgggaagttagagaaggatcaggtcaatcatcttcagggcctcctgtccttcgcaaaacacatagaaccaaatttcatcacttctctgaacatcaagtacactcacaaaatcatccattccataatgtcagacaaacaatga

SEQ ID NO: 11257 - RNA, 933 nt, unidentified
  source 1..933: mol_type = other RNA; note = synthetic construct
atgaccgttctgtttggcttggtgaagacacttgggatctctgagagggaagctattactttcctgagtgacgccccaaaaaaatacaaagtgtacagcattccgaagcggtcatcggggcacaggatcattgcacagccaagcaagcgacttaaagaatatcagaccgcttttctaaagtgttgcttgctgcctgtacaccctagcgccatggcgtatcgccagggcctgtccataaaagataacgccaattatcacaaggataatcaatacctccttaagatggacttggagaactttttcaatagcattacccccaacattctttgggagagttggaataagaaagagctgttcattgatgacaacgacagaaagatcttgcaaagactcctcttttggtgcccctccaagaaaaacagtggtaaactggtcttatccataggcgcccctacctcaccagctgtcagtaactcttttctctataacttcgatgaggagttatacaacttttgcctgaagtaccagatcgcatacactagatatgctgatgatctgacgttttccacaaatcagaccggggtcctgttcactgtgcacgaaatggtgaaaaagctcctcatcaaacactttgaccggcagatcactctgaatcatggaaagaccattttctcttccaaggcccataatcgtcatatcacaggagtgacaatcacgaacgacggcaaactctctattggcaggcagaagaagcggtatatcaaacacctagtatatcagttcgagttaggggttctgtcaatcgaggacatatgttaccttcagggattgctggcattcgccaaacatattgaacccctgttcataccccgcctggtgcaaaagtacagcaaggaaacactgaagaatatcttcgacatcggtagctcatga

SEQ ID NO: 11258 - RNA, 1071 nt, unidentified
  source 1..1071: mol_type = other RNA; note = synthetic construct
atgttctcacactctaaactggttagccttctgctgcccccgctggagtgcaaaaacattgcggtcttttctaaagaaccaatgagtaaactggtcacgtccctggggttcctgtcgcgtgctttgaaaatgaagaccatccttgagttcgcaagtcgcactgagcaatccccagatcaggtgatgaggtatctgaagtcagcctccaagaagtataaagtgtacagcatccttaaacggacacatggccggcgcattattgcacaacctgccaaggaattaaagcagtaccagaatatctttctcgacacacactcactacccgtgcatagttgcgcctacgcgtacaaaaaaggtgtaagcataaaggagaatgcacaacagcacgttgaaaataattacctcctgaagatggacctcgagaactttttcaattctattacccccgatatcctgtggaaccagtgggaggatcattttggttggaagtttcagagcatcgaaaaggtcctcctggagcagacattgttttggtctacctcaaaaaagctcaacaggggcaaactagtcctgtcggtgggagctccatcctcccctgccctgtccaatctgtgtatgtatagttttgatagggagctccaggagatctgtcagacttacggagtatcttacactaggtatgctgatgacttgacattctctactcaactaaaaggccgactcattaaattccccgactatgtcgagaacttactgaacaagcacttctcaaagaagatattgatcaataaccggaagacagtgttcaccagcaaagcccacaaccgtcatgtgaccgggataaccctcgctaacaacggcgtgatctcccttggcagaaagcgaaaaagatacatcaagcatcttatgcaccagttcattttggggaacattgatgacgaagaacgcatgcacctgagaggattactggcctttagtaatcacattgaacctagcttcatcagcacgcttagaaacaagtatgggaatgacgtggttcagcgggtgagcgaggttataaatgaaaagtga

SEQ ID NO: 11259 - RNA, 924 nt, unidentified
  source 1..924: mol_type = other RNA; note = synthetic construct
atgaaaattatttctcagctggcgaaatacctaaataagccggaggattctatcgaggacatactgctgatcggacccgaaagatacaaattgtactatatccctaagcgtactcacggggtgagactgatagcccaaccatctcgcgaattgaaggagtaccagcgggcattcttatcattctacaaattcccaatccatgactgcgcaatggcttatcgggagggcatttctatcaaggacaatgccatcgcccataagaacaatagttatctcctgaagctcgatctcgagaatttcttcaactccatcaatcccataattttttgggatgtgtggcagaaactggaactcagcaacctttccgccaacgaaaagaaatggattgagaacctccttttctggaatcttcacggtgatcttgtactgtccgttggagctcctagttcccctaccataagcaacttttgcatgtacattttcgatagcatcctgacatatcactgcaacaacatcgggatcacttatacgaggtatgccgacgacctgactttttcaacaaacgaagagagggttctgtttaagatcccctccgtggtcgaaaccatgttatacgactgtttcgaaggcaagctgtgtttaaacaaaggtaagacagctttttctagcaaggcacacaatcggcacgtcaccggcattacattgaccaatgagggcaaaatcagcctaggacgaagcagaaagaggtacatcaaacataagattcaccagttttccctggggaaacttgataactatgacataatgcatctgaaaggcctcctctcgtttgctcgccatattgaaccaaaattctacgacagtttgctgaataagtactcaaaggagctggtgttgtcaatttttgaggccaattatgagtga

SEQ ID NO: 11260 - RNA, 924 nt, unidentified
  source 1..924: mol_type = other RNA; note = synthetic construct
atgagtatcatttctctgctcgctcagactctaaaaaaacctgagtatgtgatagaagacattctgttcatcgctcccattcgctacaaaatctattatatcccgaaaagaacgcacgggtttagacagatcgcccaaccatccaaagagctcaaggaatgccagcgggcattcttacgtttttgtaacctgccaacccacaactgtgccatggcgtaccgggaaggtctatccattaagaataacgccatagcccacaaaaatcaggcctacctgctgaagcttgatctggagaacttttttaacagcatcacccccaatatcttctggcacacatgggagctcactggagctgaactccctacaaaggacaatcaacagtggatcgagaagctcctgttttggaatcttgaagacaagttagtgctgtcagttggcgccccctcctcgcctagcgtctcaaacttctgcatgctgatttttgatcagattttacaggaccaatgtcagaaccttggaataaaatatacgcgctacgcagatgatctgacctttagtaccaacgaaaaggacatcctgttcaagattcctgagagcgtagagaatatcttgtccaagtgcttcaatggtaatctcaggttgaacaagggcaagacaatattctccagcaaggcgcataatcggcatgtgactggaattacaatcaccaatagcggggagatttctctggggaggtcaaagaaacgatacatcaaacacaaaatccaccagttctctctggatctgttgaacaaccatgaagtgatgcatcttaaaggcctcatggcttacgcaaggcatattgagccaagttttcacgagtctttgataatcaagtatagcaaggagatcattgaaagaattttcgaagtccccaacgagtga

SEQ ID NO: 11261 - RNA, 963 nt, unidentified
  source 1..963: mol_type = other RNA; note = synthetic construct
atggcacaagactcacatctgggaccatttcctctgggtaagttaatggggatcatatatcagttggccgaaaagctcgagatgtctgaactgactgtcaagaaatacttggcaaatgcgccgaacaaatacaaggtctacaaaattcccaagcggacgtacggatttagaattattgctcagcccgccaaagaactcaagaaattccaacgcgcttttttagacgtattcgatctacctgttcacaatagtgccctcgcctatagaaagtctatatcaatcaaggacaacgctatcctgcattgcaaaaatgcctacctgcttaagatggacttagagaacttcttcaactccattactccagacctgttctggaaggaatggaacaaaactcttaagatcctgccacgtacagaggcccagtggctggagcttctgctcttttggcggccgagcaagaaaagaaatggaaagcttatcctgtcaatcggggcacctagcagtccccacatctcgaatttctgcctgtttaacttcgatattatcatgagcacaaagtgtgaggcgctgggtatcacgtattctaggtatgccgatgacctcaccttcagcaccaacaagaaaaacatattgttcaccattcccaagtttgtggattccatcctgacagcttcctttgatggcaaacttacaatcaacaagaacaaaaccgtgttctccagtaaagcacataataggcatgtgactggcattactatcacaaatgacggaaatattagcatcgggcgcgagaaaaaaaggattataaagcacctcgtgcacaattataagattggcaccctcccacctgaggaaatagattacctgaagggcttgctagctttttccggccacatcgatcccacctttattgactctttgaagaagaacatccagcagcgactgagcaaaaaatacatttga

SEQ ID NO: 11262 - RNA, 942 nt, unidentified
  source 1..942: mol_type = other RNA; note = synthetic construct
atgtcagtcattgaaaagctcgcactgacattggacaaagagcagagggaggtcgaacggtttctggtgaatgctccaaacaagtataaggtgtatagcatccccaaaagaacgcacggctcgcgcgtgattgcccaacctagtaaagagttaaagacttaccagagagcctttatcgacctgtacgaaaagtaccttcctatacacgacaatagcttctcttacagaaaaggggtaggcatcaaacagaacgcagacgtccacaagaagaatccctacctactgaaaatggacttagagtccttcttcaattctatcgttccttcaatgctgtgggaggaatgggagcgatctatcgggaacaccccaaatgctcgtgaaaaaatgtggatcgagagactgctcttctggaacccctccaaacgcagcgggggcaagttgatcctgtctatcggagcgccaagctctcccatgattagtaatttcgttatgcatagtctcgataaggtgctatcggtagaatgctccgagaagggcgtgtcctatactcgctacgcagatgacatgacattttcaactcggaacaaggacaccctctttatttttcctgagcttgtgtccaatatcattaagtctttgtttggcaatcgtatcagcattaaccggtccaaaacggtctatagcagcaaagctcataaccgacacgttaccggggtcaccctgacaaacgagggaaggcttagtcttggaagagatcggaagcggtatatcaaacacctggtgttcgaatttagggaaaagaggctggatattgataccttcaaccatctcaagggtctgatagccttcgccaaatacatagagccggacttcattattcgcttggagaagaaatactcaacaaggctcataaagaaggtgatggacggtgattatgattga

SEQ ID NO: 11263 - RNA, 942 nt, unidentified
  source 1..942: mol_type = other RNA; note = synthetic construct
atgtcagtgctcgagaaattagccattactctgggaaaagagcaagccgaagtcgagtcgttcctgttaaacgccccaaataagtacaaagtttacagcattccgaagcgtacccatggaaaccgcattattgcacagcccagcagagaattgaagaagtatcagagagcctttatcgacctgtacgaggtgtattttcctgttcacaaaaacgcgttttcatacaaaaaggggatcggcatcaagcagaatgccgaggttcacaagaacaatccttatttgctcaaaatggatttggagaacttctttaacagcatagtgcctaacatgttttgggaggaatgggaacgctccatcggagataccccaaataagaatgagatcaagtggattgagcggatcctgttttggtccccctctaaaaaatctaatgggaagatggtcctgagtattggcgctccttcttctcccctcatatccaactttgtcatgcattcattcgacaaaatccttacgagcgaatgcgagaagaagggagtgtcatacactagatacgctgacgatatgactttcagtaccaaaaacaagaacaccctgttcagcctccccgaaacagtgtccaatgtgataaggggtgtattcggcaatagggtaagtattaacaggagcaaaacagtgtattccagtaaggctcacaataggcacgtgacaggggtcaccctgacaaacgaagggaaagtgtctcttggccgcgatcgaaagcggtacattaaacatcttatcttcgagtatcagaagaacaatctggacgcagaaaagtttaatcacctgcggggtctaatagctttcgcacggtatatcgagccatgtttcatcgatcgactcgaaaataagtactccgccagactagtcaaaaaggttatggacggcgactatgagtga

SEQ ID NO: 11264 - RNA, 933 nt, unidentified
  source 1..933: mol_type = other RNA; note = synthetic construct
atgagtgtaattaatagattggcgaccagcctgcaccagaatgaacttgaagtgagagcctatttagagaatgcaagcggtaagtataaggtgtatagaatccccaaacgaacaactggattcaggatcattgctcagcctgccaaaatgttaaaggaataccagcgagctttcctgcagctttaccgattcccaatccacgactgtgctatggcatatcaaaaaggcaaaagcatacgtgataatgcgctgatgcacgcccacaacccttatctactcaaaactgacctagaggactttttcaattccataacgcccgatattttttggcaatgcgtagagcagaccagtgtcaatgtctccttgtttctcccggaggaccgccggtacgtggatcagattctcttttggaaaccaaccaagcggagtacacggttaatgctgtctgtgggcgcaccctcctcaccaatcatttccaacttctgcctgcatgagttcgatcagttgatccacgaaatttgtcggaacctggacatcgtgtacaccaggtacgccgatgacctcacattttcgtgcaacgtgagagacgttctcggttcactgccttccatgatagagacactgcttaataagctcttcaagaagaagctgaggcttaaccgtggaaagactatctttagctctatggcccataaccgccatgttacgggggttaccctgaacaacaaaggcaaactgagcttgggacgggagcgcaagagatttattaagcacctgattaaccagtacaggtacgggctgatagatgagtctgacaaagcctaccttgtcgggctgttggctttcgcatcacatatcgaacccgaattcatcatccgcatgaacaataagtattctactgagctgatggataggctcaggcgccaacagtga

SEQ ID NO: 11265 - RNA, 933 nt, unidentified
  source 1..933: mol_type = other RNA; note = synthetic construct
atgtcactcatcaatcgcctggctacatccttacagcaaagtgagctgaaggtcaacgcatacctggaaggagccagtgggaagtataaggtctacaggatccctaagcggactaccggcttcagaataattgcacagcccgcaaaggccctcaaagactaccagagagctttcctgcagttatataggttcccaattcatgagtgtgccatggcctatcagaagggcaagtctatacgtgataatgctcttgctcacgccagaaacccttatctcctgaaaacagacttggaggacttctttaacagcatcacccccgatatcttttggcagtgcgtggagcgctcttcatctagcgaattgcaattccaactagcagatagaagatatgttgatcaggtgttgttctggaaaccaacaaaacgttcaacacgactcatgctgagtgtgggtgcgccaagcagccctgttatttccaatttctgtctttacgagtttgataccctgatcaatgagtactgcagggaattggacattatttacacgcggtatgccgatgaccttaccttctcctgcaacactcgcgaagtgcttaaaagcgtacccgccattatcgaaacgttgctgaacaagatattttccaagaaactccggttaaaccggggcaaaaccatattttcgtctatggcacataacaggcacgtcactggggtgactctgaataacgagggtcggctaagcctgggacgagaacgaaaaagattcatcaagcatctgatcaatcagtaccggtacgggatgattgatgaatcagacaaagcttacctggtgggacttctggcgtttgcctcccacatcgagccggactttatcctgaggatgaatgacaagtactcctatgagctcatggaccgcctccgcaggcagcaatga

SEQ ID NO: 11266 - RNA, 933 nt, unidentified
  source 1..933: mol_type = other RNA; note = synthetic construct
atgagtgtaatcaatggcctcgccgggctgctaaatcagagcgaactggatgttgtgttatacctgcagagcgcctctcgaaagtataaggtgtataagatccccaaacgcaccacgggctttaggatcatagcgcagccagctaaggccctgaaagattatcagcgggctttcctgcagctttataggcttcctgttcacaaatgcgctatggcttaccaaaaaggtaagtctgtgagggataatgcccttgtccatgcccagaattcttttctcttgaagacagacctcgaagatttctttaattccattacccccgacattttttgggagtccatagagagatctcccagcgacacccctcaaattagtgcagaggataaagggtacgtggagcatctactcttctggcagccagcaaaacgctccaagagacttattttgagcgtaggagcgccctcatccccggtcgtctcgaacttctgtttatatgaatttgacaacctgatctccgagttctgcctcccactaaatatcgcttacacccggtacgctgacgatctgactttttcatgtaatactagggacgtgctgggagttctccctttgattatagagaaactcctgaacaagctgtataggcggaaacttagactgaaccgcgcaaagaccgtctttagctcaatggcacacaaccggcacgtgacaggggtgacaatcaataacgaaggcgagttaagtctgggaagagaacggaagcgtttcattaagcacctcattaaccaatacagatacgatatgatagacgaagccgacaaggcctacttggtgggtctgctggccttcgcaaaacatatcgagcctgagttcatcctgcgaatgaaccgaaagtatactacagaattgatggagcgcatccgtcgccagcagtga

SEQ ID NO: 11267 - RNA, 933 nt, unidentified
  source 1..933: mol_type = other RNA; note = synthetic construct
atgagtttcatcaataagcttggcgttaacttcaatcagtccccactggaacttaaggtgttcctggaaaatgccccctctaagtacaaagtgtacaaaatcgctaaacgaactggtggctttcgtatcattgcacaaccggtaaaagccttgaaggtgtaccagcgggcttttctgcaactgtataacttccctgtccatggatccgcaatggcatatcaggaaggcaagtctatacgagacaacgccctgatgcacgcaaggaacccttatctgctcaagaccgacctagaggatttctttaattcaatcaccccagacatattttggaaatgcgtggagcttagcagcgctgacgctccacaatttagcgtggaggatagacggtatgtcgagaagattttattctggcagccggccaagagaagcaaaaggctcatgctctccgtaggcgccccaagttcacccgtgatttccaacttctgtctcctggagttcgataagctgatctcacatgagtgcagggaactgggaattgtctatacgagatacgctgatgacctcacctttagcagccgcatacctggggttctttctcccttgcccgcgatgatagagcagctgctcaaaaagctatacaaaagcaagttacggctgaacaggtctaagactattttctccagtatggctcacaatcggcacgtgacaggagttaccctgaataacgaggggggtctgtcccttggccgcgaaaggaaacgctatatcaaacatctcatcaatcagtacaagtatgacgccattgatgaatcggacaaggcgtacctgatcgggttgttggcctttgcatcacacatcgaacctgcctttattctgcgcatgaacgacaaatactctacagagttaatggatcgtttgagaagtcagcagtga

SEQ ID NO: 11268 - RNA, 927 nt, unidentified
  source 1..927: mol_type = other RNA; note = synthetic construct
atgtccgttatcaacgacctgggccgctgtttgaaccaaagcgatttagtagtgaaggcctttctggagaacgccccaagcaaatacaaggtgtataggatcccaaagcgcacaaccggttttcgtattatcgcacaaccggccaaagagctcaaacgctaccagagagcgtttatggggacctaccgcttcccggtgcacgaatgcgctatggcctaccaggagggaaagtcaattagggataacgctcttgcgcatgcccacaacccttatctgttaaaaacagacttggaggatttcttcaattctatcacacctgcaatcttctggcagtgcattgagtcttgtcccgttgatgccccacagtttcaggatgaggaccgacgctacgtcgaacgactcctattttggcagcccgcgaagagaaacaagagattaatgctgtccgttggcgcaccatcaagtcctataatcagcaatttctgcctcctggagctggacagattcctgtgtgaggaatgcgagcggttgggtgtgtcttacaccaggtacgcagacgacctgaccttcagcacatctcttcccggggtattgagcgccatccctgccctgattgaatccctcctcaaacggctattcaattccaagctgcggctcaatcggaataagactcttttttcatcgagagctcataacaggcacgtgactggagtcactttgaataatgaaggggaactgtccctgggaagggctaggaagcggttcataaaacacctgattcacagatatgacaagctggatgaggctgataaagcttatctcgtgggccttcttgcatttgccagtcatatcgaacccgagtttataatccgtatgaacgccaaatatagtacggaagtcattgaccgaattcgtcggcaacagtga

SEQ ID NO: 11269 - RNA, 933 nt, unidentified
  source 1..933: mol_type = other RNA; note = synthetic construct
atgtcagtcatttctgagctggctatgctgctgaatcagaacgaacaggatctcagggcattcctaaaaaatgcgtccagcaaatacaaggtctataaaatacccaagagaacgctgggcttcagaatcatcgcccagccggcaaaggctttaaaggagtgtcagcgcgcctttatccaacgctatcctttgcctgttcatgcgtgtgccttggcataccgtgagggtaaaagcattcgggataatgcattcatccacgctcagaattcatatctccttaagaccgaccttgaggactttttcaactccattacccctgaaatcttttggcaatgcgttgatgcatcccacgatggggcccccgtatttgacggatctgatagggtggacattgagcggatcttattttggcagccagccaaaaggagtcaacgactgatacttagtgtgggggccccctcaagtcccgcaattagtaacttctgcctctacgatttcgaccgactgctgtccgagagctgccagactatgggcgtggcttactcccggtacgccgatgacctgactttttcatgttccatgccaaacgtgctgcgaaccttgcctgctataatagaggctttgctgaatagactcttcaacaggcgcctcagattaaatcggggcaagacagtatttagctctaaagcgcataacaggcacgtcacaggggtgacactgagcaatgagggtctgcttagcctaggacgggaacgcaagagatatattaagcaccttatcaaccagtacaggtacgacctcttggacgaagaagataaggcctatctagtgggactgctcgccttcgcttcgcacatcgaaccagaattcattctgcgcatgaacgccaagtattcttctgagctgatggacagaatccggcgtcataaatga

SEQ ID NO: 11270 - RNA, 936 nt, unidentified
  source 1..936: mol_type = other RNA; note = synthetic construct
atgagcgtgatctctggtctggctacccttctgcatcaatctgaaagcgatgtccggttgtttctggagaatgccccccggaaatacaaggtttaccggattccgaagagaacaacgggtttcaggataatcgcgcaacctgccaaacgcctgaaggaattccagagagctttcatgcaactctatttgttccccgtgcacgaatccagcatggcttacagaaagggcaaatctattagagacaacgcctccgcccacgctaacaaccagtatctactcaagaccgatctcgaggattttttcaatagtatcacccctgcaattttctggagatgtattgagatgagttccgagcaggcaccacagtttctcacccaggacaaaccctacgtagagcgcatcctgttttggcaacccgtcaagcgcagcaagtcgcggctgatgttatcagtgggcgcacctagttcaccagctatcagcaacttctgcctgtacgaatttgaccggcagatgaatgaggagtgccagaatctcgggattacatacacgcgatatgcggatgatctgaccttctcttgtaacatccaggacttactcaggactgtgccagcaataattgaggccctgcttaacaaacttttcaagaacgccttaagaatgaaccacggaaagacagtgtttagctccaaagcccataatcgtcatgttactgggatcacactaaataatgaagggaaactgtccttgggacgtgaacgcaaaaggtttattaagcaccttattaaccagtacaagtatggcttgctggatgacgcagacaaagcctatctgatcggactgctggcctttgcttcacacatagaacctgaattcatcactaggatgaatgagaagtattcaaacgagctcatagagcgaatccgccgacagaggtga

SEQ ID NO: 11271 - RNA, 933 nt, unidentified
  source 1..933: mol_type = other RNA; note = synthetic construct
atgtccattatcaatgggcttgccaccgtattgcatagatccgaggccgatgtccgcagcttcctggagaatgcgccgaggaagtataaagtttatagaatccccaagcggacaactggtttcagaatcatagcacagccagcaaaggaactcaaggccttgcaacgagccttcttgcaactctactcttttcctgttcacgaaacatctatggcttatagaaaaggaaagagcatccgggacaacgctctcgcccatgtgaacaatccgtatctgctgaagactgatctggaggacttctttaacagcataacacctgacatcttttggcggtgtatagatactagctcaattgaaacgcctaaattttcggtgcaggaccgcccatacgtcgaacgcattctgttttggcagcctgtaaaaaagagcaaaaagcgcctcatgttatccgttggggccccctcaagtccagatatttcaaacttctgcctctacgaatttgatcgtaaactgtcagaggactgccagaatctgggtattacctataccaggtacgcagatgacctgaccttctcctgtgatatgagagacgtgctgcgaactgtgccagtcatgattgaggctctactcaagaagattttcaacaaggcccttaagatcaatcacggcaaaacagtgtccagttctaaagctcataatcgtcacgtgaccggcgtgacgttaagtaacgaggggaatttgtctctgggcagggagcgcaaacggttcatcaagcaccttatcaatcagtacaaatacggactgctagacgaagccgacattgcttatctgcgaggcctgcttgcgttcgcaaaccacatagaacccgattttatcggacgggtcaacaacaagtacagcatcgagttaatggagaggctcaggaggccctga

SEQ ID NO: 11272 - RNA, 936 nt, unidentified
  source 1..936: mol_type = other RNA; note = synthetic construct
atgagtgtcattcgtggtctggcttccgtactgcggcaatctgattcagatatctcgacttttctggcgactgcaccacgcaaatataaggtgtacaaaatcccaaaacggaccacagggttcagagtgattgctcagcctactaagggcttgaaagacatacagagagcctttgttcagctttactcatttcctgtgcatgatgcgagcatggcctacatgaagggcaaagggattagggacaatgccgcagcccacgctggtaatcaatatttgttaaaagcagacctcgaagacttcttcaactccattacccccgcaatcttttggagatgcattgagatgagcagcgtgcagacacctcagtttgagcccctggacaagatctttatcgagaagatccttttctggcagcccatcaaaaggaggaagaccaagttgatcctctccgtgggggccccttcctctccagttataagcaatttctgcatgtacgagttcgataaccgcattcatacagcttgtaagaaggtagagattacctacaccaggtatgctgatgacctgacgttctctagtaatataccagatgtcttgaaagccgttccgtctactttagaggccctgctcaagaacctctttggaagcgcactacgtcttaatcatagcaaaacggtgttctcttccaaagcccacaacagacacgtgactggcgtcaccatcaacaatgaggaaaccctgagtctgggacgggaccgcaaaaggttcataaagcacttaatcaaccagtacaagtatggactgctggataacgaagacaaggcctatctgacaggccttctcgcgttcgctaatcacattgaacccggatttatcacacgcatgaacgaaaagtactcactggagctaatggaacgactccggggccaacgatga

SEQ ID NO: 11273 - RNA, 939 nt, unidentified
  source 1..939: mol_type = other RNA; note = synthetic construct
atgcagattatcaaagcgttggcagccatcctgcgtcagagcgaatcagacgtgagactgtatcttcagaatgccccattgaagtacaaagtgtacaggatccccaagcgcactaatggtttcaggattatcgcccagccagccaaggctctgaaggaataccaacgtgctctaatacagctttatagttttcccgtacatgatgtggccatggcttataggaaaggaaagtctattcgggacaatgccattgctcacgccaataatagatatctgctgaaaaccgatctagaggacttttttaattctatcactcctacagtcttctggcactgtttcgagcaatgcagcgtggacactcctcagttttccacgcaggacaaaaactacgtggagaagattctgttttggcaacctgttaaacggtcaaaacataccctgatgctctctgtcggggcacccagttccccaactgtaagcaacttttgcctttacgaattcgaccgactccttagcgacgagtgcttgcgcttagatatagtgtatacacgctacgcagatgatctgaccttctcaacgaacacacctaacctgctgagactgctgccctcattcattcaggtcctcctcacaaagttatacaaaaatgcacttcgcctcaaccacggaaaaaccgtttttagctctaaggcctacaatcggcacgtcaccggcatcaccctgaacaacgaaggccagctgtccctgggtcgggagaggaagagattcatcaagcacttgatcaaccaatacaagtatgggctactcgacgaggcggatataggctatttatgtgggctcttggctttcgtgaaccatatagaaccggagttcattattaagatgaacgagaagtacaccgtttccctcatctcgtccatccatcgaagtaatcagtga

SEQ ID NO: 11274 - RNA, 939 nt, unidentified
  source 1..939: mol_type = other RNA; note = synthetic construct
atgcaagtcatcaaggagctcgctgctatactgcatcaggacgagtccgacattagactgtatttgaaacacgcaccccacaaatacaaggtgtaccgcattcctaaaaggacgcatggttttcgtattatagcccagccagctaaagtacttaaagcctaccagaggacactgattcagctctatccctttccagtgcatgacgcagccatggcctatcgcaaagggaagtctattagggataacgctttggcccacgcagataatcggttcctccttaaaactgacctggaagatttctttaactccatcacgcctgaaatattttggcgatgcatcgagaggtgttcagtcgacgctccccagtttagtgcacaagataagagctacgttgagaagatactcttttggcaaccagttaagagatcgcgtcacactcttatgctgtcagtgggtgcgccaagctcaccgatggtaagtaatttttgcctttacgaattcgaccggctgttgtccgacgagtgtcagtccaccgggatcgtctacactagatatgcagacgatctcaccttctctaccaacacacccaacttactgaagctactgcctgcgttcatccaggccttattggctaagctgtataaaaatgctctcagactcaatcatggaaagacagtgttcagcagtaaggcgcataatcgacacgtgacaggcattactttgaacaatgaggggcagctgagcttaggacgggagcggaagcgcttcatcaaacacctgatcaatcagtataagtacggcctgctggacgatgttgatacctcttatctaaggggactgctggccttcgccaaccacattgaacctgaattcatcaccagaatgaacgagaagtacaccgccgcccttgtgggcagcatctaccgctctaaacaatga

SEQ ID NO: 11275 - RNA, 945 nt, unidentified
  source 1..945: mol_type = other RNA; note = synthetic construct
atgtctgtcatcaaggagctggccacatttcttcaccaatctgaattcgacgtttccctgtttcttcaaaatgccccccgtaagtataaagtttatcggatcccaaagagaacctcaggattcaggatcatcgcccagcctgctaaggccttgaaggtatatcaacgcgctctcatgcagttgtacactctccccgtgcacgatgcagccatggcgtaccggaaaggcaaatccataagagacaatgctctggcccatgcccagaaccagtatctgttaaagatcgacctggagaacttttttaacagtattacccctaccctgttctggaactgtatagatgaatgtctggtgaatgacccgaaattttctagcacccaggataggatctacgtggaaaagattctgttctggcagcctgtgagacggagcaagaaaactctgttcctaagcgttggggctccctcaagccccgctgtctccaatttctgcctctataagtttgaccatctgctgaccgaggaatgccagacactcggcatcgtgtacactaggtacgctgatgacttgacattctctaccaacatcaaggatattctgaagctccttccagccctcatacagacacttctgaagaaactctataatagtgcactacgcctcaacaacggcaaaactgtgttctcctcaaaagcacacaatcgtcacgtcacaggggtgacgattaacaaccaaggtaatctttcgttgggaagggagcgaaagcgatttttgaagcatctgattaatcagcacaaatacggtctgttagacgatactgagttagggtacctacggggactgcttgcattcgcaaatcatattgagccacagtttataatgagaatgcgcgaaaaatacaccgtagatctgatcagcagtatcacgggcgcgattaacgactga

SEQ ID NO: 11276 - RNA, 936 nt, unidentified
  source 1..936: mol_type = other RNA; note = synthetic construct
atggggatcattaaggagctttccattttcctgcaccaggatgaatccgacgtctctctgtacctgcagtctgctccccgcaaatataaggtgtaccgtattccaaaacggactaacggcttccgagtaatcgcccaacctaccaagaccctgaaggagtaccagagggcattcgtgcatgcctaccccttgccagtacatgaagccgctatggcctatagagtgggaaggagcattagagataatgctgaggcgcataccgccaatcagtacctcctcaagaccgatctggaggatttctttaactcaattacacccgcaatattctggcgctgtatcgaacagtgttccgctgaggtgcctacattccttcaccaagataaaatctacattgaccggcttctgttctggcagcctacaaagaggagtgcgcgcactctcatgttgtccgtcggtgcacctagctcacccgcagttagcaatttttgcctgtatgaatttgatcgactgttaagcgacgaatgcaaacgtttagatatcgtttacactcgctatgccgacgacttgacgttttcaaccaatacaaaagacctcttgaagatcctgccagcctttatacagagccttctgaaggagctgtataaaaatgctttacggctgaaccacggtaaaactgtgttctcgtctaaagcacataaccggcacgtgacaggggtcaccattaacaacgagggcaagctcagtctcggaagagagaggaagaggttcatgaaacacctgatcaaccaatacaagtacgggctcctggacgacgccgacactaattatttgagaggcctactagcttttgcctctcacatagaaccggagtttatcaccaagatgtccaaaaagtatacggatgcgctgatccgacggctttacagaagtaattga

SEQ ID NO: 11277 - RNA, 939 nt, unidentified
  source 1..939: mol_type = other RNA; note = synthetic construct
atgcagatgattaagcaactggcagattcactccaacaggacgagagcgatattaagaagtttctgcagaatggaccccgaaaatacaaagtataccgtattcccaaaagaactaccggattccgcattatcgctcaaccatccaagaaactcaaagaataccagcgctatttcatagaattctatcctttgcccacacacaaagctgccctggcctacaggaaagggaaaagcatacgggataatgcactcgctcacgtgaatcagagttacctgctgaagatggactttgagaacttctttaactcaatcacgcccgcctttttctggcatagccttaccagctgtacatcaagtatccctcagtttaccgacgttgaaaagtcttacgtggaaaagatcctattttggcagcctatcaagaggtctaaaaacacactgatgttatctgttggggccccgtcatctccagtcatttctaatttctgtctgtatgagttcgacaggagactgagccaaatatgcgaggaatacggggtgatttatactcgctatgctgatgacctgacattctccaccaacattaaaaatcttctacctaagttccccagtatcatccacagcttattgcaggagctgttcaatggcatccttaaaattaaccacgcaaaaaccgtgtattccagtaaggcgcataacagacatgtgacaggaatcacccttaacaatgagggccagttatccctcggccgagagaaaaagcggtttatcaagcatatgataaaccagtacaagtacaatgtcctggatgacgaagataagaactatctgtgcggtctgctcgccttttccctgcacattgagccagaatttatcgtccggttggagaagaagtacacttcggagttgatcaaaaagctcactggtaagacgctctga

SEQ ID NO: 11278 - RNA, 1026 nt, unidentified
  source 1..1026: mol_type = other RNA; note = synthetic construct
aagaagtatgtccattttgccgtgtccagtaaggaactgagccccagagtgctgaaattgctggggttctttgtagagcgttttatgaacctcgttcagcaactagcaaagcatctcaaaaagaatgagtccgatgtcattcggtttcttgtcgatgcccccaataagtaccgtgtgtataagatacctaagaggtcacatggacacagagtcatcgcgcagcccacgaaagagctcaaagagtaccaacgcgcctttatctcaatctttaaatttccggtacaccactctgctatggcttactgcgaaggtaagagcattaaggagaatgccttagctcatgttgagaactcttacttactgaaaaccgatttcgaaaacttcttcaactccattaccccagcaattttttggcagagtatcgagcactgtcgagtggacgcgcctattttcaccgcccaagagagaaagttggtcgaaaaactcattttctggtgcccttctaaggagaaaaatgggaaacttgtgctgtctgttggcgcccccacatcaccaaccatttccaacttctgtctttatgagttcgacaatctgatcagcaacgcatgtaatgcacaacagatcacatatacccgctacgctgacgacctcacattttccacaaataagcgggatattctgtgcactatcgtgtcctcaattcagcagttactcctgaccatcttctcgcaccacatcaagttgaactacagcaaaactgcattcagttcgcgggctcacaacagacacgtgacaggcatcactatcagtaacgaaagcaaactgagccttggccgagaacggaaaaggtatatcaagcatctgataaatcagttcaagtacaatctgctggacgactctgatataaggcatctccagggactgctagcctttgctcagcatatagaaccagtgttcatctctaggttgaagactaaatacacgaacgagctgatacagcgcatttatgaagccagccacgattga

SEQ ID NO: 11279 - RNA, 942 nt, unidentified
  source 1..942: mol_type = other RNA; note = synthetic construct
atgaatctcgtgaagcaattggctcgccatctgcggaaaagcgaatccgaggtaatccgctttctggtcgatgcaccaagtaaataccgcgtgtacaaaataccaaagagatctcacgggcatagggtgattgcccagccttcaaaagaactcaaagagtaccagagagcatttttagccatctacacttttcccgtgcatcccaccgccatggcttactgtgaggggaaaagtatacgtgaaaatgcactggcccacgtccagaacaattacctcctgaagacagacttcgagaacttttttaactcaatcacccctgccattttttggcagtccgttggcagttgcaccgtagacacgcccatgttcacaacccaagagaagagactggttgaaaagcttattttctggtgtcccagcaaaactgaactcggtaagttagtgctgtccgtgggcgcccctacttcacctagcatatccaatttctgcctatatgaattcgatcgattcatgaccaacgtgtgcagcgatcagaagattacatatactaggtacgctgatgacctcacgttctccacaaacgagaagaacacccttaatacaatcgtcccagtcatacaacagttgcttgttgaatttttctcgtactccctgaagttgaatcactctaaaacagcgttttcttctcgagcccacaatcgtcacgtgactggtatcaccctgagcaatgaaagccggttaagtcttggccgggagaggaaacggtatatcaagcacctaatcaaccagttcaagtataacctgctggacggaagcgacatcaggcatctgcaaggactcctggcattcgctcagcatattgagccggtctttatttcacgcctgaagaccaagtatacttcggagttgattcagagaatctatgaggcgtctcacgattga

SEQ ID NO: 11280 - RNA, 939 nt, unidentified
  source 1..939: mol_type = other RNA; note = synthetic construct
atgaacctcgtgcatcaattagctaaacagttaagaaagtctgagctggaggttatcagatttctggaaaatgcccctaacaaatatcgagtgtataagatcccaaagaggtcccatggtcatcgaattatagctcagccgacaaaagagctgaaagaatatcagcgcgcttttctatcaatctgcaatttcccagtacaccattcagccatggcatactgcgaaggtaaagggatcaaggagaatgctctggcccacgtcaaccataattacttgctcaaaattgacttcgagaacttcttcaattctatcactcccactctgttttggcaggcgatcgaaaatgccaaatgtgacattcccgcttttacgacccaggaaaaggagatagtcgagaagattgttttctggtgtcctagtaagctgaagcacggaaaactggtgttgtcagtgggagcccctaccagccccattatctcgaacttttgcctcaatgagtttgataggttcatcagtgacatctgtaatgaccaaaagatcacgtatacaaggtatgcggacgatttaacattctccactaatacccgcgatttgctttacaccataatccccagcattcaggatcttctagccctgatgttttcccacgatctgaagctcaaccactctaaaactgtgttcagctccagaggccacaaccggcacgtgacaggggtcactctcagtaacgacggaacaatctctctcggccgtgaacgcaagcggtacattaagcacctcattaaccagtttaagtacaaccttctggatgaaggggacacccggcacctgcaaggccttttggcattcgcacagcatatcgaaccagacttcataagacggctgaatgcaaagtacaccattgagctgatgaggagcattaaagaggccaacagctga

SEQ ID NO: 11281 - RNA, 942 nt, unidentified
  source 1..942: mol_type = other RNA; note = synthetic construct
atgaatttagtcaagcagctggcccagcatttgggaaaaagtgaatacgaggtgagcttgtttcttgttgatgctccgaataaatatcgggtgtacaagatccccaaaaggacctatggccaccgtgtaattgctcaaccctctaaggagctcaagaagtaccaaagggccttcctagacatatatcctttccccgtgcattctgcagcgatggcctactgtgaaggaaagagtatcaaagataacgcccaggcgcacgtgcagaacgactatctccttaagactgacctcgagaactttttcaactccattacaccaacaatcttttggtcctgtattgaatcctgctcactggatactccttcctttactacccatgagaaaaagcttgtggagtccctcctgttctggtgcccatctaaaacaaagaacggcaagttagttctttctgttggggcacccagctcgcctaccatctcaaatttctgcctttatgagttcgacaggtacctcagcaccatctgtaactttcagaatatcacgtacacccggtacgctgacgacctgacattctccaccaagaaaaaggacatactctatacggtgataccttctttgcaggatctgctggtcaaactgttcagccaaagtatcagactgaatcactcaaaaaccgtctttagttcaagagcccacaatagacacgtaacaggggtgactctgaataatgaccgacgactgagcctaggtcgccagcggaagaggtacatcaaacacctcgtcaaccagtttaaatacgaccagctggatgaggtggatacacgccatctgcggggcttgttagcttttgcaaagcatattgaaccaactttcattaagcgcctgaaggataagtacagcagcgaactgattaaacgtatttatgaggccagaaacgaatga

SEQ ID NO: 11282 - RNA, 960 nt, unidentified
  source 1..960: mol_type = other RNA; note = synthetic construct
atgaatttagtgagtaagctggcactgtatcttgaaaagtccgaatctgaggtaatccgcttcctctcagacgcacctaataagtatagagtgtacaagataccgaaaaggtcccacgggcataggatcatcgctcagccctctaaagaactgaaagagtatcagcgagcattcctggagctatacgaattcccagtgcacgattccgccatggcctactgcaaaggtaaaggtatcaaggagaatgccctggcccattctaaaaacagttacctgctgaagaccgacttggagaatttctttaactcaatcacaccacccattttttggcaatgcatggagaagtgcgcgtcgactgtccctcagtttacgaagcaggagaaagtcctggtggaaaagctcattttttggtgtccaagcaaagataggaatggcaaactggtcttaagcatcggggctccttccagccccgccatctcaaacttttgtctttatcagttcgacgatttcatgtccgatgtatgttacgatcacaaaatcacctacacacgctatgctgatgaccttaccttcagtacaaatgagaaggacctgctgcacactatcataaattctattcagtactccctcaactactttttctctaatagcctcaagctaaatcattcgaagaccgtttttagctctagagcgcacaatcggcacgttactggcatcaccataaacaaccatggacgtctcagcttgggcagggagcggaaacgatacattaaacacctggtgaaccagttcaagtacaaccaattgagcgaaagtgacattttccacctccaaggattattgtcatttgctcggcatatagaacccaagtttattttccgccttaaagacaagtatacaaacgagctggtgcagagaatttatgaagccggaaacgagcaacagaacaagaagcagtga

SEQ ID NO: 11283 - RNA, 1023 nt, unidentified
  source 1..1023: mol_type = other RNA; note = synthetic construct
atgtacgagcattttgccgttagctctaaagagctgtctccaagggctccgctgctcttggggttcttcgtggaacggaaaatgaatctcgttaagaggctcgcacaccacctgggcaaatctgaaccagaggtcatccatttcttggcagatgctccaaataaatacaaggtgtacaagatccctaaaagaagttatggacaccgtgtgatcgctcagcccacccgagagttgaaactctatcagaaagcattcctggaactgtactcattccctgtgcactcaagtgccaccgcttactgtaagggcaagagcataaaagataacgcactaagccacgtcaaaaatcattatctgctcaaaacggacctggagaacttttttaacagcataacccccaacattttttggaagtcgattgaaaacgactccattgccacccctaaattctctacttcagaaattgccctcgtagagcggctcatcttctggcggcctagcaaactgcaggggggcaagctggtgttgagtgtgggtgccccatcctcacccactatatccaacttttgcctgtaccagtttgatgagtacttatccatcatttgcaaggaacaaaatatcagctataccaggtacgccgacgaccttactttttctacgtgtgataaggacgtactccatacagtcatcccgctgatccagtcccttttagattacttctttgcgtccgagctaaagcttaatcactctaagactgtcttcagcagtaaggctcataacagacacgttacagggattaccctgaataatgagggtaaactgagtctaggacgcgagcgaaagcgctatatcaaacacctggtgcactccttcaagtatggaaagctggataacacagaaattagacatcttcaaggcatgttgtcattcgccaagcacatcgaacccatctttattgaccgcttaaaggagaagtatacagacgagcttatcaagataatttacgaagcgggccatgagtga

SEQ ID NO: 11284 - RNA, 939 nt, unidentified
  source 1..939: mol_type = other RNA; note = synthetic construct
atggatttagttaagaatctagctaacaacctgggtaaaagggaaagcgaggtcaggcggtttctagccgatgctcccaacaagtatcgagtctataaaatccctaaacgtagttatggacaccgggtgattgctcagccaagcaaagagctcaaagactaccagcgggcattccttcagctgtacacatttccagtgcacagagccgctatggcctattgtaaaggtaagtctataaaggagaacgcgcaggcacatgcatccaagaagtacttattaaagactgacctggagaacttcttcaattcaattaccccccggatcttctgggaggtggtaaggaagaataccgacttgatgaaggtgtttacatcccaagaagtcaagctggtggagaagcttctgttctggtgtccgtcaaaaactaaaagcggcaaactcattctctctgtgggcgccccaacctcccctaccatcagcaatttttgcatgagtgagtttgacaagcaactgtcccagctttgcaaagtaaaagacatagtgtacacacgctacgcagatgatctgaccttttccacaaatgaagagaacctgctgtttaagattattcccgaaattcagagcttgttgacgaagaacttctcattcaacatcaaacttaaccattcgaaaactgttttcagttcaaaggcccataatagacatgttacaggcgtcactctgtctaacaatgggaagatcagcctggggagagatcgaaagagatacatcaagcacttgattcaccaattcaaacacaatcagctcgatacgtctgaaatccaccacctgaggggaatgctcagttttgccaaacatatagagcctatcttcatcaagcgcctgtctattaagtacaccgacgaactcatccgcaatatatatgaagcgcagctctga

SEQ ID NO: 11285 - RNA, 942 nt, unidentified
  source 1..942: mol_type = other RNA; note = synthetic construct
atgtctgttatcgaactcctggccaagaagttaaataaaagtgagagcgaggtcatgagcttcctgagcgacgctccgaaaaaatacagagtctacaagataacgaagcgttcacacggctacagggttatcgctcaaccaacaaaggaattgaaagattatcagcgcgcctttttaaccctctatacattccccctgcatgaatctgcaattgcctaccgagaagggttgagtatcaaagacaacgctctggtgcacgtagagaatcagtatctgctaaagactgatctggagaacttttttaacagcatcccacccagcgtgttttgggactctttgggctcatgtagtggtgttacccctcacttctccgtgcaggatcaacagtgggtggaaaagcttttgttttggagcccatccaagaaatccaatggaaagctggtgctttctgtgggagctccttcatcccctatgatttctaacttctgcctctttgagttcgatctctcactgtcgtccctgtgcaagaaacaagccatcagctataccaggtatgcagatgacctgacttttagtaccgacgaaaaagacgtgctatacaccatgataccctccgtcaaaaacgtccttttcaataacttcaaggaccacctgaaagtaaacaactccaagacagttttttcgtcccgggcgcataacaggcacatcactggggtgacacttaataatgagggtcagttaagcattggaagagaacgcaaacggtatattaagcatctggtgcatcagttcaaatacaatgagctcgatagctcagacatttcttacctgcagggcctcctcagtttcgccaagcacattgaacccgtcttcatcgagagactgaagatcaagtattctaacgcccttatacagtgtatttacgaggcaaatcatgagtga

SEQ ID NO: 11286 - RNA, 930 nt, unidentified
  source 1..930: mol_type = other RNA; note = synthetic construct
atgtcttttatcgaacggatggccaaagagctaaataagcctcaaattgagatcgaggacttcctcttctttgcacctaacaagtataaggtctattcgatacccaaacgtacccacggctttagaactattgctcagcctactaaagaattgaaagattaccagagggcctttacgtcatgggtggaactcccagtgcacaactgcgcgatggcgtactgccaaggccggagtatcaaagacaacgcttatgctcacaagaagaacgcatacttattgaagttggatctggaaaacttcttcaattccataacaccagataccttctggcgagtctggtcttccaggtggaatcttcctaataagaacgaaagacagtgggtggaacgcttattgttttggaacaataaggagaagctcgtcctgtcagtaggggctccctccagtcccctaatcagtaatttttgtatggtgcagttcgacaaggacctgtatctgtactgtcagtctctgggagttacctatacaaggtatgccgatgacctgactttttccacaaacaaacgaaacatcctgttttcactgcccagcgatatcaatcaattccttgagaagcattttcagagcgacctcaagataaatccaagcaaaacggccttcagcagcaaagcacacaaccggcatgttaccgggattacaattaataacgacggcaagctgtcattaggacgcgagcgcaaaaggtacataaagcacaagatccaccagttcaaactcaatgtgctggatgcctacgagattcagcatctcaagggtcttctttcctttgcaaaacatattgagccgaccttcatcgagtccctggaaaagaaatacagcaagtctctgattgagatcatcttcgaagccaaatacgacgagagaaaatga

SEQ ID NO: 11287 - RNA, 921 nt, unidentified
  source 1..921: mol_type = other RNA; note = synthetic construct
atgacatttattcagcggctggcgaaagagctgaataagtctagagatgaagtggaggactttctgttcttctcaccagaaaaatacaaggtgtacaggataccaaaaagaaagcacgggtttcgcgtgatagcacagcccacaaaagaactcaagacttaccaacgcgcatttatctcccttattcagttgcctgtacatgaatgcgccatggcctattgtaaagagaagagtatcaaagacaacgcagccgcccataagaacaacaagtatctgctgaaactggatctcgagaattttttcaatagcataacccccgagatcttctgggaggtgtgggcctcttttaccagcctgccatctgaggaagaccgaaaatggatggaaaaacttctattctgggacaaacagggaaagctggttctgagcgtcggagccccctcttctcctctgctctcaaacttttgcatgactaatttcgataaggaactgacgtcctattgtaagaagaaagatgtctcctatactcgatatgcagacgatcttaccttctccactaacaaacgtgacgctctcttctcctttcctgctgtgatcagtgagttccttgataagcactttagcagccggttgatgattaaccactcaaaaaccgcgtttagctcaaaggctcacaatcggcatgttacaggtattacgatcaccaatgaagggaagctaagtttgggcagggagaggaaaagatacattaagcataaggtccaccaatttaagatcgagaagctcgatccctacgaaattcagcatttaaagggcttattggctttcgccaaacacattgagccgaaattcatcaagtccctgaacaataagtactcgaaactgctcatcaagaagatcttcgagacaaacgacgactga

SEQ ID NO: 11288 - RNA, 918 nt, unidentified
  source 1..918: mol_type = other RNA; note = synthetic construct
atgaagctggtggggcaactggctcatattctgtccatctcagagcaggacaccttgcggctgatcctgaacgcgccatttaaatacagagtttacaccatccccaaacggactcatggcaggcgagtgattgcccagcccactaaggtggtcaaaaagctgcagaagggttttatctccttgtacaattttcctgtacactcaaggtgcatggcttaccgcaagggactgagtattaagcataacgccgaaatgcacttagataactcctaccttctcaaaatggatctgagcgattttttcaactccctgacgcctaaaattttctggaacacatggaaagagttttggcagctccctgacggcctcgaacaacggttgatcgaatctatcatcttctggaataacaattccattctgacgttatcggtcggtgcaccgagctctcccgctatctctaatttctgcctgtatccatttgatgagaagctcgacaagtattgtatcgaaaagggcattgcctatacccgttatgcagacgacctgacattcagtactaaagagaacaaccttctcttcattctgccaagcatagtgagcggaatgctccacgatatattcgggggcagtctgaccatcaacaataagaaaactgtgtttagctctaaggcccacaatcgacacgttacagggataacaattaccaatgagggatcagcatctataggaagagagcgcaaaaggtacattaagcatctcctaaacaagtataagttcaacgagttgaacagtaatgatatcaatcaccttagagggcttctcgccttcgcttttcatatcgaacccgacttactaaccagcctttcaaataagtacacccacgaactactggagaaattgaaacaggagggcgaatga

SEQ ID NO: 11289 - RNA, 918 nt, unidentified
  source 1..918: mol_type = other RNA; note = synthetic construct
atggagctggtggcgcagttggcccatatcttgtcaataagtgaacaggacaccttacgtctcattctgaacgctccctacaaatatcgcgtatacacaattcctaaaaggactcatgggcgccgggttatcgctcagccaactaaggccgttaaaaaactccagaaatccttcctgcatctatatgactttccagtccatagcaaatgtatggcctaccgcaatggaatttcaatcaaggataatgccgaaaagcacttggagaatccctatctcctgaaactagacctgtcggactttttcaatagtctcacacccaagatcttttggaatacctggcaaaagttccagcaagtgcctgatgccttggagcagagactcatcgagaatatcgtgttctggaacaacaattctaagctgaccctgtccgttggcgcaccgtcatctcctgtcatctccaacttctgcctttattttttcgatgagaagctggaagcttactgcttaaaagaggatatagtcttcactcggtatgctgacgatcttaccttttccacaaaaaagaataacgtgctctttaacctgcccaacatcgtgagtaagtaccttaatgacatctttgatggtgcactgaccctgaataacaacaaaaccgtatttagcagcaaggcgcacaacaggcacgtgacgggtataactattacgaacgaggggaacgcaagcattggacgggagcgaaaacgatacattaagcatttgctccacaagtataaactgaaccaccttaattacaacgacataaatcacctgagaggcctcctggcattcgccttctacattgaaccaaacttcgccacaacattatctaagaagtatactagggaacttctagagaagctgaatgaagaaagaggctga

SEQ ID NO: 11290 - RNA, 942 nt, unidentified
  source 1..942: mol_type = other RNA; note = synthetic construct
atgaagattgtttccgtgctggcaggcgaacttgtggtatcagagcaggaaattctctccatcctccttggggcgtccaagaaatacaaagtttatcccatcccaaagcgaacacacggaattagactgatcgcacagcctacaaaaaaagttaaggtgctacagagggcttacgtcgatatgatgaattttcccgtccattccaacagtgtggcctaccgaaaaggctatagcataaaagataacgcccaattccatgcctcaaatccctatttattgaagatggacctctctaatttcttcaattcaattaccccgaagattttttgggggatgtgggaaaaattgtgggacctgcctgagccactagagaagcacttgatagagaacctcctgttttggaacatagataaaggcagctctatctcgcggttagtgctgagtgtcggtgctcctagctcgcccatcattagtaacttctgcctttatgaattcgacgagctgatgaccaaacattgtatcagcagggatatttactacacacgttatgccgatgacatgacttttagtactaagaaacgcaatgtactgttcgacatccctaactttgtgaagagcctcctgtatgacgtgttcggctcatctatctctgtcaactacaacaagactgttttcagctcaaaagctcataataggcacgtgacaggaataaccctgaccaacgatggcgagatctctttggggcgggagcgcaagcggtatatcaaacacttagtgaacgaatacagatacaacaagctctccagcgaagacttcaattacctgaagggtatccttagcttttccaagcacattgagccaaagtttgtcagatccctgattaataagtacggagaagacgtgatcacctctatatttagtggggatctgaatgagacgtga

SEQ ID NO: 11291 - RNA, 918 nt, unidentified
  source 1..918: mol_type = other RNA; note = synthetic construct
atgaaaatcgtgatggccctcgcccagcagctgaaatatagcgaacccgaattgttgcagctagtccttaaagccccatataaataccgggtctacactatcccaaaaagaacgcacggacggcggaccattgcgcaaccgacaaaatcagttaaggagctgcaaagagagttcttgaagtacaaagtgtttcccttccatgcaagtagcatggcctacagaaagggcatgtctattaaagacaatgccgcctctcattccaccaactcctttttacttaagatggaccttgctaactttttcaattcactcacccctgatgtgttctggtcagtgtgggcggaccattgggagcccctgtcacctctcgagcaccgactggtggagaacattttattctgggataataaaggcaagcttatgctgagtgtcggtgcaccaagcagtcctacgattagcaatttctgcctcttcttttttgacgtggctatcacaaattactgttccggcatagacgtaacctatactcgctacgctgatgatttgacattttcgtgcaatactcccgggatcctgtccaccattccagctttcatctctaggatcctgaaagacaagtacaacgggaaaatctctattaaccaccagaagacaatctttagctccaaggcacacaataggcacgtaaccggtataacaatcactaatgacactaagctgagcatcggacgctatcgtaagaggtacatcaagcatctgataaaccagtataagtataagctgctggacagtgatagcatataccacctgaagggcatgatttcttttgcaaaccatattgaacctgatttcctcatttccctcaagaacaagtattcttcgaagctaatcaacgaaatcattggggttcacaaatga

SEQ ID NO: 11292 - RNA, 918 nt, unidentified
  source 1..918: mol_type = other RNA; note = synthetic construct
atgaagattgtgtcagttctcgctcagcaactaaagtgttccgaaagcgatatcctgaaactgattctgaatgctccctacaagtatagggtatactcaatccccaagagaacacacggacgcagaattattgcacagcctaccaaagccgtaaaggagctccaaaggtcatatcttaagtacaaagacttcccattccatataaacagcatggcttatcgcaagggatttagtattaaggataacgccgaatcgcatcgactgtctgcatatttactgaagatggacttggccaacttctttaatagtctgacacctgacgtcttttgggatatctggcggcagcattgggaacccctgcagagccttgagcaccggctggtggagaacatcctgttctgggataattctggcaaactcatgctgtctgttggggcaccgtccagtcctgccatcagcaatttttgtctgtactttttcgacaatgcggtgtctgagtactgcgagaaaataaacgtcatctatacacgttacgctgatgaccttactttctcgtgcaacgatccaaatattcttcctaccctgcccgaattcataagccgagtcttgaaggaaaaattcagtggcaaaattctcgtgaatcaccagaagaccatcttctccagcaaggcccacaacaggcatgtgactggtataactatcaccaacgatgagaagttatcaatcggccgctacaggaaaagatacatcaaacacttgatcaaccagtacaagtataatctcctcgacgccgagacgatatatcacctgaaggggatgatttccttttctaatcatatcgagccagactttttaaacagcctacggaaaaaatactcctccaatttgatcgacgaaattattgaggtgaacaaatga

SEQ ID NO: 11293 - RNA, 921 nt, unidentified
  source 1..921: mol_type = other RNA; note = synthetic construct
atggaactcataacctctctcgcacgggccatagagaaatcagaacccgataccctcaatctcgttctttctgctccttataggtataggcggtacacaattcctaagagaacacacgggcggagactgattgctcagcctaccaaggaaatcaaagcagtacaaaaggcctttgtgaagattcgaacttttccaatccacccggctgcgatggcttatcgcaaaggagttagtatcaaagataatgcacaggcgcataaactcaacagttacttgctgaagatggaccttaccgacttttttaattcgatcacaccctccgtcttttggagggtctgggaaaaagtgtggcccctgccagagcgtctggagatgttgctgattgaacggatcattttttggtcaaacgaggacgagctaatgctgtccgtgggtgccccaagcagcccagtagtgagcaatttctgcatgtatttcttcgacgattacatctctactctgtgcgaccagttcgacctggtgtacactaggtatgccgatgacctgacattcagcaccaacaaaacgaatctgctgtttgagatgcctagcatcgtcggagccgtccttaagactgagttcaatgatttccttgcaatcaacaagtcaaaaacgatctactcctccaaggcccacaaccgccacatcacaggcattacaattaccaacaacaatgagctgagtatcgggagagaaaagaagcgatacattaagcatctagtgcatcagcacttagtgtgtaaactctctattgaggattccaatcatttacgcggcttgttatctttcgttagccacatagagcccactttcataaaatcactgaagaacaagtactccgaagaaaccatcgacaagctcttgagaggcagttatgagtga

SEQ ID NO: 11294 - RNA, 942 nt, unidentified
  source 1..942: mol_type = other RNA; note = synthetic construct
atgaatttaattacaaaactggcgaaggaactggaaactagcgagcccaatgtgctctctaccgtcgcatctggcccactgaagtacaaagtttactctattccgaagcgcacccgtgggcggaggatcattgcacatccctcaagagagttgaaacaggtgcaaaaggccttcttggcactataccaatttccgatccacagcagcgctatggcttataaaaaaggcgtgtcaatcaaagagaatgccgaatgtcatcggctgaataaatacctgctgaaaatggacttcgagaattttttcaacagcataacccccctcctattttggaaagtatggagcctgaattatccagagcctacattcctggagaaacgagtgatcgagaatattcttttttgggcccctagtatatccgagcgcgacaatttaatgctctctgtgggtgctccatcaagtcccacgatttccaacttctgtctgtatcagttcgacctcattatcaccaagtattgcgatgacaacgaaatcacttacacaagatacgcagacgatataacattctcctgcaacacacctaaggggctgtcgaagataccaaaggccgttagaaagacgctcaagaatctgtatggaacccagatcgaaatcaacaaccagaagaccgtcttcagtagtcaggcccacaacaaacatgttactggaatcactatcactcctgatgggaagctgtccattggccgggagcgcaagaggtatataaaacatcttgtacaccagtacaccctgggcgctcttgaacaagaggatattaaccacttgcgaggtttactctcttttgcgaagcacatcgaagtgtcatttttcaacagcttgattaccaagtactccgccgatgtcatgcttcagatcacaaggggaaacaatgaaaagaacttttga

SEQ ID NO: 11295 - RNA, 939 nt, unidentified
  source 1..939: mol_type = other RNA; note = synthetic construct
atgaaccttctccagcgactgagcatcgaacttggcgtgtctgaatcccacatcttaagtataaccgcgagcggccccttgaaatacaaggtctattctatccccaaaaggacccatggccgacggataattgctcatccttccaaagacttgaaaaagctgcaaaagtccttcataaagctacacaattttccaatccatacaaatgccatggcctataaggagggagtgtccatcaaagataacgcttcttttcacaaaagcaacaaatacctgctgaagatggactttgagaacttctttaattcgataacaccggtcttattttggaacgtttggaaccagcacttccctaagtcatcctacttcgacaagaagattatcgagaacattttgttctgggccccaaacatacacgaaagggagcgtctgatcctgagcgtcggggcacctagcagtccaatgatttctaatttctgcctctttcagtttgactctattctgacacattattgcattgagcggtccattttcttcactcggtatgcagatgatctcacattttcaacggatactccagacctcctgaaaaccctgcctggcgtgatctcaaatctgctgagacagttatatgagggacagatcgagattaataaccagaagaccgtttttagttctcaagcccataacaaacacgtgaccgggatcacaataactcccgaaggaaagctgagtattgggagaagcagaaaaaggtacatcaagcatcttgtacaccagtacatcctcaataagctaaaaagctcagatttcaatcacttgcgcggtctgctcactttctccatgcacatcgaaccccagttcatcacgtcacttgagaacaagtacagcaccaatattattgagaacatcgtgcgcggtattaatgaacaaaattga

SEQ ID NO: 11296 - RNA, 966 nt, unidentified
  source 1..966: mol_type = other RNA; note = synthetic construct
atgtcagtcgtgtcctatttgaccaacagttgccattgtaattcggacgacctgttccggctggcgatcaacgctcctcgacggtacaaggtgtattctattgccaaacgcacctctggctataggactattgcccacccaagcgcagagcttaagaaggttcagtaccagattatatccgcattcagcgaggggaataggcccctagctcagctgagtattcacagccaggctatggcatacaaaaccggagttgggattaaggaaaatgccaagatgcacagtcacaatagctacctgttgaagatggacttcgaacagtttttcaacagcatcactcctgagctcttctggcgttcttaccatgcactgaatcccgaaaccacattaagccgtactgataaaaagctcatcgaccttttcctgttttgggccccgaacaaatatgaccttagcagactggtgctctcagtaggcgcgccatcctcccctctgatctcaaatttctgcatgtaccaattcgacgaactgatccaccgcttttgccatgagaggaaaatcacttacacaagatatgctgatgatatcacattttctacgaatgttcctaacgtcctctttacggtgcccaagaaagtagatgagctgctgaaggagctgttcagtgggttaattatgatcaacaaccagaagacagtgtttagtagcagagcccacaacaagcacgtgacaggagtgaccatcaccccccaaggcggcttgtctctcggtagaaacaggaaacggtatatccgccatttggtgcatcaattcaccttaggtcgactggccactgacgatctaaatcacctccggggactgttgtcattttcccagtatattgagccatcatttgtcctttccctcaaaaaaaagtactcgataccaatagtcgattccatatctcgcggcaggtacgaatgttga

SEQ ID NO: 11297 - RNA, 939 nt, unidentified
  source 1..939: mol_type = other RNA; note = synthetic construct
atggacctcgtaaagaaattagcttccgaagtgggcgtgactgaacgcgaaatcaaagcgttcttatatttggcccctcggaaatacaaggtatacacaattcccaagaggaagtccggggtgcgtgtgattgcccaacctacctctgagctaaaagagttgcaaagaaaatacgtgcagatgatggatttaccgtcacatgagtgttctatggcctataagaagggggtgggcatcaaggaaaatgctgaacggcaccagggaaatacatacttgcttaagatggacctagagaacttctttaactctatcactccagaggtgttttggggtacctggagtaatttttacgctttcccaaccagcatagagaagctttatctggaaaaactcctgttctggtgcccttctaaaaagaactcgaacaaactcatcctgagtgttggagcacccagttccccagccgtctccaatttttgtatgttggtcttcgacaacgtggtcagccagtattgcatttccaagcagatagtcttcactagatatgccgatgatctgacattttcaacccaacagaaaaacgccctgtttgaggttcccagcctcattcagagagtgctgagtgaaatctttggccgaaagctgacaatcaaccatagcaagaccactttttcttcaatggcacataataggcacattacgggtataacgattaataacgacggagagctctcaatcgggcgcgataagaaaaggtacataaagcacctggtcaaccagttcaattacaataaactcgacgagcaggatctttatcacctgcgaggcctgctggctttcgcaaagtatatcgagcccaacttcatcaatagccttaacaagaaatacagctccgacgttatgaacaagctgctgcggggcgggaatgaaaaaatttga

SEQ ID NO: 11298 - RNA, 939 nt, unidentified
  source 1..939: mol_type = other RNA; note = synthetic construct
atggatctcgtgaaaaagttggcctcagaagtcggtgtgaccgagcaagaaatcaaagccttcctacaccttgctccccggaaatacaaggtttacactattcctaagaggaagagcggcgtccgtgttatcgcacagccaacgagtgagcttaaaaaactccagcgcaagtttgtgaagatagtgaactttccaacgcacgagtgttcaatggcctataagaagggggtcggtattaaacagaacgctgaaatccatcaggccaatacataccttctgaaaatggatctcgagaacttcttcaattctattagcccggacattttctggaaggtgtggtctgaatttaatcctctgcctacatcagtagacaagctgtacatagagaagttgttgttttggtgtccaagcaagaagaacagtaataagcttatcctgtccgtcggagcacccagtagccccaacatttccaatttctgcatgtccaaatttgatgacgtggtttctaaattctgccaagacaggaacattatctttactcgatatgccgacgatctgacattttccactaaaaaacgcgacgtactgttcgaggtgccttccttagtccagcacgcgctgtctgaggaatttggaagacggctaaccatcaaccacagcaagaccaccttctcttcaatggctcacaaccggcatatcacagggataaccatcaataatgagggaaatctgagtatcgggagagacaagaaaaggtatattaagcacttggttcatcagttcaagtataacaatctggatgagcaggatatctatcatctcaaaggcctgctcgcattcgctaaatacatagaacccagctttttaggctccctgaacgagaagtactcgttcgaggtgatgaaaaagattatcagaggcgacaacgaagaagtgtga

SEQ ID NO: 11299 - RNA, 912 nt, unidentified
  source 1..912: mol_type = other RNA; note = synthetic construct
atgaagctgctttctgagaagtcaaatttgacagaggatcaaatcagccgaattcttgtgaacggatcccgcaagtataaagtgtacctgattccgaagagatctcacggcaacagagttatcgcacaccccgcaaaaaagctgaagctcctgcagaaggacttcttaaaaatcgtggactttccttaccacgagtgctcaatggcgtacgagaagggcactgggattaaaaagaacgccttcgctcattctaagaatgagttcctcctgaagatggatctagcggagttctttaatagcattaccccaacaatcttttggtcagccttctctaagtacttcaacattacacctaaccatatagacagttacttcgtcaataacctgattttttggttgaaggagggagataaagctgtcctgtccgtaggtgctccctcaagccccaaaatcagcaacttctgtatgttccagttcgatgaaatcgtctttcagtattgcaatgaatcgtttatcacttacaccaggtatgccgacgatatgaccttcagtaccaatgttcgtgagattctatttacgatccctagctttgtggaatcccttttgtttcagctgttcgggaccgcaatagccatcaactacagtaaaaccgtattttcctctaaagcccacaacagacacgttacaggggtgaccatcacaaatgaaggtgccctgtccctgggacggaagcgcaaacggtatatcaaacacctgactcatcaatttgtgacaggcgtgatcgacaaagaaaacatagcacatctcaggggccttttagctttctccaatgatattgaaccaagctttctcagtactctcgacaggaaatatggcccagggataactacgaagattatggagataaagtga

SEQ ID NO: 11300 - RNA, 909 nt, unidentified
  source 1..909: mol_type = other RNA; note = synthetic construct
atggacaagaaggctatttacatagaacgattcttagtatacgctccgagaaagtatcgtgtttacaagatcccaaagaggaaacatggcagccgcgtcattgcgcagccaaccgcagagcttaaaaaactgcaaagagccttcataaaccgctcaaagatccccgtgcatgagtgtgcaatggcctacaaagacggtgtcagcattaaagataacgctcagcttcactcgaccaacacattttttctgtccatggacttcgaaaattttttcaatagcatcactcctgacctgctgtggggcgtgtttaataagtttgggaaggtgatcagtccaaatgagaaactgtggctcagcaaacttctattttggtgccccagcaagaaaaactcaaacaagctcatattgtctgtgggggctccctcttcccctaaagtgtccaacttctgtatgtacttcttcgatgagtatatcagtacttattgccaggatcgcaatatcacctacagtaggtatgccgatgacctctcattctccactaatgagaaggacattctatttcagatccccggcgttgtcaaggaaaccttattgaaactgttcggccgagacatcaccattaataacagcaagacagtgttttcttctaaggcccacaacagacacgtgactggtatcacaattacaaacgagggcgaattgtctctcggacgggagaaaaagcggtacattaagcatctcattttccggtttaaaaacggactgctggatgtttccgacgtgagttacctgaggggaatcctgagctttgccttctatatagaacctgcatttaagacgtccatggtaaaaaagtatacgaaagccaccatcgattcaattttcaatggggtcgatgacgggaagtga

SEQ ID NO: 11301 - RNA, 918 nt, unidentified
  source 1..918: mol_type = other RNA; note = synthetic construct
atgttcattgctacactcgctcagaaaatggggaaaaacgatcgagaaataagagagttcctgattaacgcccccgaaaagtataaggtgttcacaatacccaaaaggaaacatggatatcgaattatcgctcagccttcccgggagctgaaagtctatcagaggcaactcgaagaccttatctcattcccagtacactacagggctatggcgtattgcaaagggcgtagcattaagatcaatgccctccaccacgttaagaattcttacttactgaagttggaccttgagaacttcttcaactcaatcacacctgacatattttggaaagtgtggtcgaagacatgggatcttccctgtgacgaggatcgcatctacatcgagaaactgattttttggagattccagggtacgctgagattgtccgtcggagccccatcttccccactcgtaagtaacttctgtatgtactatttcgatgagaagatcgaggagatctgcttgaacaataaggtcagcttcaccaggtatgcagacgacttaaccttttctagcaatgtgaagaacatcttgtttgagattcctcggctggtgcaggatactctcgaaaatcaattccacactggctttagcatcaatacctctaagaccatctttagttcacgcgcacacaatcgtcatgtgactggcatcaccctcgataacaccggtaaaattagtctaggacgggaccgcaagagatacataaagcataaggttcatcattacacgctgaatattctggacgaggacgaaatcaaccacctgcggggcctgattgcctttgccaaatacattgaaccggtgttttttcactccctggaagccaagtacactgcaaacatgatgagcaaactacttgaagggaaggatgagtga

SEQ ID NO: 11302 - RNA, 915 nt, unidentified
  source 1..915: mol_type = other RNA; note = synthetic construct
atgtttacagaagctttcgctaggaaaatggggcgagatgagctggaaatcaccgagtttttaatgaacgcccctgacaagtataaggtctacgccataccaaagcggaagcaaggttaccggattattgcacagccctcgagagagcttaaacattatcagaggcagctccaggattttatcatatttcctaagcacaagtgtgcgatggcgtacaggaagggactgtcaatcaaaaacaatgccttgtcacacgtgaataacagttatctacttaagcttgacctggagaacttcttcaattctatcactccagatctcttctggtctgtctggagccgaacttggtccctgccaagcaaggaggaccagcttttcctcgagaaactaattttctggcggttccagggcagtctgatactgtccgttggcgccccctcctctcccagtatctccaacttctgcatgtattattttgacggggagatcgaggcaatctgcacgaaaatgaaaatcacgtacacaagatacgctgatgacttgacctttagcagcaacgtgagaaatattctgtttgaaatccctgtgctcattgagaacattctgaacgaacagtttaaggggctgctccggttaaattcaagtaagactatattctccagcaaagcccataataggcatgtgaccggaataaccttgaacaataatggcaagattagcctcggacgcgatcgcaaaagatacattaaacacaaggtacacctgtataccctcggtatgctggacgccacagaattaaaccacctgaaaggcatgatcacttttgcacgcttcatcgagccggcttttttcaagtcattggaaaccaagtacaactctaatgttatcttccgtctgacacaagaaaaaatttga

SEQ ID NO: 11303 - RNA, 906 nt, unidentified
  source 1..906: mol_type = other RNA; note = synthetic construct
atgttgctgagcgcgctggcccagaaaatgggcatttccgaagacgtggctgaacagtttctgatcaatgctcccgagaaatacaaggtgtatagcattcctaaaagagggatcggattccgcttaatcgcccaaccatccaaggagctcaaggtttatcagaagacattgcttaatctgattgtgctgccaatcaacgataccgcaaaggcttatcggttaggtgaaagcattaaaagtaacgctctcattcacagcggaaacgcctatttgctgaaaatggacttggaagatttcttcaattctattaccccagacgttttttggtcagtatggcagagattttgggagctccccgatgagtacgatatgtccgtcatcgaatcagtgactttttggaagaaggataattcgcttgtactgtccataggcgcaccttctagtcccatgatttctaacttctgtctcttctttttcgacgaggagataaacaagttctgcgtcaagaataacattagctactcacgttacgccgacgacctgactttttcgacaaatattaggaatgtgctcttctccctaccgaaactgatcgccaaggtgctcaaggagaacttttctggggcactaaaaatcaaccgaggtaaaaccatctttagttctaaggcacataacaggcatgtcacaggcatcaccttatccaacgacggaaaaatatcactggggcgggccaggaagcgctacataaaacacaagatccaccactataagctgggccttctcgacttcgatgagattaatcatttgaagggccttatagcgtttagcaaattcatcgaacctctgtttttcgaaagcctggagatcaaatacagtaagatcacgcttatgaaactgatggagtga

SEQ ID NO: 11304 - RNA, 933 nt, unidentified
  source 1..933: mol_type = other RNA; note = synthetic construct
atgggagtcatcgacaagctggcaaataagctgaatttcacgaagaaagatgtggcttttttcctcttcgatgcccccaagaagtataaagtgtacaacattcctaagagaagtttcggacaccgcgttatagcacagccatctaaggagctgaaagaataccaaagaacctttctggagctataccagtttcctcaccatgctaactccatggcctatagctccggcaagtccatcaaggataatgcggaggtgcaccggaaacagcgatacttgctcaagatggatctagaaaacttctttaacagcattactccagaggttttttggaatgcgtggggcaagtttaaagccctgcccgatgacaatgacaaggagtggattgaaagactgcttttttggcagccccgctcgacccgaagcaatgacctcaaactctccgtcggtgcaccaagctcaccgtccatatctaatttctgcatgtatctgttcgatgaagtcgtgacagagcattgtcagaaggaaagtgtgtactacacaaggtacgccgacgaccttactttcagtacaaacaagaaagacatcctgtcaagcatccccagtgtgattaaaactaaacttaaggagtgctttgaccacaggctggtaatcaatcagcggaaaacgaaattctcctctaaagcccataaccggcatgtaaccggcattacaatctctaacgatgagaagttgtcattagggcgggagagaaaaaggtatatcaaacacttagttcaccaattccagttgaacaagcttgaccagaaggatattcgccatttgcaagggctgatagcttttgcccgtcacatcgaacctatgttcataagctctctcaccaagaaatattcagaaaccctgatccagaggatcattgaagctcacaacgagtga

SEQ ID NO: 11305 - RNA, 930 nt, unidentified
  source 1..930: mol_type = other RNA; note = synthetic construct
atggacactgctgactttctttctaagctgacaaataagagccgttcaagcattgtagatttcctaaggctggcaccaaataagtatcgagtctacactattccaaagagatcttatggctatcggacaattgcacatcccactgccaatctcaaatttctgcaaagaacattctcggaaaacttcgcctttcccacgcacgccgctgctcaagcttatatatccggaaaagggattaaatccaatgcaactcagcacaagaacaattgctacctcctgaaactggacctggaagactttttcaactccataaaacccgacctgttctggggagtgtgggataaggccttccaggagcttcctagtcctgcctccaaagagatgttggagcagctgctgttttggcggccttcccggcgcatcggacataccttggtcctctcagttggggcacctagctctccagccatcagtaacttttgtatgtacttcttcgatgtggcgataacgaatatatgcgagctgctggaggtgaaatacaccagatacgctgatgatcttacatttagcaccaatcagaagaacattctgttcgaactcccggcattaatcgagtcgacccttaaggaagagttcagtctacagctcaacatcaacaagaagaaaaccaaattctctagcaaggcgcacaaccgccacgtgacaggtgttaccatcaccaacgacagcaccctttccctcgggaggtcacggaaacgctacatcaagcacctggtgcatagagccactctgaagcagttgaacacagacgagctcaatcacctgattggcttgttatcatttgctcatgatattgaacccgactttttaactaggttggatgccaagtatggtgacggcagtatccagcgaatcaggagctctatctga

SEQ ID NO: 11306 - RNA, 939 nt, unidentified
  source 1..939: mol_type = other RNA; note = synthetic construct
atgagggagattattaagtacgcagacagtctggaaatttcagtggagaacctgcagatatttctacttaatgccccgaagatgtacaaagtgtacaagatacttaagcggacccatggatatcgagtcatcgcccagcccgctaaacaactgaaggagtatcagaggaagttcatcaaaatcttttcccagtacttggtggtacacgaatacgcgatggcctatcagaagaataagaacattcagcagaacgcagagatccacaaaaataatagctatctgcttaagatggacttcgagaatttcttcaactctatcacacctgctctgttctggaatgagtgggaaaacattaaccccgatatcttcgacgaaaatgagaagaatctcttctcacgcctcctcttttggaacccaaatcgaaaacggactcagcgcgaaaatttaatactttcgatcggggccccaagttctcctttgattagcaactttgttatgtaccggttcgataaattgatcacccagtattgtctggacaaaaatatcaactacacaagatatgctgacgatttgacattctccaccaacattaagaacattctataccagatacccgtcgaagtgtctaagaacctgaacttactctttggtaataagctccgcatcaacaatagcaaaaccgtgttttcatccaaggcccataacagacacattacgggcataacaatcactaacaacaataagctgagcctggggagggagaggaaacgttatatcagagccctggttcaccaatataagtacgcacaactcgaaaaagctgatattcagtacctgaaaggactcttaaacttttgcaaatccatcgaggtcagttttattcattccctggcgcaaaaatacggcaatgaaactctgaagaatatcatgaaggagtga

SEQ ID NO: 11307 - RNA, 939 nt, unidentified
  source 1..939: mol_type = other RNA; note = synthetic construct
atgcaggcttttctgaagttcgctgagagcctgaagatcagtgcaagagaactcgccatatttctgcataatgccccgaagatgtacaaggtttacaagataccaaaacgtacacacggctaccgcgtgatcgctcagcccactaagcaactgaaagaataccaacggaagttcattgaaattttctccactcagatgccagtgcatgagtatgctatggcgtaccagaaaaacaaaaacatccaacagaatgccattttccataaagacaatagctatctcttgaagatggattttgagaactttttcaactccattactcctgccatcctttggaatgagtgggaaaagattaacccaggggtcttgaacataatcgagaaagacttcttctctcgactactgttttggaatcccaatatcaagcgaaagaagcaagagaaattaatcctcagtattggggcacctagtagcccctccgtttcaaattttgtcatgtacgggtttgatgacctcattacccagtactgcaacgctagggagataaagtatacacgctacgcggacgatctgaccttctccaccaactctaaaaacatcttgtatcctattcccgccgaagtggataaaaccctgaaattactttttggtcacaatctgagggtaaacaatggtaaaacggtgttctcgtcaaaggcacacaatcggcacattaccggaatcacaatcacaaataacaataagctgtctctgggcaggaacagaaaacggtacatcagagcactcgtccaccagtatcagtgcgcccagctggacaaaaacgatatccagtatctaaagggccttcttaacttttgtaagtcagtggaaattgccttcataaagagcttgatgcgcaagtatggagaggagatcatcgagaatattatgaaagaatga

SEQ ID NO: 11308 - RNA, 939 nt, unidentified
  source 1..939: mol_type = other RNA; note = synthetic construct
atgaaaaacataaccaaatatgcaaagagcctagacttaagtgtagagaatctgcaagagttccttttaaatgctccaaagatgtacaaggtgtataagatccttaaacggacttatggttatcggactattgctcagccgactaaacagctcaaagaataccagaggcagttcaccaacctgtttacccagtacctgccagtccatgactgcgcgatggcttaccagaagaataagaacattcagaagaacgccgagatacaccgtaacaatagctacctgcttaagatggatttcgaaaacttcttcaacagtatcacccccgacctcttttggtccgagtgggaatcagcaaattcagacatgctcgacaaggatgaaaaactcctttttagtaggttgctgttctgggaccccaatatcaaaaaaaccaagcaggagaatctgattctcagcattggagctcctagctctcccctgatctccaatttcgtgatgtacagatttgatgagctcatcaaggaatactgtgtgtgtattgaggtcaattatacaagatacgccgatgatctgaccttttctacgaataagaagaacattctgtacacgatccctgcagaggtgaataagaacctgaaaaacctgtttaacaacaagctacgcgttaacaattcaaagacaatcttctcctccaaagcccataacagacacataacagggatcaccatcacaaatgacaacaaactgtctctcggccgacaacgcaaacggtatattagggccttggttcatcagtataaatacactcaactggaaaaagacgatatccaatacctgaaggggcttttgaacttttgcaaaagcgtggagatttcgttcatacactctttggcccacaagtatggctatgaggtcttaaagaatatcatgaaggaatga

SEQ ID NO: 11309 - RNA, 933 nt, unidentified
  source 1..933: mol_type = other RNA; note = synthetic construct
atgaatatcatacacttattggctcgttccctgaacgaggacgacattactattaagaactacttagcgaaagcaccactgaaatataaggtatttgctattcccaaacgcacccatggccatagaatcattgcacagcccgcgagagagctaaagcgataccaaagggcttttatcaactacatcgaattcccaatacatgattgtgcctccgcatacattaagaaccggagtataaagaacaacgccgagcaccataaagaaaactcatttctcttgaagatggaccttgaaaatttcttcaatagtatcacccctcagatcttctgggatgcctggcgcgagaattttcccctaccggacaaagagcaaatgtattacttcgagcgcctgctgttctgggatgtgggcaataatgaactcgtcctctctgttggagccccatcatcacctatggtgagtaatttttgcatgtatctcttcgattccacaatatattcgttttgcaagagcaggtctataacatacacccggtatgctgatgacctcacttttactacgaaccttaagtcaaacttgtttgacatccccaacgagatccaggtgatcctgaagaataacttctccgaccagattaaaattaaccggagcaagaccaagttttctagcaaagcccacaataggcacatcacgggcattacaattaccaacgataataagatcagcatcggaaggaatagaaagcgatacattaaacacctgattcaccagttctccatatctaaaatggaacagtctgacctttatcatctgaaaggtctgatcagcttcgccatgtatattgagcctgaatttttcaatgcactgacaaagaagtacgggagcagtatcatcaattgtatcatgtccaacaacaatgggaaaaacaattga

SEQ ID NO: 11310 - RNA, 939 nt, unidentified
  source 1..939: mol_type = other RNA; note = synthetic construct
atggagattataaaaaacctgagcaagcatctgaatcggaccgaaagccatatcaagtcgtatctgatccaggctcccaacaaatacaagatttatacaatccccaagaggtcccacggggtgagagtgattgctcaccccgcaaaagaactgaaagagatccagtatgcttttctctcaattctcaagttccccgtgcacgaggccgcaatggcctacgtgccacagaaaagcataaagacaaatgcgcacgcccacaagaacaatcagtttctacttaagatggacttcgaaaatttcttcaacagtatcaccccaaatattttctggtaccattggaataatgcctttcctgtaatcgatgcggaagagcggttttggattgagagaatcattttttggaacaacaaggacctcaaatcaaacttgacactatccgtcggagcacctacaagtccaaccatcagcaatttttgcatgtacagttttgatgaggaagtcacaaaatactgtcgcgaaaaagatattacctacacaagatatgccgatgaccttactttcacttctaataccaagggaatcttgtttaacctgcctaagcatatcgacaaaaccctgaagaagctgttcttttctgctatcaacatcaacaacaagaagactaagttctcctcaaaagcccacaatcgacatattactggtattacgataaccaacgacgaaaaattatctattggccgcaaaaggaaaaggtacattaaacacttggttcacatgtatgttctcaatttactcgatcggaatgacttcgaacatctgaagggccttctgtccttcgtgtacgatatcgagccgacttacatataccgtctggagaagaagtatacgaaattcatcatagacaacatcaaggaggggaaatatgagcaaaagcactga

SEQ ID NO: 11311 - RNA, 945 nt, unidentified
  source 1..945: mol_type = other RNA; note = synthetic construct
atgtcaaatatagatgtagtgaagcagctcactaagcactattccaagagtcccaaagagttgtttgtgttctttgtggatgcgccccgcaaatataaagtctacgagataccgaaacgtactagcggcaccagaattattgcacagccaacacccgaactaaaagattatcagcggtttatcatctccattctcaaggatcacctgccaacgcatgagtgcagtatggcctatatccaggggaaggatattaaacaaaacgctcagatgcatagtaagaacagctttttcctgaaaatggacttcattgacttctttacttccattacacctacccttttctggcatgcttgtgaaaggcaagagctcaattttgactggctggataaagaactgctggaaaaggtcttgttctggaggcctagcaaatattctaagaagcttgtgctcagcatcggcgcccctagctccccatacatctcaaactttctgatgtactccttcgatcaagagctgaacaattattgcaagcagaacggcataacatacacgaggtatgccgacgacctgaccttttccactaagaagtcgaaagtgttattcgacattcctgaatgtgtacgcaagtttctgatcaagttctacgggcagaagattcagatcaatcacttcaaaaccgttttctcttcaaagaaacacaatcgacatgttacaggactgaccatcaccaatgactcaagcataagtattggacgggccaaaaaaagatacatcaagcacctcgtccacagattcgtgaaagagaacatctctgtcgaggaccttaattacttgaagggttacctaggatttatccagtatgtggaacccaactttctgtactctttagagcggaagtacaccatctctataatcaacaagattcgagcagggcgcggtgtttga

SEQ ID NO: 11312 - RNA, 939 nt, unidentified
  source 1..939: mol_type = other RNA; note = synthetic construct
atgtcaaatatcgatgtggtcaaacagctgactgaacattatagcgagagtcccaaagagctgtttgtgtttcttgttgatgcgccccggaagtacaaggtgtatgagatccccaaaagaacgagcggtactcgaaccatagcccagcctatacctaaattgaaggagtaccagcgtttcgtgatttccatacttaaggattaccttccgacacacgaatgttcaatggcctatctcaggggcaaggatattaaacagaatgcccaaatccatagcaagaattctttcttcttgaaaatggacttcatgaacttcttcaatagcatcactccaactctgttctggcacgcatgcgaacgccaggaaattaactttgactggctggacaaagagctgttggagaagattctcttctggcgcccaagtagatactccaaaaagctggtcctttccattggagcaccttcaagcccttacatatccaactttctgatgtacagctttgaccaggaattatccaactattgcaaccagaatggtatctcatatacgagatacgctgatgacctcacctttagtacaaataagtcggagatcttattcaacatccccgagagggtacggaaactgctgatcatcttgtacggccaaaaaattcagattaaccaattcaagaccgctttttcttctaagaagcataaccggcacgtcacagggctcaccattaccaatgagaattctgtgtctattggccgcgcaaagaagaggtatataaagcatctcgtacacaagagtatcgaggaggaaatttccgttgaaggactgaactacctcaaaggatatctagggtttatccagcacgtggagccaaaatttctgatggctctagaacgaaaatacacagaagccgttatcaagaagatcaggctggggtgttga

SEQ ID NO: 11313 - RNA, 939 nt, unidentified
  source 1..939: mol_type = other RNA; note = synthetic construct
atgagccgcgtggagatcctagaaaagctgaaactcaaattcaacaagacgcccctggaactctttcagtttctggatgatgccccacgtaagtacaaggtgtatgagattcccaaacggactagtggaaccaggatcattgctcagcctatttccgagctgaaagattaccagcggtttgtcattagtatattgcagaccgatctcctgcttcacgactgttgtatggcctatgtgaaggggaaagacatcaagaagaatgccgaagcgcactctcaaaacagcttcttcttgaaaatggacttcatggactttttcaactcaattactcccagtctcttttggcatgcttgcgagcgccagaacattgattttgactggttcgataaagaactcctggagaaaatcctcttttggaggccgtcaaagtattccaagaagctggttttaagcatcggcgctccaagctcgccattcatcagcaatttccttatgtattcctttgacaacgagatctccgacttttgccgaaaaaataacatcacctacacaagatacgccgatgatttgactttctctacatccaatgcactagtgctgttctcagttcctaacttcgtcaagaaagtgttactgaagatctacggtcagaagatacagatcaatcagttcaaaacggtgttctctagcaggaaacataacagacacgtgaccggcctgacaataaccaacgagaattcagtatctattggccgggcaaaaaagcgatatataaagcatcttgtccacgcttttattgaacaaaaagttgacccccaagacttgaattatctgaagggatacctggcctttatacaatacgtagaacctaagttccttaacagtttagagcagaagtacacagcagccgtcatccaggagattagaatcgggaattga

SEQ ID NO: 11314 - RNA, 948 nt, unidentified
  source 1..948: mol_type = other RNA; note = synthetic construct
atgtccaacattgatgtgacgcaataccttatagaacaccatatggagatccataagtccaaagagggtttcgagtcattcattaagggcgcttccaggaaatatcgcagttatgaaattcctaagcgaactagtggtacccgaaagatagctcagcccatgcgccagctgaaagattatcagcgcaccatcgtgactatattcgagacaacgtttttgatccacgactgctgcatggcatacatgaaaggaagagacatcaagaccaacgccttaattcatagcgggaattcctttttcctgaagatggacttcaccgatttttttaatagcattaccccaaagctcttcttcgaaggctgcgagaggcagaaaatcgacctgaattgggccgataaagagacgctggaaaaaatcctcttttggtgtgaaaacaagtattctaaggagcttgttttgagtatcggcgccccgtcttcgccctttataagcaatttcgtcatgtatagcttcgatgaggtgctaaacgagtactgtaaaaagaatgggattacctacactcggtacgcagacgatttgacattttcaacctctacttccgggatcctattttctgtcccagacatcgtgaggggaacactgcttcaattttacggtacaaagatccagattaaccagtttaaaacagcgttttcatcaaaaaagcacaaccgtcacgttaccggcctgactatcacaaatgacaataacatcagtatcgggcgggaaaagaagcggtacataaagcacctcgtgcataatttcattgaggagaagattacactggaagacctgaactatctgagaggctacctgggattcatcaaatatgtagagccttctttcttaatcagcctcgaacagaaatacactcagagcgtcattcaaaagattagactcggaaactga

SEQ ID NO: 11315 - RNA, 939 nt, unidentified
  source 1..939: mol_type = other RNA; note = synthetic construct
atgtctcgtatggacatcgccgggcatctaactacacattattctaaaacacctcaggagctttttgtgtatcttgtggacgctcctaagaagtacaaagtgtatgaaatcccaaagagaacttccgggactcgaacaattgcccaacccacccccgagctcaagaagtaccagagcttcgtagtgagcatactgaaagagtatttacccatccataattgctgcatggcctacacagacggcagaaacattaagcagaatgcgcagattcactcacgcaattccttctttctcaaaatggacctgatggatttcttcaacagtatcatacctaagttgttgtgggaggcctttgagagggaaggtgttcaattagattggctcgacaaggagttcctcgaaaaaatcctgttttggaaacggagcaagtactctaaaaagctgatcctgtcaatcggtgctcccagttccccgttcatctccaacttcttgatgtatagtttcgacaaagttctggatgaatactgtgaaaacaatggcatcacctatacgagatacgcagacgatctgacattctccaccaaagaaaaagatgtcctgtttctcattccagatgtagtccgagaaactcttgtgaagttttatggacagaagattaagatcaaccacttcaagaccgctttttcgtctaaaaagtacaacaggcacgtgacgggcattactatcaccaatagcgacgagatctcaattggcagggcaaagaaacgctacattaaacacctagtgcacaagtttgttgaggaacgcatctcactcgatgacctgaattacctgcggggatacttgggatttataaaatacgtcgagccaaagttcctgataagccttgagaaaaagtatacccagaacgtcattgagaagattcggatagggaattga

SEQ ID NO: 11316 - RNA, 948 nt, unidentified
  source 1..948: mol_type = other RNA; note = synthetic construct
atgtctaaagttgacatcatcgagtacctgatgtctaaacaagtccacaacttcgactccaaaatggattttttcaagtttttcggggaagcacctaagaaatacaaaagatatgagatcccgaaacggacaagtgggacacgaacgatagcccagccaatccgggagctgaaagattatcagcgagctctgattgatctcttccaggggtacttccccgtccatgatagctcaatggcttatgtgaaaggtaaagacataaagaggaatgctgaaatccactcccagaacatctactttctgaagatggacttcaccgattttttcggcagcattacacccaagatattttggaaggcgtgtgagcgcgccggtatagaattcgattggcttgaaaaagagattatcgagaagacgtttttctggaagccttcgaagtacagtaataaactggttctctcaatcggcgcccccagctctcccttcatttctaacttcatcatgttttccttcgactgcgagattgcccagtattgcgaagagcaggggatcacatacaccaggtacgcagatgacatgacttttagcacaaacactccaaatttactctttagcatgagtgataccgtgcgcaatgtgttaatcgagttttacggaaacaccatcaagatcaatcacttgaaaactgtcttttcatccaagaaacataacagacacgtgaccggaattaccatcaccaacgacgacgaactgtcaattggcagagcaaaaaagaggtatattaagcacctggtgcataagttcatcgaagagaagattagcctggaggacctatcctatcttcgcggatacctcggctttattaagtatgtagaaccgaacttccttattactttggagaagaagtacactcagaatgtaattcaacggatacgtgtgggcaattga

SEQ ID NO: 11317 - RNA, 948 nt, unidentified
  source 1..948: mol_type = other RNA; note = synthetic construct
atgtccaaggtcgacgtcattgagtacctcatgtctcaacagattcacaacttcgattccaagatggatttcttcaaatttttcgatgaggccccaaaaaagtacaaacgatacgagatacctaaaagaacttcaggcacccgaacgattgctcagcccatcagggagctgaaagactatcaacgtgccctgattgacttatttcaggagaactttcccatccacgccagctctatggcatacgtgaaaggaaaggacattaagaagaatgccgaagtgcactcacagaatatttactttttacgcatggacttcacagactttttcaactcaataactcccaaaatcttctggaatgcatgcgaaagagctggaatcgagtttgattggctcgaaaaagaaattatcgagaagaccatcttctggaaacctagcaagtacagcaataacctggtattgtctataggggccccatcgagtccgtttatcagtaacttcattatgtactccttcgataacgaaattgcgaaatattgtcaggaacggaagatttcttataccaggtacgctgacgacttgaccttcagcactaagttgccaaatgtgctgctggatctgacccgggttataggcaacacactcatcggctttttcgggaacgctattaagatcaatcatctaaaaaccgcgtttagcagtaaaaaacataatcgccacgttactggtatcacgatcacaaataaagatgagctcagcataggcagagccaagaagcggtatattaagcacctagtgcataacttcatagaggaaaagatctcacctgacgatctgaactatcttaggggttatctggggtttatcaagtatgtggagcccaagtttctggcatcccttgaaaaaaagtacacacagaatgtcatccagaagatccttctcggatcctga

SEQ ID NO: 11318 - RNA, 948 nt, unidentified
  source 1..948: mol_type = other RNA; note = synthetic construct
atgaagaatcttaatatcctgaaatctctggaggaaaaattcagcataccccagcacgaactgcaggagtttattaaaagctcccccagaaagtacaaggtgtatcagattccaaaaaggtcatccggaacccgtactatcgcccaacctaccgcagaactgaaggaatatcagcggcacctcgttagtatttttagccctatactgcctgtacatgagacatctctagcctatattaaggggaaatccatcaaagataacgcattaatacactgcaaaaacagatacttcctcaagatggacttcgccaatttttttaactccatcactccgaacatcttttggaactgttgggaagaatccaagaaccagaataaaatcaatgacctcgacaaggagatccttacaaacctcatattttggaagccatctaagtatcagaagaatctggtcttgtctatcggcgctccttctagcccacttatcagtaacttctgcatgtacaaattcgatattgctctgtcagagatatgtcacaagaagaatatctcctacactcgctatgctgacgacctgaccttcagcacagagtatgccaatattttatttgatctccccctgattgtgagcaaaattttgatggatctgtatggcgggtcactggaaataaatcatttgaaaactgcgttctcgtcaaagaagcataaccgacatgtgacgggcatcaccatcaccaatgaaggtaagattagtttaagccgcaagaagaagaggtacattaaacatctgatccacaagttcatctttggatctatcgagatcaacgagctcacgtacctgaaaggttacttctcgtttattcaacacattgagcccgacttcctaagtaggttgaaatccaaatactcagatgagacaattaaccttatccggagcatggagctctga

SEQ ID NO: 11319 - RNA, 942 nt, unidentified
  source 1..942: mol_type = other RNA; note = synthetic construct
atgaacaatctgaacatcctcaagattctagaagagaagtttgatgtgcctcagcacgagctgttagagtttattaaatcctcaccacggaagtataaggtgtatcagattccgaagcgtaccagcgggacccggactatcgcccaacccacagctgagttaaaaaagtatcagaggtacctcgtgtccatattcacacctatcttgcccatacataaaaatgctttcgcctacattcagggaaaatcgatcaaggataatgcattagtccacagctcaaattcatacttcctcaagatggatttctctaacttcttcaactccatcacccccaatattttctggaatttctttgaggagacgaacgtcaagttttccggcctggaccgaattctgctgtcccaccttttgttttggaagccttccaaatatcagcagaacctggtgctgagtattggcgcaccctcttccccactgatctctaacttttgtatgtacaagttcgatgtggtaatcagtgagttctgcaagaataacaacatcaactattctcggtacgccgacgacctgaccttttctacaaacattgcgaactcgctctataatctgccacttatcgttagcaaatcactgaaggaactgtacggaaacagcatcgaaattaatcctttgaagacgagtttcagcagtaagaaacacaatagacatatcactggtatcaccataactaacgacgggaaactttcactctctaggaaaaagaaacgatacatcagacatctaatccacaaattcatgatgaagagcattgagactaatgaattgcagtatctccgcggctacttttcctttatacaacatgttgaaccagactttcttagtcgcctgattagcaaatacagcgaagagacaataaggctgatcagactcatggaaaattga

SEQ ID NO: 11320 - RNA, 939 nt, unidentified
  source 1..939: mol_type = other RNA; note = synthetic construct
atgtctattctggaacacctcatatccaatacctcatattctcggaaggacctgttagagtttctcgaaaatgctccccgcaagtacaagatttaccatattccaaaacggacatatggcttcaggacaattgcacaacccataccggaactgaagaatctccagcgaataacgatcaaattcttggagaacgagttacctatccataatagcgctgctgcctacattaaagggaagtcaataaaacacaacgcactcagtcactgcaagaacaagtatttcctgaagctggacttcgagaatttctttaactccattaacaccactgtgttttggaagatgtgggatagttatacaaatgtgcaggttcctactcaggataagacctacattgaaaacctgctgttctggaggccatctaagacctccaaaaagctaatattaagcatcggggccccatcatctccctttatcagcaatttttgcatgtacgagtttgatcaggccgtggaagagatttgtctgaagcataaagtgacatacacccggtatgccgatgacttgacattttccactaatactaaaggagtcctttttgatttccccaaatatatcaacagcatcctccttgacgtatacgacggccaacttcgcttgaactcgttgaaaacgaaattctcaagtaaagcgcacaacaggcacgttactggtgtgaccatcacaaacgacaaaaaaatttcccttggaagagcaagaaagcgttacatcaagtcactgatcttcaagtacatcaatagcaacatcgatctcgaggacattagcaaactgaagggcctactgtccttttcttatagtatcgaacctaccttcatcctgtctctgaagagtaagtacagcgccgaggtcatcgacgagattttcgaaaagaccaaatcctga

SEQ ID NO: 11321 - RNA, 939 nt, unidentified
  source 1..939: mol_type = other RNA; note = synthetic construct
atgtctattctggaacacttggtagaaaactcctcatactccagccaggaacttattgagtttctggataatgctccccgcaagtacaaagtgttccatattccaaaacggacatacggctttcgcactatcgcacagcctatcccggagttaaaagatctccagcggatcgctatcaagtatctcgagaaccagttgcccgtgcataagaatgctatggcctatctcaaggggaaaggcattaagcagaacgccaccaagcactgtaagaataaatacttcctgaagctggacttcgaaaacttcttcaatagtgttaacaccacagtgttttggcagatgtggagtctgtacagcgagttccaaatacctcttcaggagcaagccatcatcaataatctgctgttttggaggccttctaaaacgagcaagaaactcgtcctgagtatcggtgccccatcatctcccttcatttccaacttctgcatgtttcagtttgacgaagctataacagagctatgcctgatttatgatgtgacctacactagatatgccgacgacctgacattcagcactaacaccaaaaacgttctctttgattttcctaaacacgtgaccacgatattgctgaacatctaccagggacaattgcgacttaattccctcaagacaaagttttcaagcaaggcgcataatagacacgtcaccgggatcactatcaccaacgataaaaagatttcccttggcaggtcgcgtaaaaggtacattaagtctcttgtctacaagtatatggcatctgagctggacaatgaaaacctggcaaagctgaagggattgttaagttttagctattcaatcgaacccactttcatcttagcgctgaaactcaaatattccgccgagataattgacaaactattcgagaagacaaagccatga

SEQ ID NO: 11322 - RNA, 927 nt, unidentified
  source 1..927: mol_type = other RNA; note = synthetic construct
atgggaataatctcccggatggctgtgcgccttaatatgtctgagccactgctcgtgagtcatctgaacggtggggccaggaaatataagctttttttcatccccaagaagagagggggcaagcgggctattgcccagccttcgaaggagatcaagtttctccaacgtgtctttttatcagccgtgcatctgcccacttccaacttcgtctattcctacaagcaggggaagaacattttccagaacgccagcctgcacaaaggcaacaagtactttctaaagttagacttcgataacttcttcaacagtattacgccaagaattttctgggaacaatggaaactggcctttcctgaacagaactacttaaatgcagtggacaaaatctgtctggaacagctgttgttttggcaaccctctgcttataaatccgatttggttttgagcgttggcgctccgtcttcacccgcgatatctaatttctgtctgctgagcttcgacaacgaaatccattcatattgctatcaaagaggaatcacttttagccgctacgccgatgacctcacattctctaccaatgagccgaatgttctctacgaggtgcttccttttgtgcaggaactgctgactcagaaatttaatggcgcaattaggctcaatccaagcaaaaccgtgttcacaagtaagaaacacctttgcaaagtaaccggactgatcatcacaccagaggggaagataagcatcggtaggaataacaaacggtacataaagcacttgacctttgagtacctgcagggccgactagaggaggaagatgtcatgaagctgaaaggattcctgtcgttcgcaaagtcaattgagcccagctttatccactcccttcagaagaaatatagtcctgtactcttgtccaagctcggtatttga

SEQ ID NO: 11323 - RNA, 930 nt, unidentified
  source 1..930: mol_type = other RNA; note = synthetic construct
atgtgcctgatagatgacttagtgactgaattttcaaagagcaagaacgagattcttgaatactcttttgtggcaccgaataagtacaaggtgtataagattcccaaacgcaagaccggagagcgtgtgatcgctcagccaacaaaggagcttaagtcatttcagaggtacattgtcaataagaaactaaacatcctgcctatccataactgcgcctttgcttacgtgaaactgaaaaacatcaaggagaacgccaatcaacacaagtccaattcatacttactgaacatggatttggaagacttctttaattccattacccccagcttattctggaaagtctggggtaggattctgatcaatctgcccgaccttgaggatcggaaactttatgaaaacttcctcttctggaaaccaaagaaattcagtaacaaactgatcctaagcataggcgcaccatcctcgcctttcatttctaactttatcctctacgagttggatgatttcttgttcgaattctgtaagatcaactctattacgtactctagatatgcggatgacctgaccttttccactaacataaaagatatcctcttcagcattcctaatgaagttgaaagtaagatcctggaactgtacgagggcgccattaacctgaatacatccaaaacctactttagctccaaagcccgaaatagacacgtgacagggctggtcttgagtaacgacggaaagatcagtattgggagaagcaagaagaagttcgttaaacacttgatctttcagtatatgctcaacaggctgaatcatgaggagatacttttcctccggggctatctcaattttatcaaagacgtagagcccgagtatatatctatcctcaagcggaaatattcagacaatctgatcctgcgcattatggtagactga

SEQ ID NO: 11324 - RNA, 939 nt, unidentified
  source 1..939: mol_type = other RNA; note = synthetic construct
atgagcctgatcgatgagctggcctttgagtttaacaaaagcaaggaggaaatcaggacctacctgctccaggctccatctaagtataaagtgtaccttatccccaagagaaaggttggaaaaagagtgatagcccagccaaccaaagacctcaaactaattcagcggtttatcttagccaagaaactgaaacatctccctattcatgatgccgcctttgcttatgtgaagaacaagagcatcaagaataacgcagcagtccatttatcgaattcctacctgttgaacctggacttagaagattttttcaactctatcacacccaagcttttctggagagtatggaagcggacaatagaccaggtacccgaggttgaggagcgccgcatatacaatcagtttttgttttggcagccaaaaaagaattccaagaagcttattctgagtatcggagcgccttccagtccttatatctcaaacttcatcctttatgagctagaccgttacctgacagtcttctgcaaaaacaactttatcagctactctcgctatgctgatgacctgactttctcatcaaatgtgaggaattccctgttcaaagtgccgaaagttgtggaagacaaactgttcgacctttacgaaggcgaaataaacctcaatcacagtaagacggtgttctctagcaaggcaaaaaacaggcacgttaccggcctggtgctgactaacgatgggaagatttctattggtcgggctaagaaacgattcattaagcacttggtgtatcgatttaagattggcgaactcgagcaaagttccttccaatacgtcagcgggtatctgaattttattcaggatgtcgagcccgtgttcttggaatcactcaagttcaaatacaccgaagaggtagtgaataagatcatgctcggtgtctgggagtga

SEQ ID NO: 11325 - RNA, 942 nt, unidentified
  source 1..942: mol_type = other RNA; note = synthetic construct
atgaacttgctggatgaattggccatcaaattcaacaaatccaaggacgaaatccggacctattccctgaaagcacccgataaatataagatgtatctcatccctaagcgaaagaaaggtaaaaggcttatcgctcagcctacctctgaactgaaactcattcagagatacatcgtgatacacaagctgcaaaaactccccatacacccttgcacgtacgcctatagaaagaacatcagcattaaagacaacgcatccgtccatgtcaagaactcttatctcctcaacctggacttagagaatttcttcaatagcattacaccgcgtctattttggaaggtttgggagcgcacacttaataacctgccagacaaggaagagcaggagctgtacgaaaaccttattttttggcggccacgcaagtcaagtcataaaatgatcctcagtatcggagccccaagcagcccctacatatccaacttcatattgtatgagctggacagctttctgtcttcttactgtgacgaaaagtcaatcaactactcgcggtacgctgatgatttgacatttagcacttctaaacgcaatatcctctttgatattcccaacatcgtagaggggaaaatattcgagctgtacaacgggttgatttcattaaatgacgataagaccacctattccagtaaggcgcgaaatcggcacgtgactggacttgtgctggccaatgacggtaagatcagcatcggcaggagaaagaaaaggttcattaagagcctgatcttcaagtcaattaacaatgagttacctcttgagtccattagttacctatcgggctatctgagttacatcaatgatgttgaaccctcctttatttactctctggaaaggaaatactcctatgaggtgattcataagattatgggctcaaagaatgagaattga

SEQ ID NO: 11326 - RNA, 942 nt, unidentified
  source 1..942: mol_type = other RNA; note = synthetic construct
atggatctcatcagtcggcttgaaataaagttcagcagcctgtcaagggtggacgtacgctcctaccttagcaaagccccagacaagtataaagtgtatccaattcccaagcgaaaaggcggtacgagggtcattgcccagcccgcaaaagagacaaagattttgcagaatttcgtcattgacgaaatcttctataactttccgattcatcaagccgcgatggcttaccggaaaaatcacagtatcaaaatgaacgcatctatccatgcatcccagaaatacctgctgtctatggactttgaaaatttcttccactctatcacacctcaactgttttgggacgtgtatgcacggctaatccaggagcctataacctttgaggataagaattactaccagaacctcttcttctggcgccctaaaaagcagtcagataagctgctactttcgatcggcgcgcccagtagtcccttcatatccaattttgtcatgtatgagttcgacacctttatttacgacttctgtaagtccgtgggaataaaatataccaggtacgccgatgacctcactttctccacaaaccagaaagatattcttttcgagataccacacttagttgccaagaagttggatgaactgtacaagaaccgaatcaacattaaccgtaacaagacttctttttcaagcaaggcccacaatagacatgttactgggatcgtgttaacaaacgaaaataagatcagcctgggaagaaaaaagaagcgctatatcaaacacttggtgcatgagtttaagctcgggaagctgtcaattgctgataaaaactatctctgcggctttctgaactacgccaattttatcgagcctgagtttattttgagcctggaaaataagtacaccaaagaaatcattgctctggctagaaggaacatcaatgagtga

SEQ ID NO: 11327 - RNA, 945 nt, unidentified
  source 1..945: mol_type = other RNA; note = synthetic construct
atggatttgaagttgtaccagtacctcgagtcacagaacagcaatttcacaaacctgctgcgcgcgacccccagcaagcactacaaagtgtataaaatccctaaaaagcggttaggctttagaacaattgctcagcccaccccagcggttaaagttatacagaaacagattgtggactatctcatacctaaaacctcaatccatacctccgctttagcctatgtatctggcaaaggtgttaaggataacgccctccaacatgtcaagtccgactacctgctgaaagtcgatctggagaacttcttcaatagtatcaccccgaagatgctggtgaaagctctgaagcaccagggcattaacatatctcaaactgacattatggtgcttagccagttcctgttctggaatatcacaaagaaaactaacgggaagttggtactctccgtgggagcaccatcaagtcccttcgtttctaacttagtcatgtttgcctttgatcagagaatgagcaagttgtgcagatctacgggcattacttataccaggtacgccgacgaccttactttttccacaacacacaaaaacatcctgttccagcatctcaatgaggtccgaaaggtgctaaaaaaagaatttggggctaggctcgtgctgaatgaaagcaagactgtattcagcagtaaagcccacaatcggcatgtcacaggggtgaccctgacgaataacaataagatctcactaggacgagacaaaaagcgttacatctcctctcttattcacaagtttaagcttggactgttggatcaagaggatatataccatctgcaaggcctgatctcctatgccaagcacattgaggtgcggtttctccgcaacatgagcctgaagtatggtgcaaatgtgcttgactcgatcaggaagtacagtggggaagacgatgcatga

SEQ ID NO: 11328 - RNA, 945 nt, unidentified
  source 1..945: mol_type = other RNA; note = synthetic construct
atggatttgaagctgtaccaatatctcaacgagcgtaacctcaattttaagagtttattggaggcaacgccctctaagcactataaagtgtataagatcccgaagaagcggctcgggttcaggactattgcccagccaacacctgctgtcaaaataatccagaaggaaattgttgactacctcacacccaaagtgtccattcatactagcgccaccgcttatgttcccggacggagcgtcaaggataacgctcttgtccacgtgaagtctaatttcctactgaaggtggacttagagaacttcttcaacaacatcacccctaagatgctgtttaaatccctcaagaaacagggcatcgtggttagtggcgtggacctgattgtgctgcagcagtttcttttttggaatatcagcaagaaacgctcaggaaaacttgctttgtccgtgggggccccaagctcacctttcgtatctaacgtcgtaatgctgtccttcgacgagagaatgacgaaactttgcaggaaatctggtattaattacagtcgatacgcagatgatctgacttttagcacaacccagaagggactgttgtttgagcacttatttgtcgtgcgaaaagcccttaaaaaagaattcggggcgaggctcgttctgaatgaatcaaagaccgtattctcttccaaggcccacaatcggcatgtgaccggtatcaccctgacaaataacaataagatctcgctcggaagagaacgcaagagatacatttcagcgctggtccataaattcaaactggggctgctggatgtggaagacactctacacctgcaaggcttgataagttacgccaaccatatagaggcaagctttgtgcagaaaatgagcatcaagtatggcgataatgtcctaacagagattatcaagtactccggcgagaacgacgtttga

SEQ ID NO: 11329 - RNA, 960 nt, unidentified
  source 1..960: mol_type = other RNA; note = synthetic construct
atggacctgaaggagttgcacttgctgcagtatgtcatttccaaaaacatgcatacagtgagccttctggatgatcaccccagtctgcattacaaggtctacaaaatccctaagaaaaatatcgggttcaggactatagcccagccgacagcgccactgaagaagatgcagcgcgacattgtggaatatatgacccctcgggtttgtatccacaaaaacgctatggcatatattgaaggcgtaggcatcaaaaataatgctcttgcccacgcaaagtctacatatctgttgaaagtggatctggaaaacttttttaactctatcaccccagaaatgctgttccatagcctcaaaaatcaggggttcaaaataaactcaatcgattgggcttacttaaaagaactcctcttttggaacattgccaagaagaaaaacaaaggcaaactggtacttagtgttggcgcaccctcgtcccccctcattagcaacataatcatgtacaactttgacgtgcgtatgacctccctgtgcgagaaacagaacatcaactatactagatacgccgacgatctgaccttttctacgaaagacaagaatatcttgttcgagcacctcaagatcataaggaaggtccttgataatgaatttaagggtgagctagtgttaaatgagtcaaagacaatcttcagctctaaaggtcataaccgccacgtgactggcattacgctaaccaataataacaaaatcagcattgggcgggagaagaagcgatatattagttccctgatccacaagttcaagtaccaaaagttaaatgaggacgacatatatcatctgcaaggactcctgtcattcgccagccacattgagaaggactttatctacagaatgtcaaaaaagtacggaatcgacaccattaagaagattaaactcttctccggagataagaatgatcagtga

SEQ ID NO: 11330 - RNA, 951 nt, unidentified
  source 1..951: mol_type = other RNA; note = synthetic construct
atggatattaagctctatgagcagctgaattctacaaacatcgggttcaatgaactgtttctccgaagtccatcgaaacactacaaggtatacaaaattcccaagcgtactctaggctttagaacgatcgcccaaccgaccccagctgtgaagcggatccagaagcagattgtgtcgatcatctctaaaaacgcaaaagtgcaccattgtgccacagcgtacgtgcgcggcaagggtatcaaagaaaatgctaacaaacacgtctgcagtgaatatatactcaaagttgacttggagaacttttttaacagcgttacacctaagatgctgttcaaggctcttaagaagcagaagatcgttttaagccagattgatgagaaggttatagagcaattcctgttttggaacatgtccaaaaaaatcaatggcaagttggtgttaagtgtcggggcaccttccagtcccttcatttccaatctggtaatgtattccttcgacaaaaagatggaagaatactgttcaaaggagagcattgtgtatacacgctatgccgatgatctaaccttcagcactaagtccaagggcattctgtttactcatcttcagtttgtcaggaagatgatcgccaaggaattctcttctaagcttatgttgaacgagagcaagaccgtgttttcttccaaggctcacaataggcacgtgaccggtattgtcctgaccaataacaacaaattgagcctggggagggaaaaaaagcggtacatatcagcactgattcataagttcaaactgggaaaactgctcatagatgacatataccacttaaaaggactcctctcccatgccagccatatcgaaagagacttcatcctgaaaatgtcagagaaatacggcgccgaggtggtccttgagatcaataaattctcatgcggagagtctaacgacgggtga

SEQ ID NO: 11331 - RNA, 939 nt, unidentified
  source 1..939: mol_type = other RNA; note = synthetic construct
atggacctgcgcctctacaggcagctggagcaacggaaccccaacttcattagattattgaaccgttacccctctagacattacaaggtgtacaaaatccctaagcgcacatttgggttccggactatagcccagccgactccaaacgtgaaacaggttcaaaagctggtgatttcgcttctctccgagaaagtgaacgtgcatccctgcgctaccgcctacgtccaggggaagtcaataaaagacaacgcatcatatcacgtgaagtccgaatacctgctgaaagtagacttggagaatttcttcaacagcatcactcctaagatgttgtttaaagccctaaagaagcagtctattagcctaaccgaccaggacatgctggttctcgaacagtgtctgttctggaacatgagcaagaaactcaatggcaagctggtgctctcggtaggagctccatctagtccctacgtcagtaacgtcattatgtacagcttcgacaaaaggatgtcaaagatctgcgcaaagaataatatcaactatacgcggtatgcggatgatttgacatttagtacgaataccaagggccttctttttggacacctgaatgaggtccgaaaacttttaaagaaggaatttggcgccaaactcactctgaatgagtctaaaacagtcttcagctccaaagcccacaaccgccatattaccggtgtgaccatcaccaataataataagcttagcttgggtagggatagaaaaaggtatatatcagctctgatccacaagtttaaacattcccaactgagtgaggatgatatttatcacctgaaagggttaatctctcacgctctccacatcgaaagcaagttcgttcatcggatgattaagaaatattccaaggaaacactgaactccatccgaaagtatccttctggagcatga

SEQ ID NO: 11332 - RNA, 939 nt, unidentified
  source 1..939: mol_type = other RNA; note = synthetic construct
atgaaatcaggcatctatggaattctaaaggctgagttctgcgactttgacgccttcctgtctagtaagcccccactgcactacaaggtgtacaagatccctaaaagaaccattggctttcgaactattgctcaacctacaccaaccctcaagaaaattcagaagaccctggtgggactgattgaacctcacgttaaaatccacccaaacgctgccgcttaccggatcggtaagggggttaaagaaaatgcgttatcccacgttaactcctcctaccttttaaaggtcgacctcgagaatttttttaactccatcaccccgcatatgctgttcaagacgttgaaacagcagcatatcgaaataaacgatgtggacaagtatgtgctggagcagatcttcttttggaaccgaagtagacgtaagaatggtaggctaatcctgtccattggagccccctcgtctccctttatcagcaatgtcattatgtcaaagttcgacaacgacattagcatcatctgtgacaaaaaaggcgtatcatatacaaggtatgcagacgatatgacgttctctactaaagagaaagatgtgatattctctgtcatggccgatgtgcggcgccttctgcgcaataacttcagcaataagatgaatgtgaacgagcttaaaaccatattcagcagtaaagcacataataggagggtgaccggtgtcacactgactaacgataataagatctccatagggagagataaaaagcggtacatttcagccctgacacataagtttaagttcggaaagctcgatattagtgacatttaccacctcaaagggctgatcagctatgcaagacacgtagatgtcgggtttatacgcaagttgcaaaaaaagtacggcgtgactacactcgaattgatcaacaagtattctagcgagggctga

SEQ ID NO: 11333 - RNA, 948 nt, unidentified
  source 1..948: mol_type = other RNA; note = synthetic construct
atggacctgaacttatatcagcgcttggaaactgacaactgtaatctgaataagttgctctcatctctgccctcgactcactacaaagtgtacaaaattccgaagagaaccatagggttccggactatagcccagcctacttccgaaatcaaagacatccagcgcaagatcattgaaatcctgagccctaaagtgcagctgcatcccattgccaccgcgtatattaagggccaatccattaagtcaaatgccctgaaacacgtcaatagtgaattcctcatgaagatcgatctggaaaacttctttaactcaatcaacccagagatgctgatgaaagcactgtccaagcagaaagttgaaatctcatcggaggatgagaagattctgagggaacttctgttttggaacaggagcaagcgaatcaatggcaaagtcgtgttatccgtaggggctccaagcagccctttcatatctaatctgatcatgtacgagttcgatagtaagctagagtctatgtgcacaaaaaggaaggtgatatgcaccagatatgccgatgacctcacattttctacctgtgataaaggagagcttttctctctgttacccgagatccggaaactcctttaccgaacatttggtaaccgtttggtggttaacgatagtaagacggtgtttagcagtaagaagcataatagacacgtaaccggcatcacactaaccaacagcaatcggttgtccataggaagagagaaaaagaggtacatcagcgctctgattcataaattcaagaacaagaagctcgacgagcaagacattatgcatttgaaaggccttctctcttatgcagtccacatcgaggacattttcgttcaccgcatggggaaaaagtacggatatgaaacgctcgaggctattaagaagttttcccttggtgagtgcaatgaatga

SEQ ID NO: 11334 - RNA, 942 nt, unidentified
  source 1..942: mol_type = other RNA; note = synthetic construct
atgcacctggaacttagtgacttcctgcacaaaaagatacctgagtttgatgccttcctacagtccagacctagcacacattacaaagtgttcaagattcccaagaggaaaattggatttagggtcatagcccagccaaccccgcaggtcaaggcagttcagagtcaaattgtgtcgttcctcgagaaaaagagtaaaatacacccttgcagcatggcttatcagaaggggtgttccatcaagaaaaacgcattagcccactccgatagcgaattcatcctcaaagtcgacctggagaatttttttaactccatcaaccccgagatgcttttcaacgcactcgaatctcaatccatagtgattagtgatgatgacaaattcatcttggaagagtgtttgttttggaatcgctctaagaaacgtactagcaaactgatcctgtcagtgggagctccctcgagtccatacctgtccaatatcgtaatgtatgactttgatcgcgtgatccacaagatttgcattaaccttaacgtaaactacacacggtacgctgatgacctaaccttttcaaccaaggaaaagaatgtgctgtcagaaatgattagcaagattagagaggctctcaagacattcttcaccagcaagattatcattaacgagagcaagactatcttttcttcaaaggcgcataatcggcacgttacaggcatcacgctcactaataataacaaaatctctgtcgggcgagagaagagaaggtatatttccgccctgatccataaatttaagaattccttgctggacgaaagcgacatatatcacttacagggcctgttctcttttgcctgccatatcgaggtggacttcaagaaacggatgaagaagaaatacggtgatgacgtggttcataatctgatcaaatactcatctcgcgagaactga

SEQ ID NO: 11335 - RNA, 963 nt, unidentified
  source 1..963: mol_type = other RNA; note = synthetic construct
atgtccatcgatattgagacaacattgaaaaaagcctaccctgactttgaaattttactgaagtcacggccagcgacacattacaaggtgtataaaatccccaaacggaccattggctacagaattatagctcaaccgacccctagggtaaaagcaatccagagcgatatcatcaaaattctgaaggagtatgtgtacattcatgacgctgctactgcatatgttgatgggcgaaatattctcgacaacgccaaaatccatcagaactcagtgttccttctcaaactggacctcgtaaatttcttcaatcggatcactcccgaaattctgttcaaggccctgagcagacaggggctgcacatctccgatgacaacaagaacatactacggcaattttgtttctggaatcgtagtaaaaggaagaacggcgctttggtcctgtcagtgggagccccaagctctcccttcatttctaatgtggtgatgaagtcttttgacgaggagcttactagcttttgcgaatccaataagatcaactatagtcgctacgcagatgacctaaccttctccaccaatgaacgcgacgtgcttggtttggcccaccagaaagtgaagacaaccctttcacacttctttggcacccgcatcataatcaacaacaacaagatcgtttactcctcgaaggcccataacaggcacgtcactggcgtcacgctcacgaacgataataagctctctattggacgagagagaaaaaggtacatttccagtctggtcttcaagttcaaagaaggaaaattaagcggggatgacatcaatcacctcaagggtctgatagggtttagctttaacatagagcctctgtttattggcagattggagaagaagtatggtaaaagcaccatcaagagtatcaagaagtattctgaaggaggagttaatggcacagatctgactgagtga

SEQ ID NO: 11336 - RNA, 939 nt, unidentified
  source 1..939: mol_type = other RNA; note = synthetic construct
atgtctatcgatattgaaactacgctccagaaagcttatcctgactttgacgaactgctcaaatccagaccagcaacccattacaaagtgtacaaaatacccaaaaggaccattggctatagaataatagcccagcccacctctcgggttaaggccattcagcgtaatatcattgagatcttacggcaacatgcacacatccacgacgctgcgaccgcttacgttgacggcaagaacattctgcacaatgcaaaaatccatcaaaactccgtgtacctgctaaaactggaccttgtcaacttttttaacaagattactcctgagatcttgttcaaggccctggcccgccagcaccttgacatatcagacgaggataagaacatactgaagcagttctgtttttggaacagaagtaagcggaaaaatggggccctggtgcttagtgttggtgccccgagcagcccattcatcagcaatctggtaatgaattcgttcgatgaagagatttcctcattctgcaaaaaaaacaagatctcctacacacgatatgcagacgatctgacattctcaaccaatgagagggatattctgggactcgcgcaccagaaagtgaagactacactaatccgcttttttgggacaaggttaatcatcaacaataataaggtcgtctacagctcaaaggcccataaccggcacgtaacgggagtgactttgacaaacaacaataagttgagcattggccgagacagaaaacgttatattacttccctggtgttcaagttcaaggagggcaagctctctaatgtggatattaaccatcttcgcgggctcatcagtttcgcttacaatatcgagcccacctttattgagaggttggaaaaaaagtatggtgatagcaccatcaaatctatcaagaagtatagtgaaggaggctga

SEQ ID NO: 11337 - RNA, 939 nt, unidentified
  source 1..939: mol_type = other RNA; note = synthetic construct
atgtccatcgatctcgagtctgagttgaccgaaaaatttgctgatctgcagcaattactgaagtccaggccgtctacacattacaaagtctacaaaattcccaagcggacaattggcttcaggctcatcgctcagccaactaaaaaagttaaggatgtgcagagaatcatcgttgagaacttatcaaagattgcgctcgtgcatgacgtcgccaccgcatatattaagggccggaatatcctgtacaacgccagtttgcatcaagatagtgactacctgcttaaactggaccttgaggactttttcaacagtatcacgcccgatttcttctttaaggagttggagagacagtccatcagtctgagcataaacgacaaatttctcatcgagcagctgtgcttctggaaccggtcaaagaagcgtaatggcgcactagtactttccgtaggatctcccagcagcccttttatctccaacgttgtcatgtatagcttcgataagaagctgcacggcatatgtctggccgaaaaaataaattactcacgctatgccgacgatatgaccttttctacaaaggaaaaggattccctcaaattcattcacaatgaagtgaaggggttgctgcaggagtatttcgggaatcgcattctcattaaccagtcaaagattgtgtattccagcaaggctcacaatagacacataactggaattactctgaccaacaatgacaaactgtcaatgggcagggacaagaagcgctacattagcagcctggtgtacaaatttaagaacggtcagctggactttgacgatattcaaagtctcaaaggactaatcgggtacgcacgatctatcgaacctgtgttccttttacgaatacagaagaaatatggtccatcgatcatcgaggaaatcaataaatattctagcgaagagtga

SEQ ID NO: 11338 - RNA, 939 nt, unidentified
  source 1..939: mol_type = other RNA; note = synthetic construct
atgataatcgatttaaagggtgagctttcagaaaaggtagatgacctgcaacagctgctcaaatcaagacccagcacacattacaaggtgtataaaatcccaaagcggagtattggctttcgacttattgcgcagcctacaaagaaactcaaacacatacagaagctaatagtggatctgttattgaataaggtgaaggtgcataagaacgccacggcttacatcaaggggaaaaatatctccttcaacgcatccatccataaaaatagcgagtatttgctgaagttggatctggagaacttctttaacagcataaagccaggaatgttctttaaggagctggagaggcagaacatccggttgagcaacgaggatacagccattctggaacaattctgcttttggaaccgaagtaaaagaaaaaatggggccctggtattgtcagtgggagctccgagtagtcccttcatttccaatgtcctgatgtatacatttgaccaggaactgtatgaattctgtgcttccaaaaaaatcgcctactcaaggtatgcagacgacatgacctttagcaccaaggaaaaaaacgttctcttaagcatccacaaacacgtcgactttcttctcatcaagtacttctctaagaatctaaggattaacgacctgaaagtggtctactcttctaaagctcacaatcggcacgtgactggcgttactctgaccaatgacaatgagatctccattggtagagataaaaagcgcctcatctctgccatggtttacaacttcaagaataattcgctaggccttgatgacacccatacgctccagggactgatcgggtatgccttctctattgagcctgattttattaagcgtctccaggcaaagtacggctccaccatacttgaagacattaacaagaacctgctgcgcacttga

SEQ ID NO: 11339 - RNA, 945 nt, unidentified
  source 1..945: mol_type = other RNA; note = synthetic construct
atgaattatcttctgctcaagaacgtagctacagatattaagttcttcgagactttgtatagcagcccttctaaccattacaaggtgttcaaaatccccaagcggtcaattggatttcgtataattgctcagccaaccaagaacgtgaaggactaccagagaaagattgttcgggtgttggagccattaactgccattcattccgctgcgacagcctataagaagaatcaagggattaaggacaacgcgtttatccataaaaatagtgagtttctgctgaaactggatctggtgaactttttcaactccatcacccccgaaatgtttttcaatgccctgaacgtgcagaagattaaatacagcgagaacgatcggatggccatgtctgagtacctgttctggaatatcaacgagaggcgagcagacaataaaaaacttgttctgagtgtgggcgcaccttccagtccttttataagcaattttgtcatgttcgccttcgataaaaaaattagccaattttgcctcgccaactctataaactattcacgctacgctgacgatctgacgttttctacgaaggataaaaatgtcctcttcaatgttatctcagaagtgcagactaccctcaaggcctgttttggccacaagcttaaaataaataccagcaagaccatcttctcctccaaagcccacaacaggcatgtaactggaattacactgaccaacaacaatcagttgtccataggtagggagaggaagcgatacatctcggcactagtccacaaggcttcacttaatatgttgcccaaagaagacatccatcacttacagggcctcatcagttttgcacgccacatcgaaccgaccttcatccagagactagaacgcagatatgggaaggacatcatccacaacatcattaatacagacctggacaaattctga

SEQ ID NO: 11340 - RNA, 948 nt, unidentified
  source 1..948: mol_type = other RNA; note = synthetic construct
atggagtttaagatcgttcaggccctgatcaaggagtttcctgagctgaaagagcttgtcaagaagacgccttccacccattacaaagtcttcaaaatcccaaaacgtacgatcgggtttaggactatagcccagcctacctcatctttaaaagacgttcaacggaaggttgtggatttactgctgccccacgttaaggtgcatcatgccgctaaagcctacataaaaaagtgctccattaaagacaacgcggctgtccacctcaatagccagtatctgttgaaactggactttgaaaatttcttcaactctatcactcccattatgcttttcaaagtgctcgcagagcagggagtgagtgtctctaagagcgatagcaagattttgagcgagatcctattctggaatcggtcgaagaagatcaacgcacccctcgtgctgtctattggtgcaccaagctccccgctgattagtaacatcgtgatgtacagttttgacagaaagatcgaagatatatgcaaagccctggacattaattattccaggtatgctgatgacttgacatttagcaccaacattaaatcagtgctcttcaatcttgtggacatggtcaatgaagccctccagattgaatttgagggtgagatcaatatcaactcatctaaaacagtgttctcttcgaagaagcacaatcgccacgtaactggcataacattgaccaactcaaacaagcttagtattgggaggattcggaagcgatatatctccgcgctggtgcataagttcaaaaccaaccaactgaacgatttaactgagattaaccacctaaagggactcctgggctttgcttactacatcgaacccaatttcatagtaagactcacaaagaagtacggctccgacattatgatccgcatcagaaagttcaatagcgaagatctgaaatga

SEQ ID NO: 11341 - RNA, 948 nt, unidentified
  source 1..948: mol_type = other RNA; note = synthetic construct
atgaagctgtccgttctgagccatatctcaccagaagtgttcccagtcgaattcagtcactatctggctaaaaaacccagtggtcactacaaggtgtacaagatacctaaacggacttttggatttcgagttattgcccagcccactcccgagttaaaatgtatccaaagagccatcgtggaacagatgaaaccttatgtccagatccattcgagcgccaaggcctatattaacggcattaacattaaggagaacgcaagcgctcacgtagagtcttcttacctcttgaagctggacctggaaaatttcttcaattccctgaccccctctatgtttttaaaggcactcaattatcaggagattgagctagtcaataatgacattgagccgctgattgagctgcttttttggaaccgaaccaagaaaaagtcacctaatctcgtgctttctgtgggagctccaagcagtccgttcctgtctaactttatcatgtacgagttcgacaaaatcgtgacatcctattgcacaaagtcaaacataaactactcaaggtacgcggatgatctgacgttctccaccagcgaaaagaatctcctgttcgttatccctaaatatatcgaaaacaccttgcgtgatctcttcgacgatagaattaaactcaatcgctccaagacctttttctcgtccaaagcacacaacaggcatgtaacaggaatcacaatcagtaacaataacaagctgtctctagggagggacaggaaacggtacatccgggccctgttgcacaagtttagcatcagaagcctcgataatgaagatgacatagaacatttgaagggccttattggctttgctaaaactgtggagccaatattcatcgataagatgaagaaccgctatggtgagaaagtctttattgacctttttcgctactccgggggggactga

SEQ ID NO: 11342 - RNA, 948 nt, unidentified
  source 1..948: mol_type = other RNA; note = synthetic construct
atgaagctaccaatactgagcaggatcagttccgaggtgtttccctccgaattcagtcactacctggccaagctgccatctagccactacaaagtgtacaagatccccaagaggacgtttggttttcgagtgattgcacaacctacaccagagcttaaatgtattcagcgggagatcgtaaagcagattaagccttacgtgaagatccacaacgtggcaaaagcctatgttgatggcgtcaatataaaagacaacgcttatgtccatgtgaaatcgaattatctgctgaagcttgatctggaaaacttcttcaattccctcaccccgtccatgtttctctcagccctgaactatcaggagattgagttggtgaacaaagaagtggaccctctgatcgagttactcttttggaataggactaagaagaagcgccctaatttgatactgagcgttggtgcccccagctccccgttcctgagtaactttatcatgtacgagttcgataagatagttatgaaccactgcatgaaattgaatatcaactattcgcgttacgcggatgatctaactttctctacatcagagaaaggcgttttgtgcatgatcccaaagttcattgaaaaagtactctgtgacctgcatgacggcaagattaaactcaactacagtaaaagcgtcttctcatctaaagctcataacagacacgtgaccggaatcacactgtccaataacaataagcttagcctcggccgggaccgaaagcgctatattcgggctctcctgcataaattttcaaccgagtctttacagtatgaggacgatattaatcacctgaaagggttaatcggatttgcaaagatggtcgaacccagcttctttgaaaaaatgaagaccagatacgggtctaaggtgttcgtcgaccttttcagatacgggggagaacattga

SEQ ID NO: 11343 - RNA, 948 nt, unidentified
  source 1..948: mol_type = other RNA; note = synthetic construct
atgcaagtctctatccttagtagaatacccccagaagctttcccaaatgggttgtcacaatacctgggcgagaaaccgagctcacactacaaagtttataagatcccaaagcggacatttggctttagagtgattgctcagcctacccccgaactgaaggacatccagcgagcaatcactacgcagatcaaaccttttgtccagattcacagctctgcaaaagcatatgtagagggagtctcaataaaggacaatgccattgtccacgtgcagtccaactacttgctcaaactagatctggaaaacttctttaactcactcacccccaccatgttccttgacgctttaaattaccagaatatccgtctggttgacggagaggttgagtctctgatggagctgctgttttggaaccgcactaagaagaagacacccaatctgatcctgagtgtgggcgccccttcaagcccatttttgtccaaccttatcatgtatgagtttgacacaattgtgtccagtcactccgcgaaactcaatgtgaactatagtcgatatgccgatgatttaactttctctaccagcgagaaagatgtgctcttctcctttccgcagttcattgaaaacgtgctgaacgatctgtacgatgggagaatcaaactgaatcatagcaagtccgtgttctcttccaaggcccacaacaggcatgtgaccggcataacgctcagtaataacaataagattagcctgggacgggacaagaagaggtacattcggagcctcctgtataaattctcggtacaggccctccaagatgaggaggacattaagcatttaaaggggctaataggtttcgccaagacagtcgaacctagcttccttgaacgcatgaaagctaggtacggtatctctatcttcaaagatttgtttcgctacgacggcgacgactga

SEQ ID NO: 11344 - RNA, 948 nt, unidentified
  source 1..948: mol_type = other RNA; note = synthetic construct
atgaaattgcctatcctgtctagaattcccccagatatctttcccaaggggttcaatgactacctggcatccaatccttcggcccactacaaagtgtacaaaattccgaagaggacattcgggtttcgtgttattgcacaacctacaccagagctgaaaaatattcagaggtctatcatcaatcgaattaagcctctcgtgcgcatacacaattccgctaaagcctatgtggacaacgtgggtatcaaagagaacgccagcgttcacattaagagtaattatctcctgaagctggacttggaaaacttttttaacagcctgacacctcccatgctgctcaatgccatcgactaccagaacatcgaactagtggatgaggagatctatccattggtcgaactcctgttttggaatcggactaagaagaagacacccaatctggtgctatccgtaggggctccaagttcaccgtttcttagcaacttgataatgtacgagtttgatcgcattgtcaccgagtactgcggactgaacgatgtgaactattcccggtatgccgacgatctcactttctccacccttaataagggagttctctttaacattccatcattcattgaagagtgtcttcacgaattattcaaaggcaagatcaagctgaaccgcagtaaaactaccttcacctctaaagcgcataatcggcacgtcacgggaataaccctggctaacaataacaagatttctttaggccgagaaagaaagagatatataagggctcttcttcataaattctcaacgaacagcatcaaagataaggaggacatcgagcatctcaaaggcctgataggcttcgcaaagtatatcgagcccagcttctttgacaagatgaaagtaaaatacggtgaaaagctgatcttcaagttgttaaagtacgacggcatctcatga

SEQ ID NO: 11345 - RNA, 948 nt, unidentified
  source 1..948: mol_type = other RNA; note = synthetic construct
atgcagctctctattctgtcatgttttactcctgaggactttgaaaccgaccttaatcagtatctggctgagaaaccatcacatcactacaaagtgtacaagattccaaagcggactattggtttccgcgtaattgcacaacccaccccgaaattgaaatccatccagagaaagattgtggagaagatgatgtcgtacctcgtcgtgcactccgctgcaaaagcctacgtgaagtcttgttccataaaagacaacgctttagttcatgccaactctaacttcctgcttaagctggacctggaaaatttcttcaattccttgacgcccgatatgttgaagagagcggtgcagtaccaggggttttccatcgtcgagaaggaagccaacgctctcaacgaactgctattctggaacaagtctaaaaagaagaaagcgaacttgtatctgtccgttggcgcccccagttcccctttcttgagtaacgtgatcatgtttgagtttgatgaagcagtaactaaactatgcaagcaactcgggattagttatagcaggtatgcagatgatctgaccttcagcacatctgtcaaaaatgtcctttttgaagtgccaaagataatcgaagagatcttactccagatgttcggtggaaaacttaagctaaattacagcaagacaaggttttcaagcaaggctcataaccggcacgttacaggcattacccttacaaataataacaagctgagcttagggagagagcgcaaacgatacatcaggtcactgctgcacaaatttagcaattctctgctcagtgaggatgacatcaattcgctgaagggactcataagcttcgccatgaacgtggagcctgccttcatcgccaaaatgaaggcacactatggcaccgccctgtttgacgagctgaaccgttataactgcggaaataattga

SEQ ID NO: 11346 - RNA, 948 nt, unidentified
  source 1..948: mol_type = other RNA; note = synthetic construct
atgcaactctcgattctgtcacggatctcccaggaggatttcaattctagcctgaatcagtatctggcagagagcccaagtactcactataaggtgtacaagatcccgaagaggtcatttggatttagggtaatagcccaaccaactccccagctgaagaatattcagcgcaagatagttggcgaaattaaaggctacatgcatgtccactctgccgccaaagcatacgtgaaagactgtagtattaaggacaacgccatcgtgcatgtcaactctaactatttgctaaaactcgatcttgagaacttctttaacagccttacacctgcaatgttagcccgggccctgaagtatcaggggttgtcattactggaatccgaagtcgctgctctcaatgaactgctgttctggaacagaacgaagaaaaaatctcccaatcttgtcctttccgtgggtgctcccagctccccattcctctccaatgtgatcatgtacgaatttgacgaagccgtgtctaagttttgcagcgagtctgggctgagttattcgcgatacgctgatgatctgacatttagcacatcaatcaaagacatcctgtttgaggtgcctaaattcatcgagagtattctgttccagctcttccagggcaaattgaaactgaactactccaagacaaccttctcaagcaaagcccataataggcacgtaactggcgtgaccctgaccaataacaataagctatccctcggccgtgagagaaagagatatatccgcgctatgttgcacaaattcagttgtgaagagctgtgcgactatgacgttcaagcgttgaagggattaattagctttgcacttaacatagagcctacctttgttgacaagatgaagggtcggtacggggcgaagctcttcgacgatctattcaagtacaataacggagataactga

SEQ ID NO: 11347 - RNA, 954 nt, unidentified
  source 1..954: mol_type = other RNA; note = synthetic construct
atgaagcttagcattttgtcccggatatcccaagaggccttctgtagtaatttaacacaatacctcgccaaaaacccaagcaagcactataagacatacaagatccccaagcgccgatttggattccgtatcattgcacagcccactcctcagttgaagctgattcagcgcaagatcgtagagatgctcaaagtacaccttaaggttcatccggcagctaaggcgtacgtcaaaaactgctcgatcaaagataatgccgaagtgcacgtgaactcaaattatcttctgaaactggatctggaaaacttctttaattccctcacacctgacatgttagcgaaatcactcttttatcagggagtcatgttctccgaaaacgaggtggctgggctgaatgaactgctcttttggaaccgaaccaagaaaaagaccccaaatctggtcttgagtgtgggtgctccctcctcaccatttctgtctaatatcatcatgtacgagtttgacgacattgttagcgcccggtgctctgaactgcaggtgagctattcaagatacgctgacgatctaaccttcagtacgttggagaaagggatacttttcgacatctctgagcttattgagagcgttctgttcgagctgtatcagggcagggtgaagctcaattacagcaagacaactttttctagtaaggcccacaaccggcatgtcactggcattaccctcaccaacaacaacaagctctctctaggaagggagaggaaaagatatatcagggcattgttacataagttctccaacgaggccctgtctgattatgatatacaagtgctgaaagggctaattggttttagcagatccattgaacctatgttcatcgaaaaaatgaagatacgctacggcatcgaactgttcgcaaaactgtacaaacagacgaattcgaatggcgacacttga

SEQ ID NO: 11348 - RNA, 945 nt, unidentified
  source 1..945: mol_type = other RNA; note = synthetic construct
atgaaactgaatattgagaaagtcctggccgaaaaaaatccaaatttgaatatcggcgagctcctagctagtataccgagcaagcattataaggtgtataagattccgaagcggactatcggttttagattgatcgcgcaaccaacacccaaaatcaagaacatacagcggtccattattgccgaactggcccctctgctcaagattcataaatctgcaacagcgtatatccagggcaagtccattcttgataatgcccgcgttcacagggcctcaaactacctgttaaagctggacctggaaaatttctttaactctataacgcctgacatcttcatcaatagtttgaaaaaccagggcatcgagctcagtgctaagaattcaaacctactgatccaactgcttttttggaataggagccgaaagagaaatggaaatctcgtactgtcagtgggggctccttcttctccattcatttccaacattatcatgtacgacttcgacaaaaaactgtaccagtactgcaagtcgatcggagcaagctacaccagatatgcagatgatctcacttttagtgcaaaggaaaagtcggtgctccagcgcatccccaacgaggtgaaaaggttgctgttcaaagagtttagcaacgaaatccggcttaacaactccaaaaccgttttctctagcaaggcccataaccgacacgtgaccgggatcaccctttccaataacaacaagctgtccctggggcgggatcgcaagaggtatatatctgccctggtccacaagttcacactctcattgttagatgaggacgacattttacacctcaaaggcctaataggacttgctaaatttattgaacccgagtttatcgagagacttgagagcaagtacggcaatagcttcattctgaacctgaaccgttacctcattaaagattga

SEQ ID NO: 11349 - RNA, 957 nt, unidentified
  source 1..957: mol_type = other RNA; note = synthetic construct
atgagcctcgacctccattcgtacctgtcacagtttgatagtgacttggacgcatttctcctgaccaggcctagtaagcattataaagcctacaagattccgaagcgcaaagtgggttttcgggtgatcgctcagcctaccccaaaggtcaaaatgctgcaaaggaaacttgtgaaacagttatctacaatcctcgacgtacacgacgcggcatatggctacagagtggggagaggcataaaacagaacgccgaaaagcacgtggacagcgaatatctcctgaaaatggatatcagcaacttctttaactccctctcaccaaatgtatttttcgatgccatccactctcagaatattcggctttcaaaacaagacagggagattctgcgcgaaatatgcttttggaatcgtaccaagcggtcaacggggaagttggttctctcagtgggggctcccagtagtccctttatcacaaacgtgatcatgttctccttcgacgagaaggtgagcaagtactgtgagaagatcggcgtcacctataccaggtatgctgatgatctgacattcagcagtaaggaaaagaatcttctgcagaaggtgcgtgagcagatagtcagagacttagaatccctgtactctggtgttttagtgattaacgaggccaaaactatattctccagcaaaggcaataacagacacgttactgggatcgtattgactaacaataatagactgagcattggacggcgccgaaagaggtacctatccgctctagtccataagttcaagtgcaacgagctggatgcacttgattctcgaatgctgcagggatggttgtctcaagcccgccacatcgaaccttccttctatgagcggctggaggttaaatacggaaaggagattctgaaacagatttcctctttcaatatcgaagtcgaagatgagcccggcacatga

SEQ ID NO: 11350 - RNA, 954 nt, unidentified
  source 1..954: mol_type = other RNA; note = synthetic construct
atgaagattgaaatcccatatcaggatataggaattagcaggatcaaactcgcctccactgctagacgctcgccactgaagtacaaagtgtataagatccccaaaaggcgctcaggcgtccgagtgattgcccaaccaacccctgaggtcaaagatctccagagaaagcttgtcgactttttgcggacccagcttacagtgcacagttgtgcgaccgcctacgaacctgggaaaggcattcgggaaaacgctcagcaacatgtgaataacccctacctgttaaagatggacttcagtaacttctttaacagcatcactcccgagattttcaaaaatgctctgttgcacgattccgttgagatcgacgataacaccctcatgttgcttatcaacatattcttctggtgccctgggaagaaactgtctggaaaactggtcctctcagttggtgccccttcctctccgttcatatccaattacgtcatgaagaagtttgatcagctcctgagcgttctgtgcgaacaggctggtattacctatacacgatatgcagacgacatgacgtttagtacacaaagagagaatgtactgttcacactgaaagagcagatcgccacgctgatagtgcagagtggctatgaaaacatcaccatcaatgaatccaagacagtgttttccagcaaggcacacaatcgccatgttactggggtgactctgaccaatgataaccagctctcagtgggcaggaaaaataagcggtacgcaagctcactaattttccgttttaagttaggcgaattgtctacagacgagactcttatgctaaaagggctcttagcccattactttcacatcgaacccgagttcaagctgtctatgcaaaagaagtacggagtagagattatcagcgacattgtgaactatcaggagctgatcaacgagtctgacagctga

SEQ ID NO: 11351 - RNA, 954 nt, unidentified
  source 1..954: mol_type = other RNA; note = synthetic construct
atgaaaattgacattccctataaggatatcggtatcaatgaaaagaagttattcctaacagcccatcggattccgctcaaatacaaggtgtacaaaatacccaagcgccactccggagttaggataattgctcagcctacccctgaagtgaaagaaatacagcgcaaactcgttggcttcctgcggacccgtctgagaatccataactgcgcaacagcatatgaggccggcaagggcattaaagagaacgctctgaaacacgttaaaaaccagtatttgctgaaaatggacctcgcgaatttctttaactccatcacgccagatatctttcagaatgccttagcccacgattcagtggaactggacgagactacctggacaactctcgtcaatgtgtttttttgggctccaggtaagaaattgactgggaaactggtactcagcgtgggagcaccatcgtcacctttcatctccaactacatcatgaagaggttcgatgagcaggtatctgacctatgcgagaagagcggtgtcacttacacccgatatgcagacgatataactttcagcacgaaccaacagaacattctgttctcccttaaagagaatatcgggagtctgttgcaagcgaatggctataagtcaatcaacatcaacgagagtaaaaccgtcttttctagcaaggctcataataggcatgtgacaggagtgacccttacaaatgacgggaagttgagtgtcggccgagataagaagcgctatgccagctctctcatctttcggttcagattagccgagctttgtcatgacgacattctttttctgaagggactgctggctcactacttccacatcgagccctccttcagattttctatggaaaagaaatacgggaagaacattattcacgccctgatgaagtaccagggcgatgtgcacgaacccgacaattga

SEQ ID NO: 11352 - RNA, 939 nt, unidentified
  source 1..939: mol_type = other RNA; note = synthetic construct
atgcaattagagcgaaagttatgtgagtctttcaaccttacccctctgcagctgagcgtgttgagttccaaagcaccaaagaagtatagggtctactatatcccaaaaagaacatcagggcttcgcgctattgcgcagcctactaaagagttgaagaatattcaacggtttctggctagtgaactcgatgcctactgccctatccatcccgccgcaatggcttaccgaaatgggaagtcaatcaaagacaacgctgaatgtcacaagaataacccgtacctgctaaagatggacttccagaatttctttaacaagataaagcccgacattttcttcgaaaagcttaacgccctcgatgtgaagtatgatggaaaagacaagaaacacctacgtaattttctgttctggaaaccaggtcagaagcgctccataacacatatcctcagtataggcgcaccttcctctcccttcgtgagcaactttgtcatgtttgacttcgattttgagatctcgaaatggtgcgccgaattcgatattgtttacaccagatatgctgacgacattactttttctacggcccggaagaatattctgttcagcgtccccaagattgtaaagaacatcttgagcaaacatgcgtcaggcattaccatcaacgaagcaaaaacaatcttcacgtcaaaagcccacaatagacacgtgaccggagttacaatcaccaacgatggaaaactcagcatcggcaggaagaaaaagaaatatctgttctccctggtgtttaaatactctattggcgagctgactagggatgagatcttttacgccaaggggctgatgagccattgcatgcacatcgagaagaatataatctcccggatgaagaataagtatggagccgacgtgattaacaaatttctcaaagaaggtggcgacgagtga

SEQ ID NO: 11353 - RNA, 984 nt, unidentified
  source 1..984: mol_type = other RNA; note = synthetic construct
atgctggccgccatctctgctgctagcataagtgagatgaatatcatgcaactggagaggaaattatgcgaaaaatttgagttgaccccactcagactcagcattctgagctcaaaggcgcccaagaaatatcgggtttactacattccaaaacgcaactctggcttgcgggcaattgcccagcccactaaagaacttaaggacatacagcgatttctgatctccgaattggagccatatctgcctgtgcatcctagcgccatggcttaccgcaaaggtgtgagtattagagataacgctgagtgtcacaagaataatccatacctcctgaagatggatttccagaacttcttcaacaagataaaaccgaatgttttcttcgataagctgaatgacttcggctttgagtacgactataaggacaagatttacctccacaactttttgttctggaagcccggccagaagcggtccatcacctacgttctttctgtcggcgcccctagtagtccctttatctccaactttgtgatgttcgagttcgatatggctgtatcaaaatggtgcgcagaatttaatatcatctataccagatacgcagatgatgtcacattcagcacttccaggcgaaatatcctcttttccgtacctaaaatggtgaaaaatatgcttgcccaatatgcatctggaattacaattaacgaagcaaagacggtcttcacatcaaaagcccacaacaggcacgtgaccggtgtgactattaccaatgatgggaagttatcaataggacgcaaacgtaagaagcacctattcagcctgctgtttaaatattccatgggggaactgacaaaagacgagattctgtatgcgaagggcctaatgtctcattgtatgcatatcgaaaagaacatcatcgccaggcttaagatgaagtacggatcggagctcatcaacgacttttttaaagacgggggggacgagtga

SEQ ID NO: 11354 - RNA, 984 nt, unidentified
  source 1..984: mol_type = other RNA; note = synthetic construct
atgctggccgctatagttgcggctagcatctttgagatagacattatgcaactggctaaaaaactttgcgagaagtttagtctgacaccattaaagctttccatgctgagcactaaagcacctaaaaagtaccgggtctattatattcctaagcgaacaagcggctttagggccatcgctcagcccactaaggaactgaaggaaatccagaggtttttggtgtcagaactcgaacccatactaccgattcattcatccgccatggcatacagatgtgggatctccatcaagaacaatgcagagaaacacaaaaacaacagcttcattctcaaaatggacttccaaaacttcttcaacaagatcaaacccggaatcttcttcgagaagttcaataatctggatatccagtgcaattctcatgataggtatctacttcacaacttcttgttttggaagcccggccagaagagaagtgtcacccacattctgagtgtgggggctcctagcagcccattcatctcgaatttcgtaatgtttgacttcgattcagccatttctgaatggtgtgcaaaatttgacatcgtgtacacccggtacgccgatgatatcactttcagtacctccagaaagggaatcttattttccgtgccaaagattgttaagaacatgctcgcggagtatgcatctgggatcaccctgaacgaagccaaaacgatttttacctccaaagcccacaatcggcacgtgactggagtaaccatcacaaccgacggcaagctgtcaattggccgcaagaaaaagaaatacctgtactctctcgtctttaaatatacaaaaggtgagctcacgaatgaagaaatattgtacgccaaggggttgatggcttattgcattcatattgagcgtaacatcataactcgccttaagaagaaatacggctctgaggtgattaatcagtttctgaaggagacaggtgacgagtga

SEQ ID NO: 11355 - RNA, 936 nt, unidentified
  source 1..936: mol_type = other RNA; note = synthetic construct
atgcaaattgaaaagctactgtgcgagaaacataaggtaaccacgttgcagctgtcggtgatcgctgcgaaagccccaaagagatacagggtgtactatatacctaagagaacgaccgggtttcgggtgattgcacagccgacaaaaaagattaaggaaatccagcgtactctagtcgcctacctgaaggattttctcccagtgcattcctccgccactgcctatcagaataacatcagcattaaggacaacgccaatcggcacaaaagaaacgactacctgctcaagatggactttcagaacttcttcaacaaagtgaagccagagcttttcttcgcaaaactgaataagctggactttaatatcacacggaaggatgaatccctcttgcgcgatttcctgttttggaagcctggtcaaaagcggtctaaaactcacatactgtctgttggcgctccctcttcacccttcatcagcaactttgttatgtacgagttcgacaaagctatgcatgagttttgtgtttcaatgggagtcgtgtacaccagatatgccgatgacataacattcagcacttccagtaagggcatgctttttgtcattcccaggattgtgaaggcacttctcgcggaacatgccagcggccttaccgtcaatgagtctaaaaccgtattcagttcaaaggctcacaataggcacatcacaggcgtcacaatcactaacgaaggtaagttgagcataggaaggaagaaaaaacgacatttatcaagtctgatcttccgctattccttaaacgagctgaccgaggaagaggtgttaaatgcaaaagggctgctcagctattgcatccacattgagcctgatttcattctccgcatgaaagtgaaatacgggcacgatctgatcaataaatttttggctgaaggagcccgatga

SEQ ID NO: 11356 - RNA, 945 nt, unidentified
  source 1..945: mol_type = other RNA; note = synthetic construct
atgactgtccaaatcgaaaaaatcctgtgcgaccacctggactaccccacatacgagctgacttctattgccattagggcacctaagaagtatcgggtttactacattcccaagagaaatggtggcttacgcgtcatatcgcagcctacaaaacagctgaaaaagatccagcgcgtactggtggcccacctcactaatctgctccccgtgcactcttcagcaatggcttatcggagggggatctcaattaagcataacgctatcctgcacaaggagaatacgtttcttctgaagatggacttccagaacttctttaacaagatcaagccggacttcttctttagcaggctaaacagtatcgacatcaatcttgtcgccaacgatgcgttcctcttaaagaactttctgttttggaagcccggccaaaaaagatccgtgacctatattttatctgtgggcgctcctagttcaccatttataagcaacttcgtgatgtacgagttcgatgaggccattaatgagtggtgcaaaaatcacggaataacatattcccgatacgccgatgacatcaccttctccaccaacaaaaaagatcttcttttcagtgtaccaaagattgttaagagctttctggctaagcatacacagggcatgaccattaatgaagccaaaaccgtgtattcaagcaaagcacataaccgccatgtgactggggttacgatcaccagtgaaggtaaattgtccgtgggcagaaagcgaaagaaacatctgtcctctctcctgcacaaatatagcctcaacttgctaaacccagaggaaattttgcgggcgaaggggttgatgagccactgtatcaatatcgagaaagatttcctgctcaggatgaaaaaaaagtacggaaaggatatagtcgacaattttatgcgtgaaggaaattacgactga

SEQ ID NO: 11357 - RNA, 933 nt, unidentified
  source 1..933: mol_type = other RNA; note = synthetic construct
atgcagctaacctccaagataatcaaaaagttcaactacgagcgccttgcctttgagcagctgttaaacgaagccccgaaaaagtacaaggtctactacattcctaagagaggagccggttttagagttattgctcagccaacaaaggaactgaagaacgtgcagagatttatcgtctctcttcttgaacctattctccccgttcaccacaaagcaatggcgtatcaactcaacaagtcaatcaaggataatgcctacctccacaaggataattcctatgtactgaagatggatttccagaatttcttcaacaaaatcaagcctgacctgttcctcaccaaaattgaagcaagcaacctggagttggagtccctggataagttcgtgctgcggaatctcctgttttggcggcctggcaccaaacggtcaatcaccttgatccttagcataggggctcccagctctcccttcataagtaactttatcatgtacgacttcgaccgaaatgtggacgactggtgtctgaatcatggcgtggtgtactcgcgatatgctgatgacattactttttctacgaacaccaaagatctgctcgtgagtgtcccaaagatggtgaaaaaaatgttgtctgagtatgttcccggtctgacagtcaacgagtccaaaactatatttacgagcaaggcacacaatcgccatgtcactggggtgacactcacaccagaaggcaaactgtcagtgggaagggaaaggaaaaggatgctgtatgccaaaatgcatcaatattacctagggatgttgagtaccgaggacatcaacaaggttcgtggattagtaactttcgctaattacattgagggcgactttattttcaggcttaagaagaagtatggcaatgagttaatcgatcgctttctgaaagaagggtgctga

SEQ ID NO: 11358 - RNA, 936 nt, unidentified
  source 1..936: mol_type = other RNA; note = synthetic construct
atgcagctgacgagtaagatcattagcaagttcaactacaatcggctggcttttcagctcctgttgaacgaagctcctaagaaatacaaggtatattacatccccaaaagaggcgccggatttagagtcatcgcccagccaactaaagaactgaagaacgtgcagcgttttattgtgtctctcttgcaacctaaactccccgtccaccataaagcaatggcatacgaatataagaagtctatcaaggacaatgctctcctacacaaggataacaattacatcctgaagatggattttcagaacttcttcaacaagatcaaacccgacatatttttctctaagcttgagaacacgggcctgaagctggactccttcgatgagaataccctccgcaatttgctcttctggcggcctgggaaaaaacgctccacaaccctgatactttcagtcggggccccatcatcaccgtttatttccaactttgttatgtacgacttcgataagtctctagatgattggtgtaggaataacggtattacatatagtcgctatgccgatgacattacatttagcaccaatatcaaggacatcctctgcagggtacctaaggtggttaaaaagatgctgagcctgcacgtgcccggcctttcgataaatgagtccaaaactatcttcactagtatggcgcataacagacacgtgactggagtgaccttgacaccacagggaaatcttagcatcgggcgagacaggaaacgaatgctgttcgcaaaaatacataagtattccttgggcttactgagtagcgaagagattaacaagaccaaaggcatgattgccttcgctaactatctggagggtgactttttacttcggctgcaaaaaaagtacgggtgcgagttaattaccaaattcctgatggaaggaaataagtga

SEQ ID NO: 11359 - RNA, 936 nt, unidentified
  source 1..936: mol_type = other RNA; note = synthetic construct
atgcaactgacatctaagatcattagcaagttcaattacagcaaccttgcgttccaccttctcctggccgatgcccccaagaagtacaaagtgtattacattccaaagcgggggtccggcttcagaatgatcgcccagcccaccaaagaactgaaacatgtacagagattccttgtaagcttactcgaaccaaatttgcctgtgcactataaggctatggcctaccagaagaataagtccataaaggataacgccctgctgcacaaaggcaataactacattctcaagatggacttccagaatttcttcaacaagattaaacccgagctgtttttctctaagctgcaaaacgctaatatcaccctcgagtccggagatagggctgttttacgcaacctgctcttttggcggcccggcacaaaaaggagtatgacactgatcctctctattggggcgccatcgtcaccgttcatcagcaactttgttatgtacgacttcgatcgcaaaattgatgactggtgcgagtccaataatattgtctacagtcgatatgcagatgacatcactttttctacaaacagtaaggacttactatcgtctgtccctaaagtcgtgaaaaagatgctggcaactaacgtgcctgggctgagcatcaacgagtcaaaaactatatttaccagtatggcccataacaggcatgtgaccggagtgacccttacgtcagacggtaaactgtcaatcggacgcgacagaaagcggatgttgtatgcaaaaatacacaagtatagcctgggactcttgtcctccgaagagatcaataaagttcgagggctaatcagctttgctgattacttggaagaggactttcttctgcgtctaaggaagaaatatggtcacgacctgatagataagtttatgaaggaaggcggcttgtga

SEQ ID NO: 11360 - RNA, 930 nt, unidentified
  source 1..930: mol_type = other RNA; note = synthetic construct
atgacaatacgcaaagagctcagtaagaaactggaactgcctgagttgcagatcgttctcttctgtattaatgcgagtaaaaagtacagagtgtactctattcccaagcggaaggtcgggcggaggattattgcacagcctacaaaagagcttaagaaatatcagcgtgtgttggtcgagatcttacagccgtacctgaaagttcacgaatgcgcatatgcgtacaaaaccgacatcagcattaaggataatgctgaacaacacagaaggaacacttatatcctgaagatggatttccagaactttttcaacaagattaagcccgagctgtttttttccaaggtggattcggtcagcataaaattatctagagaagatcggagtctgctgatggacattcttttttggaaacccggttccaagcgatcaacggccctcgtcctttctgtaggggcacctagctctccctttatcagcaacttcatcatgttcgattttgacaaggccatatttgaatactgcaagaacatcggtgttacatatactcgctatgctgatgaccttaccttcagcaccaataaaaaggacgtgttgttcggggtgcctgtagtggtgaaggccgctctgtccgcacttgccccaggaatgatcattaacgactccaaaacagtgttcagctcaaaagcccacaaccggcatgtgaccggagtcacgatatctaatgagggcgaactcagcctgggaagaagtaagaaacgatatatatcctcactcatccataagtactctctgggcaccctgccagactccgagatcgactacctaaggggcctcctgtcctatgcccaacacatcgagccaatgttcctgactaggctaaagaataaatacggcgagaagttgattaatcatatccgctcaggcgcttga

SEQ ID NO: 11361 - RNA, 939 nt, unidentified
  source 1..939: mol_type = other RNA; note = synthetic construct
atgagtatctccattctgcttgctaaaaagcttaacatcaccgaacatcaacttcattcattctgtctcaatgctccaaagaaatacaaggtgtatacaatccctaagaggtctatgggaaagaggattattgcccagcccactaagaccctgaaacgtgtccaaagagaggccttgggaattcttttgccctttctggaggtgcacttctctagctacgcttataagaaagggctggggattaaagataatgccatgctgcacaaagataattcctatttgctcaagatggacttccagaacttcttcaacaagataaaacccgacgtgtttatggccaaactgcggaacaagatcccagacatctcgtacagcgatgaagaattgctgaagaacgtttttttctggaagccggggctcaagaaaagtaaaaccttgatcctctccatcggcgcaccttcaagccctcacatctcaaatttcgtgatgtttgaatttgactctgagattgagagcctatgcaggggtttaggtgttgtctacactcgctatgctgacgatctgacttttagcacaaacaaaaaagacgtgctgtttcagctgcccaagattatacggggactcctgtccacatgcatgccatctttaacgatcaacgacagtaaaacggtttttagcagtaaggcacacaatcggcatgtcaccggcgtaacaataaccaacgacggcatgctgtcactaggaagaaaaaagaaaagatacctttcctcgctgatcttcaagtattccctcaatcagattaattacgaggatttctctcacctccgagggatgctgggtcatgcaaagtacatagagcctgcgttcgtatttcgcatgaaggccaagtatggcgccgagctggtggataagatcattttaggcgaaagctacgagtga

SEQ ID NO: 11362 - RNA, 936 nt, unidentified
  source 1..936: mol_type = other RNA; note = synthetic construct
atgtccatttataatcagctatgcgagaagatgaaagttgaccctgctgatctggactttttctcccacaatgcccccaaaaagtacaaggtttactccattccaaaacggactgtgggccacagactgatagcacaacctacatccgaattgaaggaataccagagagcactggtgtctatcctcgagaaatcattgccgattcatgagtccgcctacgcatatcggaaaaacatcggcataaaacagaatgccctgaagcatgtcgctaattcatacctgctgaaaatggacttccagaacttcttcaataaaatcaagccagagatcttcttcagcaaactcctcaaagccaatattgaaattagcgacgacgatcgcaagattttaaagaaccttctcttttggaagccaggactgcgtagaagcgtaacccttgtactgagtgtgggcgctccatcaagccccctgatcaccaactttgtcatgtactactttgacgaacacatgacgaactggtgtaaaaaaaacaagatttcctacacacggtatgcggatgacataaccttctcgacaaacaccaagtctattttgtttagcgtgccctctatagtcaggactatcttgaagcaagagattcctggaatgtcaatcaacgagagcaagaccattttcagcagtaaggcccataaccgccacgtgactggtgtgactttaaccacggataacaaaatctctctcggacgaaagaagaagaaagaaatcagtgcccttttacaccgctttacactgaagatcctccctcccgaggatatctctttccttatcggtctgctgagtcacgctaagaatatcgaaccgatatttctgtctaggatgaaatccaagtatggggaggatacattttataatctaaggggggactatcatgtttga

SEQ ID NO: 11363 - RNA, 936 nt, unidentified
  source 1..936: mol_type = other RNA; note = synthetic construct
atggaaatcctttctgctgtgagcaaagagttgggcgtcaatgtaaatgagctgcggaggctaagttcagtcgcaccaaaaaaatacaaggtgtatactatccccaagcgccaatcaggctttcggcttattgcccagccgactagcgaaattaagcgcatccaacgagaagtggttaaaatcttggcatctaagctgattgtgcatgatgccgccaaggcctacaaggttagcatcggcatcaaagacaacgctaagattcatatggctaattcctatctcctgaaaatggactttcagaacttcttcaacaagataaagcctgccctgttgtttgataagctcagatcacagggagttgtgctctctggtgaggacaaggaattccttgaagggatattgttttggaaacctggaaaaaaacgctctattaccctggtgttatccgtcggtgcccctagtagccccttcgtgtcgaatttcgttatgtacgacttcgacaactacataaacaactggtgctccgtaaggaacatctcatactcccggtacgccgatgatattaccttctctaccgacgagaaaaatatcttatttgaagtgccaaaggtggtcagattcgcgctatcgctgtgtgccaaaggaatttctctcaatgagagcaaaacagtgtttacaagcaaagctcacaataggcatgtcacgggcgtaacactgactgtcgatggggagctgtccctgggaagacagaaaaagcgtatgatctccagtctgcttcacaaatataccctggggctcttagcaaaggaagatgtgatcagcctgaagggttttgtgggccacgcgctctatatagagcccaagtttatcgcacgaatgaagattaagtatggcaaggaggttattcacgctctgttcagtgaggaggggatgtga

SEQ ID NO: 11364 - RNA, 948 nt, unidentified
  source 1..948: mol_type = other RNA; note = synthetic construct
atgaacatcttaactactctccgtgagcagcttctcaccaataatgttattatgcctcaggaattcgaacggttggaagtaagaggtagccacgcttataaagtatattctatcccaaagcggaaagctggccgccgtacaatcgcacatccatcctccaagttaaaaatttgtcagcgacatctgaatgctattctgaaccctctgctgaaggtgcacgactcaagttacgcctatgtcaagggaagatcaattaaggacaatgccctggtccattcccacagcgcatacgttctgaagatggatttccagaactttttcaactcgatcacccccacgatactgaggcagtgcttaattcagaatgatatcctgctcagtgttaatgagcttgaaaagctagagcagctgatattttggaatcccagtaagaaaaggaacgggaagcttattctctcagtggggagtcctatttctccactgatttcaaatgccattatgtacccctttgacaagatcatcaacgatatatgcaccaaacacggcatcaactacacgcgctatgcagacgatatcaccttctccactaacataaagaataccctgaataagctcccggagatagtggagcaattgatcatccaaacatacgccgggagaattatcatcaacaagaggaagaccgtgtttagcagcaaaaaacacaacaggcacgtgacaggaattactctaacaaacgactccaagatctctattggcagatctcggaaacgctatatttcttccctcgtgtttaagtacatcaacaaaaacttggacatcgatgagatcaatcatatgaaaggtatgttggccttcgcgtataatattgaacccatctacatacaccggcttagccataaatacaaagtgaacatcgtcgagaagatactgcgaggaagcaattga

SEQ ID NO: 11365 - RNA, 948 nt, unidentified
  source 1..948: mol_type = other RNA; note = synthetic construct
atgaacattctgacgaccttacgggaacagctgctggcgaataatctgctaatgccacaagaatttgagaaactggaggctaagggctcccatgcctataaagtatattccatccctaaacggaaggccgggagaaggactatagcacacccgtcaaagaaattgaagatatgccaaagacagttatctcatattttgtcccccttactcaatatccacgatagctcttacgcatatattaagggccgatcaattaaggataatgcactggtacatagccactgcgactatctgttgaaaatggatttccacaactttttcaactcaatcacaccttctattctcaggaaatgtcttgttcagaatgagatcctgattaccgagtacgacatcaacaaaatagagcagctcatattctggaacccttcaaaaaagcgctatggtaagcttatactgagcgtcggatcgcccatcagtccactcatcagcaatgccatcatgtatccctttgataaagtgatctctgaaacctgtaccaaaaacgggatcaggtacacaaggtacgccgacgacattacttttagtacgaatcgcgacaacgtcctgcacaatatccccgaacttgtggagcacgtcctaaacaagatctactttggacagatcattatcaataagcggaagaccttctttagctccaagaaacataatcgacatgtgacaggcatcacactcactaacgacaataaggtgtctattgggagaagccgtaaacggtacattagtagtttggttttccgttacattaacaagaacctcgatattgatgacattaatcacatgaagggtatgcttgctttcgcttataacatcgaaccaatgttcatccacagactgtcccataagtacaaggtgaacatcgtggagaaaatactgcgcggacacgactga

SEQ ID NO: 11366 - RNA, 948 nt, unidentified
  source 1..948: mol_type = other RNA; note = synthetic construct
atgaagatcgtgcccattcttcagcagcagctgacaaaacggaaaaccgtgagcgacgcagactttaggaaattgcttgctctgggatctcatgcgtacaaggtgtataccattcctaagagaaaggccggtcaccgccttatcgcccacccatctaagagcctgaaagaatgtcagaggcaactgaccagcattctggagctctatttacctgtctcagactctagttacgcttatatgaaaggcaggtctataaaggataacgccctggttcatgttcactcttcctatattctcaagatggacttccaggacttcttcaattcaatcactccggagatctttcgacagcatctggagcgtaatgacataattattagcgagacggaatttaagatccttgagcaactcatcttctggaatccttccaagcgcaaatatgggaagctaatcttaagtgtagggagtcccatctcaccattcatttccaacacgatcatgtattacttcgacgagtacatcaacaacctgtgtagccaactaaatatcaattactcacggtacgccgatgatctgacatttagcaccaaccagaaggatatactctttagtctgccacagtttgtgtcggatattttgcacaaagaattctcagggagaatagtgattaaccaccggaaaactgttttttcctccaaaggtcacaaccgccacgtcacaggagtcactataaccaaccagaataaactgtccattggcaggaaaagaaagcgatatatttccagcctggtattcaattgcatcaacaacaatctcagtaatgaggaaatcatgcatttgaagggcttgctggcatactgctacaatatagaacccatgtttattcatcggctttctagaaagtacaagttcaacatcatcaagaacctcgtgaaaaaggatgactga

SEQ ID NO: 11367 - RNA, 990 nt, unidentified
  source 1..990: mol_type = other RNA; note = synthetic construct
atgtgcttggggtgtttctatgttggcgggaagctgaagatactgcctctgctggagcagtccctggcaaataacgaagtcgtgagcaacagcgatttcagaaagctgcaaatgctggggtcacacgcttataaagtctacaccattcccaagagaaaggcaggaaaacgggtgatagcgcatccaagcgttaagttaaagaagtgccagtccaacttagtgagcatcctggaattgtatctacctgtgcatgacagtagttacgcctacgtgaagggtcgatctattaaggataacgccctggtacacgctaaatctgactatttgctgaagatggacttttacgactttttcaatagcattactcctcccctgctttctgagcatctcgataaggttggacttacagtagacttatacgaactggctaagcttaaccagctgctcttctggaaccccagtaagaaaaaacacggaaagttgatcctgagtgtgggcgccccatctagccccttcatatccaatacgatgatgtacttcttcgacgaaaaaatctccaagctctgtgcaaagaataacatcaattattcgcgctacgccgatgacttgaccttttcctctaataaaaagggcattttgttcctcctcccagatgtggtgaagaaaatcctcaagcaggagttcaaggacaaaatcgtcattaatgactccaagaccatctttagttcaaaaaagcacaatcgccacgtgacaggactaactataaataacaacggctcaatttctctgggcagaaaaaggaaaaaatacatctcaagcctggtttttgagtaccttaataataggcttgatgagggtgaattttatcacctgatcggtctactcgcctttagctataacgtcgagccgatgtttcttcatcgtctctcccggaaatacaaagtgaacgtcatcgattcaattctcaaaaaagggaggctgaacgagtga

SEQ ID NO: 11368 - RNA, 954 nt, unidentified
  source 1..954: mol_type = other RNA; note = synthetic construct
atgaaaatcctgtcaatactcgagctgcggctgtctgagcgggagaagataagttacgcagatttcttgaaactgcagaacctgggaagccatgcgtaccgcgtttactcaattccaaaacgcaaagcagggaatagaacaattgctcacccttccagcaagctcaaggagtgccaacggcagcttgtgagcatcctcgagatgtatctgcccgtacacgagtccgcttatgcttatatgaaaggcaggagcattaaagataatgccctggtccattccaagtctgcctacttactgaagatggactttcaggacttcttcaactccatcacccctgaaaccctcgaaaggcacatgcggaagttgggccttacattacctatcaacgaacagaaggccctggagcaattagtattttggaacccatctaagcgtaagtatggcaaactcattctgtccgtgggatctccgattagcccctttattagcaacagtgtgatgttctttttcgatcagaaaatgttcgacatctgtaccaagcacaatatcaattactcccgttatgccgacgatcttacttttagtactaattccaaggggctacttttcagtatccccgagctcgtgaagcaggccataaaacaggaattcaatggggaattggtcattaacgattctaagacgatatttagctcgaaagcacataacaggcatgtcaccggtatcactatcaacaataacggccagatttcactaggccgacaaagaaagagatatgtgagttctctggtttaccagtataccaaaaacgaactgagcgaggaggaaatcgaccgcttgaagggtttgctgtcattttgccacaatgtggagccctacttcctgtcaagactcacacgaaagtacaaactgaatatcgttgacgaacttctaaggaagggaacaaagaaatga

SEQ ID NO: 11369 - RNA, 945 nt, unidentified
  source 1..945: mol_type = other RNA; note = synthetic construct
atggagtctaagctgtttcatacactgtgtacaaacttgaaccttagtacctctgaattaatggagttcattagtaatgcccccatctcctacaaagtgtattcaattccgaaaaagaacggcggaagacggacaatagcgcacccctcaaagaagctaaaaaagatccaacgggaactgctcgtcctacttgagaaaactttacagattcaccagtctgccttcgcttacatcaaggggaaaaacatcataaacaatgccgagcttcacaagaataataaatacctcttgaagctggacttctatgatttcttcaatagcatctccgacgtgatttttatcaattatctggacaagatcgggctgagcctgtccgaactggactccaaattagtgagccatatctttttttggaacccaaataacaaggataagacccataaaaagctcatcctgagcgtaggctcaccctctagccctatgatctcgaacgctatcatgtatttcttcgacagcgagatcaaaattcactgcgattctatgtccatagtttatactaggtatgcagacgacctgagtatcagcggaaatgacaaggataaactgaaagagatcacccagtttatacgctctcgcctgtacgacctctttaacgggaaaattatcctcaatgatctcaagaccattcttgtctcacctggctacaataagtttattactggtatcacccttacaccacagggaggattgtccattggtaggaagagaaagaagtacattttcgggttgatctacaagtacataaagaacgaactgaaagatgatagcattagtcacataaagggcatgctctcatttagttattccattgaaccttcgttcattcgacgtctggagttgaaatacggcaaagatacgatcagaaggataattaacgagaaatga

SEQ ID NO: 11370 - RNA, 945 nt, unidentified
  source 1..945: mol_type = other RNA; note = synthetic construct
atggaatctaaatttttccacaccttgtgtaagaagctgaacctgagtactagtgagctgatggaatttatttcaaatgccccagtgtcctacaaaatctattccatccctaaaaagaacggcggcagaagggtaattgcccaccctgccaaaaagctgaaaaagattcagcgagagctgctcctcctgcttgaaaaggatctgaagatccatcagtctgcgtttgcatacatcaagggcaaaaatatcatacagaatgctgagccacacaagaataacaagtacttactcaagttggatttctacgatttcttcaacagcatttcggacgacatctttattaactacctcgacaaaattggactggtgcttaatgagctggataaagagttggtcaaacacatctttttctggaatccgaacagcaaagacaaaaggcacaaaaagcttatcttatctgtcggaagccccagctcgcctatgatcagcaatgcaattatgtacttcttcgactcagagattaaaacgtattgcgacagcatctctattgtgtatacacgctatgccgatgacctgagcatctcagggaacgacaaggataacctgaaggacgtgatcatgtttatccggtccaagttgtatgatctatttaacggccggatcattctcaatgatctcaaaaccacattgatctctcccgggtacaataagttcgttaccggaattactctaaccacacaaggcggtctttccatcggcagaaaacggaaacgttatatattctccctggtgtacaagtacatcaagaacgaattaaaggaagacgctgtcctccatatgaaggggatgatatccttttcacatctggttgagcccagtttcataataaggctggagagtaaatatgggaagaacataatcaaccgcattattaatggtaagtga

SEQ ID NO: 11371 - RNA, 957 nt, unidentified
  source 1..957: mol_type = other RNA; note = synthetic construct
atgaagagtaaacggaaattcgaactgttttataagctccacgagggcgagcgttttagttccaagcttaatgagctgatcgctttaacacctactgctcccatctcatataaggtgtactcaatcccaaagaagaaaggcggccgaagaactatcgcacaccctaccaaaaagctgaaggaaatccagaaaaaactgctggagcttttacagctccaaatccacaaatccgcctatgcgtacagaaaaggacggaatattgcccagaatgccgaaacccataaagaaaacaagttcttgcttaagctggattttcacgacttcttcaatagcataaacaacatcatcttcacccgccatctggataagattggaatccactataatgaggacgacaaatggctgataaaccatatcttcttctggaaccccaacaagaaggataactcccacaagaaactgattctctctgtgggagccccaagtagcccaactatatccaatgctgtcatgtactttttcgataaggaaattgaggagtactgcgagtccaaatcaatgaagtactcaagatatgcagacgatattagcatcagcgggaataacaagaacgagctgaagacaatcattcctgtcatacgcgagaaattgaacgaactgtttaacgggcgaatcattctgaatgaactaaagaccgtaatcataagcccgggctataataaattcattacagggatcacactcacgtctcagggctcgatcagtattggtaggaagaggaaacgctatattttttccctggtgtacaaatacaagatcaatgagctctctaaggacctcatcccccatttaaaaggtctactgctctttagcaagaacattgaaccctcttttattgttaggttggagttgaagtacggaaaggagataattcggaggattcttgacgaaaaatga

SEQ ID NO: 11372 - RNA, 1038 nt, unidentified
  source 1..1038: mol_type = other RNA; note = synthetic construct
atgcagagtcccgctttcgttccttgccctggggcggctccatttgcaagttttagcaaagagtcctatgcccagggactgccgtgggcactacagctcgaggccatgatgctgttttcagatcggatttgtgacgaactcggctactccaagcgtcagctcaactcatttctgaagaatgcaccccgcaaatatcgggtgtactccatacctaaaaggactgtgggatacaggacaattgcacacccctctaaaaagctcaaggagatccaaagagtgtgcgacgctctactgcaggatattttacctgtgcatcattgtgcatacgcctataaaaagggttgcagcattaaaaagaacgccatgcttcacgtctctcaatcatatctgctgaagatggatttctctaatttcttcaacagcatcactccagatatgttctggtctaaggtagacggtttcaagattgggataaataaaaaggagagaggaaaattgaccaaggctatgttctggcagcccaaccgccacgactccgacaagttgaaactttcaatcggcgccccaactagtcctctgatcagcaattttgtcgcgtacgagtttgattgtttcctcagcgaatggtgcatttcccaaggaatcatctacagcaggtacgccgacgacttgacattttctaccttcaatgccggcattttattctccgttcccagagtggtaaaggcctttctgaacaagtatttcgacggcatcacaataaacgaggctaagacgaagtttagttcaaaaaagcacaacagacacgtgaccggcatcaccctgaccgatgatggtcggatcagccttgggcgaggggagaaaaggcgaattttccattttgttcatgtgttttccctgggcgaactggatccggatctcctgccaaaactccgcgggaaaattgtcttctatgaacacatccagccaggctttatcaaacggcttagtgacaagtacacagaagagttgatatcttcgttactgaatggagactga

SEQ ID NO: 11373 - RNA, 939 nt, unidentified
  source 1..939: mol_type = other RNA; note = synthetic construct
atgctgttgatcgagaagatcatcaaggaatctaagctctctaggcctgaactgacaattctcagccataaagccccgtatatgtacaaagtttatgccattcctaagcgccgaagtggctaccgcatcatagcccatcctgccaaacccctgaaattaattcagaggctcattctccagctgctggaaccctctgtgaagattcacgacaacgtccatgcttacgtgaaaggccggtccattattactaacgcaacagtgcataagaaaaataagtacttgctgaagatggacattaacaacttcttcaacagcatcaaacctgaattgttctggtcttccctgaacaaacaggacatcatgcttccaaaaatacaccaaaagaccattgagagattaatcttttggaatcccagcaagaagaaagatgggaaactcattctaagcgtcggggctccaacctccccattcatctcgaatatcgtgatgttttcattcgacagtaagctcagtagcgtatgcgataagctggggatctcatactctagatacgccgacgatctcaccttttcaaccaagaagaagaacatactgttcaatctgccccacatcgtgaagatccttttgcaagaagagttctccggagcaatgaccataaatgagcagaaaactgttttttcgagcaaggctcataacagacacgtgactggtattacaatcacaaatgacaagcagctttccataggacgagctcggaaaaagtatatttatcacctgatccaccaggccacgctgggcaacttggatgatgagcgtatgaatcaccttctgggactgatatccttttgtaggtcaattgacgcaaacttcttagacaagatcgcgaataagtatggtagcagttttgtcaaagatctaatcaaacgggagcttaaatga

SEQ ID NO: 11374 - RNA, 951 nt, unidentified
  source 1..951: mol_type = other RNA; note = synthetic construct
atgctccagaggctttacagtaagctgcagaaaaagttggagatccccagatacaaaatagaatccttcagtagttcagcaccgaacaggtataaggtttacacaattccaaaacgcacatcgggtagacgtgtcatcgctcatccttccagagaattgaaaaaataccagcgggcgctcgtaagcatcctgactccccttctctctgttcacaaatgctcattcgcctacaaaaagggcgtgagcatcaaagaaaatgcacttgagcatgcaaaaaatagctatctcctgaagatggactttaatgactttttcaactctatcgatcctgaactgttctttttgatgaataagtccaatggggtcgagttttctgacagtgaaaagaagctgattcaaaacctagtcttctggaacaagaccaagtcctatgagcagaaactcgtcctgtctgtgggggccccatcaagccccttcatcagcaactttgtgatgttcaagttcgacgaactgatcgagaagtttagtaagaagaacaacatcacatacacccgctatgctgatgacattaccttctctactaataagcggaacgccttattcttgattccagaggaggtaaataatattctgagagagcactacggctatcgcataacagttaactccaccaaaactgtgtttagctcaaaggcccacaaccgacatattactggaattacgatcaacaatgaaggacaactgtccataggtagggataggaagcgaatgatctcttccctaatacataagtactcaatcaaagtgcttgacatctcggatttccagtatttacagggcctgctcagctttgcttctcacgtggagcctcggtttctggattccatgacccggaaatatggacacgagacgattaccaatattgtgaaaggggatttttacgacagctga

SEQ ID NO: 11375 - RNA, 945 nt, unidentified
  source 1..945: mol_type = other RNA; note = synthetic construct
atgatgtttaaattgtacttcaagcttagcaagaagttggaactgtctcgcagtcgaatcgaatcatttagtaaaaatgcacccaacatgtacaaggtgtatacaatccccaaacgtacatccggaagacgggtaatcgctcacccaagcagggagctgaaagtctatcaaagagcgctggtcgagatccttgcctcaagtttcgaaccgcaccattgtagcttcgcttaccgtaaacagctttcgattaaagagaacgcactggtccactcaagaaatagctatctactcaagatggacttttcagaattcttcaattctatcgagcccgacatgctgttttctgctgccaaggttcgcaacatcggactgagcgatgccgagaagagactagtggaaaatctcgtcttttggaataagaccaaatcccataacaccaaattggttctctccgttggggcccctagtagcccactcatatcaaatttcatcatgttcgagtttgacaggctcatgtatgaattctccaagaataacagcatcgtgtataccaggtacgcagatgatattaccttttccacgaaccggaagaatactctgttcgatgtgcctaacgaggtgaaccgagtgctgtcgaaattttacgactaccgcatttctataaactccacgaagactgtgttctcctctaaagctcataacaggcacatcactggcgtaacaataacaaatgacgggaaactttcaattggccgctcccggaaacggatgatctcaagcttaattcatcagttcactctgaagaagatagatagctgcgacttttcttacctgcagggcctgttaagctttgcctcccacattgagccttctttcatcttctctatgaagagtaagtatggtgatgagattattacccagatcattaagggtgactttagttga

SEQ ID NO: 11376 - RNA, 987 nt, unidentified
  source 1..987: mol_type = other RNA; note = synthetic construct
atgttgcagctgtccgccgcccctttctccctttctcgtgccatgttcaagttgtatttcaagctggcccagaagctggatgtgtctcggcggagaattgatactctggcatctggcgccccaaataagtacaaagtctacacaatacccaagcgcactagtggattacgagtgattgcacatcccagcagagaggtgaaagtctaccagagggcacttattaagatcttgcaggacgttctcagggtacaccattgcagttatgcctataagaagaagctatccataaaggacaatgcgttaaggcatgcttctaatcggtacctcctcaagatggactttaacgactttttcaacagcatcacccctgaagtctttgaggatgcactgaaccacgtggaagtggatttcagtgaagctgaaacgaagctcatcaagcacctagtgttctggaacaaaaacaagtcatttccaccacatcttgttctgtcagtcggtgcccctacctcccccctgatctcaaacttcataatgtatgagttcgataaggctatgtacgacttctgtgaagagaatctgattacctacacccgatatgctgacgatattaccttttctaccaacgttaaggatattctcttcaaggtaccgaataaagtgaataagatcttggaggagaaatttaacggagcgatttccatcaaccaaagtaaaactatcttcagcagtaaagctcacaatagacatattacaggcattacaatcacaaaccagggttcacttagcatcggcaggagccgcaaaagaatgatatcctcgctgatccacaaatttatgatcggcgagatcgactattctgactttaaatacctgcagggcctgctcagcttttcgagccacatcgaacccagctttatttcctcaatgcgcaaaaaatacggggaggggataatcggacaagtgattaaaggggacttcaatgagtga

SEQ ID NO: 11377 - RNA, 963 nt, unidentified
  source 1..963: mol_type = other RNA; note = synthetic construct
atgctgaaaatctttctaaagctgcagaacgaactcgcttcttcaaaaaatgacggtgtgctgcccacacgagccagaatcgaaagtttcgcgaggagagctacaaactgctataaggtatatagcattcctaaacgcacgagtggagtgcgggtcattgcacaccctagcaaggaactgaagaattatcagcgggcactgatttcaatccttgagcagcaacttgaaccccattccgcgagctacgcttaccaaaaagggaagtccattaagctcaacgcccagaaacacacgaagaagaaatttctgctaaagatggacttcaacgatttcttcaacagcattaccccacagatattcctcacagaattacgctatcgacggatttttttaagtaaggccgaagagaaattgctgattaacctgttcttttggaataagaccaaaagcgaggacaaaaagctcgtgttatctgtaggcgcaccttcctccccgatgctgtctaacttcattatgtacaggtttgatgagttggttagtaagtacgctaaggagaatagcatcgtctacacccgctacgccgatgaccttaccttctcaactaacattaaaaacgtcctgttctcggttccagaatatatcaaaggaatattgcgcgacctctaccagcactatatcactataaacgactctaaaaccatctttacatccatggcccacaatcggcacgtgaccgggattactataactaataactttgagctgagcatcggaagagagcgtaaacgtctcatttccgccatgatccataagtttaagatcggcgttctgaatgaggatgatctttgttacttgcagggcctgctctcatttgcaataaatatcgagcccaatttcatcaataggctgtctagaaagtatggtaaagagatcgtgcatgtgatcaggaagggcgggttgtga

SEQ ID NO: 11378 - RNA, 957 nt, unidentified
  source 1..957: mol_type = other RNA; note = synthetic construct
atggcccagaagctgttcagtaaactgatagacattctgcccttagtgagcgctagccggtcaaagatcgaacgcttttctctgacagcccccaaccggtataaagtctactccattcctaagagaacctccggccgccgaatcatcgcacacccctcaaaagaactgaagatataccaacgagccttgctgtcttctctcgagtacctcttagattctcacgatagcgcttacgcgtataagaaagaccggaacattaaagcaaacgctaaaagacatgttaggaaaaagtacctgctgaagatggatttcaacgatttcttcaattctatcactccagatatgctcttcacccagtttgtaaaagaagaagtcattttctccgaggccgaaaagaggctgctaaagaacctcttgttctggaataaaactaagtcctttgacggaaagatggtgctttccgttggggccccaagcagtcctagcgtgagcaatttcatcatgaaggagttcgatgagtttgtgtatcggtatagtaaggagaagagtatcatctacaccagatatgctgacgaccttacgttcagtaccaataaaaaagacacgctatttgacatgccgaattttatcaagaaggtgcttggcgaggtgtttgagcataaactcacaattaatgagtccaaaaccatttacacatccatggcacataataggcacgtaacaggcgttactctcactaacaagtcgacactctcaattggtcgtgagaagaaacgcttaatctcattgctggtccacaagtacaagataaacgagatcgatgaatccgacttcaactatcttcacggactgctgagcttttcgcatcacattgaacctagctttaccaaaaggttgtctaaaaagtatgggtcagacatactgaaaaatattatcaaggggatctactgcgaatga

SEQ ID NO: 11379 - RNA, 933 nt, unidentified
  source 1..933: mol_type = other RNA; note = synthetic construct
atgaggattaagctctttagtaacctgcagacgaaactcaattgtagccgcaaaaaaatcgagactttttctgagaaggctccctataagtataaggtgtacaccatccccaaaaggtcatccggactgagggtgatcgctcaccctagcaaagaactgaaggtgtatcagcgagccctactctcggtactgggggatcacttgatcagccataagagttccttcgcctacaaactcaatacaggaattaaggacaacgcataccagcatatgcacaattcttaccttctcaaacttgactttagtaacttcttcaacagcatcgttcccgatatgctcctggccgcactaaactttcgggggatcgaagtttctgatgccgaactgcgattattgtccaacctgctcttttggaataagacaaaaacgtccgataacaaactagtactgtctgtgggagccccgtcatcacctgcgatatccaactttatcatgtttcggttcgataaagtggtctttaagtattgcaaggagaagtctatcatttacacaagatacgccgatgacttgaccttcagcacaaatataaaggacgcacttttcgagcttccacgttatattaacggcttattgggtagtatgttcgaccaccgcattatgctcaatgaacgcaaaactgtgtttagttctaaggctcacaaccgtcatgtcaccggcattaccatcaccaacgagaataatctgtccgttggccgggctagaaagagaactgtgtccagcctggtccacaaatatagcctgaataagttagaccaattcgagttcgagcagttgcgggggatgctgtcattcatactgcatatcgagccacatttccttcacagactggaaaagaagtacggtaggagcctgctgataaaaattcgctcatga

SEQ ID NO: 11380 - RNA, 984 nt, unidentified
  source 1..984: mol_type = other RNA; note = synthetic construct
atgctcctgatctccttgcaggaatttagcctgaccatccggctttataaagcctttgaagacgaactaggtgtaactcggagccgtctcatgaatttcgccaaaactgctcctaagcgatataaagtttacacaatccctaagagaaccagtggatatagagtcatagcgcatcccagcaaatcgctgaaaaagatccagaagttcctggctgggtttttggctgacatcttcattactcacccaaattccttcgcatataagaagggggtgtcaattaaggataatgcttcggtgcatctcggcaccaaatatctgcttaagatggacttctctaactttttcaacagtattaccttcgacctgctggtgtcctcctgcaaagaatgtgaggtgaaaatttcactggcagagctccgcttactcgaggggctgttattttggaacaaaaccaagaccattaacggcgacttggtgctgtcagtgggagcccccaccagtccacttgtttctaacttcgtcatgtacaagtttgatatcttcatctccgactactgcaagatcaacaacattaactacagccgatacgccgatgacatcacattttccactaatgacaagaataagctctttggtgtcacaagggtagtgaaagatatactcagcgagcactactcaaataagataactgttaacaacgtcaagacaacattttctagcaaagcacataaccggcacatcaccggcgtcacattaacgaacgataataagttgagtgtcggcagagagaggaaacgcctgatttctaccctaatccacaagtacgttattaatgacatagagaagcaagatgtgacttatctgcagggaatgctttctttcgccatccacgtggaaccggatttccgcgggaaaatgagcaagaaatacggctctaatgtagtgacggagattctgaaactgagggtggagaatgatgaatga

SEQ ID NO: 11381 - RNA, 960 nt, unidentified
  source 1..960: mol_type = other RNA; note = synthetic construct
atgactattaggctgtatcgcgccttcgaggaagactttggtattactagggcgagattgacaacttttgcaaagaccgctccaaagaagtataaggtgtatacaataccgaaacgtagctcgggataccgggtcatcgcccatccttccaaatcactgaaggagaagcaaaaattcctcgtagcctttttgtcagattttttcgtttctcacagcaattccttcgcgtacaagaagggagtgggaatcaaagataatgccaggatgcatcttggcaccaaatatctgctgaaaatggatttcagcgacttcttcaacagcatcacagtcgacctgcttgccctagcatgcgacgagaatggtatcaaagtcagttcggctgaactcaagctgttggaatccctccttttctggaacaagacaaaaactatccggggctcccagaacctcgtcctgtccgttggggcccctacctctcccctagtttccaactttgtgatgtacaagtttgatactttgatgagtgactactgtagtcagaatgagatcaactattcacgatatgctgatgacattacgttcagcaccaataaaaagaatcacctgtttcaggtgacacgcgtagtgaaggatatactgtctgaccactacagtaacaagattacagtgaacaacatcaagactgtgttctctagcaaagcacataataggcacgtgacgggcatcaccatcacaaacaacaataagttatcagtggggcgagagagaaaaagactcatatccaccctcattcataaatacaccataggcagcatcgacatcgatgacacggtctacctgcagggcttactttctttcgctattcacgtggaacccgattttcgggtgaaaatgtctaataagtacgggtttgaggtaattaataccattctgaagctgcgcgttgaaaacgacaaatga

SEQ ID NO: 11382 - RNA, 951 nt, unidentified
  source 1..951: mol_type = other RNA; note = synthetic construct
atgaaacttaagctgtacagggctctgtatgaatcactttctataactcgatcttcactcaataggtttgccgagagtgctcctaaaaagtacagagtgtataccatccccaagcggacaagtggccagcgagtgatcgcacatcctagtaagcagcttaaggccgtgcagaaagagctggtgaagatcctagtctttcctctgaagtcccacgagacagcttatgcatacaaaaagggattgagcataaaagacaacgcagaacagcatctcaatacagcctacctattaaaaatggacttcagcgactttttcaattccattactccagcggtcttattcttgatttgcgagaacaacaacataaagtggtcagatgccgaaaagcgcctgctcaagaatctgctgttttggaataagaccaagagctttaatgggaaacttgtgttgagcgttggagccccatcttcccccctcatctccaatttcgtcatgtatgactttgatgtgaagatttccgacttctgtaagaagaacaaaatcaactacactcgttatgccgatgatataacattctcaaccaatgttaaggagatactgttcgaggtcccgaaattagtaaaaacgctgctgaacgagatttacaataacctgatcaccattaacgacctgaagactatcttttcttctaaaaggcacaatcggcacgtcacaggcgtaaccattagcagtgaaaacaaactctccatcggtcggagccgcaagcgcatgatctcatccttgattcacaaattcaagatcaatgtgatctctcaagaagatacgtgctatctccaagggctgctggctttttcgatcagcgtggagcccattttcatcgagagaatgaagaacaaatacaccgagagcgttatccataacattctcaaaattagagtggaaaacgaatga

SEQ ID NO: 11383 - RNA, 942 nt, unidentified
  source 1..942: mol_type = other RNA; note = synthetic construct
atgcaactgcatctctataagaatattacggagatgttgtcttggagccgaagtcagataacaagctttgcccgtaacgcgcctaataagtacaaagtgtacactattccgaaaagatcttctgggcagagactgattgctcatccatctaggaagttgaaacttctgcagcgggcgctagtggagattctgtcaaacaatctgatcccacatgagtgcgcttttgcctaccgcaacagtatttccattaaggaaaacgcacagtatcatctcgacaaccagtatctgttaaagatggacttctcggatttctttaactccataacaccagacatcttgttctccgtctgcgaaatcaaagaaatcacgctgagcgaagccgagaagtggcttctccaacgggcctttttttggaataagacaaagagtcacgatggcaagctcgttttatctgtcggtgcccccagcagccccctaatctccaatttcatcatgtatccgttcgatgaggctataaacctgtattgtacccagcacagtatatactatacacgatacgctgacgacctgaccttctccaccaagattaaaaacaccctgttcaatatacccgatatcgttaaatgggccctgaaaaagcactacgcaagtcagattagcatcaatgagtttaagactgtgttctcatcaaaagcacacaatcggcacatcactggcataactatcaccaacgataataagctttccgtaggaagggaaagaaagaggatgatcagctcacttatccacaagtataaaattgggattgtgaacgaagaggagaaaacctacttgcaaggactcctctcattctctttccatattgaacccatgtttaaaatccgcatgtccaagaaatacagccctgagatcattaacgagatcctgaagtttcgcaaatga

SEQ ID NO: 11384 - RNA, 942 nt, unidentified
  source 1..942: mol_type = other RNA; note = synthetic construct
atgcagctgcatctctatagatcaatcatcgacaagttatcctggtcacggagtaggattacgagcttcgcacggaatgcaccaaataagtacaaggtgtatactatccctaagaggagttctggtcagcgccttatagctcacccatctaagaaccttaagctcatccaaaagaaatggattgagatactgtccgacatatttgtctcccatcaaagcgcctttgcctacaaagataacatggggatcagggagaatgcccagcatcatatgaaaaaccagtatctgctgaagatggacttcaccgactttttcaattccatcacaccggaaattttcttttctatttgcctgaagaaggaaataatcatgtccaacgccgaaaaatggctgctgcagcagaccctgttttggaacaaaaccaaatcttatgacggcaagttggtgttgagcgtcggagcacctagctcacctctcgttagcaattttgtgatgttccccttcgacgagatcattagcgagtattgtaacagtcaccacattaaatactctcgatacgctgatgacctgaccttctcgacagatgagaaaaattgcctattcacgatccccaacttggtgaaaagtgctcttcagaaaatttacgcctaccagatctctatcaacgagttcaaaactatcttttcctcaaaggcccataatcgtcacatcacaggaattacaataaccaacgataatgatctcagcattggcagagggaggaagcgcatgatttccagtctcattcacagataccgaataggtgtaatggacgatattgaaaaggctcacctgcaaggctttctggcgttctcgttctatattgaacccttatttaagactcggatgatcaagaaatactcaagcgaggttatcactgatatcctaaaatttcgcaagtga

SEQ ID NO: 11385 - RNA, 1143 nt, unidentified
  source 1..1143: mol_type = other RNA; note = synthetic construct
atgtcctcccgggcccttagacaaacacaaatctactggggcaccataccagtggcggttaagaacttcccccgagctggcgttcggacaagtcaccctgatcgggggaaattctccaccgccagctttagcaaaggtgaaagtccggtgttgtcctttcagtacagacacttttatctcagaatctgcacggatatgcaccagaagttgtactctaaactggtagacaaacttgacagtactaggagtactatcaacagcttttcaaaaaacgcgcctaataagtacaaagtctacactatccctaaacggacctctgggcatagggttatcgcacatcccagtaaggagctgaaaaagtatcagagggccctggtcagtatcctgtctgatattcttaacatacacccaacctcttatgcatacagaacaggcttttcgatcaaggataatgcatataagcacaggaagaatcagtacctgctgaagatggacttttccgacttcttcaacagcatagagccaaagctgctgttctttgtgttcgacgaatgtgaaattcatttctcatcatctgagcttcgcctgctggaaaagctgctcttctggaacaagaataagtccgtggacgcaaaattggcccttagcgtaggagctccaagctcacccctcatttcgaatttcatcatgtgtatcttcgacgagaaaattaactacttttgcgagaaaaacggcataacttatacgcgatacgctgatgatctcaccttttcaagcaacaagaagaatatcctgttcaatgtgcccaatattgtcaagaacctactcaaggaggagtataaaaatctcatcttagtgaacgacctgaaaacatgtttttctagcaaggcccataaccgtcacatcaccggggtgacaatcaataatgacgctgagttgtccattggaagagatcgcaaaaggttaatcagcgccatgattaataactataagaagggcattctcctgtccgaggattttgactatttacgcggaatcttgtcattcgccaataacattgaacctgatttcatttctcgcatgaaacgtaaatacggtaaatgcattctgctaaagataaagaaggggctaccgaacgaatga

SEQ ID NO: 11386 - RNA, 948 nt, unidentified
  source 1..948: mol_type = other RNA; note = synthetic construct
atgcgccagcagttatacagcaagctccaaatcaagctggggcgcagccgaagtagcatcaagagctttgcaaacaatgctcctaacaaatataaggtctacaccatacctaagcggacctccggcagaagagtaattgcacatccttcaaaacttctgaaagactatcagcgggcactgacagatatcctcaagccagctctaaccgtgcaccccgctgccttcgcctaccgtactggatttagcataaaagataacgctcagatgcataagaaccatcagtacttgttgaagatggacttcaatgacttctttaactccattgatccagagctgttcgaagatattctcattaggcggggtattaggtttagtaacgccgagatgtcactgctaacccgtctgcttttctggaataagactaaaagtcacgacgaaaaactcgtcttgtcagtgggggcaccgagctcccccctgatatctaacttcgtgatgtccatcttcgatgccaaaatgaaactgcattgcctcaagcggcagatcacatacacgagatacgctgacgacctcacgttttcgacaaataaaaaagacgtgctgtttaacatcccccagttggtgaaagacacactcactaaggattactcacacaagattctgatcaacgagcttaagaccatctttgcctctaaggcccacaatcgccacatcactggagtgactatcaataatgcctctgagctgtccatagggagagaacgaaagaggttgatcagtgcgttagtccataagtatacagttaagcaactggataccgacgacattcactatgttcagggccttttaagctttgcgcaaaatattgaaccacacttcgtagatcgcctttctaagaaatatggcttcgatgttctgtctaaactgattagggacaaaggtgatgagtga

SEQ ID NO: 11387 - RNA, 945 nt, unidentified
  source 1..945: mol_type = other RNA; note = synthetic construct
atgcacaataaaatattctccaagcttcaggcctcaacaagtagagcaaggagcaccatcgaatcttttagccgtaatgccccgaataagtataaggtgtactccatacccaaaagaacctccggttctcgaaccattgcccacccctctaaagaattgaaatattaccagagggcactagctatcattctcaggcccattctgacagtgcacatccgggcttacgcctacagaaccgggctttcaattaaagacaatgccgcgatacacgccaagaataagtacttgctcaagatggactttaacgacttctttaattccatcacaccagtaatgtttttcaaaatatgcgacaagcgtaagatcaagttcagcgctagcgaacaacgcttattaactagaatgctgttctggaacaaaagtcgatcagctaacgagaaattggtgctgagcgtgggagcccctacgagtcctctggtcagcaacttcacaatgagtctattcgattttctgctccacgatgaatgtctttctcgcggcatcacttattctaggtacgcagatgatatcactttttccaccaaccacaagggtattctgtttgatatccctctgtatgttaaagctgtccttgcggagcggtatgactacggaataacaattaacgagtcaaaaaccgtgttcagttcgaaggcccataatcggcatattacggggatcactattaacaacgagggcaagttatctctgggccgcgagagaaagcgcgttatctcaagcctcgtccatcaatttaaactgaacaagctcgcaatcgaggacttcgcatacttgcaggggctgctggccttcgcgcagcatattgagccagcttttatcatccggctgaaaaacaagtatggcgaatccactgtgtccaacattaataagggactcaatatctga

SEQ ID NO: 11388 - RNA, 954 nt, unidentified
  source 1..954: mol_type = other RNA; note = synthetic construct
atgcaccataagatctactctaagctgcagctgaaattgaagaccagccggtcctccattgataactttgccttgaatagccccaacaagtacaaggtttatactattccaaagcggacggcaggttttagagtcatcgctcatcccagtagagagttgaagtgttatcagcgccatcttgttgagattctcacaccccacctgaagaatcacagtagcagtatcgcctatacaaaagagaagagcattcgtgaaaatgccctgatacatgtgaggaacgactacttactcaaaatggactttaatgacttcttcaacagcatcaccccagaactgttcttccacatttgcagagtgcaggaggtattcttctcgcaagccgaggagaggctgctgaccaaactgctattttggtccaagtctaagtccaaagatgagcatctcgtgctgagtgttggggcaccttcaagtcctctgattagcaattttacgatgtacacattcgacgaacttataacatcaatatgccacgagaatggcatctcatacaccaggtacgcggatgatattaccttctccacaaaccgaaagaacattctcttttctatcccgtctttggtgaaatccattctcctgaacaagtacgagtataagatcactatcaatgactcaaagactgtattctcatccaaggctcacaatcgccacgtcaccggcatcactcttaacaacgaagggcagttatctctcgggcggaaccgtaaaaggatgcttagctccatgattcacaaagaaaaaatcggttctctgagcttagacgattttacttatatgcgcggactaatctcgtttgcaaaacatatagaacctgcttttatcttccgaatgagagtgaaatatggaaacgaaaccgtggataacataatcaaaggcgtccggaatgtgacaaattga

SEQ ID NO: 11389 - RNA, 948 nt, unidentified
  source 1..948: mol_type = other RNA; note = synthetic construct
atgtatcaaaagctctacagtaaactgcagaacgagcttaagcggtcccgttctagcatcgagtccttcagtaaaacagcacccaacaggtataaagtttacacgatacctaaacggactagcggacaccgcgtcattgctcatcctagcagagaattaaaactttttcagaaagccctgaacaccttactgctggatacattgaagacgcatttctgttcggtggcgtacgccaagggcctctcgataaaagataatgcccttaggcacgctggcaatagctatctcctgaagttggacttcaatgacttcttcaactcaattgagcctgacctgttttttgttatctgtgatctgcaggaaatcaatttctccaacgccgagaaacggctcctgacacagctctgcttctggaacaaaaccaagagcaacaatactaagctggttctctctgtgggtgctcccagctctcccatgatttcaaacttcgtgatgaccgtatttgatgagctgatgtataagcattgccgagtccaaggcattacctatacaaggtacgccgatgacttaacattcagcaccaataaaaagaacatccttttcgacatcccaacttttgtggaagcggtcctagtggcatattacgcctccaagatttctatcaatccggagaagacatgctactcctcaaaaaaacacaataggcatgtgactggaattaccatctctaatactggggaactcagtttgggccgcgagagaaaaagaatgatctccgcaatgctgcacaacttcaaggtagggcgattggattcagatgactacgcatacctgcagggactactgagttttgctcgccacatcgaaccaaagtttgtggacaagtttagaaagaagtatggggacggcctgattgacaccataaccaagggtaactttaatgagtga

SEQ ID NO: 11390 - RNA, 963 nt, unidentified
  source 1..963: mol_type = other RNA; note = synthetic construct
atgagactccacttgtatgctaaactcacagaaattcaatcacgcaataggaggcagatcgacaacttcctgtataacgccccaaaccgctacaaggtctattcgattcctaagcgcaatgggggggagcgggtaattgcacagccttctggcgaattgaaggattttcagcacaacctgatcaatatcttagagagcaatttcctcatacattccagtgctgtggcgtataagaagggattcggcattaaacataacgcagctatgcatagtggtaatccgtacttgcttaagctcgacttcactgacttttttaacagtataacgccagagctcttttttatggcgtgcgtgtggaatagatatgatctgtcaacagccgagaagcgggtctttacaaaaggactcttttggaataaagccaaatcccagtccggccgtctttctctgagcgtgggtgccccctcctctcccttagtttccaatatcatcatgtacctgttcgatgaggaattttctagacgatgtgaaaagaggggcatcgtgtacacgaggtacgctgacgacttgactttctcaacccaccataaaaacagcctgtttagcctgcctgacgaggttagggtgttcctgaacaaaaactaccataaccggattaccctaaacgagaggaagactattttcacatccagagcccacaatagacacgtaaccggcgtcacccttactactcaaggagggctcagtgtggggcgcgaacggaagcgattcataagctctctgatccacaagtacaccttgggtatccttgagcccgatatggcatactatctacagggcctgttaagcttcgccatttacatagagcccgaattccggacccgactgagcaaaaaatattcacaggaaacaatcctggagctgctgaagcttcgtaaggaggatggaaccgagaatgaatga

SEQ ID NO: 11391 - RNA, 987 nt, unidentified
  source 1..987: mol_type = other RNA; note = synthetic construct
atgcggttaaacctctacgctaaactgaccgagatacaatcaagaaatcgaagacagattgacagttttttgttcaatgcccccaatcgatataaggtctatagcattcccaagaggaatgggggcgaacgcattatagcccatcctagttcagaattgaagtcctttcagcactctctaattgacatcctggaaagcaatttccttattcacaaatccgccgtagcgtataaaaaaggctggggaatcaagcacaatgcggcactccacagtaacaacccctacattctcaagctggacttcacagatttcttcaactctatcaccccggacctgctcctgatggcctgtgcctggaatggatacacgctgagcatcgccgaggagagagtgttaactaagagtctgttctggaacaaagctaagtcacaatcaggtaggttgtccctgagtgtgggagcacctagctctcctctcatctctaacatagtgatgtacttgtttgatgagacattctcatccttatgcgaacagcgggagattatttacagcagatacgcagacgatctgacctttagcactcagcataaaaatatcctgttttccctgccagatgaggttaggacctttcttaacaagaactatcacaaccgtatcacacttaatgagaggaagacagtgttcacctctcgcgctcacaaccgccatatcacagggatcacccttacgactaaaggcaccctcagcgtcggccgcgagagaaaacggtttatttcgagcctgattcataagtacaagctaggccttctggaaccagaaatgacttattacttgcaggggctactctcctttgctatctatattgaaccagagttccgtacacggatgtccaagaaatactctcaggagataatcctggagatcatcaagctgaggaaagaagatggtacctacaaaaagctcaagatctatcagactcatatatga

SEQ ID NO: 11392 - RNA, 963 nt, unidentified
  source 1..963: mol_type = other RNA; note = synthetic construct
atgaggctgaatctgtatgcgaaactcatagagatacagagccgctctcggcgcgcaatcgactcattcctctacaatgcacccaaccgatacaaagtttatagtatacccaagaggaacggcggagagagaatcatcgctcatccctctagagaactcaagaccttccaatacgatctgatcaggattttagaacctcactttcgcattcatacatcagctgtcgcttataagaagggcagtggcattaaacagaatgccgccatgcactcccacaacccatacattctcaagatggactttaccgacttttttaacagtattactccggacctgttgttcatggcatgtgcttggaatgaatgcaatctctctgcagctgaacagcgcgtgttgactaagggcctgttttggaataaggccaagtcccagagcggacggctctccctttctgtcggtgccccaagtagccctttcattagcaacatcatcatgttcctgtttgacgagacgttttcgagattgtgcgaacagcgggggatagtttatagcagatatgccgatgacctaacattcagcactcaccataaaaacatcctgttcacgctgcccgatgaggtacgcatcttcctaaacaagaactatcacaatcgtattactctgaacgagcgtaaaacggtgtttacctctagggcccacaatcggcatattaccggcatcaccttgacaactcagggttcattaagcgtggggcgagagcgaaaaaggttcatctcctcccttattcataagtacacactgggaatcttagaacctgagatgacttactatcttcaagggcttctgtcatttgcgatccacatagaaccagagttcaaaaccaggatgatcaacaaatactccaccgatgccgtgatggagattatcacactgcggaaaaaggatgagacatacagaacctga

SEQ ID NO: 11393 - RNA, 966 nt, unidentified
  source 1..966: mol_type = other RNA; note = synthetic construct
atgaggttaaacctgtacgcaaaactcgtcaagattcagccgcgcaatagacgccaaattgactctttcctgttcaacgcccccaatcgctacaaggtctataccattcctaagcggaacgggggcgagcggattattgcgcaccccagcagagagttgaagacattccagtacggtctgataactatactggagactcacttcaggatccacgaatctgccgtggcgtataagaagggcctcggaatcaaacagaacgccacactgcatagcaacaatccatatatcctgaagatggatttttcggatttcttcaattctatcacccccgacctgctgttcatggcctgtgaatggaatgattatgaactgtccagcgctgagaaaagggtgttgacaaaagggcttttttggaacaaagctaagaaccagtccggacggttgagtctctcagttggcgctcctagctccccactgatcagcaacgtgataatgtatctctttgacgactcctttaccaacttttgccagcaacgcgagataacatattcacggtacgcagatgatctcacttttagcacccaccacaagaacgccctatttgatcttccaaatgaagtgcgtcatttccttaataaggagtaccaaaatcgtattacgctgaatgagagaaagaccgtattcacctcacgagctcacaatcgccatatcactggagtgactttaaccactcagggtagtctgtctatcgggcgagagcgaaaaaggttcatctcctccctcattcataagtacaaattaggcctcctggaccctgacacatcatattacctgcagggcttgcttagttttgccatctacatcgaacccgactttagagttaggatgtctaaaaagtacagtacaaacaccgtcacggaaattatcaaactaagaaaagaagacgaggcataccggaagcagtga

SEQ ID NO: 11394 - RNA, 966 nt, unidentified
  source 1..966: mol_type = other RNA; note = synthetic construct
atgcggcttaacctctacgcgaaactgatcgagattcagcctaggtcacggaggcagattgaccgcttcctggccaacgcacccaataaatacaaggtctacaccatccctaagcgcgatattggtgagagaattatcgctcagcccagtcgtgaactcaagaaattccagcactatatcataagcatcctcgaatccttgttcgaaatccacacctccgcaatcgcttataggaagggcacggggattaagcagaatgctaatatgcattcagccaacccgtacatacttaagatggacttcagcaattttttcaactcgattactcccgacttatttttcctggcgtgtaagtggaacaactattctctctccgccgcagaggagcggttattgactaaggctcttttttggaataagtctaaaacacaggatgggagactggccctgtccattggcgctccaagtagcccactcgtaagcaatataatcatgtatctgttcgatgaggagttcaacaccctgtgcaaagacaatggtatcgtctactctcgatatgcagacgatctgacgttcagcacctctcacaaaaacctgctgttctccctaccagacaaagttagggcctttctgtttaagcattataacaatcggatcactctgaacgaaagaaaaacagtgtttacatcaaaggcccacaacagacacattacaggagtgaccctaactaatgagggcacactgagtgttgggagggagcgcaaacgattaatctctagcctggtgcataagtacaagctaggccttttggaacctgatatggtgtactatctccaaggattgctttcatttgcatcctacattgagcccaattttcgctttcggctggctagaaagtacagtgccgaaaccatcactaaactcataaagttgcgtaaagccgatggaaagttcaagaaacaatga

SEQ ID NO: 11395 - RNA, 963 nt, unidentified
  source 1..963: mol_type = other RNA; note = synthetic construct
atgcgtctgaacttgtacactaagctggtgaaaattcagccccgaaatcgtcgacaaatagactctttcctgtataacgctccgaacagatacaaagtgtacagtatcccaaaacggaatggcggcgagcgaattatagcacacccctcccgcgagctgaaaaatttccagtacaacttgatagacatcctggaacctttactcaagatccatcctaatgccctagcgtacaggaagggactaggtataaagaaaaatgccagcttgcacgcccagaattcgtacatcttaaaactcgacttctccgacttttttaattcaattacccccgatctgcttttcaccgcatgtactaagaatgaatatgaactgagttccgcagaaaaaagggtcctgacaaagggactcttctggaacaaggctaagtcacagtcagccagactctccctttctgtaggggccccaagctctcctctgatctccaacattatcatgtactattttgacgagacgttcacggatatctgcaaccagagggagatagtgtatacaaggtatgccgacgacttgacctttagcaccaataagaagaacatcctctttaatttgcccgatgagattcgcttctttctgaacaaggagtacaaaaacctcattacactgaacgagcggaagaccgtcttcacttctagagctcataaccggcacattaccgggattacaatcacaactgagggtagcctaagtgttggccgggaacgcaaaaggctgattagcagcctgatccacagatacaccctggattctctgtcaccagatatgacttattacctccaagggttacttagttttgctatctatatcgaacctgacttccgggatagaatgtccaaaaagtatagctcgcatatcatcaccaagcttattaaacttcgcaaggaggatggaacatactgcgaatga

SEQ ID NO: 11396 - RNA, 963 nt, unidentified
  source 1..963: mol_type = other RNA; note = synthetic construct
atgcatctgaatttatacgccaagcttgatggagtgcagtcgctcacgagaaagcaaatcgattcattcctggccaatgctcctgaccggtataaagtctactctattcccaaacggaacggaggtgagaggataatagcgcaccctgcaaagcgattaaagcagtttcagtaccacattgtagacattatggaagaagtttgtgagatccatccctgcgcaatggcctatagcaagggcaaaagcatcaaagagaatgcactgagccatgccgataaccagtatatcttgaagcttgacttttccgatttcttcaactctatcacaccagagatgctcttcaaagctctgaccgacaataacctgaacgttactaaagcagaagaacgcgccttgtctaagtccctgttctggaataagtccaaaaccgtgaacagtcgactggccctatcagtgggcgcaccttcaagtcccctcatcagcaatattgtgatgtactcctttgacgctttcttcgccaacttttgcaagcagcacggcatgcactttactaggtatgctgatgatttgaccttctccacaaatattaagggggttttgttccgtattcccgacatggtccggaagtatctcaacgagtactacaaaaacaacatcacactaaatgagaggaagactgtgtttacctccaaggcgcacaacagaagagtcacggggataactattacaccgcaaggtaccctgagcctgggcagagaacgcaaaaggctgatcagtgtgctgatccacaaatatacacttgggatcctcgaatcagacaccttaagctatctccagggaatgcttgcctttgctttccatatagagccagtgttttacgagtctatgaaacgcaagtacagttctgaaaccatttacaatctgatgccaatccggaagaaaaatgtagagtcgactagctga

SEQ ID NO: 11397 - RNA, 951 nt, unidentified
  source 1..951: mol_type = other RNA; note = synthetic construct
atgaagctgcacttatatgcgaagctcaccaaagatctggacaagtcaagaagcgccgtagagcggtatatctataatgcacccatgaagtataaggtgtacactattcccaagaggacatcaggacagcgagtgatcgcgcatccagctaggaaacttaaggtgtttcagagggctctaattaaggtcattgagccacactttaatttacacataaaggccatggcataccgcaatgggatcgggatcaagcacaatgctgccatacatcagaacaataactacctgctgaaactcgacttcaacgacttctttaattcaattactcctgacctcctgtttacacacttcctcaagaaagagattttgttgtccgatgccgaaaagaaactgctgactaacacctttttctggaacaagcctaaaaaaaaggacggcaagctagtgctgtccgtcggagccccgagtagtccattcatttctaacttgatcctgttccctttcgatgagctgatcgacgactattgctcgaaaaaaaacattagctactctcggtacgccgacgatctgaccttcagcacctccgagaagaacatcctatttcagttgcccagccttgtcaaacggcatctgtcgagcatttacaagaacaaaatcaccattaacgagttcaaaaccgtgttttcttccaaagcacataatagacatgttacaggcgttacgatcacaaacaccggggagctgagcattggtcgtgaaagaaaacgcttgatcagctccttaatacacaagtttaagatcggtgagctcaatcttgatcttactaggtatctgcaaggacttctgtctttcgcttcagatatagagcccagtttcaagagtcgaatggaactcaagtactctctctccacgatcgaaaaaatcatagaatttcgcggcgaaaatgaatga

SEQ ID NO: 11398 - RNA, 963 nt, unidentified
  source 1..963: mol_type = other RNA; note = synthetic construct
atgaagctgcacctgtatgccgagctgacgaagaaattgaataggtcacgcaattctgttgagcgattcatcagcaacgctccgatgaaatacaaggtctacaccatccccaaaagaacatccgggcagcgcgttatcgcacaccctgccaaaaaattaaaggtgctgcaaagagcattggttgccgtcctccagccacacttttctattcatgacaaagccatggcgtataggaaaggccttgggataaaacaaaacgccacattacatcagaagaatgactacctgctgaagctcgatttcaatgattttttcaactcgatcacacccgaaatttttattaagtactgcacccagaaggagattgaactgagtgacgctgaaaagaaactcctgatcaagacattcttttggaataaaacgaagaagactgatggaaaacttgtattgtcagtgggcgcaccaagtagccccttcctcagtaacgtgctgatgttcggatttgacgagttcatcgaaaactactgttcccagaaaaatataagctatagtcggtacgccgatgacctcaccttctctacttcagataaaaatgtcctcttccacatccctaagttagtgaaaacccaacttgggctgatgtttttcaaccagattaccatcaacgaatttaagaccgtgttttcctccaaggctcacaataggcacgtaactggcgtgacactgaacaacaatggtgaactatctattggccgcggccgaaagagattgataagctcccttatccataagttcatgcacggtgagctagacattgagctgactcgtcacctgcagggactccttagctttgcttccgatattgaacctatattcaagtcacggatggagattaagtattctcataagctgatcgagagcatcgtgaaatttcggggggaacatgagcaggagaaccagtga

SEQ ID NO: 11399 - RNA, 960 nt, unidentified
  source 1..960: mol_type = other RNA; note = synthetic construct
atgaagttaaatctctatgctaagctcacagacaaactcggccggagccgaaatactgttgaacgctacatctcaaatgggcctatgaagtataaagtgtacaccattccgaaacgtacctccggacaacgagtgattgcacaccctgccaagaagcttaaggtgatacagagggccctagtcagcgttctggagccccacttgaaaatccatcataaggctatggcttataggaaaggcctgggaataaaggataacgccgtcctgcataaagagaacgagtatttgctcaagctggatttttcggactttttcaattccattacacccgaactgttcatcaactactgcatgcagaatgatattacactttctactgcggagaagaacctgctgatcaaaacctttttctggaataagacgaagaaaaacgatggaaagctggttctaagtgtgggtgcaccaagctctccattcatctctaacacaatcatgtacttctttgacgaggccatcgacaagtactgtatcactaaaaacattacctactccagatatgccgacgacttaacgttctccactcctgataagaatgtgcttttccatattcccacactggtaaaaaaacagctcgggattatcttcagtaaccagatcaccattaacgctttcaagaccattttttcatcaaaagcccacaaccggcacgtaactggcgtcacaatcaataacgatggcgagatatccattggtcgcgagagaaaaagattgatatcaagcctgatacacaagtttatcttgggccagctggacatcgaacacattcgctatttacagggactgcttagctttgcaaccgacattgaacccaaatttaaaagtcggatgatatccaagtactctaatcaggtgatcgagaacctcatcaagttcagggggagcgatgaacaaaccaattga

SEQ ID NO: 11400 - RNA, 951 nt, unidentified
  source 1..951: mol_type = other RNA; note = synthetic construct
atgaaactgcacttgttttctaacctggtgaaagagactaaattctccagaaacgcgattgagcggtacatatataatgcacctatgaagtacaaggtgtacaccatccccaagaggtcttccgggcaacgggttattgctcatcccgccaagaaattgaaaatcctccagagggctctggtaagtatcctaatgccttttcttaatatccacgaccgcgcaatggcttaccgaaagggtattggaataaaacataatgcgaccatgcacaaaaataacgagtacattctgaagattgacttcaacgacttcttcaatagtattacgccagatatgatactggaacggttttctaagaacaacatcgaattatctagcgcagagaagaaacttatcatcaagtgctttttctggaacaaaacgaaaagaattgacgggaagctcgtgctatcagtaggcgccccctcgtccccgtttctgagtaatgttctgatgtttgatttcgatgagttctttagcaactattgcaaagaaaacagcatcgtgtactctaggtatgcagacgacatcacatttagcagctcaaaaaagaatgtcctcttcattattcctgatcttgtcaagaaacagttggccatactgttcaagaacaagatcaccataaatgagtttaagaccatcttctcatccaaagcccacaatagacatgtgaccggcgtgacaataaacaataacggtgaactctctctcggacgcgagcgaaagcgcttcattagcgccctgattcacaagtttactttgaaaacactgtcccttgatcaggcccaacagttacagggcatgatttcctttgctagtgatatcgagccatcgttccgtctgagaatggaaaagaagtattcagagggaatcatctgtaagatcgtcaagttcagggggagctatgaatga

SEQ ID NO: 11401 - RNA, 948 nt, unidentified
  source 1..948: mol_type = other RNA; note = synthetic construct
atgtctgtacacctctacaagcgccttagcgaggctatggcaacccctcggaacactattgatagctatatacgtaacgccccgatgaaatacaaagtgtataccattcccaaacgaacatctggtcaacgggtaatcgcccacccagcgatacgcctgaaaaagattcagagggccctggtcgtgctgctccaggagtacatgttcatccaccaaaaagccatggcatacaaaacagggtctagcataaagaaaaatgccgaactacatagaaccaatgactacattttgaagatcgatttcaacgactttttcaatagtatcacaccagacctctttgttaattactgtaataacctagggctgaaactgaccagtgctgagatgaacgcactgattaagatcctcttttggaacaaaagcaagaaaaatgatggcaaactggtcctgtctgtgggcgctccttcctcacctttcatctccaatgtgatactttacagtttcgatgaaatcgtggacaattattgcaacgaacggaacattgtttactcaagatatgcggatgacttgtcgttctccactaaagagaagaacattttattctcagtgcccgagttcattaagaagcagctcaacaagctgtttagcaatgctatcaccatcaatgaactgaagactacgttttccagtaaagcccacaaccgccatataacgggagtcacaatcgacaacgatggaagactttcaatcgggagggaaaggaagaggtatatctctagcctcattcataagttttccttgaagaagcttgagtttaacgatgctaagcacttgcagggcctgttcgccttcgcctgcaatattgaaccccgatttaaggcaagaatggagaagaagtattccaaactgatcattgacgacttaatcaagctcaaagagttactgtga

SEQ ID NO: 11402 - RNA, 954 nt, unidentified
  source 1..954: mol_type = other RNA; note = synthetic construct
atgcagatttacgagtttctttgtaaggaactgctggtcagcaaacaggaaattaatgagtttgtgctgagcgcaccaaaaaagtacaagcggtacacaatccccaaaaggacttctgggaaacgtgtgatcgcacagcctgcgaagaggctcaaagactatcagcgcgctcttatcaaactgctggagcagatattgcccgttcatgacgcagccttcgcttacaagaagaacatcggtatcaaggagaatgcccggaggcaccagaaatccagttacctactgaaaatggacttcagagactttttttactccattactccggatctgttctttgctatactgaagaagctagacatagtattcagccctcaggattgctatctcttaacacaggtgttgttcttcaatccaagcaagaagaccggaggtaaactgatcatgtctattggcgcgccttcgtctccctttatttccaactcaatcatgttcttcttcgacaaggctatttatgagtcttgtctgaagaagggcatatgctacaccagatacgccgatgatttgaccttttcctccaacaagaaaaacgccttatttgagttacccgtcctggtaaagcaactcctcgtcgagcatttttgcggctgcatcacgattaacgaaagtaaaacggtgttctcaagcaagagccataacaggcacgtgaccggaatcacaattaccaacgacgatagattgtcaattggaagacagcgaaaacgatatatcagtagtctgattcacaaattctctctgaatcaacttgccgacgaagatatcaattatcttcaagggctcctcgcctttgcttgtcacatcgaaccaaatttcaaacaacgcatgatcgacaagtattccgcagaaacaatctcacagatagtgacttgtgttcgccggggggatgagaaggcctga

SEQ ID NO: 11403 - RNA, 942 nt, unidentified
  source 1..942: mol_type = other RNA; note = synthetic construct
atgcagatatacgatttcctctgtaaggagatatcggtatcaaaacaagagatttatgacttcgtgagttccgctcccaagatgtacaaagtttataccattcctaagcggactagtggcaaacgcgtcatcgcccaacccgcgaagagattgaaagactaccagagagccttggtcaaactgctagagaaagtcctgccagtgcatgatgccgcctttgcatacaagaagcaagtgggaatcaaagagaacgcaatgaaacaccagaagtcttcatatctgctgaagatggatttccagaacttcttttatagcattacaccgaccctgttcttcagcattctttataagctgaacatagatctgtcaagtgaagaccgttacctccttacgcagattctattcttcaatccttccaagaaaacaggaggtaagctggttctctccataggggctccatcttcccccttcatcagcaatagcattatgtatttcttcgacatgtccatctatgagtactgtatcaacaataacatcaactacacgcggtatgcagacgacctcacatttagttgccagaagaaggacatcctctttgccgtgcctacacatgtaaaacagcttttggttgaatactttgatggcaggatcaccatcaacgaaagcaaaactgtgttttcttcgaagtctcacaataggcacgtgaccggtgtgacccttactaatgataacagactgtccatcgggcgacagaaaaagcggtacattagcagcttaatccatcagttttctctcaatcagctggccgacgaagatatctcatacttacaaggcctgttggcatttgcttgccacattgagcccaattttaagcagcgaatgattgacaaatactctgcggaaataattgctaagatcatcactcgcaagaggaccctgtga

SEQ ID NO: 11404 - RNA, 960 nt, unidentified
  source 1..960: mol_type = other RNA; note = synthetic construct
atgcaactctatcagttcctctctaccgagctttcaacatccaagcaggagattgacaaattcattctctcagcacctaagatgtacaagatctacactattcccaagaggacaagcggaaaacgaactatcgcacatccagctaaaaaactgaaggaataccaaagaaccctgattagtctgctcgaacagtctctgccagtccacgatgtcgccttcgcctataaaaagaacacaggcatcaagcagaacgctgcgcagcatcagcaatccaaatatctgctgaaaatggattttcaggatttctttcactcgatcaaacccaaactttttctgtccattctcgaaaagctcaaggtggacctgactcaagaagataggtacctgttaagccagatcttgttctggaatcccagcaaaagaagtgggggcaagctgatattatcaattggtgcaccttcctctccgtttatttccaacgttatcatgttcttcttcgaccaggctttgtatactgagtgccatcggcagaatattacctacaccaggtacgccgatgacataagtttttctaccaatacgaagaacactctttttgagatccctcacctcgtaaaaaagctgttggtgaaccactttaatggagccatcaccgtgaatgagtctaagacagtttttagctctaaagcccataatcgtcatattaccgggataacgctgaccaacgagaataaattgtcgatcgggagacagaagaaacgctacatcagtagcctaatacaccagtttagcttaggacaactgccaacagaagacatccagtatctacaaggcctgcttgctttcgcctgtcacatagagcctgagttcaagcagaagatgatcaagaagtatagcttcgaaacaatcaaccagatctccacttcagtggaaggtgaggacgagcccattcgccggtga

SEQ ID NO: 11405 - RNA, 951 nt, unidentified
  source 1..951: mol_type = other RNA; note = synthetic construct
atgcacatatgccaggccttgtgcgctgagctcaagcttgacaaaactcaggtgattgattttgcattagagtccccaaaaatgtacaaggtatacgccatcccgaaaagaacttctggcaaacgtattatcgctcacccagcaaagcgcgttaaggtggcccagcacgctcttttgaggcagatgaaggttatcttccccattcaccattgcgcctttgcgtatcaggagggtttaagcattaagctgaatgcccaggagcattgtcataaccagtatcttctgaagatggacttccagaatttctttaactccatcacagcgccactgttcgttcggatgctagacaaactctccattaagatctcgccccaagatacctttctgatcgaacatctcgcattttggtgtcctagtaaggaaactggtgggaaacggatcttgtccgtgggagcccccagctcaccttttatatcaaactggataatgtacgggttcgacaaaatcgtgttcgaactgtgtcggaaagaaaacattgtgtacacaaggtatgccgacgatttgaccttcagtaccaataagaaaaacgtcctctacaagatccctaagcagatcaagtctattcttcgcgagcaactggatggcggcatcgtcataaatgatgtgaagacgatattcaccagtaaaaagcacaacagacatgtaacaggcattacgttaactaatcagggactgctgtctatcgggagaaagaggaaacgacacatctccctcctgctgcacaagttttcactcgggctgctgggaaccgaggatattctcagcctgaggggccttctaacctttgctaaccacatcgaaagcgacttcaaagcacgaatgacaaagaaatacagctctcaagtgattcaacagctgttggcttatgaccgcgtccacaatcatgagtga

SEQ ID NO: 11406 - RNA, 951 nt, unidentified
  source 1..951: mol_type = other RNA; note = synthetic construct
atgctcatctgccagagcctttgcacggagctgaatctcaaccaaacacagttgatagattttgcaattgaagctcccaagatgtacaaagtgtatgccataccaaagcgaacctctggcaagcgtattatcgctcatcccgcaaaaagagtcaagattgcccaacgggccttactcacacagatggaaactatttttcctatccacaggtgcgccttcgcatatcagcaggggctgtccatcaagctgaacgcccagcagcattgtgacaaccaattcctgctcaaaatggacttccagaacttctttaattccataaccgcgcctctgtttgtgtcaatgcttgataaactctctatcaacatctccagccaggatctgttcttgatcgaacatctggctttttggtgtccaagcaaagaaaccggaggaaaaaggatcctgtcaattggcgcgcccattagtccgttcataagcaattggataatgtacggtttcgacaaaactatctttgacctatgccggaaagagaatatcgtctacacaagatatgccgatgatttgacgttctcaactaacaagaagaatatcttacaccggatgccaaaaaaaattaagtcaatcctcagagacgagctgggggggaacattgtgatcaacgacattaagactatcctgacatctaagaagcacaatcgccacgtgacaggtataaccattaccaatcacggcgacctctccgtaggccgcgataggaagcggtacatttctctacttatccacaagtttagccttggactgctgtccgaggaagacatcgctagtttatgtggcctgttcagtttcgcaaatcatattgagcctgattttaaggaccgaatggttaaaaagtacaccgcccaagttattcagaagttgttttcgtacgatcgcgtgtataaacatgagtga

SEQ ID NO: 11407 - RNA, 936 nt, unidentified
  source 1..936: mol_type = other RNA; note = synthetic construct
atgcacttggcacactttctgagcaccagcctgagcatttccaaccaggaaattataaccttttcctcttcagccccaaaccgctacaaggtttactcaatccctaagaggactagcgggaagcgaacaatagcacatcccgcaaagaaactgaagctcgtgcaacggctcctatcgaaccacctgtccacgatccttccagtgcatgagtccgctttcgcgtaccggaaaggcctggggatcaaagataatgcgcagtaccacatgaacggacgatatctcttgaaaatggacttccagaatttctttctgtctatcgtgcccgagctattattcatcacactgaaaaagaacgccatcgaattcagtgaagaggacgagtttctcatgtcccggctgcttttctggaggccttccaaatcaagttctggcaaacttgtcctgtctataggtgcccccagctcccctctgattagcaatttcatcatgttccagtttgaccaggagatggcagccaagtgcaagtctaagggcgtgcgctactcaagatacgctgatgatctgacttttagtacaaatgtgaagggtgccttgtttgacctgacttccctcgtcaaggagctgctcgaaaagcaccttctcggatatattgctattaacgagacgaaaacagttttttctagcaaggcccataatagacacgtaaccggcgttaccttaaccaacgatgggcagttaagcattggacgtcagaggaagagattcatcagctctcttatccatcagtatagtctagggaaactgcccgctgaggacttgtcatatctccagggattgatagcttatgccaatgacatcgaaccggtattcgtcaaacgcatgtcgaagaagtacagtccacaaactatggatcaactgattaaaggcgtgaaatga

SEQ ID NO: 11408 - RNA, 945 nt, unidentified
  source 1..945: mol_type = other RNA; note = synthetic construct
atggattttttcgagagactggctcgcgacctggatattagcgaacaagatgttcgcgggtttgccttgactgcgcccaaccgctacaaaatctacaggatccctaagagaacctctgggtcccgggtgattgcgcatccttcgcggatgctgaaggcctatcagcgattgatcattagctacgtcactgagttgctcccagtgcacagttgtgcctacgcataccgacagggcgttggaattaaggacaatgcacgtgtgcatgccaaaagcagctatctgctgaagatggacctacagaacttctttaactccataaatccaagtctcttctttgacgtggttgagaaggtcggactggaagtcgctgatcgggataagtggttacttacaaaactcctgttctggtcacctaataaatcttcttccgggcgtcttatactcagcgtcggggccccgagttcacccttagtgtccaatttcatcatgtatccctttgatattaggatgtctgagtattgtttcgcaaacggcctgaaatacaccagatacgctgacgacataaccctctccaccaacaagaggggttgcttgttcgatctgccagactacatcaaaggcgtgcttgccaatgagtatcagggtaagttgtccgtaaatgaaagtaaaaccgtgttcagttccaaggctcacaaccggcacgtcacaggtatcacaatcactaacaaaggctcactatcaatcggaagacagagaaaaaggtacatttcgtctctgatctatcaattttctagcgatcagctcgaccccgacgatacgctgcacctgaagggcctcttatcatttgcatttgacgtggagcctgaccttcggaggcgcttcgaaaagaagtatacaagcaaggtaattcatcagatactgacgtgcgaaaaaggaaatgattga

SEQ ID NO: 11409 - RNA, 945 nt, unidentified
  source 1..945: mol_type = other RNA; note = synthetic construct
atgaagatcgtggagtttctgtccaataaaacaggcaagaacatccaggctctaattcgtctgatcgatcaggcgcctagaatgtacaaagtctacaagatcccaaaaaggtctgttggcttcagggtgattgctcagccgtccaaagagataaaggaactgcagcggtttaccgtcgaaatgctggaaaaaattctgccagttcacgagaaggcgatggcctatcaaaaaggaaaggatatccggtcaaacgccctgctgcacgtgaagaatgactatattctcaagatggactttgaggatttcttcaattctataaaccccgaggtattccacaagtctttggaaatagatgagatcagcattaacaataccgaactgtatttcctcaccagactgctgttctggaaccccagtaaaaggaagaacgggaaactcatcctttcagtcggagctcccagcagtcctatcatctctaattacataatgcaccgattcgactgcgcaatcgaggagttttgtaattccaacgcaattatgtactctagatacgccgatgatatgacattctctacttccaaaaagaaccatctgtttagcatacctgaaatcgtgcgaaagaccttacgcaataagtactataaacgcatctccatcaaacaaagcaaaactatcttttcctcaaaggcccataatcgccatattactggggtgacgctcaataacgaaggaaagatatcaattggtaggagcagaaaacggatgcttagttcgctaatttttaaggccagcaaaaatgctattgacgacgagagtctttccagcttgacaggtcagctcggccaggccttttatattgacaacttcttcaaggagagtatgatcaaaaagtacggggagagcttgattaagtcaatcttaggcaagaaaaacgaaaaggcatga

SEQ ID NO: 11410 - RNA, 945 nt, unidentified
  source 1..945: mol_type = other RNA; note = synthetic construct
atgtacattgttgagtatttaagcaagaagaccgggcgcggaatgcaggagctctcaagactggtggatcaggccccccgcatgtacaaagtctacaagattccaaagaggtcagccggctttcgagtgattgctcagccctctaaggacattaaggagcttcagagatttgccgtagagatcctaaagcagatactgcctgtgcacgataaagccatggcttatcaaaagggtaaggatatcaaaaccaacgcactgctccatgcgcgcaacgattatatcctgaagatggacttcgaagacttctttaactctatcaacccggaactgtttaacatttctgtcgagaaggacaaaatcaacataacaaagaatgagctgtactggttgactaggctcctcttctggaacccttccaaaagaaaaaatggcaagctgattttatccgtgggagcacccagttctcctctggtgtccaactacataatgtatagattcgattgcgctattgaagaatactgcaatagcaatagcatcacctacagccgatatgcagacgacatgacgtttagcaccagcaagcggaatgtgttgtttatgattccagagatagtgaggaaaatcctgaagaacaactcatataagcggatcagtatcaagcaatctaagacagtcttcactagtaaagctcataatcggcatgttactggagtcacaatcaataatgaaggcaaagttagtgtcggcaggagccgtaaacggatgctaagttctctgatcttcaaagcctccaaaaatgaactcgatcacgaggtactttcctcattgacagggcagctggggcaggccttctacattgacgtgtgtttcaaggagtccatgatcaaaaaatatggcgcgtcgataattaagtccatcctttcaggtaaccacgaaaaaacctga

SEQ ID NO: 11411 - RNA, 945 nt, unidentified
  source 1..945: mol_type = other RNA; note = synthetic construct
atgaccattgtcaaatatctgagtgagaaaacaggcactgaaatccaagaactgaataaactcattagccaagcaccccggatgtacaaggtgtacaaaatccccaaacggtccctgggtttcagagtgatcgcacagcccgccaaaagcatcaagaaactgcaaaggtttgcagtcgagattcttgagactattcttcctgttcacgagtctgctatggcttatcagaaggacaaggatattaagaagaacgctcttctgcacgtaaaaaacaactacatactcaagatggactttgaggactttttcaactcaattaatccggaactctttattaagtcactgaagaaagacaagatcctcatcagtaagatcgatttaaaccacctgaccaaattgcttttctggaatccaagcaagagaaagaatggaaagctgattctgtctgtcggcgcgccttcctctccattgatcagcaattatatcatgtacaggttcgattgcgacatagaggaatattgccagctcaaaaacatcacttattcacggtatgccgacgatatgaccttttccacaaaggaaaaagatcgtttattcgagatacctgggttcgtgaagaaaaccctaaagaaacagagttacaagaagatcagtatcaagcagtctaagacgattttttcttcgaaagcccataaccgccatgtgaccggagttacactgaacaatcagggcaatctgtcaattggcagggccagaaagcgcatgttatccagcttcatctacaaagcctgtaagaatgaattgaaccaggaagagctgctgagcctcgtgggacagctagggcaggccttttacatagataagatcttcaagaagtccatggagcgaaaatacggcttgctcacaattaaatccatactggggggtaacaatgagaaaatctga

SEQ ID NO: 11412 - RNA, 945 nt, unidentified
  source 1..945: mol_type = other RNA; note = synthetic construct
atgcaaatcgcggaatatctaagtacaaagactggcaagtctgtccatgatattgggagtctgatttctaacgcccctagaatgtacaaagtgtaccgcatccccaaaaggacaggcggttaccgagttatcgcccaaccaagcaaggtgattaaaagcttacagcggcatgcagtcgagatgctcagagactacctgcccgtgcacctccatgcaatggcgtaccaaaaaggaaaggatatcaaactcaatgctcaggtccactgcaagaatgaatatatactgaagatggacttcgaagacttttttaactccattaatcctgagctgtttaaaaagtgtctgaaacttgatggcttgcacttcagtgagtctgatatcaacctccttattaagctgctattctggaatccctctaagcgaaagaatgggaaacttatcctcagcgtaggagccccatcctcgccgctgattagcaactatatcatgtaccggtttgactgtgccatcgagaagtattgcaaacaggagaatattacctattcaaggtacgctgacgatataaccttctccacacttaaaaaagaccagctgttcatcatacctgacattgttaataagaccctgaaacagaactcctataagcgtatatcaattaagctctccaagaccgtgttttctagcaaggcccataataggcacgtgactggagtgactttgaacaacgacggggatatctccatcggccgggctagaaagcgcatgttgagttccctgatatttcaggctatgcacggaaaactggacaacgatgagttgtcatctttaaaggggcagctgggtcaggcattctatattgatagcaagttcaaggcctcgatgcacaaaaagtacggcatcagcattatcaacaaaatcatcggcggaaactcagaaaaaacgtga

SEQ ID NO: 11413 - RNA, 957 nt, unidentified
  source 1..957: mol_type = other RNA; note = synthetic construct
atgaatctgctagatctgctaaatagggagttaaataagactaccttcagcatctcagagagcgacatactgattttctctatgaatgcccccaagaaatatagagtttatagcatcccaaagcgatccgctgggacgcgtatcattgcacatccctcaaaagagttaaaagtctaccagaggcacctcgtagacctctttaaaaacatcctccctacgcaccacaccgcctatgcttatcgacagggcctctctattaaggagaacgcggaatgtcacaagaagaacaaatatctcctcaagatggatttcgagaatttcttcaactccatcaatccgctgattctgaaaaacgagctggtgaagaacaagatcaaattcaccaaggaagatttcaagctgcttgaacagctctgcttctggtgcccctccaaaaagataggcggcaaattgattcttagtgtcggagcaccttcgtctccctccatctctaactttatcatgtaccagtttgacgagatagtcgaaaattggtgtaagcagcggaaaattacatacacacgctacgcagatgatatcagtttttctacaagcctgaaagacgccctgtttgaagtgcctaaattggtagagagtacccttactagcaactttggaaagagaatctcggttaaagcctctaaaaccgtgttcagctcaaaggctcacaatagacatattactggtgtgaccattactaatgaaggggagctgtcaattgggcgcgacaggaagcggtacattagttccttgatccataagtttaagctgaacatgctggctcaacaagacatcgagcaccttaaaggcttgctgggtttcgcctttcatgtggaaccagtgtttcgcgagcggatgatcaacaagtacagcaagaagacaatggatgaaataaaccagttcaggtccgagtcctga

SEQ ID NO: 11414 - RNA, 927 nt, unidentified
  source 1..927: mol_type = other RNA; note = synthetic construct
atgagtatcctcactctgctctcgaatgacctgggcatctccgaaaacgaactgaaagctttattggtcaatgcccctagaaaatataaggtttactcaatccccaagaggactggaggacggagaaccatcgcacagcctattccagcattgaagcaagcgcagcgcagctttaataagtgcatcaacctgaatgtgcacgaagctgccatggcctaccggacagggctgtccattaaggagaatgccaatatacaccggatgaacccttaccttcttaagatggatctggagaactttttcaatagcatcacaccctctctgctgtggctgaaccttaaaaagcagaacatcgagttcaacttgtatgataatcactacctggagaatctgctattctggcgcccccgcaaaagcagcaagattatattatccgtcggggctccatctagtccgtacgtgtcaaactccctaatgtataactttgacataacagttcacgaactctgctctaacatgcacattaagtactccaggtatgccgacgatctgactttcagtaccaaggagaaaaatcatttgtttgaagtgcccaaagctattaacaacctgctcctgaaggaattcggtaacaacttaaccattaataccagcaagaccgtgttcagttctaaagcccacaaccgacatgtgacgggtgtcacaattaataatcaggggaatttgtccctaggcagggagaaaaaacgatacatcaaacacctcgttcataagtttagctttgatctccttgatgactcagaggtgccatatctgaaaggactgctctcacatgcaaaccatattgagcctgacttcatagtacgtcttcagaagaagtattctgacgagatcatccaatgtctcgtaaatggcacgaacagatga

SEQ ID NO: 11415 - RNA, 933 nt, unidentified
  source 1..933: mol_type = other RNA; note = synthetic construct
atggatctcattgacgccttgtctagctctcttaagatcaacaagtcaactcttcaggatttctgtaccttagctccaaataagtaccggatttatagcatacccaagaggaattccgggtataggataatagcgcatcccagtaaagagttgaagaagtatcagagaactctgaatgacctgatcaagaacatcctgccggtgcattccagcgcttttgcataccgcaacggtctagacattaaaaagaacgccctaagacacgccaagaatccctacttactgaaaatggattttcacgatttcttcaatcgcattacaccagacgtgttttggaaacaagttggaaacaaattcctgagcctgaccagaaaggatgccgatattttcgagaagttgattttctggaaccggagcaaaaaaaatgacgggaaactgattctttcagttggtgcccctacctcacctctcatttccaattccgtgatgtataacttcgactgcagcataagtgaatggtgtgtcaagaatgacatcacatacacgcgatatgcagatgatatcaccttctcaacccgtaaaaagaatatcctcttcacagtgcctgaaaagatcaagaacgagatcattatgcactttgggaacgctatgctgatcaacgacggcaaaactatcttttcttccaaagcacacaatcgacacattacaggaatcactataacgaacgagggaatcccatcgctcggcagggagaagaagcggtacatctatcatctgctgcatcagtacagtcttaacctgttagaacacgatgacatcctccacttgaagggccagtttagctttagttgctacattgacaaatctctgatgcatcgcgctgaaaaaaagtattcctctgagctggtccaaaaactcatccactacgtatga

SEQ ID NO: 11416 - RNA, 948 nt, unidentified
  source 1..948: mol_type = other RNA; note = synthetic construct
atgcagttgattgacttcctgtcaagcaagttggagaagacgccccaggaaattgaaaagttcgcgctaaccgctcccaagatgtacaaaatttacaccatccccaaaaggaaggccggccacagaattatagcacacccgagcaaaaacttgaagtcataccaacaccttgtgatagactatattaagatcaagcttccaatccacggcgccgcccaagcatataaaaccgggcattccattaaaaccaacgccctggcccacatcaacggagaatacctgttaaagatggacttcaataacttcttcaactctattacaccagagctattttcattagagtgtgcgaaaaggaatatagatctgactcggtccgaactgtctttgatcaagaaactcatcttctggaatccatctaaaaaaaaaggcggaaagttaatcctgagcgtcggtgctcccacttcccctctgattagtaactttgtcatgtatggattcgattatcttctgtccgaatattgccacaagaattacatttcgtacacaagatatgcagatgacctgacatttagcactcgcaagaagaacaatctgtttcagatccctagtatagtgaaagatttcctctccgccgaactcaacaagcgtatctcggtgaatgagagcaagactatctttagctctaaggcccacaaccggcatatcacgggcgtaaccctgaccacagagaacaagctctccgttggccgagagagaaaacgctatatctactctctcctgcacagcttttccctggggaacatggcaaagcctgatatagagcatctgcaggggctttttagtttcgcttgccatatcgacgagacatttaaatctcgggctgagaataagtactcaaaactcatcattagtcagcttcatgagggtaggctcaataatgaaaaatga

SEQ ID NO: 11417 - RNA, 1014 nt, unidentified
  source 1..1014: mol_type = other RNA; note = synthetic construct
atgactaccctgagacaacatttactcacttcccctctcgttgccgagctggccttctcgctcctgtcttcttcctctaaaaaagttaccaaacccgacgtggataagtggttgattctgtcactggctaaggtgatgcttagtggccctaagatgtatagagtctacacaatacctaagaaaaacggcgggaaacgaacaattgcacatcccagtaaagtgctcaaagtgtttcagaaagggcttgtggaatttttgatcaataaactaccagtgcacgatgccgcgtatgcttatcggaagaacatctcaatcaaggacaacgccttccagcacgtaaagaattcatattttctgaggatggacctggctgatttctttaattctatcgacacgagtctgttcgaggaacagatcgagaagcataaagtccagcttgccgactcagacaaggtcttacttcgcaggtccgctttttggtccccaaagaagattaactctggaaacctgatactgagcgtcggagcgccaagctctcctatgatctccaatttcatcatgttctcgtttgacgaaacgattaccagcatttgcgagcccctgaagattaaatacacccgatatgcagatgatctctttttcagcaccagtcataaggatgtcttattcaaaatgccgaaactgatacaatacgtgctctactccgagttcggtaagaagattactatcaatgaggtgaagacatctttctcaagcaaagcacacaacagacacattgcagggataacaatcactaataacgacactttgtccctgggacgggaacgcaaacgtacaattagtagtatgattcacaagtacagcttgggcaattgtaccgatttcgaacttgccaagctccagggcctgttgagctttagcaagcacatagagcccctgtttatcgagcggatgaaaaagaagtactcagtttccctaatcgacgtaatcatcagcggtcagtggaggaagtga

SEQ ID NO: 11418 - RNA, 1017 nt, unidentified
  source 1..1017: mol_type = other RNA; note = synthetic construct
atgactacactgcgccaccacctcttaacctcaccgctcgtggcagaacatgccttcagcttactatcatcctcgagctctaagaaagttaccaagtctgacgtggagaaatggctgactattagtatagccaccgtaatgactagcggccctaaaatgtataaggtgtacacgatccccaagaaaaacgggggcaaacgcactatcgcccacccttccaaagttctgaaagtttttcaaaagggcctggtcgagttcctcgtgaataagctgccagtccacgatgctgcatatgcctacaggaagaacatatctattaaagacaacgccctgcagcatgcgaaaaatgcttattttctgaggatggacttagccgacttctttaactcaattgacgtgaatctgttcgagaaacagatagagaagcacaaaattgagttggctgcggccgacaaagcacttctccgacggagcgctttctggtcgccaaagaagatgagtagtggcaatttgattctatccgtgggtgctccttctagtcccatgattagcaacttcatcatgttctcctttgatgaaacaatcacgagtgtgtgcgatccccttcgtatcaagtacactcgctacgcagatgatctctttttctctaccgagcataaaaacatcctgttcaagatcccctctctgattcagtatgtcctgacctctgagtttggaaagaaaattgccatcaatgaagtgaagacctccttttcaagcaaggcccataacaggcatatcgctggggtaacaatcacaaataatgataccctcagtttgggaagagaacgaaagagacttatctcatccatgattcacaagtacagcctggggaactccaatgacattgagcttgcaaaacttcagggactcttgtcatttagcaagcacatagaaccactgttcatcgacagaatgaaggagaagtacagcatatccctggtcgaaaacatcatcacaggtcggtggcggaagtga

SEQ ID NO: 11419 - RNA, 1017 nt, unidentified
  source 1..1017: mol_type = other RNA; note = synthetic construct
atgacaaccctgaaacatcatttactcacaagtcctctggtggccgagcaggcattcagcctgctctcgaccagcagctctaaaaaagtgaccaaactggatgtcgaaaaatggctgacagtcagccttgccaaggttatggtgtccgggccaaaaatgtatcgggtgtatacaatacccaaaaaaaacggaggaaagaggacgatcgctcacccatccagagccctgaaggtaattcaacgaggcttagtggagtttctgaatgacaagctgcccgtccatgacgctgcctacgcctaccgcaaaaacatctcaatcaaagataacgcgctccagcacgttactaatccctattttctacgcatggatctcgctgacttctttaacagtatcgacgttaaccttttcgaagagcgtattgaaaaacacaaaattcagctcagtgcagcagataaagcactgatcaggaggagcgccttttggagcccgaaaaagactaacactggaaccttgatcctttctatcggggcccccagttcccctctgatcagcaatttcattatgtttagcttcgacgagacaatttcttccatctgcgccccactgaagatcacttacactcggtatgctgatgacctgttcttttcgaccaagaataagaacatactgttcaagattccttccttgattcaatacgtactctctaccgaattcggcaagaagttgaccataaatgaggtgaagactagtttctcaagcaaggctcataatcgccacattgcaggtgtgacgataacaaataatgacaccctgtctctcgggagagagaagaagcgaatcatttcatctatgattcacaagtactccttgggcaagtccgatgatatagagcttgcgaaattacagggtttgctgtcattttccaagcacatcgagcctctatttatcgaacggatgatgaagaagtactctgtgaaccttgtcgacaagattatctcaggccagtggagaaaatga

SEQ ID NO: 11420 - RNA, 1023 nt, unidentified
  source 1..1023: mol_type = other RNA; note = synthetic construct
atgaaaaagctgactatcttctttgccagttccccatttatagaggcctggctgcacattgtgaaacccagcgatgaagaaaactttacgagtgaacagaagattgcccacatcaagcaatcaattgccttgataatgcggagcggcccaaaaatgtacaaagtctatagcatccccaagcgaaatgggggcaaaagggtaatcgcacaccctgcagccatgctgaaggcattccaaagagatctctgcttgcacctcgctaacctacttcctgtgcattccgccgcaacagcttaccagcctgcctcatctgtgaaaatcaatgcccttgcgcacgcctccaaccattacctggtcaaaatggatctcgctaacttcttcaattcgatcgatgttgacatatttgcggccgagctccgccggcacaaaatcgctttgaccctgaaggagctgtcatttatcagacaatgtaccttctggagcccatccaaaacaagcactggtaggcttattctaagtgtgggagcgcccaccagtccgctgatttccaacttcgttatgcatgcattcgatgacatcatccagaagatttgcgagccactggctgtcacttacacccggtatgctgacgatctctttttttctactaatgtgcgcgacatttcttttaaaatccccgacttagtggcttatgtgttggcaaagacatacgagaaccacttctctataaatcaggccaagactagattttccagccgcgcccataatcgacatgtaaccggtgtcacaatcaccaatgaaggcgccttatctgttgggaggcagcgtaagaggattatttcaagccttatacacaagtacaccctgcagaaaatcaacctggctgaaacaaagattctgcaggggctgctcagttgggcattctgtattgagcctacgttcgtcatttctatgcggaagaagtattccgacaacgtgatccagtcaataatcagcggaaattggaacaacgacagagcttga

SEQ ID NO: 11421 - RNA, 1014 nt, unidentified
  source 1..1014: mol_type = other RNA; note = synthetic construct
atgaagaagatcacaaatttcttcgttacatccccttttgttgatgcctggctccagaccacagttccctccgtgggcgagctgtcgaccgaacagagggtcgcctgtatagggcacaatctggccctgatcacccggagcggtccgaaaatgtataaggtgtattctattcccaagcgaaatggtggaaagcgagttattgcccatcccgccgccatgctgaaggcatttcaaagagatctcaacctccacttagttagtcttctgccagtacacaacgctgctactgcttaccgggtaagcagtagcgtaaaaactaatgcaaaggcacacgcgagcaatccatacctgctcaaaatggacctgtacaatttctttaactctatcgacgtcgatattttcgtcgctgaattaaggcgtcatcggattactctggcagtgaaagagttgtcatttatccgccagtgcaccttctggtccccttccaagacatctaccggccggcttatactatcagtgggagcccctacttcccccctcatttccaactttgtcatgtatgagtttgacaacattatccacaaaatctgtgaaagtctctctgtgacctatacgaggtacgccgacgatctgtttttcagtacaaacgtgcaggacgtgttattcaaaattcctgatcttgtgacctatgtgttgacgaacacgtacaacgggaaattctcaaccaatcaaaccaagactagattttcaagcaaagcacacaacaggcatgtgaccggcgtgacaataactaatgaaggcagattgtctttggggagacagcgcaagcgtatgatttcagctctgattcatcagcattgccttaagaagatcaatctggtcgagactaaaaaactacagggcctgctgagctgggcgtccaacatcgagccaacattcgtgatctctatgcgcaaaaagtacagcgataaggtcatacaaagtatcatcagcggaaattggaacgacgactga

SEQ ID NO: 11422 - RNA, 1017 nt, unidentified
  source 1..1017: mol_type = other RNA; note = synthetic construct
atggcaaaacttatagagcagcttatacactcaactcccgttacagcttacgccaatagcgtcctttctgaatacactgataagtttacagccaaggacattgagatcatcgccactcaaacactaaatgacgtgaaggcaaggggacctaaaatgtacaaagtgtacaccattccaaaacgcaatgggggaaaaagattgattgcacatccatccaagcctctgaaggccacccagcgggctctggtagagcttttgcagaaacaactgcccgtgcacgaggccgcttttgcttatcgcgatggggtatcaatcaaggataacgctttcgcgcattcaaagaacccgtattttctgaaaatggatctctccgacttctttaatagcatcgataccgaactcttcgaggaccagctgaagtctcactctatttttatccggaataagaaactgcttcacaataccatcttctggagccccgcgaaagaactcaacaataagttaaagctcagtgtgggtgccccctcttcccctctgatatccaacttcatcatgtacaacttcgatgaggcaatcagcacgatttgccactcctcaaacattaaatatacgagatacgccgacgatttatttttcagcaccaataccaaaaacctactcttcaacattcctagtttggtcaactatctcctggagaagcagtatgacaacaaactgtccgtgaacgaaagcaagacatcatttagttctaaggctcataacaggcatattactggagtcaccataactaatgacaacaatctgtcgatcggcagaaaaaagaagcgatacatttccagtctcgttcataaatacaagctgggcagcttagacgttgaaaatatcgaaacactgcaggggctgctgggctttgcaaagcacgtggagccaagcttcatgataaggttgtgtaagaagtatagtcagaacacaatcgactctatcacccgtggtgcctggaaaaataatgagaagtga

SEQ ID NO: 11423 - RNA, 1014 nt, unidentified
  source 1..1014: mol_type = other RNA; note = synthetic construct
atggctaagctgatcgaccagttaatcaactcgagttttgtggtgagttacgcgtatagcgtcctatcagcctgcacagggaaatttactcaggaggacgtcaagttactcgcaacacagaccattaacgatgtaaaagctcgggggcccaagatgtataaggtgtataccatccccaaaaggaacggcggtaagcggcttatagcccaccctagtaaaccactgaaagccacgcagcgcgctctcgtcgaagtgttacaaaaaaagcttccagtacatgaagccgcgtttgcatacagaagcggattgagcatacgtgacaacgccctggttcactccaaaaacaggtacttcttgaaactcgacttgtccgacttcttcaatagcatcgatgttgatctttttgaaagccaactggcatcaaatcgcattttcatcaggaataagaccctgctcaaccagattattttttggtccccgactaaggatctgcagtctaaattgaagctgtctgttggggccccctcttcaccactgatctccaacttcattatgtaccggtttgacaaagatatgtccaaaatctgtgactctctcaacgtgagatataccagatacgcagatgacctgtttttttcgacgaatatcaaggatatcctgttcgacatacctgaactcgtgaactacatacttgataagcgatacgacaataagctactggtgaataaaagcaagacatctttctcctcaaaggctcacaataggcacattaccggagtcactattacaaatgagggaaagctcagtatcggccgaggaaagaaacgctacatcagttcactggtccacaagtataacctgggcttgctggagtatgaggatatggaaaaactccaggggctgctaggcttcgctaagcatattgagcctagcttcattatcaaacttagcaagaagtattcccatcaatctgtggagtacatagccaaaggtggctggaagaataacgagtga

SEQ ID NO: 11424 - RNA, 1020 nt, unidentified
  source 1..1020: mol_type = other RNA; note = synthetic construct
atgactaagctgaagaatcaactgataaattccacatccgttcgcagctatgcttacgatgtcctttcagaacagagtaccagaattagtgaggacgacattgaagccttggcacagaaaaccgtgcacgacgtctgggataatgggccaaagatgtacaaggtgtatacaatccctaaaagatccgggggacgacgcacaatcgcccatccatccaagcccctgaaggcagtccaaaaagctcttgtggaactgtgggaagcggagttgcctattcatagcgcagcgttggcttaccagaaagggaagtcgattaaggagaatgccgagtgtcaccggtataacaaatttctactcaaggtggacttatctgagttctttaattccatcgacattgaggtgttcgaaagccagttactgggcaacaacataaaatttgacaagagggattctcgactgataagaaacatcctgttttggtcgcctcagaaatccctgtctagtaagctcgtgctgtccgttggtgccccgtcctctcccttcattagcaactttgtgatgtatacgtttgactcattaatctctgaagtatgcgaatctttgaacattatctacactaggtatgccgatgatatgtttttcagtacccaggttaagaacactctcttcaaagtcccagagattatctcattcctgctgaaaaacaagtacaacaataagttgctcatcaacgaatctaaaaccattttctcaagcaaagcccacaatcgccacgtcacgggaatcaccatcacaaatgataacaaactgtcactcggcaggagccgtaagcggtacataagtagcatggtgcataagtataaactcggcatgcttgattttgaggacatcgagcagctgcaaggccttctgggattcgctaagaatatcgagcccgagttcctagtacggctcaaaaagaaatacagcagcgagactgtgaacatcattcttaatggtaagtggaagaatgaaaagtga

SEQ ID NO: 11425 - RNA, 1029 nt, unidentified
  source 1..1029: mol_type = other RNA; note = synthetic construct
atgacaaaaatcgcaaaacagctcctgagctcgccttttatccattcctatgcctataaggaacttgatgaactgatggacaacgtaacccagaaagatattgactcattcgtggaactgactgtggatgatgcgattatcaacgggcccaaaatgtataaagtctacgcaattccgaaacggaatggcgggcgacgtatcatcgcccacccctctcaaccattgaaggcagtacagcgagacttgattgaaatcttaaagtcccagctgcctattcatgacgccgcctttgcctaccagcaaggcaagtctataaaaggcaacgccgaggtccacaggttcaataagtttttcctaaagatggatctgtctaacttctttaacagcatcgatgtcgacctcttttataatcacttggacctgaactcagttaatatcgacattgaggacaagagcacgatcaaaaacattatattctggcgccctcagaagaacgagactggagagctgcgcttgagcgttggcgctccctccagtccactcataagtaacttcatcatgtacaagttcgattctattatcagtgaggtgtgcgcttcctttaagataaaatacacaaggtacgctgatgacctgttctttagtacgaccgtgaagggtgtgctttttaagatacccgatatcgtggaattcattttgaagagcaagtacgacgatgtgctcaccattaataagagcaagacctccttctcttcaaaagcccacaacagaaatatcactgggattaccattacaaatagcaatgagctctccctgggtagaaatagaaagcggtacataagtgcgttagtccacaagtatcggattggactcctagacgataatgctacagagtccctgcagggccttctggcatttgctaaaaacatcgagccaaagttccttatgaggctgaaaaacaaatatagcaacgacgttatcgagtctatcatctcaggacgctggaaaaatcatgaatcagaggaatga

SEQ ID NO: 11426 - RNA, 984 nt, unidentified
  source 1..984: mol_type = other RNA; note = synthetic construct
atggaaaacatcttcaattacctgctgagctcgcctaacgttgtggatttcagcaatgaaagcaagaaaaccaagcaacctaaactccctcaggacattctgcatgatgttctgctctacggccctaagatgtacaaggtgtataccatcccaaaaaaaaatggcggcaagcgagtgattgctcaccccagcagggggctgaaggtggttcagcgcgacttggtagtgtttcttgaaaaaatcctccccgtccataattctgcctacgcgtatattaaaaaccgatccatcaaggacaatgcccactatcattccaagaacagataccacctgaagatggacctctccaacttttttaacagcatcgacaccgaactgtttttcacacaacttgatactaatggggtaactttcaacagtgatgagatgtaccttttacagaggagcctgttttggagtccaactaagtctgagattggaaagctcattacgtccgtaggagccccgagttcgcccctgatatctaactttatcatgaacacgtatgacttcatgataagcgacatctgcaaatcattagaggtcaaatactcacgctacgcagatgacatgttcttcagcaccaatatcaaagatatactgttcactcttccaaacattgtggattacattctcgacacaatctattcaggcaagttgagagtgaacagtgcaaagaccaaattctcatccaaggctcacaatcggtatatcacaggactcgtgatcacaaatgacgccaaagtctctatagggcgttctaggaagcggctgatttcctctttagtgcacaagcatcagctgggcctgctagagccagactcagttagttccctgcagggtttgttggggtttgtgagatccgtcgagcccgaatttcttgatcgcttggtgaagaaatacggtgattatgagatccagcggattataaaaggactagtctga

SEQ ID NO: 11427 - RNA, 1011 nt, unidentified
  source 1..1011: mol_type = other RNA; note = synthetic construct
atgaagaagctgctaaactatctggcttcccccgagacggcagataacttgaaaaaatatttcgagctcgcctatccacaaattaagtacgatgaggatgttttcaatctgatggcgaagcaccacattgagacactccttaaaagtgctcctaaaatgtacaagatctacaccattcccaaaaggaacggcggaaatcggacaatcgcgcacccagcaaagggcctgaaagccactcagcgtgaccttagtaaatacctggttgacattcttcctgtgcattcatgcgcttttgcatacaccaagaacaaaagcataaaggataacgccctcgtgcattccaagaataaatttcttctcaagatggacctggtcaactttttcaacaacatcaatgacactctcctgaataatgaactggttgagaatgacatcccgctaactaccctggagataactcaggtcaataaactgtcattctggtgtcctacaaaggacgacgatggaaagatgatcttgagcgtgggtgcccctatcagccccttaatctcgaacttcatcatgtatagattcgatagcaagttatctgagttggcagtcaacaacaaagtgaagtattctcgctatgccgacgatatcttcctttctacaaacgctcccaacgtgctgggcttgttcgtgaatgtggtggagctgctcctgctggaattatacgggggtaagctggtaatcaataaaaccaaaacggtcttttcctcgaaggccaacaatagacatgtaacaggcctcaccatcaataattccggggaagtatccctcgggaggaaacggaagcgagtgatttcttctttggtccacaagtttagcattggcattctggatagcagcgaaattgaaagtctgcgcggacttctctcattttcctcatctgtggaaccagaattcataaccagattggagaaaaagtacacctttaagctaattgacaagatagttagggggctgagttga

SEQ ID NO: 11428 - RNA, 1002 nt, unidentified
  source 1..1002: mol_type = other RNA; note = synthetic construct
atgaaaaagcttttagactatctcaccagttctgataacctcaaaaactaccttaaactgacatatccccaaatttcctatgatgacgatgtctttcttatcatgggaaagtaccacctatcttctctctacaaaagcgcccctaaaatgtacaagttctacactatccctaaacggaatgggggacgtcgcgccatcgcccatccatctaagaaactgaaggtaacacagcgcgatctgtcaacttaccttgagaaaattctgccggtccacgactgtgcattcgcgtatagaaagaataagtccatcaaggataacgccctgatccacgtggggaataagtttttgctgaagatggacctggttaatttctttaactcaatcacccccaaaatgctcattaatgagataaaggagtcagatctgtcatttgaggagtccgaactcgactacatcaaaaaattagctttctggtgccccagcaaagaagataacggcaaactgattctaagcgtgggggctccaagctctcccttgctcagcaacttcatcatgtatagatttgactccgtcctgagcgaggtagccaagtctaataaggtgaagtactccagatacgctgacgatatctttctgagtaccaatgtgccaaatgtcctcaagctgttcgttaacattgtgaaaatcatcttgaaggagatgtatcatgatgagctgataatcaatgaaatgaagacagtgttctcaagcaaggcacacaatcggcacgttaccggtattacgattactaacgacaacaagataagcttgggtcggcagaataaacgaatgattagttcgctggtgcataagtactccttgggcgtgcttgacacaagtaaaatcataaggctaaggggcctcatctctttcgcatccagtattgaacctgacttcataattaggctggaaaacaagtatacctttaacctgatcaacaagctgattaaaggattagactga

SEQ ID NO: 11429 - RNA, 1020 nt, unidentified
  source 1..1020: mol_type = other RNA; note = synthetic construct
atggaggaactgcagaagtcactgttagcatccaaccctgtcaaagaattcttttctcagaaggcatctcatatattcggagagagcggtcagaagttgcccatggctgctgagtctttggcactggccgccctccaaaacgttaaagtgcagggctttaagatgtataaggtttacaccatcccaaagaggtcaggcggaaatcgagtgatagcacatcccagcaaagaactcaaagctttccaaagagggctcgtcgatatcctggagagtgaactacctatccacagctgcgctcacgcctatgttaagcgtaaatccattaaatcgaacgccatggcccatgccaaaaatcagtacctacttaagatggacttccttaacttctttaactcagtggatatcgagttactggccaaagcctgttccggcaacaagaaaatcgaagaagttgggttgatgcagttcgcgaatctggtcttttggagtccgacaaagcagagagatggaaagctcgtactgtctgtcggtgctccaaccagcccattgttgtcaaactttgtgctgtacgagttcgacaatctcattagtctggtgtgtaactccatgcatgtgacatatactagatatgccgatgacctcttctttagcacgaacgaagcagatattctcaagtccgttcccaatatcgtgaagtacttcctggactacatttacggcgataaacttcgggtgaatgacgcgaaaactgccttttcctctaaggctcacaatcgccacgtgaccggtctagtaattgcgaactccgggcgcatcagtctgggacgagaacggaagcggtttatcaagagtcttgtgtacaagagcacaaaaaatgagctggacgtggaggagttaaactcacttatgggcctgctgtctttcagccaacacgtagagcctgacttcataatgaggctggtctgcaaatttggccaggacgcagtcgattatattgtgaatgctcagtggagggggtga

SEQ ID NO: 11430 - RNA, 927 nt, unidentified
  source 1..927: mol_type = other RNA; note = synthetic construct
atgaacattatcgagattatctccaaaaagacaatgctcgcttcctccaacgtaattacgtttattcatactgcaccctatagatacaagaagtactacctgccgaagaacaacggcggttccagggaaatcgctcaaccttctagggaactgaaaatcatgcaacggttgattcttcagctgctgctaccatatttacccgttcacgaaaatgccttcgcctacgtggagggcaaatccataaagaggaatgccctgatgcaccggaacaatgagtactttctgaagatggacttttcagatttcttcaactcaatcaaacctatcgacctacgaaatgttttgttgaagaatggttatgagactattcccctcaatttaaacctcatagacaatctgttcttctataagaagacaaagaagagcgggcttagtttaagcgtcggagctccttcatctccattgataagtaacgcggtactgtacgactttgacgtccgagtgagtgaattgtgtaagcaggaagacatcacctatacaagatacgcagatgaccttactttctcttgcaacgagaaaggcaaacttctcgtgtttcagaaggagatagccaagatcctgcgcaaaattcagagtccaaagctgaagctgaacgataagaaaaccatctacgcttcaagaagcgttagccgccgcgtgaccgggattgtgataaataataatggcgagctgagcctgggaagacataagaaaaggatgatctcctcgcttgtgcaccggtacaccctgggaaaactcatccccgatgacatccacaaactgaaagggtatctcgcctatgccaaacatattgagtctggctttatcgtgtctatgcgtaacaaatacggggcagatgtcattgatagcatcctcaagtataactga

SEQ ID NO: 11431 - RNA, 927 nt, unidentified
  source 1..927: mol_type = other RNA; note = synthetic construct
atgaacattatcgagatcatttccaagaaaactatgcttagttccagcaacgtgattacctttatccacacagctccataccggtacaaaaaatactacctcaagaagaactcaggcggtgtgcgtgaaatagcccagccttcaagggagctcaagatcatgcagaagctcattttggagttactggtaccgtacttaccagtccatgaaaatgcattcgcttatgttgagggcaaaagcattaaaaggaacgccctgatgcatcacaagaacgagtattttcttaaaatggacttcagcgacttctttaatagtatcaagcccctcgatctgcgcaacacgttgaccgacaatggatttgaaacaatacctgtgaacctgaatctgatcgataagttgttcttctacaagaagaccaaaaagtccgggctgagtctatccgtaggcgcgcctagctctcccctgatctctaacgcagtcctttacgattttgacatcaaagtcactgaactgtgcgagagacaagatataatttacactcgatatgcagatgacctcacattctcgtgtaatgagaagggcaagctgattggatttcagaaagaaattgtgaggattctgagaaaaatgaagagccccaaacttaagatcaacgacaagaagaccatttatgcctctcgagctgtttctcggcgcgtgactgggatcatcataaataataacggcgatctgagtctgggtcggcacaaaaaacgcatgatttcatctctcatccacagatataccctgaatcagttaaataacgacgacatcctcaagctaaaggggtatatatcctatgccaaacacatcgatattaacttcgtgtccagcatgaacaaaaagtacggagccgagacattgaattcaatcaccaagcataattga

SEQ ID NO: 11432 - RNA, 927 nt, unidentified
  source 1..927: mol_type = other RNA; note = synthetic construct
atgaacattattgacattatctcgaagaagacactcctcccatcaccgaatgtgatggtgtttatcaataccgcaccctacagatataagaaatactacctgcctaaaaactcaggcggagtgagagagattgcacagccaagtcgcgaactgaaggttatgcagaggattatcatcgaaaagattgccgattttctgcccatccacgaatccgcctttgcatatgtgaaagggaagtcaatcaaggagaacgcccagaaacacaaaaggaacgagtactttcttaagttggatttctccaacttcttcaattctataaagcctagcgatctgcggcgggtcctgatcaagaatggatttgagaataacactttcaacctgttgctcatcgacaagatcttcttctacaaaaaaaccaagaagagcggactgactctcagcgtcggtgcccccagtagccctctaatatctaacgccgtgctatatgaatttgatgtgaaagtcacggagttgtgtaataaggaggggattacatatacacggtacgctgacgatcttactttttcttgcaacgagaaaggtaaacttataggcttccagaaatccatcattaaaatcctcaggaagataccatcaccccatctgagactgaatgacaaaaaaaccatctataccagtaagtccgtaagccgacgtgttactggcatcgtgataaacaatgatggccaattaagcctggggcgaaagaacaagcgcatgatttctagtttaatccaccattacacactgaataagttgaacgctgaggacgtttacaagctgaaggggtacctttcttatgcgaagcatattgaaacgaccttcataaactccatgaccatcaaatatggcgtagacaccattaatgctattctcaaatccaattga

SEQ ID NO: 11433 - RNA, 927 nt, unidentified
  source 1..927: mol_type = other RNA; note = synthetic construct
atgaacatcatcgacataatctctaagaaaactatgctgccttcgtcaaatgtcataacatttatcaacaccgcaccttatcggtacaagaagtactacctgaagaaaaacaatggaagtcttagggaaatcgcccagccttctcgggagctgaagatcatgcagaaactgatcctcaatattctgtcggaatttcttccagttcatgagaatgctttcgcctatatcgaagggaaaagcattaagctgaatgcactcaaacacaaggaaaacaaatacttcttgaagatggacttctccgatttttttaattccatcaaaccgatagacctgcgcaatatcctcattaagaacggcttcgagagtaatatgtacaacctcaaactgatcgacaacctgttcttctataaaaagactaagaagagtgccttgagcttaagcgtcggggcaccatctagccccctgatttcaaatgcggtgctgtaccagtttgatattgaactcagcgagatttgcaggaacgagaatataacatacacgagatatgctgatgatctgactttctcctccaacgagaagggaaagcttattgattttcccaaagtagtctacttgatccttagaaaaatgcatagccccaagataaaagtgaataactcaaagaccatctacacctctaaagccgtgtccaggcgcgtaacagggattaccatcaacaaccagggcgaattgagcctgggccgacacaaaaaacgtgtgatttgtagtctaatccataagtttctccaaggagagttagacaatgacgaaattcacaagttaaagggttatctgtcatatgctaagcacattgagatcaacttcattaagtctatggagaagaagtatggtgtggagctcctaaactccataaaaaaagtggtttga

SEQ ID NO: 11434 - RNA, 933 nt, unidentified
  source 1..933: mol_type = other RNA; note = synthetic construct
atggacatcataaaaaaaatagcggatgagacacttatgcccgtatcaaaggttagcgcatttatttttaccgctccttatcgctataaagtctacccaatccccaagaggaacggaggctttagggagatcgcacagccgtcgcgcgcccttaaattcatgcagcggatagtgatcgctgaattggagaaagtgttgaaggtacatgaaaacgcgtacgcctacgtcaaaggccgatccattaaagacaatgtggagaagcatcaacggaattcttatattcttaaggtcgatttctgcgagttctttaactctatcagtccctgtgacttggaactctgcctcaaaaacaacggtttagattccctgttatcttccaaggagctgctgaacaagctcttcttttacaaaaagtccaaaagaagtgccctgtctatgtccattggggctccaagcagtccatttctgagcaacgccatcatgtacaacttcgattccgtgatcagcgacatgtgtagcaataagaacattacttacacccggtatgcagacgacctgacgttcagtactaatgagaaaggcattctgtatgagtttatccatgaaatcgacaaagtcctggaaggcatagatagccctaagctaaaactcaacgacaaaaagaccatattcgcctctaagaagtgcaatagacacatcacaggcattgtgatcaataatgagggagaactgtcgatcggtagagataagaagcgttacctgtcatcacttgtgcacaaattcagcctaaatgccctcaatgaggaagagattgaacacctcaagggatatctggcttatgttaacaagatcgaaccttcctttatctcagggatgaagaggaagtacggggttgaggtggtgaactctattattacattcaatcccttgtga

SEQ ID NO: 11435 - RNA, 942 nt, unidentified
  source 1..942: mol_type = other RNA; note = synthetic construct
atggtcatagacgattgcataaccaagatgctgaaaaatcaacttctgctgagcgatgctgagttactctattttgcgtccactgctcctcaccggtacaagaagtacttcattccaaaaagaaacggggtggacctacgcgagattgcgcacccttctagccagttgaaatatgtacaaagactgctggttgagtctatggtaaagactttcccaattcactcaagtgctgtggcatatcggaaaggcatctctatccgtgataacgcaactctgcatcttaagaacaattacttgctcaaaatggactttgagaacttcttcaataacatcacacccgaaatcttcttcgacgcttgtgaagacaacaatattagctactccgagaaggacaagaacctccttaagaacattctgttctacaagaagagacgcgcaagtggactgagtttgtcaattggtgccccgtcgtcccccttagtctccaactttatcatgtatcagtttgacgttcttgtgtctgacttttgcgccgcccggaatatcgtgtatagtaggtacgccgatgatctcttcttttcaaccaggaaaagcgatgagctctcccaggtggccgggttcataaaggaaatcctccgaacaatgtacaggggaagactgaaaattaatgacgcaaagacaatccataccagcaagaaaaataagaggcttgttacgggcgtggtcttgtcatctgaggacaaactgtctatcggacgagaaaaaaagcggttttacagcagcatgatccacaaattcaccctgaagctgctggatggggatgagatccataagctccagggttatctgtcgcacgccaaaaacatagaacccctatttatttcccgcatggaaaaaaaatacggccataaggctttagccgagattatgtcctataattga

SEQ ID NO: 11436 - RNA, 951 nt, unidentified
  source 1..951: mol_type = other RNA; note = synthetic construct
atgagtttgcttgcatttctgtcggacaacctgatgttccattcttctgagttgaaaaagttcatctccacagctccacatcgctataagcactatccaattccaaagcgctcagggaacggcttccggataatcagtcagcctagcaaggaactcaagtttatccaaaaaattctggtagagcacctcgaagaggtggtgatcattcaccacaaagcgttagcgtacagaaaagggctcagcattaaagacaatgccctcctgcacaaggccaatccctacctgttgaaaatggacttcaaggactttttccctagcatcgtccctgagctgttctttgacgccctactgaagcaggatatccatttttctaagcaggactacgcactcctccagaaggtgttttttatgaagaagactagaaagagcccctttatactatccattggagctcctagttccccattaatcagcaacgcagtgatgtttgaattcgataaacagatcgatgaactgtgccaaaaacggaatattacctattcacggtacgctgacgatctagtgttctcatcgaaaatcgatggtgcactctttgacctgcccaaactcgttgagggcgttcttgacaaagattactttggcctgatccgcataaacaaggataaaacagtcttcagctctaaagcccataaccgacatatcaccggagtaaccattacgaatgacaacaagctgtccattggtagggataagaagaggttgttgtcctctaaggttcaccgatatagtcttaaccagctggaggccgaactggccgccaagctttccggagagatatcattcgctatattcatcgagccgagctttaaagctttcctgattagaaaatacgggagggatgtggtcgagtctttactgcgtttcaatttcgaaaatactcccgaactttga

SEQ ID NO: 11437 - RNA, 936 nt, unidentified
  source 1..936: mol_type = other RNA; note = synthetic construct
atgaacctcattaagtttctcaaggaaactacgttaatccctgaagatgaattactcaagtttgcctccaccgcgccccataggtacaaggaatacgacatcccaaaaaggaacggtaaaggggtccgccatattgcccagccctcaaaagagctgaaattcttccagaagatcattgtgaactatctgagcgacattctgccggtgcacgaaaaagccacggcttataagcaaagagtgggcatcaaggaaaatgcactgtaccactgtggaaacgagttcattttgaagatggactttgaaaacttcttccctagcatcacaccagacgttctctttcacctctttaaacggcttgatatcaaatttgacaagactgatgagttcttcctggagaagttgttgtttaaaaaaggcaggcgcgatcgtaacagttatctgtctattggttcaccttccagcccctttatttccaattgcatcatgtacttcttcgacatagaggcagaccgcgtgtgctggaacagaggcattacatattctaggtacgctgacgatatcacccttagtaccaagaagcggaataacctgtttgatatgcccaagctactcaatgagatgctgactagagagcttctgggcttcattaaggtcaataaagacaaaaccgttttctcaagcaagcgccacaatagacatatcaccggagtaacactgaacaatgacggagatatttccttgggccgagatcgtaaacggcttatctcgtccatgatacaccgatttaaatctggacagctggatagcatacaaacagccgagctgcaggggtttatctctttctcatactatatagagccactattcctcaacaggttaaagctgaagtatgggactgatatcatcgaccggataaagagttacaatctgttgtga

SEQ ID NO: 11438 - RNA, 936 nt, unidentified
  source 1..936: mol_type = other RNA; note = synthetic construct
atgagtatctatgtcttcctttctgactcactccttattagcgaaagtgatttggagaaattctcttcaacagcaccttatcgctataaagtctatgatattcccaagcgcaatgggaaaggcttcaggaccattgctcacccctcgaaggagttaaagctgattcagcgcttatgtgtgcagtacctggagaataagctatacgtgaatgatgccgctacaggctacagacggggactgtccataaaggataacgcagccgcccacagcaaaaataagtacttgctgaagatggactttgaggacttttttccatccatcaagccacttctgtttttctacatttgcaaacagcgagagataaaattcaccgtgaaagaaaaggctttcctcaggtatatcctgtttaggaaaagcagaggagaagacgttttccgtttaagtatcggtgctccgtcttcccctctgatctccaattttgtgatgagcacattcgacgagatcgtgctgaagtattgcatcaacaacaagatcacctacactagatacgccgatgacctcgccttctcaactaatgtacgtaacagccttttcgacgtacccaagaccatacaggagcggttgcatgatgcaacaagaggaaccatcaaggtgaactcttccaagacggttttttcatctcgaaaacataaccggcatataacgggcgttactctaacaaatgacgggctgctctctctgggacgcaaaaagaagagggagatttcgagtctggtccacaaatttagcatcggtactctcgaacaaaccaaaatttccaacttgcaaggccagctgagcttcgcctatcacatcgaacctgaatttctcatacggctgcagaaaaagtacggccaggcgatcattgataagattaaggggaaaactgacaaatga

SEQ ID NO: 11439 - RNA, 930 nt, unidentified
  source 1..930: mol_type = other RNA; note = synthetic construct
atgaatatagaagaatacttaactgagctcttgtacgtgggccccgacttactctataagtttgcgagtacatcatctcggagatataaaacctaccagatcaaaaaacggtctggaaaaggcgttagaaccatagctcatcctagtaaggaactcaagtacatacagaggctgctggtcgagaaactggaacagctactgcccgtcagcgataacgcctacgcatacattaaggggaagtctatcagagataacgctcagcagcatgtcaacaacaagtatttcctcaagatcgacttttccgattttttctatagcatcacaccggacatttttttcttcatgctgaagaagcacaagatagagtattcccaaaaggaccagtttctacttaagaatctgctgttctggcgaaaagaacgggatggcggtctgactctttctattggcgctccatcatccccattgattagcaacttcgtgctttatgacttcgacaaaagcattaactcatggtgccagggtaataagatcgtgtatacgaggtacgccgacgatattagcttttcaacaaataaacgcaacgccttgtttgacgtgctcgccaatgtaaaaaaaaccctcaatgactgtgggctggagaacatcaagattaacgattccaaaaccatcttttctagtaaggcacataatcgacacatcacaggggttactattaccaatgataacaaactgagcatcggacgcgagaagaaaaggctcctgagttccatgatccaccacttttcccaaggaaacctgcctaaggagaagtacgaggaattatcgggccatctggcccacgcattcttcattgatcccgacttcaagaatttcgtgatcaagaaatacggaaatgaggtgcttaaaaacttgtttcaacgtaagtga

SEQ ID NO: 11440 - RNA, 933 nt, unidentified
  source 1..933: mol_type = other RNA; note = synthetic construct
atgataatcgaacatttgagtgagacgttattcctcgccgaacatgatattgttcgatttagcctgtcctcacctcaccgctacaaggtttatgagattcctaaaagaaactctagcaaaacccgcactattgctcacccctctaaggagctgaagttcatccagcgggctcttgtggagttcttgtcaaaaatcctccctatccatgaggcagcattcgcatacaagaaaggcatgggcataaaggataatgcaaaacagcattcgaaatccaaatacctactcaagatggacttcaaggatttcttcccaagcattacgccagaccttttttttagggtggccgaggattacggcatcgaatttaatgagaatgacaggattgtgctaacaggccttctgttttggaaaccgaagcgctccgatgggctggtattatccatcggagcccccacctctcccctgatctccaacttcgtcatgtttgagtttgacaaaaaggtaagcagtgactgcctgaacaagaagattacatataccagatatgcagacgacatcaccttcagcactcgggtcaaagatgccctgtttgaaataccacccttcattagctcggtgttgaatgaaactgtgaagggtattgagctgaaccctgaaaaaacaatctttacctctcgagcgcacaaccggcacgtgactggggtcacactgactaacgacggtgagatatctgttgggcgtgagaaaaagagactcatctcatcaatgatccacaagagtaagtacagtaaactgtcttccgaagctgctgccaatctgctcggacttatctcctatgcgacccacattgaaccagagttcatggataggatgatcaagaagtacggagccgaagtgatccaagctataaaggccagggccattggcagctga

SEQ ID NO: 11441 - RNA, 933 nt, unidentified
  source 1..933: mol_type = other RNA; note = synthetic construct
atgatcataaagcacctgtctgatacactcttcctcgccgaacacgatattgtacgcttctctttatccagcccccatcgctacaaagtatatgagatcccaaagaggaatagtaaaaaaacccggacgattgcccatcccagtaaggagcttaagttcatccaacggaccctggtggattacctgtctaagattttacccgtgcatggcgcggcttttgcatataaaaaggggataggtatcaaggacaacgcaaggcagcacgccaagtccaagtacctcctgaaaatggacttcaaagattttttcccatccattactcctgagttgtttttcagcgttgccaaggcccacggtatagaattcaacaaggaggataggattgtgctgaccggcctgttgttttggaaaccggaaggctcagatggcctcgtgttaagtatcggggccccaacatcacctctgattagcaacttcgttatgtatatctttgaccagaaactctctgacgagtgcctcaatagaaaggtcacttacacacgctacgctgacgacatcacctttagcactaggatcaaaaatacactattcgaactgcctcatctaattacttcgttgcttaccaaaaccgtcgatggagtggtcattaatcccgataaaactgtgtttacttcccgggcgcataacagacacgttacaggcgtgaccttgaccaatgagggagagctttctatagggcgagagagaaagcgactgatctcgtcaatgatccacaaaagtaagtttagcaaactgagctccgaagacgcatctaacctgctcgggctgatctcatacgctacgcacatcgaatcccagttccttgaccgtatgacaaagaagtatggagctgaggtcctgcaggcaattaaggacagagccgtgggaagctga

SEQ ID NO: 11442 - RNA, 933 nt, unidentified
  source 1..933: mol_type = other RNA; note = synthetic construct
atgatcatcgagtacttgtccgaaagtcttttcatggccaaatatgacatcgtaaatttcgccttaacaagcccccatcgttacaaggtctacgaaattcccaaaaggaatagtaaaaacactcgcaccatagctcatccttctaaagaactgaagttcatccagcgggagcttctgaagaaattgatcgaaatcttgccagtgcacgatgctgcctttgcttatcaaaaagggatcggaattaaggataatgcgaataagcatagcaacagtaagtatctccttaagatggatttcaagaactttttccccagcattacccctagcctgtttttttctatagctgagaagaacggtatcgtctttgacaaaaatgatcagctggtgctgaagggccttttgttctacaaatccaaagccaacaaggagctcactctatcagttggtgcacctacctcaccactgattagcaatttcctcatgcacatttttgaccaaaagatttcctacgaatgttccctgaagaaagtgacctatacacgatatgccgacgacatcacgttctcgacgaacattaagaacatcttatttgagctgccggagattatcatgcagctgctccaggagacagtggtcggcgtggaaataaatccagagaagaccattttcacatcaaaagcacacaatcggcacgtaactggcgtgacactaactaacgagggggggctgtctattggaagagataagaaaagactgatctctagcatgatccacaagtctaaatttaataccctcgcaaacgacgatgcatgctacttactcggcctgatatcccacgcgagtcatattgaacccgagttcctggaaaggataatcaagaaatacggactcgaggttatacagaacattaagctgtcagccatcacttcctga

SEQ ID NO: 11443 - RNA, 933 nt, unidentified
  source 1..933: mol_type = other RNA; note = synthetic construct
atgattatagagtatttgtctgaatccctgctgattgccgaacatgatttgacgtcattcgccttgaccgctcctcacaggtataaagtatacgagatcgcgaaacggaattccaaaaaaacacgtacaatcgcacatccatctaaagaacttaagttcatacagcggtctttggttgagctgtttgagaagagcctagacattcataaggcggcctttgcatacaaaaaggggttcgggattaaagataacgctaaggcccatattaactcgaagtacttactcaagatggacttcaaaaactttttcccttcaattaccccctcactcttttttaccgtggccgagaagaagggcgttgtatttacagctgccgatagggccatccttacgggcctggtgttttggaaacctcagggaagggacgatctgatcctgagtatcggtgcacccacttccccaatagtgagcaacttcgtcatgaattattttgatgaggccgtgttcgatctctgcattaaccgcaaaataacatacacccggtacgctgacgatattaccttctccaccaagctgaaagacaatctctttgatcttcccaagataatcgagactattctgaatgagacagtccagggtatcgaggtcaattccgaaaaaaccatcttcacctcaaaagcccacaatcgccacgtgacaggagtgactctcactaacgacaatcacatcagtgtgggaagagacaagaagcgactaatctctgcaatgatccaccaaagtaagttcaagagcctgactccggaagacgctagccacatcctgggccttattagcttcgcgattcatatcgaaccagaatttctcgacagaatcctgagaaagtatggcgccgaggttttaaacaacatcaaggctaaggcaggcgggatttga

SEQ ID NO: 11444 - RNA, 933 nt, unidentified
  source 1..933: mol_type = other RNA; note = synthetic construct
atgattatcaattacctctctgacagtctgtttatgtccaaagatgatatagtgcggttcagtctaacggcccctcacagatacaaagtgtatgagattcccaagcgaaagtccggtcagaagcgcgtgatagcccatccttcaaaagaacttaagttcatccagcgctctctgattgacattctgaaactctacctccctgtccatgatgcagctttcgcttataggaagggaatcgggattaaggagaacgcaaagcagcacttgaactccaaataccttctgaagatggactttgagaactttttcccctcaattaccccagccctcttttttaaaaccttagaagagcatggattcgtcttggatggcgacgacaaactggttctctctggtctgcttttctggaaaaagaaggattttgacgggttgactctgtctataggtgctccgacaagtcccttggtcagcaatagcgtcatgtacctgtttgacaaaaagattagcgagatctgtctttcaagaaagataagctacacgaggtatgctgacgacatcaccttctctaccaacattaagaacattttgttcgacatcccagaactggtgtcttccgttcttaacgagctagtggatggcgtgaaactgaattgcaagaagactatcttcacaagcaaagcccacaatcggcatgtgaccggggtaacactgactaatgatggcaagctgagcatcggccgagaacggaaacgtctgatttcatcgatgatccaccaaagcaagttctgcaatctcacaatggatgaagcatccaagttactgggactcatcagtcatgccgagcacatcgagccaggatttctgaagaggatgatccacaaatatggcgaggaagttttaaacaatatcaaatccagagcgtccggggtatga

SEQ ID NO: 11445 - RNA, 936 nt, unidentified
  source 1..936: mol_type = other RNA; note = synthetic construct
atggacattcttcaacacataagtgacttgctcctcacaaagaaaagtgagattatatccttcagcttaacagctccataccgatacaagatctacaggattgctaaacggaatagcgataagaagagaactatagcgcatccctccaaagaactgaagtttattcaacgtgccatcactgagtatctcagcgataagctccctgttcacgaatgcgcctttgcatataaaaaggggtcaagcataaaaaccaacgcacagattcatctacacaccaagtatctgctgaagatggactttgaaaacttcttcccatccatcacccctaggttgttcttcagcaagctccgacttgcaaacattgacctgacggcggacgacaaagtcatcctggagaatattctttttttcaagtccaaacgcaactcaaacctaagactgtctatcggagcccctagttcaccgctgatcagtaacttcgtgatgtatttttgggatatagaagtgcagaagatttgttcgaaaatcggcgttaactatactaggtacgccgatgatctcacattttccaccaataataaggacgtgttgttcgatatccccgatatgctggagaatatcttaccaaaatactctctgggtaagatccggatcaatcatgagaaaacagtgttttcctctaaggggcacaatcgccacgtcacgggaattactctgaccaacgacaacaagctgtctatcggccgcgagagaaaacggaagatatcagccatgattcaccattttatcaatggtaagctgcccgctgatgaatacaataagctgattggcttattggccttcgctaaaaacatcgagccctctttctacaagagcatggtaattaagtatgggcctgacaacatccataaacttcagaaacagaaagacaaatga

SEQ ID NO: 11446 - RNA, 960 nt, unidentified
  source 1..960: mol_type = other RNA; note = synthetic construct
atgaatatttctaagcacctgtgcgagaaattggtaatggatgaggacgagatctttaagtttagtataactgccccctacagatacaaagtgtatgagattccgaaaaggaattcgccaaagaaacgcactatagcccaaccaagcaaggagcttaagttcatccaacggattattatctccttactgaaggacgtgctgcccattcatgctagctgctatgcttaccggaagaatttatctatcaaacacaacgcacttgttcatctgaataccaagtacctcctgaaaatggactttgaggattttttcccctccatctcccctcatctgttctttgaaatccttaaactcacaaagatccagttcgaagataatgacctcatcctcctcgaaaagctgttgttttttaagccaaaacgtaactctactcttaggctcagtataggtgcccctagttcccccttcatcagcaatttcgtgatgtattttttcgacattgaggtgcagagtctctgtgacgctcacggcattaactattcacgatatgccgatgaccttacattctcaacgaacaacaaagatctgctgttcgacatgcctattatcgtgtctgacattctgtctaaacattcctttgattccatcaagatcaacaacagaaagaccattttttcaagcaaaggtcacaaccgacacgtaacagggataacactgaccaatgaatccaacttgtcagttggcagagagaaaaagcgcctaataagcgtcatgatccactatttcgtcaccgggaggttggatgtggacgatgttctaaagctgcagggaatgctgagcttcgcacggtttgtggaacctaagttctacttgagcatgtgtaagaaatacggcctggtcaatatcaagaagctgaacagtttacagattgcgtctggagataaaagctcatacatctga

SEQ ID NO: 11447 - RNA, 915 nt, unidentified
  source 1..915: mol_type = other RNA; note = synthetic construct
atgagcaagcccgaaataattcgattctgcttaaccagccctcacagatataaaacgtacaagattcctaagaggaactcagatcaaaaaagaacaatcagccacccaagtaaagagctcaaatttatacagcgtgtgctgaacgattatctgcgcgaaaaactgccgattcatgactgcgcctacgcctataagcagggactgaatattaaagacaatgctgaagttcatgcctctaccaaatatttcctcaagatggacttcgaagacttctttccatcaatcacccccgatttcttttttacaatgctggacaaagcggggctcgagattaatgaaatcgatagtatccttctgaagaacttcatcttctgtaaagcaagtcggaagtcaggcctttttctgagcatcggggccccttcctcccccctaataagcaacttcgtgctttttgggtttgacgagaatatcaaaaggttttgcgcagagaaaaacattaattacactcgctacgctgacgatttgactttcagctccaacatcaagaattccctatttgaggtgcccgagatcgttaaattctacctggacaaggagactaatggcaagattaagatcaataagaggaagaccgtattctcttctaaagctcacaatcggcacgtcactggtgtgaccttaacaaacgatgagaagttgtctgtcggcagaaaccgaaaacgcctgatttccgcaatgatacaccattttaagtgtggtaagctcgatccaacagagattgataagctgaagggcctcatgtcgttcgtgaactatattgaaggagacttttacaggcggatgatcatcaaatacggatcagaaacgatcgacaagttgaacaactataaacaggtcaagcgggatgccaagtga

SEQ ID NO: 11448 - RNA, 924 nt, unidentified
  source 1..924: mol_type = other RNA; note = synthetic construct
atgaatattttcgagcaactgagcgacatcttatgtgtggacgccaatgagctaatggatttcgcttctacctcaccacatagatataaggtgtatactatagcgaaacggaatagcaacaagcgccggttgatagcacacccttcaaaagaattgaaattcatccagaggattctgatcaagattctcgagccaaagctgaaagttaataacgtggcacatgcctatattaaggacaagtccattaaaaccaacgcaatgcagcacgtaaactctaagtatttgcttaagatggacctggaaaatttcttcccctctattaccccaaatcttttttttagctgcctcactaagtctggcgtcgagatcactgaaagagataaggaactcctgacagggtttctgttttggaaacccaggcacagttacaaattgcttctctcaataggtgctccttcctcccctctggttagcaattttatcctgaactcgctggacgaagagctatccgtatactgcgagagcaataagattaagtacacacgctacgctgatgacctgacgttcagtacaaacgtgaaagatatcctcttctccctcccggaggttgtcagcgagagtctgtataataactacaacggagacatcaaggtgaacaaggataaaaccatcttcagcagtaagggatttaatcgacacgtcactggcatcgtgttaaccaacgacaacgtcctgtctatcggtagagaaaaaaaacgtgtgatatcatccacgattcacaaactcaagcttggcgccttggatgacaacgaggtgaatcagctgcagggaatctttgcccatgcctgtttcattgaacccgatttttacaataggatgctgaagaagtacggggctgagacattaaacaaaatcaaaaagtga

SEQ ID NO: 11449 - RNA, 930 nt, unidentified
  source 1..930: mol_type = other RNA; note = synthetic construct
atgaagattgtcgatgtgctgagccttaaactgctgatgtccaacaccgacattgttaaatttgccaataccgcaccacatcgctacaaagtgtatcagattcccaagaggaattcttccaagaagcgcacaatcgcccagccttctaaggagctgaaattcctacaacggatcttgtgcggtattctggaagatatcctgcccatccacaattcggcttttgcctacaagaagaacattggaatcaaacagaatgcagaatttcacagcaagaacaaattccttctcaaaatggatttcaagaactttttcccgtcaatcaatcctaacctttttctccggcaaatagagtcacacgctatttctctggacgaggtggataagaagttgctaataaacctcatcttcagaaagccctaccgagagggaattctggagttatccattggcgctcctagctctccactcataagcaacttcatcatgtacaatttcgacaaggccatcagtgaaaagtgtaacagtatgagtatcacttacacgagatatgcagacgatattaccttttctaccaactccgttaacattctgttcaatatccccaaaatcgtggaaagtctcctccatgatatatatcagggggacatctccttaaataaagagaagacagtctttagctcaaaggcgcataatcgtcacgtaactggcataacactgtccaacgacagcaaattgtcaatcggcaggtataagaaaagggtgttaagctctaaaatccaccattacttgctgggtcatctcaaagaagacgagattcagaaattgaagggagaactggccttttccttccacatagaaccaattcttaaaaagcgattcatccggaagtatgggaaagagtgctttctgaagctggacaaggagctttga

SEQ ID NO: 11450 - RNA, 927 nt, unidentified
  source 1..927: mol_type = other RNA; note = synthetic construct
atgaaaattatcgagctgttgtcttctatgttgcttatggaaaacagcgacatcatcaaattcagtaacagtgcaccatatcgatataaggtttatcagatccccaagcgcaactcactgaaaaagcggactatagcacaaccctccaaagaactgaagttcatacagaagttgctctaccaaatactgggcaaggaacttcccgtacacaagagcgcctttgcttaccagaagtatataggaatcaaacagaacgccgagcagcacgtgaagaataggtttctcttaaagatggacttcaagaacttctttcctagcgtcaatcctgagctgttttttatagagattgagcattacggcatcgagctggacaaaattgataagtccctactcaccaatttaatcttccggaagccatatcggaaagggggtctggagctctctattggggctcctatttctcccctcatctcgaattttgtgatgtacagattcgacgatttcatttccatcaagtgcaatgaaatgaacgtgaagtacaccagatatgccgacgatctgaccttttcatccaactgtaaagacatcttattcgaaattccaggcatagtcgagaaagcgctgtttgatatctacaagggtaacatcgttatcaacaagagtaaaaccattttcagctcaaaggctcacaatcgtcatgtgactggaattacactcagcaatgacgattctctatccattggaaggaataagaaaaggattcttagcgcaagcctgcattattacacactggggagattgacgaaagaagagatccagaagctgaaaggctacctcgccttttcattctacatcgaaccgaacctggagtccaaacttattcgcaaatacggcaaagagtgccttgataatctgatgaaggaatga

SEQ ID NO: 11451 - RNA, 924 nt, unidentified
  source 1..924: mol_type = other RNA; note = synthetic construct
atgaacattctttcttccatcagcgacaaattactcatgaataattcagacctgctggagttttcaaggacgtgtccccatagatataaaatctacacaatccctaagcggaactctaagaaaaaaagggtaatcgcacagccaagcaaagaactgaagtttattcagcggatacttatacagaatttggaaaacaagctgcccatccataacatggcgtttgcctatagaaaggggattagcatcaagaacaacgctcagaaacacttgtacaacgactatctgctcaagatggacttcaaagatttctttgagtccattaccccgaagatcttttttcgcgaactggagaagcacaagatcatcctctcatctgaagatattaagtttcttacaggagtcatcttccgaaaggagaaaaatgagctcctgctgagcattggctcccccatttccccactaatcagcaatttcgtgatgtttagtttcgacaagatagtctacgaactttgcctcaaaaaagagataacttacaccagatacgccgatgatattaccttcagtactaatcgcaaaaacatactgttcaacatcccttcgatgatcgaagacgtgctgttagcaaattacgaaggagagatcatcctcaataaagaaaaaaccagattcaccagtaaggcccacaataggcacgttactggcgtgacactgagtaatgagaacaaattaagcatcggccgtacaaagaagcgagagttgattgtggccttgcactacttcataaacaataagctggacatcgactctattgagaaactgaggggggagctcgcttttgctttctatattgagcctgatttcaagaaccggctaattaagaagtatggtcaaaactccctggatcgcattcggcataataactga

SEQ ID NO: 11452 - RNA, 930 nt, unidentified
  source 1..930: mol_type = other RNA; note = synthetic construct
atgaatatcgttgattaccttagcgacttaatattgatggatcgccgcgaactgttgaaattttcttctacatcaccgtaccgatataaagtgtatgagattcccaaaaggaactcgaatggaaagcgaactattgctcaaccaagtaaagagctgaaatatatccagagggccctcttgaaattctttgacggggtcattccaatccacgatagtgtgttctcttacaaaaagggaatatccatcaaagacaacgcctgctgtcatgtaaactacaaatacctgctcaagatggatttcaaagacttttttccttccattaccccctcgatcctgttcaatgagtttgagaaatataagctgtacttcaatgacgacgacaaaaagctgctatctggtctgcttttttggaagaagaaccggaagaatgatttcttacagctcagtattggcgcccctaccagccccttcatttccaacttcatcctctactcattcgacaaggccatcagtgatatatgcagcgaaaagaacgtggtgtattccagatatgcggatgacatcacattttcaagcaatgtcaagaatgtgctcttcgaatttcctaagatcgtcatcgaactgctgtaccagctatacaacggcaacattaagatcaacaaagacaagaccgttttttccagccgggcacacaaccgtcatgtgactgggattacgcttagcaatgatgggttcctgagcatcggcagagaaaagaaaaggaagctgtcttcctgttttcactactacattacccggaaattatcaaagatcgagatagacaagctgaagggcgagctggcattcgctttttatattgagccagatttcaagaatcgcctcatgggaaagtatggtgaaaaaacattggagctccttatgagagagtga

SEQ ID NO: 11453 - RNA, 930 nt, unidentified
  source 1..930: mol_type = other RNA; note = synthetic construct
atgacaatcctcgatatcctgatggacactctgttgctcgatatgcaagaattgaagaagttcgcctctacatccccctataggtataaagtgtatcagatccctaagcggaacagcaaaaaaaagagaaccatcgcccacccatccaaggaacttaaattcattcaacgggctcttaatggcattctgagtaatattcttccagtccacgaggccgtgttcagctacaaaaaggaagttagtattaaggacaacgctcagaagcatctcaagtcacagtacctcctgaagatggattttaagaacttctttcctagcatcactccagaaattttcttcgaccagctggacaaaaataatatttcatactccgtggaagacagagagattatcagtcgcctgttattttggaaaccctctcggtataaagaatacttaagtctctccatcggagcaccctcttcaccgctgatatccaatttcattatgtacagctttgacaagaagataaacgactactgcaacaatatcaacgtcacgtatacccgatatgcagacgatattactttcacgaccaacgtaaggaatatcttgttcgatatccctaatgagattaaaaagatcctactggaggagttttccggtaagatcatcataaacaacaagaagaccatctttagctctaaagcgaataatagacatgttacaggcatacgtctgaccaacgataacaagctatctataggcaggaataagaaacgcgtgctgagcagcaaggtgcatcactactcactcggaaaaatcaacgatgacgaagccaaaaaattacagggggagctggctttcactttttatattgagcccgagtttgagtcgaaacttattaaaaagtacgggctggagacactgctcaagttgaacaaaatatga

SEQ ID NO: 11454 - RNA, 930 nt, unidentified
  source 1..930: mol_type = other RNA; note = synthetic construct
atgagcatagttgattacgtgtgtgatgccctttgcatcgaaaaaatgcagttaatgcactttgctgtaacagctccccaccgatacaagaagtacgagatcccgaagagatccgggaacggcacccggaccattgcacaacccagtaagcaactcaagttcattcagcggatcatcatctctgagctcgaaaagattcttactcctcacccatctgccttcgcgtacattaaggggatcagcataaaggacaatgcggagatgcatgttaaaaatcgttacctgctcaaaatggatttcaaagacttctttcccagcattacccccgacctgatgtttcaggagtatgctaggtttggtgtcacattcagccctgaggatagtgcactgttgtcaaacatcctgtttttcaaacttaggaagaatagtaagctgaaactgtccatcggcgcaccatcatcacctttcatctccaacataatcatgcgccactttgacgccgtgatatcagaactgtgccagcataaaaagatctcctatacccgatatgccgatgacatcacgttctccagcaatattaagaacgttctatttgagatccctgaggccattactgtcgcactcaaaaaggaggggtataaatgcattaagatcaacaaggagaagacggtcttcagttccaagagaaacaatagacacgtgacaggtataaccattagcaatgaagacaaactgtctgtgggacgcactaaaaagcggattctcacagctgccgtgcacaaatttagcctgggatatttgtcggaatctgacatcgagaagctgaaaggcgaactatcttttgtattcttcgtggaaccagcctttaaggacaggttaattaaaaagtacggatacgatgtgtgtcataaattgtggaaacatgcttga

SEQ ID NO: 11455 - RNA, 930 nt, unidentified
  source 1..930: mol_type = other RNA; note = synthetic construct
atgagcatcatcgactacgtgtgtgacgccttatgtatcgaaaagactcagctcatccaattcgccgtcaccgcaccccacagatataaaaaatacgatatccctaagcggtccggaaacggcacccgaacaattgctcagccaagcaagcaactcaagtttattcagaagatcatcttgctcaaattggagaaattactgacacctcatcagtccgcatacgcgtacgtaaagaataagagcattaaggataacgctacagtgcacattaataaccggtatcttctgaagatggatttcaaggactttttcccatcgatcaccccggagctgatgtttcaggagtacgcacgcttcggaattatgttctcaaacgatgaacagactctgctctcaaacatactgtttttcaagctgaggaaaaatagcaaactgaaactgtctatcggagctccttcttctcccttcatatctaacattgtgatgcgtcattttgacaccgtggtgagtgagctttgcgagaataaaaagatcaagtataccaggtacgccgatgacataacctttagcagcaatattcgggacgtcctgtttgaatttccccagatcattgccaatactctaaaaaacgaaggctatcatgatatcacgctgaacatagagaaaacgatcttctcctccaagcgcaacaatagacacgttactggggtcactctgagtaatgatgggaacttatccattggccgcgacaaaaagcgattgctttcagcctcaattcacacattcagtctaggtaagctctgcgaaaaggacattgagaaacttaaaggtgagctggcttttgccttctatatcgaacccgagttcaaaataaggatgctcaagaagtacgggtccagtacatgctctagattgtggaaagttgactga

SEQ ID NO: 11456 - RNA, 933 nt, unidentified
  source 1..933: mol_type = other RNA; note = synthetic construct
atgaacattgtatcctacgtgtgcgataccttgtgtattgacgagaaacagttgatgctgttcgcagccacgtctccacaccgatataaaacctatgaaatccctaagcgctccggaaatggaactcgtacaattgcccacccctctaaacagcttaaatttatccagcgcctggtaatctcccaactggagaagatcgtgtctccacataaggccgcagttgcttatattaaagggctcagtatcaaggataatgcgatattacatgctaagaacagcttcctactgaaaatggacttcaaggattttttccactctatcacccccgaactgatgttccaaacttacgagcagctgggggtttccttcagcatcaaggagcgagaattcctctcgaacattctgttttataaggtgaggaagaatagccacctcaggctttcaataggcgctccgtcaagtccttttatcagcaacatcgtcatgcaccacttcgatgacagtatgtctaaatactgctccgaaaaagagatcatttacacaaggtatgctgacgatttgactttcagcagcaatataaagggtatactgtttcatctgcccgatgaggtgcggtttcacctagacgaaacaggctacaagtcaatcgtcgtgaacattgagaaaaccacttttacaagcaagaaacacaatcggcatgtgactggcattacgatctctaatgattccacaacctcaatcggtagacagcggaaaagaaaccttagtgccgccattcataagtttagtctcggcaatatgaccgaagacgagattgaaaaactgaaaggcgacttatcatttgcattctttgtcgagcctgacttcaagctcagaatgaagcagaaatacggagagaagatatacgggatgctgttcaagaagaactcctga

SEQ ID NO: 11457 - RNA, 939 nt, unidentified
  source 1..939: mol_type = other RNA; note = synthetic construct
atgagcatcttcgatagtatcgtggactctctgtgtacgtcacccgaacatcttcgcaactttgccgcgacttccccttatcggtacaaagtctatgacatcccaaaaaggagcgggtctggaaaacgtaaaatagcgcaccccgcaaagcagttgaagtacattcagcgattagccgtgcacgagctggaaaagttcttcaccccacacgaatccgccttcgcttatgtgaaaggcaaatctatcagagacaacgctaaggttcacgtaaggaacgagtatctgctcaagatggatttcaaagacttttttccgagtattacaccagaactgttctttgcacaggtggaaaaattgggcactaccttttgcgatgaagacaaggttttcctgtccaacattctgttctacaagttgcgatcttactcaaagctgaggttaagcatcggggcacctagctcccctttcgtgagtaatattgtcatgcgggaatttgacatcaaaatatctgagttctgcaaaaccaagtccatcgcctatagcagatacgccgatgacctgtgtttttctacaaacatttccggtctactgttcgagctgcctaaactggttaccaaaacactcaagtcgaatggctacgccgagctcaaaatgaataggagcaaaaccgtgtacagctccaagggacataatagacatgtcacgggcgtgactctgagtaatgatgagaagctatcagtcggccgtagtaagaagcgcgagactatagctcgcgtacatcactatctcaacggtagactcacacccgaacaagtggagagccttcaggggtatctttcatttgtctttcacatcgagcccgagtttaagatccggttgcataagaagtacggaaatgaagctattgagatgctcctttcagagcggaagattgattga

SEQ ID NO: 11458 - RNA, 933 nt, unidentified
  source 1..933: mol_type = other RNA; note = synthetic construct
atggtaaagatagtgaattttatctcagagtcactctgcattgaggagtccgaactgatctcctttgcacacaccgccccccacaggtacaaaatctatacaataccaaagcgctcaggaaacggccgaaggacgatcgctcacccctctaagcaactcaaatttatccaacgcctcacccttcggcttctgcaggacgtcttacctattcacgaaagtgctctggcgtacaagaagagtatcagcattagagataacgccaatatccatcgtaagaaccagtacttactgaagatggactttaaggatttctttccatctattacaccgagcctgttgtttagagaactagagcgaaagaatatcattgtctcagacgaggacaaaaatttcctggccagcattctctttttcaagcttagatcgaattcttctctcaaactgagtatcggggcaccttcctccccattgatttccaacttcattatgcaccactttgatcagatcttgagctcagagtgcaaaaagatgaagatctgttatacccgttacgctgacgatattacctttagcactaacatcaaggattctctgttcaaaatccctagcatagttaagaacatccttaagaacgagaaataccccgagctaaaggtgaatgaggaaaaaaccgtgttctcttccaaagcccataacagacatgtgacgggaatcacaattacaaacgagggcgcactcagtgtagggcgggaaaagaggcggctgttaagtgcctccctgcataggtatattgagggcaaaatagacggtgaaactaagaatactctgaaaggtcagctgagcttcgccttcttcattgaaccccagttcaaaatacgcctgcagaaaaagtatggggaacgggctttggagaaactcttcagcaatgaatga

SEQ ID NO: 11459 - RNA, 936 nt, unidentified
  source 1..936: mol_type = other RNA; note = synthetic construct
atgaacatcctcaatagcgtgtctaaggagagtggcctttcagttaccgacctcctggcattcagcaaaacctgccctcaccgctataaggtctattttattgccaaacgcaatagcgacgctaaacgggttattgctcagcctagcaaggaggtgaagtacctgcagggggctgtgataaagattttcaagagctttgacctggtacatgaggcggccttcgcttacaaggatggcataaacatcaagcaaaatgcccaggtccatgccaatcagaaatacatcttgaagatggacttcaaagacttcttcccgagtatcaccccagatctgctattttcacaactcaatatcgcgaaggtgtttcttagtgaaaaagacaaagagtttctctccggactccttttctggaaacgacgaaggaactcaaaattacggttatcaattggagcaccaagttcccccttgatgtccaacattgtgatgtacttcttcgattcctatatagaaagctactgtagactgaatagaataaggtacacgaggtatgccgatgacctgtgctttagttcttcgatggcaggaggacttgactccgtgaaagatactgtgaacaaagccctgcgctcattttttgggcgcaaaatcagactgaacaccgctaagactattttcgcatctaaggccatgaatcggcacattacaggcatcacactgactaacgatggtaagctctccgtcgggcgtgacagaaagagggagattattgccgcagtccacaaagtgagccagggcaacagccccgattgttctttgaagacactggctggtctgatctcttatgtacattctgtggaaggggattttaaagaccgtctaatcaagaagtacggcgaagttatcgtccagaagatcttcgattccttgcgggagtga

SEQ ID NO: 11460 - RNA, 948 nt, unidentified
  source 1..948: mol_type = other RNA; note = synthetic construct
atgatcgaactgaacttgcttaaatcgctgaatacagattttcccctaggcgaggacaacatactctctttcgcacgaactgcaccgcataggtacaagacctatgaaatcctcaaacgagacggtgtgagcaagaggaaaatcgcccagcctagcaaggaagtcaaattactgcagagaagcgcgctgaaagtgttggaaccaatactgcctgtgcatcccctcgctttcgcctatactaaggcaaggtctatcaagcacaatgcgcttatccacaaggagtccaaatttatcctgaagctcgacctgaccaatttttttaactccattactcctaagctcctgcttgagaagtttcataccgctaatattagtctgacgcacaacgaccaggacctgattagtcacctgtttttctggaaggagaaacgcaatgagtctccaaaactgagtgtgggggctccatcatcacccctcttatccaacttcatcatgtacaactttgacacgaagattatcgaagtatgcaaaaaaaacggctgtctgtacagccgctacgccgatgatattaccatttcctcaaccgaaaacttctatcagctcaatctgccattcatcatagccaaaattctacgggaggaattcggggaatccatcaccttgaataacacaaagacaaagtacattagcagtgcctatcggcgtcaagtcactggtgttatactcacaaatgatcaggatatctctatcggacatcgcaaaaagcggcttttgtcaagcaaaattcaccacttcaagatccagagactgttggatcccaatgagattcagaaactaaagggagagcttgcttttgccttctatatcaaacctgagttaaggaagaaattcgagataaagtacggccaaaacaccatcacaaagattctgaagtacaagagactgtga

SEQ ID NO: 11461 - RNA, 942 nt, unidentified
  source 1..942: mol_type = other RNA; note = synthetic construct
atgattgagctgaatcttctcaagttccttaacatcgagtttcccctcggcgaggaaaatattatcagttttgtgaataccgcccctcatagatacaaaacctatgagattctcaagaaagatggcaaaaacaaaagaaagatcgctcagcccagcaaagaggtaaagctgttacagcgttcagctctgaaactactcgagccgatactcccaatccatgacctcgcctttgcatacaccaaaaatcgaagcatcaaaaacaacgcgatgatccaccaaaattccaaattcattctgaagactgatctgtcaaattttttcaactcgataacacccaagattttgctcgagcagatacgcaagaccaacatatcagtttcaagtaagaatgaggaacttgtgtccaatttattcttttggaaggaaacacgcaaggacggactgaagttgagcattggagcaccttcgtctccactgttgagcaacttcatcatgtacaactttgacaacaaaatcgtggaggtctgcaagcagtatgactgtgcctattccaggtacgcagacgatatcactatcagctctagtaagaacttttatgaactgaacttcccactgatcattaaaaagatcttgctggaagaattcggtgaatctattaagctgaatagcaacaagacgaagtatatttccaaagcctaccaccggaatgtcactggcataacaatcacaaatgatgggtccattagtattgggagcaataataaacggctgctatcttctaagattcaccacttcaaaaacaacaagataaaggataccaacgagatcttcaagttaaaaggtcagctttccttcgcttttcatatcaggcctcaactgaaggagcagtttgaaaaaaaatatggaaaggacaccatctacaaaattctgaagtacaagtga

SEQ ID NO: 11462 - RNA, 948 nt, unidentified
  source 1..948: mol_type = other RNA; note = synthetic construct
atgaaggagctgaacttgctcaatctacttaatctcgaattccctctgggacaggataacatactgagttttagcaggaccgcaccccatagatacaagacttatgaaatcctgaagaaagatggaatctctacacggaaaatcgcccaaccctccaaggaagtcaagcttttgcaacgaagcgccataaaaattctcgaatcaaattttccggtgcactacagcgcatttgcctatgttaagaatcgctccattaagcagaatgccataatacaccagaactcgaactacattttcaagaccgacttgagtaacttttttaactctataacgcctctgattttcctcgaaaagatcaagcagaacaacatcattctttccgacaaaaattcacagctcatcacacatctgttcttttggaaagagaatcgcaatgactcactcaaactatccattggcgctccatctagtccctttatctctaacttcatcatgttcaacttcgatgagaagattctggagatttgcaaaaaacacaactgtgagtactcaagatatgccgacgacataactatttcttcccggaataatttcttcgaattaaacttcaccagcatcatcacagcgttacttaatgaagagtttaagggcaacatcaagctgaatacgaagaagactaagtacattagtaaggcttatcatcgtaatatcactggtattaccatcaccaatgaccacaacatcagcattgggcataggaaaaaaagattgctgagcgccaagatccaccacttcaaaaacaacaagatcaaaaaccagtccgatattctcaaactgaaaggcgagctggcattcgctttttatatcatgccacatttaagggagaagttcgagaataaatacgggaatgataccattctgcagatcctgaagtttaaaacagattga

SEQ ID NO: 11463 - RNA, 1008 nt, unidentified
  source 1..1008: mol_type = other RNA; note = synthetic construct
atgagtaactttctacagaaactgaagcagttcgtttaccagctctttaactctaaatctgagaagaatgtgctgaaaatatcgtaccctaccaatatcaaccagcagaagtttaagaacaagaagtcctttttggatttcgcctattctgccccctacaaatataagaactactacattcccaagaggaatagcacccaaaagcgtttaatttcccagccaaccgcagagttaaagtttgtacaaaaggacgtcatcaatcagttgtcagctttcctcccgattcacaactgcgcctatgcatacgtgaagaatcgcaatattaaagacaatgctgaactgcatcggcatagcaattatgtgctgaagttagacttcaagcatttcttccacagcatcagaccaaaaatcctctttaatcagctggaacaccaccagattaagctgtcagaaatcgatcagaccatactgagctttattttcttctggcgagaaaagaaagacagtccccttaaattgtcaattggagccccctcctccccagtcctgagcaactttataatgtatcggtttgacgagatgctgaaccagctgtgcgagaagcaccagtgtatatacagtcggtatgccgatgatatcacaatcagctccaaatatcatttctacgacctaaactttcctcaacatgtgcaaaaccttctggatcaggagttccaaggcaagattaagctcaatacacagaagacaaaataccttacgcgcaaacatagaagatttgtgactgggatcactctgactaacgatgctaaattgtctatcggccgacaacaaaaaaggcttctcagtgcgaagattcaccacttcaagataaacaaactgaatgacgagcagcagatcctgtctctcaagggacagctggcattcgctttctatatccagcctgagcttaaagttcagttttcaaggaaatacggtgaagagctcttgcacaaaatcatgtccgactga

SEQ ID NO: 11464 - RNA, 906 nt, unidentified
  source 1..906: mol_type = other RNA; note = synthetic construct
atgtcagattcagagttgtttgacctcgcaaaaacctgccctcacagatacaaggtgtatgagatcgataagaaaaatgggggaaagaggctcattgcccatccatccaaagagttgaagtatatccagaaactcatccttgacattctgaaagcaaacctgtcaatacaccattcggcatacgcctacgtcgccgagaaaaatattaaggagaatgcctctcttcacgtaaacaatagttacctgcttaagatggacttcaaggatttctttccatccattaccccgggcctattcttcgacgaatgtgaaaaacataacatcttcttctccaaagaagacaaggatttgctggccaatattctattttggaagaagaagcacgctaaaaagttggtcctctctataggtgcgccctcttcaccctttatctccaacttcatcatgttctcttttgatgctctcatcagcgagtattgcaatactaacggcatcaaatacagccggtatgctgacgacttaacatttagcaccaataagaaagagaagttaagcaaactgcccaaactgatctccgaaaaactgaattcgctgtaccggaagagtattcgcataaacattgaaaagaccacgtttgttagcaaggcttgtagcaggaaagtgactggattagtcatcactaataacaacacaatctctatagggcgcgaacgaaaacgtcagataagtgccatggtgcaccagtatagcattggtaagatgacaaactccaaggatattgaaaaactggtgggactggtgaattttgcgatctacattgagcctcaattcctgaacttcctccttaaaaagtatggcagagagatcgttaatagtatctacaagctgaagaacaagaacaagtga

SEQ ID NO: 11465 - RNA, 939 nt, unidentified
  source 1..939: mol_type = other RNA; note = synthetic construct
atgaacattgatatcaagaggcacttgagaaataacctctttatttcagacctggagatattcgaactgtcgaaaacctgcccccatcggtacaaggtctatgagattaataagaagaacggtggtacgcgcacaattgcccacccctctaaggaacttaagtacattcagaccttaatcatcaatgttctgaagacgcaactacctatccatcggtgtgcatttgcctatgtagctggcaaaaacataaaggagaacgctttgttgcatgtcaaaaatccgtatgtcttaaagatggacttcaaagatttcttcccttccataacacccggcctttttttcaatgagtgcgaaaaacactcactctacctgtcaaaggaggatcagcagctgatcgcaaactttctgttttggaagaaaaagagagcgcacaagcttattctgagtatcggagccccatcctctccattcattagcaacttcataatgtactcctttgatgtggtggtgaatgagtattgtagcgaaaaaggcatcatttacagccgctacgcagacgatctcacattttctacaaaacaggctgggcttctgtcccacctccctaaaattgtgtcagagaagctgaattccctgtacaaaaagtctatacgaattaacagcgagaaaaccactttcgttagcaaagctcacagcaggaaggtgactgggctgatactgaccaaccagaataacgtaagtatcggaaggactaaaaaacgtaacatttccgccatggttcatcaatataagatcgggaaaatcatcgataagaaggaaatcgagaagctaattggactcgtgaattttgccgtgtacattgaaccagacttcctcaatttcttgatcaaaaagtatggcaaagacactatcagtaagatctataagatcgacacctga

SEQ ID NO: 11466 - RNA, 906 nt, unidentified
  source 1..906: mol_type = other RNA; note = synthetic construct
atgtccgaaaaagaactgttcaatttctcaaagacctgtccacaccggtacaaagtatatcccataccgaagaaaaatggtggcgagcggatcattgcccaccccgcaaaagagctaaagtatattcaacgagtcattgtcaagatactcaagaccaaactatctatccatcacagctcctatgcttacatgaataacatctcaatcaaggacaatgccgcattgcattccaataacgatttcatcctgaagatggatttcaaagagttttttcccagcatcacacctctgattttttttaacgcactcaatacgcagaatatccacttatccaaaattgatagtgcccttttagcgaatttcctcttttggaagccctacagaaagcaaaaactcgttttgtcaattggcgcccccagctcgcctctgataagcaattttgtgatgtacgaattcgacaatcagatcagttctctttgccgtaatctgaacatcacatacagccgctatgccgacgatctcacctttagtacccaggaaaaaaacgtgctttacgtgcttcctaaacagatccaacagattttgaacactacttacaagaagggaattcgcatcaacccagagaagacatctttcatttcaaaggcttttcagagaaaggtgacgggactcatactgactaacgagaataacattagtatcggcagggacaagaaaaggctgataagctccatgctgcacaagtataagattgggctgaacacccagaaagaggatatcgaaaaactgactgggttgctgtccttcgctttctatatagagccacattttaaggagtctatgatcaggaaatacgaaatcgacacaattaacaaactgttcaagaacaaggagaacccttcttga

SEQ ID NO: 11467 - RNA, 939 nt, unidentified
  source 1..939: mol_type = other RNA; note = synthetic construct
atgtccctcctacaattcatcgctaatggcctgtacatcacggaggatgaagccattcggtatattgtaaccatcccccgcagatataagaagttcaacatccggaaaagaaattccaatgagttcaggctcattgcacagcccgccaaacaggtgaaaagtatccagcgaattgtgctcaagtatgttatcagtgattttcacgtgcatgaacgcgcgtttgcatatgaatcatacaaggacataaggaagaatgctctcgttcaccacaataacgactacattctgaaaatggacttcaagaactttttcccgtccatacggccatttcacttgatgaactgtttcgccaatatgaacattaaactggacgagatggattttttcgtcatcgaaaaccttttcttctggaaaccccgtcgcaactcgcctttgcagctgtcaatcggcgcaccttccagccctaagatctctaacgtaatcatgtactcttttgactgcgagatcttttctagatgtaaggagatgggaattgagtattcaagatatgctgatgacctgacttttagtaccacaaaaaagggcattcttttcgatataccaaagatcgtgagggaaattctaaatgaggtcaatctgaaaagcataaagatcaaccatgagaagacaatcttttccagcaaaaagtttaaccgccatgttacaggaataaccatcactaatgacggtggccttagcctggggcgtgagaagaagaggatcttgcgatcaaagattcatcactacatttgcggggtgttaccagatgtggaaatcctgaaactgcggggtgagttagggtacgctaaatttattgaacccagcttcttcaaagccatggtgaataaatacggatatgacgtcatagatagcattgccaagtacggcaactgctcttga

SEQ ID NO: 11468 - RNA, 939 nt, unidentified
  source 1..939: mol_type = other RNA; note = synthetic construct
atgaatctgcttcaattcatatccaatggcttgtatctgacagatgatgaagcaatttcttacatcatgaccatcccgaggaggtataagaagttctatattaagaagcgcagttcacaggaatatagacttattgcacagcccgctaggcaagttaaatcactgcagaaggtggttctgaaacatatcgacaaacactttcacgtgcacgaaaatgcctttgcctatgaatacaacaaagacattcgaaagaacgcgttactacactctaagaatcagtttatcctgaagatggacttcaaaaacttctttctcagcataaaacccattctgctgaagaaatatttcaacgagattggcatcgagttggataagaaggacattatcgtgatagagaatctgtttttctggaagctgcgtcgcaatagccctctccgcctcagtattggggctcctagttcgcccaagatctctaacgtggtgatgtacttttttgattgcgagatctccaaaaagtgcaaacagttaggaatagaatactcaagatacgccgatgacctgacattcagcacgaacatcaacaacatcttatttagcattccaaagatcgtgagagagacactaaaccaggtcggactgaacgacattaagatcaatcacaagaagactgtcttctccagcaaaaagttcaatcgacatgtaaccggcgttaccattactaacgataaaaaactgtcacttggtcgggagagaaagcggttgcttcggtccaaaatccatcattacacctgtggtatcctcagtgaaacggagatattgaaactcaggggagagctcgggtttgccaaatttatagagccaacattcttcgaaagcatggtaaataagtacggctacaaagtcattaagtccatcaccacttatgggaatctgtcttga

SEQ ID NO: 11469 - RNA, 933 nt, unidentified
  source 1..933: mol_type = other RNA; note = synthetic construct
atgaatctgttacagtttatcgccaatggactatatctgactgaagacgaagccatgagatacatcgttacaattccacggcggtacaaaaagttttacatccggaaaaggaatggcattgactatcgtctcatagcacagcccgctcgccaggttaaatttctccaaaaggctacattgaagtatatggggaagtatttccatatacacgagtccgcgtttgcttataaatctggcaaggacattcggaagaacgctctcgtgcactgtaacaacgaatacattctcaagatggactttaagaacttcttccttagcattaagcctatccaccttaaaaattacttcagtaggatggggataaccctcgatgagaaagatatctttgtgctggagaacttgttcttctggaagttgcgcaggaactccccgttacgactgagcatcggtgccccttcaagtcctatgctgtcgaatgtagtgatgtatctgttcgatgtagagattaacaatcagtgcgaagccttagatgtgacatataccaggtacgccgacgacctgacgttctcatcaaacgttaagggaatcctgtttgatatccccaaaattgtgaaagaggtccttactaaggtcaatatgaagggcatcaaaatcaaccgcgagaagacagtgttttccagcaaaaagttcaacagacatataaccggggtgaccatcactaacaatggtaccctgagtcttggcagagaaaggaaacgtttgctacgctctaaaattcatcactacatctgcggactgctgccagatgtcgaaattctgaagctgagaggagaactcgggtacgcaaaatttattgagcccaagttcttcgagtctatgatgtcccgatatggttacgagataatcgagagcatcgcaaagtacggcaattga

SEQ ID NO: 11470 - RNA, 933 nt, unidentified
  source 1..933: mol_type = other RNA; note = synthetic construct
atggaactgctttcttatatatccaagggactgtttctctccgaggaagaggccaagcggtatattgtgaccattccccgtcgatacaaaaaataccccattgcgaaaagaaatggtaatggataccggctgatcgctcaaccagcaaggcaggtgaaggcactccagaaagcagtcattaaccacatgctggccaatctgaaggtgcacgaaaatgcattcgcctatgaagccgacaaaagcattagaagcaatgctttgatgcattgtaacaatgattacctgctgaagatggacttcaagaacttttttatgtcaatcaagccacataacctattgtccgtcttgaaagaatatggcgtagagctgacgggcacggatatcttcgtgttagagaacttattcttctggaaacttagacgcaactcaccgcttcgactgagtgtcggggcgccttcttctcccatcatatcgaataccgtgatgtattttttcgatgaggagattagtaagagatgcaaggaactcgacataacctattctcgctatgctgatgaccttacattttccactaagattaagggtgctctgtttgatgttcctaagttagttcgcgaagtactgaacatcgtgaatttgaggaatatcaaaatcaaccacgaaaagacagtctttaccagccgtaagttcaaccgccatgtgacaggcgttactattactaccgaggggtacctgagtctggggagggaccggaagaggctccttaggtccaaaattcatcactacgtgtgcggggtcctaagcgagaaagaaatcctcacactcaaaggagagctgggctacgccaagttcatcgagcacaagtttttcctcagcatgatcaaacggtacggcaacgccgtgatctcagagatctcaaaatacgagatatga

SEQ ID NO: 11471 - RNA, 933 nt, unidentified
  source 1..933: mol_type = other RNA; note = synthetic construct
atggagctgctgaactatattgcaaacggtttattcctcagcgacgaagaggcaaggaagtatatctcaacaattcctaggagatacaagaagtatcacatcctcaaacgaaatggaaaagcctttcgcctcatcgcgcagcctgcccgacaagtgaaaagtctgcagagcgctgtgttgaatcacatttccgacgtgctgcaggtacacgagtccgcgtttgcatacgagagcagcaagggcattaaagccaatgccctgatccactgtagaaatgactatctgctgaaaatggatttcaagaacttcttcttgtcaattaagccgtttaactttctgcgtaacttgaaggagtttggcattgagctgaatgaaacagatgtcttcgtgatcgaaaacttattcttttggaagctgcgccggagttcaccacttcggttatccataggggctccctctagtccgaaaattagcaatgtcgtaatgtacttcttcgacgaaaaaatgaccaagaaatgcgccgctctcggaataacctattcaaggtacgccgatgatttgacgttctccactaaggtcaagggtgtgctatttaacgtgcccaagatcgttagagaaatcctgaatgaagttagtctccggaacatcaagatcaaccatgagaagactgtttttagctcctctaagtttaacaggcatatcacaggagtgaccatcactcccgacgggcatctttctctagggagagagcggaaacgtctgcttcgctccaaaattcatcactatgtgagcggcgtgctctctccaaaagaaatcctgacccttaaaggcgagatgggctacgctaagttcatagagcactcgttctaccagtctatgattaatcgctacggagtcgccgtcatagatgcaattgctaagtacgaaatctga

SEQ ID NO: 11472 - RNA, 933 nt, unidentified
  source 1..933: mol_type = other RNA; note = synthetic construct
atggagctactgtcattcatatccaacgggctgctcctgactgaagccgagacaaagaagtatatctccacaatccctagacggtataagaagtaccaaatccccaaacgtaacggacacggcaatcgactgattgctcagccggccaaacaggtcaagttgcttcagaaagccgtgctaaatttcatatgcgaacacctgcaggtacacgaaagcgcttttgcgtacgaggaaaataagtcaatacgggctaatgctcttatacattgttctaaccagtacctcttaaaaatggacttcaggaattttttcctgagtatcaagccccacaatttgattaactacttccaaactaagggagtcgtgcttacggagtccgacatcttcatcatcgagaacttgtttttctggaagcttagacgcaatagtcccttgcggctgtccattggggcaccatccagcccaaagctgagcaacgtgatcatgtataactttgacgagaaaatctctctcaagtgcagcaagatgaacatcatctattcacggtatgcagatgatattaccttctccagccacgtcaaagggagcttattcgaaatccctaggattgtgagagagactctgaatgaggttaacctcaagaacatcaaaattaaccatcagaagactgtgttttcatctcgaaagttcaatcgccatattaccggagtgacaataaccacggaaggtcatttatctctgggtcgtgttcgcaaaaggctgctgaggagcaagattcacagattcattaatgagaaactcaccagtaaggaaacagccagtctcaaaggcgaactgggctacgcaaaatttatcgagtactcgttttatcagtctatgattgacaaatacggctttgataccatcaacaagattgccaaatttcctcaatga

SEQ ID NO: 11473 - RNA, 933 nt, unidentified
  source 1..933: mol_type = other RNA; note = synthetic construct
atgaatcttctccagtacatcgcaaatggattgtttctcacagaggatgagacaaagaggttcataataacagctccccggcgatacaagaaatttacgattgcaaagaggaatggccttgaccgcagattaatcgcgcagcctgcacgacaagtgaagtctatacagagagctgtgttgaaacacattcgtgaaaatatcaaggtacatgagcacgcctttgcctacgaaaaggagagggacatcaagaaaaatgcctcactgcacaaagatcatgattacttgctgaagatggacttcaagaacttcttcctgagcataaagcccgttaacctactcaacgtgatcaagatgcaggggatctcgttagaaaacgacgatgtcttcgtgcttgaaaacctatttttctggaaactgaggcggaattcccctctgcgcctgagtatcggagctccatcttccccattcatttctaacgccgtcatgtttttctttgatacggttatgtcagaaaagtgcaaaaaaatcgaggtcacttatactcgctacgccgatgacctcaccttcagtaccaacaggaaaaatgtactcttcgaagtgcctaggttggttcgggagattctgaatgaaactagcctccgaaacattaaaattaaccatgagaagaccgtgttctccagcaagaaatttaatcggcacgtcaccggtgtgaccctcgccaacaacggagtgctttccctggggcgtgaaagaaaaagactgctgagatcaaaagtggactattaccggaaggggctgctgagccccgaggaaattctgaccttaaagggtgagctgggcaacgctaagtttatcgagccggaatttattgagcgcgtcgagagtaaatatggctctgacgttatccgcgagatccaaaagtataatatttga

SEQ ID NO: 11474 - RNA, 933 nt, unidentified
  source 1..933: mol_type = other RNA; note = synthetic construct
atgtcacttttgaaatatatcgccgacggcctattcttgacagaggaagagacaaagcgcttcataattaccgtacccaggaggtacaagaggttcacaatagccaaaagaaaagggttagagagaaggctgatagcccagcctgctcgccaggtgaaaagtatccagagagcagtgctgaagtacatccgggatgaaattaaggtacacgaatgtgcttttgcatacgagatcgatcgggatataaaaaagaacgcttttttgcacaaggacaatagctatctcctcaagatggacttcaagaatttctttcttagcatcaagccaatcaatctcctgaatgttattaaaaggcatgggatagaactagagggaaacgatatctttgtcctggagaacctgttcttttggaaacttcgcagaaacagtcctctgagactgagcattggggccccctcctcaccattcatttcgaacgcagtcatgttcttttttgacaagatgctttccgagaaatgcgagcaaatgggtgtggtgtatactcgatatgcggatgacctgaccttcagcacgaatcgcaaaaacatcctctttggaatgcctcggctggtccgtgaagttctgaatgagacgaatctccggaacatcaagattaaccatgagaaaaccgtcttctcctctaaacggtttaatcgtcatgtgaccgggttaactctggccaataacggcgtgttgtctcttggccgagaaaggaaacgcctcttgcggtccaaagttgaccactacaaaaagggcttactgtctcccaaggagattctgattctgaagggagaactcggttacgctaagtttatcgagccggtgttcatcgaacgagtcaagcagaagtatggcagagatgtggtgcaccagatccaaaagtacaacatttga

SEQ ID NO: 11475 - RNA, 939 nt, unidentified
  source 1..939: mol_type = other RNA; note = synthetic construct
atgaaactgcttgagattatatccaaaggcctgtatttgacggaagacgaagcaaaacgttacatcgccactatgccaagaagatataagaggtaccatatagcaaagagaaactctgataagaagagactgatcgctcagcctgctcggcaggtcaaaagcattcaacgcagtgtaatttcaatcattcacgacgaaatcttgatacacgagaatgcttacgcctatgcctccggacgggatatcaaaaagaatgctgaaatgcacaggaaaaacaaatacatcctcaaaatggacttcaagaacttttttctgagcataaagccgcacaatctctttcatgtgttcgaacgtcagggaattattctcgatgacgaggacttttttgtttacgggtgtctattcttctggaaacagcgaaggaactctcctctgagactgtcgattggggcccccagcagcccattcattagcaacgccattatgttcttttttgacgatgtgatttccaataagtgcaaagagatggacgtgtcatatacacggtatgccgatgacatgactttcagtaccaacaataagggaatactgttcgatttacccaaactggtccgaaacacactcaacgacgtgggtctgaagaacataaagatcaaccatgagaagacagtcttctcctcaaagaaatttaataggcacgtgaccggcgttactatcaccaatgatgaggcactttctatcggtcgcgaaaagaaaaggttattgcgcaccaagattgattattaccgcaagggcctgctcaatcccggagaggtgatgaagctaaagggcgagcttggctttgcgaaattcatcgaggaagggtttatcgaacggatgattaagaagtacgggatcgaactgatcgagagtatcaaaaagttcgagatcaatgagtga

SEQ ID NO: 11476 - RNA, 936 nt, unidentified
  source 1..936: mol_type = other RNA; note = synthetic construct
atgagtttgctggaaaagatcagtaatggcctaatgctgagcaaggctgatgcaaagaattatatttctactatcccccgccggtataaggtctacaccatcaagaagaggaattccgaagaaaccagactaatcgcccaccctagtaaacaggtgaagtccctgcaacgagcgatgctgacttacttcaaagacaagctgccagtgcattcctctgcctacgcgtacatttcaggcaaatcgattaaagagaatgcagaacgccacgtcaacaatagctatatcttgaagatggacttccggcatttcttcttatcaatcgagcctctgcattttatcaacgtgatttataaccacgggtttgagctcaatgaggaagataaattcgttatctggaacctgttcttctggaaaaggagatctaatagcccactgcggttgagcgtcggtgcaccttcttcccccttcatctctaatgccataatgtacttctttgacgaagccatcagcgagacttgcgccaaaatgaacgtaacatatacccgttatgctgatgatcttacattttccacgaacaacgaagatatactctttaacataccccgcatggttaaaggaattctgaaggccaacggcttaagcaaaattaaaatcaacgaggctaagacagtgtacagcagtaaaaagtttaataggcacgtgaccggggtgacactttctaatgacggctgtatctccctcggtcgagaaaggaagagacttctgtcaagtaagattcatcacttttcccagggcagactcagcgacgtagaggttcttaagctcaaaggggagctgggattcgctaaattcattgagccgttgtttatagagcggatgtcaattaagtacggactcgacattataaaccacatccagaagtttaacccatcatga

SEQ ID NO: 11477 - RNA, 936 nt, unidentified
  source 1..936: mol_type = other RNA; note = synthetic construct
atgaccctcttggagaaaatcgcaaacggtctgatgctgtcaaaggatgacgccaaaaactacgtgtcaacaattccaagacgttacaaggtttacacaataaacaagcgcaacagtgaagaaaaacgattgattgcgcaccccagcaagcaggtgaaggccctccagcgggcattcatgtctggattcaagaaaaatatccctatccattcatctgcctacgcctatgaaaacgagcgggacataaagaagaatgcccttcagcacgtgtccaatcccttccttctgaagatggatttccgacatttttttttgagcattgagcctaggcacctgatcaaagtcatgaatgaccacggctttgagctgaatgacgaagataagttcgtgatttctcatatgttcttctggaagcgccgctccaactcgctgttaaaactgtctatcggagcccccagcagtccttttatctccaatgccgtgatgtatttttttgacgaggctctcagtattgcttgcaaggatatagatgtcgtatatacgagatatgctgacgacctcactttttcaacctgtcaaagcggggttctattcggcgtcccgaaaatggtgaaaaatatcctgaaagctaacggcctgagcaagattaagatcaacgagaagaagacagttttcagcagtaaaaagttcaaccggcacgtcaccggagtgactctcaataatgagggcgcagtctccctaggcagagaaaggaaaaggctcctgtcctctaagatacatcacttttgcaacgaccttttagatgaagacgagactttgaaactgaagggggagcttggttttgcgaagtttattgaaccatccttcgtagagaagatgaaaaacaaatacggggtggatattatcatggcaatccagaaatacaatccaaactga

SEQ ID NO: 11478 - RNA, 930 nt, unidentified
  source 1..930: mol_type = other RNA; note = synthetic construct
atgaaaatcgtaaacttcatctcagacaagtttttcatgccagagcaggaagtacggaactatttgcgcaccgttccaagacggtataaacagtttaccatagacaagaggaatggtgagccccgcttgattgcacagcctgctaagcaggtgaaagcattacaagtgtcagttctgtctgaactcaagcgatacattcccatccatgagtgtgcttacgcttatcaatcaggtcggaatattaaggccaacgccttgcttcatgccaagaacagctatctccttaaaatggactttaagaacttcttcctgagtattaagccagaagtctttctcaatgttctgagtaagcacggaatcgcagtctccgaggacgatgccctgtctattgccaatcttttcttttggaagcttaggagaaattccccgctgagactgagtatcggcgcgccctctagtcctttcatctctaacgcaacaatgtactttttcgacagctatctgtccgctgaatgcaagaaaatagatgtggactattcaaggtacgccgatgatcttactttttccaccaagacgaagggcatactcaaggatattcccttgctggtcaagaaagcgctagagatgaacgatctgaaaaccatcaagatcaacaatagcaaaacagtgttctcctcgaaaaaattcaataggcacgtgacagggattactctgaataacaacggagacattagcctgggccgcaacaaaaaacgttttctctcttcccgaatccactactacagcttaggcctattaaacaatgatgacatactggagctcaaagggctgctgggattcgccaattacatcgaacctatctttctcgagagaatgaaggtgaaatacggcgatgacttgatcgtgagcatacagaagtatattgggtga

SEQ ID NO: 11479 - RNA, 933 nt, unidentified
  source 1..933: mol_type = other RNA; note = synthetic construct
atgaatctgtttgggatcgtgtctaactcactgttcttaagcgatatggaaataaggaattacgtctctacgatccctcgaaggtataagcggtacagcattcctaagcgcaatggaattgagtttcggataatagcccagccagcgaagcaggtgaaggtgcttcaaagaatagtgctgccttttctgcagcagattattcccatccatggcaatgcacacgcctacgagaagaacaagtcaattaagaccaatgcactggtgcactctaaaaacgagtatctccttaagatggactttaagaacttcttcctctcgatcaaaccgaacgacttcattgacatcatgaaaaagcacgagattaagattaccgacgacgataagttcattatcgaaaacctgttcttctggaaactaaccagacggtccccactccgtttgtcaataggggctcccagttctccctttatctccaatgccgtaatgtatttctttgacgagatcattagccacgagtgcgaggccctggatgttaaatacacaagatatgctgatgacctgacattctccaccaatgtcaaagacattttgttcctcgtgccaaaaattgtcaaaggcgttctcaaatcctccggcttgaagaatatcaagatcaacacgaacaagaccgttttcagtagcaagaaatttaatcgacatgtcactggaatcactctgactaacgatggtgaagtgtcattgggccgtgagaggaaaagggtaataagcgtgcggatccattactttacactcgggcttctaagtacagatgacatcctgaaactgaagggcgatttagggttcgctaagtttatcgaacccgaatttatctatagaatggaacgcaaatacggactggagaacatcgaaaaacttcgcaagtttatgggttga

SEQ ID NO: 11480 - RNA, 933 nt, unidentified
  source 1..933: mol_type = other RNA; note = synthetic construct
atgaccatcgtggagtacatttcccagggactgtttatctccgagtcagagtttgtgtcctataccaatactatgcccagacgttacaaacagttctatatcaagaagcgaaatggagaggatcgactcatcgctcagcccgcaaagacagtgaaaaacttgcaacttacagtggtggggctgctgagggacgaactcaggatacacccagctgccatggcttacgttaagggaaggtctattaaagacaatgcccaaaaacacgtacacaatcagttcctcttaaagatggacttcaaaaacttcttcctgagcatcaagcctgcaatgtttttaatgtgcctcaaaaaacagggcgtgaaccttgatgagagagacgaacacgtgatttcaaacatctttttctggaagcttcggcggaattccacactgcgcttgagcataggcgccccctctagccctttcgttagcaatgtagtgatgtactactttgacgaggccgttgagtctctatgtagaatgctgggagtcgtttacacccggtatgcagatgacctgacgttttcaactaacaagaagaatgtgctattcgaactgcctagtgtcgtgaagaacgtcctgaacgatgtggggttaaaggctattaaggtcaacaaggataaaactgtgttttcgagcaagaagtttaatcgtcatgtcacgggtgttacactgaacaactctggcgagctttccctcgggagggaaagaaaacggaccatcagtgccatgattcaccatcataagttgggtttgctgaataacgaagatgtaactaagctcaaaggctatctggggtttgcgaaatatgtcgaaccactcttcctgacccgcatggaacgcaaatacggtgagcagctgattagtcaaatccagaaattcataccgggctga

SEQ ID NO: 11481 - RNA, 930 nt, unidentified
  source 1..930: mol_type = other RNA; note = synthetic construct
atggatattgttgaatttctggctcaggctgtgtttctatctgagaaggagtttgtgtcctatgtgaataccatgcccagaagatacaagcagttttacatcaagaagaggaacggagacgacaggctgattgcccagccggcgcgtaccgtgaaaacactgcaactgaccgtcgtaggtatgttgcagcatgaccttaaaatacatgacgccagcatggcctacgtgaaaggcaaaagcatcaaggacaacgccctccagcatgtgaataaccaatacctactgaagatggacttcaagaacttctttctgtcgattaaaccagagatgttccttacctgtgtaagaaaacagggtctgaaactgtccgaacgcgattcactcattctggcaaatctctttttctggaagctgcgccggaattcttcattgagactttccatcggcgcccccagtagccctttcgtcagtaacgttactatgtattacttcgatgagatggtcagtgatatttgcaatgagtacggaatcacctatactaggtacgcagatgacttaacatttagcacgaataagaaagggattctgttctcactccccccactcatcaaagattcattaaagcaaactgggttgaacgacataaagataaacaacaagaagacggtcttttcttccaagaaattcaaccgacacattacaggcgttacactttctaacgatgacaaaatcagcctgggccgagagaggaaacgcatgatctccgctatggtccaccacttcaagaatgaagtgttagaagtggatgaaatctataaactcaagggatatttgggcttcgcaaattacatcgagcctatgtttatcgctcggctgaaacggaagtatggggagaatgtgattatgcagatccagaagttcatagtttga

SEQ ID NO: 11482 - RNA, 930 nt, unidentified
  source 1..930: mol_type = other RNA; note = synthetic construct
atggacattgtggagtaccttgcgcagggggtgtttctgagcgagaaagactttctgagctatgttaatacaatgcccagaagatataagcagttcactgttaaaaagcgtaatggagaggacaggttaattgctcaacccgcccggacagtaaagacgctccagatggtagtcgtgagcttactgaagaatcacctaaacatccatgaagcagccatggcatacgtgaagggcaaaagtataaaggacaatgcaaacgcgcacgtgcagaacaaattcatcctgaaaatggatttcaggaacttctttctctccataaaacctgatatattcttggcctgtatcgaaaagcaggggctgattctttctgatcaggacaaaatggtcttgtcaaacctgttcttctggaagcttagacgaaactccagcttgcgcctttcaatcggcgctccatcttcgccgtttgtgtccaatgtgaccatgttctttttcgacgaactgatttccaagatatgcaaggataaagggattgtttacacacgctacgccgacgatctctcattcagtactaaccaaaaagacatcctcttctccatcccagctctagtgaaagaatctctgaaagtcgttggcctgaagaacatcaaagtcaataatgccaagaccgtcttctcaagtaaaaagtttaaccggcacgtgactggtatcaccttgtccaatgagggcgtagtgagtctgggacgcgaaaggaagcgatctatcagcgctatggtgcatcattttaccttagggctcctggataaggagtctatttacaaactgaaaggctatctcggttttgccaagtacattgagcctagctttgtgctgcggctcaagatcaagtatggagacgaggtcgttctgaagattcagaagtttaacgattga

SEQ ID NO: 11483 - RNA, 948 nt, unidentified
  source 1..948: mol_type = other RNA; note = synthetic construct
atgaatatcctgaatcagcttagcaacaccctcttcatggataaggattctctgaagtcatttatttccactgccccacgacggtacaaaaagtacactatccctaagaggaacggcgatggggtaaggatcatcgctcagcccagcaaacagatcaagtcactgcaaaggtatgccgctaatctgcttagtaaacacctacgggtccactacgctgcacatgcttacgtgagaggcaaaggtattaaaaccaacgcagccgcccatcgcaactccaactatatcctgaagatagacttcaaggatttcttccattctattacccccgacattttcctgaagaccctggaaaccaacaacaacatcattgagaacgaggacaaatttattatctcgcacctgttcttttggaagcttcgggggaattccccgttgcgattgtcaattggagcccccactagcccaataatcagcaatgccataatgtattgcttcgacgaggagctcacaaactattgcacagagattaatgtgacatacactagatacgcagacgatttgacattctcttcctttcactccctgagcctagcgacaattcagtccaccgtgcagaggttactgataaagcactataagagaaagatcaagatcaaccgtgaaaaaaccatctattgcaataaggcaatgaatcgcaatattacgggagttatcctgaacaatgaaaatgaactttcactcgggagaaaaaaaaaacgcatgataagtagtctcgtccacaaatttagttacagcctgctcaaccaaaaggagattaactacctcaatggaattttaggtcatgcttctcacattgagcctcagtttatcgagcggttgaaagaaaagtatggccatgacgtgatcgcgaaaatcaagaagtctataacttacgcccacatcacgtga

SEQ ID NO: 11484 - RNA, 948 nt, unidentified
  source 1..948: mol_type = other RNA; note = synthetic construct
atgtcaattctgaaccagttatccgccacactgtttatggataaagatagcctcaagagtttcatcagtaccgcccctagacgctataaaaagtacactattccaaagaggtctggcgacggggtaagaattatcgcgcagccgagcaaacaaataaaatccctgcagcgcttcaccgccaacctcttaagcgagcatctgaaggtgcattatgccgcccatgcatatgtccctgggaagggtattaagactaatgctgcggctcacaaaaatagccagttcatccttaagatcgatttcaaggactttttccactccataacacccgatctctttattaaaactctggaagcaaatgaagctaatatatcagaggaagaccggtttatcatcgcacacctcctcttttggaagttacgtggcaacagtccccttcggctatctataggggcaccaacatcgcccctaatcagcaacgctattatgtactgcttcgatgaagagttgaccaactattgcactgatttgaatgtgacatacacgaggtatgctgacgacctgaccttttcctccttccatggcctttctctggccaccatccaaagaacagtgcagaccctgctgataaagcactacaatcgaaagatccggatcaacagggacaaaacaattttttgtaacaaggccatgaacaggactattaccggcgtggtgttgaataattctaatgaactctcactgggacgaaaaaaaaagcgcatgatcagttctctggtccacaaatttagctattccctcctgaaccaaaaagagattaactacttgaacggaattcttggtcacgccttccatatcgagcctcagttcatcgagagactgcaggttaaatacggacacgatgttatcgacaagatcaagcagtcaattacgtacgacgacattacctga

SEQ ID NO: 11485 - RNA, 948 nt, unidentified
  source 1..948: mol_type = other RNA; note = synthetic construct
atgtccttacttgagcagttctccagcgccctgtttatggaccgggcaagtcttaaatcgtttatttatactgccccaagacggtacaaacgctacgcaattcctaagaaaaacggaaacgggttccgaacgattgctcagccttctaagcagatcaagagcctgcagcggttcggcatcagcctgctcgcgatctttctgaaaacccattactctgcacacgcctatgtggaaggcaagggcatcaaaactaacgcagccgcccaccagggttcggaccatcttctgaagatggatttcaaggacttctttcactccattacccccgacattttgatgaatacactggacaaaaatggcggcaaggaaattttggatgaagaagatcgtcacattatctcccacctgtttttttggaaattgagaggtaattctcctctgcgcctaagcatcggggctccgacctctcccataatctcaaacgctatcatgtacgattttgacgaagagatcgccgattattgtgcggagctgaacgtcaaatacacacgctatgccgatgacctcacattctcctctaaggacagggagtcactgaccacgatccccaacgaagtcaatattgtgctcaggaagaatttcggaagcaaaattcggatcaataaagagaagactctgcactgcaataagtctatgaacaggtcagttaccgggattgtgttaaataatacaaacgacagtctcagcttagggagaaagaagaagaggatgatctccagtttcgtacataagttctcatttagcttgctcgatcaaaacgaaattaactatctgaacggaatcctaggacatgctgcccatatcgagccacaattcatagagcgacttaaagagaaatacggtcaggatgtgatagcaaagataaaggctagtatagagtacctctga

SEQ ID NO: 11486 - RNA, 945 nt, unidentified
  source 1..945: mol_type = other RNA; note = synthetic construct
atgtccttgctagatcacctgagtgaggtctttttcatggataaggccagcctgaaatcttttatttttagtgcgcccaggcgctacaaaaaatatcccatccctaaacggaatggcgaaggagatcgtatcatcgctcagccgagtaaacaaatcaaaagcttacagcgtttcaccattaaccttctcatagactatttaaaggtccaccacgcagcccatgcctatgtgtccggtaagtcaattaagaccaacgcggccgctcacagaaagaactcgtacatcctcaagatggacttcaaggactttttccattcaatcactccagatctgtttctgaaggtactgagcgatcgagataatgacggaaaacttacagaagaggacagcttcctcatatccaatctcttcttctggaaattgaggggtaactctcccctgcgactgtccattggggctcccacgagtccaattatcagcaacactatcatgtacgactttgacgaagagctaaccaattattgccttgagctcaacatcgtgtacacaagatatgccgatgatctgacattttcgtcatctgacagggaatctcttagcatcattcctatagcagttcggagggtgctgatcaagaacttcaaccgcaaaatcagaatcaattccggcaaaaccatcttttgctcaaaggcaatgagccggaacattacaggcgtggtcattaacaataattgtgagctgtcactggggcggaaaaagaagagaatgatttcttccctggttcacaaattctcctattccttgttaacccaggacgagatgaattacctgaatggaattttgtctcacgcccattacatcgagcctgcttttatagaacgcctcaagagtaagtacgggtctgatgtgattgacaagataaagcatagcattactttcccatga

SEQ ID NO: 11487 - RNA, 942 nt, unidentified
  source 1..942: mol_type = other RNA; note = synthetic construct
atgacgaatctgtttgaaacccttcaggaacagctaagtctctccgatgacgaattgctgtcttacctacatacagtccctttgcgttacaagagatattacatcgataagcgaaattctactgaaaagcgcttaattgcgcagcccagccgaacagtgaagatactgcaaaagtacgttgcttctgagctcgaggaagttattcctgttcatcagagtgctatggcttactgtaagggacgggggataaaggaaaatgcaaagaagcacgcacacagtcgctatctcctgaaaatggatttaaagcggttcttcgatagcatcacaccgaccattctgtcagacgtgattatgaaacacggaatcgaattgtcagagaaagactatatcctggtatcgcagctttttttttggaaactccggcgtaatagccccctgaggctgagtataggagccccaagctcacctttcgtcagcaacgccattatgtatttctttgatgaggagatctctaaacactgcgaagaattgaacatcgtgtatactaggtacgcagatgacatgacctttagcaccaataaaaaaaacgtgctgttcgagctcgagaggacagtagttaaactgcttagacttaacttcggcaaggacataaaggtgaacaaagagaagactgtccattcctcaaaagcccacaacagacatgtgactggggtgaccttatccaacacaggcaagctctctattggcagggagaacaaacgcaatatcagggtgtccatccatcggttcattaatggtaagaccaatgatagagacgtgcaaaacctcaaaggtaacctggggtttgccaaacacattgagccagagttcgtcaagtccctggaggaccgctacggcgtcgagacgatcaagaagatccagacttttgacatcctgccctga

SEQ ID NO: 11488 - RNA, 933 nt, unidentified
  source 1..933: mol_type = other RNA; note = synthetic construct
atgttccagctgttcgacactttccgagaacagctggccctcagcaacgacgagctatcaagttaccttcacaccattcctttcagatacaagagattctacatcgacaagaggaactctgatgagaaaagactgatcgcacagccagccaaagctgtaaaaactttgcagcggtatgccatttccgaaatagaagacgagctgccgatccacagttctgccatggcgtattgcaaaggacgtggaataaaggagaatgcactagtgcacgctaaatcccgctatctcttaaaactcgacctgaagaacttctttgagtctatctccccagagattctgttatccgttattagcaaacatagcattgaactttgtgacaacgataagttcctgatctcaaacctctttttttggaagctgcgcagaaatagtcatctgaagttgtctgtgggtgcaccttcttccccctttatctccaacgtgataatgtacttctttgataaggaccttgcggaaaaatgcaacgaaatgaatgtgagctacacaagatatgcagatgatatgacattcagcacgcaagatagcaatatactctacaagattgagactatcgtgaggaagcttctcaagtttcatttcgacaataaactcaccatcaacaggtcaaaaaccgttcacagttcaaaggctcataaccggcacgtcacaggagtcaccttggataatcacggccgtatctcgttgggcagggataacaaacgcagccttcgggccggcgtgtataattttacccaagggcggctgaataaggatgaggctatgaaactgcgcggtaagctggggttcgccaagtacattgaacccaaatttatcttacgactggagaagacatttgggaaggacgtcattgacgagctgaagaaatataattga

SEQ ID NO: 11489 - RNA, 945 nt, unidentified
  source 1..945: mol_type = other RNA; note = synthetic construct
atgactaatatcttcaggggactctgtgagcaactgcttatgtccgagaatgagctgaagagttatatcagctccgttccctttaggtataaacggtattacatacctaagcggaattcaaatgaactgcgtttaattgcccatcccgccaaagtggtcaagtctttgcagcgacatgcagtgagcaagctggagccgctcttaccaatccacaagtgtgccatggcctactgcaaaggcaaagggattaaagaaaatgcgtaccagcacaaaaacaacaggtttctgcttaaaatggacctgagagatttttttggttccatcaacccatctatttttctaggagtgctcaaaaagcacgatttaaccctctctaaggaagatgtattcctattgtctaacctcttcttctggaaattgagaagaaactccccccttcgccttagtgtgggcgcaccttcaagtccttttgtaagcaatgccattatgtacttctttgacaaggagctgcacgagtactgcaacgataatgatatagtgtatacacgatacgctgacgacatgacgttttcaacatcgaagaaggacattctgtttgctctggagaagaccgtgaaagctttcctgaagaagaacttcgggtccttccttcgggttaaccataataaaactttccattccagcactgcccacaatcgccatgtcacagggattaccataaccaacaataaaaagatcagcgttggcagaaatcggaagaggaaaattcgcgcttgcgtgcactcattcaagaatggcttgctgagcaacaacgatgcactcaaactgaagggcgagctcggattcatcaagcacatagaaccagactttatcatcaacctgactaacaagtatggtctggacacgatcaaaaagatccagaccttcgaaagtgtcgacacatga

SEQ ID NO: 11490 - RNA, 945 nt, unidentified
  source 1..945: mol_type = other RNA; note = synthetic construct
atgaacattatcgaaagaatctctgaagacttgttgatgccggaaaaagagcttctaaattttagctcgactgctccccgcagatataagaaatatacaatcgccaagcgcaacagcgacgaaaggcgactgatcgctcatccttcaaaggaagtgaaattcctgcagagactccttgtgacacacctggaggacaagctcaccatacatgcaagtgccaatgcttacgtgaaacagaaaggtatcaagtccaacgcattagcgcacaaggacaaccagtacctcctcaaaatggacttcaagaacttctttctctcaatcactcccagtatattgatcgagcaaatgctggcctttgggatcggcctggatgataggaatatcgagtttatcagcgggatcctattctggaaactgcgtagaaatagcccactgcggttatctattggcgccccatcatccccctttatttccaacgtcattatgtacaacttcgaccggctgattgaaaaggagtgcaaagtcatgggcattacttatacccggtacgctgatgatctggccttctcaactaacatcaaggacatactgtttgagattccaaagctggtaaagaatacgctgaagaagctgtacggatctaagattagggttaacacaaagaaaacggtgttctcctccaaaaagtttaacaggcatataacagggattacccttaccaataataacctgcttagtataggacgcaagaaaaaacggttcatcagcagcctggtgcacaagtatacactcgaactcctgtctgatgaggagatccttcagttgaaaggcctattaagccacgtttccaatattgagcctttgttcattggtcgactgagtaataaatacggcaccaacatcatgaccgatctcgcaccttctaagttctttattggaaattga

SEQ ID NO: 11491 - RNA, 945 nt, unidentified
  source 1..945: mol_type = other RNA; note = synthetic construct
atgaacattatcgaaagcatttctgaggccctgttgatgcctgagaaagaactgctatcattttcctccacggctccaagacggtacaaaaagtacaccattgctaagcgcaactcagatgagcgcagactgatcgcacacccgtcaaaggaagtcaagtttttgcagaggctcctggttacccatatggaagacaaactgcctatccatgactccgccagtgcatacgtgaagcaaaaggatataaaatcgaacgcattctgccataagaacaaccagtatcttctgaagatggacttcaagaacttctttctatctatcactcccgacattctgttagagcagatgctgtccttcgggatcaagcttgatagcaataacatggattttatcagcggaatgttattctggaaattaaggcggaattcaccactgcggctatctattggagcgccaagttctccctttataagcaatgtggtgatgtacaacttcgactgcatcatcgagaaagaatgtaaacacatggggattacatatacacgctatgccgatgacctgacgtttagtaccaacagcaagaacattttgttcgagatgcccaagctggtcaaaaagactctgaaggagctttatggaactagaatccgagtgaatagcgataagacagtgtttagctccaaaaaattcaataggcacatcactggcgtcacccttacaaataataatctgctcagcgtgggcagggccaagaaacgttacattagttccctcatacacaagtataccctctcactcctgtccgaggaagagatcctccagctgaaggggctcctctcccacgcctctaatattgaacctttgttgatcggtcgactgtctaaaaaatacggtgtagacgttatggctaaccttgctcccaaaaagttctttataggcaattga

SEQ ID NO: 11492 - RNA, 936 nt, unidentified
  source 1..936: mol_type = other RNA; note = synthetic construct
atgagcttgattagcgaaatctctgatgatgtgctgatgaccaaagatgaactgctgtcattctctttcactgctccgaggaggtacaagaagtaccatattcttaagcgaaatggaaatgggttaagactgatcgcgcaccccagcaaggaggtaaagttttttcagcgcctcgcaatttctaagctggagatccttttgccaattcatgactgtgccatcgcctacgttaagggcaagagtatacgggataatgcagaggcacacagacggaatcgctatatgctcaaaatggatttcaagaacttcttcatgagcatcacacccgaccttttcattagttctctggaaaggaacgatataaatctcgaagcccaagacatcaaatttctggagggtgtgctgttctggaagctgagacggaattcccccctacgactcagcgtcggggctccttcctcgccttttatttcaaacttcgtgatgacggccttcgacatttttatgtttggctactgcaaggacaaagggatcacatatacgaggtacgccgacgacctgaccttctcaactcgtgagaaagatctcctctttacaatccctaaagtcgtgcgcgatgccctgaaagaatactgcaacagtaagatccgtataaacagcaaaaaaaccgtgtttaccagtaagaaattcaatcggcatgtgacaggtgtcaccattactaacgacgagaagctttccctaggaagagagagaaagcggttaatctccgctatggttcaccactttgtagacgataaatattcattgagccacgaagaaatccagaagctgaaaggctatctgtcttttgctaaatccatagagccagacttcataaacaggttgtccaagaaatatggacgcgagtacatcttaaagattcagtcgtttaactga

SEQ ID NO: 11493 - RNA, 936 nt, unidentified
  source 1..936: mol_type = other RNA; note = synthetic construct
atgagcattctgagtgacatatctaaagacgtgctgatgacagaatctgagatccttaacttcagttccactgcccccagaaggtataaaaggtattacattctcaagcgcaatggtaaagatcttcgcctcattgcccacccctctaaggaagtcaagtttttccagcgtctggtaatttccaaactcgacgggaaactgcctattcatcattgcgctatggcttacgtgaagggcaaaagcattaaagacaatgcagacgcccataagaaaaacaagtacctgctgaagatggatttcaagaactttttcatgtccgtgactcctgagctgttcataagtagccttaagaagaacaacattatcctggacaccaacgacttaatctttttggaaggcatcctattctggaaactcagacgaaatagtccattacggctatcagtcggagcaccctcgtcaccgttcatctccaattttattatgaagagcttcgatgactacatcttcaatacatgtaaggagatgaatgttacctatacccggtatgctgacgatatcaccttctcgactaacattaagactctgttgtttacgtttcctgtgattatcaagaacgcgttaaaagaacactgcgataagaagatacgaatcaattcagagaagacgatttttacctcaaaaaagttcaacaggcacattacaggtatcaccatcaacaataataacaacctttccctcggcagaaataaaaagcggctcatatctagcatggttcaccattttatcagcaaagatcacagcttgacagccgatgaaattttgaaactgaaggggcatctgtcctttgcacactttatagagccagatttcatccaacgcctgtctgacaagtacggaaatgaggagatcatcaacatcatcaaacacatatga

SEQ ID NO: 11494 - RNA, 924 nt, unidentified
  source 1..924: mol_type = other RNA; note = synthetic construct
atgagaatctccaagaagttagccgacgaactactcttagatgaggccgagctgaggaagttttgtgccacagcgccatatcgatataagaaatacgagatacccaagcggaattccgataagaccaggctgatcgcccagcctagtaaagaagtcaaattcatgcaacggctggtggtgaagtacctgagagacatcctccctgtgtccagacacgccatggcatacgagagtggaacttcgatagtcaagaatgcttctattcacaagaacaacccatatctgctcaagatggatttcaagaacttcttcttgtccatcacaccctccctgttctttgggctgatgtcagatggcggggtcgaattttctgacgacgacaaaatcctgttgagcaacttactcttttggaaattgcgcagaaatagtcccctccggctgtctgtaggtgccccttctagcccattcatcagcaacgtcgtgatgtatcattttgattgccttatggaatcacagtgcgctgcaatgcgtattcgctacagccgatatgccgacgacatgactttctccacccgcgagagggatgctctatcagagatgcccggttttgtgaggtctgtgcttaaacgggactatgacggcaaaattaaggtgaactccgaaaaaactatctttctgagtaaggcaaagcgaaggacggtcacagggataaccattacaaatgatgataccttgagtgtaggacgtgaccgcaaacggaacatttctgctatggttcatcacttcagccttggaaagctgagcgctgaagaggtgcagaagctcaaaggctacctttcatttgttgccgcagttgagccgaatttcatctacagaatgatgagcaaatacggcaataaagtgattgaggcgctgttcatttga

SEQ ID NO: 11495 - RNA, 954 nt, unidentified
  source 1..954: mol_type = other RNA; note = synthetic construct
atgagcattttttcaacactggccgacaagttgctgatgtccgaggaggaactgttacggtttgcactcacaatgccccgcaggtataagaagtacgaaatcctcaaaaggaatggcattgacactcggcagattgctcaaccctctcgcgaatcaaagttcattcagcgtatgataatcgacgagctgagaggggtactgagggtgcataaagctgcaacagcctatgagaaagagacagggatccggttaaatgctctgaggcatctgaatagcaggtacctactgaagatggatttcaagaacttctttcctagcatcacacccgaactgttttttgcggtcgccgagtccagtggagtggactttgagcaagccgataaagttttcctggaacacgctttgttcttccgcgccacccgcagatcacggcttagaatgagtatcggcgccccaagctcccctttcatatccaactttgtgatgaataccttcgatcacgctatgatgaagttctgtgtggaaagaaacatcagctatactcgttacgcagatgacttgaccttcactaccaacgaaaaaaatatcctgttcgatctcccaaagatggtggcaactctgctagcggaatattgcttcaagaagatccggattaacagttcaaagacggttttttcgtctaaacggtttaatcgacatgtgacgggtattgtacttaccaacaataacgagctgtctatcggacgagcccgaaagcgcgagatagcctctcttattaactcctttagatacggcgcactcagcgaggatgcaactttgaaactcaaaggtcttatggctcacgcttaccacatcgaaccggactttatcgcgagaatgaaactcaagtacagttatgaggtcgtcaatgccatactgaggtaccctctcgccattcagaccttagagcagtga

SEQ ID NO: 11496 - RNA, 942 nt, unidentified
  source 1..942: mol_type = other RNA; note = synthetic construct
atgtcacttgcaagtatcctcgcaaataaactggtcatgtcaaacgcagatttatttggcttcgtactgacaatgccccgcagatataagcagtacaagatcttcaaaaggaatggaattgaaaccaggcatatagcccaaccttctaaggaggccaagtttatccagcgcatcatagtggaggaacttagaaaactcctgccacccatccacaaagctgctacagcttatgagcctggcactggcattaaagccaacgccctgcggcacttgaactcccggtatctgctcaagatggactttaagaatttcttcccaagcattacaccggagttcctcttcctcgccgcggagagctccggtatcaagttcgacgaactagacaaaattctgctcgaaaatgccctgttctacaagagcactagacgtgcccggctgagaatgtctataggcgctcctagtagcccatttatctctaactttgtcatgtcaggctttgataatgatatgttcgattactgcgcaaagcgaaatatctcctatactcgctatgcagatgacctgacctttacgaccaacgagaaagatgtcctttttgagatccccaagattgtggagtctaccttgattaatgcctgttttaggaagatcagaattaacagcaagaagaccatttttagttcgaagaagtacaatcggcatgttactggagttgtgttgacatccgacgggcagttatccgtagggcgcgcgaggaaacgagaagtgtctagtctgataaactccttcaagtacgggaagctagacgaaaaagaacgtcttcatctgaaaggtttgatcgctcacgttcaccacattgagcctgacttcatcttcaaaatgaggaagaaatactcagacgaggtggtgaacagcctgatgaaaccacccacggccggatga

SEQ ID NO: 11497 - RNA, 948 nt, unidentified
  source 1..948: mol_type = other RNA; note = synthetic construct
atgaatctcatttcaaaactgacagaaaagctgatgatgacagaggaagaacttttgcgcttcgcattaacgatgccacggagatacaagcagtattttattccgaagagaaacagtaatgagcggcggctgatagcccaaccctcccaggaggccaagttcatacagaggataattattgccgagctgcgagagctgcttacggtccataaagcagcgacagcttatgaaaaggggactggaatcaggctcaatgctatccaccatgtgggcaacagatacctgctcaagatggacttcaaaaatttcttcccctcaatcaccccagagctactgtttatgattctgcgagactgcggcatcaaatatgatgaccgcgatagaaccatcttagagcacgccctatttttcaaaagtacacgacggagccgtctgagactctctgtgggggctccttcctctccctttatttccaacttcatcatgaacatcttcgatgagaacctcgcagcttactgcctgcagcagggtattacctacactcggtatgcagacgacttgactttcacctgtaacaaaaagggaattctcttcaatgtccctgatgtggtgaagcagttttcaaaggaacattgtcacggcaaaatcaggatcaattcttccaagactgtgtttagcagcaaggcctttaataggcatgttaccggaatcgttttgacaaacgacaatcaactgagtatcggccgcgctcgtaaacgcgagatcgcttctcttgtcaactcatttaagtatgggcacttggatctggatgaaagcagcaggcttaaaggtttactcgcctacgcgaaccacattgaacctgactttatcgcccgcatgaagaccaagtactccgcagacgtaattgatgccatattccacctggattcgactcagaaagaccattga

SEQ ID NO: 11498 - RNA, 936 nt, unidentified
  source 1..936: mol_type = other RNA; note = synthetic construct
atgaattttcttcagcatatgtgcgacaagctgttcatgtctcaggatgaactgattaacttcgcacgcaccatgccctacaggtacaaaaaataccgagtggggaaaagaaacgggtctgggtataggatcattgcccaaccaagttcagaagccaaatttatccagcgtatcctgctgaaggaattgcgcagattgctcccagtgcacgagtgtgctatggcctacgagcctggagtaggcatccgcaagaatgcaatgaggcatctgcactctgattacttattgaagatggactttaaggacttctttccttccataacacctgacctattcttcttctttactaagaagatcggactggaactgggagagaaggataaggagcttctcgagaatgtgatcttctggaaatcaacacggtcctcatatcttaagctatccattggcgcgccgacaagcccctttatttctaatttcgttatgcacgagttcgacaaaagtatgaaccagttttgtatctccaaagccataacatatacgcggtatgccgatgacctgacctttactagcaacgctaagaatatactctttgagattcccagtctggtgtctggacacctcaagaaggattgcctcggtcttatcaaggtcaacaccaaaaaaactgtgttttcgagcaaagctttcaacaggcatgttaccggcattgtcctcgcaaatgacaatagcctgtcgctgggccgggaacaaaaaagaacgctttcctcaattatccatagatttagcttaggcaagctgtccgaaaaggaaaccagtcgattgaaaggtcacctgagcttcgctcatcacatagagccaaagttcatcgatcggatgaagaaaaaatacgggaacgacttaatcgatctgattttcctccacagctgcgagtga

SEQ ID NO: 11499 - RNA, 927 nt, unidentified
  source 1..927: mol_type = other RNA; note = synthetic construct
atgatgagtatcttatccttcgtgtcagatgccctgatgatcgacaaggtagagatgatgatgtttgcccaaacagctccacatcgatataagaagtacttcatcaacaagcgcaatggcgccggggttaggttgatagctcaaccaagcaaggagacaaaattcatccagagggtggtcctgtctaaactgcgtgagatcctgcccgtccacagatgtgcgatggcttatgagaaatctgttggtattaagctgaacgctatgcaccacaaagacggccgctacctccttaagatggatttccgggacttctttccttcaattatgcctaacatgttcttggccctagccaaagattgcggcgtggaattctctgacgaggacaaagagtttctctcaagaattctgttcttccgtagcacccgaaagtcacttctaaggctctccattggggcaccgacttcccccttcatctccaacttcattatgtacaagtttgacgttgcaatggcagaatattgccaggagaacggcatcaactatactagatacgcagacgatgtgacgttttcttccaatgtgaaaggaatcctgtttgatgtgccagatatagtcaaaaagaatctgcggcagtattgctgtggacagatcaaaataaatccccttaagaccatcttctccagcaaagcttttaatcgccatgtaaccgggatcgtgattaataacgacagctctctcagtcttggccgggaaaagaaaaggatctacagcagtatgattcataagttttcgctgggtttaatggacgaaaaggagcgcgaaagactcaaaggatttctggcgtacgccatctatattgagcctgattttatagaacggatgaagaagaagtacagtagcgatctgattgccgccattatgttgtga

SEQ ID NO: 11500 - RNA, 945 nt, unidentified
  source 1..945: mol_type = other RNA; note = synthetic construct
atgtcaattactacagccctttgtgaaaagatgcttacaggaaaaagcgagctgctgtcattttcccacacggtacccaggcgctacaagacctactacatcaaaaagagaaactcaaccgagatgagattgatagcacacccagccaagacagttaaattcatccaacgactggccgtggaggaactgaggaattatttccctatccaccattgtgccaccgcctatgaaaagggcactggcattaagatgaatgcattccaacatcggaggaatcagtacctcctgaagatggacttcaaaaacttttttctgtcgatcacgccggagctcttctttcgagtgagtgaggacctgggggtggtgttcgatagcgaagataaggcactgctggagggacttctgttttggcggctcaggcgcaattctccattgcggctaagcatcggtgctccttcctcccccttcgtgtcaaacctggtgatgtacaagttcgatgctgcactatgcgagatttgcgagtctatgggcgtagtgtatacacgttatgcagacgatttgacattcaccaccaatagaaaagacgtgctcttcgctatacccgacatcgtgagacagaacttaaaggcgcagtgctactctaagatccgtatcaactctgagaaaactgtcttttccagtaaggcttttaatcgccacattactggagtcaccattaccaacgaagggcggctgagtgttggtagggaaagaaaacgcctcgtcagcgcgctcattcataaatttactttaggcgccctgagcgatcagcagatcgaaaatcttaagggccagttggcccacgtcaaaaacatagagcctgacttcgtcgttcggatgaaaaaaaagtattccgatgaagccattgctaaaatctttgcctggaagcgagaggggtttttatga

SEQ ID NO: 11501 - RNA, 939 nt, unidentified
  source 1..939: mol_type = other RNA; note = synthetic construct
atgaactttctctcgaagctaaatgatgccctgatgattggggagaaggccctgctttcatttatcctaaccagccctcaccggtataagaaatacgagataaataagcggaacggaaaagggaaacggctcatcgcccatccaagcaaacagctgaaatacatccaaagactgctcgtgaaagaactggaggagcagcttcccgttcatgaaagtgccatggcttataagaaaggggttggcattaagaacaatgccttagcgcacaaggacagcaaatacctcctgaagatggacttcaaagatttcttctattctatcaccccggaaatgtttttcaaggccaccgcaagtaagggcctgcactactctgaatcagacaagctggtgctgagtcatctgctgttctttcgacttaatcgaaactcccctctgactttatcaattggtgcaccctccagcccactcattagtaacttctctatgaacctctttgatgaggctatctccaattactgcgccgagcttgaagtgacttacacgcgttacgctgatgacatcgtgttttccacaaactcgaagaatgcactattttccatacctagcaaagtggagaaaactctgaagtccgaatgtttcggatgtgtcaaggtcaatacaggcaaaaccgtattctcatctaaagcgcacaatcgccacgtcacaggtatcacaatttccaacgagggaaaactctctttgggacgcgataggaagaggaagatatcctctttggtgcataagttcggtctgggcctgcttaacgtaagggagattaatgaactgagaggcttactcgcttttgcatcagacatcgagcccctgttcttggctcgcttgagagggaagtatggcagcaaatgcttgagtagcattagcaactataagcaggaagagtga

SEQ ID NO: 11502 - RNA, 927 nt, unidentified
  source 1..927: mol_type = other RNA; note = synthetic construct
atggatatcatgctacttctaaaaaccatgcttgtcattagtgagagtgagatcctgaaattttcagccacagctccacaccgctacaagaaatatagaattcccaaacgaaacggaaacggcaagcggcgcatagcccatccctccaaagagctgaagttcatacagcgactcattgtgaataagctggagagcatcctccctgtacatgactccgcaaaggcatataaaaagggcgttagcatcaaagacaacgccctggcccataagaataccaggtatatgctgaagatggattgtaaagacttcttccctagtattgaaccacagctgttttttaaagtggcatcctcgtgcgggattaatttctctaacttggacaaggaactcttatcaaaccttctcttttataagctcacgcggagatctcgtctgaagctgagtatcggcgcgccttcttcacccttggtaagtaactttgtcatgtacttcttcgacgctgctatctacgaatattgttccgagttaggagttaattacacaagatacgccgatgacttgacatttagcactaatcggaaagaagtgttatttgaattcccaaaggtgatttccgagcaacttaagaagcattgcaatgggtcaattaaagtgaacagcatcaagaccgtcttcagctctaagggtcacaataggcacgttaccgggatcactatcacaaacgatagcaagctgtccctcggtcggtccaagaaaaggaccatctcgagcctgatccacaaatacagcctgggaattttgactgatgagcagaaggattgcctgcgcgggcacatttcttttgctaaattcgtggagccggccttcttcataaggatggagaaaaagtacggcaaggaagtgatacagtcaatcttttctgactga

SEQ ID NO: 11503 - RNA, 942 nt, unidentified
  source 1..942: mol_type = other RNA; note = synthetic construct
atgaatctaagtgaaattctggctagctccctcttcatggatgacgaggagattcgctcattcgcagcatcatccccctatcgctacaaggtgtacactattgctaaaagaaattcgcaggaacgaagggtcatcgcacacccttctaaggagctgaagtttattcaaagattgatagtcagcctgctggagaaacggctcccgatccattatactgcaaaagcctacacaaagggactgtcaatcaaagataatgctcagccccatatgaaaagcaaatatcttctcaagatggaccttaaggatttcttccctagcatcaaaccctcactcttctttagggagtgcagggtgcatggggtcgaactttccgagctggacgtcgagctgctggagggatttctgttctggaagcgtcggcgtgcgacccagctggtgttgagcatcggtgccccttcgagtccaattgtatccaactttatcctttaccggttcgacgaagtgataagcgaatactgtatgcgcttgggcattaattacacaagatacgccgacgacttgaccttctctacgaacgaaaaggatctcctgataaagtttcccgcccgggtgcgcaaagtgttaaaccacctgtatgatggacagatcaaggtgaacctgaagaagaccgttctttcttctaaagctcataacaggcacgttacaggcattacattatctaatgacggcaagttgagtgtagggagagagaagaaaaggaagctgtccgcctctatccaccacttcatcatgaaaaagctctccgttgaagaaatcttaaagctcaaaggtgagctagcccacaccacttttattgaaccactctttctggaacgaatgatcgagaagtatgggtatgatgcgataaacgagctaaaacattttagcgacgagtccagttga

SEQ ID NO: 11504 - RNA, 942 nt, unidentified
  source 1..942: mol_type = other RNA; note = synthetic construct
atgaatctgtcagagctattggaaagctttctgttcatggaggaggaggagatcgtctcttttgcagcctcctctccctatcggtacaaagtctacagtatcgcaaagagaaacagtgaagagcggcgaattattgcgcacccatctaaggaacttaagttcattcagaggattatcgtggaccagctggcaggacaattgccgatccataacacggccaaagcctatatgaagggtctgtcaatcaaggataatgcacggccacacgccaaatataagtacctgctaaagatggatctcaagaacttctttcctagtataaaaccctcgttgttcttcaaagaatgcaggttacatggcgtagaattaagcgagctggatatcgatttgctggaagggtttcttttttggaagcgtaaacgggccactcatttagtgctttcaataggcgccccttccagccccctggtgagtaacttcatcctgtatagatttgatgaggctatcagcagatactgtaaatctctcggcattaattatactcgctacgccgatgacctgaccttctccacaaatgaaaaggacgttcttctgaagtttcccgctaaggttcgcaagaccctgaactacctctatgatggtcagattaagatcaacctccgcaaaacagtgctgtctagcaaagcgcacaatcgtcacgtcacagggattacacttagcaatgaggggaaactgtccgtgggccgcgagacgaaaaggactctctccgctagcattcaccgattcacccaacagaagctctcggacgacgacatcctcaagctaaaaggaaacctcgctcacaccgtgttcatagagcctgactttttggacaggatgatcaaaaagtacggaagaaatgccatatatgaactgaagcattacaccccatcctcaaactga

SEQ ID NO: 11505 - RNA, 942 nt, unidentified
  source 1..942: mol_type = other RNA; note = synthetic construct
atgaacctgtcagagctccttgcttctctgattttcatggatgatgaggagattatctcctttgctgcctcaagcccttacaggtacaaggtctattctattccgaaaaggaacagtgaagaaaggcgtatcatcgcccacccttcgaaggaattgaagttctttcagcgggtcattgtgaagcagctgtccgagcgcctccctatccatagtgccgctaaggcctataccaaggggctaagtataaaggataacgccttgccacatgcaaacagcaagtacttgttgaaaatggacctgaaggacttttttcccagtataaatccctccctattttttaaagagtgccggcgtcatggaattgactttagcgatctggacatcgaactgctggagggcttcctcttttggaagcgacgccgggctactaagctggtgctctccattggggcaccctcttccccactggtgagcaatttcatcctttataagttcgacgaagatatcagcagatactgtaattccattgggatcaactatactcggtatgcagacgatttaaccttctctaccaacaagaaggatgtgcttctgaagtttcccactaaagtgaggaacacactcaatagcctgtacgacggacaaattaaagtgaaccttcgcaaaacagttctgagctcaaaagctcacaatagacacgtaaccggtgtcacattaacaaatgagggaaaattgtccgttggtcgagaagcaaaaagaaatctgagtgcgtctatacactcattcacgctgcagaaattatcaaacgaggagatcttcaaactcaagggccatcttgcccatgccgagttcatagaaccagacttcctggagagaatggtaaagaaatacggccaggaggcgatctgggaactcaaacactacacccactctaagaattga

SEQ ID NO: 11506 - RNA, 939 nt, unidentified
  source 1..939: mol_type = other RNA; note = synthetic construct
atgaacttatccgagctcctggcctcactgctgtttatggatgatgaagagatcatctctttcgccacgtcatctccctaccggtacaaagtctactcaattgcgaagcgaaactccagtgagcgtagaatcatagcccatccctccaaagaacttaaatttattcagcggctaatcatacagcaactgacagttatccttcctgtacataaggccgcaatcgcttacactaaaggactctctattaaagacaatgccagacctcatgcgaacagcaaatacctgctgaagatggacctgaaagacttcttcccgtctattaacccctcccttttcttcaaagaatgcaagaagaatggcatcgacttcagcgacttagatatgaagattctggagggtttcttgttttggaagaggcgcaggacaactaatctggtgctgtccattggggcaccttcttccccactagtgagcaacttcatcctctttaagtttgacgagatcattagtaatcactgcgcaattcttggaatcaactatacacgctatgcagacgacttgacattcagcaccaatgagaagaatgtgctgttgtcgtttccagcttacgttagaaaagtgctgaataccctgtatgatgggcagataaaggtcaatctgaagaaaaccgtgttgagtagcaaagcccacaacaggcacgttaccggcgtaactcttaccaacgaaggttgtctcagtgtggggcggaacaaaaagcgccagctgagcgctgctatccactatttttctctgaagaaactctcaaacgaggatatcttcaagttaaagggcagcctcgcccattccgtctttattgaaccagattttttgctccagatggagcgaaagtacggaaaggaaatcatattccaactcattcactatgctctagacgattga

SEQ ID NO: 11507 - RNA, 942 nt, unidentified
  source 1..942: mol_type = other RNA; note = synthetic construct
atgtctctgttcgagagtctgtccatgatgctgctgatggatgagggagaattgcggtcatttgctttgacggcaccttataggtacaaggtatatacaatcgccaagcggaactcagaggagcggcgagtgatcgctcatcccagcaaggaactgaagttcgttcaacgcttgattataaaccagcttgagcccaaactgccaattcacccgtccgcgacagcctacatcaaaggaaagtccatcaaagacaatgctctccctcatgtcaatagtaagtacctcctgaagatggatttaaaaaacttcttccctagcattaagcccgagctcttttttaaggaatgtcgacaccacgggatagaactgacggacgtggataaatcgcttctagaaggatttctgttctggaaaacccgcaggtccaataaactgactctatcaattggcgctccaagtagtcctatggtgtcgaatttcattttgcaccggtttgatgagaagatgtccaagttatgcctcgccgagggggtaagatacaccaggtacgcagatgacctgaccttttccactaataaaagaggcacactactgtcttaccagtctaaagtgcgcaggataattggaattctgtatgatggcaacatcaaaatcaatcttaggaaaaccgttcttagcagcaaggcccacaaccgtcatgttaccggcgtgacactgactaacgacggtaatctcagcgtcggcagagaggaaaagcgtaaaatctctgcggccatacatcactattcattcaacatgttggagcatgaagacgtcctccgcctcagcggtagacttgcacacgccagcttcatcgagcccgagtttctggaaaagatgatcaagaagtatgggcaggacaccatctctaaattaatgaagtctgggactgaaccagtgtga

SEQ ID NO: 11508 - RNA, 930 nt, unidentified
  source 1..930: mol_type = other RNA; note = synthetic construct
atgaatctcttcgaatcactcagcgcaatgttactaatggatgaaaaggaactgcgctcatttgctcttaccgccccctatagatacaaggtgtacactattgcaaaacgtaatagcgacgacaggcggattatagcccatcccagcaaagagctgaagtttatccagcggcttatcatcaatatgctcttgcccaagctcccagttcactccgctgccaccgcgtacatcaaggggaaatctattaaggacaacgctataccgcacgcatctaaaaagtacctgttgaaaatggacctgaaagactttttcccaagtatcaaaccagatctgttcttcaaagaatgccggcaccacaaaatcgagatctccgagacagataagtcactgctagagggcttcctgttttggaaaacgagaaggtctaaccagttaaagctgagtatcggggcccctagctctcctttcatctcgaacttcattctatatcggtttgatgaggaagtgagcaagttgtgtcgcgccgaaggcgtcacatacacacgatacgccgatgacctgaccttttcaactaacaaaaaaggggtgctcttgagctatcagagcaaggtaaggagaatcatagggaccctttataacggtaacatcaaggttaatctcaagaagactgtgctttcctctaaaggccataataggcacgtcacgggtatcacactttccaacgatggatccatttccttaggacgagagcaaaaacgcaagatttccgctggcatacaccatttctctctgaatctgctggagcatgaggacgtgctgaagctgggcggaaagctggcgcatgcaagttttattgaaccttcgttcctcgagaaaatgattaagaagtatggacaggaggccattagtagattgatgaagactacctga

SEQ ID NO: 11509 - RNA, 951 nt, unidentified
  source 1..951: mol_type = other RNA; note = synthetic construct
atgaacttaagtgagacgctgagtacagttctcttcatggatgaggctgagttgaggtcttttgcttcaagtgccccctacaggtacaaagtgtatgcaattaacaagaggaattccgatgaaaaaaggataatcgcccacccttctaaggaactgaagtttatccagagactgattatcaaacaactccagccccgcttaccggtgcatacagtggcaacagcctatattcgcggtaaaagtatcaaagacaatgccctgcctcatgcaaagtcaaaatacctactgaagatggacctgaagaatttcttcccaagcattaagcccgatttgttctttaaggagtgtaaacatcagggtgtgccactaagcgatagcgacaaggaactgctggagggatttctcttttggaagtcccgccgagctaaaggactcagcctgtctatcggcgctccttccagccccctagtgtccaacttcatattatacaggttcgacaaagccatgaatcagctttgccagtccgagggcgtcacttataccagatatgcagacgatcttatcttttctaccaataagaagggcgtactgctggcctaccccccaaaagttagacggctcatagggaccctgtatgacgggaacattaaaatcaacctgcggaaaacggtgctgtcgagcaaagcgcacaaccgtcacgtgacaggcattaccctgaccaacgacggccgcctttctgtagggcgggatgataagcgtaagctttcagccgcgatccatcactacgcttcccacatgttgactcctgaagaggtgcagatccttagaggaaagctgagctatgcagtcttcgtcgaaccggagctgctcgaacggctcattcgaaagtacgggaaacaggtcatagccgacttgcaaaaggttaatccaactttgaatctcaagtcatga

SEQ ID NO: 11510 - RNA, 948 nt, unidentified
  source 1..948: mol_type = other RNA; note = synthetic construct
atgtcgatctcaaaattgttgagcaagaacctgttcatggatgagcttgaactgcgctctttcagtcttagctctccttaccgatataaagtgtacaagatccctaaacgcaactcaaaggaacttcggactatcgcacatccgtccaaagagctcaagtttgtgcagagacttatagtaagggagttgggtcagctcttacctgtttccgaagccgccacagcctatatgaaaggcatttccattagggataacgccttagttcacagtaacactagatacctcctgaaaatggacttgaagaatttctttcccagcatcacacctgagatctttttcaatgagtgtctgcgtgctggtgtagaattcgaacagcttgatattgacctgctgagagggtttctattctggaggccacgtcgctctaaaaagctgattttgtcaatcggagccccaagttctcccctggtgtcaaactttatcctgaatcagttcgacgagaatattatcaatttctgcaagaccattggcgtgcggtactcccgatacgcggacgatatgacctttagtacagacattaagggagtcctgttcacgtttcccttaatgatcaaaaagattctcaagaccctgtatggcaacagcataaagataaatcaggacaagaccgtgttcgcaagcaaggcacacaataggcatgtcactggcgtgaccctctctaacgatggctgcgtgacagttgggagagaatccaagcggaagatttccgctagcatccaccactttagcctcgggatcctacagccaaacaacataatccaactgaaagggctcttcgctcattcgacctttatagagccaaaactgaaaaaccaaatggtcgagaagtacggaatcgagatcattgaacggctgatgtcttatcagcccaatgatctgaagaaatga

SEQ ID NO: 11511 - RNA, 939 nt, unidentified
  source 1..939: mol_type = other RNA; note = synthetic construct
atgaacatcagcacattactttccgaacacttgttcttggacgatatcgagttgagaagttttgccgatagcgccccttacagatacaaggtgtacaaaatccccaaacgaaacagcgaggagcttcgcacgatcgcacacccctctaaggagcttaaattcgtacagcgactcattgcaaaagagctatcgagcgtgttgccactacaccaggcgtccatggcctacagaaaggggacatctatacgggataatgccctcgtgcattccaactcttcttatctcctgaagatggatctgaaggactttttcccgagtataaagcctgaacttttttttcgggaatgcagcaggtatggcttggagtggacggacctggacaaaactctgttaaatgggtttctgttctggaagcctcgccgcgctaagaaactggtactgtcaattggagcccccagcagtccactggtcagcaatttcgttctgtaccaatttgatgaacacatcgccaactattgtaaagaactcggagtgaactataccaggtatgctgacgacatgaccttctccaccgatagaaaggacctgctgttcaagttccctatacaggtgaggaagaccctgaaggctctctatggctcatccatcaaagtcaatctgaataaaactgtgttctccagtaaggcacacaatcgtcatgtcaccggagttactttatcaaacgaaggcaaggtgacaattggtcgggagcgtaaaagggtcctctccgcttctattcaccattttagcctgggcgtgctcgggcatgacgaaatcctcaagctgaaaggacactttgcgcatctgattttcattgagcccctagttaaggagcaaatgattaaaaagtacggttcaagtctgatcgggcggcttacatcataccagggctctccatga

SEQ ID NO: 11512 - RNA, 930 nt, unidentified
  source 1..930: mol_type = other RNA; note = synthetic construct
atgaatatcgaaaagtatttgagcgagaatctgtctataaacattagcgccttgcattccttttcgcgcactgctccgcatcgatacaaagtgtatagcattcccaagcgaaactcaaagggggaaaggattatcgcccacccctccaaagagctgaaattcatccagaagatgatcataaagaagctcactgatatcctgccccttcatgagtccgtgatttcatatcggaagaaaaagtccatagttaacaacgtgatccctcacctgaattcgagctttctgctgaagattgatctaaaagacttctttccatctatcgaaccagacctcttcttcgagcaatgcaaattactcgacatacactttagtgacaatgataagaagctgctgaccggcttcctcttttggaggaaccgtaagagcagcaagctgcagctgtctattggagcgccatcttcccctctgatcagcaacttcatcctgtaccgctttgatgatcggattacaaaattgtgtgcaagctacaatgtcaattacacaaggtatgccgacgatttatccttctcaaccatcagtaacagtatcctactgaaattgtccgaggagatctcagctatgcttcaggagatcttccaggggagattcctgattaatcacgagaagaccattttttcaagcaaagcctctaatagacatattacgggaataacgataaccaattcaggtgaaatgtctttgggtagaaactttaaaaggaacattagtgcatgcatccataagtttacacttaaccagctcccccaggaagaacttcttaagctgaagggccacctctctttctttaaacacgtagaaccttacttcatcttacggatggagagtaaatacggcaagcacattctcgacaaaatccgcaaatcccaatga

SEQ ID NO: 11513 - RNA, 939 nt, unidentified
  source 1..939: mol_type = other RNA; note = synthetic construct
atgacaaataatcttaagtctctccgaaaattgctgcaaagtacccttttcctctcagacgacctgatcaacattttcattaccacggcgccctatcgctacaaaatctatgagatcgacaagagatccagtgacgaaaagcgaaagatagcgcatccatcaaaagaactgaagcttatccagaggattatcgttaaggagttgagcaatatgctgccagtacacgactgtgcctatgcttacaggaccgggcgcggcattaaagagaatgccttgattcactccaaaaactcgtatctcttaaagctagatctgtctaatttcttcaacagcctcactcctgagatctttttcgctgaatgccggcgaaataacattgattttgataaggacaacgcaagcattatatcaaactgtctcttctatagagagcacagaaagagttctctcaagctgtctgtgggggccccttcatccccctttatctccaacgtgataatgtactctttcgaccagattatcgagacagagtgcaggaaacgggaaattacgtttaccaggtacgcagacgatatgacattctcgaccagtataaaaaacacactgatcgggttcgatgagctcatcaagaaggtcctgttcgatctgtttaaaggcgctatcagcctaaatcaggacaagactatcttatctagcaaagctcacaaccggcatatcactggcattacaatcagcaacaacgataatatcagcttaggtcgggagagaaaacgtctgatttcctccgccatacatcgcttttcatacggaaaacttgatcaggaagccgtggacaaattgaagggtctgctggcatttgcctactacatagaaccgtcctttattgcaaccatggagaagaagtatggacgcgaaactatcaataagctgaaaaagtga

SEQ ID NO: 11514 - RNA, 948 nt, unidentified
  source 1..948: mol_type = other RNA; note = synthetic construct
atgtccaataacccaaagagctttcgcaagctgttgcagtccaccttattcctgtctgatgagctcatcaatactttcatagcaacctctccatataggtacaagatatacgacatagctaagaggaattctgacgaaatgcggagaattgcccaccccagtaaggagctcaaatttattcaacgtatcatcgtgaaggagctatcggatcttctgcctatccacgaatgcgcctacgcttataggcccggacggggtatcaaagagaacgccttattccactcaaagaactcatacctgctgaaactggatttgagcaatttctttaacagccttacaccgaaaattttcttttccgagtgcaagcgaaataacatattttttgacgaggacgatacctcaattatctccaactgtttgttttaccgtgaacaccgcaaagcttctctgaaactaagtgtgggtgccccctccagcccttttatttccaatgcgatcatgtacagcttcgataaacgcattgaagaggtctgtaataataagggggtaagctttactagatatgctgacgacatgactttcagtacaaacacaaagaatgtgctcgtcggattcgaccgaatcgtgaaagaggtgctttttgacatcttcaaagacgcaattttcctcaacaacgataagaccattttctcaagtaaggcacataaccggcatatcacaggggtcaccatctctaatgacgacaacatctcgctgggcagagatagaaaaaggtatatatctagcgcgattcatcacttttcactggataagctgtccgagaacgagattgaaaaactcaagggccttttggccttcgccgaacacatcgaacatagcttcgttgatcggatggttaaaaaatatggcagtgatgtgatgaagaagctgaagaaaacggacaagtga

SEQ ID NO: 11515 - RNA, 939 nt, unidentified
  source 1..939: mol_type = other RNA; note = synthetic construct
atgctgattctcgaggaattagcttctaagctgttgatctccaccgccgagcttgtaaagtttgtaaacactgcgccctaccgctataaagtgtactcaatacccaaacgctccggccgaggtctgcgtacgattgcccagccaactgaagtcctcaaggtcattcagagaatggtcctcgactcatatttgaagggacttcctatccacgattgcgccactgcctacagagatggattgagcatcaaagaaaatgcagcagtccacctgggatccaagtacctgctgaagatggacttttctgatttcttcccttctattggcccctcagacctgattacccacattaaaaagcatcggaaggatatagccagagaagatgcctatgcagtgaggaagattttcttttgggctacaaaaaaagaccctgcacataggctgagtatcggtgctccctcatctccattcatcagtaacaccctaatgtatgaattcgactgtaaagttttcgatgagtgtacacgactcggggtccgctataccagatacgctgatgacctgacctttactaccaacgtgaggggcatcctgtttgagttgcctgacatcgtgacaaaaacctgcgccgagattggatatccaacactgcgcgtgaatcaggacaagacagtgttcagcagcaagggcaacaaccggcatgtgacagggcttgttttaacgaatgacaataagatatccctaggccgggaaaagaaaaggtactttcgtagccttatccaccggtactccttagggggtatgagcagtgaggatatatatgcgctcaaaggcaggctggcttttgctaagcacgttgagccgactttctactatgcagtggtgcaaaaatacggggccgagctgatcaagtcgatcatggagtaccagatcctcaaatga

SEQ ID NO: 11516 - RNA, 939 nt, unidentified
  source 1..939: mol_type = other RNA; note = synthetic construct
atgttgatcctggaggagttggccagcaagctcctcatctcaaccgctgaattagttacttttgtgaacacagcgccttacagatataaggtctatactatccccaagcgtagcggacggggagtaaggatcatagcccagccaactgaggtgctgaaggtgatgcagcggatggtgctcgattcctatctcaaaggtctgcccgtccacgattgcgctactgcctacagagacggagtctccataaaagaaaatgcaaccgctcacttggactctaagtatctgttaaagatggactttagcgactttttcccctcaatctccccaagcgatctgatctctcacatcaagcgccaccgcggctcagttagtcgcgaagacgcatacgcggtcaaaaaaattttcttctgggcacgtaagaaagatcctttacataggctatcgattggggccccgtcctccccattcatatctaacaccctgatgtacgaattcgattgtaaagtgtttgacgagtgcgcacgcatcggggtgagatacactaggtacgcagatgatcttacattcaccacgaatacacaaggtgtgctgttcggcctgctagacattgtgaataaaatttgtgccgagctcgcttatcccacacttagaatcaacagtgataagaccgtcttcagttctaagggtaataaccgacatattacaggccttgtactgaccaatgacaacaaggtgtctttgggaagggagcggaaaaggtattttcggagccttatacataaatactcactcggcgagctgagtggggaagacatttatgccctgaagggccgactggctttcgccaagcacgtggagcctacgttttacagcgccgttattcagaaatacggggccgaactcatcgcttccatcatggtttttcagattctggagtga

SEQ ID NO: 11517 - RNA, 951 nt, unidentified
  source 1..951: mol_type = other RNA; note = synthetic construct
atgacaatattggcgtatctcagcaacaagttattgatcagctcggccgaactaattggatttgtgaatacggcaccctaccggtacaaagtgtatcctatcccaaagcgttcaggaaggggggtgaggatcatcgcacagccaaccgacgttctcaaagtgatgcaacggatggtcctggaatctttcttggttggcctgcctgtgcaccactgtgctacagcatatcgggatggtgtgggcatcagagaaaatgctactgagcatctgaagtccaagtacctgctcaaaatggacttttccgattttttcccctctattggacctaaagatctgatcctccatattaagaaacacaggggcgagatttccaaagaggacgcctacgccgtcaaaaaactgttcttctggactaagaagaaagaccccgtacataagctgtccatcggagcaccaagtagccccttcatcagcaacacgctgatgtacgaattcgattgtcgtatattcgaggaatgcgcccgattagaaataagctatactagatatgcggacgacctaacttttaccacaaataagcaggggatcttgtttgaactgcctagtttagtcgtgagaatttgccgagagattgactacccaaccctgaatataaacgctgataaaacagtgttctcttcaaagggccgcaaccgccacgtcaccggtcttgtactcaccaacgacgataagatcagccttggccacgagaagaaacggtacgtacgctcactgatctatagatactcccttggggggatgtccagcgatgagatttactctctcaagggcatgcttgctttcgccaagcatgtcgagccgagtttttaccagtcagtggttaggaaatatggtgaggccgtggttgggagtattgtctcttttcaactgattaagcaggtggcccagtga

SEQ ID NO: 11518 - RNA, 939 nt, unidentified
  source 1..939: mol_type = other RNA; note = synthetic construct
atgacaattttaacagaacttagtcagaagctcctgattagctctgaggaactgaaagagttcattaacaccgccccgtacaggtataaagtttaccccattcccaaacgcaacggccgtggagtaagagtcatcgcacagccaaccgaagtgctgaaagctatgcaaaggatggtcctggatgatttccttgctggcttgcctgtgcacgcctgcgccatggcatacagagacggtctgggcatcaaggacaatgcgagtctgcatgtaaagaatcagtacctcctaaagatggacttttccgacttctttcccagcatcggccctgacgatctaataagtcacattagacggcatcgagaggggataggacgcgaggatgcgtatgccgtgaaaaaattgttcttctgggcacggaagaaggatcccactcacagactttcaatcggggctccaagctcgcccttcatatctaacacgctcttgtatgatttcgattgtcgggtgaatgacgagtgcacccggctcggtattatctacacgaggtatgccgacgatctcacctttactactaataataagggggtgctgttcgggattcctgactttataacacacatctgtaagctggttgactacccaactctgaaggtgaaccacgagaaaaccgtgttttcaagcaaaaagaacaatcgtcatgtcaccggcttggtcctgacaaacgataacaagatttccctgggccatgacaagaagaggcacatccgatcactgatctacaaatattccctcggagggatcccatctgaagagatccttgctttaaagggtatgctggcatttgccaagcacattgagcctgtgttctatcaggccgttatgcgcaaatacggatttcatgtcttagactctatcatgtcctttcaacctaaagaatga

SEQ ID NO: 11519 - RNA, 942 nt, unidentified
  source 1..942: mol_type = other RNA; note = synthetic construct
atgacaatcttagccgacttagccaaaaagtttcttatctcgagcgtcgagatcgcccatttcgtcaatacagccccgtaccggtataaggtctacacaatccccaaacgaagcgggagaggtgttagggtgattgctcagcctaccgatgtgctcaaggtgatgcagagaatggtactggagacttatttggtgggtctgcccgtgcacaattgcgctgtggcctacaaagaaggacagggcattaaagagaatgctattgcacacgttaacaatcaatttctgctgaagatggacttttctgatttttttccaagcattgggcctcaggatctgatctcccatattaagaaacacaaaggccagataagtcgtgaagacgcctacgcggtgaaaaagctcttcttctgggcgcgcaagaaagatcccacacaccggctctccattggagccccttcctcaccattcatcagcaatactttgctgtatgaattcgattgtctagtaagtcatgcatgctctaagctgggtgtggtatatacgaggtacgcagacgatctgacctttaccaccaatgagcaaggcgtccttttcgacgtgccagtgtttatttttaagatctgtgacgcagtcgagtatcccagactcaaggtgaacagtgacaaaacagtgttttctagcaaggcaaacaacaggcatgttaccggagttgtgctgactaacgacaacaagatatcactcggccacgctcgaaagcggcagatccgctctctagtatataaatacagttcaggagagatgaccactgaggaagtctactcactgaaaggcatgctttctttcgcccgccacatagaacctacgttcttccaggggttgataagaaagtattcctacgaggttgtggggtccatcgtcaggttcgaaagcatcaaggcttga

SEQ ID NO: 11520 - RNA, 966 nt, unidentified
  source 1..966: mol_type = other RNA; note = synthetic construct
atgagcatccttgagctgttgtcacagaaactcatgatgtccagttctgagttgagactgttcatcaaaactgctccctatcgttacaaagtttacccaattctcaagcggtctggcaagggtattcgcctcatcgcccagcccacggacgtactgaagatgatgcaaagaatggtcgcagatgagtcgttaagcggtcttccagttcatgcttgcgccactgcctatcgcgaaggcttgtcgattaaagacaatgccgaggcccacgcaaagaaccagtaccttctcaagatggatttttccgatttcttcccttcaatggggccgtctgacctagtgaaacacatcgaaaagcacaaaggatccattacggccgaagatgcgtacatggtaaagaaactgttcttctgggcccgcaaaaaagatcctatccacaggctgagcataggcgccccaagttcccccttgattagtaacactctgatgtacgattttgactgcgcacttcaggagtattgtgacaaactgtccatcacatatacaaggtatgcggacgacataacattcaccactaataccaaggagattctatcagcaattccaaattacatcgaggggttatgtgagcggatctcataccccaagctcaagattaacaatcaaaagaccgtgttctcttccaagaaaaataataggcatgtcaccggactggtgatatctaacgaggacaaggtgtctctgggaagggaacgaaagcgatatatccggagcctgatccacaagagcattgcggaagcaatgaccagcgaagagatctataacctgagaggcctcctggctttttccaaacatgtggaacctacattttaccagagtgtcattaagaagtacgggcagcctgccatctactttatagaaacctttcagagcgctcaaaaggctgctaaagtgatcaacaaaacatga

SEQ ID NO: 11521 - RNA, 936 nt, unidentified
  source 1..936: mol_type = other RNA; note = synthetic construct
atgtctattctggaactgctgagccagaagctgatgatgtccacctctgagttgcgcagctttattaagactgccccctacaggtacaaagtctaccccgtgcctaaacggtcaggcaagggggttagaatcatagcacaaccgactgacgtgctcaagatgatgcagagaatggtcgccgatgaatttctaagcgagctcccaattcatgcttgtgctacagcgtaccgcgaaggcttatctatcaaagacaacgctgaggcacacgttaaaaaccagtacctcctgaagatggatttcagcgatttctttccatccatgcgtccgtccgatttggttaaacacatcagcaagtacaagggttcaattacagccgaagacgcttatatggtgaaaaagcttttcttctgggcaagaaagaaggaccctatacatcgactatccatcggggcgccatcttctccccttatatccaacactttgatgtacgaatttgactgcattcttcaggagtactgcgacaagctctccgtaacctatacgagatatgccgatgacatcaccctcacgacaaacatcaaaggtgtcctgctgggcgtccctaatcacgtcaaggagctgtgtggacatattgcctatcccacactgaaggtgaacgacgccaagaccgtgttttcatcgaagaaaaacaataggcacgtgaccggcttagtgatcagcaatgaggataaagtgagtctgggacgagagaggaaacgctatatacggagtctgatccataaaagtgtggtaggagatatgacaaatgaagagatgtacaatctccggggcttgcttgccttcgctaggcacatcgagcctaccttctacgacgcaattgctaagaaatatgggctgtcagccatctatttcattgaaacttttcaaccagcatga

SEQ ID NO: 11522 - RNA, 978 nt, unidentified
  source 1..978: mol_type = other RNA; note = synthetic construct
atgtcaatcttagagtcgctctcacagaagttcatgatctccgcaaacgagctgagaagcttcatcaaaactgctccatataggtataaagtctaccccattcctaaacgcagcggcaagggattcagactgattgctcagcccagcgacgtactgaagatgatgcaacgcatggtgctggaggaatttctcagcgaactgcctgttcattcatgcgccgccgcttacagggagggattgtccatcaaagacaacgcagaggcgcatgcaaagaatcagtatctcctgaaaatggactttagtgacttttttccatcaatggcgccagctgatctgataaaccatatcgtgaaacacaagggcgccattactagcgaagacgcctacatggtcaggaagctgttcttctgggcccgaaaacaagatcctacctaccgcctctccatcggcgcaccatctagtccgttcatctctaatacgttgatgtatagtttcgactgcgtgttacaggattactgtgagaagataggggtcacatacacaaggtatgcagatgacattacccttactaccaatgtgaagggtctattgctgaacatgccgaactacgtgcggtccatttgtaaagagattgcttatcctactctcaaggttaacgaacagaagacggttttttcctctaaaaaatctaaccgacacgtgaccggtctagtgatcaacaatgaaaatcagatcagcctggggcgtgaaagaaagcggtacattagatctttgatacacaagagttcgctgggaggcctgacagatgaggaaatgcacaatctcaaaggcctccttgccttcgccaagtacattgaacccaccttttacaaaagcgtactggataagtatgggctgcccgccctttatcttatcgagacatttcaatccaatcccaaggtcatagagtctttagagatcaagcggcagttcccttga

SEQ ID NO: 11523 - RNA, 936 nt, unidentified
  source 1..936: mol_type = other RNA; note = synthetic construct
atgtccatcctggagagcctcgcaaacaagttattgatcaagccgggggaattgtttagctttataaagtcagcgccttaccgatataaagtgtattctatccctaagcggaatggaaggggcatgcgcatcatcgcccagcctagtgaagccttgaaagtgatgcagagacttgttctcgatgactatctgatggggctacccattcataattctgcaaccgcatacattgtcggaaagtccatcagagacaacgccttacgacatgctaacaacccatatctgctgaaaatggacttttctgaattctttccctccattagcccagccgacctgtcgctgcacgtgaagaaatacaaaggcgtagtctccccagaggatgagtttatgctgagaaagctcttcttctgggcacagaaacacgatacccgccaccggctgtcaattggtgctcctagcagcccctttatctccaatactcttatgtacgagtttgatagtaagctctctcgggcttgttccgagaaggaggttgtatatacacgctacgctgatgacctcactctgaccacgcgtaacaaagacgtcttgttctctatgcccgaattcattgccggcttatgccaacaaatcgagtacccgcgtctgcagattaattccgagaaaacagtcttctcttcaaaaaagcacaataggcatgtgaccggtatcgtgataaacaataaaaacgagctgtcacttggaagggagaagaagaggttcattaagtcatacatctacaggttcagtagtgatgaactgagcagtgtggaaataattcagctaagagggctccttgcctttgccaaacacgttgaagtgagcttctataatgcgctgatagctaagtacggcctcgagacagtgagccgcatcgaacggtatcagccagtctga

SEQ ID NO: 11524 - RNA, 939 nt, unidentified
  source 1..939: mol_type = other RNA; note = synthetic construct
atggacatttacaatgctctgagcgagctgttactaatcgatgaagtcgagatcgtgagttatataaataaagctccacacaggtacaaagtttataagatccctaagaggaacggaagtggcagcagggtgatcgcccagcctgcaaaggagctcaaagtcttgcaaaaatcggcactgaacatgccccttctggatctaccagttcataaatccgcctttgcctatatggagggcattggcattaagcaaaatgcccagaagcactccaagaatcagtacctgttaaaaatggacttcagtgattttttcccttctattgtgtcttctgaccttctgagtcatgttgaaaagcacaaagggaaactcgaaatcaaagaaaaagtggccctgaagaaactgtttttctggtgcgtgaaaggatccaccgaacacagactttctatcggggccccctcatcccccttcctcagcaatacgattttgtttgatttcgacacgatcgtgaatgattactgtacccaggagaagataacatatactcggtatgctgatgacttgacctttacaactaatgtgagcggtgtactctttgagctgcctacttacattgaaggggttctgaagaaactggagtaccccacattgaagataaaccactccaagaccgtgttttcatctaagaagaacaaccgccatgtaactggcctcgtgcttaccaacgacaatgcgatttcactgggccgtgatcggaagagatacatccgaagcctggtctacggtttctgcaacaagaaactttctgacgacgagagcataaagctgcgcggattaatctccttcgctaagcatgtggagccgacattcttccggtcgctcgtcaaaaagtactcactcgcagtcatcagcgatattgaaagatattatccagacaactga

SEQ ID NO: 11525 - RNA, 936 nt, unidentified
  source 1..936: mol_type = other RNA; note = synthetic construct
atggatatctacgagtctttatctgagatgctgctgatcgatgaatccgagattgtggaatacatcaacaaggctccgcataagtataaggtttacgaaatccctaaacgcaacggacatgggactcgcacgatagctcagcccgccagggaactaaaagtgttccaaaaactcagtctggagcacccactgctgaaccttcccgttcacgacgccgcctttgcataccgagacggaatagggataaaacagaatgccgaagtgcacgctaagaaccagtatctcctgaaaatggatttcgccgacttctttccgtcaatcctggacacagatttgattactcatatcgagaaacaccatggcaaaatcgatcaaagaaataagaccgctattagcaagttgtttttctggcggaaaaagcgggacatcatcaacaggcttagcatcggtgcccctagttccccttttatcagcaataccctgctttatgactttgatgaggagatatccaatatttgcactcccctgatgattacatacactagatacgcggacgacttaattttcaccacgaatgagccaggaatcctgagtaacataccaaacgtagtggttgaaacccttaagtccatcaaagtgcccacattgcgcatcaatccccagaagacagtgtatagtagcaagaagaacaacagacatgtcacagggctggtcctgtcaaatgacgacaaggtatcactcggtaggacccgtaagcggtatattcgaagcttggtgtttcagtatcactctgagaacctcgcaagcgacgatattgtcaaactcaaaggcctcctaggcttcgcgaaacacattgagccaaccttctattcttcgctcatcaataagtactcactggatctgattttatccattgaaaagtacgatcctgcatga

SEQ ID NO: 11526 - RNA, 927 nt, unidentified
  source 1..927: mol_type = other RNA; note = synthetic construct
atgtccattattaagtatctcgccgatcagctactattgtccgaggaggacattagacttttcatcaagaaagccccctacaagtataaggtgtttgctatacagaagcgtaacaaccatggagaaaggattatcgctcaacccgctaaggaattgaaatccatccagcagatggtgcttattgagtttcttaaggaactgcccattcactcatgcgcaatggcataccgacacggtatttccattaaagataatgccaaggtccatagcagtaacacctacctgcttaaaatggactttgccgatttcttccatagcatcagacccgaagacctgatcgagcactacgagaagtacaaagcgaaactgtctgccgatgacagggtgagtctgaaaaagatattcttttgggcaagcaggaaaccacctgagatcaaattgagcatcggggcccctagctcaccgttcatttctaacaccattctgtttgatttcgactctatcgtgtccaaagtgtgtatagctcacgaaatcacatacacccgctatgcggacgacctcacatttaccacaaacattagggatactctgttcgacatccctaatctcatcgcaagagtcatcaaggatattgattatccacgcctgaagataaaccatactaagacggtcttttcttcaaagcggtctaaccgccacgtaactggactggtgctgacgaatgagaatcagattagcatagggcgaagtatgaagcggaaaatcaagacaatgatcttcctctactcaaagaagaatttaagccctgacgacatcaaatttttgcggggctatttaagtcacatccataatgttgagccaactttcctccactcgctgaccaaaaaatttggcacacggatagttacctccatcttccaccaatga

SEQ ID NO: 11527 - RNA, 945 nt, unidentified
  source 1..945: mol_type = other RNA; note = synthetic construct
atgtccctgatagacttcctgaaggagaagacaggagttcataaatcgacattaaaaagcttcgtgaggtctgccccacaccggtataaaacattcccaattgacaagcggaactctgataaaaagcgtttaatcgctcaacctagtcgcctgctgaaaaaaatccagaacctcgtcgtgtctgagtacgaattcctgatcaatcttcccattcacccgtgcgtcatgtcctatgtgaaaggtaaaagtattcgggacaacgcactggtgcacaaggacagctcttacctactcaagatggattttaaggacttctttccctccatcaagcctagtgacctcatcgaacacatagagaagcataagagagtgtcactggatgatgatgaaaaagactatctttcccgcctctttttttattcccagagcagaaaagaagagattgtgctgagcattggggctccatcatctccctacatttcaaacactgtgctttatgacttcgacgtgaccatcgccgccgaatgtgattccactggcgttaagtacacacgatacgcagatgatttgacgttcagctcaaacgacaagcagagcctgataaatctccataacgccatggagtcaatcttatcttccctacagtaccctaaactggccttgaatactaataagaccacctttcttagtaagagggtcaatcgacacgtcaccggtctggtaataaataacgacgggggagttggcattgggaggaagaagaaaagagagatcaagagtctcgtgcaccgctacttgaatcatagcctcgaggatgaaaggcatccctatctgagaggatacttggcttacatctggggcgtagataaacagtttgtcgcgcagctggaggccaaatatgaaatcagcattcttgatgttgtgaagcaactggaggcagactga

SEQ ID NO: 11528 - RNA, 942 nt, unidentified
  source 1..942: mol_type = other RNA; note = synthetic construct
atgagtatcgtcgattttctggtggaaaaactggtcgtgcccaaaagcatcgttgaaaccctcgtactgacagcgccgcacaggtacaaaacatatgaagtgaccaagagaaacggaaaaggtaaaagggagattgctcagccatcgaaagaactcaaatacattcagcggatcgttctcaaagagttcgatttgatgcagaacttaccgatccatgattcagccatggcataccgcaaaaatataggaatacaagacaacgccctgatgcacaaagacaaccagtacctgctgaagatggacttcagcaacttctttccaagtattgttcctacggatctgatcaagcacattgaaaagtacaagggcctcaagctcgatgaggaggatataaaatgtctttcccggttgttcttttatactaaagaaaagggttccggcttagtactgagcattggggctcctagcagcccctatatctccaatacactgatgtatgatttcgacatcttgctccagaagaagtgcgagcaaaaaaatattgtgtatagcaggtacgcagacgacctgaccctgtccacaaatgtgcccaagatattgttcgactttcctgccgtggtcaatggaattctgaaggaaatcttaaccccaaagctgctaataaacgactctaagaccgtttttcttagtaaaggaaccaaccgcaatgtgactggcttggtgatctctaatgaggggaaagtcactattggccgtgataagaaaagagaaatcaagagtatggtgtataagtactctctatcacatcagctagacccagagtccgagattccctacctgaaggggtacctcaattacatcaacggcgtcgagccttcatttctgaagtctcttgagaagaagtatgggatcgaccttatcaagcttattcgaaactcatga

SEQ ID NO: 11529 - RNA, 945 nt, unidentified
  source 1..945: mol_type = other RNA; note = synthetic construct
atgagcatactcgagggattaagtaagaaaattcttctaaacgagcctgatttgtggaagttcattagtagtgccccacacagatataagaaatacaagatcgagaaacggaatggcaagggctttcgcgatattgcacaaccatcaaaagaactgaagtttgtgcagaatacagccgttttcgggatcgacctctttcagaatctgcccattcatcactcagctaaggcatacatcaagaagatcaacatcaaagacaatgccgaagcgcataaactgaactcatactttctgaaaatggatttcagcaacttctttcctagtatcaaacccgtcgacttcattaaccacatagagaagcacaaaaatctcacactttcggagaaagacaagctgatcatctccaagctgtttttctacaagaagtaccgtaagagcgaactggtcttatctgtggggagcccaacttctccctatatttctaacaccctcatgtatgacttcgacgatatcgtatacaagtactgcatagagaagaagatcacttataccaggtacgctgatgacctaaccttttccactatgaccaaggtcgatctgtttgagatacctgtgttcattaaatccaccttaaatgagcttctgtatccgaggattctgattaacaacgacaagacggtgttcttgagcaaacggacaaatagacatattacaggactcgttattacgaacgatggcaaggtgtcaatcggacgaaaaaagaaacgctacattcagtccttggtgtacaaatattgtaacagcaatatctctgaggaatccacttcctacctcaaagggtatttggccttttgcctgggtatcgatgtagacttcgttatcagcctggaaaagaaatatggtaaggaaaacatcgactctataaggggccttaataaaggctga

SEQ ID NO: 11530 - RNA, 942 nt, unidentified
  source 1..942: mol_type = other RNA; note = synthetic construct
atggtgacaatcattcaggacctttcttccctcctctcaattgatgctgaacgactaaggaagtatatcgccacgtgcccccatcgctataaagtgtacggcataccgaaaaggaatggctctggcatccgtactatcgcccaacctgccaaagagctgaaaactctccagaagcttgtgtacgaaaagtatctcgaaagcttacctgtgcacgaagcttgcacagcgtaccgcaagaacattagcattaaagacaatgccctggcacatgttaagaacaactaccttctgaaaatggactttctgaattatttcccctcaatcacacctaaggatctaattaagcacatagaaaagcatctcaactggaatgagtgggaagaagataagttcgtcatcgaaaggctgttcttttacgtgcgaaacagaggggagggactgcggctgtctattggggctcccaccagcccatttctgtcgaataccatcctctacgagtttgacagcaagattaccgagttatgcaatctgcaaaacatcacatacaccaggtatgcagacgatattgccttcagtaccaacaaaaaggacatactgttcgactttgcaggggtcgttgctgatatcctgtctcagtgtgagtatcccagcatcagtatcaacccagacaagactgtatttttgtccagaaaaggtaacatgcacattactgggctggttttgtccaatgatcgcaaagtatctataggcagatccaagaagcggtatattaaatcacttgtgtatcggttcttgaataacaatttgaccgaggacgagaaactctacctgagtggttacctgtcattctgtgtgtccgtcgagccagatttcatcgagaaacttaagagtaagtacggagccaacacgatcaatgagttgatgggccggcagagcggatga

SEQ ID NO: 11531 - RNA, 975 nt, unidentified
  source 1..975: mol_type = other RNA; note = synthetic construct
atgaatatcgtgtcgtatctgtcccagacgctgtacatcgccgagaatgaggtcgagaagtttatcaacactgccccacacagatacaagcagtaccagatacctaaacggaacaacaacggagtgagacttattgcccagcccgctgctgaactgaaaattatgcagctcctggccattgcgcagtttcagcaatttctaccggttcattcatccgcaacagcatactgcagggggaagggcattatggataatgccaaagctcacgcaaagaactcctacttactgaaaatggactttaaggacttctttcacagtatcaaaccatctgacctcatccgccactgctcccaacatatggggggtatcgacgacgctaccgctaagcagattaccaaactctttttctggacccctaagcggactagttcactgatcctctccatagggagccctgctagcccattcatctcgaacactgtcatgtatcaatttgattgcctaatgtctgagatctgttctgaaaagggcattgtgtatacaaggtatgcagatgatatcacattcaccactaatgtgaaaggcttgctcttccagatacccagcctggtgattgacatctgtaagaagattgattaccccagacttagcgttaacagcgaaaagacagttttctcatccaaaggaaataaccggcatgtcaccggagtaaccataacaaatgagggtaagctttctctgggccgacacaagaaaaggaaaatcaaaagtctggtgttcgactgtttgaataacaagttggattcagccgaacgtcgctctttatccggactccttgcgcacgccaaacatatagagccaagtttcttcctgtctctgacgaagaagtacggctatagcgagatcgcaaagattgccagcaataaacccactctggaagtagtggtcgccaaccctttgaccatttgcgactga

SEQ ID NO: 11532 - RNA, 951 nt, unidentified
  source 1..951: mol_type = other RNA; note = synthetic construct
atgaagatcattagctttctgagcaaaacgttatacctccccgagcatgaagtgacagcgttcatcaacactgctccctatcgatataaggaatattccataccgaaacgcaatggaactggaactcggcagatcgcacagcctagttctgaagtcaaggtgttgcaaactctcgctattgagaagattaagaataacctgccaatacatagctctgcgatggcttatagagaaggactgtccatcaaagacaacgccagtatgcacgccaagaacaaattccttctaaagatggacttcgagaattttttccactccttacttccccacgatctgctgctgcatacagagaaatattacagtagcatatccgaggaggataaaaagaccttatccaagctctttttctgggccacgaagagggatagaaaacttaagttgagcatcggggccccttcatcaccctttatttctaatacgctgctatacgatttcgacgaagccgtctcaaacgtatgtcgccctctcgacatcacttacaccagatacgctgacgacctgacctttaccaccaataccaacaagattctgttcgaaattccagacctgattcagaagatctgcgaaaccctgacctaccctaaactgaagattaataaggggaagaccgtgttttcctctaaaaaacataacaggcacatcacaggcatcacaattacaaatgaggcaacacttagtttgggccggcaccggaaaaggcatatccgtagccttgttcaccaacacatgttgggtaagctctcatcgaaacagatcaccgagctgaaaggcctgttggcatttagcaagcacatagagctaaccttctacaaaactctcgtgaataagtatggtttcaaaactctgctcgatatccaggccacacagacaaagaactctgatactccatga

SEQ ID NO: 11533 - RNA, 936 nt, unidentified
  source 1..936: mol_type = other RNA; note = synthetic construct
atgattcttcaatttttgagcaacttgctgaacctggaaaaacgcgaaattataaagttcatagccagcagtccataccggtataaggtgtactctatccccaagagaaagaagggcgaatttcggctcattagccagccttcctcacagttaaagttcatccagaaggcgacactggatcattttttctctgacctccctgtgcactcgagtgccatggcctacattaaaggcaaagggataaaagataacgcactaatgcatgcaggaaatgcctttatgcttaaaatggacttccaggattactttcccagcattaaacccgaggatttcgtgaatcacataaagtcttccagccaacttaggttctccgaagaagatgagttcgtagtttgccgactgtttttttggtcgcccgtgagaggtaagcctttggtcatgtccatcggcgcccctagttcaccattcatcagcaacacagttatgtatccgtttgacgagaaagtggacagttattgtaagaataatggggtcatctactcacgctacgctgacgacctagtcttttccacttgttccccgcagattctctctctcgtgccaaagttcattgaggagacaatccgcctcttgtcttatccaaagttaaagatcaaccgagagaagaccgtttttagctccaagaaacataaccggcacattactggactgacgatcaccaatgagtctaccgtgtctattggaagagctaggaaaaggtatgtgagtagcctggttcaccgttacactctgtcacagcttgataacgcacagatcgtctatctgaaaggctacctggctttctgctccgacgtggagatcacattcgtaaagaggctcgagaagaaatatggtgaatcagtcatcagcgaactgctgaaaaataccggcgggtga

SEQ ID NO: 11534 - RNA, 942 nt, unidentified
  source 1..942: mol_type = other RNA; note = synthetic construct
atgaacatactaaataaggtttcagagatgtctggaataccgcaagacatgtgcgctaaattcattatctctgcccctatgcgttataagaggtacgagatacccaagcgaaatgggtccggaacgagacttatcgcccagccttctaaaatagttaagcccctgcagaaaatctgtattgaccagctgcgcaaaactctgccaattcacagcgctgctctcgcctatgaagttggcacctcaatcaagaaaaatgcgaataaacatcgctacaatcgctacctgcttaaaatggacttcactaactttttcccatccattaagccagatgtattgttgagaacctttgaagagcacggcctagtgattacggaggaggataaattcgtgttgagctccctgctcttttggaagccccgtaggagagcgcccaacttagaactgagtatcggtgccccttcaagcccgtttattagcaacgccgtcatgtatttctttgatgtggccgtgaccgaacattgttctaacaggggcatcgtgtacactagatacgcagacgatctcacctttagcaccaacattgcagacacactgtttgagatcccaaatttcttatacgaccttgtccaacagactaatatgtcgttcctgaggtttaatacagacaagacagtctttgcaagtaaaaaggtgaataggcacatcaccggcgtaacaattacaaacgacgggcggctgagtctgggtcgcaaacggaagcggaagattagcgctatgattcatagattctcactccagcagctccgatccaacgatgaaataaacgagcttaaaggcatcctggggttcgcaaaacacatcgagcctatcttcgtccggcggatgtgcgataagtatggaaaggacactatcgtgaagatccagaagttcaactccgattga

SEQ ID NO: 11535 - RNA, 942 nt, unidentified
  source 1..942: mol_type = other RNA; note = synthetic construct
atgaatattctcgacaaaatttcggagctcagtggcataccccaggacatgtgcgccagattcgttgtgtccgcccctgtccggtataaacgctacgagattccaaaaagaaacggggggggaactcgtttaattgcccagcctagcaaatctgtaaagccactacagcgggtctgtatcagtgaactcagaggagtgctccccattcacggttccgctctagcctacgaggctgggaccggtatcaagcggaacgctaataagcacaggtataaccgatatttgttgaagatggacttcacaaactttttcccgtcaatcaagccagatgtgctgctgtccacctttgagcaacacaatgtcgcgttaacagaggtggataaattcgtgctttccagccttctgttttggaagccctccaggagcgagtctaccctcgaactgtctattggcgcaccgtctagtcctttcatcagcaacgcagtgatgtacttcttcgatgtggcagttacagaatactgtgaacgaaagggtataacatacacgagatacgcggacgacctggcctttagtaccaacactgcagacatcctgttcgaactccctaaattcctgaatgaactggtccagcagccctccatgtctttccttcgctttaacaccgataagactgtgtttgctagcaagaaggttaatcgccatatcaccggcgtaacgataactaatgacggcaggctgtcattgggccgtaaacgcaaaaggaaaatcagctcattaatccatcggttttcactgcagcaactgcggtgcgatgaagaagtgaatgagttgaaggggatgcttggatttgccaagcatatagagccaatctttgtcaggagaatgtgccagaaatatggagaggagattatcctgaagattcaaaagttcaacagcgattga

SEQ ID NO: 11536 - RNA, 942 nt, unidentified
  source 1..942: mol_type = other RNA; note = synthetic construct
atgaatatcctggacaaaatttctgaggtgtccgggatgccgcgaaccatgtgtttgagatttatcgtgagtgcccctattcgctacaagagatacgaaatcccaaaacgcaatggccggggtgtgaggctgattgcacagccatcaaagtctgtgaagcccctgcagaaggcgtgcatcggggaactgagggacattttaccaatccatcctgctgccttagcatacgaggtgggaacaggtattaaaagaaacgccaacaaacatcgctataatcggtatctcttaaaaatggacttcactgatttctttccttctatcaaacccgacgtcctgctgagcacgttggaacagcacaatgttgagttgacagaagaggacaagtcagttctgtcaagcctcctgttttggaaaccgactagaggcgattcaaacctggagctgtccattggagctcccagcagcccctttatttctaatgccgtcatgtactttttcgatgtaaccgtggaggactattgcaaacaaagggggatcgtctacactcggtatgccgacgacctattctttagcactaacgcctccgatatactcttcgatgtgccacgattcctaagtggacttgttcagaagcccaacctcgcattcctgaggtttaacaatgataaaaccgtctttgcttccaagaaggtaaacaggcatatcaccggcattacgattacaaatgatggacgactcagtcttggccggaagcgcaaacggaaaataagtagcctcatccaccgtttctccctccagcaactgacaaaccctgaggaaataaatgagttgaaggggcttctgggcttcgctaagcacatagaacccatcttccttatccgtatgtataacaagtacggtagagacaccatcctgaagatacagaagtttaactcggattga

SEQ ID NO: 11537 - RNA, 939 nt, unidentified
  source 1..939: mol_type = other RNA; note = synthetic construct
atgaacatcctgaatcagatcagcgagaaaaccggcatgcctaaacggctgtgtgcaagcttcattatcactgctccgaagcgctataaaaggtacgaaatacccaaacgcaacgggcgcggcgttagacttatagctcaaccagccaagtccgtgaagctgctgcagaggatttgcgtagaatcactgcgtaagagcctgccaatacaccaggcggcaactgcttatgaggtgggcaccggcatcaagatgaacgctaatcggcaccggtttaacaagtatctgctcaagatggattttgccgacttttttccctctattaccccagaagtgctgtttaatacatttgagtcacatggggtagagttatcggatgaaaaccagtacatcttaaagaacctactgttttggaagcctacgcgggatagttctttggagctgagtattggagcgccctcgagtccattcattagcaatgccgttatgcacgagttcgacagcaaggttaccgaattctgcgatagcctaggtgtgagatatacccgatacgccgacgaccttgtctttagcactaatacacctaacgtcttgttcgatctgccggaagtcctcggatctctcttatctgaaccctccctctcattcctccgtttcaactccgacaaaacagtgttcgcctccaaaagaaataatcgacatatcactggagtgacactcaccaatgacggaaggttgagtatcggtagaaaaaggaaacgccggctgtcttcccttattcacagatacaagcttgggcagttgaccgcatccaaggatatcgaggagctcaaaggtcatctgggctttgcaaaacacatcgaacctattttcatagccaggatgacgaagaagtacgggatcgagacaattcaatctctgcagaagttcaaatcagagtga

SEQ ID NO: 11538 - RNA, 948 nt, unidentified
  source 1..948: mol_type = other RNA; note = synthetic construct
atggagctcatcaacaagatcagtaccattactggcgttccgaaagggacatgcattagtctcatcgtgaccgcaccccgaagatacaagcggtacgagatccctaagcgtaatggttcagggacccgactgatagcgcaaccagctaaatccatcaaaacactacagcgggtttgtatcgagatcctgagggattatcttcctgtgcacggcgtggcaatggcttacgaggttggcgtcgggatcaagcgcaacgccaacagacaccgctatcaccggtacgtcctcaagatggatttctctgacttctttccaagcataacgccagaagtcctgctcaacactatatcccgccatggggtagtattgagcgacattgacaagatggtcctgacaaatctgctcttctggaaacccacccgtcataatgacaacctgcaattgtcaattggagctccttcttctcccttcgtgagcaacgccgtcatgttcttttttgatagcatgctgaacgaaaagtgtagacagttaggcattacctacactaggtatgccgacgatctaatcttcagcacaaatctgaaggatgtgctgtttgaggtgccgtctctgttgtccagagatgttttggccaacacggaattcaatttcttatgcataaacgagggaaagacagtgttcgcatccaagaggaataatagacacatcactggtgtgacaatcaccaatgacgggaggttatcaatcggtcgcaagcggaaacgggtacttagttcgcttattcacaaatttaccactggagaactgaaagaccctattgaaattatgaagctcaagggcctgctgggctttgccaaacatattgagcccatatttatccagaggatggccgtgaagtacggatccgaagtgattgagcagcttaaaaaatatccaaccaaaatctga

SEQ ID NO: 11539 - RNA, 933 nt, unidentified
  source 1..933: mol_type = other RNA; note = synthetic construct
atgtcgtaccttgaacagtttacggaaataacctcattatcctccgtggaaatcctgaatttcgtgaagagtgctccataccgctataaacaatactatatccccaaaaggtctgggcgtggagtgagattgatcgcgcaaccatctaaagaggttaagtacatgcagtatatcggcaagcagctaatcctcgacgaacttcccgtccacgcggctgcttatgcttatcagaagggagcaagtattaaagccaatgcctctcaacacgtatctaataagtaccttctcaaaatggacttctcggactttttccctagtattaaacctcccctgctgctcgacgtgatccagtctaaagtcggcacactgtccacccacgatacaactttgattaagaggttgttcttctggcaaagagagaggatttcccctctgcagctgtccataggcgcaccttcaagcccgctgattagcaacgtcgtgatgtatgatttcgatgagtttattcacgcctactgcagtgagagagggattaattacacccgctacgcagacgatctgagcttttcaaccaatgaacgcggattgctgttccatatacccgaactcgtttcatcttacctaacagaaaacgagcatttgggcctgtcaataaatagtggtaagaccaagtttagcagcaaaaaacataaccggcatgtaactggtcttgttctcaacaatgagaaccagctcagcctcgggagggaacgaaagcggaagatccggacactggtgtttctgttctcccagagcgcccttgatctggatgagacttatcacctgaagggcctcctagcctttgccttaaacatcgagccaaacttcatcctgcgattaagaagcaagtactcctccgagatgattgactctatctttcggtatcaggagtga

SEQ ID NO: 11540 - RNA, 933 nt, unidentified
  source 1..933: mol_type = other RNA; note = synthetic construct
atgagctatctggaaaatttcaccgaaatcacaagtcttggtagtcaagagatcctggacttcgttaaatccgctccccataggtacaaacaatataccatccccaaacggaacgggcgaggcgttagacttattgcccagccatccaaggaggtgaagtacatgcagtatattggtaaacagctgatattggatgaactgcctgtccattcagctgcatacgcatatcagaagagaaccagtatcaaggctaacgcaagccagcatattgccaataagtatctcctcaagatggatttctctgacttctttccttctatcaagccacccttactattgggagtgattcaacggcaggtgggcgagctatcggcggacgatattaccctgataaaacggctgtttttttggcaacgggacaggatgtcaccgctccagctgtctattggggccccctcctcacctctcatatccaatgtaatcatgtacgccttcgacgagtatctctactcatactgcgcgcagcgtggcatctcttatacaagatacgccgacgatctcagttttagcacaaacgagcgcgggctgttgtttcacattccagaagttgtctctaattaccttagcactaatgagcacctgggattatccatcaacaccaccaagacaaaattcagcagcaaaaaacacaaccgccacgtgactggcctcgtaataaataacgacgaccagctgtcactgggaaggaaacgcaagcgtaagatcagaacgttggtgtacttattcactcagtccgctctggaaactgatgaggtgtttcacctgaagggcctgttggccttcgcaagcaacatcgaacctgagttcatccttcgacttaagtccaagtttagtaatgaagtcgtggattctatttggaggtaccaggagtga

SEQ ID NO: 11541 - RNA, 936 nt, unidentified
  source 1..936: mol_type = other RNA; note = synthetic construct
atgcaaccatctaacctaatatgcaagaggtttatgatgagcaaagctgagctgtaccattacgcaaatacttgtccgcatagatataagacttactcgatcgataaacgttcaggtgggaagcggaaaatctcccagccttcaagggacttgaaggccgtgcaacggttcgtcctgtctgagtatttggagaagcgccttgtcattcattcttccgcaaaagcttatcgcgtcggggtgtctattgtggacaacgccaaggaacacgtcgcgcagaaatatctgttaaagatggatttctcgaactttttccccagcatcctatcctccgactttatgaagttgctccgcagggataagatcgttgattctgaagaggaggtgaaactgctctctaagatctttttcatgaacgacagtggctcactgagacttagcattggctcccccggaagcccatccataagcaatgccatcatgtacgatttcgatgaggtgatcagtaagaagtccatcgacaactctatcttctacacccgatactcagacgacataaccttttccacgaacgagaaagacatcctcttcagctggcctaatgttgtgagtgacgttcttcgaggaattgatttcccaaaactgaaaatcaacacagacaagaccaagtttagttcaaagaagttcaatcgccacgtgacaggcattacactggcaaatcaggggtatctcagtatcggaagagagaagaaacggctgattcgtgcccgggtacacaatgccatgaacctcgatgatgaagagattttaagcctcagcggtgacataagctttgcttgccaggtagaacccaatattcttgaaaaattgtggaggaagtaccctgatcagatgaatctgattctgagaaggaaagaaaaaaccaaccagctggaatga

SEQ ID NO: 11542 - RNA, 915 nt, unidentified
  source 1..915: mol_type = other RNA; note = synthetic construct
atgacagtcagtgaccttataagacgccgatttagcttcagcccagccgagttacgggtttacgcccagacatgcccttatcggtataaaacctacccgatagacaaaagaaacagccagcagaagcggtggatcagtcagccttctaaggacctgaaggcagttcagaggctcgtcttgtccgaattcctgggcccaaagctgactgtgcacgactcagcaaaagcctataaatcggacaccaatattttggataacgcggggccacacctaaagaaccgctacttgttaaagatggacttcagggatttctttcccagtatcagagcccaggattttgttcgctatctcctgggtagcggaatcgtgcaagatgaggctgaagctaatctcttggccaggatcttctttaagtactgcgacggtgagctgtgtctgtccattgggagccccggatctcctgtgatttccaatgctctgctatttcccttcgatgagaacatctctgacatatgtcagaaaaatatcgtggcgtatactcgctactctgatgaccttacgttttcaaccaacaccagagatttactcttcagctggcctcagaaggtggaggaggctctgaccgcactgcaatccccaaaactggaactcaatagggaaaagacagtattctcatccaagaagttcaaccggcatgtaaccgggattacaattactaacgacgataaagcatctatcggcagggacaaaaagcgggcccttagaactcgcatttacaatgccccgaatctgaatgaagaagagctggcccgactccgaggatatatctcatttgtcaaccaagtggagtccgatatgatcagtaagctttggaagaaataccccaaacagatgggccgtattctgcgtcaatga

SEQ ID NO: 11543 - RNA, 945 nt, unidentified
  source 1..945: mol_type = other RNA; note = synthetic construct
atgagcgatataattcaacggattaagcgccggttcgcattctctgatagtgagtttaatacctacctcaatactgctcctttccggtataagaactatactatcccaaaacgatcaggaggtgtgcggctgatcagtcagccgtcaaaggatctgaagagcatccagaggtttatactatccgaattcctgttacccaagcttgagatacacgagtgcgcaacagcctatcgtgaggaaagaaatatagcagataacgctagaccccatctgcagaatcagttcctcctgaaaatggacttcaaagacttttttcccagcattagagcaattgactttagccaatacgcgctgaggcgctcaatcgtcgagagtgaagaggaagccaccatgttgggcaaaatctttttcaagtccaccaacaatggattaagactgtcaattgggagtcctggctcaccccccatcagtaacgccgttatgatcaacttcgataagcagatctcttccatgtgtcgtgactcggggatcgcgtttacccgctactccgacgacctcacgttctcttccaactctaagggcatcctttttggtattcctaaccaggtccaggaggtactcgaagtgattcaacgcccaaaactgatgatcaacgccgaaaagaccaagttcagctccaaaaaatttaatcgacacgtgaccggcatcacaattacaaatgatggactaatgtccttgggaagacagacaaaaagaagggttaggtctgaggtgtacaacgcccctagcatgcaaccaaaggaacggcagcgactccgcgggtacttgagctatgccaaacagttcgagccgagctttgtgataaaactgtgggagaagtacccagcccagatggctcttattaagaattctgctttcactaagaggaacggcgaccctcagtga

SEQ ID NO: 11544 - RNA, 957 nt, unidentified
  source 1..957: mol_type = other RNA; note = synthetic construct
atgggtgctggcgaaagggtggttacaatcatagatcacatccaacatgaattcggcttttctagaaacgagctggtcgcctatgctggcacgtgcccacaccggtacaagacctataacatccgcaagcggaatggggatccacgaaccattagtcagccaagcaaagatcttaaggcagtccagcgatttattgtgagtaggttcttcgaggaccagtttgtgattcatgaagctgccaccgcatacagaaaaggcgtgagcatcgtcgacaacgctaaaccccacttaaatagctcctatctgctcaagatggactttaaaaacttcttcccttccattaagagtgacgatttcgtaacatacctagttgagatgggaatctacgaggacgaagcgaggatattgagccgtatattctttaaaaaggagagggacgaactggtgttatccataggcgccccttccagccccattatcagtaacgctctgctacacgaattcgatgaacgcgtcgcacagtattcgaaggaacggtcacttaatttcacaagatactcagacgatatcactatctcaaccaatgtggagaatgtgttgtttgacgtcccgaactacataaatgagcttctgggggatattcgactgccccggctcagaatcaatgaggagaagactgtattttccagcaagaaattcaaccgtcatgtgacaggtattactatctctaacgaagggcaggcatctctgggacgcagcaagaaacggcgcttgaaagccgcggttcattcagccgataaactgaccgagatcgagaggtttaaactcagaggacgcctcgcctttgctaagcaggtggaccctaagtttattgagcttctgcacgccaagtatcccaagcagatctctctcattaattctgcccaatgggcatgggacctgtccgatttcctgtga

SEQ ID NO: 11545 - RNA, 942 nt, unidentified
  source 1..942: mol_type = other RNA; note = synthetic construct
atgaagcctacgcagatactcaagaaagagctcttcttggcagatatcgagttaaagaggtatgtgagcagctgcccccggagatacaaacggtaccctattgacaagaggtctgggggcaagcgcatcatcgcgcaacccactcccgacctgaaggctgtccaacgtctgctcgtcagtcagttcttagagaaatgtcttcaggttcacgagtgtgccatggcttatcaggtgggcaaatctatcgtggacaatgcgaagattcactcaaaaaattcgtacctgctgaagatggattttaaggacttctttccatctattcgcagtaaggacctttgccacctgcttgtggcccaaggtcacctcgatcagggcgacgaaatcgaattgcgaactatttctagagtcttctttatgctggaaaacgacgagctggttctttcagtaggggcaccctcatctccgttcatcagtaacgcactgttgttcgaattcgatacaatagccgacgagtattgcaaggagcatgggattagcttctcacgatactccgatgatctcaccttcagcacaaatattaaggacgccttgtttgctgtgcctggatttataaaagaggccttaaaggccatggaatatccaagtctgctagtaaatgatggaaaaacagtcttctcctccagggctcataaccgccatgtgaccggcatcaccctgaccaacgacggaaaactgtccatagggcgtaaaaagaaaagatcaatccggacacaggtgttcctgttttccgcgtctagactgagcactcaggaagcccggtccctccagggttacatcagctttgccaggagcgttgatgctgccttttacagtagcctactgtccaaatatccagtggcaatggcacagctcgaggccgctaactttggcgaaattaattga

SEQ ID NO: 11546 - RNA, 951 nt, unidentified
  source 1..951: mol_type = other RNA; note = synthetic construct
atgcggcccaaagacgttttgcgtcagaacctgtttatctcagggtcagaactcgaccgctacctgtcctcctgcccgaggaggtacaagcattataagatcgataaacgtgggggggaaaaagactccaaaagacccattagccagcctacaccagaactgaagggtttgcagaggaccctgctggatgagttcctgctggagcggttgcctgtgcatgaggccgctatggcgtacaagaaggatactagtatcgcagataatgcgaaggtgcacgcccggaatccgtatcttctcaaaatggactttgagaacttttttcccagcatcaaaagcttcgatctttgttctctgttaattgacaccggcaaactagacaaggacgaccagctggatctccgcattatatctcgcgtgtttttcatgcgagagggcccagaactcgtcctttctataggcgccccaagtagccccttcatatcaaatgcaatgctgtttaacttcgattccatcgtaactgagcactgctcaagcctgaacatttcctactctcggtatagtgacgacctgacattctcgacaaaggagaagggaattttattcgacatccctacattcattcgcgagactttaaagctcatcaaatatccaaagctgtctgtcaacgaaaagaagaccgtgttcagttccaaagcacataatagacacgtaaccggcgtgaccctctcaaatagcggcgaaatctccctgggtagatctaaaaaaaggtcgcttcgaacgcaggtctatttgttcagcaggggacaactcctacccaaggaggctgccgccttgcaaggatacattgcatttagcaactctgttgaacccaaatttgtggagtccctactggaaaagtaccctgaggccatgagagcccttgctgctgctagatttagtctcgatgattga

SEQ ID NO: 11547 - RNA, 921 nt, unidentified
  source 1..921: mol_type = other RNA; note = synthetic construct
atgagtcttatcgagcagctatctaagcgcaccaacctccctctggatagcatccagaagtatgcgaagacatgccccgtgcgatacaaggtgtattccattccaaaacgcaatggtaaaggctttagagtaatcgcccagccttctgcaccagtgaaagccttacaacgggagttggtgtcaattctggaagattacattctcgttcatgaatgcgctatggcatatagagaaggcgtttccatttttgacaatgccagcaagcacaaggataacgactacttgttgaaaatggactttaaagacttcttcccttcaatcgacccagcgacggtgctgggcttaataatgtctcagtgtccagtggcagaaaaaagcgataccctttatctgctgagtattctctgtcgcaagcccagaggaagcgatcgttttattgtctctataggcgcaccgtcttcaccttttatcagcaatgcctacatgtacgtgtttgacgatatcctgtccaagctgctagtcgacaaggggatctcatacacacgttatgccgatgacttgactttctctactagaaagaaaggggctctgttcgaggttcccgctctcgtcaaaaaggtgctggtagattcgggataccggaccattcgggttaacgaggagaaaacagtgttctcctccaagaagcacaaccgacatgtcactggactggtattaaccaatgacggtagggtgagcctcgggcgcagcaagaaaagggaaatcaggacacttatattcaaatacctgcacggcgagctgtcgaagccggaggtcgagtccctcaaggggcttgctagtcacgcccggcatatcgagcccgaattctgggaaaggctgaaaagtaagtatggaatagatgactccttctttaaactctga

SEQ ID NO: 11548 - RNA, 963 nt, unidentified
  source 1..963: mol_type = other RNA; note = synthetic construct
atgctaaatagtgctctgattacttactttagcgttaagaccggcctggataagagtgtgtgtctgcatgtggctctaagcgcacctaaacggtacaaagcctacagcattccaaaaagaaatggcgagatgaggaccatcgcccagcctacacccgttgtgaagcacctgcaacggctggccctgaggctttttgacggcaagctgcctattcacaaagctgccacggcctatcgcaaaggaagctccatcgtcagcaatgtaagccctcatctcggaaactctttcattcttaagacagacttcaactcatttttcaactcaatcaaaccgcaggacttggacctccttgatctggggggaactattggcctgaaatcggaggaagtgtatatcttaaagcacctgttcttttggttgccaaagggggcatccgatttttgtctctccatcggtgccccctcaagccccatgctgtcaaattatttgctctttcagatcgataccaagatctataactattgcatcgagcacaatattgagtacacccgctactctgacgacattaccttgtccacagacaaaaagttcatactgaaggacgcgtacgattgtattaatggtatatgcactcgcacatcttcgccctctttagtgatcaatcaacggaaaaccgtcttcacttccaaaaagcataagcgttttattacgggactggtgatcagtaatgatgaaaagatctccttaggcagggaaaaacgacgactgataaagtccattctattcaacttcgtaaacaacaaggaaacaactatacagagtctggagcagcttaacgggctcttggcattcgccgcacacatcgaaccagagtacgttatgagactctgcaaacagtacgaggcgcacctctctcatctctatgataagggggtctttcttatcagatatgcttctaagtga

SEQ ID NO: 11549 - RNA, 936 nt, unidentified
  source 1..936: mol_type = other RNA; note = synthetic construct
atggtaatcgacgagatcctcaaaaaaattatctaccctcggccgatgttggagtatctgatcctcacagcgcctcgaaggtataaggtgtacgacatcccaaaaaggaatgggaaagggtctaggactatagctcaacccaccaaactgatcaaggctattcagcgcgagtgtatcgaatatttatccaagttattcccagtccatttcaccgctactgcctacgtcaaaggaaagtcgataagagataatgcactcaagcacaaaaacaatcggttcctgctgaagatggacttcaagaacttcttcaacaacatcactgagtatgactttaggaaatacatccagaagcatcgcacggactacaatatcagctggacggagaaggattgcgaagatctatgcaacatcttcttttggtgtcccaagaatacctataaaagaattctgtcagtgggcgcccctagtagtccctctctgtctaatattctgatgtacgattttgacgccatcatctacaaatactgtagtgaaaacgacgtggtgtatacaagatatgccgatgatttgaccttttcttgcaataaggcatttaagctaaaggacgttgagaagtatgtgactgatatcagcaaagccatagattcaccaacccttgtaattaacgaggacaagaccgttcatacatccaagaaaaagaatcggcacgttacaggcattacaattaccaatgatggccagctctcactcggttacaaacgcaagattgtcctgaagagccttatacacaagtacgctaacaacgagctggacgaaaatagcatattgtacctgaagggaatgctgaacttcgcaacttccattgaacccgactttattcagcgtatgaaaaacaaatacggtgaagatacagtgtccgccattcttcgatattga

SEQ ID NO: 11550 - RNA, 912 nt, unidentified
  source 1..912: mol_type = other RNA; note = synthetic construct
atgctgctggagctaatcagtaaatccacgcttatcgaaaaagatcaggtgctggatattgccaataaggcgagcataagttatgccaggttcaccataccaaagaaagacggatcacagcgtttgatttatcaaccgagtatggccatccgggccctacagaaagtggtctacgatgaggtgctggataagctgccagttcacgatgcatgctatgcatacagaaaaaaacggtcactcaaagaccatgctaacgtgcacaagaataataactacttactgcgaattgacctgaaggacttttttgagtccattacccgatccgacattgagaaatactgccatgagtccattagtaaggttttcccccatttcaacgaagaggattttaaactcatgacaaacatcatctgcagaaaggatactatcacaatcggctcagtcacctccccttcactgagtaatagcatatgttatacgctggatgaaaggatttctcgcttggctaagtcgcacggtgtcaagtatacacgctacgctgacgacatgttcttcagcactagcaacaaaaacgttctttgtatcatccagaagggcgtgtccgggatcattaaaggattagaataccccacccttaccatcaacaaaaaaaagactaagcacagtagcaagaaaaatagaatgagcgtcacaggcgtagtgatcactctcgacaagaaactgagcataggtagaggaaataagcggtttattcgcgaacaagtatataagtggtcttctttgtcttccgaggacaagtcctatctctctgggtacctcagcttcgtgaagtctatcgagccttcatacatcaataggctgtgtaacaagtacagctctcagaagatacaggaaattcttaggttttcgtga

SEQ ID NO: 11551 - RNA, 912 nt, unidentified
  source 1..912: mol_type = other RNA; note = synthetic construct
atgctcctcgaactgatttccaagaatactcttatcgaaaaagaccaagtgctggatatcgctaataaagccagcactttgtacgcacgattcacaattccaaaaaaagacggctctgaacggctcatttatcaaccgtcaatggcgatccgtgccctgcagaaggtggtgtatgatggagtcctggacaaacttcctgttcacgacgcctgttacgcctacagaaagggtagggggttaaaggagcatgcaaatatccaccgcaactctaaatacctgttgcggatcgatctaaaggatttttttgagtctatcacccggagtgacattgaaaagtattgcaatgagtatgtgagcaaagtgtttccaatcttcaacgaaggagatttcaacctaatgattgacatcatctgccggaaaaacacaattacaatcggctcagtaacttcaccttccctgagtaactcaatttgctacaacctcgacgagaaaattagtagactgtctgatagttacggggtgaaatatacgcgctacgctgatgatatgttcttttccaccaccaacaagaacattctcaagataattcagaaggaggtgagctccataatcaagaagctggactaccccaaattaacgataaataacaagaagacccgacatagcagtaagaagaataggatgagcgtcacaggggtcgtcataaccgtagacaagaagctgtctataggacgcgataaaaaaaggttcattaggggccaggtttataattggaagaatctgtcgatcgaggaaaagtcctatctgagcggttaccttagcttcgtcaaatctgtggagccctcctacatcaacagactttgtgacaaatattcatcccacgttatccaggagatcttgagatttagctga

SEQ ID NO: 11552 - RNA, 924 nt, unidentified
  source 1..924: mol_type = other RNA; note = synthetic construct
atgatcctggaagagattcagaagaggacttttctcgatatagactacattcgatccatcataaaccggagcaactctctgtacagcaagttttacatcttcaagagagacgggtctaaaaggtggattcatcatcccaagaaggaacttaagcttatccaacgagtggtaaatgataacattctcgacaagctgaagatccacccatcatcaacagcttacagaaggggatgttcggtgaaaaagaatgcgctactgcacgttaacaatgacttcttactgagaatggactttaaaagctttttcgattccatttcctacgatgacatcgagaacttcctcgataaagaatttagcattagcgaaccgaattggacttattccgatacaaaattgctggctaaactgctctgctataagaactccctggtgatgggtgccgtgacctctccttgtatcagcaacgccatttgttataagctggataaaaagctgtccgggttgtgccagaaccacaatgttatatacagtcggtatgcagatgacctgtatttcagtacctctgagcgtaatacactttttttcatcgagaaagaggtcctaaagatagtcgccaatctggagttacctagtgggcttaccatcaacaagaataaaaccttccactctagccgcaaaaggaaaaaacaggtgaccggcttaattctgactcatgacaagaagttgtctatcggtcgcaataagaaacggacagtcaagagtaaagtgcataactgggcaacgcttaacgagaatgaaagatcatacctcagcggctatatttcctatattcactcaatcgaaccccagttcatcaaccgcctctgcctgaaatacggcgccgacctcgtaggagagatcatatcatacaatagtaagttgtga

SEQ ID NO: 11553 - RNA, 939 nt, unidentified
  source 1..939: mol_type = other RNA; note = synthetic construct
atgaagcttattctcgacgttatacattccaagacgtttcttgaggtggactacattatcattctgctgggaaaggtgaacagtttatacagtagattcagcattgacaagaagaatggttccgggcggagaaccgtctatcacccttccaaagaacttaaagccgtgcaaagagttatcaatgatcacatcatcacgaaactcgatacacacgacgcatgtaaagcttataagctggggtgcactactaagaaaaacgccgagccacatctgaattctcgcttcttgctgcgtatggacttcaagtctttctttgagagtatcgaatacaaagatgtgcataagttctgtcaggagtttatcaagaagcactttattgagtggacagacgaggacagtgagatctttagcaaattcgtgtgctataagggccgactcgtgatgggcagtgtgacctcgcctgccctgaccaatgcaatgtgcgttgggttagacaatctgctgtacgaaaaatgcgaatctattggagtaaagtacagcaggtatgccgatgatctctacttttcaactgacgctccaaacatcttgaagaagctggagaaggatgtgtacaaaatcgtcagctctttgaaaatacccagctccctgaagataaactccgataaaacataccactcaagcaggaaacgacgcatgatagtcactgggctcgtgatcacaaattctggaaccatctcagttggccggggcaaaaaacgggaaatcaagtccctagtcttcaactgggaatctctagatgaggagtttaagaaatacacctccggttatctgagctatattaagtcagtcgaacccgaattccttaataacttgtgtctgaagtacggcgcggagaaaattagggtggtaatgacctataaccagtcactcaagatttga

SEQ ID NO: 11554 - RNA, 921 nt, unidentified
  source 1..921: mol_type = other RNA; note = synthetic construct
atgttacttgagctcatcaaagccaaaactctgctcgacgaagattacatcaaagaaacgtgcctgaactcaaatgcattatactcaagcttctacctccctaagaaaaacgggaagcttcgaaaaatataccatccacacaaggagctgaaggccttccagcgaattctccatgataacgtgttggcttactccaaagtgcactcagcgagcatggcctatagttccggctcctcaatcaaacgtaatgccgagagacatagcgagaagaaatttctgctcaggatggactttagaagcttctttgagagtatctcctctaaggacgtgttccagttctgtgaaaaaactctttctaatcagttcagtggatgggatcgcttcgatagcgacatgtttaccaatttcgtttgctacaagaattccctggtaatgggtgctgtaacctcgccctccatagctaacctgatcctgtatgaatttgacgacagtttgagcacgttctgtagtagcattggggtcacctatacacggtacgcagacgatatgtacttttcgacaaacaccagaaatgtcctaaaggaggtcgaaaggcgggtgtataaaatcgtcgagaagctgcaattacccaacgacctgaaaatcaacacctcaaagacatatcactcctctaagtcccgcaggcggctagttactggattggtgctgacttgtgaaggctctgtttctctgggcagaaaaaaaaagcgcgaggtgcggtctttgatttttaagtgggatagccttacagatgaggagaagcagagcctgtctggatatctctcttacgcaaagtcaatagagcctgactttattaataggctgtgcatgaagtacggttccaatattgtgaagaacgtgctcgaatatagtccagaatga

SEQ ID NO: 11555 - RNA, 921 nt, unidentified
  source 1..921: mol_type = other RNA; note = synthetic construct
atgttaattaagctcatctccgaaaaatcattgatcgacgaggattttattcttgatttcgctaacaagcaacaagtgaactatttcaagtttcagattgagaaacgcacaggtggaatgaggacaatttatcacccgagtaaggaactcaaatacatacagaagatactgctggacgacgttatatccagccttccaatccacaattgctgttacgcatatgttaaaaacaggaacatccatacgcatgctatacagcacaaaaacgctaaatatcttctaagactggattttcgcaatttctttgagtccatttcatacaaagacatctatgagttctgcgagacaaccatggggatatataataaagggtggacctcctcagatagtgaaatctttagtaagctcgtgtgttacaaagataggttaaccatcgggagcgtcacttcaccctctctgtcgaacgccatctgttacgatttggacattaagttaagccagctggccctttccaagtctgtcaaatatacccgttacgcagatgacatgttctttagtacaaagatcaaaggtgtgctgtatgcactgcagaatgacatcaacaatatcatctctaccaatacactgcctagcaaattgaagctgaatctggaaaagactcatcacactagcaagaaacggaagatggccattactggcctggtgattacgaatgacggaaatatatctctcggcagaagaaagaagcgagagattaagtctaagatttacaagtgggacaccctgagcactgatgaacggacatacctcagcggctacctggcgtacatcaagtccgtagaacccgagttcattaacaacctatgcgataaatacgacgccaacttgatcctcgagattatcaagttcaacaccaaatga

SEQ ID NO: 11556 - RNA, 942 nt, unidentified
  source 1..942: mol_type = other RNA; note = synthetic construct
atgttactcgaattaatcagttcacttacgttgctggaggaggaatacatactaaatatagctcagacctcttcccagcgctacaagaagttctacatcaccaagaaaaatggcaatttgcgggcaatctaccatcccagcaaagagctaaaaggcatacaaagagtcattcataatgagctgctgcagaagttgccgacacacccagccagtgcagcctataaaaaaggctgctccatcaagaagcacgccgagcagcacaagaaaagcaaatatctcttgaggcttgacttcaagaattttttcgaaagcatctccgagattgatattcgctgtttcgcgaataacaatatcattggcgttattaaagggtggagcgaagaggacactaaactgctggtggaactggctacttttaaaggaggactcactattggatcaatcacttctcccctcctgtcggacgcactgtgttatcagctggatattgccctattttccctgagccatgagctgggggtcacatacacacgttatgctgatgacctctatttttcaaccaaccaccgaaatacacttaaaaagattccttccaacgtggatactataatcaaggaacttgaataccctaagaaactgaagattaactacagtaagaccaaccattcatctaaaaagaacaggatgatggtgaccgggctcacattgaccaacgatttcaaagtatccatcgggaggtccaagaagagagagattcggagtaagatatacaaatggtctgaactgaacaaagacgataagctgcacctgtcaggttaccttagctatatcaagtctgtggagcccagcttcatcaacaccttatgcggcaagtatggtgccacgattatccaaagtatcatcagatttaacagcaaaaaggacccaaatctcaagtcttga

SEQ ID NO: 11557 - RNA, 927 nt, unidentified
  source 1..927: mol_type = other RNA; note = synthetic construct
atgttgttagagatgatttccaatttgaccttgcttgagaaggaatatatccagaacattgccaaaacagctagtaaaagatacaagcgtttcctcattcctaaaaagagtggaggaaatagggtgatttatcatccaagtaaggagctgaagggcatccagcgcgtgatacatgaggaactactccagaaactgcctattcatcttgcatcggcagcctacaataaaggatgctccatcaaaaagcacgcggagcagcaccggaaggccaagtacctgctgagactggattttaagaacttctttgagagcatcaccgaaattgacatcaattgcttcgttaacaacaagttcatcgatattttcgatgactggtctgaagaagacacgaagcttctcattgacctgactactttcaagggtgggctgactataggctcaattacaagcccactgttaagcaacgccatctgttaccagcttgacatagcactgttttctttaagccacgagctggaggtcacatatacccggtatgctgatgatctgtacttttcaaccttccaccgagatgtgctcaaaaagatcccgtctaaagtggacatcattataaaagaactcgaataccccaaaaacctaaaggttaacaataacaagaccaatcactcctcaaaaaagaacaggatgatggtgacaggtctgacgctgaccaatgactttaaagtatctatcgggagaagcaaaaagagggagatccgctctaaaatatacaaatgggtggacctcaaccaagatgacaagcttcaactcagtgggtatttgagctatatcaagtcagtcgagccctcctttattaatactctgtgtggcaaatacggcgctaaggtcatacagcagatcatcatcttcaactccaagaatatttga

SEQ ID NO: 11558 - RNA, 924 nt, unidentified
  source 1..924: mol_type = other RNA; note = synthetic construct
atgctgctcgaactgctgtctcgactcacgatcctagaagaggagtacatattgaatatcgcacaaacgtctgctcagcggtacaagaaatttcacataaagaagcggaatgggacactgcgcgctattttccagcccagcaaagaggtaaaaggatttcagaggatcatacacgatgaagtccttaaacgccttccatcacatccagcctcggccgcctataaggaaggtagcagtatcaagaagcacgccgagctgcacaaacgttcgaagtacctgctccgcttagacttcaaggacttcttcgagtccatcagtgaacatgatatcagaaagtttgctagcgagaatctcactggcaaaattaaagggtggacagacgaggacaccaatttgttggtgaagctgtgtacctttaaaggcggacttacaattggcagcataactagccccctcctgagtgatgccatttgttacaatctagacgtggccttgtattctctgtcccatgagctgggcattacctatactagatacgcagatgatctttatttctccactaacaaatctggggtgctgaaaaaaatccctgaacgggtggaagagattatctcccgactggaatgcccgaacaagctcaaaataaacaagtccaaaacacaccactcatccagaaagaataagatgaaagttaccggactgaccattactaacgacttcaagatcagcatcggtagggagaaaaagagggaaattaggtctaaagtctttaattgggatggattaagtcccgaggagaaggctcatttatccggctacctgtcatatattaagagcgttgagcctgcgtttatcaacaacctctgcacaaagtacggggcatcaatcatcaaggaaattaccgtgttcaactctaagaagtga

SEQ ID NO: 11559 - RNA, 924 nt, unidentified
  source 1..924: mol_type = other RNA; note = synthetic construct
atgctgcttgaactgattagtaacattaccatcctggaagaagattatatcctcaacgtggcacagacatcctctcagcgctataagaagttctacatccccaagcgtaacgggagcctcagagctatcttccagccctctaaggagctgaagggaattcagcgcgtaattcacgacgaagtcctgaagaaactccctagccatactgcttcctcggcttataaggaaggctcttcagttaagaaacacgctgagcaacacaggaaatccaactacctgctgcgattggatttcaaggacttctttgagtccatcagcgaccatgatatacggaaattcgccaatcaaaatcttgtggagaagatcactggctggacagaggatgacaccaacctattaatcaagctggccacttttaaggaaggtctgaccatcggaagcattacgagtccgctccttagtgatgcaatttgctacaatctggatgtagcgttattttccttttcacatgagctagggatcacctacacaaggtatgccgacgacctctatttttccaccaataacaggggcgttctgaaaactatcccatcaaaagtggaggacgttatatctaatcttgactacccaagtcagctcacgatcaatagatcaaaaacataccatagtagcaagaagaacaaaatgatggtgacaggattgactctgaccaatgactataaagtctcgattgggcggaccaaaaaacgggagatccgaagcaagatttacaactggtccgcattggatctggaacagaaacaccacttgagcggctatctcagctacataaaatctgtggagcctgcctttataaacaccttatgtacaaagtacggtgccaatgtgattagagagatatcagtcttcaattctaacaagtga

SEQ ID NO: 11560 - RNA, 930 nt, unidentified
  source 1..930: mol_type = other RNA; note = synthetic construct
atgctgattaacctcattagcaaactggtcctgttagagaaggaatacatcgtcagcattgccgacacagccagcagacggtacaagcggttctttatcaacaaaaagaatgggaagctccgcgccatctatcatcccgcaaaagaactgaaagctatccagcgggttatccacgacgaagttctaaagaaactccctagccatgaggccagctgcgcttataagcagggttgctcagtgaagaaacatgccgaaatgcacaaaggggctcgctatatgctgaggatagacttcaaaaatttcttcgaatccatcagaaccgaggacatacgtcacttcgcagataagaagatgatgagttatatcgaaggctggactaaggctgacacagagcttctcgtgaaacttacatcttttcaggaagggctgactattggatctattacctctccgctactgagtgatgcgatctgttacgacctcgatgtatcagtatttagtcttgctcacgagttgggcgtgaaatataccaggtacgccgacgacttgtacttttctacgaacaaaaaaggagtgctgaagtccattccccctaagattgaggcaatactgttagatctgaagtgtccacataacctcaagattaacaccgcaaaaactcaccactcctccaagaaaagtaggatgatggtcactggcctgaccatcacgaatgataacaatatctccattggtcgcacccgaaaacgagagattagaagccaaatatacaattggacatcactgaatgatgaggataagaagtacttgtcgggctacttgtcttatgtgaagagcgttgaaccagagtttatcaacgccctttgttgcaagtatggcgcgtacaagataaaggagatcatcgtgttcaactcatccggaatcaattga

SEQ ID NO: 11561 - RNA, 918 nt, unidentified
  source 1..918: mol_type = other RNA; note = synthetic construct
atgattttactgaagtacttagcaaaggaactgttgctcgacgagtcttacatcgaagagcttgctaactcagccagcaaccattacaaaagctttaccatcccgaagaaatcagggggcgataggctgatcaatcagccttctcgagagctgaaggcgctccagcgcaccctgcatgataacatactgagtaagcttcccatccatgattcagcattcgcttatagggacgggcaaagtattgataaacacgctaaggtgcacttatcagccagatacctgctgagactggacttcaaggacttctttgaaagcatcaaggcgcacgatatttaccgatttatcaacaaacacggtatcaacctactggacaattggagtgagctggacacaaagttgttggtggacattgtgtgttacaaacagaaactcacaatgggctccgtcacctcccctattcttagtaatgccatttgcttcgccttggacaagcagctcgaaaaaatctgctatatgcatgacgtgaagtacagcagatatgccgatgacctgttcttttctacatccaaaccaaatgtgctccggaagatcgaaaaagatgtattcaatgtcgttgcagctctaaacgagcccgaaaagctgaaaattaaccgcaagaagacgtatcactcttctaagaaaaataggatgtcggttactggaattatactgaccacagatgggaacattagcataggaagggataataaacgcaaagtccggactatggtgttctcctggaataagctcgatgttgtagagaagcggtatcttcagggttacctcagcttttgtgcctccatagagccagagtttatcaactccctttgcaataagtatggcgcagacaaaatcactgagatccaacgttataactga

SEQ ID NO: 11562 - RNA, 918 nt, unidentified
  source 1..918: mol_type = other RNA; note = synthetic construct
atgattctcttggaatatcttgctagggagctgatcctggataaaggctatatcaaggacttggccataaattcctccctgaactatatttccttttcaatccccaaaaagtcagggggtgagcgtattatacaccagccatcacgagaactgaaagcgctacaaagagctctccacgataatctactcaaaaagctacccatccacgagagcgcatttgcctacagaaaagggaaggggatcgatcagcacgccaaggttcatttgagtgcccgatacctgcttcggctggacttcaagcagtttttcgagagcattaaagctaaagacatcacctcctttatcaataagaataaggacctgctgcttagcggctggactgatagtgatacaaaactgctcgtcgatattgtgtgctacaagcataagttgacaatgggatctgtcacctcgccaatcctgtcaaacgcaatttgctttctgttagacaaggaactggaaaagatatgctacttaaatgacgtcaagtattctcggtatgcagatgacctcttcttcagtacctctaagcctaatgtgctgaggaagattcaaaaagaggtttttaagatcgtgagcgagcttgacgaacctggccagctcaaaatcaacgtaaacaagacctatcattccagcaaacggaacaggatgtctgtgacaggattgattttaacaaacgacggaaaggtcagtgttggccgctgtaacaaaagaaaggtgcgcactatggtgttcaattgggatacgcttgatgaaaaggacaaattctacctgcagggttacctgtccttctgtagcagcatagagccggagttcattaactcgctctgtaataaatacggctctgaggtaatcgtgaaaatccagacttacaactga

SEQ ID NO: 11563 - RNA, 924 nt, unidentified
  source 1..924: mol_type = other RNA; note = synthetic construct
atgaaattactggatcacctgtcaagttccctcctgcttgacaaaacctatatcatggaactggctgaaactgcgtcgcaaaggtacaagcagtttagcattcccaagaaaacaggaggcttcaggtcaatccttcaccccgccagggaactgaagacactacagcgcattattcatgaggatatcctcgtcaagctgcctattcacaatagtgcatttgcctacagaaagaagctcaacatcttcgaccatgcaaatgtgcacatcggtgcctcctacttactgagaatggacttcaaaaactttttcgagagcatttcctcaaaaaacatcgcgaagttcttggactctaaagccaattatctgctcaaagactggaaagctgaagatactgagctgttggtgaagctagtgtgttataaaagcagcttaacaataggcagtgtttcctctccgacgctcagcaatgcaatatgttatgaactcgacgaggccctgcacaagctatgctatgtaagagggatacaatacacccgttacgctgatgatctctatttttccactaacgagcctaacattcttaactcgatccagaataacgtctacgaaatcgtgaacagtctgagcattccagacaagttgcggataaactcctctaaaacccatcattcaagccggaaaaatcgaatgagcatcaccggtctgattcttacaaattccggggatgtttcaatagggcgagacatgaagcgcaaaattcggtcccttattttcaaatggtgctctctggatgtgaaggagaagaagtacttggccggctatctgtctttttgtgcttctatcgagccagagttcttgaatagtctgtgcaagaagtacggagccgacatcatctacgagatccagaactttatgaataagtga

SEQ ID NO: 11564 - RNA, 912 nt, unidentified
  source 1..912: mol_type = other RNA; note = synthetic construct
atgttaattgagcacttatccgacacactcattctgacgaatgatttcatcaacgatctggcagatactgcttccaagaactacaacaaatttagtgtcccaaaaaagaacggcgggacaagggtggtataccagccaaataaagaattgaaactccttcagagggtgattcacgatgatttcctgaagatcctccccgtgcatcctgcctgttccgcctatctggacggcgctagcgtgaaggaaaatgctgagagacataagaataacaagtacctcctccgcatagactttgtagacttcttcaaaagcattacccataatgacatcttgtcatttctaatcgagaacaagatccaccctcaatggaacgataacgacacggaactcctgctgaaactggtttgctataatggtagattaacaatgggctcagttaccagtccaatgataagcaatcttgtctgcaataaactggacaaagcaatcgagtctatttgtaacatccaggacataatttactctcgctatgcggatgatatttacctctccactaacacaccgaatattctgggaatgatgcccaagaagatcaccaacatcttgcgtaaaatcgactatcccaaacaccttataatcaataccagcaaaacacaacactctagcaagaaaactcggatgaccattaccggactgaaaatcactaatatggggaccatctcaatcgggcgggagaagaagcgagaaattaggtccctggtgcataaatgggacactttgcccatagagaagaaaaagtatcttcagggttacctaagttattgtgtgtcggtcgaacctctgtttattaacgccctgtgcgagaagttttctgccaagataatcaagaagattcagagttacaagttctga

SEQ ID NO: 11565 - RNA, 912 nt, unidentified
  source 1..912: mol_type = other RNA; note = synthetic construct
atgcttattgatcacctatcagatagtctcatccttacccataatttcatcaatgatttggccaacactgccagcaaaaattataacaaattctctgtgcccaagaagaacggcggaaccagggtggtgtatcaaccacataaagaattgaaactgctccagcgggtgattcacgatgacttcctgtactcccttcaggtgcatccagcatgtacagcatacattgacggctcatccgtgaaaaaaaatgctgagaaacacagacataacaaatacttactcaggctggatttcgtcgacttctttaaatcgattacccacaatgacatattgctgtacttaatggagaacaagattcacccccagtggacggacgaggatacagagatctttctgaaactcgtatgctataacgggcgccttactatgggagcagttacgtcccctatgattagcaatctaatttgcatcaagctggataaggctatcgaatcaatatgtagccccctgaacattacatatactcgctacgccgacgatatatatttgtcaaccaacacagcgaatatcctcgggctgatgcctaaaaagatcatccacatcctgaggaccatagaataccctaaaaacctgatcatcaatacaagcaagacacaacattcttccaagaagacccggatgatcattaccggcctgaagattactaatgacggtgagatttctataggtagagacaaaaagcgtgagatccgatctctggtctataagtgggacagcctcagcattgaacagaagaagtacttgcagggatatttatcctactgcgtaagtgttgaaccgctctttatcaacgctctgtgtgagaagtttagtgccaaggtcatcaagaagatacagacttacaaactgtga

SEQ ID NO: 11566 - RNA, 912 nt, unidentified
  source 1..912: mol_type = other RNA; note = synthetic construct
atgctgattgagcacttaagtgattctctgatcctcacagaaaatttcatctgtgaactcgccgacactgcttcgaagaactataacaaatttagcgtaccaaagaagaacggagggaccagagtggtctaccagccacataaagagctgaagctgctgcagagagtcattcatgatgatttcttggtgaaaatgcctgtgcatcctgcctccacggcctatcttaaaggagcgtctgttaagaacaatgccgagaagcacaagaacaataaatacctactgaggctagacttcgttgattttttcaagtccataacccataatgacattctttcctttatgatggagaacaaaatccaccctgactggaacgagtatgacaaagaaatctttctcaagctggtgtgctacaacgggaggttaaccatgggcgcagtgacatcacccatgttatcaaacctgatctgtaataagctggatcggattattgacagcatctgctctcaacagaacataacctacacccgatacgcagatgacatctatctcagcaccaatacagctgggattttgggcagtatgccccagagaatcattaatgtactccgtctcttggagtacccgaagcaccttatcatcaattcctctaaaactaagcactcaagtaagaaaagcaggatgatggttacaggattgacgatcactaacactggcaatattagtataggtcgcgacaaaaaacgggaaatacgcagcctggtctataaatgggatcagctgacaatagagaagaagaaatacctgcagggttatctgagctactgtgtgtctgtggaacccctttttattaattcactctgcgagaagttctccgctaagatcatcaagaagattcaatccagcaaactgtga

SEQ ID NO: 11567 - RNA, 912 nt, unidentified
  source 1..912: mol_type = other RNA; note = synthetic construct
atgcttattgaacacctgagcgagaacttgattctgacaaagcaattcatccttaacttagcagattcatcatccgactgctacaataaattctcagtgccaaagaagggtggcggaacacgggtgatttaccaacctaataaagagctgaaactgctgcagagggttcttcatgacgattttctaacgaaaatgccagtccataacgcgtgcacagcctatagagatgggtctactgtgaagctgaacgccgagctgcacaaggataaaaaatatctactgcggctggacttcgtcaatttttttaagagcatcacacacaacgatatctttctttacctgcaggaaaacaaactcagccccaattggatagatgatgacaccgagcttttcctcaagctcgtatgttataaggggcgactcactatgggagcagtgacctctcccatgctcagtaatcttgtgtgtgaaaagctggacagagctatagaggggatctgcaaccatgacgccctcacctactcccgttatgctgatgacatttacttaagcactaatacccctaacatcctgtctcaggtaccgaagaaagtgattgctgtcttgagaaatctcgagtaccctaagaatctgatcataaacacttccaagactctgcactcctcccagaaaaggcgaatgttggttaccggcttgacaatcaccaaccagggaaatattagtattggtcgcgacaagaaacgcgagatccggagtctgatccacaagtgggaggccttaccaacggacaaacgcaagtatctgcagggctatttgtcgtactgtgcatcagttgaacccctgtttataaacagcctctgcgaaaagtactctgccaaactaatcaggaagattcagagctataaattctga

SEQ ID NO: 11568 - RNA, 912 nt, unidentified
  source 1..912: mol_type = other RNA; note = synthetic construct
atgctgatagagtaccttagcaaatccctggtgcttacccccgactttattaaagaaatcgcggatacggccaatgagagatacaacaagttctctatcccaaaaaagaatggcggcaccagggtcatctaccaacctcaaaaggagttaaaagtgttgcagcgctcactccacgatcactttctgaagaaagtccctactcaccaggctatttgtgcttaccaggaaggaagcagcataaagaagcacgccgagctccattcaaagaataattaccttcttcgcctcgactttattgacttcttcaagtcaatcacttctaacgatattctgcattatctgatggagcataaactacattcggaatggactgaaaacgatagtcagttgctgctaaaactggtgtgctttaagggacggctcactatagggtccgtgacaagtccactgctgtctaacttagtctgcaatcacttggaccggtgcatcagtgagatcgccatctcgagaggcatcacatacagccgatatgcagatgacatctacctctccacctccagcaaagacattctgttcgatatgccgaagaaaataatttccgttctgcggaacattaattatcccaagaacttgatcctgaactcaacaaagacaattcactccagtagaaaaaagaagatgaccgtaacaggtctaatcataacgaatgataagaccgttagcattgggaggaaaaagaaacgtgagattcgatctcttgtgcataaatgggacgtgctgaccttagagaaaaagaagtatctccagggttatttgtctttttgtgcagggatcgaacccctgttcatcaacagcctgtgtgaaaagttctctgcccgcaagattagggacatccagaaacagaagctctga

SEQ ID NO: 11569 - RNA, 918 nt, unidentified
  source 1..918: mol_type = other RNA; note = synthetic construct
atgttattaaattacctctccaacaatctggtgctgactccggagttcatttcaaatatagccgatactgctaatgaacggtataataagttcagcatctctaaggataacgggaaaaaccgggtcatctatcaaccccagaaggaactgaagctgctgcaaagggttctacatgacgatttcttgcgacggattatccctcacccatgttgcactgcttacaaagatggagcttcaacatacaaaaacgccatccagcacattgaaaatcggtacctgctcaggctcgacttcgtggatttttttaagagcataacctccaacgatatcttcctgtttctgaaagagaacagctccaagttgcatccagagtggacagaggaagacaatgagctgttcctgaaaatagtctgctataaaggacgcctcaccatgggttccgtcaccgccccaggcgtgtctaacctggtttgcaaagccctcgattaccgaatctccgacctatgtgcagctagagggatcacttatacaagatattcagacgacatgtacttttctacgaacaaggaaaacatccttcttaacctcacccccgagattatcgccatcattagaaatattgactaccctaagcaccttataataaattcaagcaagaccaagcacagctcccgcaaaaggaaaatgagtgtgacgggccttgtgattacaaacgacaagaagatttctttgggtcgcgacaaaaagagggagatcagaagtctggtgcacaagtgggataatttggacagcaagcgtaaaaaacatttacaggggtatctctcgtattgtgcaagtgtagagcctctgtttatcaacagtctgtgcattaaatttggcgcggcaaccatctctaagatccagaagtacattccctga

SEQ ID NO: 11570 - RNA, 954 nt, unidentified
  source 1..954: mol_type = other RNA; note = synthetic construct
atgctcatcaagtatctgtcagataacctagtcctcaccaccgattttattcaggagctcgctaacactgccgacgatcggtacaacaaattcagcgtgcctaaaaaaaatggtgggacacgtgtgatctaccaaccccagaaggagctaaaactcatccagagggttctgcacgacgacttcctgaaaaagataatcgcacaccctgcctgcagcgcatattgtgacggttcttctgtgaagaaaaacgctgaaagacataaaagcaacaagtacctgctgcggttggatttcgtcgactttttcaagtccatcacaagcaacgacgtcttacattttctcgccgacaataagcttcataacgattggacaacacacgatacggagctgttcctgaagctcgtgtgttttaaaggaaggttgaccatgggcggcgtaacttccccaatcctgagtaatttagtgtgcaacaatttggatgtggcaataaatgacatctctatttcccttggcattacgtactccagatacgccgacgacatttatctctctaccaataatccgaacatcttgttctgcatgccaggaaaggttatttcactgctacgatccatcgagtaccctaactatctgatcctcaacactaagaagactaatcactcaagcaagaagaacaaaatgatgattacagggctgattcttaccaatgatggagaagtttccctggggaggaagaaaaaacgcgagatcaaaaccttagtatacatctgggaaactctttctattgaaagacgcaaatatctgcaaggctatttgtcctattgtgctagcgtggaacccctgttcataaatagtctgtgcgagaagttttcggcgaaaaagataaaggatattcagagctacaagtttcagtcttcgaattcaagtgtccccagtaagatacttaccaaatga

SEQ ID NO: 11571 - RNA, 915 nt, unidentified
  source 1..915: mol_type = other RNA; note = synthetic construct
atgctgatcaagtatctctctgataaccttgttctgacgactgctttcatacacgaactcgctgatactgccgacaacaggtataataagtttagcatcccaaagaagagtgggggaacacgggtgatctaccagccccataaagagcttaagctgatacagcgcattctgcacgacgattttttaaaaaagatccctgtccacccagcctgtaccgcgtactccgatggatcatccgtgaagaaaaatgcagagaaacataagcacagcaaatacctgctccgcttggacttcgttgacttctttaagagcatcaccagtaacgacatttactacttcctgtccgagaataaactgcattctaattgggtcaaagaggacaacgagttgttcttaaaattggtgtgttttaagggccggctgacaatgggcggcgtgacaagtcccattttgagtaacctgatatgctacgaactagacatagctattaatgaactctctcagtccctcggggtgatttactctcgatatgcagatgatatctatctttcaaccaacaatcctaacattcttttcaatctgcccgcaaggatcattaagatcctcagatctgtgaagtacccaaagaacctgatcttgaatactaaaaagacagttcacagcagcaaaaagagaaaaatgattgtcacggggctgaccatcaccaacgataatcaaatctccattggcaggaaaaagaaacgtgaaatcaaaactctggtgtacttatggaagggtcttacccctgagaagaagaaatatctacagggatatctgtcatactgcagcggtgtagaaccgtcgtttattaacgccctctgcgagaagttttcagccaaagtaatccaggacatccagcaatataagataaactga

SEQ ID NO: 11572 - RNA, 927 nt, unidentified
  source 1..927: mol_type = other RNA; note = synthetic construct
atgctgcttaagtatctgtctgagtctctcatcttgaccgcggattttataactaacctcagtaacacggctgacgagaggtataacaagttcgggatcccaaagaaaaatggaggaacgcgagtagtgtatcagccccaaaaagaattgaaacttctgcaacgcgtgctacacgacgactttttgaagaagattaacgtgcatattgcctgcacagcctattgtgagggctcctcggtgctgaaaaatgccaatatacataaggagaacaagtacctgcttagactcgacttcgtcgattttttcaagtcaatcacttccaatgacatccggctttttctgaatgagaaaaagggcgaattctccgattcttgggatgacctcgatagtgacctgtttcttaaattggtgtgtttcaagggacgtctgaccatgggcggtgtcgcaagccctatgatcagtaatctgatatgctacaagcttgatctgctgattaacgaactctgtctcagcctcggcgtaacatatagcagatacgctgatgatatgtacttcagcacaaatacacccgatattttgtttacaatcccgaaaagagtgatctcaatactgaggcagctcgactatcctaaaaagctgattctaaacaccaataagaccaagcacctcagcaaaaagcgcaaaatgattatcaccgggctggttatcaccaacactgggactgtctcattaggccgggagaagaaaagggaaatccggtccctggtttacaaatggaacattctggacgacaaaaagaaaaagtacctgcagggttacttatcttactgcgcaagtgttgaaccattattcattaacgctctatgcgagaagttcagctcccaggccatctctgagattcagacctattgtcccccttcaacttga

SEQ ID NO: 11573 - RNA, 915 nt, unidentified
  source 1..915: mol_type = other RNA; note = synthetic construct
atgctgacagagtatctcgcctccagtctcatattgacaaccgattttatcagggacgtggcagataccgctgacgaacgctataacaaattcgggatcccaaagaagaacggtgctacgcgggtggtgtaccagccgcagaaggaacttaaaatactgcaaagggtcctgcactctgagtttctggtaaagctgaaagttcattcgtcttcaactgcctatagtgacggaagctcagttataaagaatgcgaacctgcacaagaacaaaaaattcctgttacggctggactttgtggacttcttcaaaagtatccgatcatccgacattcgtctgtttttgaacgagcggggtagtgaactctctgatcagtggaccaacgacgattctgatgttttcttgaaactggtctgcttcaaggggagactgactatgggcggagtgacaagccccgccatatccaatctcatttgctataagctagactccgcattatctgagatctgtctttccctgggggtgacttactcgcgctatgccgatgatatgtatttttccactaacgtgccaaatgtcctgtttagcatgcctaatcggcttatcaaaatccttagatctatcgattaccctcgctccctctacattaacaccgagaaaactaagcattcctcaaaaaagcgaagcatgaaaattacaggcttaaccctaaccaataacggagaagtctcactcggcagggagaagaagaggagaatcagaagccttgtcttcaactggagtaatttgacagtggacgaaaaaaagtacctccaaggctacttgagctactgcgctagcgtagagcccctgttcattaattctctgtgtgagaagtttagcagcaagattatcacgaatattcagaagtacaagtga

SEQ ID NO: 11574 - RNA, 918 nt, unidentified
  source 1..918: mol_type = other RNA; note = synthetic construct
atgctgctggattatttatcctcaagtcttgtcctgactaatgagttcgtgtcactgatcgctaatacttctgacgagcggtacaataagttctcaatcccaaagaagaacggcgggactagagttgtctatcaaccccagaaggagctcaagctgttacaacgggtgttgcatgacgatttcctgagtaagatccctcttcactctgcctgcaccgcctactgtaggggcagttccgtgattaaaaatgcaaacatgcaccgtggtaacaagtttctgcttagactcgactttgtcaactttttcaagagcattacgtctaacgacatattcaactacctgaatgagaatcgcgacaaactcgacggccactggacaaacgaagatctcgaactgtttttgaagatcgtttgctacaaaggtcggttgaccatgggatccgttacctccccggtaatctccaatctcgtgtgctctatgcttgatagtaagctgcaggccgtctgtgtgcccctaggagtcacatatagcaggtatgcagatgacatgtacttttcaaccaacgggaagaatattttgttcgatattccatcacgagtgattggaatcatccgaactctgggctaccctaaaggcttaatactgaacacatccaagactagccattcgagtaagaagagaaaaatgtccataacagggctggtaatcacaaatgacgggaaaatttctctcggaagggataaaaaacgcgaaatccgcaccctggtgtatatgtgggacagcctcacggtgaagaaaaagaaatatttgcagggttacctgagctactgtgcttcggttgagcccctatttattaacagcctttgcgtgaaattcagctctgcggtgatcagcaaaatacagtccttcaccccttga

SEQ ID NO: 11575 - RNA, 930 nt, unidentified
  source 1..930: mol_type = other RNA; note = synthetic construct
atgctcatcgagtatcttgctaaggtcttactgctagaagccgatttcattctgaaggtagcaaatgacgccaactcccattacggcaaattctctgttccaaagaaaggaggaggcacccgtattgtctatcagccatctaaggagctcaaggttctgcagcgactgttgcacgacaatgttctgagcaaactgcccatccaccctaacgcagtggcctaccagcagggctcttcagtctttaaacatgccagtattcacaaggctaaaagattcatgctcaagatggacttcgaagggttttttgatagcatcaaaaagtcagacgtagagcgcttcattaatgacaacaagcacttctttagtgacgattggagcaaagatgatacggacttattggtgaagatagtgtgctttaatgggagactgacaatgggggccgtgtcctcccctgtagtttctaacgcgatatgttacgagcttgatcatatcctaaatgagttctgtttgtcaaagggcattacctacacaaggtacgctgacgacatgtactttagtaccaacgaggagaacgtgttaaagcaaatcccgccctttcttcggtcaaatctcaaaaacctgaaatatcccagtaagctgtggatcaaccggaaaaagactctccacatgtcgaagaaaaataaaatgatggtgacaggtgtgactctgactaccgatggcggagtgtcccttggtagggataagaaacggatggtcaagagccttatttttaagtgggaagctctcgacgagaagaaaagactgttcttgcagggatatctgagctattgcaaatctgtggagcccctcttcataaataggctgtgcgcaaagtacagctccgaactgatcgatgaaatccaacgctatcagcctgtcgtgtccgaatga

SEQ ID NO: 11576 - RNA, 978 nt, unidentified
  source 1..978: mol_type = other RNA; note = synthetic construct
atgcttctggaattcatcgcccagcacctgatcctgacgcccgaatatattctgacagtcgcaaatacagctagcaagaggtataaagagtattacattgacaagagagacggaactaaacgcctgatccatcatccttcgaaggagctcaaaagtatccagaggtgcatcaaccaagggatcctccctcggctccccgtgcatcattgtgctgccgcttacaaaccgggggccaagttgattgatcacgttacccggcacaagaactccaaatatctactgaggcttgactttaaggatttttttcacagactgaccgacatggacatcatgctgtgcctcgatgagtacaagcattttcttccgtctgattggaatgtgctagactccgatttgctcatcaaattggtatgtcgatatcacaagttaacaataggagctgcaacctccccaagcttgtcaaatattctctgtttcaagctggacacccagattcagaccctctgcgatcacctcggcgtcgaatacactcgctacgccgacgatatgtatttctcaaccataaagcccaatattctttatgacgtgaggtctagtgtttataatatcgtgaacagcctgaaataccccagcaacctgctgttcaacaaccggaaaaccaagcacactagcaaaaaacaccgtcgagtgatcactggcctggtggtaactcctacggcgaagatctccattggtagagataagaaaagagacattcgcagcaagatttataattggaatggtctgagtgtcgccgaaaaatactctctgaagggctacctgagttactgtaattctgttgagccatccttcataaactctttatgcgataagtacacagcgggaacaattaaccttatattgaagtacgacgaatcagctgaggccccaaagcctaaactattatcaccaatcgaggcaatcgcagcctccgcctga

SEQ ID NO: 11577 - RNA, 936 nt, unidentified
  source 1..936: mol_type = other RNA; note = synthetic construct
atgataagagagaggatggcctcagccatcggagtgacaatcgaatacatttcaggactggccaacggcgcaagccatgcgtataaaacttaccgcatacccaagagagacggaaggctaaggaccatacatcacccatccaagcaactgaaagcgctgcagcgctggctgctccagaatgtaatagagaaccttcccgtgcacagcgcagcttttgcctacaagaaaagcacctccatgtttgacaatgcaagagcccatagcaagaacaggttcctgctgcgtattgatctgaatgactttttcccttccattaccgataccgatgtacgccggtttatccaagaccgggccaccatgttcgaaggctggacaaacggcgacatcgacgctttttgtaagattatctgcagaaatggtcacctcaccatcggagctcctaccagtcccgccatcagtaatgttctttgcttcgacctggattcagccctatcctctttggcaagtaaattaggtgtcacatatacgcgctatgctgatgatcttttcttttctacaaaccaggcgggcgttttgcgacccttgcaggaaagcgtcgagcagacagtgcgggtcgctactctcccaggaaatctggccattaatcatggcaagactcgtcacagctcgaaaaagaggttacggcgcgtgactgggatcgtgattgggagtgacgggaaagctcacgtgggccggggagtgaagagaaagattcgtggtatgattcatagattcgactctctcaacgatcaggatcgagcatctctggctggcctcatcgcttatgtcatcgggttcgaccctgccttcctgaactctcttgtgactaaatacgggcacgcagcagtttcccgagcccggtttccaacgaggccgtcaggtgtcaatgtgaactga

SEQ ID NO: 11578 - RNA, 912 nt, unidentified
  source 1..912: mol_type = other RNA; note = synthetic construct
atgatggtggacaagatggccctggacctaggcctgacccgaaaatttgtggctaatttttcacggggagcgtcacacgcctataagttctacaccatccctaagagaaacgggggcgagaggcctatccaccatccatcgaaacaactcaaatccatgcagcgctggctgctggcatacgtgatcgaacccctcccagtacaccctgctgcaaccgcttacaggaagcatcggtccatactcgacaatgcccgtgcccacgcggcatccaagttcctgctccggatggattgcgagaacttttttcccagcatcactgaggacgatgtgctcttgtacattcagcagcgaccaagcttattcccggggtggactgccttcgacatagaggtcttctgcaaacttatctgtcgcaatggtagactgaccattggcgcccctacatctccgggaatttccaacgctctatgttatgaaatggattctgccctggccgatctgggcctcaaaaggagcgtcaactacacaaggtatgcagacgacctgttttttagtgcatcaaagcctgatgttttgcgcccacttcagagcgacatcgagcaactgataacagatcttgaacttcccggggggctcaaaatcaatccagccaagactcggcactcaagtaagcgagggagaagaagggcaacgggaattgtgctgggttctgacggccagcctcatattggtcgcgccctgaaacgcaaggttagaagcctgattcacggagtagattctttggatcccgccgctcgtcagagtttagcgggcttagtcagctacgctattggattcgaccccgatttcatgaactccttggttatcaagtatggccatgctgtgatgcagaaagtgcggttccccacatga

SEQ ID NO: 11579 - RNA, 939 nt, unidentified
  source 1..939: mol_type = other RNA; note = synthetic construct
atgatgctggaacaaatggctaacggaatcggtatccctgtggtgtttatcgagaatttggcgaacgcagcttcctacgagtacaagacttatactattaggaaacgatccggcggtctacgcacaatccatcaccctagcaggcggctcaaggccctgcaaagatggttactggccaacgtcattcagaattttcccgtgcatctcgccgccaccgcatatgctccagggaggtccatcttcaaaaacgcctctgttcacgctactagccgatacctgctgcgcatggatttcactgatttcttcccaagtattacgcagaatgacgtacgttcgtacgtgaatacaaacacccggtttttcgagggctggaatagtaccgacgtgaacgcgttttgtaatctcatttcaagaaacggtgtgctcacaataggcgctcctaccagccccgctatcagtaatgcactttgttatgacttggacgcaaggctcgagctgttttgctccaagtctggggtcacatacacaagatatgccgatgacttattcttcagcgccgatcggtctggaacccttcgccagattgaagaaggcgttcttcgaattgtgtcagaactggagatcccgagatgcctggtcatcaatagggccaagacgagacactcttcaaaacggggaacccggagggtgaccgggattgttctaggcagtgacgggaaacctcatatcggacgcacactgaagcgtaaaataagagccagcattcaccagtttgctgccctggatgacgccggtaaggattccttggcaggacttatagctttcgccgtagggtttgatcccgacttcctgaacagcttgatcaagaagtacggcctcgcggcagtccgcatagctatgaaaaagccatcagcaaagactggcgggaaacccctgtga

SEQ ID NO: 11580 - RNA, 1026 nt, unidentified
  source 1..1026: mol_type = other RNA; note = synthetic construct
atgactactgaacttggcctcacgtgggagttcgtggctaatctggcagggtccgcctcctacgaatacaagaagttcatcgtcagaaaaaagtctggaggcctccgcgagatcttccaccccagccgtaaactgaaggcagtgcagatttggttgctgcgaaatttactgggccaactcccggtgcacgagagtgcaaccgcctatcggaccggaatatccatatacgataacgctacaaggcataccaaaagccgatacttgctgcgcattgaccttgagaattttttcccctctattcgcgattcagatttcagtgcgtatgtggacagtaatcaggaaaacttcaaggggtggactgaaatcgacaaagccattgtgacgtccctgatgttccggaacggtgagctaacaatcggggcacccacaagtcctgcgctgtccaacgctctgtgctttcaactcgacgtgcagctctcaaagttagcaaataacaggggtctggtctataccagatatgctgacgatttgttcttctcgtctatcaaaccaggggtactgagcagcgttcttgacgaggctcaatccatcatcgacgaactcccaattcccgccactcttaaaattaacagagcgaagacacggcatagctctaaaaagggaaggaggcaggtgaccggcatcgtgttgggatcagacggaaagcctcatatctcacgaacatttaagagaagcataagaagcatggttcacaaattcgatctgttacgcgaggatcagaaggtggccttgccaggtatgatatcatttgtagccggcgaggagcccggctttctgaacagcctgattaccaaatacggctttgaactgattgcccgtgtcactaccatccagtctcttgctgaacggcagcgcatccacctacctaaggttaaaccatcccctccgaagaaagtcagggccaagtctagtacccaggttctctttgatacactgcggaatgccgggtttgatgtcgacgactga

SEQ ID NO: 11581 - RNA, 912 nt, unidentified
  source 1..912: mol_type = other RNA; note = synthetic construct
atgatcattgaaaaaatgtcagccgagctgtcccttccactcaaatacgtggacttccttgcactgacagcttcacaccagtacaagcagtacaccatccctaaaaggacaggcggagagcgcatcattctccaccctagtcgtaaattaaaggccctccaaagatggctgctgagtaacgtaattgccgtgtggcccgtgcatcctgctgccatggcatatcggcccggggtttctatttttgataatgccaacatccacgtccagtctcagtatctgctgcggatggatatgacgaatttctttccttcaatcgaggtccgggatctggttgcttttatggcaaagcgcccaaccttatttcaagactggactgatcgtgataagagctacttcgcaaggctggtgttccggcacgggaagctcactgttggagctccaacgtcccccgcgctcagcaacgcactgtgcttcgaactagatagcgccttagccggtattacatctgctcagggggtggcttacagccgctacgccgacgacctatttttttccgccaataagaagcaggtgctgatcagtatcgaagccgaggctaaagctgtgttgggtgagatcaagattccggctaatctctctctcaaccaggccaaaaccaagcactctagcaaaaggggggcaagacgcgtcactggcatagtactgggaagtgacggcaaggcctatgtgtcacgagataccaaaagaacaatccgaactttggtgcatcagttggacacccttaaggacgaagagagaataaggctggccggccttatatcctatgtctcgggcttcgaacccgcgttcctgaacaatttgattctgaagtatggagcagacaaagtcagctccgcgaagcaacatacctga

SEQ ID NO: 11582 - RNA, 921 nt, unidentified
  source 1..921: mol_type = other RNA; note = synthetic construct
atgtctatagttgactcagcggcagccagcttaggcgtatcgcgggacaaaatcctcacattggccgatcaggctaatcatagttacgtgacctattccattccaaaaaagtcagggggagagcgtgagattcaccatcctagcaaacccctgaaagccgtgcagcgctggtttctcagacggtggataagcctcctgcctgtgtctcctcttgctactgcttatgagccaggaagctcagtgttgaagaatgccctcgtccatgagggcgccaaatacgcagttcgcattgatctgcaagacttttattggtccatttccagcgatgacttccgcagctatttggcgaccgtgccggcaggagcagagattgattttggggacgtggaaacagtagcagcactgctgttccggcacggccgtttaacagtcggatccccaacatctccctcgctgtcaaacagaatgtgccgaaagctggatactgaatgtgaggcactagccgttaagatcgacgccagatacagtcgctatgccgatgacatgtacttctccgctacccacccagggatcctgtccgctatcgagagttcactggaatccatcttatccggtctggacacgcctggttctctacgaattaacaagagcaagacgcagcacttcagtcagaagaccgggatcttcgtgactggacttgtcatcggctcagacggtaaggtgtacctcgggcggagacgcaaaagggaaatccgagcgctgatccacaatttggaatctctggaccttgatgctaggagacggcttgccggcaaaatatctttcgctaggagcattgagcccgcttttgtcaacgccctcataaagaagtacaccgtcggcaggtttaggtctgccagtaggcccgatagcgccggctga

SEQ ID NO: 11583 - RNA, 927 nt, unidentified
  source 1..927: mol_type = other RNA; note = synthetic construct
atgctgatcgagttgctttcacagagactcctgttaccagagaaatatatctccaacttagcagcgggtgctagccaccactacaagacctactatgtgtctaaaaggagaggcggggccaggctcattgaacatcccagcaagcaactgaaggccgtacagaggtggcttgccgcaaacataatctgccactttcctgtacacgccgccgccaccgcgtacaaaagcggagtcaatatcgccgataatgccaggaggcatgctagttcctcatttctggtgcggatagacctgcaggactttttcccttcgctgcgggctgtcgatgtgaaaagactggcggagacttcccttgtgttcgtgcctgggggcggacagtggagctctgacaatattgacgtgttcgtttgtttgagttgcaaggacgggcggctcactatcggcgcaccaacaagcccacccttgtgcaacgccctttgttatcatctggatctgcagctgacagcatttgcacagcagcgcgaactcacttactcaaggtatgctgacgacctggtgttctctgcgcgggctccggaccaattacgcggagttcccgctcaggtagccgctaccctcgaaaacctggaggtcccacgtggcctgaaaatcaacacgtccaagacatggcacgccagtcgacgaggtcgcagaaaattgacgggcgtggtgattacatcagatggaaagctgagtgtgggccgccagctaaagcgtcgattacggactcttgtttaccgccattataccctggataaaacccaaaagaagaatctcgcaagatggttggcacacgttagaagcattgagcctgaattcatcaattccctaattctcaagtacggggctgatcgggtcgtcgatgccatgcaaccccattctggttga

SEQ ID NO: 11584 - RNA, 942 nt, unidentified
  source 1..942: mol_type = other RNA; note = synthetic construct
atgctgattgagctcctgagcaagactagcaatgtgccagaatcaaaactgttgtcacttagcctcacagcgagccgccgttataaagtttataccatccctaagagaacgggcggggatcggttgatcgagcacccttcgcgcgaactgaaggctattcaacgctggatagtgcaagctctcttcgcacgcttcccagtccatgaggccgctacagcgtacaggaaaggcactgggatcagagagaatgccgaaagacaccgccagtccaagttcaccaatcgttacgactttagtaacttctttcctagtttttcccaggacagggttctccattatgtatctgagcagagtaaaaacttggggatagacctcacccagcgagatctggacttcgtgggaaacattgtgtgccgtcatggccgcctaaccataggtgccccctcaagccctgccattagtaacgcaatgatgtttgaatttgacagccgaatgcacgaagcctctcagtctcgaggactggtgtttactcggtacgccgatgatattttcttgtcctctttcgaacccgggaagctggagggcctggaagcactgatcctgaagtccaagagggatatcccccacttacggctcaggcttaatagacagaagacagcatatctgtcaaagaagtactccaggaaagtgaccggaattgtcattacaccgcagcacacgttatccattggcagagaaagaaaacgggaggtcaaggctctcatccatcagtggatcaaggggggcatcgaacccgagcggttctactatctgaaaggtcttttcgcattcgccatcgacatcgagccacaacttgaggctaggttaatggagaagtacggaaaagagaaaattcagctgctacggtctgccgattttgactttccaatcggtctgatatga

SEQ ID NO: 11585 - RNA, 942 nt, unidentified
  source 1..942: mol_type = other RNA; note = synthetic construct
atgctgatcgagctactctctcgtacagctaagatccccgaagctaagttagtcagtctggcagagtcagccagccgacggtacaaggtgtatacgatacccaaaaggaccggaggggaacgagttatcgaacatccttctagggaattgaaagctattcagaggtggatagtgagagcgctgatcagccggtttccactgcacgagagcgcaactgcctaccgaaagggaaccggcatccgggagaatgctgaaagacaccggaagaccaagtttaccaaccgttacgacttcgccagtttcttccctagcttctcccaagctcgggtggtacagtatattggggagcaggccaaagccgtgggcatagatctctccgagagagatttggaatttatcggcaacatcgtgtgtcggaatgggaggcttactattggagcaccctcttcgccggccattactaatgccatgatgttcgaatttgacagaagaatgcacgaggactgccacgctaagggattagtctatacgcgatacgcagatgatctgttcgtttcctctttcgaacccggtcaacttgacggcattgagaaagtgatcgtcaaaaacaagcggggcataagtcatctcaggctgaggctgaatcatcagaaaactgcctatctctccaagaaataccgccgcgttattaccggggtagtcataacacctcagcacacactgagcatcggtcgcgagcgcaagcgcgaggtgaaagccctaatccataagtggattaagggcgatatcgacccaacaaacttttactacatgaggggtttgttttcatttgccatcgatattgagccagagttcgagaaaagactcgcggaaaagtatggggcggcacgcatccgtcagcttagatcagcagaccacgacttccctattggactgatttga

SEQ ID NO: 11586 - RNA, 942 nt, unidentified
  source 1..942: mol_type = other RNA; note = synthetic construct
atgctgatcgagttgctgtctcgcacatcgggcatcccagatgagaggctgttgcgcatatccgccacagcctcccaacagtataagttgtacaccgtgcctaaaaggaccggaggcgaaaggcttattgagcatcctagtagggaactgaaagccatccagagatgggtgatacgagcgctcattaatcggtttccggtccacgatagtgctacagcctacagaataggctcaggtattagagaaaacgccgagcgacaccggacgtctaagtatactaaccgttacgactttatgaatttcttccccagctttaggaaggagcacattagcatattcatcaaggaacagagcgacattattgggattgatctgagtgaacgagacatagatttcatcgctaatatcgtatgccgcaacggaaggctcaccattggcgctccaagcagccccgcaatcaccaatgccatgatgtttgcattcgacaagaagatgcacgacgcatgtaaatccagagatctcatttttacccggtatgctgacgatattttcatttccgcatcagaagctagaaaactattcaacatcgagaatctgatcatcgacagcaagcgtgatatccattacctcaacctgaggatcaaccataaaaagactgccatgctttcaaaaaagtaccaccggtctataactggggtggttatcactcctcaacatacgctgtccatcggacgcgaccgcaaacgcgagattaagagtttaatccacagatggatcaatggtcagattgatgcggagaaaacagagtacctaaagggccttttttcttatgctatcgacattgaaccatccttcgaaacacggttaatcgacaagtatggggcagatatcataaaatcactgagatctcccgagaatgccattaacaccaaccggagctga

SEQ ID NO: 11587 - RNA, 978 nt, unidentified
  source 1..978: mol_type = other RNA; note = synthetic construct
atgcttattgatcaaatcgcccggtcaagtcagctagaggttgatgagctggtgcgcctagcacaaaatgcatcccagcactataagctctataatattcccaagcgaaacggtgagccccggagaattgcgcacccgagccgtgaactcaaggccatccagcgctggattgtgaaagtgatcatccagaggtttcccatacatgacgctgccacagcttacaggacaggagggggcattcgtgaaaatgcggagcggcaccgcatctccctgtacactaataggtatgactttgcaaacttcttccctagctttaaacgggaacaggtccagagttttatacaatctgagtccgagaaagtcggacttttgctctcagacgacgatgccgactttgtgggaaaaattgtgtgtcggtatgacaggttaactatcggcgcccctagtagcccttctattaccaatgccatgatgttcccattcgatcagatcctcttcgattactgcgtcaagagggatttgatatatacaagatacgccgacgatatcttcatctcggctaacaaaagcgaccagttaaacaacctggaagtgcgtatcgccgatgcgaaaaggaaaatccctcacctgagcattcgacttaacagacaaaagaccgcatacctgtccaaaaagtaccatagatctatcacgggtgttgtaataacccccgatcataaattgtccgttgggagatcacgcaagcgcgaaatccgggctctggtccaccgctggataaatggcaagctggacccaatcgaggtgtcttatatgcgaggcctgattgccttcgctagggacattgagcctaagtttgaagtagcactgcgagctaagtacggcccgcagcggatcgaggaaattctcagaagaccagacctgaccacaactcccgggtggccaaaggaggggaataacgatgacgatgtgccattctga

SEQ ID NO: 11588 - RNA, 966 nt, unidentified
  source 1..966: mol_type = other RNA; note = synthetic construct
atgttaatccagcagatcgccaggaccactaaactcgacgaacaagacctcagacacctcgcagcgtctgccgatcgtcgctataaagtctacctgatccccaagcggggacatggccacaggaaaattgaacatcccagcagagagattaaagctttgcagaggtggatcacaaaggtgatcatcgatcggtttcctgtccatcatgcagccacagcctaccgcaaggggaacggagtgcgggaaaacgcagagcggcaccgaaccagcaaatataccaatagatatgacttcgctaacttctttccaagcttcgggcaggctcaagttgagaacttcgtgaagcaggaagccgaaaagctggggatgctgttcgacaatgacgatttacgttttgtcggcaatatagtatgccgattcggaaggctgagtatcggcgctcctagttcaccagcgctgaccaatgccatgatgttcgactttgatcgcactcttttcgattggtgtcagtccaaagagctgatatacacccgctacgccgacgacctctttatttcggctaatgagccggaccgacttaacaagttagagccacttatagctaaggccaaacgcgacgtggctcatctcacgcttagactgaacaggaggaagactgcctacttgtcaaagaaatacacccgactgataacaggtgtgattattacaagcgatcacaagttgtccattggtcgcgaaagaaagagagagatcaaagcgctggttcaccggtggctcaacggcaaactggaggccggagagatctattatatgcgggggctactggcatttgccagggatatcgagcccgagtttgaaaagaatctccgttctaagtacggtgatgcagctattaatgaagtgctaagacacccctccctgggcaaggcaccagatcctgagttccagttgcctccgtggctgtga

SEQ ID NO: 11589 - RNA, 930 nt, unidentified
  source 1..930: mol_type = other RNA; note = synthetic construct
atgctgattgagatgctggctcgcactacttcatttgacctcgatcggctctctcggattagtatgacagcctcccgccggtataagatttacaccattccaaaacgcacaggcggggttcgcacaattgagcacccctcgcgcgagctgaaggccatccaacggtggatcataaaagcgctttttgccaagttccccgtccatgaatccgctaccgcatatagaaaagggtttggaatcagagaaaatgccctgaggcacaagcagactagctacaccaatcgttacgatttcgctgacttctttccttcttttcaacagtcctccgtggagaaattcttagccttacaggccaagatcctacagatagatctgagccctctggatatcagattcgtaggtaacgtggtttgcagaaatcagcgacttaccataggagccccctcaagcccggcaattactaacgccatgatgttcaagtttgacgaaaatcttaacaacagttgtgaatctgacaaactcatctacaccaggtacgctgatgatatttttgttagcagcaatgaacctaacaaactctttgatgtcgaagtgcggattgagaacgcgcatagagggatagactatctgagcctcgagttgaagaatgagaagacagcgatcttgtctcgcaaatacgcaaggaaggtggctggagtcgtgattacgcctacccataacctgagtatcggtagagagaggaaacgagagatcaaagcactggtgcactcctggtcagtaggcgctcttgagaaggacaggttcgcctacctgcgaggcttgttggcattcgcccgtgacatcgaaccagatttcgaaaggagactgcgggctaagtatggcgaccccacgatcgacaggctactcttcgccccagacctgtatgcatga

SEQ ID NO: 11590 - RNA, 948 nt, unidentified
  source 1..948: mol_type = other RNA; note = synthetic construct
atgctcgtggagctgttagttcgggcctcaaaaatatctgaggctaagctgacctcattagccgccaccgcctccaatagatataaagtgtacgagattcctaagcgttcgggcggaaaacgaaccatagaacacccatccaaggaattgaaggccatccaaaggtggatagctaaggccgtctttgctaggttccccattcatagcggtgccacagcataccgccagggattcggcatcagagaaaatgcggagcgccatagacagagtaaattcaccaatcggtatgatttctccaacttttttccatccttcactcaggcggaggtgcagaacttccttcgatccagatctgcagcagtgggattggttctaacagaaaaagacattgggttcgtggggaacattgtgtgtcgcaacggcagactgacgattggaagccccacttctcccatcatcacaaacacaatgatgtttgacttcgatgtaaccctggataatttttgcgctgagcggggcctcatctttactcggtacgcagacgatatgtttgtcagcagtaataaggaaggccagctgttctccgtggaggatgggattcacctggcgatgaattctatccctaacctcaacttggaagtgaatcacaagaaaaccgccctcctgagcaaaaagtacctgcgccgtgtcacgggggtagttatcactagcgatcataggctaagcattggtcggcataggaagcgagagataaaagcacttattcacaagtggcgcacagggacccttgaggtcgagaaactgcactatatgcggggtctggtggctttcgctagggacgtggaaccgaattttgagcagaggctcagactgaagtatggcgaccaagccatcgacgaaatcgtccactcaagtgacctttcaatcgtttttgacaagaacacttga

SEQ ID NO: 11591 - RNA, 936 nt, unidentified
  source 1..936: mol_type = other RNA; note = synthetic construct
atgttgctggaacgtctcgagaagcatacaggcctgccaaggtccctcttagagcgatacgctgaaaccgcctccaaacggtatcgggtttatacagtggagaaaagaaatggagacaggagaacaatagagcatcctagtagagagattaaggcgatacagaggtggctgatcagagctctcatcgggaacatgcccgttcacgaggcctctaccgcctactccaagggcgcttcaatccggaaaaacgccgagcgccacgtgagatcacgttataccgtcaggttggatttcgaaggttttttcccgtctttcggcggagctgacgtaatcgcctatctgaaaaagacgcacgatgatcccattatggtcctgtcagctgaggacttgagctttattcgtcgcatcgtgtgccgacacgatgcccttaccataggcgcccctactagccccgggctgactaatgccatgatgttcgagtttgatagtgctctcgccgactggtgtgcagcacgagctctgatctatacgcgctacgccgacgacctgtttatctctgctagcgcccctggagcacttgctggcgtagaagccaaggccgccgagttggcagcggcatttccatacgccaagttagcgctgaacagggaaaaaactgcacatctgagccgcaaatataggcggtcaattacaggacttgtgatcaccccagaacagacactcagcattggtcgcgacaagaagattcgactcaaatcggatgtgtacgcatacagcaaggggaatctacagtccgaacaacggtcccgcaccgcgggtctaatcgcattcgtgagggacgtcgagcccgctttctacgagactctgttaagaaagtacgggagagaaactattgaagggctgcagaaaggcctgcggtctagtcttaagggatga

SEQ ID NO: 11592 - RNA, 909 nt, unidentified
  source 1..909: mol_type = other RNA; note = synthetic construct
atgttgttggatgagctctctgcggaaaccgggttgcgacccgatcgcctggagtattatgccgattctgcatccagacggtactactccttcaccattaaaaagagaaacggcgacccccgttggatcagacaccctgcaaagcccctgaagtcgctccagaggtggctgaacagcaacgttatatctaggatgcgggtccatcagtgtgcgatggcctaccagccaggaagcaatatcaggagcaacgcattaagacacgccagttccaatttcacagtgaggattgactttgaagatttcttcccttcgtttaaacgatccggtattgtgaagtttctgaaggaccaggaaaaattcggcctgaagctcggaaggcgggatatcacctttttgtctaagattgtgacacgttttgatgagctgacgattggcgcaccttcaagcccgctcctaactaatgcaatgatgtatagcttcgataaagaagtctcagaattttgcgagcgtaaggggctgacctacactcgctacgccgacgacatctatatctcttccgttgctcccaatggcctggatggcgttcttcaacgggtggccgctgctgccaaaaagtttccttacgccaagctccgaataaactcctcaaagaccagttatacaagcaggagataccggcgcatgataactggattagtgatcactccagaccataaaatcagcctgggtcgcaagagaaaacgggagatccacagtctggtacatatggccagtgtggacaaactggaccttgagaaactctcttacctgcaagggatgctagctttcaccaaggacgtcgaaccatcattcttcgagacattagtagctaagtatggacgcaaaacggtggagcgcattcttctttga

SEQ ID NO: 11593 - RNA, 909 nt, unidentified
  source 1..909: mol_type = other RNA; note = synthetic construct
atgctaatcgactggttgtgtgccgagacgggattgcagagagaaagactgattgcttttgcagcgtctgcctctaagcgctacttcgtttttcggattaagaagcgggatggttccgaacggcagatcgcccaccccgcaaagccactaaaaggcattcagagatggctgaactcgcgcgtgattaaatcctggaaagtgcatgatgctgctacagcctaccagcgtggagcctctatcaggcttaatgcactgcgccacgccgaaacaaactttacactccgagtagactttaaggatttcttcccctcattccaagccaaggggatagagaaatttatctcagaccagcccaacgggggtaagaaatttgacaaggtggacctgaagttcatcactgatataatcacccggaatggacgcctcactattggctcacctagcagtccgtttatcacaaacgccatgatgtattcctttgacgaggaagtgagcttattctgcgacgctagcggattggtgtataccagatacgcggatgacatttttgtttcaagtcacaatccaggcaatctggctcaagcgtatgacttcctgtgcagcgctgcaaataagttcccttacgccaatctttccatcaatcataacaaaaccaagttcctgagccgtaagtataggaggactatcaccgggatagtgatcacctctgataggaagatttctattggcaggcctcgaaaaaaggaaatcaagagtctcattaacagctacatctacggcaaacttgatgatgagaaagagatgtatctcaaaggcatggtcagtttcgcatgtgatgccgacaacgtcttctttctgtccctggagaagaagtacggtaaaaaagtcatggggagattaatagggtga

SEQ ID NO: 11594 - RNA, 912 nt, unidentified
  source 1..912: mol_type = other RNA; note = synthetic construct
atgttgcttgagcgcctgaggaaacaatcaggcctgaccaccgctcaaatcgaaatgtatgccgccacggcaagtaagaggtacaagatctacacaatcaaaaagaagaacgggggagataggaccatcgaacacccatctcgcgctctgaaatcactgcagcggtgggtcaataaaagcatcattagcaaactgccgacgcacgtgtctgccaccgcatacgccaaaggttgttccatccgtaagaacgcccagcaccacctaggctctatttttacactccacgtcgacttcaagtcctttttccccagtttcaaaagcgatgggataagcgatttctttagaattaagtccaaggagttgggaatcgagttgtccgaagaggacgtgaactttattactaggatagtgtgccggaataattgtcttacaatcggtgctcctacctcacccagcatcactaatgccatcatgttcgagtttgacgacgtagttaacgagtggtgcaaccagcgccgactagtttatacccgctatgccgacgatctctatatctcagcgttcgagcctgggatgctgtctgatgtcatcccatttcttattagtgcactcgacaaacagagattcgtgagactgaagataaaccatgataagactgcatttttgagcaaaaagtaccggcgagctattacaggaataattattacaaccgagggcaagctctctattggcttaaagcgtaagaagctcattaaaagtatggtgctggatttcaagtacgggagattacccatggaggacaaatcgaggcttcatggactgataagctttgctctggacatcgaacctgcgttccatgaaacactgatccggaaatacggcgaaaatactatcaagtccatttccacttga

SEQ ID NO: 11595 - RNA, 930 nt, unidentified
  source 1..930: mol_type = other RNA; note = synthetic construct
atgctcctggagaggctggagcgtcagagcaggctcagtagagggcagctggagcaattcgccataactgcaagcaagagatacaagatctacaatatcccaaagcggaatggcggggagcgccaaatagaacaaccttcccgggccatcaaggctattcagcgctggctgaacttgaacttgattagaaaattccctatccacatatcttccacggcatacaataaaggttccagtatcctgcgcaacgccgagtttcacaagaacacaaattttaccgtccgaattgacttcgaagattattttccatccttccgcgacaatggaatagaacgcttccttcaggaaaaccgatctgtgattggtgatcccctagacgacaatgacatctcattcatccggaacattgtctgtcggcatggcagactgaccatcggcgctcccagttctcccctactgacaaacgcgatcatgttccagttcgacgggatagtgtatcagttttgccagtctaggggtttggtgtacacccggtatgcggatgacattttcatctcagccactcgcgcaaacagcctcggcgatgtggcagattttgtcgctagcgtttcgacgggttacccgtacgctaatttaaccatcaattgccggaagacagtgtttctgtccaaaaaatataggcgagtggtcaccgggatggtgattacaccccaggggtcagtaagcgtgggaaggaacttaaaagatgaagtgagaagcggcgtttacaagtttaagaacggaatcatcgatggagacgagattgcccgtattagaggcctcgtagcctatatttacggcgttgagccatcatttcttggaatcctggaaaggaagtatggagacgagactattggcagactccttggcgggaggcctctggtcaaatga

SEQ ID NO: 11596 - RNA, 939 nt, unidentified
  source 1..939: mol_type = other RNA; note = synthetic construct
atgctgttggagaagctgaaagatcatagcgggctgagcgagcgccaacttgatagatacgcagcgacagctagcaatcgatacaaggtttataccatacccaagaaaccctttggtgtgagaaccatcgaacacccctcacgggagattaaagccattcagcggtggttaaacagtaatatcatccgcaaactcccagtccattcatccgccaccgcctaccacagaggagcatctataaaagaaaatgcaatccggcacgccggctccaactttacattgcatgtagacttccagaacttttttccaagttttcatggacaccacatcgagaagtttctcaggtggtggtctgaggagaacaagattaatctgaacgataacgacatcagtttcttcaggaagattgtgtgtagaaataatgctctgacgattggagctccaagctcgcctattttgaccaatgccatgatgttcgactttgatggaacagtggccctctggtgcacatctaacggctttatttatacacgctatgcggacgacatcttcatctcatccgtcttacctgggaaactggggaatgctctggaattccttaaggagacttgcccgagttttccctatgctaacctgtcaatcaaccacaataagactgcattcctatctaggcgctacaaacgatctataactggcctgatcattactcctgagcggaaaatcagcattggcagggccaaaaaggaagagattaagagcgaagtgtacaagttctccaagggcgaactcaccagcgaggagatcggaaggctacgtggcaaaatagccttcactcgtgatgttgaaccttccttctacgacagactgctcaacaagtacgggtattccacgatccataccttggagttcctgggggaaggtgatcttcttggtaagtga

SEQ ID NO: 11597 - RNA, 933 nt, unidentified
  source 1..933: mol_type = other RNA; note = synthetic construct
atgttacgcgaagtgctcgcagagaaaagtggaatttcccccaagagattacagtttatccaagaaaatgccagccggatgtataaggtctatccaatctccaaacgtgacggtaccgacagaattatatcccagcctacaccagagctgaaggccctgcagaggtggctaagtagggggatttttcagcggttgccggtgtctagttgcgccatggcgtacaagaagggtgcttccatcagagaaaatgccaaggcacacgtgaaaacatcattcaccctccatcttgattttgaggatttcttcccttcgttttctaccgatcatatcatccgatacctctccgaaaatactaaactgaactcagatgacatccaattctgtagcgacgtagtctgcagacacggacgcctgaccatcggggctccttcgtctccagctgtcacaaacgccttgatgcactccttcgacctgcaggtagattcttggtgcagcggccggggcttggtgtatacgcgttacgcagatgacattaacatctcatcagcgggtagcggcagtctcggggatgtcgaaggcttcatatccgcaacggccaaggactttaaatacgctagcttgactataaacggaaagaagaccgcatatctgagtaagaaataccgccggtctattactggtatcaatgttactcccgaaggatgtatatccattggccgcgctaggaagagggagattaaatcactggttcacagcttcaagcttggcagccttgagccagagctgctgtggaagctgggagggctaatcgcttttgcccatgacgtggagcccgacttcgtggtttctctgaaaaaaaaatacggaagcgccacagtggaggccattctccaccagaaaacccctaggggccttcgagggcccaaggagtga

SEQ ID NO: 11598 - RNA, 930 nt, unidentified
  source 1..930: mol_type = other RNA; note = synthetic construct
atgctcagggaagtgcttgctgcaaaatccggtatgtctctctccaggattgaacggctgcagtgcaacgccagtaagatgtacaaaacatatccgatccctaaaagggatggctcagatcgcatgatttcacagcctacacctgagctgaaggcagtgcaacggtggctagcgcgcggcatatttcaacgtctgcccgttagtgcctgcgccacagcttataagaaaggcgcttcaatcaggaagaacgcagaagcccatgtagccagcagcttcactattcatcttgatttcaaagacttcttcccctcattctcccacggccacgtctctcgattcttaagtgaagctactcggctgagccaggaggacatcctattttgtagcgatattgtctcccgacatggatgcttgaccataggcgcccctagttctccaagcgttaccaatgcattgatgtattcttttgacgtgtcagtagagagatggtgcatgaagcggggtttgatctacacccgttacgctgacgacatcaatatatcgagcaaatgtccaggcgcacttagggaggttgaagactttgtgcgcgacgcctccggggcttttgagtatgcaaatctggtgattaacgagagaaagaccgcctacctgtccagaaagtacaggcgatccattaccggggttaatgtgacacccgaagggagactgagcattgggagagatagaaagcgcgagatcaagagtttagtgcaccagtgtgtcatgggaactctccaggtcgacatgctgtggcggctcggtggactcatcgccttttcttctgatgtggagccccacttcgtcgatgctctgaaaaacaagtacggagccgacgtgatcgagaagatcctgcaccagaaaacgccacgcggagcgtgggtggcggattga

SEQ ID NO: 11599 - RNA, 921 nt, unidentified
  source 1..921: mol_type = other RNA; note = synthetic construct
atgctccgcgacgccctgtccaatctggctggaataccaatttctaggatttctcgtattcaggagaatgctagcaagctgtataaggtctacgaaattccaaagaacaacggaaaaaagagaactatttcccagccgacccccgaactgaaggccatccagcggtggctaatacgaaatgtattcgccaaacttccagtgtcaacttacgccaccgcatacaaaaaaggcgcgtcgatcagactgaatgccgagttccatcgaaattcactttttaccttgcacatggatttcgagaacttcttcccctcattcactgagaacaacgtgtttgattttctgaaggagaacacgaatctgaatcaagacgatatatccttctgtgtggacttatgctgcaggtttggtgcactgaccgttggaagtcctagctcccctgctctgacaaatgcgatgatgtacgcctttgaccaacagatcagcgattggtgtgcagaacgcaaattagtctacacccgctatgctgacgatattaacattagcagctcatctcctgatgcactcggcgacgccgaggggttcataaaagacgcttctaaggagttcaagtttggcaacctcaaagtaaacgaagtcaagactagttacctcagcaagaagtatagacgttccatcaccgggctaaacatcacgccacaaggtagtatcagtatcgggcgggatagaaaaagggagatcaagtccctcgtgtataagtacaaagaggagttgctgcccaaagaactgttttggcaggtgggagggttgatcgcctttgcaaatgacgtggagcctacattcgttcggtctttgattgaaaaatatggccagaagacaatcgaagaacttcttcaccagcggacacccaggggcctcaagtga

SEQ ID NO: 11600 - RNA, 915 nt, unidentified
  source 1..915: mol_type = other RNA; note = synthetic construct
atgttaatcgagacactgtctaaacagagcggcgttactattgaaaatctgaagtggcttgccgaaacagcctccaagagatacaagacctacgagatccctaagcgcacgggtggggtgagaaccatccaccatccaagtcgaggcctgaaggggattcaaaggtgggtatcaaagttcctgctagctaggctccccgtgcataccgcggcccaagcttatgtgcgtggcgcatctatacggaaaaatgctgagctgcacgcgggctccaaattcaccctacggattgactttgcgaatttctttcccagctttagctcagagcacgtggaggtctttctggcaactgctgaaagggatagatctattggtctgaccgatcaagacatcagtttcgtgagtagaattgtgtctcgacacggccagctgacaatcggggcaccatcgagccccattctgaccaatgccatgatgcattttttcgatggacagatcgccgaatttgcagaacgacagaacttgacctatactaggtacgcagatgacttgttcttctcctcaagcaagcctgataaccttactgatgccctcgagatagtgcagcaggtatccgttgcttatccttatgccaacctccgggttaaccccgacaagacagctttcttaagtcgtcgctacagcagacgcgtcacaggtcttgtcattacgactgacgggaaagtctccatcggacgggagcgcaaacgcatggtcaaagcccaggtgcacaaattcctccagggacagctggacatatttgaagtgccgaagttgaggggctacctcgccttcgtgcaagacgttgagccagaattttgggagggcctgaaacggaagtacggggccgacgctatgatcaccgtaacaggaggatga

SEQ ID NO: 11601 - RNA, 936 nt, unidentified
  source 1..936: mol_type = other RNA; note = synthetic construct
atgcttatcgaggccctcattaagcagagcggaatgaatgatgtatccttggagtggctcgcacttacagcgagcaagcgctataagacctacgatatacctaagagaaacggtgccacccgaacaatccaccacccttccaaatcaattaagagcatacagagatgggtcagtaagttccttttgcgtcggctacccgtgcacgttgctgctcaggcttatgtcagaggcgcctccatcaggaaaaacgcagagttacacgccggaagtaagtttacgttaagaatcgacttttcggatttctttccttccttctctcgcgaacatgtggaactgttcctggcggccgtggaacgagatcgaagtattggcctgaccaaccgcgacatctcttttctgagccgcattgtgtctcgtcatgggcagctgactataggcgcaccatcatccccaattcttaccaatgcaatgatgcacttttttgactcccagattgccgagttcgcagacaggaaaaacttgatctatactagatacgctgatgatctgttctttagtagcaataagcccgacaacctcactgatgttctcgccattgtgcagcaagtctctgctacttatccctacgctaatctgaggatcaaccccgataagaccgtgttcctgtctcggaggtacagcaggcgggtcacgggactggtgctgacaaccgacggcaaggtcagcatcggtagggcccggaaacgcgccgtgaaagcccaagttcataaactgatccagggagaattcgacaattttgagttgccaacactccgggggtacctcgctttcatacaagacgtggagccggaattttgggagtcactaaaatcaaagtacggcgcggacgcaatgttaacagtagttgggaaacagcatttctcgaatctgctgtga

SEQ ID NO: 11602 - RNA, 936 nt, unidentified
  source 1..936: mol_type = other RNA; note = synthetic construct
atgttgaaagagacacttagtaagcaaagtggcgtcacaatagagaatctcgagtggcttgcggaaaccgccagcaaaagatacaagacatatgaaatcccaaagaggaacggtgggctgaggaccattcatcacccctctagaggtttgaaaggcattcaacgttgggtgtcaaaattcctcttacgtaggctgccagtgcatgttgcagcccaggcttatgttcggggcgcctcaatccggaagaacgccggactccacgcaaactctaagttcactctccgaattgatttcgcggacttctttcctagcttttcaaaagagcacgtggaggttttcttagcagccgtagagcgcgaacgacagatcggcctcgtacagcaggacatctcctttgtgagcagaatcgtgtctcgccatgggcggttgaccattggagccccgtctagccctatgttaacgaatgcgatgatgcacctgtttgatagtcaaatctctgaattcgccgagaggcaaaagctaatatacagcagatacgctgacgatctgttttttagttccaacggacccgataacctttccgacgtcgttgctaccgtgcgtcagattgcagattcgtacccttatgctaatctgcggctgaatccagacaagaccgtgtttctgtccagacggtatagccgccgcgtcactgggttggtcctgacgaccgacggcaaagtctccattgggcgagaaaggaaaagggctgtgaaggctcaggtgtataaattcatccagggggagctggacaacttcgaagtgcccacactgcgcggttacctggccttcatacaggacgtggaacccgagttctgggagtcactaaatcggaagtacggagccgatactatgctcactgtaagaggcaagcagcactttgcagccctgctttga

SEQ ID NO: 11603 - RNA, 939 nt, unidentified
  source 1..939: mol_type = other RNA; note = synthetic construct
atgctggttgaggccctgcagaaacaaagcgggctacctacctctgtgatcatgaggatcgccgaaaccgcctcaaagagatacaaggcttataagatcccaaaaagatccggcggatggcgggatattagccatcctagcagggagctgaaggcaattcagcgatggatcaatcgtaccctctttatgaagctccccatccatgaaagtgccacggcttacgccaaggggtcaggtatcagaaggaacgctgaaatccacgcctggtcgtcctatacacttagattagacttcgagaatttcttcccctcttttgacattcacggaattagtgagttcatcgccgcccaaagcgatgagagggaatggggcctaactaaacaggacgtgctgttcgtggggatggtagttactcggtatggaagaatgactatcggcgcaccctcctcaccaattcttacaaacgcaatgatgtacatgctcgattccgagttggctgaaatcagtgaaaagcgtaagttgagctacacccgatacgcggacgacatttttctgtccgcctatgctccggatagccttgctgatatgattcccatagcaaaggagattgtgggccgccagaaatttgttaggctgaaatttgcagatgaaaagaccgcgcatctgtctaagcggtataaacgctctataacagggctggtcgtcaccccagatcagaaaatttcaatcggtcgggagcgcaaaaggactataaagagcttagtattccggttcatcaacggagagctcggtgacgtggaactgatgcgattgtccgggacgatagcattcgtgtacgatgtggagcgcgctttttatgacagtctcgtccgcaagtacggcgaggacgtcattggcaaaatccagaaacctcacctggcggacgccgagtctacatga

SEQ ID NO: 11604 - RNA, 975 nt, unidentified
  source 1..975: mol_type = other RNA; note = synthetic construct
atgttacttgagaaactgcagattcagtccaaccagtctctagagcgtctggaaaggtttgccacctctgcaagcaagcgctacaaagtgttccaaattccaaaacgcagtggcggctttcgcattatcgagcagcccagcaaagaaatcaaggccatccaacggtggctgattgaggcgctgtttgatgagttccccatacaccattcggccacagcctatatccgagggaagaatatccggagtaatgctgaggtccatgctgaaagtaattttaccctgaagctggatttcgagaacttctttccgtcattcacggaaaggcacctgataaaattcttaagaaactaccctctcatcgagaagaaacagatcaacgacagggacatcaactttatttcacgcatatgcctcagaaacgggcggctcaccattggcgcgccatcatcacccaccataaccaatgctatgatgtatcagtttgatacacttatgtccgcccggtgtgcagaagataatttcagctatacaagatacgccgacgacgtgttcgtcagctcccgaagttacatcaacgttggagagattattctgttcgtagagaatttgctttctaaatacgagtacgcatccctccgactgaataaagataagacagccatcctgtctagaaaaggcaggagatctatcactggttgcgtgataactcctcagaggggcatctcgatcggacggaagctcaagaaaagcattaagcacaagatctatgaatccatcaacgggcgtttaagctctctggaagctactaagttgatgggttatctcggatttctgaaggatattgaacccaactatttcgagtccctgaagaaaaaatacggagctgacgcaattaagacgatcaccagcgggaattacgatgaaattaagttggtgccactaatattggacgaccttgacgacactcctttttga

SEQ ID NO: 11605 - RNA, 924 nt, unidentified
  source 1..924: mol_type = other RNA; note = synthetic construct
atgattctcgagtggattgctaaagaaaccggtgtgggagcggctcagatcgctacaatcgtgcggtctgctaacaacaggtactgtacttatagcattcctaaacgcgacgggactccgcgccagatttcacagccctccaagaagttgaagtttgtccagagatggcttgcaaagagagtgttcgtgaatctgccagtgcacaagagtgcgacggcatacctgcctggcgtggggatcaggaaaaatgccctcgagcatgcctcgtctaaatatctgctaaagatggatatgtcagattttttcccttccatccgggaggaagacattgttaagctcatgctgttgaacagtgaaaagtgggccgggtttgaagatgccgacgctaacttcatcggaaaagcagttagctaccgaggtgcgctcactattggcgccccatcctcaccagtacttagcaatgccatcctgtttgagttcgacgaactggtccacgagtactgcataaacaatgagctggtatacagtcggtacgccgatgacatcagcatttcttctaagggacgcattgatcttcacgcagtcagcggggttgtggaagagtttgtccaaaaactggagacacccaaactgaatataaaccgtgagaagaccgtgattgtaagtaagaagcatcagagattcataacaggcctgaatttgacatctgacggaaatgtctccgttggccgattaaggaaacgcgaaatcaggaccctgatcttcaaattcaagtccgccgaccttgatttttcagagatagggtatctaaaaggttggatggcatacctcaacgccgtggaacccagctttgtggagagagctcgtttaaagtatggcgaccggaccgtgcaaaaaatcttcgagtatgatgtcgacggctga

SEQ ID NO: 11606 - RNA, 981 nt, unidentified
  source 1..981: mol_type = other RNA; note = synthetic construct
atgaactacgcagagcttctacaggcttggtgccgcctgttgagagctacaccccaggacgtaacagtcttgttaatgaggggaccttaccagtataagcattatcagattgagaaaaggactggcggcaagcgggatatattccacccaacccccaacctgaaggccgtgcagcgatggctggtaaatgagcacttacaaaccctgcctgtgcacgacagtgtgtactcctaccgggtgggtagagggatcaggcagcacgcggatgcacatgtgcactcaaactttctactgaggctggatttcaaggacttctttccctctattacacaggactggcttctgcaatttctgttgcagagtgcccatgaaggaagcctcagccttgatgatagggccattgcagcatgtatgcgggtgctgtgcagattcaataaatttgatggctctctcgccctgtccattggagctccaagctcacctgccatcagcaacgcaatcctttttcctgctgacgtggacgcgcactccagatgtgccgagctgggctgtctctacacccgttatgcagatgacatctatgtgagctcacgcgaaaagaatgtgctcgtggaggccgaaagacaagtcaaggccgcgttttcgcaacatgccccgcgcttgcagttcaacgctgacaagcgaatcaatgtctctaagaaagccaaacgagtggtcacgggccttaccctgacacccgaccgcaagctctccatcggtagagagttgaaacggagtataaaaactctcgtttacctccacgtctccgggaaactggatccagttgaacgcccgcgtttatgcggactcgtctcatatgttagggacgttgaaccagctttctacaactctctggtgctgaagttcgggcatgtaactatggaagagctgttccggtgcggtcctggcgaggctctttatctgcccaatgaggggctatga

SEQ ID NO: 11607 - RNA, 951 nt, unidentified
  source 1..951: mol_type = other RNA; note = synthetic construct
atgacgaggaatgatctcatatttgccctggcaaaattgctgagggcatcacatgaggacattcagaagctcattttgacagccccctaccagtacaagcactacaagattaagaagcggaccggagggtatcgcgacatctatcatcctactgcatctctgaaagcggtgcagcgatggctggtttcaaattgttttcttcacctcatgatccatccctcggtcttcagctacagagaaggcgtcggaattcgccagcacgcgagccagcacctgcactcaaattttctgttacggattgacttcaaagattttttcccctctattgatcaaagctgggtcctggatttcttctatcaggaggttaacgccggccgcctccctatccaactcgagacagtccctaccctggccaggcttgtatgtaggttcgcaaaagaagagaaaaccatggccctatctataggggccccgtccagcccccttttgagtaacgctatgcttttcgccttagaccaggacatggatgagtattgccgtgctcacgactgcgtatacacgcgatacgcagacgatatttacattagcaccaaacacccaaacatactatccggcatcagagatctgctgacctcaaagatcctcgaattcacacctaaactcgtgatcaacgacaaaaaaactatcaacgtctccaagaagatcaaacgggtggtgactggtttgattctcactccagatcgccaggtgagtcttgggcgtaatttaaagaggtctatcaagaccaagatctatttgtttacacatggtcaactaccagtggacgaagttgaacatctgagaggactggtggcttacgctagtgacgctgaggccgtgttttatgatgccctgatccacaagtttggctccgcttccatagacagactgctgaatcggaagaagaactga

SEQ ID NO: 11608 - RNA, 966 nt, unidentified
  source 1..966: mol_type = other RNA; note = synthetic construct
atgaactatagtgacctgctgtcttctgccgccaagctgctaaggacatccagcatcgaggccgagcggattatcattacagctccttacaggtacaagcactacaaaatcgaaaagcgaaatgggggtcagcgggacattcatcatcctactcccgcattaaaagccatccagcggtggctcgtatccaccccgcttgcgaatttacccgtgcacgattgtgtctactcatatcgcaagggcagaaacatcgcaatgcacgccgcaatgcacgttgagtccaactacattacccgtttcgacttcagcgattttttccccagcatcaccgctaccaccataaggaggtttttattggaagagactatgaaagggacaatagatcttgacacagccgccatcaatgcaattgtgagactcgtttgccgagccgaggacaaaagcggaaagctggtactgtcaataggagcccccagttctcctcatctcagtaatgcagtgttgcatgattttgaccacgtgatggagtcctctgcgcgtattgccgggggcatgtatacccgctacgccgacgatatttatgtttctggccgtactaaagaaacggtcgcattgctggagaaggcttttatccgggaaacatcaaagctgctaccatatctcaagatcaacgagagaaaaacgcagagattgtctcggaagcgccgcatggctgtgactggcatcaacgtgacaccacaaagaaaactgtcggtcggccgggatcttaagaggagcctgaaaaccaaggtccacctggctctcctggggcagatagcgccagaggagctgtccgctctgcgaggtatgattgctcatgtcgcaagcgtggaacctgctttcatggactcgctcagtaagaaatttggagtggaacgccttgaatccttccttactagcagagaaatcgaggaggtgtcaaggtga

SEQ ID NO: 11609 - RNA, 945 nt, unidentified
  source 1..945: mol_type = other RNA; note = synthetic construct
atgaagaatgcagacttggagcgggccctctctgcttacctccggatcaaacctccagacctgaggcagatcgttaggacggccccttatcgctacaaacactaccagattgacaagcgcaacggcggaaaaagggacatatttcacccgtctcccgagttgaaagccatccagagatggcttgtggaaaatgtgctgcttaatatcccggtgagccccagcgccatgggctatgagaaaggctgtagtattcgcgatcatgcacggcagcacctgcagtcaaactactttaccaagctggatttctccaacttcttccccagcatacaattggattggattactcgttttcttctggaaagcctgcccgactatgataacgaggctattcatagtatcgctcgcttggcttgccgctgggcagatgctggcatgcccttagcactgagcattggagccccttcctctccagccctgagtaatcggatcatgttcgctctcgataccgccctgtcggaagtggcctcagccaacgatgtcacttattccagatacgctgatgacatttacttttcctgcgctaaggccaatactctgcatgatctcgaaagagaggcgcggaaaatcatcatcgagatgacccctgcactgcgattgaacgagcaaaaaacattacacacaagcaggaagcggaaggtactaatctctggcgtcggtataacatccaccagaaaactgtccatcggtcgaaacttaaagaggagtattcgaacacaggttttcctctggtcaatgggatcactgccagcggaaaacttccctaagcttagagggctgctgaattttgcgaatgacattgagccagagtttctcgcctctctccacagaaagttcggggacgacctaataaagaggtttcttgcaggggacttcgaacgtaattga

SEQ ID NO: 11610 - RNA, 951 nt, unidentified
  source 1..951: mol_type = other RNA; note = synthetic construct
atgaataggaatcagctcatagccgagctggccgctcagttacgagtgtcccccgctaacattgaacgcgtcatagcaagcgcccataggaggtataagcggtacactctcattaagaggacaggcggatcacgggaaatctttcacccaactcctgagctgaaagctatccagcggtggttgattaaaaacgtattcgaccaacttccgacccaccctagtgtgcatgcatatgagccaaattgtagcattgcgcgacacgcggctgctcatcgtcgctcaaatttcttcctgcgtatggacttttctgattttttcccaagcatctccgcccagtgggtgaaaaacttcctgttggagtctatccaggccggactcgtagatcttgacaaggattcggtggatagtatctgcagactggtctgcaggcgggggagactggaggtggaaagtaaactgacgatcggttccccttcttcgccgagcataagcaatcggatcctgtacacattcgatagtaagctattcgaagcctgtcacgagcgtggcgttatttacactaggtatgccgacgacatttacttttccacccgagaacccgacgtgttacatgagattgaacagatagttaccgacctcgtcagggccacagtgcccgaattgtctttgaaccgaaagaaaacccaaagagctagccgcaagcgccgggtcctgattactggtcttgtgatcacctctgatagaaaaatctcagttggaagagatctgaagagaagcgtgcgcacgcaaattcacctgtggaagcagggcaacctgccactggaggacatccctagactccgcgggcttgtctcttttatcgcaggcacagagcccgagtttctatcctccatctcaaggaagtatggggcagagtccatcgaacggttactcaaccccgcaattaattga

SEQ ID NO: 11611 - RNA, 981 nt, unidentified
  source 1..981: mol_type = other RNA; note = synthetic construct
atgatgaataatgataacctgatcacggcctggagtggattattgcggtctagttccgaagacgtgatacggttcatatttacagctccgcaccgctataagcattacaagatcccaaagaagactggagggttcagagacatttaccatccaactcctgaactcaaagctgttcagcgttggcttaacgcgaatatcttctcctcactgaggattcacgatgctgtctattcctaccgcaacgggagatctattaaagaccacgcatctatacacctcagttcgaattactttctgcggttagacttcaaagacttcttcccctctatcgaactgtcctgggtcgaggagtttctccgctttaactctaacaacaacatcattccttgcgacctgacaacaattagcaccatcagccacgtggtttgtaggtatagcgagaaagagaaaactaatgcattgagcattggcgcccctacaagccccatcttaagtaatgccattctatacgacctggatcaggccgtgtccagattgtgctccgagaatgatgtgatctatagcagatatgccgatgatatctatctctcgaccaaacataaaaactccctggacaggatcggttcagatgtgctggagcttgttggcaagctggtacccatgctgcagataaaccaaaagaagaccatctacagctctaggaaacgcaaagtcaacataaccggcctgaacatttcaacggaacgaaatgtctctgtgggtagggaactgaagagatcagtcaagactgaattccatctttggtgtatcggcaagcttccaaatgaaaagctgacccgactacgtggcatgatctcctacgtgaagggggtggagcctagtttctttgacgctttgcggaataaatttggagcagagaagatggaatcatttctcagcctcaacattgccccaattgagtttgtagagatccccttctga

SEQ ID NO: 11612 - RNA, 969 nt, unidentified
  source 1..969: mol_type = other RNA; note = synthetic construct
atgaacaagaatgaactccttattaagttggccacccatcttgacatattgccggaagaggtggagcacattctcaagtcagctccctatagatacaagcattatacactcaagaagagaggaggaggggcccgggacatttaccatcctacccctgaaatgaaagcgatacaaacttggctggtggcgaacatttttgcagctctccctgttcacgagtccgtttactcttaccgaagcggcctgtcaatcgccgatcacgccagggtccatgtcaaatccaaattcgtgactaaactggacctgcagtcattctttcccagcatcgccggcatacaggtgagagccatgcttcgtgcggctaatgcagcaaaaaaggtggccttgacagatgacgcaatcgctaccatcgtgaggttctgctgcaggggtgataggggtggcggcgatttacgtctgagcatcggatccccaagttcacccgcgattagcaatgcaattctctacggcttagatgagaatctcaagaaggcaagtcatcacgtgggcgttacgtatacccggtacgccgatgatctgtacttctccacaagcgacagggacgtgcttgctggtgtagagcgcgcagcccgaagcatcatagctcgctatggcttcctaaaagtcaatgaggacaagacccagcgcacatctaaaaaaaggcgggtagtcatcactgggctgaccgctacaagtgctgggggagtttctatcggacggggtagaaaacgcaagattaaaacggagctgtatctgcacttttcggagagactaccattggacaagatcgggactctgcggggcctggtgtcttttagtatgggcgtcgaacccaacttctatcactccttatgtctgaagttcggggaaaaccgcatgcgagcctttatcgccgaaggagggaacggagggcagtctgccccattttga

SEQ ID NO: 11613 - RNA, 966 nt, unidentified
  source 1..966: mol_type = other RNA; note = synthetic construct
atgacactcctgtcccgcatggccgccgatatgggcctgtcatcagcttacatccataaaattgctgtttccgcatcccaccgatataaagtgtactctgtcaggaagagaactggaggcagaagggtgatcgagcaccctgcacgggaattaaagctgctgcagacctggctgctggataaactgttctcacatttcagggcctccgactctgtatacagttatcggatcgggaagtctatccgcggacatgcaaataaccaccgccgtaattccttcttgcttaagatcgacctgaaagactttttccctagcattacttctgaggacgtgtacaagtttctgaaagaccggcagaatgatctaagcagtcccctgacccccaccgactgccgattaattgccgctattgtgtgtcggcgaggccgcctaaccattggcgctccatcaagcccagcgattagcaactccatcctttatcgctttgatctggctatagccacattttgcagacaaagaggtgtcacttacacacggtatgcagacgatctttttttctcgactaacacccctaacttgcttaccgagataaacaaagaagttaggaggtgtctgagcgccctcccataccccaggctgaagattaaccctgagaaaacggtctttacaagtcgcaaaagattacggctcgtaacaggggtcgttttgacgtctgataagagactctctgtgggccgtgccaagaagaggatgctgaggaccctagtgtacctctttagcaccgaccgtctcgatgaaaaaaaaactgcctatctgagaggaaatctcgcatatgtggcttccatcgagcccacattcatcggatcgctcgagaagaagttcgggaagcgggtgctggaccgacttcacaagcagccattgataaatttgaagccgaaaagcagaagtgcggaaggtttcaagtga

SEQ ID NO: 11614 - RNA, 918 nt, unidentified
  source 1..918: mol_type = other RNA; note = synthetic construct
atgttcctccagcagctcgtgaaaatcactggactttcagaagcatatatcataaaactcgccaggacggcctctcatcggtatagaacttatcagatccctaagaggaagagcggcgtccgaactattgaccatccctcgcgtcaccttaaattcctccagaggtggctggttcggaacattttttcatacgcccctgttcacccaagtgtctacagctataaggagggtgtcagtataagacagcacgcgtccttacatgtgaagagcaaatacacacttcgcattgattttcgcgatttctttcccagtatcaaatctgccgacgtacaaaagcttctcgataagaacgtagagcggttcccattccagctcaccgatcgcgacattcacattatcttatccctgtctagcaaggacggcaaattgaccatcggtgccccttgctcccctgctgtgtctaatgcaatcatgtacgacttcgacaagcactggtcacaaaggtcaaagcgcctgaatgtgatttattctaggtacgctgatgacatttacttcagtaccaatcgctccggggtgctaagcaagatcctgtccgagctgaaagaacatctggcaacgcgcgacagcccccggttgatcctgaacaacgccaagaccgtttttgcttctagaaagaggcgtagagtggtgacaggcatcgtcatcacaccgaccagaaagctgagcctgggccgggagaaaaagagacagctgagaaccttgactttcttatttggaaaagggcaactggatcgagatcgagctaaaagcctacaggggtttctgtcctacgcgtcaacaatagagccaatctttattagtaggttgcggaaaaagttcggagacgaactgatttccaaaatagtgcagatgccctga

SEQ ID NO: 11615 - RNA, 1014 nt, unidentified
  source 1..1014: mol_type = other RNA; note = synthetic construct
atgatactcgagaggatcgctagagaaacaggtatcggcgtggatcacttaagagtgattgtcaagacagcctccaggaggtacaaaacgtacacaattcctaagcggacaggggggagaaggactatatctcacccaactcccgaggtaaaatttctgcagcggtggctggttcggaatatgttttctgccctccccgtgcatcatgctgtggcatcgtaccgcgagggcgttggaatcgcggataatgctcaggcccacgttcgcaagaactatctccttaagatcgacttcaaaaactttttccctagcatcagggccgcagacatcaggcatttactggagaaaaactcgagtcgattcagcgacatcttaaccgacgacgacgtacaggtgataacggatattgtgtgtaagaacggcgcactaagcatcggagctccgtcctctcctattctgagtaatgcgatcctcatcgatttcgacgagttcgtcttccaagcctcaaaggatagagaggtaatttacacacggtatgcagatgacctgttcctcagcaccgataaacccaactgccttagtgtcatgatggagctaatccgtattcggttgtcctcagggggccagccaagcctttccatcaatgaagagaagtcagtgtttaccagccgcaagcgaaaccggactgtgactggcctggttctgacctctgaccgcactctgagtgtcggtcgaaaaaaaaagcgccagattaggaccatgattcacctgtaccaggaagacaagctttccgccgaatccatttcttacctgcgcgggtatttggcctttgtgcacgctgccgaaccggatctcctggtgagattgcagcagaaatttggtcaagaaaccatggaccagctgatgtgctatcccctggtcccacgtaaaggacatggaagaggcgctcaaagacccgcaatacctttgggggcccacaagaccggatctccacaaaattcaagcgattcctga

SEQ ID NO: 11616 - RNA, 930 nt, unidentified
  source 1..930: mol_type = other RNA; note = synthetic construct
atgagaattgcccagatcatcgctaagcaaacatccgcagttactgcggcacacttaatcgcccttgcaaactcagctaaccacagatacaagacctataagatcagtaaacgcaacggacagcatcgtactattgagcacccaagcaggcagctgaagtttgtccagaggtggcttggccgcaagctcttcagtaagtttcccatacatagcaaagcttttgcctatgtgaggggaaaaagcattgcccatcatgcagagattcacgtgtccaataattacctccttcgaatcgactttaaaaatttctttcccagcattaccgccgaaaacatcaagcacaagttgaatgatttcagatacaaagacggaagcaatttggagccagccgagattgattttattacgaagatagtcaccaagtctggacagctgacaatcggggctccttccagtcctatcatctcaaacatcctcatgtacgagttcgaccactactgggaccaatactcttccgagcgggggattacatattctcgctatgccgatgatatttacttcagcaccaacgtgcccaatctgctcaaccagtgcctgattgacgtgcgggagtatctgcgagaaaaccccaaccctagactgttcatcaatgacaacaaggttgtacacacaagcaaaaaaaggaatagaactgtaacgggcctaaccctgactagtgatcggaaagtgtctataggtcgcgataggaaacgtcaaatccggtcgttaatcttcaagcataagaatggcctgctgaatgagcaacagattggtcagctatctggcatattgtcctatgtgcggtcagttgaaccggaatttattacatccatcgaacagaaatacgggggggcgttcatcaactcaatatcgggcgtcaaccagacctga

SEQ ID NO: 11617 - RNA, 954 nt, unidentified
  source 1..954: mol_type = other RNA; note = synthetic construct
atgatcttaaggagcatggcggcagatatgagggttccagtggcttatatcgagctcattgccactacagcatctcatcgctacaaaatttaccgaatacgtaagaggacgggcggcacaagagagatatcacatccttcaaaggagctgaagggactccagagatggcttgtactgcatgtttttagccagctgccgattcatgacagcgtgtactcttacagaaatgggctgtccattcgggatcacgccgaagtccacaaaaggaacaactatctggtccggattgatttcaaagacttctttccctctattactgccaaagacgtcgcgaggttgctgcttgccaatcgacaaaatctgcccctgacaattactgctgctgacttgaaagccatctgctggatcgcctgcagaaacggccggttaaccatcggcgctccatcaagtccagtgatttccaatgcagtcttgtaccctctagatgagtattggtttaatacatgtgaacagagagggatcagttatagtcgttatgccgatgatatctatctgtcaaccaacgccccaaacgtgcttgctaccatctacaaggaaatcaggaaggacctggaggagcgcgaatggcccaagctacagattaaccagcggaaggtggtttttacgagcagaaagcacaatcgcaacgtgaccgggcttatcctgactagcgacagacgggtgtccataggacacaaaaagaaacgctggttacgctctcaggtgttcaagttcatggagggtcaactccccgccgagcaagtgtcctatctccgcggatacttgagttttgcaaaaagcgtcgaaccttccttcctgacccggctgcgaaagaagtacggtgcatcggtaatccaccagatcgctaatatacagcctatgcagctcaaactcgttaaggtgaggaagaaatga

SEQ ID NO: 11618 - RNA, 954 nt, unidentified
  source 1..954: mol_type = other RNA; note = synthetic construct
atgatcctcagaaagatggccgaagatatgcgcgttccattagcccatattgagctattggctaccacagctaaccaccgatataaaatttacaggatacctaaacggaccggcggtactcgcgaaatctcgcatccttcaaaagagctgaagtctctgcaaagatggttggcgctgcacctgttttcaagacttccaattcacgatagcgtgtatagttaccggataggcgtggggattagggatcacgctgaaatccataaacgaggaaactatctggtcaggatagacctcaaggacttctttccctccatcacatcaaaagacgtcgcccgtctcctgatcgaaaatcgccagaaactagggcagattatcactgcaacggatctgaaggccatttgctggattgtgtgtcggaatggaagactcaccattggcgcgcccagttcccccgtaatctccaatgcagtactttatgcagttgatgagtactggagcgtgacatgcgagcaaaggggtattacctactctaggtatgccgacgacatatacctgtccacgaatcggccaaatatccttgcaggaacttacgacgaaatgcggaaggaccttgagaatcgcgagtggccgaaactgcaaattaacaggcgaaaggtggtgtttacttctagaaagcacaaccgtaacgtgaccggattgatcctgacaagcgataggcgagtttctatcgggcatgagaaaaagagacagatccgcagccaggtcttcaagtttacacaggaccagctgagcgctgagcaggtgtcttacctccgtggctatttaagtttcgctaagtccgtcgaaccttcattcctcactcggttgcgcaagaagttcggcgtgagtgtcatacaccaaatcgccaacacccagagcatccagatcaaaaaggttaaggccagaaaacagtga

SEQ ID NO: 11619 - RNA, 921 nt, unidentified
  source 1..921: mol_type = other RNA; note = synthetic construct
atgattctcgagagaataagcgcacagttggcgctcccaacgccattcctcggaaagctcgcgaggacagcctctcaccgatataaggagtatcccattaagaagaaatctggcggcacaagaacaattcatcatcctgcccgggaactaaaactcattcagacctggctgcttcacaacgtgttgatacgcctgcctgtgcacgctgcagcaactgcgtacagacagggttttagtatcaaacggaacgcagaaatgcacgtcagtcataattacttgcttaggattgacttccaaaacttttttccctcccttaccgggatagatgttgtggggattctgcaggctaaccgccaaaaactggccgatgtggaggtgactgaccaggacattattttcatcacccagatcgtatgccgctacaattcactgaccatcggtgctcccacttctccccagttgtccaacgccattatgttcaaatttgacgagacatggagcaggatggcccaggcattagaagtcacctattcacggtacgccgataacctgtacttctcaacaaatcgtcctgatacccttagagagatactcggcaggctgcgtgaatcgctgaatgaggtgggacacccagccttaaagatcaatgaggacaagactatctttagtagccgcaaaagacggcggttagctgccggcctggtactgacttctgatcgaaaaatcagcatcggcagagagaaaaagaggtggatcaagagtttggtcaatcgctttaagtataaacaacttaagccggaagaagttgctagcctccgagggtggatcagctacctgcggtccatcgagcctacgttcgtgctgtccctggaaaggaagtatggactggacctagccgctaactccacctgggaggtttga

SEQ ID NO: 11620 - RNA, 945 nt, unidentified
  source 1..945: mol_type = other RNA; note = synthetic construct
atgaatatttttcaggaagagatctccagccacttctcaaaaagttaccgagatatatttcggtacgcgctctcagctagccggagatataaatcttataccattcccaagagaactggaggatcccgtgacatagtgcaaccaagcaaagaactaaaagagtatcagcgatacattgtcagcaccctgttcaacaaactcccagtacactacgccgtgtatagctaccagaaagagaaaaatatcaagcaaatggccacaaagcacataaacgcaaggtttcttcttcggattgactttaaggaattcttcccctcaatcaagggggaacatataaggtctttcctgaaatccaatgtggactacctggaaacctctattaacgattatgacctgactctgattaacctgttggtgtgcaagagtaataagttgactatcggcgccccgtcgtcgcccgtgatctcaaacacgatcttgtacgagttggacaactttcttttcgataagtgtaacgttgagggtattgtgtatacaagatatgctgacgacctgtatttcagcacaatccatcctaataagttaaagacaatcctgcccctgctgaaacagtacctcaagacattctttattcgcctcgtcatcaatgaagacaagaatatctacacgtccaaaaaacgcagacagcagattactggcctgacccttaccaccgataaaaaactctccgtagggcggaagaagaagaggtacatcaagagtctaatctacaaatattcccaacagaacatcgttccagaagagattaattacctcaagggttatatgtcttacttatacagtatcgagcctgattatatagagaaactgcgcaagaagtactctagcgagctggtcggcgagctcctgcctttaaggcataaggaggaaaacgatgaggaatga

SEQ ID NO: 11621 - RNA, 930 nt, unidentified
  source 1..930: mol_type = other RNA; note = synthetic construct
atgaatatattccaggaagagattagtcgacattttgaaaagtcctatagggacatctttcagtatgcatccagggcgtcacggaggtacaaatcatataccattccaaagaagactggaggcagccggaagattatacaacccagcaaagagttaaaagagtatcaacgctatctgatcgagacaatctttaacaaactgcccgtgcacgatgctgtttacagttatcgcgagggtcgctctattaagcagatggccgaaaagcacattgacgcccggtatctgttaaggatcgactttaaagagttttttccatctatccgtggggagcacatcagagaattcctgacatcgaatattcatcacattgagctctccatcagtgactacgatttgactctgattaacctcctggtgtgtaaaagcaacaagttgactataggtgccccttcttcccctattatctcaaacaccatcctttacgagctcgacaaattcctattcgatacttgccacgctgagaacattatctacacacgttacgccgatgatctttatttcagcaccatgtgccccaataaattacagacactgcttccaatactgaagcagtacctgaaaaccttcttcataagactcgcaatcaatgaagacaaaaacatctatacgtctaagaagcggaagcagcaagtaaccgggttgaccctgacgaccgacaagaaaatcagcgtgggaagaaaaaagaagagatacatccgatccttgatccataagtactcacagcagaatatcactggcgaagaagctaactacctaaagggctatatgtcctacctgtactctatagagcctgattacattgaaaatctggtccgcaaatatagcaaggagacaattgcagaactcctcccgcttaagaacaataattga

SEQ ID NO: 11622 - RNA, 930 nt, unidentified
  source 1..930: mol_type = other RNA; note = synthetic construct
atgaatacttttcagaagcagctgtccgaaaagtttgagaaaccctttcttgagatttatcaattcgcttattccgcctctagaaggtataagacctacaatattccaaaaagaaccgggggaaaccggattatctcacagcctagcaaagaactcaaggagtatcagcgctacctgataaccaaagtgttctccaagttccccatacatgaaagcgtctactcatatcaggatggaaagaacattaaaggcatggcgctgaaccacgttaataaacggttcctgttacgtgtggacttcaaaagtttttttcccagcattaagggcgaatatatcaggggttttctggtgaagaatatcgagctctatgagctgagcctcagcaagaatgacatcactctaatcaacatgttcgtatgcaaatccaaccaactatctatcggtgcacccagttcaccaattatctcaaacatacttctgtacgaactggattcctacttatctgagatctgcaccaatctgaatattatttacacgagatacgccgacgatatgtatttcagtacgaaccagacaaatcaactcgaaaagattttgcctctgcttaaagagtacctcaagtcgttttacatcaaactggttgtgaacgaagataaaaacatcttcaccagcaaaaagaggcgacagatagtgactgggttgatcctgacaactgacgggaacatttcggtcggaaagaataaaaagcgcgagattaagtccctgatttatcagtacatcaagcagacaatctctagcgctgacttaaactatcttaaaggctacttgccttatctctacagtatcgagccgtcttacatagacatattgaagcggaagtacacagagaaaatcatttgtaagcttctgccactcaagcaagatatctga

SEQ ID NO: 11623 - RNA, 927 nt, unidentified
  source 1..927: mol_type = other RNA; note = synthetic construct
atgctaaaattcaatgagctgcttaagaaagaggacgacattgacttctttaagctctatctgtttagtctcgatgccagcagaaaatacaagacgtactccataaagaaacgcaaaggaggcttaagaaccatcaatcatccctctaaggagttgaagaagtaccaacggattctgagcaaactgatttttagcaagttgcctatccacgagtccgtcttctcatacaaaaagcgcatatctattaagaacctggccgaacagcacaagaataacaggtttcttcttcgaattgatttcaaggacttctttccctctttaacaagcaaaaacatcagggaactcttagaaaagaatctgagcctgtttgacttcgaactgtccaaagacgatatcacactgattaacaacatcgtgtgcaagagtaacaaactaacaataggcgcgcccacttcaccaatcatctcaaatgctctcttgtatgatttcgactgcgagatgaacaacttctcgaaaaagatcaagtattcccgttatgcagacgatttgtactttagcagtaatattccaaacctgctccagaatatcattccttacatcaagacctttctcctgaactataagattaaactacagatcaacgaggataaaaacatctacacctctaaaaagcggaaaaggtgtgtaactggactggtgcttaccacagataatgaaatcagtattggtagagagaagaagaaatatctgaagtctctgattttcaagtacatcaaaaagaccatcactagcgaggagcttatttatctcaaggggtacctctcctttgtgaaatcagtcgaagaatccttcttgaacaacctgataaaaaagtacaacccggtgataatcaaggaaattcaggagctgaaaaacatcgttatatga

SEQ ID NO: 11624 - RNA, 924 nt, unidentified
  source 1..924: mol_type = other RNA; note = synthetic construct
atgatctttctggagtcaatctgtaaacggtttgagaagaacctgaatcaaattgttgacttttctacgaccgctaacaagcgttacaagacgtacaaaattaagaaaaggactagcgggaccagaacaatcgaacagcctagccaggagcttaaactgtatcagaagttcatcagcgaaaagatttttctcaatcttcccgtccacgaggcggtgtttagctacaagaagaacattagcattaagaatctggctgataagcataagaataaccgatatctcctaaggattgatttcaaggattttttcccatcaatcaaaggcgataacataaggttgttcctcaaaaactctaatctaaaactgtctgatctcgagattactcttattaatctgttcgtctgcaagaataacaagttaactataggcgccagctcgtcaccctccatcaccaatgcaattctgttctccttcgacgacgacgtatataaattttgcctcgagcagaacattatctattcaagatatgccgacgacctgtattttagtacaaatgaagagggaatcctgtcctccattttggaatacgtgaaaaactacatcttcagttacaagattgacctgcatatcaactacgataagaatatctacaccagtaagaaacaccgccgcataattacagggttaacaatcaccaccgatggcaatatcagtgtgggtcggaaacagaagcaatacataaagtctctcataaactcctacaagtataaatgtctggaagacgagcagatcaactacttaaagggttaccttaactttctggtttatatcgagccgacttacatcgacaatttgaagaataagtacggagaagtgataatcaacgaattgttcatcaacaagttcaacaacaagtgcaattga

SEQ ID NO: 11625 - RNA, 933 nt, unidentified
  source 1..933: mol_type = other RNA; note = synthetic construct
atgatcgtgaaacgcatagctcaggagactggcctggactctgcctacctcgataaggtggtcagaacagcatctcaccggtataagacctataaaatcgccaaaaagaacggtggcctgaggatcatctcacatcctgccaaagaacttaagtttctgcagagatggcttgtgtcaaatctcttctgccatctgcccatccacagtgctgtatttagctatagggaaggtcggaatattaagcagctagcggaaactcacattgcaaataactttttgttgcggatagatttcgaagggttctttccctccatcctggtgagagacgtctcaaacctactgaaaaacagcatcgatgtgctgccgttccaattgtctcgcagcgacgtgaataaaatcgggatgattgtttgcaaggacggtcgcatcaccataggagcaccaagtagccctatgctttccaacgccatactctttaatatcgatactgagattgctgacgcctgtgttaaaaagggcgtggtatatacacgttacgccgatgacttgtacttctccacaaatgaaccaatggttttacaagaggtctttgagggggtgaaaggagtgctcaggaagaataagagtccaaagatcaggattaacgcagagaagaccattttcacgagccgcaaacataaaaagatggtaacaggcctttatatcacccctgataggcgggtgtctattggccgacagaagaaaagagctataaaagccctggtttactcatatatcaaccagtccattgcggaggaggacatgagttatctgcgagggtacctctcctacattaagagcgtcgagcccggattcttaagatcgctggaaaaaaagtacggacaggaagtcctgcagaagattatgatccacgagtacgtgaagcgtaagtga

SEQ ID NO: 11626 - RNA, 996 nt, unidentified
  source 1..996: mol_type = other RNA; note = synthetic construct
atgaatttgataaaggtgatggcagacaagtttggcctatctcctgatttcgtgcagaagactatatcatttgcacctaggagctacaagcggtttgagatttccaagaagaacggacaaaagaggaccgtttaccaaccagcccgtaaagtgaaactccttcagtccttcgtatctgacgagattattaaacgatttccactgcaccctgccgtcttcagctacagagaaggactgtctatccgcgacaatgccgaacaacataggagaaacaactacctcctccgactcgacttccgcaactttttcgaatctattgagatcaaagacgtcatccagttctttatccggaacgtgaaaaatgctcccttcgtgctgagccacgacgatattttgctcctcagtcagctatgttgtttcagagctgatgatggtaaactgagagtcgtgatcggggcccctagctccccaagtatcgcaaatgcgatactgtatgactttgacgtcgaggtttttgatcattgcaaatctcaggggataatttataccagatatgccgacgatctttacttcagtacgaatcaccaaaatttactgagcaagatcccggagttcgtctctagggttctttcccagacctcaagcccccgcctgatgatcaatgagaaaaagacatatcacacatcgaaaaagcatcgtagaatcgtgacaggattaaccataacatccgaaaatcgcattagcatcggtcgagataggaaacgggaaatcaggactctggtgtttaagtgcatctccaacagtattgacattgacaaaaaggagtacttgcgcggccttttgtcttatgtttcatcggtggatccagactttttcttctccctgctgcggaagttcggcgaggatgctatctactccattcagaagaaccagccccagagtgatcggaacgtactgtcaactgaggaatcagatagcggggaatttcccttctga

SEQ ID NO: 11627 - RNA, 918 nt, unidentified
  source 1..918: mol_type = other RNA; note = synthetic construct
atgattatccagcagattgctaagtccagtggcatcgaggctagctacctgcgcacaatcgtgagtaccgcctcccacagatacaagatctataaaatccccaagaaaactggtggggaacgcgagatccatcacccaagtagggaactgaagtatctgcagcgatggctcgtggataacgtgttcgcctatcttcctgtgcacgaagccgtcttctcatacagagacgggaagtcaatccgggatctggccaaaaagcacgcgaattctagatacatgctgaggctggattttgcttccttctttccatcgattgtggggagcgatgttgttaggttgttaaaaaacaacgtaggctccgtccctattagtttgactacccatgatctgatggacattcgcaatatcgtgtgcagatttggccgtctgaccatcggggcccctagctctcccgtcatttctaacgccatattattcgagttcgacaactatatctacagcaagtgtaagcagataggcattaggtataccagatacgcagatgacctgatattctcttctcaaaagactggagttctcagtcgggtggaggctgacgtcatcgcagccctcaagcaccttcccggtccaaaactggcgattaacgacaaaaagacagtcttttccagcggaaaaaatcgcaggaaagtagtgggcctggtgataacaagcgaaaagaaaatctccattggacgggataaaaagcggtatgtgaagagcttggtttacaagtatatcaatggcatcctctctgccgacgaacttgtttacctacgaggttacctagcatttgtcaattcagtggagcccgagtttctcgcaatgttgtcagctaaatacggatccgacaaaattcgtcttataacgcatccggtatga

SEQ ID NO: 11628 - RNA, 975 nt, unidentified
  source 1..975: mol_type = other RNA; note = synthetic construct
atgacactcaatgagattgccaaaaatctcggcgtcagaatctccaccctgcagtcgatagcacgacaagccaactacctgtatatttcataccgggtgaaaaagtacgatggcagttatcgcaccattaatcatcctagccggaggcttaaggcaatccaacgcgaaattctgaagcaggtatttagtaaagcccccgtccacgtgaacgtgtatagctacaaaaaagggatctctattggagatctcgcaaggtaccacgccggggcgtcatacttaacaaggtttgactttaccaagttctttgaaagcatcctccagtccgatattgatctccttatcgagaagctgatagacagtggatctatcgatcttctcaaaagcgacatacagactatctctaagctggtgacactgaaaggggcgcttacgatcggggccccttcatcccccatgataagcaattgcattatgtacagcttcgacgttttctgtgctgactactgcagatccaaaggagtgaaatattcaaggtatgccgatgacatctatctgagttctagcagccctaacgttctgaaaccactgggtgctttcttgattaccaacttttctaagcatactagcctgaagttgtcattaaacagagacaaatccctattcaccagcaagaaacacggcatgaaagtcactggcttgacgttaacctctgatggtaaggtgtctctgggccgggaaaagaagcggaagatccgcagtatgctgcatcacttttcccacggacgcctggacgaaaggcaggcagagtcgttgcgtggataccttaatttcgctctaaacatggagcccactttcatcacatccatgaaggctaaatttggcaaggagattaagcagctctcaatcagtccgccaaagcccaagcgttggccattctactctcgacagtccatcggtattagagggtcctattga

SEQ ID NO: 11629 - RNA, 1002 nt, unidentified
  source 1..1002: mol_type = other RNA; note = synthetic construct
atgtcaattgtcaaaaagattgctgaggagaatggagtgcctgagcatctgatcaaccgcattgtgaattcctccaaccatgcctataagacctacgaaattgctaagaagaatggcgacactagaacaatctgccaccctagcaaaaaagtgaaagccctgcaatactggttaaaccagaacgtattttgccacctcccagtacacagcagcgtgtattcttataggtccggcctcagtatactcgacgtggcaaaggaacacgtgggaaagaagtactttctgaagttggatttcaaggcattctttccgtccatcactgccgacgacctccgacgtcatctgcacaaacacaacaatttagttgagctggaccgagatgatatcgaggtcgcgcttaagatagtttcatatcaggaagctctcaccataggatctccatctagccccattctgtccaacagtatactctacgactttgatgacaagctgacactgttctgtatcgacaaaggtgttacctatacccggtacgccgatgatcttacgtttagcacaaacgatagtaatgtgctgacagaaatcaattccttcaccagagaactgttacaggggtttgatggtgtcaaactgaaaattaacgaggacaaaactcagttcttgtcaaaaaaaggaagggttcggatactgggccttatcctaacttcggacgggaagatctctgtgggcagggaaaaaaagagagagatcaggagtctagtgaaccggttcaaatacgatgctatcgaacccgatcatgactctaacgggaatgtcttgagcacgattgaggagaaaaagcgctctcttcaaggctacatcagcttcattgaatcaatcgaacccgacttcattagttccttgaagaataagtacgatgagaatgtcatcgaggcaattaagaagttttcatatgaggaggccatccagtcgagaacagtgattgaccgcacccctagctga

SEQ ID NO: 11630 - RNA, 948 nt, unidentified
  source 1..948: mol_type = other RNA; note = synthetic construct
atgatgatctatccccggactctgacgggcactatcgacattgagaattttctcaggaaacgccctatgctgatcgataaatttagcaaggaaattggtctgccaagaccgagcgtccagaaaatcgcagcgtcggctaactatttgtataagcattacaccatcccaaagcgttctggaggtgagagagacatctatcatcccacgcctcgtctgaagctagtacagcggtggattacccggcacgtgattagggatctgcccgtgtcagacgccgctatggcttaccgcaagggcaagtctataaccgacaatgcaaggcttcatgccgggaagagattcctccttaagatggatttcactgacttctttcctagcataaaagctcgagatttgcaacccatcttgacttccaggggttacgacccagaagacgtgaacttcattctgaccatctgctttaaatccggcagtctgaccattggagccccttccagtccagccgtctcaaatatcgtcatgtttgcgcttgatcaggagttcaagggaatcgccgataggcggaaattaacctattctcgctacgccgatgatctcaccttcgctggcaacgtgagaggcaatttaattgaagcaaaaaaggacgtggaaagactgatcgggacatgggccagtcctaacctcacacttaaccaacgcaaaacagttctggtgtcatctgcccaccggcagaaagttacaggcataacactaaccactgacggggagatctccattgggcgcgagaaaaagagggagttgagagctatagtacaccgaagcacataccagaagctcgaaccggaggtcgaggcatatgttcagggatggctggcatacgccaatagcattgaacccaaattcgtggactccctccgaaagaagttcgacacttacctggatttttga

SEQ ID NO: 11631 - RNA, 942 nt, unidentified
  source 1..942: mol_type = other RNA; note = synthetic construct
atgagtctacgcgataggctggagaaatcactgcccttctctcggaaagagatagacttactcgtgctttctgcccccctgcggtacaaaacctatcagattcctaagaagactctgggcaagttccgagaggtcagccaacctacaccggaagtaaagctactccagaggtggttgattagtaatgtgtttggcgattttgctgtgcacgatgccgctaaggcatatcgcaacggcatcgggctgctccagaacgtggcaccccataagaaccacagataccttctcaagcttgacttttcaaacttctttccttcaatctctagcggacacttcttcgaatttatggatggcaaagggtacgatcacgacgacctgattgttatgtcccgtgtctttttcaaaaactatcgtaagacagcgtccctcagactcgctattggcgcaccaagctcgccagcacttagtaatattctgctgtacgacttggacgtagcgatcagcaatttctgcaggaatttagatattacctacactcggtatgccgacgatctctcttttagcacaaacactgccgaagtcttgtccgaggttgagaagaatatcagtaagatcatcaaggagaattgtatcatcaatctgaccttgaatgaggagaagacagtgcatgccagcaaaaaaaacgggcggaaaataaccggactcacgatcacctcagacaataagatctccataggtctgcagcagaagaaactgttgagagccaagattgaccgataccaaaaaggactgttaactcaggacgccattgattccctaaaagggtatatcgctttcgtggattctgtggagccagaacatctggttcgcctgaccaaaagatacggtattgaaatcatgcgccagctgtatacgaggataaaccttgaaaacaacatatga

SEQ ID NO: 11632 - RNA, 939 nt, unidentified
  source 1..939: mol_type = other RNA; note = synthetic construct
atgtctcttcgagatcagcttctgagggctttgccctttaacgcaaccgagctggacttactcatttggagtgcaccactgcggtataagacatactacatcaaaaaacggcagcctggtcttttccgcgaagtttcccagcctacccccgaggtaaaattgctccagcgctggctggtggccaacgtgctgagcaactttccagtccataccagcgctaaagcctacaagcgggggactggcctaatagaaaatgtgcaacctcatgtccaacacaggtttctcctgaaagttgacttcgagaatttcttccccagtatcaaggctgatcactttatccgctttgcgagcgacgccggaatcgacgacctggacagcaatttaatgaagcaggtgctgttcaagcgcacgaaggggaccgggagtcttgcccttgccatcggcgctccgtcctcaccacacctgagtaatctgatgttgcactcgctggattgtgcgttagccctcaccgcttcaagggagaacattgcatatactagatatgcagatgacctgtccttttctacatccacacccggagtgctaagtgagttcgaaaaaaagctgccactgataattcgagagaactgcgacataccacttaagctcaacgccgaaaaaactattcatgcatccaaaaaaagcggcaggcggattacgggcctcacaatcaccccgcagggcacaatttcagttgggctcgagcagaagaagctgctcagatctcaaattcatcgtttcagcaagaatgaactgaatgctgaatctatccagtctctgactggatatatcgcctacttggcctccatcgagcctgcgcacctggtcagactagctagatactatggtatagatgtgatgcgtgccctctacccccctatctcagatttgttggtatga

SEQ ID NO: 11633 - RNA, 918 nt, unidentified
  source 1..918: mol_type = other RNA; note = synthetic construct
atgtcactgaaaaaaatcctagagaaatccctccccttctcatcaaaagagatcgacttttttgtcatgagtgcccccttgcgatacaaggtgtacaaaattaagaagaaggagcctggcaaatttcgtgaagtgtctcagcctagtgctgaagtcaagctgctacagcggtggttgatgctgaacgttcttgtcaaattcaaggtgcatgattccgccaaggcctataaagctggagtcgggttattggataacgtgagcccacatgtgaacaatagattcctgttgaagatggatttcgagaatttctttccgagtattactagcggggacttctttgacttcatggtcggcaaaggatacgattacgaggatatcgttgtaatggtgagcatacttttcaaaaaggatagagcagatgactcattacgcttagccatcggcgctccttcttccccactcctgagtaacattctgctgtacaacttcgacgtggccctggacgactactgtcaaaccctcggggtcgtgtatacacgatatgcagacgatctgtctttttccacaaagaactccggagttcttaatggtgtggagaaggcacttggagggataattgaaagttcatgctctatcagcctgaaggtgaaccgggataagaccatccactcttcgaaaaaaaatggcaggaaaatcactggactggtgattgggtctgacaataaggtgagcataggtttggaacgcaagaggctgctcaggagccaagtatatcggtttaagaagggtttcctcgaccccgaacaggttggctccctcaagggctatattgcgtttcttcagagcgtagaaccagagcacgttaaaagactgatcaatatttacggccgcgagacgatgtttctcctgctgtcctga

SEQ ID NO: 11634 - RNA, 921 nt, unidentified
  source 1..921: mol_type = other RNA; note = synthetic construct
atgtcacttaaagatcgtctgctgcgcgccctcccttttagccgacaggagttagaattgctaataagcactgccccattccggtataaagaatacaaaatccccaagcgaaaggaaggagcattcaggcttatcgcacagcctaccccagaggtcaagcttgtccagaggtggttggtgaagaacgaactgtcgaccctgcctatacactccgctgcaaaagcctataaggctgacacaggcctcatcgagaatgtgattccccataagaatcatagattcctgctcaaattagacttcgaaaactttttccctagtatcactgcttctgactttcaccaattcatggaagataatgggttctcaaataccgacattccgacgctcattaatctgttgtttaagagagatcacgctactaaatcactgcggcttgccatcggagctccatccagccccacgatttccaacattctattgtaccctctggatagggccctggacaaccattgcagtgacttagcagtgagttacacacgctatgccgatgatttgagcttctctacaaatctcccgggtatcctgaaggacatcgagcagtccgtaccagcacttatcaaagcctcatgttctctgaacctgcggatcaacaagaacaagaccacccatacatctaaaaaaagagggaggagagtgacaggactggttataaccagcgagaacgagataagcgtgggtcgctttcggaagcgtctgctgagagcccaaatccaccactttggcgcgggcaagctcccacccgaagagactgaggcgctacgagggtacctttctttcctcaatagtgttgagcccgatcagattgacaggctccggattttttatggcaaggagctgatgtcccgcctgatgtcccgctga

SEQ ID NO: 11635 - RNA, 918 nt, unidentified
  source 1..918: mol_type = other RNA; note = synthetic construct
atgagcctgagaacacgtcttctagcaaaccttccttttagcaaaaatgagctgaatctgctgattgcgagcgctccaattcgctataaggagtactctataccaaagcgacagccgaataagagaagggaagtctcccaacccaccccagaaatcaagctaatccagcgctgggtcgtggaaaacgaactcaacaaatttcctatacacgagtcggcacgggcctataagaaaaacgtgggcctgattgcaaacgtgttgcctcataagaacaatcggtacctcttgaaagtcgattttaaggacttctttccgtctataacaaaccacgactttaggaagttcatgatcgggacggagttcagtgatgatgatctgcacgacttgtcacagatcctgttcaaggctgaccataagactaaaactcttcggctggccataggtgccccatcatctcctctgctcagtaatattctgctttactcactcgacagtgttatccacgaccattgcaaagagattgaggtgacttacactaggtatgctgatgacctgagcttttccaccaaccgccccaatctgctcacaagtctttacgagaatcttcccatcctcattagctccggaaccgacatacatttaacggtaaacattgagaagaccgtgcacacttccaagggtaacgggagaaggatcaccggactgacaattaccgaaaagaatgagattagcatcggcagagaacggaaaagaatcttaaacgcccaggtgttccgcttcaagaataatctcctgtctatcgaggatatcgagaaactcaaaggctatatctccttcctgcgatctgttgagcccgaacacatcaaccgtttaatccagaaatacggggaatcaacaattttggccttgcaaaggtga

SEQ ID NO: 11636 - RNA, 918 nt, unidentified
  source 1..918: mol_type = other RNA; note = synthetic construct
atgctgctcaaagagcttatgcttgaatccttacctttttctagtggcgaactcgaggtgctgatcggcaccgcgccatttaggtacaaggaatataagataccgaagagggattctgataagttccgccagatcagccagcccaccccagaggttaagctgctccagcgttgggttgtggttaacgtgttgagccaatttcccgtgcacccagcagcaacagcatacagaagcggccggggtctattagaaaatgtgcgcccccaccaaaaaaatcgcttcctgctaaaagtcgatttcaaggactttttcccctcaattacttcagagaacttcaaggtgtttctcaaagaatcatcatactcggacgcagagatccgaatcttgtgcaatatcctgttcaagcttgacaggcgaacggaacaactgaggctggccattggagccccatccagccctgccctgagcaacatcctgatgtatcggtttgatgaagtgattagtaagttttgtgaccggttgtatgtagtctacacacggtatgctgatgacctcactttttccaccaatgagcgcgacgtattgtgtaaggtcgagaaagcccttcctgaggtgatcgccgaattcggcctgattgctctgacggtcaaccaggaaaaaacccgccatgctagcaaaaagactgggagacagataacagggctcaacatatctagtgagggggaggtttccattggaagagacagaaaaaggctgctcagagtccagattttcaaattcagcaagggagagcttacagccgatgagatcgactctctgagaggttacattgctttcttacagtacgcggagcctgcccatgtgacccgattgcggtcctcttttggcgatgacctgatctcccgtctgtgcagttga

SEQ ID NO: 11637 - RNA, 918 nt, unidentified
  source 1..918: mol_type = other RNA; note = synthetic construct
atgtcactgaaaaccgatctgctgcaggctctgccgttcaccgagcatgaacttacaatgctcattgccaccgctccccgccgttacaaggaatataccatcgagaaaaggaggcgccccgagcggaggaatatagcgcagccaactccagaaattaagactctccaaaggtggttgagcaaaaacgtgctgagcaagtttcctatacacgcctctgctactgcataccgaaaggacgttgggctatctgccaatgtgtcccctcatcttggcaacagattcttgctcaaaatcgacttcaagaattttttcccctccatcgaaagcgatgacctcgtggcatacttagagaagaaagcagagctgacaaatgacgactgctatattctcacgcagattctattcaaaaagaacgtcgagaaaggaaagctgactttggctgtgggtgccccttcaagcccacaggtcagtaacatcctgcttttccagttcgatgaagcggtgtctaattattgcttagcccacaatatagcctatacccggtacgcagatgacctcagcttttctacttccaccccggttattttgcgagattgtctaagtgtcgtgcgcaaaataatccaggatctgccttacccaaaactggtgatcaacgaagagaagaccgtagagacttccaagaagagggggcggagaatcacgggtcttaccattacaaacgatgacacaatctcgattggcagactgcagaagagaaaactgcgggttctgatccaccgttttaaaacaggcaatttggacgcctgtgaacaagagagtcttcgcgggtacttagcctttctgaactccgtggaacccaagcatgtcgagagactgaagatctcatttggagtagacacactcgctctgctcctgtga

SEQ ID NO: 11638 - RNA, 918 nt, unidentified
  source 1..918: mol_type = other RNA; note = synthetic construct
atgagtcttaaagttgacctcctccaagcactgcccttcacggcccaggaacttgacgtgctgattgccaccgctcctcgccggtacaaagagtataccatcgagaaacgcaataagaccggccggagaaacatcgctcaacccactcccgagataaagacactgcagcgttggttgagcaagaacgtgctctccaattttcctatccacgccagcgctaccgcatatcgcactggagtcggcctcgcgcagaatataagcccacatctaaacaatcggttcttgctgaaaatcgacttccagaactttttccctagtattacttcagacgatttgctcgcttatctggaaaagcgaaaggaattcacggatgacgatagatacgtgctgacccaaatcttatttaagagggacgccgaacggcgaaagcttactcttgcagtgggggcaccatccagccctcagttgtccaatatcctgctgtttcagtttgacgaggatatttccgccttctgcatagaaaataagatcgcctacacaaggtatgctgacgacctctctttttcaaccagtacacccgaaatcctgaggggatgtctgaacacagtacggcagatactgcgagatctccaacacccaaggctactgattaacgatgggaaaactgtggagacgtccaaaaaacgcggtaggcgcattaccggactgacaattacaaatgagggcgcaatctctgtcgggaggctccagaagagagagttgagagttcttatccatcgttttctcaacggccatctggatgcctgcgaacaggagtctctgagaggttacctggcgttcctttactcagtcgagccgactcacattgagagactaaaggccagcttcggcgcttctaccttagcctcgctgttatga

SEQ ID NO: 11639 - RNA, 915 nt, unidentified
  source 1..915: mol_type = other RNA; note = synthetic construct
atgagtttacggtcgaagattctgatggaccttccatttactgagagagagttgagtctgctgataatttcagctccccggagatacaaagagtactggattccaaagaggaacggcaggcagagactcattgcacagccaacccccgagattaaactgctgcaaagatggctcgtgcagaactatctaagcggcttccctgttcacgctgccgcaactgcttatcgacagggcatcggactgaaagaaaatgtcctcccccacctccgaaatcggtacatgctcaagttggatttcgagaatttttttccgtcattgaagtctagcgatctgctgaacttcctgaaagacgcacctctggaccaggttgatatcaatatgctcgcgcagttgcttttcaggaaagccgatctggggcttgaactagctgtgggtgcgccgtcctcacctcatctgtccaacgtgctcatgtataagttagacgacagaatcaacggattttgcacggccaacgggatcgcctacaccaggtacgctgatgatctcaccttcagcaccagtaaaccccatgtccttcgcgagtgtttacagttcgtgacgtccgccttggcagaaacagcctctcctaagctgcggcttaatgccgaaaagacagtagagacaagcaaaaaacgtggccgccgggttactggactgagcatctccacagagtctaaaatatcaatcgggagggacaagaagagggacctgcgcgtacttgtccatcgctttactaagggagacttaaatgccgaagaaatccaaaagctccgagggtactgcgccttcctgcgctctgtggagccagagcacctggatcgtttggcaaagtcctttggtgtggaagtgctgctagctctgaccgaaggctattga

SEQ ID NO: 11640 - RNA, 921 nt, unidentified
  source 1..921: mol_type = other RNA; note = synthetic construct
atggcgctgaaggacctcatgttggaatctctgccttttacgtcaaccgagctcgataggttaatcgaaaccgcccccctgagatataaggagtatgagatccccaagaggaatagtgacgacaagaggcctattgcccagccgacccctgaggtgaaactgatgcagcgctggttaatggacgaggttttgaggaagtttaaaatccaccacgctgcaacagcttacagaaagggcgtccagctcgttgacaatgtaaggccacacgctaacaatcggttcatgctcaaacttgactttcgcaatttctttccatccattatagctaaggatttcgcatcgtatctcgtaaagtccggttggcgcaaccgagacgatatacatcttctgtgcaacgtcatttttaaattcaaccgtagacggaagctcttagaactgagtatcggcgcccccagctccccaatggtcagtaacttcctgatgttcgacattgatcaagagatctaccagtattgtaaggacaatgagatcacatacactagatatgccgacgatttgacgttctcaactaaccgtaccgagatcctacgcgactgcaaggattttgtggtcgatgtgttggacaatactgacagccctctgctgcgactgaacgtggataaaatcgtggagacatccgtgaaacgggggcgaagggtgactggacttggaatcacaagcgataacaaagttagcattgggagagaaaagaaaagagcacttcgcctagaaatttaccggtacattaatgggtacctgtcagccaccgattctgaagcgttgcgtggctacctcgccttcctgaagtctgtggaaccagagcatatacaacggctgcagaaatcttttgatgatgaccggctgggtggactgcttccctga

SEQ ID NO: 11641 - RNA, 948 nt, unidentified
  source 1..948: mol_type = other RNA; note = synthetic construct
atgtctatatttgatagaatgctgcgggagctgcctttctcagcatccgaactgaaatacctaatcgcaacggcccagtatagatataaggtgtacaagatcccaaaacgccagtctaatcagtttaggacaattgcacagcctagccctgaaatcaaactgcttcagcgatggctcatgtcagacatcctgtctactttcccaataaacaaagccgccaccgcttacagagagggccggtctattgccgatcacgccagtctgcacgctaaaaaaaagtttctcctcaagatggacttcaagaattttttcccaagtatcagtgcggaagacgtccatcgctatttgattgagtaccgcaaggtttcccccgaggataccaggctgatcgggctgctggtgtgctggagaaacaaaacagacggaaagttgtgcttatcgattggagcaccgtcctcaccgcttctgtccaacgcgatgttatacacgttcgacaaagtcgtgactaagttgtgtagggatcaaaaagttacttactctcgttatgctgatgaccttgctttcagcacaaacaagaaggaggttctatctgtgatcaccaccaatatctacgatatttgtaacaatctggtctaccccagactcgtaattaacgagcagaagactgtaagcatctcccgcagttatcggcgggtcttggtgggactcgtgttgacccccacaggtaaggtgagcctggggcgagaaaagaaacgcagactaaggtccgagctttatcgattctcgcaaggccgtctgaatctggccgatgtcccaaagctgaggggcgagctcgcctttgcttggagcgtggaatcagactttatatttaccctgctccggcagttcagcgaaggtgtgtttaggcaactcgacttacctttcagccttcccaacgagattaattga

SEQ ID NO: 11642 - RNA, 948 nt, unidentified
  source 1..948: mol_type = other RNA; note = synthetic construct
atgtccctgttacagaaaatgctgatcgacctgccgttcagcggggatgagctgaaagccctcatctcaaccgccccatatcgctataaggtgtaccagatccctaaacggcagcctaatcagtttcgtactatcgctcagccgtctgctgagatcaaagtcatacagcggtggctgattaagaacgtcctttctagtctgcctatccacaaagctgcaaccgcatacaggctgggcgaaagcatatctgaccacgccgtcattcacgccgataaacgctttttgctgaagatggattttgaagacttcttcccaagcatttcagccgctgatattcagatgcatctgatacaaagcggaaagctatcacaagatgacgctaggttagtgcgccagattgtgtgttggttcgacaagatcaaagggggattctgcctgtccatcggtgcgccaagcagtcctctcctgtctaacgctctcctttataccttcgataagaaaattacacagctacttaagggtaaaaaggtgtcctactcgaggtacgcagacgaccttgccttttcgacgaaccgcacagacgttttgtccactatccccgcccaggtgcagtccatatgcgatgagctggaatacccccaactaagaatcaatcatagcaagactgtgtcaacctccagggccttcagacggacacttgtgggcctcgtattaactccaaccggagaggtcagtctgggccgcgagaagaagagacgtatgagaagcgagctgtatagattttctaagggcctcttggcagtaaccgaaacaccccggttgcgaggagagctcgcgtttgcctggagtgttgagcgagcattcattaattctctcgttaggcaatttggcattgaggtgttccggatcctggatttgccctttggggaagaatacgacctcaactga

SEQ ID NO: 11643 - RNA, 939 nt, unidentified
  source 1..939: mol_type = other RNA; note = synthetic construct
atgaacctgttggacaggatgatcgatgaactgccattcagtaaagaggagcttcttgagattatcgcgaccgcatcataccggtataaagtgtttcagataccgaagcggcagcctggtcaatggcgcaccattgcccagcccacacccgaagttaaactcttacaaagatggctggtggataatgtgctcagccagctgcctgtgcatagggcagctacagcctaccgggagggggtcagtatctacgcccacgccgaaaagcatgtcgacaagaagtatctgttgaagatggatttccaggatttctttccttcaatttccgcagacgctgttcagcagcaccttctgggcgtgggcaagataaaagaaaaagacgctaccctcatcagagcgctggtgacttggcgcaataaggtatctggaaagcgatgcctgtccataggggcaccatcgtctccaattctttctaacacaatgatgtatcggtttgacactgagattagtatcatcgcaaagcgatatggagctgtctactcacgctacgccgacgacatggccttttccacgaataggaagggtgttctcacagagctgtctagagaagtagagagcctatgtggcaagctgccttatccccgcctgactcttaacaaacagaaaaccgtgtacacttcacgagcctataaacgtgtgttagtggggctcgtgctgacccccgacaggaaggtcagcttaggccgggagaaaaaacgtgagctgaggagtaagctctacagattgctcaaaggcgcccccggagttgatagcgccagcttgcgcggtgaactggctttcgctaacagcgtagaaccagagtttatctcctccttggtcagacagtttggcacagatgcattcctacaactagggctgccgttcggatcctctaaggcgtga

SEQ ID NO: 11644 - RNA, 939 nt, unidentified
  source 1..939: mol_type = other RNA; note = synthetic construct
atgtcaattttcaaccgcatgctcactgaactcccctatagcaaagacgagttgcttaatctgatcgctaccgcccagtttaggtataaagtctacaaaatccccaagaggaagccaaatcagtttcgcactatagcgcagccttccccagaaattaagctgattcaacggtggttggtgaaatccgtgctggctgacttgcccctgcataaggttgcaactgcatataggaagggcaaatcaatcgccgaccatgcaaatctgcacaaaaagtaccagttcctccttaaaatggactttaaggatttcttccctagcattaatgtgctcgacgtgcgtaactatctaattgaaaccgccaatatgagtgaggatgatgctcggctggtgagctctcttgtttgttggaaggacaaagagaagaatagactgtgtttatccataggtgccccatctagccctcacctatctaacataatcatgtacgagttcgatgaacaggttagtatcatgtgcaaagagttaaacgtgtcatattcacggtacgcggacgatctggccttttcgaccagccagaagaacgtccttgagaaaatcccgaacattatcaagaacatatgcctcgcactggagtaccccaagctgattattaacgattctaagacagtatccacaagcagagctaaagggcgagtggtagttggactggtcttgacatccgaaggaaatatcagtctgggcagagaaaagaagcgccagctcagatacgaactttacaaattctccaagggggtcttggaccatgagagcatctctaaactacggggtgatctcgcctttgtctggagtgtggaggagcgattcatccacacgctgctgaggcaatttggcaatgaggtgttcaccaacctggaattaccttttcaaaaggccgactga

SEQ ID NO: 11645 - RNA, 942 nt, unidentified
  source 1..942: mol_type = other RNA; note = synthetic construct
atgaagttgcttcagctcctgcttcgggaagtgccgtttgaaaagcaggaactgctcactatcattgccacagcatctcggaggtacaaagtgtaccaaattcccaagaaagacggcaaatcagtcagaacaattgctcaaccagcccctgaagtgaagctcctgcagagaatactgcacgagaaactaatcggaaagtggcctatacacaaagccgcaactgcgtatattagtgaacagtccattgccgatcatgttagacgtcacgttaatagcaagtacctactgaagctggacttcaaaaacttctttcctagcattaccgccgcagatatcaggcagcatgctaggagacacagcaaactgggggaagacgatttggatatctttgtaaacatagtcgcctggcgcaacaatctggaccattccttctgcttgtcaatcggtgctccaagcagtcctgcaattagcaactcgatgatgtttgagtttgatgagtcaatcagtgctttctgtaagaagaaggaggtgacctattccaggtatgccgacgacctcgctttttctacaacccacagggatactctgaaagaggtcgaggcggaggtgcaccggttaaccctgtctatccagagccccaaacttaccatcaacgagaagaagacggtcaatgtttccaagaagtacaaccgatccttggtgggactgactatcacacccgaccagaaggtgtcattagggcgcgagcgcaaacgggatattagagccaagctttatctttatggacgcggctacctcaatggggaggacgtagcccatttacgaggcttgctggcgtacgcttggtctatcgaaccaacgttcatactgagtctggcagagaaacaaggtaatgagctcttcgccaagctggaactccccttccgtaatctaaaagactga

SEQ ID NO: 11646 - RNA, 927 nt, unidentified
  source 1..927: mol_type = other RNA; note = synthetic construct
atggtggtaagtctcttggctaaactttccaaagacctgctcttgcccaaggaacggctggagtatctcatccggtccgctccctacagatacaaagtgtacgaggtgcctaagagatcaggaacagggatgagaacgattgcccaacccgcaaaggaggtgaaacgcctccagtactgggttattgaaaatctcttcccgcgactacccatccatcctagcgctaccgcttacatcaaagccaagaacatactgaacaattctgagctgcatgtggccaagccgtacctgttgaaactggacttcgtcgactttttcccatctatcaagggcgatgactttattcagtatatccgggaactgaacaacttagatcttgatgaacttgatctgcaactccttgttaggatcctgttctggtatcctaaaaggatccacaatctccaactgtccgtcggtgcgccatccagcccatatctcagcaacgccataatgcaccgctttgattcagaaattgagagctattgttgccagaggagtattacctacactaggtacgcagacgacatgacttttagcatgatggagaaggcagcccggtcggaagtcctgaaccgagtcttacaggtgatacagcagctgccattccccaagctacagatcaatcaaaagaagaccatctttggctcaaaggcccaccgccgaatggttacagggctggtactgtctaacgccggaagggtgtccctaggacgtgagaagaagagacgcattcgtgcacagatacaccacttaattaccgggcatttgacacctcaggagaaatcttcacttagaggtatgctggcgtttgctaggagcattgagcctaatttcgtggaacgcatggagcagaaatatggcaaacgggtcttgagtaatatctga

SEQ ID NO: 11647 - RNA, 936 nt, unidentified
  source 1..936: mol_type = other RNA; note = synthetic construct
atgataagctctttgctcggatcaatgtccgctgatctattaatccctaaggataggttggactatctgctacggtccgcaccataccgttataaggtataccagatccccaagagaagtggttccggtaccagaactatcgcacagccagccaaagaagttaaatctctccaatattgggtgattaagaacatttacccgttcttccctatacatccctctgccactgcgtacacaatcggcaagtcaatcttgaaaaacagcgaggcccatgccacaaaaccttacctgctgaaactggatttcaaagattttttcccaagcattaccgggaatgactttctccaatacagcaagaacataaaacagctggccctttcggaccgggaccttcgtcttctcatgaggctgctgttctggctgagcgagcgaaattacgatttcagattaagtattggggccccgacatcccccttcctgtcaaatgctatcatgtatcagttcgatcaagtggtctttgactattgcaatgagcgcaatatctcttacacccgctatgcagacgacatggctttttcaatgcacaacattaagatgcggagtgaagttctggaaatggtgcagaataccctgacctccctgcccttcccaaaactacagttgaaccacaagaagacaatctttgggtctaaggcacacagaaggattgtaacgggactcgtcctctccaacaatgacactgtgagcctgggccgagaaaaaaagcgccggatcagggcccagattcaccaccttctgcttggaagactggacaacaaggagatttcgaaattaaagggcatgttggcttttgcgcatgatatcgagcctgcctttgtggagcgcatggtcgaaaaatatggcgagaaggtgataaagagtctcaggagcgcttga

SEQ ID NO: 11648 - RNA, 921 nt, unidentified
  source 1..921: mol_type = other RNA; note = synthetic construct
atgacattgttgggacagatgtccaaggatctcctggttcctaaaggaggattagtatatctcatgagatcagccccccatcggtacaaagtttttcccattcccaaacattctgggaaaggccagcgcattatagcccaacccgcgcgcgaagtcaaaagacttcagtattgggtgatcaaaaacctatttcctaggctggagatccacccagctgctactgcctacatccacgggcgcaacatccggtataacaccgagattcactcccaacttccatacatcctcaagctggatctgaaggattatttcccgagtctgaagggtgatgacttcaagcgttacgcatcaaatcacagcggcctcagtttaagtgacgaagaggtggatcatctggtgcggctgctgttttggcaaagggacaaggactcacagcttcagctgtccataggcgcaccttctagcccagggctctccaatgccctgatgtacagcttcgactccgagatcttttctttctgcaacgctaacggcattaattataccagatatgccgatgacatggccttctcaatgagggagaaggagaaaagaggtgatgctctgaggaaagtgaccgaaatattggaggtgatggaaagccctaagctgcacattaatgacgggaaaactgtgttcggctccaaggcacaccgaagaatgttgacagggcttatcctgacgaatgacggtcgagtctcgctcggccgagaaaagaagcgccggattcggagccagatataccattttatcaaaggcgacctatctgatacaaagaggcagtacttacagggaatgctgagtttcagcaaggacgtcgaaccagagtttattcgccgtatggaaaaaaagtacggaatcgagactctcaactctatctga

SEQ ID NO: 11649 - RNA, 930 nt, unidentified
  source 1..930: mol_type = other RNA; note = synthetic construct
atgaaggacgttcttttagagaaaatgtcctatgatctcctcctcaaaaaggagcagatcatacacttgattttgagcgcaccacataggtacaaagtgtatcaaatacccaagaagagtggcgctggaatgcggacaattgcgcagcccgctaaagaagtgaagatattacagtactgggtgatagagaactgtttccctctgatgcctatccacagagcagctactgcctatgttaaggacaagaatattcgtgacaattgcgaaccacatattaaaaatccctactttctgaagctcgatttcaaggattttttccctagcatcaaatccgatgacttcatccagtatatgaaaaacatcgggaacataacctttgatgacatcgacatccaacgactcgcgagaatcctgttttggtgtcccaaggaatacactgggctgcagctgtctattggagcaccttcatccccatacttgtctaacgccatcatgtatcgcttcgataacgaaattgacctgtactgcacacagcacaatatctcgtacaccaggtatgccgacgacatgactttctctatgctggacaaaacactgcgggaaaacgtccagcaaaaggtgattgaattacttcaaagcatcccctttccacagcttgagctcaataataagaagaccatctggggttccaaagcccatcgtcgcatgatcaccggtctgattatctcaaacgatgagaaaatcagtctagggagggagcgcaagcgccgaattcgggctcagctcaattacgccattaatggaaagctgacgccggagcagaaaaaatcattgagcggcatgctggcctttgtacggaacattgagccggatttcgtcctgagacttgaaaagaagtatggcagagagctaattagtaacctgaggtga

SEQ ID NO: 11650 - RNA, 918 nt, unidentified
  source 1..918: mol_type = other RNA; note = synthetic construct
atgctggccgataggattgccgacgatctgttactccctatggagatgcttcagtatctagttcgctctgccccccaccgctaccgggtatacaggatccccaaacacagcggctccgggttccgtactatcgcacagccagccagagaggtgaggatgttgcagtactgggtgatgaaaaacatatttcccgagttgccggtgcatagcgcggcaaccgcttattgcgctggtaagaatataagagataattgcgcccctcacgcagctaacccttaccttctgaagcttgactttcggaatttctttcctagcatcaaagcgggggacttcatccaatatgctgcagaagcaagacatcttcccttcgatcccccagaactgcggatgctggcttgtattctctttcgtagacccaagggaaaaaaggagatggtcctgtcagtcggggctccatctagcccttacctgtctaacgccctgctgtacgggttcgatgacgaaatgtcccggtattgtgagtcacgaggaatcgtttacaccagatatgccgacgacatggcattctccatgcaggacaaggccaagagactggaggttctccacaaggtgagggacgtgttgcggcagatgccgtttccacgtctgactttgaacgatcgcaaaacagtattcgcatcaaaggcccatagaaggagtataacgggcctgacactcgccaacgatggacgcatttccttaggccgggagcgaaagcgacagattagtgcgcagttgcatcacttcgtcaatggtaagctcccacaagaagaacgcggcaagctgcgcggcctactctcgtatgtgaaagacatcgagcctgccttttttaccaggatggctgagaaatacggaagggaaaaaattgctggtatctga

SEQ ID NO: 11651 - RNA, 921 nt, unidentified
  source 1..921: mol_type = other RNA; note = synthetic construct
atggctaatgaacttctcattagtcagatgtctaacgactttatgctgccagagaagaagctcaaaaagcttatcttgtctgccccatatcgctataaggtatactccatccctaaaaggtcaggcaagggttacagggtcattgcccaacccgcgaaggaggtcaaaatcctgcagtactggatcgtaagaaacgtgctgtgcaagttcgttgtccatgatgccgcaagagcttacgtgaagggttgtgggttattaagtaacgtttctcctcattgttactccaagtatctgatgaaattggacttcaaagacttcttttactccataaaggctggagacttcctgtcgtatttctctctctataaggactttggctactccgatatggacatccaggagatggtgaagattctgttttatgcccgtaacaagggcgattattgccttagcattggggcaccctcctctcccctgctctcaaatattatcatgagcgacttcgacaaaagggtcgtggagttttgtagcagccggagtatcgtgtacaccaggtactctgatgatatgacgttttccatgagcgactcgctcctgcgaagagaggttttcttcgagatcaaaagactgttggatatcatcccatatccgcggcttaagctgaatgaagacaaaacactctttctgagcaaagccaacaaacgcatggttaccggcctggtgctatcaaatgacgggcgaatatcaatcgggcacgataaaaaacggatgttgcggagcaaaatatataagtacactaaaggccacctagatgtggatgaagtgaatcagctcaagggaatgctggcatacgtgaacagtgtcgaacctgattttatttgcaagatgaagattcgctacggagacttaattatattctga

SEQ ID NO: 11652 - RNA, 930 nt, unidentified
  source 1..930: mol_type = other RNA; note = synthetic construct
atgggaagtaagagcgtatccttttcattaatttccaagatctccagcgacctattgataccagtcgaaaatctgagatatattatccgcacatcgccttacagatacaagaagtactctatacctaaaaggcgggggcggggcgtacgatctatagcacagcctgctaaagaagttaaaaagttgcagtattgggtgataaagaacgtgctgtctaagtaccccgtgcacccagccgcaacagcctataagaaggagagctctatccttcaaaacgccgagatccatctggacagtaggtgtctgctaaagctcgatttcgaggatttctttccctcaattcttgccaccgacattgtgcacttcttcgaaaagggatcgctggagtttgatgaagaggaggtgaatgcgttggcatccattcttagttgggcgagaacccgcacggctgaacgtgttgtggcaattggcgccccctctagtcccatgctgactaatatcatgctctatgacttcgattccgttgtgcgcaggtggtgcgacgagacaaagatcaactataccagatacgcagacgatatctcactgtcaggggatagcaaagaaagcctcgccgaagccaagaggaagattgctgaactgcttgaagagatgaatagcccgaggctctccttgaacaacgacaaaaccgtctttgccatgaaaccttttagacggtttgtcactggcttatacctgtctaatgaggacaaaatctccctcggtcgggacaaaaaacgagccattcgagctaaagtccatcatttcgtcaacgggaaattcaatcaggatcagatccagcacctccgcggagtgatcgcttttgctcgtagcgttgagccagagttcgtggagcggctggagaacaaatttggtaagctgttccaatga

SEQ ID NO: 11653 - RNA, 924 nt, unidentified
  source 1..924: mol_type = other RNA; note = synthetic construct
atgctgaaaaacctcggggctgccctgctgttgtctcaacaggaactatcccggcttattagctccgctccccataggtacaagacttacctgatagaaaagaggaatcgcggccaatatagaacgatagcccagccagccaaagaagttaaggcgctccagtactgggtgatccagaacgtgttgaacatgttccacgtccacccggctgcaattggatatcaacgggggaaaaacattgcagacaatgcccgctcccatgttaatagcagattcctgctcaagctggattttaaagacttctttccttccattcggtctgcggatttcgacctgtatattcgcaagcagcagattcagatcacagaccaggaggtcgccgctcttagtagaatactcttttggaacccaaaaggaacaaaagacatgtgcttagccatcggcgctcccagctcgcctggtttgtcaaacatcttaatgttcgagtttgacagtgcagtagaagctttttgctccgaggcaggcgtttcatacactaggtacgccgacgatctgagtttcagcgcgaatctgtcagatgagcttaggcgtgtggaggaatgggtgacacacctgtgtgataatctcgaaagccctcgactgtcactcaacagggagaagaccgtgcgtgtatcgaagaaacgagccagacgggtgactgggctggtgttgacaaatgacagcaaggtcagcatcggccgagatcagaagcgccggatcagagcctctgtccaccacttcgccaccggtcgtctgccagaggatcaaagtcgcaagctgagaggcctcttagcttatatcaactctgtggagccctcctttctaaatcgcttgcggcataaatacggagcagacaccatcaagaggcttcagtctgcaacctga

SEQ ID NO: 11654 - RNA, 951 nt, unidentified
  source 1..951: mol_type = other RNA; note = synthetic construct
atggacctgatcgaccgcctgcagtcagcttttcccctttcccgccccgaagttgagttgatcattcgtaccgcaccactgcgatacaaactgcacttcatagaaaagcgcaatggccgcgggcaacggcagatagcacagcctactgccgagctcaagttggtacaaagatggctggtcagcgagtttgtgaataacctcccggtgcaccctgccgccgttgcttacaggccgcagctgggaattaaggatcacgccagaaaacatgcagcgaagaggtatctccttaaactggactttaaagacttcttcccaagcatccaggcgagagacttccacgcccatctagctcggtatacagaactttctttacccgacaaacacgctctcacacggctgctgttcagactggaccgtgaaaccaaggagatggtgctatcaattggcgccccaagttcacccgcagtgagcaatactgtcatgtaccggtttgattctatggttagtgattattgcaaggacttacgcgtggagtacactagatatgcagatgatttggccttctcaaccgatcagcctcacgtccttgacgagattcagaaccacgtcaggcagctgtgtagggccatggaatacccctccctcacgcttaacgaggggaagagtgtgtttacaagtaaaaagcatcagcgtcaattgaccggcctcattctgacaaatgagggtaaggtaagcctgggaagagaaaagaaacgagagatccgagccatggcgcatcggttctctaacggagatctatctgctgaagacgtgtctcgcttgcgggggctgctggcttttgccatgtcgatcgaaccacagtatgtcgagagcctcgtgaggatgatcggccagcagagctaccactccttaatgaggcctggtagaaggacccattcctccgatcaatga

SEQ ID NO: 11655 - RNA, 945 nt, unidentified
  source 1..945: mol_type = other RNA; note = synthetic construct
atgaatctgatcgaacgtctgcaaatagctttcccattttccagacgggaagtggagctgctgatccacaccgcccctagaagatacaagattcattcgattgagaagcggaatggcaggggcttgaggatgattgcccaacctacagcagagttaaagctggtgcagcgttggctggtttctaattacctgcagtcattacccgtgcatagtgctgcgactgcctaccgtcccagcctcggaattaaagaccacgcacaacttcacgcatcaggaaagtatctactcaagttggattttgaggacttcttcccctccatacgcggcgaagacttcaggcagcacgtggccaggttttctgatgttactcttccggaccagaccgctatggtgcgccttctgtttagggccgacgtcgatgccaaacggctgatcctgagtatcggagccccctcaagcccagctgtgtccaacaccgttatgtattctttcgatctggctgttaaggagtactgcgagcaggcaggcgtacgctatagccgctacgcagacgatctcgcgtttagtacaaacgtccctcacatcctcgaggccgtgaagactcgagtcgtcgagatatgtcgaacactcgaatatcctcggctccgcttgaacgaagggaaaacggtgttcacctctaaaaagcatcagcggcagctgaccggccttatcttgagcaacgacggacgagcctccctaggtagagagaagaaaagaaaaattagagctacagctcatcacttcgcccagggggtattatccccagaagaggtgggtaagctcaggggcctgattgcatttgccatgagcatcgatgcagagttcgtcgcgtcaattaacaatatgcttggggagcagatctttaaagaactgatgcgggggaatggggaagtggctgaaggttga

SEQ ID NO: 11656 - RNA, 927 nt, unidentified
  source 1..927: mol_type = other RNA; note = synthetic construct
atgaacttaatagaccggctgcaggcggcctttcccctatctcgcgctgaggctgcatccatgattgaaaccgcccccaggagatacaaaattcatctgatcgaaaagcggaatggcagaggccttcggcagatcgcgcaaccgacagcggaactgaagttggtccagaggtggattgtggctaactatataaatgcccttcctgtacaccaagcagctatggcttaccgtccagacctcggaataaaagatcatgccaaggagcacgcaaccaagaaatacctgttgaagcttgacttccgtgatttctttcccagtattaaggctaatgacttcaagcagcacttgacccgccatacagaaattagcgaggctgataaagtggcaatcaccaggttactgtttaggtatgatcgggagaatcaggacatgcggctgtcaatcggcgccccttcgtctccttctgtcagcaatactgtgatgttccattttgatactatcgccagtgattattgtaatgccgccggtgttcagtacacacgatacgctgacgacctcgcattctccaccaacaccccccacatcctggacgagctacagaacttcgttcgagagacatgccgccagctcgactatccaagactgactttaaacgaggagaaatccgtgtttacttcaaaaaagttccagaggcaactgacagggctgattctcacgaacgaaggttcagtcagtttggggagggaaaagaagagactcatgagagccatggcccacagatttaacctcggaactctttctctggatgatacgaagaaacttcgcggactgctggccttcgcaatcagcatcgaaccagagtatgtgaattccattatccgcatgataggcgagcctagctacaaaagcctcatgcgagggaactga

SEQ ID NO: 11657 - RNA, 933 nt, unidentified
  source 1..933: mol_type = other RNA; note = synthetic construct
atggacctgattgaccgcctgcaagcagcctttcctctgtctagagctgaagtcgaactgctaataaaaacagcccctcggcgctataaaatccacaccatcgagaagagaaatggccgaggcctcagggagattgcacagcctactgcggaattgaagcttgtacagaggtggattgtgagcacatacattaacgagctgcctgtgcactcagccgcaatcgcataccggcccggtctgggaatcaaggatcacgctaaaaagcatgcggcccgtaagtatctcctgaagctggatttcaaggactttttcccatcgattcgcgcgggtgaccttcgagcccatctgacccaccacacagacctcagtactgccgacaaaagtgctttgatgaggctcctcttccgtttagatagtgagaacggagccatggttttgtccataggcgctccctcctccccagctatctcaaacacagtgatgtatccattcgacattgccatagccgactactgccgcgaaaacgacatcgcatacacccgctacgccgacgatctggctttctctacggatactccccacgtgctggatgctctccaagattttatcaggaagacctgtcgaggcctgatatacccctctctaacccttaatgagaaaaagacggtgtttactagcaaaaaattccagcggcagctgaccgggttaattctcacaaatgatgggaccgtcagcttgggcagagagaaaaagcgggatcttagggccatggcccatcacttcagcaggggagctttgtcaaatgaggaaatgagccggcttagaggattactggcctttgctatgtccatcgagccgcagtttgttcattccattatcagaatgatcgggaaggaagcatatgcgcagctgatgcatgcatctgggacttga

SEQ ID NO: 11658 - RNA, 918 nt, unidentified
  source 1..918: mol_type = other RNA; note = synthetic construct
atgaacatcatcgaaaaccttcagaaagcttatcctctaagcaaggaggaggtggaattttttatacaatccgcaccacggaggtataaggtacatcatatcgaaaaaaggaacggtcgtggactgagagtaattgctcaacccacagcggagctcaaaattatccagaggtgggtgacgaagaagtttatcaataaactgcccgttcacgattccgcgatggcctataggctgggaaaagggatcaagaatcacgccaactcacatgcccagcagaaatacctcctcaaattagatttcaaggacttcttcccctctattaaaccaagagatctgaaattgcacttagcaaattacactgacctccacaaagacgatataagcgtcatccttaaacttctgttccgctacgataaaagcaagggcttgtccctcagtataggcgctccttcctcacctgccgtgagcaacacaattatgtatcccttcgacgaaatggtttccgactactgtaaaaagcgaaagattaagtacactcgttatgccgatgacctagccttcagcacaaatcatccccacattctcgacgtgctgcagaactttataagagagctttgcgagagtttgaaatatccgaaactcaagttgaatgaagaaaagtcagtcttcacctctaagaagtttcagcggcagctgaccgggctgattctgaccaatgacggtaagatctctctggggcgggataagaaacggctgatccgcgcaatggcacacaactacaagatcgataagctggacccaaaggaggtgagtcgcttacgaggctggctggcttttgccctttcggtggagcctgaatacgtcgagtctattaagagaatgctggataaagacatctacgagaagttgatgaagtga

SEQ ID NO: 11659 - RNA, 984 nt, unidentified
  source 1..984: mol_type = other RNA; note = synthetic construct
atggatgctaccaattcagaactgctggagttgctctgcgacgaacatcccttgactcgcgcggaagcctgggagttgattctcaccgcccctcggaggtacaagatccattacattgaaaaacggaatggcagaggccgaaggctcattgctcagcctaccgctgagttaaaagcaattcagcgctggatcatttcaaagtatatcgctgcgatgccagtacatgaggccgcaacggcttacagacctcacaagaacatctcggatcacgcgcgcgtgcatgccaaaaataaatacctgcttaaggtagacttcaaagacttctttccatctatccgggatcgcgacttcgtgcagcatgccgtgaagcaccttgggatttcaactaggcttgcctcagaactgtctttcctgctgttccgtcgtgatgaaaacaaaggtttgtccctgagtataggcgccccctccagccccagcgttagtaactctctcatgtatgaattcgacctgaagctgagcgagtattgcgatgccaacgaaatagtttatactcggtacgcagatgaccttgccctctctacaaacaaaccgcacgagctagataaagcaaatgagtttattagggagctcctgggatgtatccgctaccctcgaatcgagatcaatccggagaagaccgtctttacaagcaaaaagtttcaaaggcagctgacaggcctgatcctgtccaacgagggcaaagtctctctcggacgggacaggaagagaagcatcagagcaatggccgaccactatagaaaaggaaagcttgctcccgaattacacaccaagctaaaggggtggctggctttctccttgagtgtggagccagatttcgtgcgaagtattagaacaatgatgggggagtttcactactttaagttagtgagcgtcaatgaaaagatggaagcagaggggataataccatccggtgacgagtggtga

SEQ ID NO: 11660 - RNA, 984 nt, unidentified
  source 1..984: mol_type = other RNA; note = synthetic construct
atggatgccaccaattcacaacttctcgagctcttatgcgaagaacacccatttacaagggcggaggcttgggagctgatcaggagtgcgccaaaacgttataaggtgcacttcattgaaaagagaaatgggagagggagacgcttgatagctcaacccacagcagagctgaagactatacagcgctggatagtaaacaaattcatagcaccacttcctgtccatgacgtggccatggcctacagaccgggaaagaatattgccgaccacgcaagatcacatgctggcaacaaatatctgctgaaaatcgacttcaaggattttttcccttcaatcagggcgcgggacttcactcgccacattgtgaaacacctgggcgtgaacaccagactggcatctgagctcgctttgttactctttcgcaaggatgagaacaaaaggctgtctctgagcatcggagccccgtccagtcccagcatcagcaacactctcatgtatgaatttgactgcaaactatctgaatactgtaaggagaacgagattacttacacacgatacgcagatgatcttgccctgtccaccaataaaccccatcagttagataaggctaatgagtacattcgggagttgctgaactgtgttaagtaccccaggatcatgatcaatcctgaaaagacggttttcaccagcaagaagttccagaggcagctaaccgggctgattctttcgtccgaaggcaaagtgagtcttggtcgagagcgtaaacggctcatccgagtaatggccgatcattatcgcaaagagaaattggatccaaacctgcacacccagctgaagggttggctggcctttagcctatccgttgaacctgactttgtccggaatattcgggccttgatgggagaagagtattactccaagctgatctctatcgacgtcaaggtggccacggagcagctcattcccgctgacgacgaaacatga

SEQ ID NO: 11661 - RNA, 1017 nt, unidentified
  source 1..1017: mol_type = other RNA; note = synthetic construct
atgaccaggagcgcagctaaaccaatgagaagaagtatggacgcgacgaatagccaattgctcaatctgctgtgtgatgaattgcctttcacaaggacagaggcatgggaactgattagatcagcccccagacggtataaggtacacttcattgaaaaacggaatggccggggtaagcgcctcattgcccaacccaccgccgagctgaaggctgtgcagcgatgggtggtgactcgctttatctcccagatgcccatccatgatgctgcgtccgcgtaccgcacaaaccgctcaatcggcgatcatgcgaggctgcatgcacggaacaaatatctcctcaagatagacttcaaagacttctttcctagcatcggcgcacgcgacttcaaaaggcacgcaatcaagtaccttgccattgacgcccgcctggcctccgaattagctttacttctgttcaggcgtgacgagcacaagagatttacgctctctatcggagccccctcgtctcctgttctgagcaatactctcatgtatgagttcgattccaagctgagtgagttttgcgaaccgaaggggataacatactctcgttacgctgatgaccttgctctctccaccaataaaccacacgaacttgacaccgccttcaagtttatcaacgagcttctgaacgatctcgcttacccaaggctgactatcaatcaggaaaaaaccgttttcgcctctaagaagcatcagcgaaagttgaccggactaactttaactaacgccggagatattagcctagggcgagagcggaagagggagattagagccatggctgaccactacagaaaaggaaaattggaggggaaccgacacggccagctgaaggggtggttggcctttgctctgtcagtcgaacctgagtttgtccggaccattcggaaactgctgggtgaagagatgtatgcagcactgctgagttttggcgacgtgtcagccccactagtgacacagcttgatgatcgtgagtga

SEQ ID NO: 11662 - RNA, 972 nt, unidentified
  source 1..972: mol_type = other RNA; note = synthetic construct
atggtggacaataattcagaactggtcgatatgctgtgtgatgagctgcccttcaccagaacagaggccgctgtgtttatagacagcgcttgccggatgtacaagatccactttatcgaaaagagaaatggcaaagggaaaagactaatcgcccagccaaccgcggaggtgaaagagattcagaggtggatcattaagaagtatatcaagaaccttcctatccataatgcggcgacagcttacagggaaggccggaacatctttgaccacgcacgcccacacgtcaagaataagtacctgctcaaggtagattttaaagacttcttccccagcatacgtgcccacaatttctctaagcacatccgcaagcatttggggattagcaagcctttagcaattgaccttgcccgtgtcctttttcgacaagatgaaaagcgcagattgagtctcgctattggagcccccagtagccccagcgtgtccaacaccctcctatacgaattcgattcccagttatctatcttttgccaggcaaacaacatccaatatacaaggtatgccgatgacctcgctctgtccactgacactccgaaaatactggatgaggccttgaagtttattgaaaagctgatcaaggacatcccttacccaaaactgtcaattaacaacgagaagacggtgttcacgagcaagaaattcaaacgagagctgaccggattgattttatctaatgacggttcggtttcactgggacgggagaaaaagaggatgataaggacaatggcccacaaatactcaagtggtgaacttcatgattctctgattggccgcctcaaagggttcctcgcattcgcccattccatagagcctatctttgcagctaagatccgggagaaaattggcgaagagaaatataattccctgaccaactttcaggagactaaccatcagaaaaaagttcaggacttctga

SEQ ID NO: 11663 - RNA, 924 nt, unidentified
  source 1..924: mol_type = other RNA; note = synthetic construct
atgaatctgattgagcacatccagaaggatttctctctgtcactccatgacgctcgggtgctcattttcacagccagtagacgctataaactccattacatagagaaaagacacgggcggggcaagaggctgatagcgcaacctactgcagagatcaagctgctacagcgctgggccattgaaagctacctgtcaaagctgccgatccatagagccgccaccgcatatcgacctggcaggggaattaaggatcacgccgaagtgcacgctgacaaccgctatttactgaagttagacttccaggatttctttccttccatactcggcaggcatttccttatgcacctgaagtcacacgccagtatagccgacgacgatgctaaatttcttatgcggttactgttccggtttgaccgggatagtcaggactacgtcctaagcatcggggcaccctcatctcccgcagtcagcaataccattatgtatgactttgataacgccctcactgattactgcaagacccacgatatcatctactctcgttatgccgatgacttggcgctttctacttccaagccaaaggtgttggatgacgcttttaatttcgtgaaacagctgtgtaaggacgttccttacccccgcttgcaactaaacgacacaaagacagtattcacgagcaaaaaacaccgtaggcaactcacaggtttgatcctgaccaacgaggggaaaccctcccttggaagggagaaaaagagactcatccgatccatggcgcatagattcagtctgagcgagctgccagatgaccagatcctgcatcttagaggcctgctggcttttgcttactccattgaaccactcttttttagctcgattaatcgaatgatcggcggagaagcattccagcgcttgatgaaaggttga

SEQ ID NO: 11664 - RNA, 924 nt, unidentified
  source 1..924: mol_type = other RNA; note = synthetic construct
atgaatatcattgagcgaatacagagcgactttagcctttccttacacgatgctcgggtgcttatattcactgcagcatacagatataaactccactacattgagaagaggcacgggcgtgggaaacgcttaattgcccagccaaccgctgagattaagctgctccaaagatgggctgtagagaagtatgttggtcagctgcccatccacaaagcggcaacagcctaccggagtgggacgtcaataaaagatcacgccgcactgcacgccgaaaactgttatttgctcaaattagacttccaggatttttttccgagtatcctgggccgccattttctgatgcacttgaagagctacatgaagatctcagatgatgacgccaacctccttatgcggctgctcttccgtttcgacagggaatcccaagattatgtgctatctattggtgcgccaagttctcccgccgtgagtaacacagtgatgtacgatttcgacaataagctcactaattattgccggactcatgacatcgtctacagcagatatgccgacgatctggcgctctccaccagcaaacccaaggtgctgaacaacgcttttgacttcgtgaaaaagctgtgcggcgatatgccttaccctcgcctgcagttgaatgacgctaagacagtctttacctctaagaagcatcggaggcagttgaccggactggttcttgccaacgacgggaagccatccctcggacgcgaaaagaaaaggctaattagatcaatggcacatcatttttccctaggcgaactgcctcaggaccaggtccttcacctgcgaggattgctggctttttcgttcagcatcgagcccctgttcttctcatctattaataggatgatcggcgaggaagccttccaaagactgatcaaaggctga

SEQ ID NO: 11665 - RNA, 930 nt, unidentified
  source 1..930: mol_type = other RNA; note = synthetic construct
atgggactgattgagcgcatccagcaggacttcacgctaaccaggcgcgaggtgcagctgctgcttttaacagccgcatcccggtataagctacattatatcgaaaagcggcatggccgtggtcggagacttatagcacaacctacagcagaaataaagatccttcagaagtgggctgtggccaactacgttaatctcctgccaattcataatgctgcgacggcttaccgcccaggcagaagcattaaagaccatgctgtggcccacgccggcaatagatacctgctgaaactggactttgagaatttctttccgtccatcactgggaacaacttctttgatcacctgaagagttatctcgaagtttctgatgaggatgccaacttattggtgaggctgttgttccggtacgaactggtcagtcgaaactacgtactctcaataggagcacctagctcccccgccgtgtcaaacaccatcatgttcaagtttgataccgcccttgccgaatattgcgacgcgaaccagatcgcttatactaggtacgcagatgacttggcactgtccacaaatacccctaaagtactcaatgatgcctacaatttcgttaggcagctctgtcgagagactcagtatcctcgggtcagcttgaacgagaagaagacagtgttcgtcagcaacaaatttcgcagggagttaaccggcctggtcctgagcaatgagggaagaccctctcttggtcgagagaaaaagcgtcaaattaggtctatggcgcaccacttctcactcggccagattccccccgaggacgtgccacacttgagagggctgatcgcttttgccatatcgattgaaccagaattcattgagtccatcaaacgcatgatctcaatcgaactgtttcagtctctcatgagtgggcaagcttga

SEQ ID NO: 11666 - RNA, 927 nt, unidentified
  source 1..927: mol_type = other RNA; note = synthetic construct
atgaaacttattacggccatacagaacgacctcccattgagcatctctgaaattcagctgctcctgttgtctgctccacatcgatacaaagtacatgagatccagaagagacacaatcgcggcactcgggttatagcccagcccacctcagaaattaaagtacttcaaaggtgggccactactaatatcctggccaagttacccattcactcagccgctacagcatatgtcgccgaatccaacacaaagaagcatgcccaggcgcacgcaaagaatcgttacctgctgaagctcgactttaaagatttctttccctccatcaaggcggacgattacttgcagcacctgataaaatatgcaaaaatcgacattgacgacgcccgacttctctgtagacttttgttctggcgggaccgggtcagtaacagcttaaagttaagtatcggcgccccgagtagcccaatggtgtccaataccgtcatgtacgatttcgacacatttgtgtcggaattttgcctgaaaattgaggtggtctacacccggtatgctgacgacctggctttctctacagacaaccccaaggttctagagtccgtgcatgagtttatcatcaccctttgcaaaaatctcccttatcctaacctgcagctaaacgaggagaagacggtgttcgtgagcaaaaagcacaaaaggtatctgaccggactggttctcaccaacgatgggaagccttctgtgggtcgcgataaaaagcgtcaaatcagagcaatggtcaatacatatgctaacggaaacatgcctgatgatgagctcaataggctgagagggttgatagcatacgctcacggcattgatgaaaagttcatcgatagcctgattcgcatggtggggactgagaactacaataagctgatctcaggtaggtga

SEQ ID NO: 11667 - RNA, 972 nt, unidentified
  source 1..972: mol_type = other RNA; note = synthetic construct
atgtgccaagggcaggagcggataactaagtttattcgttccaacgacatgaatgtgattcggaccatcgtaaacgcctaccctctgagtctacgagaggcagccgtcctgatccagacagctcccgcacgctacaaggtgcaccaaattgagaaaagacacgggcgaggaactcggaccattgcacagcccacagccgaaattaaactgctgcagaagctgctcgtgagggaggtgatagagaagcttccggtgaatgacgctgccaaggcttatcgctcaggccaatcaatcgccgatcatgctcgcccccacgcaagcaaccgtttcctgttaaaactcgacttcaaggacttctttccttccatccggggagccgattttctcaagcacttgcacaaacacagtgagatcggcacggaggattctaagcacctcgtaaagctctttttctggaggccaagagggactcgctctttggtcttgtctatcggcgcccctagcagcccagcaatctcaaatacaatcatgttcgactttgattctgccttaagcgatttctgtacccgggaacatgtggtttacaccagatatgcggacgatttggctttcagcacaaacggaccagaggtgctgcacagggtgcatgaacatgtcataaatctgtgccgcactcttaagtatccccgtcttacgctgaacgacgccaaaacagtctatacctccaaaaagcatcataggagtttaaccggactggttctgtccaatgatggtaaagcgtcactcgggagagagaagaagaggcagctgagggctatggttcacagacttaagtacgatcttctaaaccaggaagaacgggccaaattgaaaggttggattgcattcgcgctcagcattgacgaagagtttgtccgatcgctgaaaagaatcatgggcgaccagacttttgaatccctgatgcgcggctga

SEQ ID NO: 11668 - RNA, 924 nt, unidentified
  source 1..924: mol_type = other RNA; note = synthetic construct
atgaacgtgatcgagataatcctgcatgaattcccgttggggcgccaggaggtcgaaagactgattcgcactgctccctcacgctacaaagtccacgagattgagaaacgcaatgggaggggcaagagaaccatcgcccagcccaccgccgagatcaaactgctgcaaagatatctggtagatagatatatctccaacctgcctgtgaatgacgcggctaaggcttacaggttaaaccacaacatactggatcacgccagcccacacgccaaaaatcagtaccttctcaagttggatttcaaggacttttttccaagcatacgggcggtggactttattaagcatctccgcaaatactctgccctctctcgggaagacatgaaaacactatctagggtcttcttttggcgtcccaagggccagagggacttgattttgtccataggcgccccatcgagccccgctatttcaaataccatccttttcgatttcgacagtgctgttatcgagcattgcatcaaaaacgagattacgtacacccgatacgcagacgacctcgccctctccactaaccagcctaatatcctgaatgatgcgtatatctttgtggaaatgctctgtcgttcattaaaaacacctaagttaaccctgaatgcagataagacggttttcacaagcaaaaagcaccaccggcaacttaccggactggtgcttagtaacgccggcactgcaagtattggacgggaaaagaagcggacaattagggcaatggcccaccattataaacagggtattctatcccaggaagagcatgggagactgcgaggttggctggcatttatgatgtctatcgatcgagagttcgtgacaactatcgaaaagatgataggagaggtagctttccaaaagctgatgcaggactga

SEQ ID NO: 11669 - RNA, 930 nt, unidentified
  source 1..930: mol_type = other RNA; note = synthetic construct
atgaacgtccttgagctcttgcagaaaaaattgcccctatcaagatcagagctgctgctgctcattgccacagctcccaatagatacaaggtgcacacaattgacaaaaggcataaccggggtaaacgtgtcatcgcccagccaacagccgaagtgaaggcgctacaaaagcttctcctgggcatactcaggggcaagttaccagttcactcttgtgccaaagcataccagcccgggacgagcatcagagatcatgccctgccacacgctcccaatcggtatctgctcaaactagacttcaaagatttcttcctgtccattaaaggaggagatttttcctcccacataaagagacatctggatattcctgatgttgagatcgaaatattcacacacgcgttcttttggacccctaagaaaaccatggactttgtattggctatcggcgcaccgagctccccgtggatttcaaataccattctttttgagttcgacgagctgctgaccgactattgcgattctaagaacgtgaagtacacccgctatgccgacgacttggcatttagtaccaatactcctcatgtattgaaggacgtgcatgcctttgttcaggacatctgcaaggagatcgcttatccacgcctcaacatcaacgaatcaaagactgtgtttacttctaagaagaacagcaggagtctcactgggctcatcctttctaatgaagggagcgtgtccataggacgagcaaaaaagcgagaaattcgggctatggcccacaagtaccagatcggtgcactggacctggagtcgaccctgcacctgcagggcctgcttgccttcatgcaaagtattgatcctgatttcaatcaaagcatcgctcgcatggtcggcaacgataggtacctgacattaacgaaacagttacagtga

SEQ ID NO: 11670 - RNA, 924 nt, unidentified
  source 1..924: mol_type = other RNA; note = synthetic construct
atgaaagtgcttgaccaactgtttaccgactttcctatgtccccccagcagcttcgaatattgatgctgactgcgccctatcgctacaagttctttcacattcctaaaaggagtggaggcagacgtctcatcagtcagccagctaaggaggtgaaatggttgcagcgctatgtaattgaaatcatccgcaagaagatccctgtgcatagatgtgccacagcctacgagccgggctcatctatcttcgcaaacgccgaggcccatgtacaaaaccggttcctgctgaagatggacttcaaaaacttttttccgagcattacggatatggatgtctcccatctcataaaatcggcttacccagacattgaggatggggaattagaattaatcgtccggctcctcgtgatgtccgacaagaagaacgagaaattcgtcttggccgctggcgccccatcttctccattcatcagcaatgcactgctaaatcaatttgataccgaactgcacctccactgccttagccagaatgtcgtatacacaaggtatgcagacgacatcgcactctctaccaacgcccccctgctgctttccgagcttcacaaatttattagggttctggtcaatgaaatgaaacatcctgtgctgaagattaacgaggagaagaccgtgtatacatcaaagaagcacaaccgaaaagtgactggtctgacattaaatagccagaagcaggtgagcctggggcgcgacatgaagagagagctgcgtgcggctgttgataagttcaggaaaaatgagttgtcccaggaagctgtgagtaccctgagaggaaaattggctttcgcactcgccgttgaacccgagtttgtgctacggctacggactcactacacggatgaagttataactaggctgttccagtcatga

SEQ ID NO: 11671 - RNA, 933 nt, unidentified
  source 1..933: mol_type = other RNA; note = synthetic construct
atgaacatgaaatcactaatcagtcttcttgtcgatgaactgcctttctctgaaagggagatccgggagctcttaaactcggccccctcgcgctacaaggtgcactatatcgagaagagaaagggtcgcggactgagacagatcgctcagcctactgccgagatcaaactgctgcagaggtgggccattaatcagtacagagatcagctgcccgtccaccctacagccaaggcatacattagtgactccggcatacgccaacatgcagccgctcacgttaagaactcttatttgctgaagctggacttcaaagacttttttccgtccattaaaggcattgatgttaggcgacacctggctaaacacctcggtgccccctccgaggatttgtcactgctcatgaagctattctgctggaagggaaagccagtaggcgggttaaggttgtcaatcggcgctccaagctctccattcatctccaactctattatgtttgagatggacgaaaagatacagaaaaaatgtagcgactacgatgccacctacacccgatacgcggacgacctggctatttcaacaaatcaaaaggacgcactgagcgcaatctatgagcatatactggaactctgcgacagtagtaagtacccctccctgaaaattaatccagggaagacagtgtttacatctaagaagcacaatcgtcatctgaccggcttgacgcttagcagcgatgggaaagtgtccctgggaagagatcgcaaaaggctcatccgggctatgacccatgcctatactactggcaaactcaaccctgacgaactcggtaaacttcggggatggatcgcgtttgcatatagcatcgagcccgatttcgtggaaagcttagagcgtatgatagggcttcaggccttgaatcggattcggagaacctga

SEQ ID NO: 11672 - RNA, 903 nt, unidentified
  source 1..903: mol_type = other RNA; note = synthetic construct
atgtctctgctccaggaattgagcgataaattccagctgcacgagcagctaatggagagtttcattaaatccgcaccataccggtacaagtttcataaaatcgacaaacggcacggagggaagcgcgagattgcccagcctgtcaagtccctgaaaatcgtccagcgctggttggtgaagcactatttatcaaagtacccaactcactctaaaagcgccatcgcgtatatcaagaacaagaacattaaggacttcgcagagccccatagaaacaacatattcctgctgaaactggatttcaaggatttcttcaacagtatcaagattagcgacttctacatcttctgtgagaagctttctattcccgaagaggacaagatctttctgggcttactcctcttctgcaagaataaacaagacgagccctatctgagtattggtgctccttcatctcccaccctgtccaatgtgctcatgtttaactttgacaacgaagtgtttaacctctgcaaaaaggatggaatcatctacacacgttacgctgatgacctggcttttagcactaatcagcctaatgttcttcggcaactgttgtcgaatataaaagaactttgtgccaagctaaactacccgaggaatctgcagatcaatacccaaaagacgatttttacctcgaagaagtataacagaacactgacagggcttgtaataagcaatgacggcaatgttgggatcggcagggagaagaaacgaaagctcagggccattgctcatcaggcaaaattaggaagattgtcacaggataaagtgggctccctgttgggcaagattgcctttcttaaaggtatagacccaagctttgccaaacaactggaagataagtatctcaaacacatctcctga

SEQ ID NO: 11673 - RNA, 903 nt, unidentified
  source 1..903: mol_type = other RNA; note = synthetic construct
atgttgatcaacgatttgaaggaaaaattcagtctcaatgagaaagagattctgtcatttatcaacagctcgccaagtaggtacaagagctacaatattaagaaaaggcacggaggcacacgtgagatagctgaacccaccagatctctaaaaatcctgcagagctgggccttgaataaatacctcagcaagtataagatccatccctccgccatagcatacgtgaaaaacaagaacatcaaggacttcgtcttgcctcattctaataacaagtatctgctcaagatagacttcaagaacttctttaactccatcaagggaatcgactttctgcactttctggaagacaaaaaaagcgatctgtccaatgaagagagacacctccttacgaacattttcttctgcaagaacaaaaccagcgaatctaaggaactgtatctgtccattggggcacctagcagtccattcatctccaacattatcatgatcgatttcgatgaccagatttctcaactgtgtgctaatattggcgttacttatacacggtatgctgatgatctggccttctctacaaataatcctaatatcttggacgagctgcttgaggagatcgaaattatttgcaagaaccttaactaccccaagaagttagagattaattcagagaagactgtgtttacctcccgaaaacacaatcggaccctaacaggcctcgtaatctccaacgacggtaaaattagtataggtcgcgagaaaaaaaggaaactccgcgtgatcgcccataaggcgtcgcttagactgctggatcaggaatctctcgataagtttaaagggactctggcctttcttttatcaatagacccggacttttcaaattacttaaagcagaaggcaaacatctga

SEQ ID NO: 11674 - RNA, 909 nt, unidentified
  source 1..909: mol_type = other RNA; note = synthetic construct
atgttgagtgtgctcgaaaatttcaagaaaacctttagcttctccacggtgtctgctattatctttatacagactgcacccaaccgctacaaatttcatacaatccagaaaaggcacgggggggagagagagattgcgcaaccgaccaagagtttaaagattgtgcaacggtgggtaattaatcagtacttccagaatagcccaatccataaggctgctaccgcatacatcaagggtaaagggattctcgaccacgccgaacaacacaaaagcaataagtatctactgaagctcgatttcaagaacttcttcaactccatcaacatacaggacttttacgaattcatcaatcgttctatgccccaattctcagaggaagacagagatatcctgggacttcttcttttttgtaagaacaaggacgacaactattatctatcgattggcgcgccttctagtcctcatgtcagcaatatcatactgtacaagttcgactgcctgattcaggagatctgctctaaaaaaggcgttgtttataccaggtacgcagacgacctggctttttcaactaacataccccacattttgaaagggatcctctgtgatatcgaacatattttgtccaacctggagtatccaaaaaatttgaaactgaaccaggagaagaccgtctttctctcacgaaagcacaatcgcacactcacaggacttgtgataagcaacactggtaagatcagcatcggcagggataagaaacggaagctgcgggccgccattcataacgccatccacggcaaactgaccgatgaggaaatccagacactgaaaggaagaattgcatttctgaagggcattgataaagagttcgccataaagctggagcaggaactgcagtccgccaatttatga

SEQ ID NO: 11675 - RNA, 921 nt, unidentified
  source 1..921: mol_type = other RNA; note = synthetic construct
atgagcactatctttgacaagatttgcgagactttcagcttaaatcctcatgaggccgaaatttttattaagaccgcgccagagagatataaactccactcgatctccaaaaggcacggtggtgtccgctatattcaccagccaaccaaaaaccttaagtttatacagcgctggttggtcaactcttacttctcaagtatgcccatccactcatgtgcccatgcctatgtgaaaaatcggaacatcctgagtaacgctaaaccccattctcacaacaagtatctaatgaagctcgatttctctgacttcttcaccagcattacgattagggattttctgatctttgcccacgacaatttaagagaattcagctacgaggaacatcatattctcgcttccctgttgttttgccgtcataagattaatggagactttgtgctcagcatcggcgcaccttcatcacctataatcagcaatattatgctctaccacttcgaccaagttctgtacgacttttgtcggacaaagtatgtttattacacaagatacgcagatgatttgagtttctccactaaccagccacgaatcctgaaagaagaggtgtttcctttcgtggaaggactttgcaagacaatcagttacccaaactacctgaagctgaataaaaacaaagtagtgcacgtctccaagaagtttaaccgcaggatcaccgggctggtgctatctaacgagggcaatatttccatagggagggataaaaagcgacagctgcgggcaatggcccatcaaatgtctcttaataagctgcccccggagaagataaataagctcttgggctatatcaacttccttaaagggaaaatcgatcccgagttcgctgaacagctgatccagaaactgaataacaagcacaataagtga

SEQ ID NO: 11676 - RNA, 960 nt, unidentified
  source 1..960: mol_type = other RNA; note = synthetic construct
atgaatattatcaatgcgcctttgtttgagcggctcttggctctaagtcctttctctgccagggagctgggcattctcatcgcaacagctccccaccgatacaaagaccactacatcgagaaacggaacggtaggggaaagcggctgatctcccaacccacagccgaacttaaattcctgcaacgcctcattgtgaaacatgaattttcatccttgcccatacatggagctgccactgcctatcggagcggctcctctataaaggcgcacgccctgccacatgcacattcccgctatctgttgaagctggatttctcggacttctttcccagcctgaaggcaaacgctctcaggtatagactaagccgcgacgcctcatatactgagcaggaactgtggatcttatgtcagctcctttgtagacagccgagacgtgatgccggcctgcagctgagtataggggcacctagttccccatgtgtaagcaactacctcatgtgggaattcgatagccggctggctgaattttgcgctgcctgcggtaccgcatacaccagatacgcagacgacattgccgtgtcaaccacatttgcggatgtgctggatgtggtcgaggccgaggttcgtaggcttcttggggagcttggatacctgggcctctctctgaatgaaggcaagaccgtaaatgtttccactaagtctcgcagaacgctcgtgggcctggtccttgcgaacgatggaacagtgtcgattggtcgggaagagaaacgacgcttaagagcaaccatgcacaggctgacgcagggaggactgtcaggcgacgaggtggctcgattccgtgggcagctcgccttcgctcactctatcgatgccagtttcgtcgacttattgtgcgctaggcacaattttcctaacgttgccagcatcggtagcccagatgggggggacctaactgactga

SEQ ID NO: 11677 - RNA, 960 nt, unidentified
  source 1..960: mol_type = other RNA; note = synthetic construct
atgtccatcgcaaacgagcccttatttgagcgtttactcgccctgagcccattctcagctcgagagctgggcactcttgtggctaccgccccgtaccggtacaaggatcattatattgagaagcgcaacggaagaggcaagcgcctaatctcccagcccacagcagaattgaaatttttacagcggctcattgtgaggcatgaattttccagcttgccaattcacgaagccgctactgcgtacaggccccaccgttccatcaaagctcacgcccttccgcacgcaagtgcccgatatctcctaaagttggactttcgcgactacttcccttcacttaaagctagcgctctgcgttataggctgtctcgggacgccacctatactgagcaagagctctggatactgtgtcagctcctgtgcagaaagccaaagagagacgcagagctgcagctcagtataggcgcaccttcttctccccacgtatcgaactatttgatgggcgagttcgactctcggctgacggacttttgcggagcttgtggagccgaatacacccgatatgcggacgatatcgcagttagtaccagcttccctcatgtgctggatgccgtggaaggggaaattcggaggctgctaggtgagctgagctacctgggattgtcactgaatgagggcaaaacagtcaacgtgtctaaaaagaataggagagtacttgtcggcctggtgctggccaacaatggtgtggtcagtatcggcagagaggaaaaaagacgcctccgcgctacaatgcataggcttgtgcagggagccctgcctgcagacgaagtcgcccacttccgggggcaactcgccttcgtctactcaatcgatccagcttttgttacctccctgtgcgcgcgctacgatttccccaatgttgggtccattggggcccctagcgggggtgatagcacagattga

SEQ ID NO: 11678 - RNA, 960 nt, unidentified
  source 1..960: mol_type = other RNA; note = synthetic construct
atgagtatcattaatgagcccttatttgagcgtctcctgacactgtccccattctccgccagagagctgggcatactaattgccacagcaccttatagatataagtcccactacattgagaaaagaaacggaaggggaaagcgcttaatcagtcaacctactgccgagctcaagttcctccagcggttggtggtcaaacacgagatgtcttcactgcaaattcataatgctgccactgcgtaccggcccaacaggtcaataaaggaacacgccctaccacatgcgcgcgccaggtacctgctgaagctcgatttccgtgacttctttccgtctctgaaagctacagctctccggcaccgacttctggcagatgcaaattactctgcccaggaactttggatgctgtgccagattctctgcaggaggccgcgaagggatgcagagctccagctttccatcggcgcccctagtagcccatatgtcagcaactatttaatgtacgagtttgatagcaagttggcacggagctgcgaggcttgtggcgctgaatacacccgctatgctgacgatatcgccatctcgacttcttttccccaaatcctagacattatcgaagtggaggtgcggcgcctgcttggggagcttgactatctgggattgagcttgaacgaaggcaaaacggtgaatgtttctaccaagaacaggcgcaccctggtaggtttggtgctcgctaacgatggtaatgtttccatagggagagaagaaaaaagacgactgcgcgccgctatgcataagctgacccaggggaaactgccagtagaggaaacagctagactgagagggcagctggcgttcgcatactcaatcgaccctgactttgtgaatgacctttgtgcccggtcaaacttcgccagcgtcgcagccattagtcagcccgataatggcaagcagaccgactga

SEQ ID NO: 11679 - RNA, 948 nt, unidentified
  source 1..948: mol_type = other RNA; note = synthetic construct
atgagcatagtgaacgaaccccttttcgaccgtctactggctctctccccttttagtgccagggaactcggcgtacttatcgctactgccccacaccggtacaagaatcattacatcgagaaacgcaacggaagaggtaagcggctcatctctcagccgaccgctgaattgaaattcttgcagcggctgattgtgaaacatgaaatgagctcacttcccatccacgacgccgcaactgcctaccgatctcagcgcagcataaaggaacacgcattacctcacgccagagcacgatacctgcttaaactcgacttccgtgatttctttccaagcctcaaggcgacagccctgagacaccggctgctactggacgcaaattatacagaacccgagctgtggatgttgtgccaaatcctcttccggaaggctggccgccatacggatctgcagctgtccattggagcaccttcctcccctcacatctcaaattatctgatgtgggaatttgacaagaagctcgcccaattctgcgagctgctgggggctgagtatacacgctacgcggatgacatagccgtcagtacttcttttccacacctgttagacgctgtggaggccgagatccgaagacttttaggtgaattagactatctgggcttgagtctgaatgaggggaagaccgttaacgtttctaccaaaagcaggaggacactggtgggactagtcctcgcaaacgatggcaccgtctccattggaagggaggagaaacggcgtctgagggccactatgcataggctcgttcagggcctgcttgcaggagaggaggtagcgagattgagagggcagctggctttcgtgtactcaattgatcgcgcctttgtggattcgttgtgtgctcgccatggctttaccagcgtggggagtattggtcagcccacgtcagattga

SEQ ID NO: 11680 - RNA, 954 nt, unidentified
  source 1..954: mol_type = other RNA; note = synthetic construct
atgaatatcatctcaactcccctcttctctcgggtcctagagaattcccccttttccgaaagagagcttctgatgctagtcctcactgcccctgagcgctataaggatcactatatagaaaaacgccacggtcggggaaagagattaatttcccagccaaccgccgagattaagtacctgcagcgcctgattgtagcaagagagttgagcgaacttcctatccatcctgcagccaccgcttaccgggtgggatgttctattaaagaccacgctctgctgcatgcctccaatcgttacctgctgaagctagatttcaccgacttctttcatagtatcaagcaggatgccgtgctcagctgtctttctagagacacaagctacagcgttaacgagcagtggatgttggtgcaactcttgtgccacaggccacgcggcgctggtgatcttcagttatcaatcggggctcctagcagtcccttcatgagcaactacgtcatgcacgaatttgacaataaggtggataggatgtgcagagcctctggcgcagtgtattctcgatatgctgacgatatggcgatctcatcatctttaccaagggtgctcgacgccgtggagcaccagattcgcgcgttgcttctggaaatgaagagcccgaaactgcgcttgaacgagagtaaaacggtgaacgtatcgaaaaaaaatcgtcgtacactggttgggctcaccctctccaacgaaggctcggtcagtatagggagagacgaaaaaaggcgactgagggccatgatgcatgcactgactgagggcaggctcgatgttacatccgtgtcactgctgcgaggaaagctggcatttgctcagagtattgactctgtgttcgttagccaactgtgccggcggcatgggttttcctccgtcaaggacatccggccacccatatcaagcatcggctga

SEQ ID NO: 11681 - RNA, 951 nt, unidentified
  source 1..951: mol_type = other RNA; note = synthetic construct
atgtcctttgccagggaacccctgtttgttcggctgctggatttaacccccttcagtgaacgagacttggccatcctgattgctaccgctcctcgcaggtacaaggatcattatattgagaagaggaacggcagggggaagcgactgattagccagcccacagcggaactcaaattcgtgcaaagactgctaatcaagcacgagcttacacatctccagctacacgaggcctccgttgcctatcgctccggttcctcaataatggaccacgcatccccacacgcgtcagctcgatacctcttaaagctggatttcaaggacttctttccgtcacttaaggcatctactctacaatacagattcaccaaggacagcgattacagcgagaacgaaaagtggatcctgtgtcagcttttgtgccgcggctctctgatcacgggagatctccagctgtcaatcggggctccttcatctccttatatttcgaactatctcatgtgggaatttgatacgaaactgaccgagttctgcaaaaaatacagcgccgagtacacacggtatgccgacgatctcgccatttctacttcccagccacacgcacttgataaaattgaaagtgaggtcaggcggctgctcatggagttgagctacctgaagctgaccctcaatgaagacaaaaaagtgaatgtgagcaaaaagaatcgcaggacattggtgagtcttcgtctggccaacgacggcaatgtatctgtggggagacagcggaaacggcaactgcgtgcggctatgaacgccttgatacatggaagattatccactgctgagatcagtagattccgcggaatgatggcttttgtctattctattgacccaaatttcgtggaccagctgtgtagtaagaacggttttgcaactataagcgccatcgacgcagtcaaaatcaagaagtga

SEQ ID NO: 11682 - RNA, 948 nt, unidentified
  source 1..948: mol_type = other RNA; note = synthetic construct
atgtccatagttacagagcccctatttcagcggctgctggcctggtccccatttagtgagcatgaattagtcgtgttgattgccaccgctccttctaggtacaaagcctactacattgagaaaaggggcgggagagggcagagagagatttcccaacctaccaaggagatcaaattccttcagaggttgctcgctagcaaagaactgcgcgagctgcccattcatgatgtggctgtcggataccgaagcgggcgctcgatcctcgatcacgcacagcctcacgcctctgcacgctatctactcaagctggacttcaccaattttttcccgagtctcaagtctaaggccctcgatcacaggttatccagggacactgcatacagcaccgctgaacgttggattctgcggaacctcctgtgtagacgaacaccaggcaccggcaactatcagttgagcatcggcgcccccagtagccctcacatttccaattacctgctgtgcgaattcgaccagcttatgagtgactactgcggtatacgggtggtgcgatatacccgctatgctgatgaccttgcattttcgacatcaatcccatcagtgttgaacgacatagagactgaggttagaagactaattcaggagctcgactatctgggtctttctctcaatgaagccaagactatcaacgtatccacaaaacacaggcggacactggtcggactgactctgtcaaatgatgggcgtgccagcatcggacggatcgccaagagagaactgcgccaagcaattcattctctgcggcatggtttacttagccaatctgaaatcgcgaacttgaggggccgcctggcgtttacgtacgctatcgacccagagttcatagaacacctgcttcatagatatggcttcgagtcaatctccacgatcgatggaccccagactgattga

SEQ ID NO: 11683 - RNA, 993 nt, unidentified
  source 1..993: mol_type = other RNA; note = synthetic construct
atgatccccgagtatgagtctctgtttgcacggatcctcgcacaatcgccattcagcagtaaggaactggtgaccctactggggacagctcctgacaggtataaagatcactttatccagaagcggaacggccgaggtctgcgtcagattagccagcctactgcggagttaaaatttttgcagcggctcttggttaattttgagttttgcaacctgccagtgcacaatgctgccactgcctatagagctgaaaagtcaattaaaagccatgcagtagaacacgcgaagaactcctacctgctgaagcttgatttcaaggatttcttcccttccattggctcagacgcgattaaacaccgcttgaggcttgacatgaactattcagagacagaactgtggatgctgtgtcaaatcctctgccgccgagatcgcctaacaaataggctgcagctgagtattggcgccccctcttcaccttttctctctaactatatcatgtgggagttcgattgtcgtatacaatcttactgcgaccagctaggggtgtcctacactcgatacgccgatgacttagccttcagcaccagcgtcccccatattctggatgtcgtgcacgaatatgtcgagagattactgagagaattgagttacctgggaatatctcttaacaaggagaaaaccgtaaacgtttccaagaagaacaggagaagccttgtgggactcgtgctgagtaattccggaaacgtttcgatcgggcgcgccgaaaagaggaatctgcgggcagcaatgcatgccttgatcaataataagctcacacaagacgaggccggcaaactgcgggggaaaatggctttccttcttgccatcgaccccgatttcgtgaatggcctctgtgtgaaatacaatttcacgagagtcgctgacatacaggctaccaactacgacagctcccagccgcagaaaaacgatggtaccgacgacctcccattttga

SEQ ID NO: 11684 - RNA, 939 nt, unidentified
  source 1..939: mol_type = other RNA; note = synthetic construct
atgaacttcagaagcgcgaatttatttactcggcttcttgagatgtccccccttagcgcccgcgagttgagtcgagtgatcgccaccgcccctcatcgctacaagtctcacttcatagagaaacggcacggcaggggcaaaaggctgatttcacagcccacagctgagttaaaatacttccagagatggcttgttgacaatgagctgaatcaactcccagtccatgatgccgccaccgcctatcgtaaggggaggagcatcctggatcatgcgacaccgcacgcaaagcagcgttaccttcttaagctggactttaaggacttctttccctcactcaacgaacacgcactccgacactgtctggaaagggactgcaactactctgaggaagaaatcgagatattatgcaacctgctactgaaaagtgcttcgattgaaggcggacctctccagctgtccatcggtgcaccttcttccccatttatttctaactatctgatgtgggagtttgacattgcgatgcagcaatactgtgaagtcatgggtgtaatgtactccagatatgctgatgacctagccttctcaacggataccccgcgcctactcgataaagtatttgacactgtccagaagatactggcctctatcagctatttgcccttgatcctgcatccagacaagacagtgaatgtgagtaaaaaacgcagacgactcctggtggggctgactctcgccaacgatggcaatgtttcaatcggaagggaagagaagcgcagattgcgggctgctctgcatgcatatacccaaggccggttgccatgtgacgaggttgctagactggcaggaatgctgagcttcgtgtggagcattgatcctaagttcgtggaaaatctctgccagcggcacgggttcagtaggatttccgatctgctccggtga
